United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 123

SEQ ID NO: 238430 - DNA, 2961 bp, Artificial Sequence
  Description of Artificial Sequence: Synthetic coding sequence
atggatctgaaggaacagccaggtaatacaatcagcgccggacaggaagatttcccctccgtccttctggagacagcggcaagtctgcctagcctgtcacctctgtccgccgctagcttcaaggaacatgagtacttaggtaatctgagtacggtgctgccaacagaaggcactctacaagaaaacgtgagcgaggcttctaaagaggtttccgaaaaggctaagacacttctcatcgatagagatcttaccgaatttagcgaacttgagtacagcgagatgggctcaagttttagtgtgagcccgaaggccgaaagcgccgtgatagtggccaacccgagggaggagatcattgtgaaaaataaagatgaggaagaaaagctggtgtcgaacaacattctgcacaaccagcaagaattgcccacggccctgactaagctggtaaaagaggatgaggttgtgtccagcgaaaaggccaaagactcttttaacgaaaagcgagttgctgtcgaagctccaatgagggaggagtatgctgacttcaaaccttttgaacgggtgtgggaggtcaaagactccaaggaagattctgacatgctggccgcagggggaaagattgagtcaaacctggagtcaaaagtggacaaaaagtgtttcgctgatagcctggagcagacaaaccacgagaaggactccgagagcagcaatgacgacacatcttttccttctacacctgagggaattaaagaccgtagcggagcctatattacatgtgcaccattcaaccccgcagcgacagaaagtatcgcaaccaatatctttcccctgctgggtgaccctacgtccgaaaacaaaacggacgagaaaaaaatagaagagaaaaaagcccagatcgttacagagaagaacacctcaacaaaaacgtcgaacccatttctggtggccgctcaggattccgagactgattatgtcaccactgataatctaaccaaggtgacagaggaggtcgtagcaaatatgccagaaggcctgaccccagacctcgtccaggaggcatgcgagtcagagctgaatgaggtgaccggaacaaagatcgcgtacgaaaccaagatggacctggtacaaactagtgaggtcatgcaagaatcactgtaccccgctgctcagctctgtccatcatttgaagaaagcgaagcaaccccaagtcccgtcctgccagacatcgtgatggaggctccactgaacagcgctgtcccatctgcaggcgcttccgtcatccagccaagcagctccccgctggaggcgtcaagtgtgaattacgagtcaataaaacatgagccagaaaatcctcccccatatgaagaagccatgagcgtttcactgaagaaggtgtccggaataaaggaggagatcaaggagccagagaacatcaacgcagcgctccaggagactgaagccccatatatctccatcgcttgtgacctgattaaagaaacgaagttgagcgctgaacccgctcccgacttcagcgactactccgagatggctaaggtggaacaacccgtacccgaccattctgagctagttgaagattcatcacctgactctgaaccagtggaccttttctccgacgattccattccagatgtgccacagaagcaggacgaaactgtcatgctggtgaaggaaagtctgacagagacctcattcgaaagtatgattgaatatgaaaataaagaaaaactctcggccttacctcccgaaggagggaaaccttacctcgaatcctttaagctgtccttagacaacacgaaggatactttgctgccggatgaagtgtcgactctgtcgaagaaggaaaagataccccttcagatggaggagctttccacagctgtatactccaacgacgacctgtttatctccaaggaggcacagatccgcgagactgagactttttccgattcctcacctattgaaatcatcgacgagttccctacattaattagctccaaaactgactctttcagcaaactcgccagagagtacaccgatcttgaggtgagccataaatcagaaattgcaaatgccccagacggtgctggtagcctgccctgtacggagttgcctcacgaccttagcttgaaaaatatacagccaaaggtggaggagaagatcagcttttccgacgatttcagcaaaaacggcagcgccacctccaaagtgttgctgttgcctccagacgtgagcgctctcgccacccaggcagaaatcgaaagcatcgtgaaacctaaggtcctagtgaaagaggctgagaagaagctgcccagcgatactgagaaagaagaccgtagccccagcgcaatcttctcggccgaactgagtaaaacttcggtggtagatttactgtactggagagacataaagaaaacaggagttgtttttggggcttctctgtttttacttctgtccctgaccgtgttctccattgtatcggtcaccgcctacatagctttggctctactttcagttaccatctcatttagaatctataagggcgtgattcaggccatacaaaagtctgacgagggacatccatttcgggcttacctcgaatctgaggtcgccatctccgaagagttagtgcagaagtatagcaactctgccctgggacacgtgaattgtacaattaaggagctccgccgtctcttcctggttgacgatttagtggattctctcaagttcgcagtgctgatgtgggtttttacatatgtgggtgcccttttcaacggcctcacccttctcatcctggctctgatatcactgttttcagtgcccgtcatctacgagcggcaccaggcccagatcgatcattatctcggcctagccaacaagaacgtcaaagatgcaatggcaaaaatccaagctaagatcccaggcctgaaacgcaaagccgaatag

SEQ ID NO: 238431 - DNA, 1179 bp, Artificial Sequence
  Description of Artificial Sequence: Synthetic coding sequence
atggaagatcttgatcaatcccctctagtctcctccagtgactctccgccaaggccgcagccggctttcaagtaccagtttgtgagagaaccagaggatgaggaagaggaagaggaagaggaggaagaggatgaagatgaggatcttgaagagctggaggtgctggagcgaaagccggcagctggcctgtctgccgcacccgtcccgacagccccagccgctggagctccgctgatggattttggaaacgacttcgtaccccctgcgccacggggtccacttcctgcagctccacctgtagcccctgagagacagccttcctgggaccccagtccggtgagctctacggtgcctgcaccttccccactctcagctgctgccgtgtcgccctcgaagctcccggaggacgacgaacccccagccaggccacctcctccacccccagcgtccgtttcacctcaggctgagcccgtgtggaccccaccggctcccgctcctgccgctcctccttccacccctgcggctccaaagaggcgtggatcgtctggtagcgtggatgagactttgtttgctcttccagctgctagtgagcctgtgatccgctcttccgccgtggtagatttgctgtattggcgggatatcaaaaagaccggcgtggtttttggagcttccttattcttactgctttccctaacagtcttctccatagtcagcgtgacggcctatattgccctggcacttctatcagtaactatttctttccggatctacaagggggtcattcaggccattcaaaaatctgacgagggtcacccctttcgagcttacctagagtctgaagtggccatttctgaggaactggtccagaaatattccaattctgctctgggtcatgtcaattgtaccattaaagagctgcgcagactcttcctggtggacgatctggttgactctcttaaattcgccgtgttaatgtgggttttcacctacgtcggcgctcttttcaacgggctgactctgctgattttagcactaatatcactgtttagcgtgcccgttatatatgaaaggcatcaggcacagatcgatcattatctaggcctggcaaataagaacgttaaagatgcgatggctaaaatccaggccaagatccctgggctaaagaggaaagcggaatag

SEQ ID NO: 238432 - DNA, 600 bp, Artificial Sequence
  Description of Artificial Sequence: Synthetic coding sequence
atggacggacagaagaagaattggaaggataaggtggtggacctcctgtattggcgcgatattaagaagaccggggttgtctttggtgcaagtttgttcctgcttctttcacttaccgtgttctccatagtgtccgtcaccgcttacattgcactggctttgttaagcgttaccatctcgtttcgtatatataaaggcgtaatccaggccatccagaaatccgacgaggggcacccctttcgcgcatacctcgagtctgaggttgccatctcagaagaactcgtgcagaagtacagcaactctgcccttggacacgttaattgcacaatcaaagaactgcgcaggctctttttggtcgatgatctcgtggattccctgaagtttgcagtcctcatgtgggtgttcacttacgttggggctctatttaacgggttaaccttactgatcctggcgctgatatccttgttctcagtgcccgttatttatgagcgccatcaggcgcagatcgatcattacctcgggctggccaacaagaatgtaaaggacgcaatggctaagatccaggccaagattcctggcctcaagcgaaaggcagaatag

SEQ ID NO: 238433 - DNA, 2961 bp, Artificial Sequence
  Description of Artificial Sequence: Synthetic coding sequence
atggaccttaaggagcagccaggaaatacaatcagtgccggacaggaagactttccgtcggtcctgctggagaccgccgcttcattgccaagtctgtcccccctgtccgctgcgagcttcaaagagcacgaatatttaggcaatctgtccaccgtgctcccgaccgagggaaccttgcaggagaacgtgagtgaggcgtccaaagaagtctccgaaaaggcgaagaccttgctgatcgaccgcgatttgacagagttttcagaactcgagtacagcgagatggggtctagtttttctgtgtcccccaaagcggagtctgctgttatagtggccaacccacgggaggaaattattgtgaagaacaaggacgaagaagagaaattggttagcaacaatatcctgcacaatcaacaggaattacctacagcattgacaaagctggttaaggaagacgaggtagtgtctagtgaaaaggctaaagactctttcaatgagaagagagttgccgtagaagctcccatgcgcgaagagtatgctgattttaaacctttcgaacgagtgtgggaggtgaaggactccaaagaggacagcgatatgctagccgcaggaggaaagatagagagcaacctagaatccaaagttgataagaagtgctttgccgactctttggaacagactaaccatgagaaagacagcgagtccagtaacgacgacacctcatttcctagtactccagagggaatcaaggatcgctctggagcatatataacatgtgccccatttaatccagcagccacagagagcattgccacgaatatcttccccttgctgggcgacccgaccagtgagaacaagacagatgagaagaaaatcgaagagaagaaagcgcagatcgtgaccgagaagaacacctctactaaaacatctaacccgttcctggtcgcagctcaggactctgagacagactacgttacaactgacaatctcacaaaggtgacagaggaagttgtggctaacatgcccgagggcctgacaccagacctcgtgcaagaagcttgtgaatccgaacttaatgaggtgactggaaccaaaattgcctacgagactaagatggacctggtgcagactagcgaggtgatgcaggagtctctgtacccggctgcccagctctgtccaagtttcgaggaatccgaagccaccccttcaccagtacttccggatattgtcatggaggccccactgaactctgccgttccatccgcaggggcttcagtgatccaaccatccagctcaccactggaggctagttccgtgaactacgagtcaatcaagcatgaacccgaaaatcccccaccgtacgaggaagcaatgagtgtgtcactcaagaaggtgtccggaatcaaggaggagatcaaagaacccgagaatatcaatgccgctctgcaggagacagaagcgccatacatcagtatcgcttgtgacctgataaaagagaccaagctatcagctgagcccgctccagatttctcggactatagtgagatggctaaagtagagcagcccgtcccagatcattcagaactcgttgaagattcttctccagattctgagcctgtcgatttattttccgacgacagtattccagacgtcccccaaaaacaggacgagactgtcatgctcgtgaaagagtccttgacagaaacttcttttgaatccatgatagaatacgagaataaagagaaattgtctgccctgccaccagaaggcggtaagccatatctggagtcctttaagctctccttagacaacacaaaggacaccctcttacctgacgaggtaagcaccctctccaaaaaagagaaaattcccctgcagatggaagagctctccactgcagtgtatagcaacgacgacttatttatctcaaaagaggctcagattagggaaaccgagacattcagcgactcctcacctatcgaaataatcgatgagttcccgaccctgattagttcgaagactgacagcttctccaagctcgctagggagtacaccgatttagaggttagtcataaatctgagatcgccaacgccccagatggcgcaggcagcttgccgtgcaccgagctaccacatgatctttcactgaagaacatacagcccaaggtcgaggagaagatatctttctcagatgatttttctaagaacggcagcgccacctctaaggtgctccttttaccccctgatgtttccgcattggccacacaggcggagatcgagtccatcgttaagccaaaagttttagttaaggaagcggaaaaaaagctccctagcgatactgaaaaggaggaccgatcccctagcgccatctttagcgcggagctgagtaagaccagcgtggtagacctactctactggagggacataaagaaaaccggggtagtatttggtgcatcattatttctgctgctcagtctcacagttttctctatcgtctcagtcacagcttatatcgctctggctctgcttagcgtgactatatccttccgcatctacaaaggcgtgatccaggccattcaaaagtccgacgaggggcacccatttagggcctacctcgaaagcgaggtagctatctccgaagagttggtgcaaaaatattcaaattctgctctcggacacgtgaattgcacaataaaggagctgagacgcctgtttctcgttgacgacctggtcgacagcctcaagtttgcagttctgatgtgggtgttcacatacgtgggggctctgttcaacgggctgacccttctgattcttgccctcatctcactgttcagcgtccccgtgatttatgagcgccatcaagctcagattgaccactatctgggactggccaataaaaatgtaaaggatgcgatggccaaaatccaggccaagatccctggcctgaaaagaaaagccgagtag

SEQ ID NO: 238434 - DNA, 1038 bp, Artificial Sequence
  Description of Artificial Sequence: Synthetic coding sequence
atggagcccgaggatgaggaggaggaagaagaagaggaggaggaagatgaggacgaagacctggaagagctggaggtactggagcgaaagcctgcagctgggctcagcgccgcacctgttccgacagctcccgctgcaggcgcaccgttgatggacttcggcaatgatttcgtccctcctgccccacgcggtccccttcctgcagctcctcctgtcgccccagaacgccagccttcctgggacccttctcccgttagttcaactgtgcccgcacccagcccactctcggcggctgcagtgtctccctcaaaactccctgaagacgacgagccccctgcaaggccccctcctccaccaccagctagtgtgtcacctcaagcagagcccgtatggacacccccagcccctgcccctgcagcaccaccctccacccccgctgcacccaagcggagaggttcctctggatctgtagtcgtggatctcctatattggcgcgacatcaagaagactggagttgtgtttggggctagccttttcctcctgctgtctcttacggtcttcagcatcgtctcggtgactgcctacatagccctcgccctcctctccgtcactattagtttccggatctataaaggcgtcatccaggccatccaaaagtccgatgagggccacccatttcgcgcatacttggagtcagaggtggctatctctgaggaattggtgcagaaatacagtaacagcgcgctcggccatgtgaattgtacaatcaaggagttgaggcgacttttcttggtagacgatctagtggacagcctgaaatttgccgtactgatgtgggtcttcacttatgtgggcgctctgttcaatggactgacacttctgattctggcactgatctccctgttcagtgttcctgtgatatatgaacgacaccaggcccagatcgaccattatttgggactcgctaataagaacgtaaaggacgcgatggccaaaatccaggcaaagattccaggtctgaagcgtaaggcagaatag

SEQ ID NO: 238435 - DNA, 2961 bp, Artificial Sequence
  Description of Artificial Sequence: Synthetic coding sequence
atggatcttaaagagcaaccaggcaatactatttctgcaggtcaggaggacttcccctcagtgcttctggagacagccgcttctttgccgtcactgtcccctctgtcagccgcttcttttaaggaacacgaatatttaggtaatctgtcaaccgtcctcccaacagagggcactctccaggaaaacgtaagtgaagcaagtaaggaggtctccgagaaggcaaagactttgctgatcgatcgcgacctgaccgagttctctgagcttgagtacagcgagatgggctcatcattctcagtgagtcctaaggccgagagcgctgtgatcgttgctaaccctcgcgaagagatcatcgtcaagaataaggacgaagaggaaaagttagtttccaataacatactgcataatcagcaagagctcccaacggcgctgacaaagctagtaaaggaggacgaggtggtgtcaagcgagaaggccaaagactctttcaacgaaaaacgggtggccgttgaggcccctatgagggaggagtacgcggactttaaaccttttgaacgtgtgtgggaggtgaaggatagtaaggaagactctgacatgctcgctgcaggcggaaagattgagagtaatctggagagtaaggtggataaaaaatgttttgccgactcgttggaacaaacgaaccacgagaaggacagtgaaagcagcaatgatgacacaagcttccctagcacaccagaaggcataaaggataggtccggggcatacatcacctgtgccccttttaaccccgctgcaactgagtcgatcgcgaccaacatctttccactgctgggtgaccctacatcagagaataagacagacgaaaagaaaatcgaggaaaaaaaagcccagatcgtgaccgagaaaaacacctcaacaaaaacaagcaaccctttcttggtggccgcacaagattccgaaactgactacgtcacaaccgataacttgaccaaggttacggaggaggtcgtcgcaaatatgcccgaggggctgactccagacctggtccaggaggcttgcgagtctgagctcaatgaggtgacggggactaagatcgcctatgagaccaagatggacctggtacaaacaagcgaggttatgcaagaatctctgtaccccgctgcacagttatgtccaagctttgaggaatcagaggccacgccttcacccgtcctgcccgatatcgtgatggaagctccgcttaattccgccgtcccaagtgctggagctagcgtgattcagccctccagtagtcctctggaagcaagctcagtcaactacgagagcatcaagcatgagccggagaatcctcccccatatgaggaagccatgagtgtttctctgaaaaaagtttctggaatcaaggaagaaattaaagagcccgagaatataaacgcagcgctgcaagaaactgaggcaccgtatatttcaatcgcctgcgatttaatcaaggagactaagctgagcgccgagcccgcaccagactttagtgactactctgagatggccaaggttgaacaacctgtcccagaccactcagaactggtggaggattcctcccccgactccgagcccgttgatcttttctctgacgattcaatacccgacgttcctcagaagcaggacgaaaccgtcatgttagtaaaggagtccctgaccgaaaccagcttcgaatcaatgatcgagtacgagaacaaagagaagctgtccgcacttccacccgagggaggaaaaccatatctggagtcttttaaactgtccctggacaatacaaaagacacactacttcccgacgaagtgtccaccctctctaaaaaagaaaagatacctctccagatggaagagctgtcaacagccgtctattctaacgacgacttgttcatcagtaaggaggcacagattagagagacagagaccttttccgactcttctcccatagagataatcgacgaattccccacgctcattagttctaagaccgattctttttcaaagttggctagagagtacaccgacttagaagtatcccataagtctgagattgccaacgccccagatggggcagggtccctgccctgcactgaactcccccacgatctgtcgctcaaaaacattcagcctaaagtggaggagaagatctctttctccgatgatttctccaagaatggcagcgccacttctaaggtcttgctgcttccaccagacgttagtgccttggccacccaggcggagattgagtcgatcgtcaaacctaaggtgctggtgaaggaggctgaaaagaagcttccctctgatactgagaaagaggatagatcccctagcgcaattttttctgcggagcttagcaaaacctcggttgtagatctgctctactggcgggatatcaagaagactggtgttgtgtttggcgcatcgttattcctgctgctttctcttactgtgtttagtatagtgtctgtcactgcatacatcgccctcgcactgctgtcagtgaccatttcctttagaatctacaagggcgtgatacaggccatacagaagagcgacgaaggacaccccttccgggcatatctggagtcagaagtggccatttccgaagagctagtgcagaagtattccaacagtgccctcggtcacgtgaactgcaccatcaaggaattgcggcgactgttcctggttgacgacttagttgatagtctgaagttcgctgtgctgatgtgggtcttcacctatgtgggtgcactgttcaacggactcactttattgattctagcactcatctccctgtttagtgtgcccgtaatctacgaacgacatcaagcccagatcgaccattatctcggcctggctaacaagaacgttaaggatgcaatggctaaaattcaagctaagatccccggactgaagaggaaggccgaatag

SEQ ID NO: 238436 - DNA, 2961 bp, Artificial Sequence
  Description of Artificial Sequence: Synthetic coding sequence
atggacctgaaagagcaacccggaaataccatcagtgcgggtcaggaagattttccatcagtgcttctcgagaccgccgcatcactgccttcactctcgcccttaagcgcagcctctttcaaagagcatgaatacctgggaaatctgtccacagtgctgccaaccgaaggaactctgcaggaaaatgtctcagaagcatctaaagaagtgtctgaaaaagcgaaaacattattaattgaccgggacctaaccgagttctccgagctggaatactctgagatggggagttcattcagcgtgtccccgaaggctgagagtgctgtgatcgttgctaacccacgtgaggaaattattgtgaagaataaagatgaagaggagaaactggtgtccaacaatattcttcacaatcagcaagagctcccaacagccttaacaaagctggtgaaagaggacgaggtggtgagctcagagaaggcgaaggactccttcaatgagaagcgggtggctgtagaagcgcctatgcgagaggaatacgctgacttcaaaccttttgagcgtgtttgggaggtgaaggatagcaaagaggactctgatatgcttgctgctgggggaaagatcgagtcgaatctggagtccaaagttgacaagaagtgcttcgccgattccctggagcagaccaaccatgaaaaagatagcgaaagcagcaacgacgataccagctttccatctacccccgaaggaattaaagatagaagcggggcttacattacctgcgcaccgttcaaccccgctgccaccgagtctatcgcaaccaacatttttccgctccttggagaccctactagcgagaacaaaaccgatgagaaaaagatcgaagaaaagaaggcccagatagttacagaaaaaaatacttctaccaaaacgtcaaacccctttttggtagcagcacaagacagcgagaccgactatgtcacgacagataatctgactaaagtgactgaggaagtggtcgccaatatgcccgagggtctgacacctgatctggttcaggaggcatgtgaatctgagctcaacgaagttacaggaaccaaaatcgcctatgagaccaaaatggatctggtacaaaccagcgaagtcatgcaagagagcctctatcctgctgcccagctgtgtccttctttcgaggaaagcgaagccactcccagcccagtcttgcctgatatcgtgatggaggctcccctcaatagtgcggttccatctgcaggtgcctccgtgatccagcctagcagctcaccccttgaagcatccagcgttaactatgagagcattaaacacgaaccagagaatccccctccttatgaagaagcaatgtctgtgagtcttaaaaaagttagtggcataaaggaggagataaaggagcccgagaatatcaacgcagcgcttcaggagacagaagctccttacatttcaatcgcctgcgatctgatcaaggaaactaaactgagcgcagagcctgccccagacttctcagactactctgagatggcaaaagttgagcagccagttccagatcattcagaattagtagaggatagctcacctgatagtgagcctgttgacctgtttagcgacgactccattccggacgttccccagaagcaagacgagactgttatgctcgtgaaagagtcgctaaccgaaactagttttgagtctatgatcgagtatgagaataaggagaagctcagcgcgttgcctccagaaggtggaaaaccttatttagagtccttcaagctgtctttagataacaccaaagatacgctcctcccagacgaggttagtaccctgagcaaaaaggagaagatccctttgcagatggaagagctgtccacagctgtctattcgaacgacgacttgttcatttcaaaggaagcccagatccgagagaccgaaacattttccgacagcagtccaattgaaataattgacgagtttccaacccttatcagttccaagactgattccttctccaagctggctagggagtacactgatctggaggtcagtcacaaaagcgaaattgctaacgctccagacggagccggatcacttccgtgcaccgagctccctcatgacctcagtcttaagaacattcagcccaaagtagaggagaaaatctcttttagtgacgactttagcaagaatggcagcgcaacgtccaaagttttactcctgcctcccgatgtgagcgcccttgcaacccaagcagagatcgagagtatcgttaagccaaaggtgcttgtaaaggaggctgagaaaaaactgccatccgacacggagaaggaggacaggtcaccgagtgccatctttagcgcagagctgagtaagaccagcgtggtggacctgctctactggagagatatcaaaaaaacaggagttgtgtttggagccagtctgttcctgttgctatctttgacagtattttccatagtgagcgtcaccgcttacatcgcactggcattgctcagtgtgaccatttcttttcggatctataagggagtgatccaggcaattcagaagtctgatgagggccatccttttcgagcatatctggaatctgaagtcgctatttcagaggagcttgtgcagaaatacagcaatagtgccctgggtcatgtaaactgcaccataaaggagttgagaagactcttcttggtggacgacttggtagactccctgaagtttgccgtgcttatgtgggtcttcacttatgttggcgctctgtttaacggactgaccctgcttatactggccctgatcagcctgttttccgtcccggtcatttatgaaaggcaccaggcccagatagatcactacctcggtctcgcgaacaagaacgtcaaggatgcaatggccaagattcaggctaagatcccgggtcttaaaaggaaggcggaatag

SEQ ID NO: 238437 - DNA, 276 bp, Artificial Sequence
  Description of Artificial Sequence: Synthetic coding sequence
atggatcttaaggagcagccaggcaatacaattagcgcaggacaagaagacttcccttccgtccttcttgaaacagctgcctccctcccaagtctgtcccccctctccgcggcatcgttcaaggagcacgagtatctcggaaacctctccaccgtactgcccacagagggcacattacaggagaatgtgtctgaggcctccaaggaggtgagtgaaaaagcgaagaccctcctaatagatagagatctcaccgaattctcagagctggagtattag

SEQ ID NO: 238438 - DNA, 1191 bp, Artificial Sequence
  Description of Artificial Sequence: Synthetic coding sequence
atggaatttctcaagacctgcgtactgaggagaaacgcctgcactgccgtgtgtttttggcggagcaaagtggttcagaaaccatccgtccggcgaattagcactacaagcccacgcagtactgtgatgcctgcatgggtcatcgacaaatatggaaagaacgaggtactccgattcactcaaaatatgatgatgcccatcatacactacccgaatgaggtgatagtcaaggtgcatgcagctagtgtgaatcccattgacgtgaacatgagaagcggctacggtgctaccgctctaaacatgaaaagagatcccttacatgtcaagatcaagggcgaggaattccctttaacactcggaagggacgtctctggagtagtgatggagtgcggcctggatgtaaaatattttaaaccaggcgacgaagtttgggctgccgtgcccccatggaagcaggggaccctttcagagttcgtagtggtgagtggcaatgaggtgtctcataagcccaagtctcttacccatacccaagcggcatctcttccctacgttgccctgacagcgtggtcggcgatcaataaagtgggcggactaaatgacaaaaattgtactggcaagcgcgtgttgatcctgggagcctctggaggagtcgggacattcgccatccaggtaatgaaagcctgggatgcccacgtgactgcagtgtgtagccaggacgccagcgaacttgtcagaaaattaggtgctgacgacgtcattgactataagtccggatccgtcgaggagcaactgaagtcactcaaaccattcgatttcattctcgacaacgtcggcggatccacggagacttgggccccagatttccttaagaaatggtcaggggcaacatacgttaccttagttactccctttctgcttaatatggatcgactgggtattgccgacggcatgctgcagacgggcgtgactgtggggtccaaagctttgaagcatttctggaagggggtgcattatagatgggcattctttatggcctcaggtccgtgcctggacgatattgcggagctagtggatgctggcaaaatccgtcccgtgatcgaacaaaccttcccattcagtaaggtccctgaggcgttcctaaaagtggagcggggacacgcgcgaggtaaaacggtgataaacgtggtgtag

SEQ ID NO: 238439 - DNA, 681 bp, Artificial Sequence
  Description of Artificial Sequence: Synthetic coding sequence
atggaattcttgaagacctgcgtcctcagacgtaacgcttgtactgccgtatgcttttggaggtccaaggtcgtgcagaagccttccgtgagaagaatttccaccacgtcccctcgcagtactgtaatgccagcctgggttatcgacaagtacggcaagaatgaggttctgagattcacccagaacatgatgatgcctattattcattacccaaacgaggtgatcgtcaaggtccacgctgccagtgtgaacccaattgacgtgaatatgcggagtggttacggcgcaaccgccctcaacatgaagcgtgaccctctgcacgttaaaatcaaaggcgaagagtttccccttactctgggccgtgatgtgtcaggcgtggtgatggaatgtggtttggacgtcaagtattttaaacccggtgatgaagtgtgggctgcagtgccaccctggaaacagggcaccttgtccgagttcgttgtagtcagcggtaacgaagtgtcccacaagcctaagtcactcacgcacacccaagctgcttctctgccctacgtggctctcacagcgtggagcgcaataaacaaagtcgggggattgaatgacaaaaactgcaccgggaaacgaatctctggtaaagaatcaataatagctggccatttctcatggcctgtggctcatgtgtag

SEQ ID NO: 238440 - DNA, 1422 bp, Artificial Sequence
  Description of Artificial Sequence: Synthetic coding sequence
atgaaaagagcctccgcaggcggaagtaggctgctcgcatgggtattgtggctgcaggcctggcaggtggcagctccttgtcctggtgcatgtgtgtgctataacgaacccaaagtcacaacctcctgccctcagcagggactgcaagccgtaccagtgggaatccccgctgcttcacagcgcatattcctgcatggcaaccggatttcgcacgtacccgctgcgagcttccgagcatgtcgtaacttgaccatcttatggttgcactccaatgttctggctcgtatcgatgctgctgcgtttaccggtttggccctgttggaacagctggacctgtctgataatgcccagctacggtctgtggatccagccaccttccatggactgggccgtctgcacacacttcacttggacagatgcgggctgcaggaactggggccaggtctcttcagggggttggccgcactgcagtacctgtacctgcaagacaacgccctgcaggcgctgcccgatgacaccttccgcgatcttggaaatctaactcacctatttctgcatggtaacagaatctcgtcagtgccagagcgcgcattccggggattgcactcgctggaccgattgcttctgcatcaaaacagagtggcacatgtccatccccacgcctttagggacctcgggcgtttgatgacgctttatctgttcgcgaataacctgagtgccctccccactgaagccctggccccactgagagccctgcaatacctgagattaaacgacaacccttgggtgtgcgactgcagggcccgacctttatgggcctggctgcaaaaattcagggggtcctccagtgaagtgccttgtagcctgcctcagcgcttagccggacgggacctgaagcgcctggcggcaaacgacctgcaggggtgtgccgtagccacgggtccatatcacccaatttggaccgggagagctactgatgaggaaccactgggcctgcctaagtgttgtcagcctgatgctgccgacaaggctagcgtgctggagcccggacgcccagcaagtgccggtaacgcgctcaaaggtagagtgccaccaggagacagtccaccaggtaacggatccgggccacgacacattaacgattcacctttcgggacgttacctgggtctgcagagccccctctgactgctgttcgacccgagggcagcgagcccccagggttccccacatcggggcctagaaggagaccgggatgctctcgaaaaaatagaacacgctcccactgcagactgggacaggcaggctcgggaggtggtggaacgggcgactctgaagggtctggcgctctgccgtccctgacgtgttcattgacacctctcggcctcgccctggtcctgtggacagtactggggccatgctag

SEQ ID NO: 238441 - DNA, 1041 bp, Artificial Sequence
  Description of Artificial Sequence: Synthetic coding sequence
atgcacctcccaggctgcgcgccagcaatggctgacggatccttcagtctggccggacatctgctgcgttcccctgggggatccacttctcggctccactcaattgaggcaatattgggtttcactaaagacgatggaatcctcggtacttttcctgctgaacggggagctaggggtgccaaggagagggatcggagattgggggctcgaccagcttgccccaaggctcctgaagagggatccgagcccagccccccaccagccccagctcctgcacctgaatacgaggcacccaggccctattgtcctaaagagcctggcgaggcacggccaagccctggccttcctgtagggcctgctaccggcgaggccaaactctctgaggaggaacagccaaaaaaaaagcataggcgtaatcgcactacttttaccacttaccaactgcatgagctcgagcgcgcattcgagaagtcgcattaccctgacgtctactctcgggaagagctggctggtaaggtaaacctgcctgaggtcagggtgcaagtttggtttcagaaccgtcgagcaaaatggagaagacaggagaagttggaggtgtcctctatgaagctccaggattcacctcttctcagcttctcgcggagccccccaagcgcgaccctgagcccgcttggtgcaggtccgggttcaggcggaggaccagcagggggtgcactcccgctggaatcttggctgggccctcctttacccggtgggggtgcaacagccctgcagagtttgcccggttttggccctcctgcacagtctctgcccgcatcctatactccaccgcctcctccccctccattcctgaacagcccccctctgggcccaggcctgcaaccgctggccccacctccccctagctacccttgtggccctggctttggagacaaattccccctggatgaggcagatccacgcaacagctcgatagctgcattgcgtctcaaggccaaggagcacattcaggcaattggtaaaccctggcaggctctctag

SEQ ID NO: 238442 - DNA, 225 bp, Artificial Sequence
  Description of Artificial Sequence: Synthetic coding sequence
atgcatctgcccggatgcgctcctgccatggcagatgggtcgttcagcctcgccggtcacctactgcggagccccggtggcagcacgagccgcctccattcaatagaggctattcttggctttacaaaggacgatggcatcctcgggacttttcctgctgagaggggcgcaaggggtgcaaaggagcgggatagacgcctgggggcacggccagcatgcccttag

SEQ ID NO: 238443 - DNA, 588 bp, Artificial Sequence
  Description of Artificial Sequence: Synthetic coding sequence
atgtcactgatctcctggttgaggtggaatgaagcgccaagcaggcttagtacacggtcccctgctgagatggtgcttgaaactctgatgatggagctcaccggccaaatgagggaggcagaacggcaacagagagaacggagcaatgccgtgagaaaggtctgcactggggtcgactattcatggctggcttcgacaccgaggtccacatatgatttaagtcccatcgagcggctgcagttggaggacgtgtgcgtcaaaattcacccttcatattgcggccctgccattctgcgtttccgccaattgcttgcagagcaagagcccgaagttcaggaagtgagccagctgttccgctctgtgctccaggaggtgttggagaggatgaagcaggaagaggaggctcataaactgacaagacagtggagcctgcgtccaaggggatcccttgccaccttcaaaaccagggcccgaatctccccctttgcctccgatattaggacgatttcagaagacgtggaacgcgacacaccccctccattgagatcatggagtatgccagagttcagagcgccaaaagccgattag

SEQ ID NO: 238444 - DNA, 762 bp, Artificial Sequence
  Description of Artificial Sequence: Synthetic coding sequence
atggcagagacatccgccctgccaacaggattcggcgagctcgaggtgctggccgttggcatggtcttgctcgtggaggctctctcaggactgtccttgaatacactgacaattttctctttctgtaagacacccgaattgaggacaccctgccatctcttggtgctgagtctcgctctggcagacagcgggatttcgctgaacgcacttgtagcagcgaccagctcccttcttaggcgctggccctacggctcggatggatgccaggcccatgggtttcaaggatttgtcacagccctggccagtatctgtagtagtgcagccattgcctggggcagatatcatcactattgcacgcgcagtcagctcgcttggaattctgctgtgtcattagtgctttttgtctggttaagtagtgccttttgggccgcactgcccctgctggggtggggccactacgactacgagccactcggtacatgctgtaccctggactatagcaaaggtgaccgcaatttcaccagtttcttattcactatgtctttctttaacttcgccatgcctcttttcatcacaatcacctcatatagccttatggagcagaagttgggaaagtctggtcatctacaggtgcccgcattaattgcgaaaatggtgcctaccatcaacgccataaactacgctttgggtaacgaaatggtctgtcgaggcatctggcaatgtctctcaccacagaagagggaaaaggatcgcacaaaatag

SEQ ID NO: 238445 - DNA, 888 bp, Artificial Sequence
  Description of Artificial Sequence: Synthetic coding sequence
atggccgaaacctctgcgctgccaactggctttggggagttggaagtgctggccgtcgggatggttctgctcgttgaggctctttctggactctcgctgaatacactgacaattttctcattctgcaagacgcctgaacttaggaccccttgtcatttgcttgtccttagtctggccttggcagactctggaattagtcttaatgccctggtagccgcaacttctagtctgctgagagtgtcccatcggcgatggccatacggctccgacgggtgccaggcacatggcttccagggttttgtgacggccctggccagtatctgctcgtctgccgctatagcatggggcagataccatcactactgtactagaagtcagttggcctggaatagcgcggtgtctttggtcctctttgtgtggttgtcatcggcattctgggccgctttgcctcttttgggctgggggcactatgactacgaacctctcggcacctgctgcactctagactacagcaagggtgatcgcaatttcacttcttttttgttcactatgagttttttcaacttcgcaatgcccctttttattacaataacctcatatagtctgatggagcagaagctggggaaatctggtcatctgcaggtgaacacaacactgccagctcgaactctgctcctcgggtgggggccttatgccatcctgtacctgtatgctgtgatagccgatgtcacttctatttcgcccaaacttcagatggtgcctgctctaatagctaaaatggtgcccacgataaacgccataaattatgctctaggtaatgaaatggtgtgccgcggaatctggcaatgtctcagccctcagaaacgggaaaaagataggacgaaatag

SEQ ID NO: 238446 - DNA, 363 bp, Artificial Sequence
  Description of Artificial Sequence: Synthetic coding sequence
atggctgagacgtctgcgctcccaacgggattcggcgaactcgaggtgttagccgtgggcatggtgctgttggttgaggatcccggtgcagctgacagccttccgccaaccggggcagaactcggttcctgcgggcagtgggatcagcccgagtgtccaagatgcagtcatatccagccctctccctgcctccctcaggctctggccctgagattaggccgacttccaggctctcggctgccagggctgtgtgacagcgtcggccagcacctgcagcagtgttcccatcggatgggcgctctgagtcccctactgcacccgccaaagtgttgtcaccgatcgcaccatttcgagtggcgatag

SEQ ID NO: 238447 - DNA, 1056 bp, Artificial Sequence
  Description of Artificial Sequence: Synthetic coding sequence
atggctccggtccttccactggtgctgccactgcagcctaggatcaggctggctcaaggactgtggctgttgagctggttactggctctggcagggggtgtcattctgctgtgtagtggtcacttgctcgtccagcttcgtcatttagggacttttctggctccttcttgccagtttcccgtgctgccacaagctgcactcgccgctggggcagttgcactggggaccggtctcgtgggggtcggtgcaagcagggcttctctgaacgctgctctatatcctccttggcgcggagtgctaggccctctactggtggcaggaacagccggtggaggcggtctgctggtcgttggtctgggactagctctggccctcccgggaagcttagacgaagccctggaagaaggattagtgactgccctggctcattacaaggataccgaagtccccggtcactgccaggctaagaggctggttgacgagctacagctgaggtatcactgttgcggacgccacggatacaaggattggtttggagtgcagtgggtctcaagcagatatttggacccaggagacagggacgtggcggatcggattcagagcaatgtggaggggctgtacctgacagacggtgtccctttttcttgctgcaacccccactccccgcgtccctgcctgcagaacagattatctgattcttatgctcaccccctattcgacccgaggcagcccaatcagaatctctgggcccaggggtgccacgaggtcctgctggagcacctccaggaccttgcaggaactcttgggtccatgctggctgtgactttcttactgcaggcactggtgctcctagggcttcggtatctccaaacagcgttggagggactgggaggagtcattgacgcagggggagagactcaagggtacctattccctagtgggctgaaagatatgctcaaaacagcttggctgcagggcggagttgcctgtagacctgccccagaagaggcgccaccaggcgaggcccctcccaaggaggacctgagtgaggcctag

SEQ ID NO: 238448 - DNA, 1602 bp, Artificial Sequence
  Description of Artificial Sequence: Synthetic coding sequence
atgtccatacaggtcgagcaccccgcaggcggatacaaaaaattgtttgagaccgtcgaggagctttcaagtccactcactgctcatgtgactggcaggatcccactatggctcacaggctctttactgaggtgtggcccaggcctgttcgaggtcggcagcgaaccattctaccacctttttgacggccaagcactcctgcataagtttgacttcaaagaagggcacgttacctatcaccgtaggttcattagaaccgatgcttatgtgagggcaatgacagaaaaaaggatcgtcatcacagagttcggcacctgcgcttttccggatccctgcaagaatatttttagtagattctttagttactttcgaggtgttgaggtgaccgacaatgcactcgtcaatgtgtacccagtgggggaggattattatgcctgcactgagaccaattttattactaaaatcaatccagagactctcgagactatcaaacaggtggatctgtgcaactacgtgagtgtcaacggagccaccgctcatccacatatcgagaatgatgggacagtttacaacatcggcaattgttttggaaagaatttttcaatcgcgtacaatatcgtgaaaatcccccctcttcaggctgacaaagaagaccctataagcaaatcagaaatcgtggtgcagtttccttgctccgacaggtttaaaccttcctatgttcacagcttcggccttacccccaattacattgttttcgtcgaaacacctgtgaagattaacttgtttaagtttctgtctagctggagtctgtggggcgcaaactacatggattgctttgaaagcaatgaaactatgggtgtctggttgcacatagctgataaaaagcgcaaaaagtacctgaacaacaagtatcgcacgtctcctttcaacctgttccatcacatcaacacatacgaggacaacggctttctgatagtcgacttatgctgttggaaaggctttgagttcgtgtacaattatttatatcttgcgaatcttcgggaaaattgggaggaggtgaagaaaaatgccaggaaagcacctcagcctgaagtgcgcaggtacgtgctccctctgaacattgacaaagctgacactggtaagaacctggtgaccttacccaacaccaccgccacagcaatcctgtgctcagacgagacaatttggctcgaacccgaggtgctcttctccggtccaagacaggcatttgagttcccgcagataaactatcagaagtactgtggaaagccctatacgtacgcatacgggttaggtctaaatcatttcgtacctgaccggttatgtaaactgaatgtaaagaccaaggagacgtgggtctggcaagagcccgattcatatccttctgaacctatctttgtctctcaccccgatgcattggaagaggatgatggagtggtgctatctgtggtcgtcagccccggtgctggacagaagccagcttacctgctgatcctgaacgctaaggacttatccgaggttgcccgtgccgaggttgaaataaacattcccgtgacctttcatggactctttaaaaagtcttag

SEQ ID NO: 238449 - DNA, 954 bp, Artificial Sequence
  Description of Artificial Sequence: Synthetic coding sequence
atgtcggaaggggtgggtaccttccggatggtgcccgaagaagagcaggagctccgggctcagctggagcagctgaccacaaaggatcacggccctgtattcgggccatgctctcagctgccacgccacactcttcagaaagccaaggacgaacttaacgagagggaggaaacccgagaagaagctgtaagggagctgcaggaaatggtacaagcacaggctgccagtggggaggaactggccgtggcagtcgcggaaagggtgcaggagaaggattctggcttcttcctccgatttataagagcccgtaaatttaacgtcggcagagcttacgagctcctgagaggatacgtgaactttcgcctgcagtatcctgaattgtttgactctctgagtcccgaggcggtgaggtgtacaatcgaggcaggttaccctggggtgctaagtagcagggataagtacggaagggtggtgatgctgtttaacattgaaaattggcagtctcaggagatcaccttcgacgagattctgcaggcttactgctttatccttgaaaaactcctggaaaatgaggagacgcagataaacgggttttgtataatagaaaattttaaagggttcactatgcaacaagccgcttctctcagaacttccgatctcagaaagatggttgatatgttgcaagattccttccctgctcggtttaaggcgatacatttcatacaccagccgtggtactttaccactacgtataatgtagtgaaaccattcttaaaatcgaagctcctcgagcgggtttttgtgcatggcgatgatctttccggattttatcaggagatcgacgagaacattctcccttctgatttcggagggaccctgccaaaatatgatgggaaggctgtcgcggaacagttatttggcccacaagcccaggccgagaacacagccttttag

SEQ ID NO: 238450 - DNA, 807 bp, Artificial Sequence
  Description of Artificial Sequence: Synthetic coding sequence
atggccgagctggatattggtcaacactgtcaagtggaacactgtcggcagagagactttttaccttttgtgtgcgatgattgtagtggtattttctgcctagagcataggtctcgggaaagtcacgggtgtccggaggtaaccgtgatcaacgagcggttgaagacagaccagcatactagctatccatgctcgtttaaagactgcgccgagagagaactggtcgccgtaatatgcccctattgtgagaaaaatttttgtctgcggcacaggcatcagtccgatcatgagtgcgaaaaactggaaatccccaagcccaggatggcagccacccagaagctagtgaaagacataattgacagtaagactggagagacagcctccaaaaggtggaaaggcgctaagaattccgagactgcagcaaaggtcgcattaatgaagctgaagatgcacgctgatggggataaaagcctcccgcagaccgagaggatctactttcaagtgttcctccccaagggttctaaggagaagagtaaacccatgtttttctgccatagatggagcataggtaaggcaattgacttcgcagcgtctctcgctcgacttaaaaatgataataataagttcacggccaaaaaactgaggctatgtcacataaccagcggagaggccctgcccttagatcataccctggagacttggatcgctaaagaggactgccccctctataacggcggtaacattattctggaatacctaaacgatgaagagcagttctgcaaaaacgtggagtcatacctggaatag

SEQ ID NO: 238451 - DNA, 2751 bp, Artificial Sequence
  Description of Artificial Sequence: Synthetic coding sequence
atgcagcgacctgtggtaaaattgtatgctaccgacggtcgcagagtcccttctctccaggctgtgatcctgtcctctggcgctgtcgtcgcggctggtcgggaaccattcaaaccgggaaactacgacatccagaagtatctattgcccgcacgcctgcccggtatcagccagagagtgtatcccaaaggcaatgctaagtcagaaagccgtaaatcctctaactggaaagtttttattattacaagcgatctgccggatgccggaacatcaagtcaaatctatatcatcctctatggccaacatagatccagcgcgccaatctacctgtacgggacagatggagcccgattccaagtcggacatgaggatatattcacaattacagtcggagatatcggggctttgttcaaaatccgaatcggacacacaaactcaggctctagccccagctggcattgcaaggagattcaactgcacaacatgaatagcggcaagcagttttatgttcccgtgcagcggtggctggcgagggatcaggaggacggcgagatttgtagagagtttcctttgctgagcaagggccagccagtgctgccggtcaccatctacgaggttaacgtggccaccggagaactttggaacgcaggaaccgtcgcaaacgtgtatatctcaattcatggcgagaagggtgatacaggttcaagacagctgttcagaagtaagtccagcttcaactttttgagagggcaaaccgatacattttttttggaagcggtgcacttgggcgacctctgtaaaattgtgatcggacacgatggcctgggaccaggaaatgggtggtttctggatgatgtggtcattaaggacccgaccaccaactacgagtatgccttcttctgtcataggtggctggatcagggagaagatgattgcaagatcgttagagaactctatgcacgggataactccatcttttccgccaggcagaaattagagctgaagcggaaagagacgtggacggccgagtcatggaaattcaccaagggcaatacactgcaattctataataagctgaccgggggattcgtgcggctacatccagatgggacggtggatgccattggagagaagacggataagtacggcgtgtttgatgtcatcttcaataaaaggaatatttgcatcttccagtcccacgagatgcgtcacctgagtctagcactggacaatggcattgtgacgggaatggtctccggtgaagctactacggaattgagggtgctttatcaaccaaaccggtgtgctctgctggagagtgcactggtgcctggccacactgtcgtgttcgacagacacgggaagatcgctgatgcttccagcgccggatatgcaaatttgtcaaaggagtttgtgatatttgtgaagggcgtttttctcaactcggcagtcgtgctccttgccacctccctgtgtcaggcgctgtgtttgcagcccgacggaagctgcacaggtgtcggtagtcaatcagagaaaagttactggaaggtgcacaagatcagtagcgggatctgcatgttcgaaagtgtcaaaaacgcacaaatgtatctgaggataaaagacggacgttgcgacggcaccgggaccggagacgtcgactgtcactttaagattaaaaagaacctcaagaatgcatctatctccttggagagtaccaaaagccccggtttgtttgtcggattacaatccgatggccaggcgaagcccatgatctataccaaggatgagaatgtgtgtttctatcctcaggtcatccagtttggcagagagaaccctatgggcatgtccgcaactcccagtcaggaagaagagaagatccacgagagcaagaagcagaagaagatccctcccgagagcgaagcgagatctccacttccttcctctacagctaaagagattcgccactttcagagcagcgaaaccctcctgagtgaagacgagtggaaagttctggttctgaccggaaatacaggaacccaggccaatgtgactctctgggtgtacggagataaaggagtgacaggccctatttcacttcggaaagactcctcagagcagcttttccttcccggacacgaagacgagttccaagtagagatcaggaacacaggcaacatttataagatcaggatcgggcatgacgggacaagcgagcagcctgaatggaatctccagcgcgttactatgcagcatatgaaatccaaaaagattctggactttgccgctaatgtttggctctcgcgaatacaagcggatggtgatgtggtgtgtgagctacctgtcgtgaagggcggacaggccatcttccccctagtaagatatcaggtggacgtgtacactggccagctcaaacatgcggaaaccgagagcgaggtcttcctttgcctattcggtgaacggggagactcgggactcaggcagctgtacaagtccaatatgcaggttaaatttcagcgcggacagatcgataaattccaggttgcagctgtcagtctgggcaaattacagaaggtgctcctgcgatgtgaggcctccgacaagtcccaatattggtattgtgagcaggtgatcgtgagagagccgggtactacatctgaaagcatctttacttgccagcggtggttaccgtttatgagccaggggatcattcacagcgagatcgaactgtacctgcaaggggaagactattag

SEQ ID NO: 238452 - DNA, 7202 bp, Artificial Sequence
  Description of Artificial Sequence: Synthetic coding sequence
atgaattcaacacccagaaatgcccaggcacccagccatcgcgaatgctttctcccatccgtagctcgcaccccaagcgtgacaaaagtaacccccgcaaagaaaatcacgttccttaaacgtggggatccaagattcgctggtgttcgtctagcagtccatcagagagcttttaaaacatttagtgccttgatggatgaactttcgcagcgtgtgccactctcattcggggtgcgaagcgttaccactcctaggggcctgcattcgctgtccgctctggagcaactggaggacggcggatgttacctgtgctcagacaaaaaaccgccaaagacaccctcaggcccagggcgaccccaggagcggaaccccactgctcagcagctacgcgatgtcgaaggacagagagaggccccaggcacatcctcgtccagaaaatccttgaaaaccccgaggagaatattgcttataaagaatatggatcctcggctccagcagacagtagtgctgtcacatagaaacacccgtaacctggccgctttcttaggcaaggccagcgatttgttgcgcttccctgtcaaacagctgtacacaacctcaggaaaaaaagtcgattctctacaggccctcttgcattcgccctctgtgctggtgtgcgctggacatgaagctttcagaacacctgccatgaaaaacgccagacgctctgaggctgaaacactgagcggactaacatcaaggaacaagaacggttcctggggcccaaagacaaaaccttctgtcattcatagcaggagtccccctgggtcaacccccagactaccagagcggccaggcccttccaacccacccgtgggacctgctcccggtaggcacccccaggacactcccgctcaatccggtccattggttgccggagacgacatgaagaagaaggtgcgcatgaatgaggatggttccctgtccgtggagatgaaggttcgctttcatctggtcggcgaagacactctgctatggtcaaggcgtatgggacgcgctagcgcactgaccgctgcctcaggtgaagaccctgtcttaggcgaagtcgaccccctctgttgcgtctgggaaggctacccatggggattctcggagcccggagtctggggcccaaggccgtgccgggtgggctgcagggaggtctttgggcgaggaggacagcccggtccaaagtatgagatctggacaaatccccttcacgcaagtcaaggggaaagagtcgctgcacgaaagagatgggggctggcccaacatgttaggtgctcgggtctgtggggccacggaaccgccggaagagaaaggtgcagccaagatagcgcgagtcctgcttcatccacagggctgccagaggggtctgaacccgaaagttcttgctgtccccgaactccagaggacggagtggattcagcctctccatccgcccagattggggctgaacgcaaagcaggcggtagcctgggcgaagatcccggactgtgcatcgacggtgctggcctcggaggacctgagcaaggagggagacttacaccacgagcacgatccgaagaaggcgctagcagcgactccagtgcatcaactggcagccatgagggaagctccgaatggggtgggaggccccagggctgccccggaaaagctcgcgcagagacttctcagcaggaggcgtctgagggcggagaccccgctagcccagccctgtcactaagctccttgcgctcagatgacctccaggcagagacgcagggccaggggacggaacaggccactggggcagcagtgactcgcgaaccacttgtgctggggctatcctgttcctgggactctgagggcgctagcagcactccatctacgtgtacttcttcacagcagggccagcgaaggcaccggtccagggcgagtgctatgtcctctccgtccagtcctggacttggtagggtagctcctcgcggacaccccagacactcccactatcgcaaagacacacattctcccctggactcatctgtaaccaagcaggtgccgcgaccccctgagcgcagaagggcttgccaggatggcagcgtgccgcgatatagcgggagctctagctccacccgtacgcaggcttctggcaatctgagaccacctagctccggctccctcccatcacaggacctgttaggaacgagtagcgccacggttaccccagctgtccattccgacttcgtgagcggagtaagcccccacaatgccccttcagccggttgggccggagatgctggcagtagaacttgtagtcccgctccaatccctccccacaccagtgattcttgttcgaagtccggagctgcctcactgggagaagaggcaagggacaccccacagccaagtagtccccttgttctgcaggttggcaggcctgaacagggggctgtgggtccccatcggagtcactgctgttctcagcccggaacacagcccgcacaggaagcccagcggggaccctcaccggaagcctcctggctctgcggtcggtattgtcccaccccgcctagaggcagaccttgcccgcagcggcgatcctctagctgcggcagcacaggctcaagtcatcagtccactgctagaggccctggtggcagcccccaggaaggtacaaggcagccaggcccaaccccttcacctgggccaaattccggagcttcacggagatcctctgcttcccaaggcgctggatccagaggcctttccgaagaaaaaaccctgcgatcaggagggggaccacaaggtcaggaggaagccagcggggtctctccgtcctcgctcccccgatcaagtccagaggccgtggtcagagagtggctcgacaacatccccgaggagcccatattaatgacttatgagttagctgatgaaaccaccggagcggctggaggtgggctgcggggaccagaggtagatccaggcgacgaccacagcctggaaggcctgggagagcctgcccaggccggacaacagagtcttgagggggaccctggacaggacccagaaccagaaggagccttgttaggctcatcagacacaggtccgcagagcggggaaggggttcctcaaggagcggcacctgaaggtgtctccgaagcccctgcagaagcaggcgctgaccgggaagccccagctggttgccgcgtaagcttgcgagccttgcccggaagagtatccgccagcacacagattatgcgagctctcatggggagtaaacaaggtagaccaagcagcgtaccagaggtgtcgcgtccgatggctagaaggttgagctgcagtgccggagcactcatcacttgcttggcttctctgcagctctttgaggaagaccttgggtcccccgcaagtaaggtgagatttaaggattctcctcgataccaggaacttctgtccatctccaaggatctatggcccggatgcgatgtcggcgaggaccagttggacagtggtctgtgggagctgacatggtcacaagcactgccagatctgggatctcacgccatgacagaaaactttactcctacctcaagtagcggagtagatatcagttcgggatctgggggatccggcgaatcatctgtgccttgcgcaatggatgggaccttagtcactcaagggacagaattgcctctgaaaacctccaatcagcgtcctgatagtaggacctatgaatcacccggtgatctggaaaaccagcagcagtgctgtttccccacattcttgaatgcaagagcatgtgcctgtgccacgaatgaggacgaagcggagcgcgattcagaggagcagcgggcatcctcgaatctggagcagttggcagagaatactgtccaagaggaagtccagcttgaagaaactaaggaagggaccgaaggagaaggccttcaggaggaagcagtacagctggaagagactaagacagaagaggggcttcaggaggagggcgtgcaacttgaggagaccaaggaaacagagggagagggtcagcaggaggaagaggcccagctcgaagagatagaggaaactgggggtgagggactgcaggaagagggggtccagctcgaggaagtcaaagagggccctgaggggggtttgcaaggagaggctctagaagaaggcctgaaagaggaaggccttccggaagaagggagcgtgcacggtcaggagcttagtgaggcatctagccccgatggcaagggatcacaggaggacgatccagtccaggaggaagaggctggtagagcttcggcgagcgctgagccctgtccggctgagggaacagaggagccaaccgagcctcccagccatctttctgaaacggaccccagcgcttccgaacggcagagtggctcccagttggagccagggttagaaaagccacccggagctaccatgatgggtcaggagcacacccaggcgcagcccacccagggagctgcggaaagaagcagctctgtggcctgcagcgctgctcttgactgtgaccccatctgggtgtccgttctccttaagaaaaccgagaaggcttttcttgctcacctggccagcgccgtagccgaactgagggccagatgggggttgcaggataatgacctgctggaccagatggctgccgaactgcagcaggacgtagcccagcggttacaggattcaactaagcgggagttacaaaaactgcagggtagagcgggacgtatggtcctcgaaccccctagagaggcattaacaggggagctgctgttacaaacgcagcagcgaagacatcgcctgcgaggccttagaaatttgtcagccttttccgagagaaccctcgggttgggcccattgtcatttaccctcgaagacgagcctgccctgtcaacggccctggggtctcagctaggcgaggaggctgaaggcgaggagttttgtccctgcgaagcgtgtgtcagaaagaaggtgagtcccatgtctcctaaagccacgatgggagctacccgcggaccgattaaagaggcctttgacctccaacagatcctgcagcggaaacgcggtgaacacaccgacggtgaggctgcggaagtagcaccaggcaagacccataccgacccaacaagtacaaggacggtgcaaggagcagagggaggtttaggacctggtctaagccaaggccctggcgtggatgagggcgaggacggcgagggcagtcagcggctgaatcgagacaaagatcccaagctcggtgaagcagagggtgatgcaatggcccaggaacgcgaaggaaagacccacaactccgaaacctctgcagggtctgaattgggggaagccgagcaagagggggaagggatatctgaaagaggcgagaccggcggacagggctcgggccacgaagataatttacagggggaggcagcagcaggcggagaccaggatcctggtcagtctgacggcgctgagggcatagaagcacccgaagccgaaggcgaggcccaaccagagtctgagggtgttgaagccccagaagccgagggcgacgctcaggaagccgaaggagaggcacagcccgaaagcgaggacgttgaggcacccgaggctgagggcgaggcccagccagaaagcgaggatgtggagactcccgaggctgaatgggaagtgcaacccgagagcgagggcgctgaggccccagaggcagagaaggaggcccagcctgaaactgagtccgttgaggccctggaaaccgaaggagaggacgaaccagagtctgaaggggctgaggcacaggaagcagaagaagccgctcaggaagctgaagggcaaacgcagcccgaaagtgaagttattgagtctcaagaggccgaggaagaggcccagccagaatccgaagacgtggaggctctggaggtggaggtggagactcaggaggccgagggggaggcccaacccgaaagcgaggacgttgaagctccggaggccgagggtgaaatgcaggaggccgaggaggaggcgcaacccgagagcgatggggtggaggctcagccaaaatcagagggtgaggaagctcaggaggtcgaaggtgaaacacagaaaacagagggcgacgctcagcccgaatccgacggggttgaggcccctgaggcagaggaagaggcccaggaggcagaaggggaggttcaagaagctgagggcgaagctcaccccgaatcagaagatgtggacgcccaggaggcggagggcgaggcccagcctgagagcgagggagtggaagctccggaagcggaaggtgaggcccagaaggctgaaggaatcgaggctccggagacagaaggggaagctcagcctgagtctgaaggcatcgaggcgccagaggctgagggcgaagctcagccagaaagcgaaggcgtcgaagctcaagatgccgaaggcgaggcccagcccgaatctgaaggcatcgaggcacaagaggccgaggaagaagcccaacccgaactggaaggtgtcgaggcacccgaggccgagggcgaagcacagcctgaatccgaagggatcgaagcacctgaggctgaaggtgaagcccagcccgaacttgagggagttgaggctcccgaggccgaggaggaagcacagccagaacccgagggggttgagactcctgaagcggagggcgaagcccaaccggagagcgagggtgaaacccagggggaaaagaagggcagcccacaggtgagtttaggcgacggacagtcagaagaggctagtgagagcagttcacccgtaccggaggatcgccctacccccccacccagccctgggggtgacacaccacaccagcgcccaggctcacagactgggccaagtagttctcgcgcttcatcttgggggaactgttggcagaaggatagcgagaatgaccacgtcctgggagataccaggtctccagatgctaagagcacggggacacctcatgccgaaagaaaggcgaccaggatgtacccggaatcaagtaccagtgagcaagaggaggcccctctggggtctagaactccggaacagggggctagcgaaggctatgacctgcaggaagaccaagcactgggatctctggcacctaccgaggctgtgggaagggctgacgggttcggacaggacgacctggacttcta

SEQ ID NO: 238453 - DNA, 5019 bp, Artificial Sequence
  Description of Artificial Sequence: Synthetic coding sequence
atgaaggtagatcgtacgaaactaaaaaaaacacccacggaagctcccgctgactgcagggctctgatcgacaagctgaaagtctgtaatgatgagcagctgctgcttgagctgcaacagattaagacctggaatatcgggaagtgcgagctgtatcattgggttgatttgctggatagattcgacggcattctggctgatgccggacagacagttgagaacatgagctggatgttagtgtgcgaccgcccagaacgtgagcagctgaaaatgctcctgctcgctgtgctcaactttacagctttgttgatagaatacagtttctctcgccatttgtatagcagtattgaacacctaaccacactgctcgcgagcagcgacatgcaggtggtgcttgccgtgctgaatctgctgtatgttttttccaagagatctaattatatcaccagactcggatcagacaaaaggacaccactgctgacccgactccagcatttggcggagagttgggggggtaaggaaaacggatttggcctggctgagtgttgccgagacctccacatgatgaaataccctccatctgcaactaccctgcacttcgagttttatgccgatccaggggctgaagtgaagatagaaaagcggaccacttcaaatacgttacactacatccatatcgagcagctggacaaaatctcagagtcccccagtgagattatggaatctcttacaaaaatgtacagcatcccgaaggataagcagatgctgctttttacgcatatccggctggcccacgggtttagcaaccataggaaaaggctccaggcggtccaggcgaggttgcacgcgatcagtattctagtgtattccaacgccctgcaggaaagcgccaactccatcctctacaacggccttatcgaggaattggtggatgtgctccagattacagataaacagctcatggaaataaaggctgcttctctccggacattaaccagcatcgttcacctagagagaacccctaaactgagctctattatagattgcacgggaacagcttcataccatgggttcctgccagtgctggtgagaaactgtatacaggccatgatcgaccccagtatggacccgtacccgcatcaatttgctactgccctcttcagctttctttaccacctcgccagctatgacgctggcggagaagcactggtttcttgcggcatgatggaggcattacttaaggtgatcaaatttctaggggacgagcaggaccagataacattcgtgaccagggcggtgcgggtcgtcgatctcattacaaacctcgacatggcagcattccaatctcacagtggcctgtccatatttatctatcgactagagcatgaggtcgacctatgccggaaagagtgccctttcgtgatcaagcctaaaattcaacgtcctaacaccacacaggaaggggaggagatggaaaccgacatggatggtgtgcaatgcattccccagcgagcagctcttctcaagtcaatgttaaacttcctcaagaaggccatccaagacccagctttctccgatgggatacgccacgtgatggatggtagtctgcctaccagcctgaagcacatcatcagcaacgctgagtactacggccctagtttgtttctgttggcgaccgaggtggttacggtgtttgtctttcaagaaccaagcttgttatcaagcctgcaagacaacgggttgacggacgtgatgctgcacgcactgctgatcaaggatgtacccgcaacaagagaggtgctgggaagcctgccgaatgtctttagcgccctttgcctgaacgcccgtggtctgcagagcttcgttcagtgtcaaccctttgagagactgttcaaggtgctcctgtcacctgactatctgcccgctatgcgccgacggagatcttccgacccgttgggcgacaccgcatcaaaccttggcagcgcagtcgacgagctgatgagacaccagcccactctgaagaccgacgccaccactgccatcattaagctcctcgaggaaatctgtaacttgggacgtgaccccaagtatatatgccagaaaccttctatccagaaggccgacggaaccgcaacggccccacccccacgatccaatcatgccgctgaagaagcttcctctgaagacgaagaggaggaggaggtccaggctatgcaatctttcaacagcacgcagcagaacgagaccgagcctaatcagcaggttgtggggacagaggaacgtatcccaatacccttgatggattacattttaaacgtgatgaaattcgtggagagcatcctgtctaataacactactgatgatcactgtcaggaattcgtcaatcagaagggcctgctgcctctggtaacaatcctgggcctgccaaacctacctattgattttccaacgtctgccgcatgccaagctgtggctggggtgtgcaaatcaatactgacgctgtcccacgagccaaaggtccttcaggagggactcttacaattagattcaatcttgtctagcctcgaacccttgcaccggccaatagagtcccccggagggagcgttctgttacgggagctggcctgcgcaggcaatgtcgccgacgcgacactgtccgcacaagccactcccctgcttcacgctctgactgccgcacatgcctacatcatgatgttcgtgcatacatgtcgggtcggacagtctgagatcaggtctatttccgtcaaccaatggggaagccagttaggcttatccgttctttctaagttgtctcagttatactgctctctggtgtgggaatcaacagtactgctgagcttgtgcacccctaattcactgccctctgggtgcgagtttggacaggccgacatgcagaaattagtgcctaaggacgaaaaagcagggaccacacaaggcggaaaacgaagcgatggcgagcaggatggggctgctggctccatggatgcgtctactcaaggactgctcgagggcataggactcgacggtgacaccctggccccaatggaaaccgatgaacccactgcatcagattctaagggcaagagcaaaataactcccgcaatggcggctcgtataaagcagatcaagccactactgtcggcaagttcgagattggggagagccctcgcagagttgttcgggctcttggtcaaattgtgtgtggggtcccccgtccggcaacgtcggagccaccacgctgcatcaactactacagcacccacacccgctgccaggtctaccgcctctgcgctcaccaaattactgaccaagggattgtcctggcagcccccaccatatacccccaccccccgattcagactcactttcttcatctgtagcgtgggctttacctcaccgatgctgttcgacgagcgtaagtatccatatcacctcatgctccagaagttcctctgcagcggcggtcacaatgcacttttcgaaacctttaactgggcactctcaatggggggaaaggtccccgtgagtgaaggtttggaacattctgatctgccagacggcacaggcgaattcctcgacgcttggttgatgctggttgaaaaaatggtaaaccccactacagttctggaatctccgcatagcctgccggctaagttgcccggtggcgtgcagaacttccctcaattctccgcactcaggttcctggtggtcacccagaaggctgctttcacatgtattaaaaatctgtggaacaggaaaccactcaaggtgtacgggggtcgcatggccgaatctatgctagcgattctatgtcatatcttgaggggggaaccggttattcgggagagactgtctaaggagaaagagggctcccgtggcgaggaagacaccgggcaggaagagggaggaagccgcagagagccacaggttaatcagcaacagttacagcagttaatggacatggggtttacgagggagcatgctatggaggcactactgaacaccagtactatggaacaggccaccgaatacttactcacccatccaccccctatcatgggcggagtggtacgtgacctttctatgagtgaagaggaccagatgatgcgagccatcgcaatgtccttaggtcaggacatccctatggatcagcgtgccgaaagccccgaagaggtggcatgcagaaaagaagaagaggagcgcaaagccagagaaaagcaagaggaagaagaggccaagtgtctggaaaaattccaggacgctgatccgctggagcaggatgaattgcataccttcacagacacaatgctgccaggctgtttccacctcctggacgaactgccagacaccgtataccgagtctgcgatctcattatgacggcaattaagcgcaatggcgcagattacagagacatgatcctgaagcaggtggttaaccaagtctgggaggccgcagacgtattgatcaaggcagcactccctctgacgacatccgacaccaagactgtgagtgaatggatcagccaaatggctactctgcctcaggccagcaatcttgccacacgaatcctcctccttacgttactcttcgaggaactgaagctcccatgtgcatgggtggtggagtcaagtggtatcctgaacgtgctcataaaacttctggaggtggtccagccctgtttgcaggccgctaaagaacaaaaagaagtgcagacaccgaagtggattacgcccgttctgctgctgatcgatttttatgagaagactgccatctcgtccaaacggagggcccaaatgaccaagtatctgcaatccaatagcaataattggagatggttcgatgacagatccggacgttggtgtagctatagcgcttctaacaattccactatagatagcgcgtggaagagtggggagaccagcgtccgctttacagccggtcgaaggaggtacacagtccagttcactaccatggtgcagggcacaagcgcagaatag

SEQ ID NO: 238454 - DNA, 666 bp, Artificial Sequence
  Description of Artificial Sequence: Synthetic coding sequence
atgagcagcaggcccggaagggaggatgttggagcggctggcgctcgcaggccgagagagcctccagagcaggagttacagcggaggagagagcaaaagagaagacgacacgatgcccagcagctccagcaactgaaacatctagagagcttctacgaaaagccccctcctgggctcatcaaggaggacgaaacgaaacccgaggattgcatcccggatgtaccagggaatgagcacgccagagaattcctggcccatgctcctactaaggggctgtggatgcctctggggaaggaggtcaaggtcatgcagtgttggaggtgcaaaaggtatggccaccgcacaggcgataaagagtgtcccttctttatcaaggggaaccagaagctggaacagtttagagtggcccacgaggatcccatgtacgatattatccgggataataagaggcatgaaaaggacgtgaggatccaacagctgaagcagttgctcgaagacagcactagcgacgaggaccgaagcagcagctccagtagcgagggcaaggagaagcataagaaaaaaaagaaaaaagagaagcacaagaagcgaaagaaggagaagaagaagaaaaaaaagcgcaagcacaagtcatcaaagagtaacgagggaagtgacagtgaatag

SEQ ID NO: 238455 - DNA, 2262 bp, Artificial Sequence
  Description of Artificial Sequence: Synthetic coding sequence
atgcgggagcctgaagagctcatgccagactctggcgcagttttcacatttggaaagtcaaagttcgcagaaaacaaccctggtaaattttggtttaagaatgacgtgcccgtgcatctgagctgtggggacgaacattcggccgtcgtcacaggtaataacaagttatatatgttcggttccaataattgggggcagttggggctgggaagcaagtccgccatctctaagcccacgtgcgtgaaagcattaaagcctgaaaaggtgaagcttgccgcttgtggccgaaaccatacgctggtgtctacggagggaggcaacgtctatgcaacaggagggaataacgagggccagttaggactgggggataccgaggagagaaatacatttcatgtcataagtttttttacaagtgaacacaagatcaagcagctcagtgctggttccaacacttcagctgcccttactgaggatggaaggttattcatgtggggagacaactcggaggggcagataggtctcaagaacgtgtcaaacgtgtgtgttccccagcaggtgaccatcggcaagcctgtgtcttggatctcatgcggctattaccacagcgcattcgttacgacagacggcgaactttacgtttttggcgagccagagaacggcaagcttggattgccaaatcagctgctcgggaaccaccggacgccccagctggtgtcggagatccctgaaaaagtcattcaagtggcatgcggtggcgaacacaccgtggtactgaccgaaaatgcagtctacaccttcggcttgggacagtttggccagctgggcctgggcactttccttttcgaaacgtccgaaccaaaagtgatcgaaaacatacgggaccagaccatctcttatatttcatgcggtgaaaatcatacagccctgataaccgacataggattgatgtatacattcggcgacggcaggcatgggaaactgggcctggggctggagaatttcaccaaccatttcatccccaccctatgctctaattttctgcggtttatcgtgaagctggagagaagccccgacagcttctctatgaggcgtacgttaccgccaatcgaaggtaccctgggtttgagtgcatgctttttgcccaattctgtcttcccacgttgttccgagaggaatcttcaagagtctgtcttgtcagaacaggatctgatgcagcccgaagagcccgactacctcttggacgagatgactaaagaggccgagattgacaatagttctactgtggagtctctaggagaaaccaccgacatcctgaacatgacccacataatgagtcttaacagcaacgaaaagtctttgaagcttagccccgtacaaaaacagaaaaaacaacagacaattggtgaactcacgcaggacacagccctcaccgagaatgacgattccgatgagtacgaggagatgtcagaaatgaaggaaggaaaggcctgtaaacagcacgtaagtcagggcatcttcatgactcagcccgcaaccactattgaagcattcagtgacgaggaggtcgagattcccgaggagaaagagggagcagaggactcaaaggggaacgggattgaagaacaggaggtggaagccaacgaagaaaatgtgaaagtgcatggaggccgtaaggaaaaaacggaaattttatccgatgacctcactgataaggcagaagatcacgaattcagcaaaacggaagagctcaaactcgaggacgtggacgaggagatcaatgccgagaatgtggaatcaaagaagaagactgtaggagacgacgaaagcgtccctaccggctaccattcaaagaccgaaggcgctgagcggaccaacgacgactccagcgcggagacgatcgaaaagaaggagaaagccaatctggaggagcgagcaatctgcgaatataacgaaaaccccaaggggtacatgctcgatgacgcagattcctcctccctcgagattctggagaacagcgagaccacacctagtaaggatatgaaaaaaaccaagaaaatcttcctgtttaagagagtcccatcaatcaaccagaaaatcgtcaaaaacaataacgaaccactgccagaaattaagagtatcggcgatcagatcatcctgaagtccgacaataaggacgcagatcaaaaccatatgagtcagaaccaccagaacattcctccgacaaacacagaaagaaggtcaaagtcctgtacgattctgtag

SEQ ID NO: 238456 - DNA, 2448 bp, Artificial Sequence
  Description of Artificial Sequence: Synthetic coding sequence
atgagggaaccagaggaattgatgcctgattctggcgcagtgttcactttcggcaaatctaagttcgctgagaacaatcccggaaagttctggtttaaaaacgacgtccccgtgcacctgagctgcggcgacgaacactcggcggttgtcacagggaataacaaactctatatgtttggaagtaataattggggccagctggggctgggctccaagtccgccatttccaagccaacctgcgtgaaagctctcaagccagaaaaagtgaagttggccgcttgtggcaggaatcatacgctggtgtccaccgaaggcggtaacgtgtacgcgacaggcggaaataatgagggccagctggggcttggggatacagaggagcggaatacctttcacgttatcagcttttttacctctgagcataagatcaagcagcttagcgccggttccaacacttcggccgctctgaccgaggatggcaggcttttcatgtggggggacaatagtgaagggcagattgggctgaaaaatgtgtcaaatgtatgcgtgccacagcaggtgactatagggaaaccagtctcctggatctcctgtggctactaccatagtgcattcgtcacaaccgacggtgagctatacgtttttggagaacccgagaatgggaagttgggacttcctaaccagcttttgggcaaccaccgtacccctcagctggtgtccgaaattcctgagaaagtgatacaggtcgcctgtggaggtgaacatactgtggtactgactgaaaatgcagtatacaccttcggtctcggacagttcggccagcttgggctcggcaccttcctgtttgaaacaagcgaacccaaggttatcgagaacattcgggaccagaccataagctatatatcttgtggggagaaccatacagcactaattacagacatcggcctgatgtatacttttggcgatggaaggcacggcaagctggggctcggcctggagaactttacaaaccacttcattcccaccctatgttctaatttcttgcgttttatcgtcaagttagtggcctgcggtgggtgtcatatggttgtgttcgcggctccccatcgaggtgtggccaaagagattgagtttgatgagatcaacgacacctgcttgtcagttgcgacatttctcccttactcctcactgacttcaggcaacgtactccagcgaactctgtctgctcggatgcggaggagagagcgggagcgatccccagattctttcagcatgcgcagaaccctaccccctattgagggtacactgggactgagtgcgtgttttttgcctaatagcgttttcccacgctgctccgaacgcaacctccaagaaagcgtactgagtgagcaggacctcatgcagcccgaagaaccagattacttgttggatgagatgacaaaggaggccgagatagataacagctcaactgtggagtccttgggggagacgacagatatcctgaatatgacgcacattatgtccctgaattcgaatgaaaagtcgctgaaactctcacctgtgcaaaagcaaaaaaaacaacagactatcggggagctcactcaagacacagccctgactgaaaacgatgatagtgatgagtatgaggaaatgtctgagatgaaagagggcaaagcctgcaaacagcacgtgtcacagggtatctttatgacccagcctgccaccaccattgaggccttctccgatgaagaagtggagattcccgaagagaaagaaggcgctgaggattctaagggcaacggtatcgaggagcaagaggtagaggccaatgaggaaaacgttaaggtgcacggcggaaggaaagagaagactgagattctgagtgacgacctcaccgataaagcggaggaccacgagtttagcaagactgaggagcttaaactggaggacgttgacgaagagattaacgcagaaaacgttgaatctaagaagaagaccgtcggtgatgacgagtcggtgcctactggataccattccaaaactgaaggggctgaacggactaacgatgactcgagtgcagagacgatcgagaagaaggaaaaagcaaacttagaggaacgcgctatctgtgaatacaacgagaacccaaagggctatatgctggatgatgcagattcttcctcgcttgagatccttgagaactccgagaccacgcccagtaaggacatgaaaaaaacaaaaaaaatctttttgtttaaacgggttccgagcatcaatcaaaagatcgttaagaacaataatgagcctttaccagaaattaagtcaatcggcgaccagatcattcttaagagcgataataaggatgcggaccagaaccacatgtcccagaatcaccagaacatcccccctactaacaccgagcgcagaagcaaatcttgtacaattctgtag

SEQ ID NO: 238457 - DNA, 1443 bp, Artificial Sequence
  Description of Artificial Sequence: Synthetic coding sequence
atgcgtgaacccgaggagctcatgcctgattcaggcgctgttttcacctttgggaaaagtaagttcgcagagaataatcccggtaagttctggttcaagaacgacgttcccgtgcacctcagctgtggcgacgagcattcggccgtggtcacgggaaataacaaactttacatgttcggatctaataactgggggcagctcggactgggatcaaagtcagcaatctctaaacccacctgcgtcaaagcgcttaaaccggagaaggtgaagctggctgcctgcgggaggaaccacaccctcgtatctacggaggggggtaatgtgtatgctactgggggtaataatgagggccagctggggctgggagataccgaggaaagaaataccttccacgtgatttcctttttcactagcgagcacaaaatcaagcagctgtctgctggctccaacacgtctgcagcattgaccgaggatgggaggctattcatgtggggggacaactcagagggacaaatcgggctgaagaacgtgagcaatgtgtgtgtccctcagcaggtgacaattgggaagccggtgtcctggatctcctgtggctactaccattctgcttttgtgacaacagacggggagctctatgtctttggggagcctgaaaacgggaaactgggactgccaaaccagctattaggcaaccacagaactccgcagttagtcagcgagatcccagagaaagtgatccaggtagcttgcggtggtgaacatacagtggtgcttaccgagaatgcagtgtacacattcggactgggacagttcggccaactggggttggggactttcctattcgaaactagtgagcctaaagtcatagagaacatcagagaccagactatttcttatattagctgtggtgaaaaccacactgctctcatcaccgacatcggcttgatgtacacgttcggcgatggtcgccacggcaaactgggtctcggtcttgagaattttaccaaccacttcatcccaacactttgttctaattttttgcggtttatagtgaagctggtggcttgcggaggttgccacatggtggttttcgcggctccacaccgaggggttgctaaagaaatcgagttcgatgagattaacgacacgtgcctttctgtagctaccttcttgccctactccagcctgacatctggaaacgtgctgcagcgcaccctcagcgcacggatgagaagacgtgagagggaaagatcccctgactcattctccatgcgccgaacacttccgcctatcgagggaactctgggcctgagtgcctgctttctccccaactcggttttcccaaggtgttctgagcgaaacctccaagaaagtgtgttaagtgagcaagatcttatgcaacctgaagaacctgacacgcaccatgagccggaatttcagtag

SEQ ID NO: 238458 - DNA, 3063 bp, Artificial Sequence
  Description of Artificial Sequence: Synthetic coding sequence
atgcgagaacccgaagagctgatgcctgattcaggcgcagtgtttacatttggcaaaagtaagttcgctgagaacaacccgggaaaattttggttcaaaaacgatgtgccagtacatctgtcttgtggtgacgaacattcagcggtggttacaggcaataataagctatacatgttcgggagtaacaattggggacagcttggattaggatcaaaatccgctattagtaaaccaacatgcgtgaaagctctgaagcctgaaaaagtaaagcttgcagcctgtggcaggaaccatacgctcgtaagtactgaaggcggaaacgtctatgccaccgggggtaacaacgaagggcagctcggtctgggcgatactgaggagcgaaatacctttcacgtcattagttttttcacatccgagcataagataaaacagctctctgcgggatccaacacctcagctgcactaaccgaggatggccgactgtttatgtggggtgataatagcgaaggtcagattggcctgaagaacgtcagtaacgtatgcgtgcctcaacaggtgactatcggcaaaccagtgtcatggatatcctgcgggtactaccattctgctttcgtgacaaccgatggcgagctctacgtctttggcgagccggagaatgggaagttggggcttccaaatcagctcctgggtaatcaccgaactcctcagctggtgagtgagattcctgagaaggtgatccaggtggcttgcggtggggaacacacagtcgttcttactgagaacgccgtctacaccttcgggctgggtcaatttggacagctaggccttggaacatttctcttcgaaacgtcagaaccaaaagtcatagagaatattagagatcagaccatcagttacatctcttgcggggagaaccatactgctctgattacagacattgggctaatgtataccttcggcgacggacggcacggtaagcttggactgggccttgaaaactttaccaatcatttcatccccactctctgctctaattttttgcggtttatagtgaaactggtggcctgtggaggctgtcacatggttgtgttcgcagccccacataggggcgtggcaaaagaaattgagtttgatgagatcaatgatacatgcctgtctgtggccacgttcctcccatatagttccctgacatcaggaaatgttttgcaacgcacgctttcagcccgaatgaggaggcgggagcgggagaggtcccctgacagtttctcaatgcgcagaacattgccaccaatagaaggtaccctgggtctgtctgcttgctttctgcctaatagtgtttttccaagatgctctgaacggaatctgcaggagagcgtccttagcgaacaggacctcatgcagcccgaggagccagactacctccttgacgagatgaccaaggaggccgaaatcgataattctagcacggtggaatcactgggtgaaactactgatatcctgaatatgacgcatattatgtccttgaactctaatgagaaatctctcaagcttagccctgttcagaaacagaagaagcaacaaactatcggggaacttacgcaagatacagccctgaccgaaaatgatgacagtgatgagtatgaagagatgtccgaaatgaaagagggaaaagcgtgcaagcagcacgtgtcccagggaatttttatgacacagcccgcaacaacaatcgaggcattttctgacgaagaagttgggaacgatacaggacaggttggccctcaggctgatacggacggagaaggcctgcagaaagaggtgtatagacacgagaacaataatggggtggatcaacttgacgcgaaggagattgaaaaagagtccgacggcggacatagccagaaggaaagcgaggccgaagagattgacagtgagaaagagaccaagctggctgagattgcaggcatgaaagatctgcgggagcgggaaaaatcgacaaaaaagatgtctccattcttcggaaatctgcccgaccggggaatgaacaccgagagcgaggaaaacaaagacttcgtgaagaagagagagagttgcaagcaggatgtgattttcgactcagaacgagagagcgttgagaaaccagacagctacatggaaggtgcatcggagtctcagcagggtattgcagatggattccagcagccagaggcgattgagttttcatccggcgaaaaggaagatgatgaggtggaaacagaccaaaacatccggtatggtcgtaaactaattgagcaggggaacgagaaggagacaaagccaattatctctaaatcaatggccaaatacgattttaaatgtgacagacttagtgagatacccgaggagaaggagggagccgaggactctaaaggcaacggtatcgaagagcaggaagtggaggccaatgaggaaaacgtcaaagtccatggcggaagaaaagagaaaactgagattcttagtgatgatctgacagacaaagcggaggatcacgagttttctaaaacagaagagctcaagcttgaggatgtggacgaggaaataaatgctgagaatgtggagtccaagaagaagacagtgggggacgacgaaagtgttcctaccgggtatcattctaagaccgagggagctgagagaacaaatgatgacagttccgcagagaccatcgaaaagaaagagaaagctaacctcgaagagcgcgcaatttgtgaatataacgaaaatccgaagggatacatgcttgatgacgccgatagcagttctctcgaaatccttgagaattcagagaccacaccgtccaaagatatgaagaagaccaaaaaaatattccttttcaaaagggtcccctccattaaccaaaagattgttaagaataacaacgagcccttgcccgaaattaagagcattggggatcagataattctgaagtccgacaacaaagacgccgatcagaatcacatgagtcagaaccatcagaacatcccgccaactaacacagagcgtcgctctaagagctgcacaatattgtag

SEQ ID NO: 238459 - DNA, 1941 bp, Artificial Sequence
  Description of Artificial Sequence: Synthetic coding sequence
atgcgggaacccgaagaactgatgccggactcaggcgcagtgttcacattcgggaagtccaaatttgccgagaataatcctgggaagttctggttcaagaacgacgttcctgtgcacttgagttgtggggatgagcactccgcggttgttaccggcaataataagctgtacatgtttggaagcaataattggggtcagttaggactcgggagtaagtccgccatttctaaaccgacatgtgtaaaggccctcaaaccagagaaagtgaaactcgccgcttgcgggaggaatcatactttggtgtccacggaagggggtaatgtgtacgccaccggaggaaacaacgaaggacagctgggccttggggataccgaggagcgaaacacttttcacgtaatctcttttttcacgtccgaacataaaattaaacagctcagcgccggatcaaatacgtccgcggcactgactgaggacggcaggctgttcatgtggggcgacaactccgagggacagattgggttgaaaaacgtatccaacgtgtgtgtgccacagcaggtgaccatcggaaagccagtttcttggatttcttgcggctactaccattccgcatttgtgaccaccgatggggagctctatgtcttcggcgagccagagaatggtaaattgggtctgccaaatcagcttctgggaaaccacagaactcctcaattggtgtctgaaatcccagaaaaagtgatccaggtggcttgcggcggtgagcatactgttgtccttactgagaacgcagtctatactttcgggctggggcagttcggccagctgggcctgggtaccttcctgtttgaaacatctgaaccgaaagtaatagagaatattagggaccagaccatttcctatatctcatgtggcgagaatcacaccgccctcataacagatattggattgatgtataccttcggggacggcaggcacggaaaattggggttgggtctggagaatttcaccaaccacttcattccaacactgtgctcaaacttcttgcgcttcatcgtcaagctggttgcatgtggcggatgccatatggtcgtgtttgccgctcctcatcgcggtgtggcaaaagagatcgaattcgacgagatcaacgacacttgcctgtcagtcgctacattcctgccgtactcaagccttacctccgggaatgtgctacagcgtactttgtccgcaagaatgcggcgacgcgagcgggaacggagccctgatagtttttctatgaggcggaccctgcctcccattgagggaaccttgggcttatctgcatgttttctccctaactcagtatttcctaggtgtagcgaacggaatctgcaggagtccgtgctctcagaacaggacttgatgcagcccgaagagcctgattacctgctcgacgagatgacaaaggaggctgagattgacaactctagtacggttgagtccctcggcgaaactactgatattctgaacatgacgcacatcatgtccctgaacagtaacgagaagtccttgaagctcagcccagtgcagaagcagaaaaagcaacagacaattggggaactgacacaggacacggcactaactgagaacgacgattcagacgagtacgaagagatgagcgaaatgaaggaaggtaaagcatgtaagcaacatgtttcccagggcattttcatgactcagcccgcaaccaccattgaagcctttagcgacgaggaggtcgagattcctgaggagaaagaaggcgctgaggatagcaagggtaatggaatcgaggagcaggaagtggaggccaatgaagagaatgtaaaggtgcacggagggaggaaagagaagacggagatcctctcagacgatctgactgataaggccgaatactccgccagtcatagccagattgtatccgtatag

SEQ ID NO: 238460 - DNA, 3459 bp, Artificial Sequence
  Description of Artificial Sequence: Synthetic coding sequence
atgagagaacctgaggagttgatgccagatagcggtgcagtattcaccttcggcaaaagtaagtttgctgagaacaaccccggaaaattctggtttaaaaatgacgtacctgtccatctgtcttgcggtgatgagcatagcgccgtggtgacaggcaataataaactgtacatgttcgggtcgaacaactgggggcagttgggccttggatctaagagcgctataagtaagccaacttgtgtcaaggccctcaaacccgagaaagtgaagttggcagcttgcggccgtaatcacacacttgtatccacggagggtggaaacgtgtatgcgacggggggtaacaatgaggggcagctcgggctgggagatacggaggagcgcaacacgtttcacgtgatcagctttttcacctcagagcacaagattaaacagctgagcgcaggctctaatacatctgctgcactgacagaggatggcaggctgttcatgtggggggacaactccgaaggccaaattggcttgaagaacgtctctaatgtatgcgtcccccaacaggtgacaattggtaagccggtctcatggatatcttgcggctattatcatagtgcgtttgtgacgacagacggcgaactgtatgtgtttggggagcctgagaatggcaaactcggactgccaaatcagttgctcgggaatcacagaacaccccagctagtgagcgagattccagaaaaggtgatccaggtggcctgtgggggagaacacactgtggtcttgaccgaaaacgcagtctacacctttgggcttggccagttcggccagctgggtttggggacctttttattcgaaacatcggagcctaaggtaattgagaatattcgggaccagaccatcagctatatcagctgcggggagaatcacactgcactgataaccgatatcggtcttatgtacacttttggcgatgggagacacggcaaactggggttaggtctagagaacttcacaaaccatttcatccccactctgtgctctaacttcctacgtttcatagtcaaacttgtagcatgcggcggttgccatatggtcgtcttcgccgctccgcacagaggtgtggcaaaggagattgagtttgatgagatcaatgacacttgtctgtcagtggcaacatttctgccctattcctctctgacttctggcaacgtgttgcaaagaacgctttccgcacggatgcggaggcgggaaagggaacgctcccctgattcttttagtatgagaaggacactgcctcccattgaaggcacactaggcctttccgcttgcttcctgcctaactccgtgttccctcgctgttccgagcgcaacctacaggaatcagttctgagcgagcaggatctgatgcagcccgaagaaccagattatcttttagacgagatgaccaaggaggccgaaattgacaattcctctaccgtggaatctctcggtgagacgacagatattctgaacatgactcacatcatgtctctcaactccaatgaaaaatcacttaagttgagcccggttcagaagcaaaagaagcagcaaacaatcggcgaactgacccaagatacagctcttactgagaacgatgacagcgatgagtatgaagagatgtccgaaatgaaggaaggaaaagcctgtaagcaacacgtaagccagggaatcttcatgactcagcccgctaccaccatcgaggcatttagcgatgaggaggtcgagattcccgaggaaaaggagggggctgaggatagtaaggggaatggaatagaagagcaagaggtagaggcgaatgaagaaaatgtgaaagtgcatggcggacgtaaggagaagaccgagattctgagcgatgatctgacagacaaagccgaggtgtccgagggcaaggctaagagtgtcggagaggctgaggacggccctgagggacgtggcgatggaacctgtgaggaaggaagcagtggggcagagcactggcaggacgaggagcgcgagaagggtgagaaggacaagggcaggggcgagatggaacgcccaggggagggcgagaaggaacttgcagagaaagaggagtggaagaagcgagacggcgaggaacaggagcagaaagagagagagcagggacaccagaaggaaaggaaccaagagatggaggaaggaggtgaggaggagcatggggagggcgaagaggaagaaggagatcgcgaagaggaggaggagaaagaaggcgagggcaaggaggaaggagagggcgaagaggtggaaggcgaacgagagaaggaagaaggcgagcggaagaaagaggagagggcaggcaaagaagaaaagggcgaggaagagggagatcagggggagggcgaagaagaagagactgaggggagaggggaagagaaagaggagggaggcgaggttgaaggaggagaggttgaggagggaaaaggcgaaagagaggaagaagaggaggagggcgagggcgaagaagaagagggggaaggggaagaggaagaaggagagggcgaagaagaggagggcgagggtaaaggcgaagaggagggagaagagggggaaggggaagaggagggagaagaaggagaaggtgagggtgaggaggaagagggcgagggagagggagaggaggaaggcgagggggagggtgaggaagaagagggggaaggcgagggggaagaagaaggggagggagaaggtgaagaggaggaaggcgaagggaagggtgaagaagaaggcgaagaaggcgaaggagagggagaggaagaagagggggagggtgagggagaggacggggagggggagggcgaggaggaagagggggagtgggaaggcgaggaggaagagggggaaggggaaggcgaggaggagggggagggggaaggagaagagggcgagggggagggcgaagaggaggagggagagggtgagggagaggaagaggagggggaggaggagggcgaggaggaaggggaaggcgaggaagaaggtgagggcgaaggcgaagaggaagaggaaggggaagtagaaggcgaggttgaaggggaggagggcgagggtgaaggagaggaggaagaaggggaagaagagggtgaggagagggaaaaggaaggggagggcgaggagaataggcggaaccgagaagaagaagaggaggaagagggaaagtaccaggaaactggagaagaagagaatgaaaggcaggatggggaagagtacaagaaagtttctaaaataaaaggcagtgtgaaatatggaaaacataagacttaccagaaaaagtctgtgaccaatacccaaggcaacggtaaggaacagcgctccaaaatgcccgtgcagagtaaacgcctattgaagaacggaccatccggttccaaaaagttttggaataatgtactgccccattacctcgaacttaaatag

SEQ ID NO: 238461 - DNA, 2121 bp, Artificial Sequence
  Description of Artificial Sequence: Synthetic coding sequence
atgaacgagtccaagcctggcgattctcagaacttagcgtgtgtgttctgccgcaagcatgacgactgtcctaacaagtatggggaaaagaaaacaaaagagaagtggaacttgactgtgcattattattgcctgttgatgagcagtgggatctggcaacgcggaaaggaggaggagggcgtgtatggttttctcattgaagatattcggaaggaagttaacagagcttccaagctcaaatgctgtgtgtgcaaaaagaatggagcctccatcggatgcgttgcgccaaggtgcaaaagaagttaccattttccttgcggcctacaacgcgagtgcatcttccagttcaccggcaatttcgcttccttttgctgggatcatcggccagtgcagataatcacgtctaacaactatcgagaatccttgccgtgcactatctgcctagagtttattgaacccatacccagctacaacatcctgaggtctccctgctgcaagaacgcctggtttcatcgggactgtctgcaggttcaagcaattaacgctggtgttttcttcttccggtgtaccatatgtaacaattcggacatctttcagaaggaaatgctgaggatggggatccatattcccgaaaaagacgcctcttgggaactggaagagaatgcctatcaagagctcctacagcactatgagcgatgtgatgttcgtaggtgccgctgcaaggaggggagagactacaatgcacccgatagcaaatgggaaattaagagatgtcagtgttgtggctcatcgggcacacatcttgcgtgtagttccctgagatcctgggagcagaactgggaatgcctcgagtgccgtggtatcatttacaatagtggagagtttcagaaggccaaaaagcatgtgctgcccaatagcaataacgttggtatcaccgattgcctcctggaggagtccagtcctaagctgccaaggcagagtcctggtagtcagtcaaaagatctgcttaggcaaggctcaaaattccgcagaaacgtcagtaccctgcttatagagcttgggttccagataaagaaaaaaacaaaacggctctatatcaataaagccaatatttggaactctgccctcgacgcttttagaaacaggaattttaatccctcctacgcaatcgaggtggcctatgtcatcgagaatgacaatttcgggtccgaacaccctggcagcaagcaggaattcctttccctgttgatgcagcaccttgagaattccagccttttcgagggatccttgagcaaaaatctgtccctgaactcccaggcactgaaggaaaacttgtactatgaagcaggaaagatgctcgcgatatccctggtgcacggcggacctagccctggcttctttagcaaaacccttttcaactgcctggtgtatggcccagagaatacccagcccatcttggatgatgtctctgatttcgatgtcgctcagatcattatccgaattaataccgcgaccaccgtggcagacctgaaaagtatcataaatgagtgttacaattacctggagctcatcggatgcctcaggctgattacaactctttccgataaatacatgcttgtaaaggatattctgggataccacgttatccagcgcgttcatacaccatttgagagttttaaacagggtttaaaaacactcggcgtgctagaaaagatccaggcctatcccgaggctttctgctctatcctttgccataaacctgaatctttgtccgctaagattctttccgaactgtttaccgtacacacacttcccgacgtgaaagctttaggattttggaacagctatctgcaggccgtggaagatggcaagtccactacaaccatggaagacatcctgatcttcgccacaggctgcagtagcattcccccagccggattcaaacccacaccctctatcgagtgcctgcatgtggatttccccgtgggcaacaaatgtaacaactgcctggcaatccctattacaaacacctataaggaattccaggagaacatggatttcactataagaaacacactgaggctcgagaaagaggaaagcagtcattatatcggccattag

SEQ ID NO: 238462 - DNA, 1938 bp, Artificial Sequence
  Description of Artificial Sequence: Synthetic coding sequence
atgctgttgatggcccctgacaggtgtagatacgtgtggaaacactgccaacctatggaaatgcggatcaaatggatatttctgtgctgcatccgccctctgtacgatttcaccagccagtacgttatggagactgattccctgttcttgcattacctgcaagaagccagcgcacgtctggacatccatcaggccatggccagtgaacatagcaccctcgctgcaggttggatatgctttgaccgcgtgctggagaccgtcgaaaaagtccacggcctggcaaccctcattggggctgggggagaagagtttggagtattggagtactggatgcgcctccgttttcccattaagcccagtctacaggcttgcaataaacggaaaaaagctcaagtctacctgtccactgacgttcttggcggacgcaaagctcaggaagaggagttcaggagtgagtcctgggagccccagaacgagctgtggatcgaaatcaccaagtgttgcggcctccgatcacgctggctgggtacccagccctcgccttatgccgtttaccgcttctttaccttttcggatcacgataccgcgattatccccgcaagcaataacccatactttcgcgatcaggcccgattcccagtcctggtgacgtccgacttggaccactatctgcgacgggaagccctgtccatccatgtttttgacgatgaggacctggagccagggtcgtatctgggaagagcaagagtaccgctcctgccgttagcaaagaacgagagtatcaagggcgactttaacctcaccgatccggctgagaagcctaatgggtccattcaggtgcaacttgattggaaatttccctacattccaccagagtcctttctgaagccagaagcccaaaccaaaggaaaggataccaaggatagctccaaaattagttccgaagaggaaaaggcatccttcccttcccaggatcaaatggcttctccagaagttccaattgaggcgggacagtaccgtagcaagaggaagccccctcatggaggcgaaagaaaagagaaggagcatcaggtggtgtcctactcccggcgtaagcacggcaagcgcattggcgtgcaaggaaaaaaccgaatggagtatctctcactgaacattctgaatggcaatacaccagagcaggttaattacacagaatggaagttttccgaaaccaacagctttattggcgacggcttcaaaaaccagcacgaagaagaggagatgaccctgtcccattcagcgttgaagcagaaggagccattacatcccgtcaatgacaaagagagttcagagcaggggagtgaagtgagcgaggctcagaccaccgactccgacgatgtcatcgtcccacctatgtctcagaaataccccaaagcggatagcgaaaagatgtgcattgagattgtatccctggcattttacccagaagctgaggttatgagcgacgaaaacattaagcaagtgtatgttgagtacaagttctacgatctcccgttgtcagaaacagagacccccgtaagtttgcgtaagccacgggctggcgaagagatccatttccacttttccaaggttattgacctcgaccctcaggaacagcaggggcgaaggcgtttcctttttgatatgcttaacggacaggaccccgaccagggccatttgaaattcaccgtcgtgtctgatcctctggatgaggagaagaaagagtgcgaagaggtaggttacgcttacctgcagctgtggcagattctggaaagtgggcgagacattcttgagcaagaacttgatatcgtcagcccagaggatctggcgacacccattggtcgtctgaaggtctccctacaggccgctgctgtcttgcacgcaatttacaaagaaatgaccgaggacctgtttagctag

SEQ ID NO: 238463 - DNA, 1839 bp, Artificial Sequence
  Description of Artificial Sequence: Synthetic coding sequence
atgttgaagctcgacaacaaagatgttattagtcacccactgggatatcctagcgagtcattgttgtcaatcgccagcatgttagactcttccgattcaagttctcagccacactggagtaacgaactcattgcagagcagctgcagcagcaggtgagtcagcttcaggaccagctggatgctgaactggaggataaaaggaaagtcctgcttgagctgtcccgggagaaggctcagaatgaggacctgaaattggaggtgacaaacattttacagaaacacaaacaggaggtggagctcctacagaatgctgcgaccattagccagccccctgaccgtcaatctgagcccgctactcaccctgccgtgttgcaggaaaacacacagatcgagccctctgaaccaaagaatcaggaggaaaagaagctcagccaagtcctgaacgagctccaagtttcccatgccgaaaccacattggagctcgaaaagacaagggacatgctaatactgcagcgtaaaatcaatgtttgttaccaagaggagcttgaggcaatgatgactaaagccgacaatgataatcgcgatcataaagagaagttggaaagattgactcgattactggacttgaaaaacaacagaattaaacaactcgaagggatcctccgttctcacgacttgcccacatccggagatttcaacctgactgatccagccgagaagcctaatggatctattcaggttcagctggattggaagtttccctacatcccacccgaaagtttcttgaagccagaggcgcagactaaaggcaaagatactaaggacagcagtaagatctcctctgaggaggagaaggctagcttcccctcccaggaccaaatggcgtcccccgaagtacccatcgaggcagggcagtacaggtctaagcgcaaacccccacatggcggtgaacgaaaggaaaaagagcatcaggttgtttcatattcgcgccgtaagcacggcaagcggattggggtacagggaaaaaataggatggaatacctgagcctgaatatccttaatggcaacaccccagagcaggtaaactacacagagtggaaattcagtgagacgaattcattcattggagacgggtttaagaaccagcacgaggaagaagagatgaccctttcgcattcggcacttaaacagaaggagccccttcaccccgttaacgacaaagaatcatctgagcagggcagcgaggtgtcggaggcccagaccacagattctgacgacgtaatagtaccaccaatgtcgcagaagtacccgaaggctgatagcgagaagatgtgcatagaaatagtgtccctggcattttacccagaggcagaagtgatgtcagacgagaacataaagcaagtttacgtggaatataaattctacgacctacccctgtctgaaaccgagacccccgtctccctgaggaagccgagggcaggcgaagaaattcatttccacttttctaaggtgatcgacctcgacccccaggagcaacagggaaggaggcggttcctgtttgatatgctaaatggtcaggatcccgaccagggccacctgaagttcacagtggtatccgatccgctggatgaagagaagaaggagtgcgaggaggtgggctacgcatatctgcagctgtggcagatccttgaaagcggccgtgacatcctggaacaagagctggacatcgtgtctcctgaagacctggcaacacccatcgggcgtctgaaagtctcactccaggctgccgcagtgctacacgccatatacaaagaaatgactgaggatcttttcagctag

SEQ ID NO: 238464 - DNA, 3861 bp, Artificial Sequence
  Description of Artificial Sequence: Synthetic coding sequence
atgtcacacctggtggatcctacaagtggcgacctgcccgtgagagatatcgatgccattccgctcgttctccctgcttcaaagggcaagaacatgaaaacgcaacccccattatctagaatgaatagggaggaactggaggatagcttttttcgcctgagagaggatcacatgctagtaaaagagctgtcctggaagcagcaggacgaaattaagcgactcaggactactttgttgcgactaactgccgctgggcgtgatctgcgggtcgctgaggaagcggcaccgctgtccgagaccgctcgacgcggacagaaggcagggtggcggcagagactttccatgcatcagcggccacagatgcatagacttcaaggacactttcactgcgtaggaccagcgtcaccccgaagagctcagcctcgagttcaggtcgggcatcgccagctgcacactgctggagccccagtgcccgagaagccaaagcgcggacctagggataggttatcctacactgccccacccagcttcaaggagcacgctacaaacgagaatagaggtgaggtggcttcaaaaccctcagaactcgtgagtgggtcaaattctatcatttccttctcttcagtcataagtatggctaagcccatcggactgtgcatgcccaatagcgctcatatcatggcctctaacactatgcaagttgaagagcctcctaagtccccagaaaagatgtggcctaaagatgagaacttcgagcaaagatcgagtctggagtgcgcccaaaaggctgcagaattaagggctagcataaaggagaaagtggaactcatcaggctgaagaaactcctgcatgagagaaatgcctccctcgtgatgacaaaggcccaactcacagaggtccaggaggcctacgagacgttgttgcagaaaaaccagggcatcctctctgcggctcatgaagctcttcttaaacaggtgaacgagctccgagccgaactcaaggaggaatctaagaaagcagttagcctaaaatcccagctcgaagatgtttctatcctgcaaatgactctcaaggagttccaggagcgagttgaagatctcgagaaagagcgcaaattgcttaacgataattacgataaactcctggagtcaatgctcgatagtagtgacagcagttctcagcctcattggagcaacgaattgatagctgaacagttgcagcagcaagttagtcaattacaggatcagttggatgcagaactggaggacaagaggaaggtgttgctcgaactgtctcgggagaaagcccagaacgaagatttaaagctggaagtgactaacatcctccaaaagcacaagcaggaagtggaactcttgcagaacgcagcaacaatctcccagccgcctgacagacagtccgagccagctacccatcccgctgttctccaagagaacacccagatcgaaccttcagaaccaaaaaaccaggaggagaagaaactctcccaggtgctgaatgagctgcaggtaagtcatgcagaaactaccttagagctggagaagaccagggatatgctcatcctccagagaaaaattaatgtatgctaccaagaagagctggaggctatgatgaccaaagcggacaacgacaatcgggatcacaaggaaaaacttgaaagacttactcgcctcctggacctgaagaataaccggatcaagcagctagagggcatcttgagatcgcacgatttacccactagcgagcagctcaaggacgtagcgtatggtacacgcccactgagtctgtgcttggagactctgcctgcccatggcgatgaggataaagtggatatttctctgctgcatcaaggcgaaaatctgtttgaactgcatatccaccaggcgtttcttacatccgctgccctggcccaggccggtgatacacagcccacaaccttttgcacgtacagtttttatgacttcgagacgcactgtactccattgagcgtaggtccgcagccgctctacgatttcacgtcccaatatgtgatggagacagattccctctttcttcactatttgcaggaggcctccgctcgactggacatccaccaggctatggcatcagagcatagcaccttggctgccggatggatttgcttcgatcgcgttctggagaccgttgagaaagtacacggactggcgactctcatcggggctggtggggaggagttcggtgtgcttgagtattggatgaggttacgattccctataaagccatctcttcaagcatgcaataagagaaaaaaagcacaggtgtacttaagtaccgatgttctgggaggtaggaaggcccaggaggaagagttccgtagcgagtcttgggaaccccaaaatgagctttggatcgaaatcactaagtgttgcggcctgaggtctcgttggctggggactcagcctagcccgtatgcagtgtaccgttttttcactttctccgatcacgatactgcaatcattcccgcatctaacaatccttattttcgggaccaggctcgattccccgttctggtcacatcagacttagatcactacttgaggcgggaggccttgagcatccacgtgtttgacgacgaggatctcgaacccggttcctacttagggagggccagggttccccttttacctttagccaaaaacgaatcaataaaaggggactttaatctgaccgatcccgctgagaagccaaatggaagtattcaggtgcagctagactggaaatttccctacattcctcccgagagcttcctcaagccggaggcgcaaacaaagggaaaggacaccaaggatagttcgaagattagctctgaagaagagaaagcaagttttcccagccaggatcagatggcatctcccgaggtcccaattgaagccggtcagtacaggtctaagcggaagccaccccacgggggagaaaggaaggagaaagagcaccaggtggtttcgtactcccggcgtaagcacggtaagcggatcggagttcagggcaaaaacaggatggagtacttgtcgctgaatatattgaatggaaacacgccagagcaggtaaactataccgagtggaagttctcagaaacaaactccttcattggtgacgggttcaaaaatcagcacgaggaagaggagatgactctcagccactcagcactaaagcagaaggaacccctgcacccagtgaacgataaggaatctagtgagcaaggcagtgaggtgtccgaggctcagacgacagattctgatgacgtgattgtaccaccgatgagccagaagtaccccaaagcggattcggagaaaatgtgcattgagatcgtctccctggcgttttatcccgaagcagaggttatgagcgatgagaatatcaagcaagtgtacgtggagtataaattctacgacctgcctctcagtgagacggagacacctgtctcgctgcggaaacctagagccggtgaagaaattcacttccactttagcaaagtaatcgatcttgacccgcaggagcagcagggtaggcgccgttttctttttgacatgctcaacggccaagaccccgaccaaggccatctgaagttcaccgtggtaagcgatccgctggatgaggagaaaaaagagtgcgaggaagttggctacgcttacttgcagctgtggcaaattctggagagcggtcgggacatactggagcaagaactcgacattgtgtcccctgaggacctggcaactcctatcggacggcttaaggtgtccctccaggcagccgctgtgctacatgctatatacaaagagatgacggaagatttgtttagttag

SEQ ID NO: 238465 - DNA, 1617 bp, Artificial Sequence
  Description of Artificial Sequence: Synthetic coding sequence
atgaatctggagctcttggaaagcttcggccagaactaccctgaagaagccgacggcactctggactgcattagcatggcccttacctgtacgtttaatagatggggcacgctactggctgtgggctgtaatgatggcagaatcgtgatttgggacttcctcaccagaggaatcgctaagatcatttcagcccacatccatccagtttgctccctctgctggtctcgagacggtcacaaacttgtgagtgcctccaccgacaatattgtttcacagtgggacgtgctgtccggagattgcgatcagcgctttcggttccccagcccgattttgaaggtgcagtaccatccaagggaccagaataaagtgctggtttgtccaatgaagagcgccccagtgatgctgacactgtctgacagtaagcacgtggtacttccagttgatgacgactccgatttgaatgtggtagcttcctttgaccgtcggggagagtatatctatactggcaacgcgaaagggaagatcctggtcctcaagaccgactcccaggacttggttgcatcatttagggtcaccactggaacatcgaacaccactgccattaaatccatcgagttcgccaggaagggctcttgttttttgataaatactgcagatcgcatcatccgagtgtacgatggtcgcgagattctgacatgtggacgagacggagaaccggaacctatgcaaaaactgcaggacctggttaaccgaacaccctggaaaaaatgttgcttctcgggcgatggggaatatatcgtggcgggaagcgccaggcagcacgcactgtatatctgggagaagtctatcgggaacttggtgaagatcctgcacggaacaagaggagagctgttgcttgatgttgcatggcacccggtgcgcccaattatcgcatcaatctcatctggtgtcgtctctatatgggcccagaatcaggtggagaattggtccgccttcgcacccgatttcaaagagttggacgagaacgtcgaatatgaggagcgtgaatccgaattcgacattgaggacgaggacaaatcagaaccagagcagactggtgcagatgcggcagaagacgaggaggtggacgtaacctctgtggatcctattgcagcgttttgttcctcagacgaagagctggaggattcaaaagcacttctctatctgccaatcgcaccagaagtggaagacccagaggaaaacccatatgggccaccacccgacgcagtgcagactagcttgatggacgaaggagcttcatccgaaaaaaaacggcagtccagcgccgacggctctcagccacccaaaaagaagccaaagacaaccaacatagaactccagggtgtccctaatgatgaagtgcatccattactgggtgtgaaaggtgacggcaagagtaagaaaaagcaagccggtagacccaagggatccaagggaaaggagaaagactctcctttcaagcctaagttgtataagggagatcgcggactccccctggaaggctctgctaaaggtaaggtgcaagcagagctgtctcaacctctcactgccggtggggctatatctgagttgctttag

SEQ ID NO: 238466 - DNA, 1503 bp, Artificial Sequence
  Description of Artificial Sequence: Synthetic coding sequence
atgaatctcgagctcttggagtcattcggacagaactatccggaagaggccgacggaaccttggactgcatctccatggctttaacttgcacctttaaccgctggggcactctgctggccgttggctgtaacgatggcaggatcgtcatttgggattttctgactagagggattgctaaaatcatctcggcacatatccacccagtatgctccctgtgctggtcccgcgatggtcacaagctcgtgtctgccagcacggacaatattgtgtcccagtgggacgtgctgagtggagactgtgaccagcggttccgctttccgtcccctatccttaaagtgcaatatcaccctagagaccagaataaagttctcgtctgtccgatgaaatctgcgccagtcatgctaacattgtccgattctaagcacgtggtgcttcctgtcgacgatgactctgatctcaacgtagtggcatctttcgatagaagaggggaatacatttacaccgggaacgcaaagggcaaaatcctcgtactgaagacggattctcaagacctggttgcatcgtttcgggtgacgaccggtacatccaatacgaccgccattaagtctatcgaatttgctcgcaaagggagttgcttcctcatcaatactgccgaccgcatcattcgggtgtatgatggcagggagattctgacttgcggtcgcgatggcgagcctgagccaatgcagaagctacaggatttagtaaacagaactccctggaagaaatgttgtttttcaggggacggagaatacattgtggctggcagtgcacgccaacatgccctttatatctgggagaaatccattggcaatctggttaaaattctccacggaaccaggggggagttgctgctagacgtggcttggcacccagtcagaccaatcatagcttccatatcatcaggagtggtctcgatctgggcgcagaatcaggtggagaactggagcgcattcgcacctgattttaaagagttggacgagaacgtcgagtacgaggagcgcgagtctgaattcgacatcgaagatgaggacaaatctgagccggaacagaccggagcagatgctgctgaagatgaagaggttgacgttactagcgttgatccaattgccgctttctgctcttccgacgaggagctcgaagacagtaaagctctgctgtacctcccaatcgccccagaggtggaagaccccgaagaaaacccctacggcccacctcccgacgccgtccagacaagtttgatggatgagggagcgtcttcagagaaaaagaggcagagcagcgcggacgggtctcagcctcctaagaagaaacctaagacaactaacattgagctacaaggtgtccccaatgacgaggtgcatcctttgcttggggtcaagggagacggaaagtcaaaaaaaaagcaggcaggacgccctaagggcagtaaagcgggaggggctatttccgaattgctttag

SEQ ID NO: 238467 - DNA, 5378 bp, Artificial Sequence
  Description of Artificial Sequence: Synthetic coding sequence
atgagttgcgttcattacaagtttagctctaagcttaactatgacactgttaccttcgacggccttcacatttcattgtgcgatctcaagaaacagatcatgggcagggagaagctgaaggcagcagactgtgatttacagataaccaacgcgcaaacaaaggaagaatatacagatgacaatgcactgattccaaagaattcttcagtcattgtcagaaggattcctatcggaggcgtgaagtcaacctctaaaacatacgtcatctcaagaactgagccagccatggcaactactaaggctatcgacgattcaagcgcaagtattagcctggctcagctgacaaagactgccaacctcgctgaagcaaatgccagcgaggaggacaaaatcaaagcaatgatgagccaatctggccatgagtacgaccctattaattacatgaaaaaaccactgggaccaccgcctcctagttatacgtgctttcggtgtggcaaaccaggccattacatcaagaattgccctaccaacggcgacaaaaatttcgagagcggaccgaggatcaagaagagtaccggcatcccaagatcctttatgatggaagtgaaagaccctaatatgaagggcgcaatgcttaccaatacaggcaaatacgccattcccactattgacgctgaggcttatgctatcgggaagaaggagaagcctccatttctgcctgaggagccatcttcgtcctcggaagaggacgatcctattccggatgaactactgtgcctgatatgcaaggacattatgaccgacgctgtcgtaattccatgctgcggcaactcttattgcgatgagtgcatccgcaccgctctcctggagagcgacgaacatacctgccctacctgtcatcagaatgatgtgtctcccgatgccctgattgcaaataagtttttacgtcaggccgtcaacaacttcaagaatgagaccggctataccaagcgcctgcggaaacagctcccaccaccaccaccaccaatccctccccctaggcccctgatccagcgaaatcttcagcctttaatgcgttctcctatctccagacagcaagaccccctaatgatcccggtgacctcctcttctacccatccagccccatcaatctcttctctgacgtccaaccagtctagcctcgctccccctgtcagcggaaacccatcttcagctcccgctcctgtgccagatatcaccgcaacggtctctatctccgtgcatagtgaaaagtccgacggcccttttcgcgactctgacaataagattttacccgctgctgcgctggcttccgagcactcgaaagggacatcaagtatcgcgattacggcattgatggaggagaagggctatcaggtgccagtgctggggactccctccttgttggggcagtcactactacacggccagctcataccaacaactgggcctgtcagaattaatacggcaagacccggtggagggaggcctggctgggaacatagtaacaaactgggatatttggtatccccaccgcagcagattcgccgtggagagcgatcttgttaccgtagtatcaatagaggtcgccaccatagcgaacggagccaacgaacacaagggccttctttgcccgctaccccagtgtttgtgcctgtgccccctccaccactgtacccaccgcctcctcacacgctgccactccccccaggcgtgccacccccacagttcagtccacagtttcctcctggtcaaccccctccggcaggatatagcgtgccaccccctggcttcccacccgcaccagctaacctcagtacgccatgggtgtcttccggagtgcagactgcacactccaacaccataccgaccactcaggcccctccgctgtctagagaggaattctatcgggaacagagacgtctcaaggaagaggagaagaaaaagagtaagcttgacgaatttactaacgacttcgcaaaggagttgatggagtacaaaaaaatacagaaggagcggaggagatccttctcgagatccaagagcccctatagcgggtcatcatattctcggagctcatacacatacagcaagtcacgttccggttcaacacggtcccggtcgtacagtcggtccttcagcaggagccattcacggagttattcccgctcccccccttaccctcggagaggtcgaggtaaaagtagaaactatagatcgcgatcccgctcacacggctatcacagatcacgttctcggtccccaccgtatagaagatatcattctcgctcgagatccccccaggcgttccgagggcagtcacctaacaaaaggaatgtaccccagggtgagaccgaaagagagtatttcaaccgctaccgagaggttcctccaccttacgatatgaaagcttattacgggagatctgtggatttccgggacccttttgaaaaggagcgctacagagagtgggagcgcaaatatagggaatggtacgaaaaatactacaaaggctacgctgctggagctcagcccagacccagcgccaatagagagaattttagtcccgagcggtttttacccctgaacattcgcaattccccattcactcgcggacggagagaagactacgtcggcggacagtcgcaccgctcacgcaacatagggtctaattaccccgagaagctgtcggctagagatggtcacaaccagaaggataatactaaaagtaaggagaaagagtctgaaaacgctcctggagacggcaagggaaataagcacaagaagcatcggaaacgacgaaaaggggaagagtctgagggcttcctgaatccagagctccttgaaaccagcagaaaaagcagagagccaacaggcgtggaggaaaataagaccgatagtctgttcgttcttccatctcgggacgatgctactccagtgagagatgagcctatggatgcagagtcaataaccttcaagtccgtctcagaaaaagataagcgcgagcgagacaaacctaaggccaagggggataagacaaagcgcaaaaatgatggcagtgccgtgagcaagaaggagaatatagtgaagcctgccaaaggaccccaagaaaaagtggacggcgaacgagaacgtagtccacgcagtgaaccgcctattaaaaaagccaaagaagagacgcctaaaaccgacaatactaagagctccagtagtagccaaaaagatgaaaaaattactggaacacctcgaaaggcccattccaaaagcgctaaggaacatcaagagaccaaacctgtaaaggaggaaaaggtgaagaaggactacagcaaggacgttaagagcgagaagttaacaaccaaggaagagaaagccaagaaacctaacgagaaaaataaacccttggacaacaagggggagaaaaggaaaagaaagaccgaagagaagggcgttgataaggacttcgagagctcttcaatgaaaatatcaaaattggaagttaccgaaatagtgaagccaagtcccaagcgcaagatggagcccgatactgaaaagatggacagaacccctgaaaaggacaaaatttctttatctgcacccgctaagaaaatcaaactgaatagggagacgggtaaaaaaattggtagtactgaaaacatcagcaatacgaaagagccatcagaaaagctggagtccacctcaagcaaggtgaaacaggagaaggtaaaggggaaagtgcggaggaaagtgaccggaacggagggctcttcctctactctggtagactatacttccacctcctcaacaggaggatcaccggtccgaaaaagcgaggagaagacagataccaagcgcacggtgatcaaaactatggaggaatacaataatgacaacacggcccctgccgaggatgttataattatgattcaggtgccccagagcaaatgggacaaggatgactttgagtcagaggaagaggacgtgaagtcaactcaacccatttcctcagtgggcaaacctgcctctgtcatcaagaacgtgtctacgaaaccttccaacattgtgaaatacccagagaaggagtctgagcccagcgaaaagattcagaagttcacgaaggacgtgagccacgagatcattcagcacgaagtaaagtccagtaagaacagtgcgagctcagagaaaggaaagactaaagaccgtgattacagtgtgttggaaaaagagaaccccgagaaaaggaagaattccacacagccagagaaggaatccaacctggatagattgaatgagcagggcaacttcaagagcctgtcacagtcttctaaagaggcacgcacttccgacaaacacgacagcacacgggcatctagtaacaaggacttcacccccaacagagataagaagaccgattacgatacccgtgaatattcctcaagcaagcgccgtgacgaaaagaatgagctgacacgccgtaaagattcaccctcacggaacaaagactcagctagtggacaaaagaataaacctagggaggagagggaccttcccaaaaagggtactggtgattcgaaaaaaagcaattcatctcctagcagagacagaaagcctcatgatcataaagctacatacgacaccaagcgccctaacgaagaaaccaagagtgtggacaaaaacccttgtaaggaccgggagaagcacgttctcgaggcacggaacaataaggaaagctctggcaacaaactgctgtacatcctaaacccccctgagacccaggtggagaaggagcagattaccggccagatagataaatccacagtgaagcctaagccccaattaagtcattcctctcgcctgagctctgatcttacccgggaaactgacgaggcagcatttgagcctgactacaacgagtcagattctgagagcaacgtgagcgtgaaggaggaagagtctagcggaaacatcagcaaagacctgaaggacaaaatcgtggagaaagccaaggagagcttagacactgctgccgtcgtgcaagtcggcatcagcaggaatcaatcccattcgtcccccagcgtctctccttctcgctctcacagtccaagtggctcccagacccgaagccattctagtagcgcttcttccgccgaatctcaggacagcaaaaagaaaaagaaaaagaaggaaaagaaaaagcataaaaaacacaagaagcataagaaacacaagaaacacgcaggcacagaagtggaactagagaagtcccagaaacataagcacaaaaagaagaaatccaaaaaaaacaaggataaagagaaggaaaaggaaaaagacgaccaaaaagtaaaaagtgtcacggtgta

SEQ ID NO: 238468 - DNA, 5276 bp, Artificial Sequence
  Description of Artificial Sequence: Synthetic coding sequence
atgtcatgcgtgcattataagttctcaagcaaactaaactacgacaccgtgacgttcgatggcctgcacatcagtctctgcgatctaaagaagcagatcatgggccgagaaaagcttaaagcagctgactgtgatctccagattactaacgcccagaccaaagaggagtacaccgatgacaatgcccttatacccaagaacagttccgttatagtgagaagaatccctataggtggggtgaaaagcacttcgaaaacctatgttatatcccggacagagcctgcaatggccacgacaaaggccatcgatgactcctctgcaagcatcagcctggcccagttaacaaagacagccaacttggcagaagcgaacgcttctgaagaggataaaatcaaagccatgatgtctcaaagtggccacgagtatgatcctataaattacatgaaaaaacctctcggcccacctccaccctcctatacctgtttcagatgcggaaagcctggtcactacatcaagaactgtcctacaaacggcgacaaaaacttcgaatccggaccgcgaatcaagaagtctactgggatcccacgtagtttcatgatggaagtgaaagacccaaacatgaaaggcgctatgctcacaaacactggcaagtacgcaattccgacgattgatgctgaggcatacgccatcgggaagaaggaaaaaccgccattcctgcctgaagaaccatcctcctcaagcgaggaggatgatccaattccagatgagctgctgtgcctaatctgtaaggacatcatgactgacgccgtggttatcccttgttgcggaaatagctactgtgacgaatgcatcagaacagccttactggagtccgacgaacacacctgccccacttgccaccagaacgatgtctcacccgatgccttgatcgctaacaagttcctccgtcaggctgtgaataatttcaagaacgagactggctacaccaagcgactccgcaagcaactgccgcctcctccccctccgatcccaccccctcggccattgattcagcggaacttacagcctttaatgagatcccccatttcccgccagcaggaccccctgatgattccagtcacaagctcctccacgcatcccgctccctctattagctctttgacatccaatcagagcagcctggcgccacccgtgagcggaaaccctagtagtgccccagcccctgttcccgatataaccgctaccgtcagcatcagcgttcactccgaaaaaagtgacgggccttttagggacagcgacaataaaatcctgccagccgcagcacttgcctcagagcacagcaaggggacctcctcaatcgctattacagctttaatggaagagaagggctatcaggtgcctgtgttgggcacacccagcctcctgggccagtctttactgcacgggcagttgatcccgactaccgggccagtgcggatcaataccgctcggcctgggggtggccgtcccggatgggagcattccaataaactcggatatctggtctctccacctcagcagattagaagaggcgaaagaagctgttacagaagtattaatcggggtaggcatcactctgagcgcagtcaacgcacacaggggccatctttgccagccacccccgtcttcgtcccggtcccgccaccccctctgtacccccctccaccccacacactgccactgccacctggtgttccaccacctcaattctctccccagttcccacctggacaaccgcctccggctggctacagtgtaccgccaccaggattcccacctgctcctgccaacctatctacaccttgggtgagttccggcgtccagactgctcactccaataccatccctacaactcaagcccctccactctcacgggaagagttttaccgggagcagagaagactgaaggaagagagtaaaagcccatactccggaagcagctattcacgtagttcctacacctattctaagtcaagaagtggctcaaccagaagccgatcatacagcaggagtttcagccgctcgcacagtaggagctattcgcggtcccccccttacccgagaagaggcaggggcaagagcagaaattataggagtcgcagtcgtagtcacggctaccaccgatctcggagcaggagccccccatatcggaggtaccactcaagatctaggtccccccaagccttcaggggtcagtcaccaaacaaacggaacgttccccagggcgaaacagaaagagagtactttaatagataccgagaggtgccacccccatatgacatgaaagcttactacggacgtagcgtcgatttcagggaccctttcgagaaggagcggtatagagagtgggagagaaagtaccgggagtggtatgagaagtattataaggggtacgcagccggtgctcagccacgaccttctgctaacagggagaatttcagccctgaaaggttcctgcctctgaacattcgcaactctccttttacgcggggacggagagaggattatgtcggtgggcagagccataggtctagaaatatcggatcaaattacccggagaagctgagtgccagggacggtcataaccagaaggacaacactaagtctaaggagaaggagagcgagaatgctccaggagacggaaagggcaacaaacacaagaaacacagaaaaaggaggaagggcgaggagtcagagggttttctgaaccccgagctgctggaaacctctaggaaaagcagggaaccaaccggtgtcgaggaaaacaagacagactctctttttgtcctgccatccagagatgacgccactcccgtgagggatgagcctatggatgccgagagtattacttttaagagcgtgtctgaaaaagataaacgggagcgggataaaccaaaggctaagggcgataaaactaaacgaaaaaatgacgggagcgcagtgagtaaaaaggaaaacatagtgaaacccgctaaaggtccccaggagaaggtggatggggagcgcgagagatcccctcgtagcgaacctccaataaagaaagctaaagaggaaacccctaaaaccgataatacgaagagtagctccagttctcagaaggatgagaaaattaccggcactccccgaaaagcacactctaagtccgcaaaggaacaccaggaaacgaaaccagtgaaagaggaaaaggtgaagaaggactatagcaaggatgtcaaatctgagaagttgacaactaaggaagagaaggccaagaaaccaaacgagaagaataaacctctggataacaagggtgagaaacgcaaaaggaagaccgaagagaagggggtggataaagacttcgagagctcctctatgaaaatctccaaactggaggtcaccgaaattgtaaagccaagcccaaaaaggaaaatggaaccagatactgagaaaatggacagaactcccgagaaagacaagatatcactgtccgctcctgcgaaaaaaattaaactgaaccgggaaaccggtaaaaagatcggctcgaccgaaaacattagtaatactaaagaaccatccgaaaagttagagtcgacctcctctaaagtgaaacaggagaaggtaaaaggaaaagtgaggaggaaggtgacaggtacagaaggcagttctagcaccctcgtggattatacgagcacttcatcaactgggggtagcccggtgaggaagtcggaagaaaagaccgatacaaagcggactgtgatcaaaaccatggaggaatataataacgataatacagcccctgctgaggacgtcatcatcatgatccaagttccgcaaagtaaatgggacaaggatgactttgaatccgaggaggaggacgttaagtctacacagccaatctcctcagttggaaagcctgccagcgttataaaaaacgtgagcactaagccgtccaacattgtcaaatacccagagaaggaatctgagcctagcgagaaaattcagaaattcacgaaagacgtatctcatgaaattatccagcacgaagtgaagtccagcaaaaattcggcatcctccgaaaaaggcaagacgaaagatcgcgattacagtgtattggaaaaagagaatcccgagaagcgcaagaattccacccaaccagaaaaagagagcaatcttgaccgcctaaacgaacagggcaatttcaagtcactgtcccaatcatcaaaggaagccaggacaagcgacaaacacgacagcacgcgagccagttccaataaggatttcactcccaatcgcgataagaagacagactatgatactcgtgaatactcatctagtaagcggagggacgaaaagaacgaacttacccgccgaaaggactcacctagccgaaataaggactccgccagtggacagaagaataagccccgagaagagcgagacttgcccaagaaaggaacaggtgattccaagaaatcaaatagttcaccatctcgtgataggaagccccacgaccacaaagctacgtatgatacaaaacgtcctaacgaggagacaaagagtgtggacaagaacccttgtaaagacagggagaagcatgtgttggaggctcggaacaacaaagaatccagcggaaacaagctcttatacatactgaatccccctgaaactcaggtggaaaaggaacagatcacaggtcagattgacaaaagtactgtcaaacccaagcctcagctgtcacattcgagtcggctgagctccgatctgacaagagagacagatgaggccgctttcgagcccgactataatgagtccgattccgagagtaatgtgagtgtgaaagaggaggaatcgagcggaaatatatcgaaggatcttaaagacaagattgttgaaaaggccaaggaaagcctcgataccgccgctgtcgtgcaagtcggcatatcccggaatcagtcccactcatccccatcggtgtcgccatcgagatcccacagccctagtgggtcgcagactcggtcacacagcagctctgccagctccgccgaaagccaggacagtaaaaaaaagaagaaaaaaaaagagaagaaaaagcacaaaaagcacaaaaaacataaaaagcataaaaagcatgccggtactgaggttgaattagagaaatcccagaagcataagcataagaagaagaagtccaaaaagaacaaggacaaggagaaggagaaagaaaaggacgatcagaaggtcaaatccgtgaccgtcta

SEQ ID NO: 238469 - DNA, 2859 bp, Artificial Sequence
  Description of Artificial Sequence: Synthetic coding sequence
atgtcctgtgtacattacaagttttcatcaaaactcaattatgacacagtgacatttgatgggcttcacatcagtttgtgtgacttaaagaaacaaatcatggggcgagaaaaacttaaggccgctgactgcgatttacaaatcaccaacgctcagactaaggaggaatatactgatgataatgctctaatccccaagaactccagcgtaattgtgaggaggatcccaataggaggagtgaagtccacaagcaaaacgtacgtcatttcaagaaccgaaccagctatggcaaccactaaagcgatagatgacagctcggcttcaattagcctggctcagctgaccaaaactgccaacctggctgaagcaaatgccagcgaggaagacaagataaaggcaatgatgtcccagagcggccacgaatatgatccaattaactacatgaaaaaaccactggggcctccacccccaagctacacctgctttcggtgtggtaagcctgggcattacattaagaactgcccgactaacggagacaaaaacttcgagagcggtcctaggatcaaaaagagcactggtatcccgagatcttttatgatggaggtgaaggaccccaacatgaaaggcgctatgctgactaacacaggtaagtatgccataccaactatcgatgccgaagcttacgccatcggcaagaaagaaaagcccccattcctgcctgaggagccgagcagctcgtctgaggaagatgatcctataccagacgagctgctctgcctcatatgcaaagacatcatgacagatgcagtcgtgattccgtgctgcggtaactcttactgcgatgagtgtattagaacagccctgctcgaatctgacgaacatacctgtcctacttgtcaccaaaacgacgtatctcctgacgctctgatagctaataagttcctcagacaagcggtgaacaactttaagaacgaaaccggatacacaaagcgcctgaggaagcaactgcctcctcctcctccccctattccccctccaagacccctaattcagcggaatctccaaccactgatgaggtctcccatcagccggcagcaagatccacttatgataccagtcacatctagcagcactcacccagcgccaagcattagcagtctcacttcaaaccagtcaagcctggctcccccagtttcgggcaatcccagcagcgccccagccccagtgcctgacatcactgcaactgtgagcatatcagttcattctgagaagtctgacggaccgttcaggacctcatccactggtggatccccagtccgtaaaagcgaggaaaagacagatactaagaggaccgtgatcaagacaatggaggaatacaacaacgacaacaccgcacctgccgaggacgtgatcattatgattcaggttccgcagagcaaatgggacaaggacgattttgaaagtgaggaagaagatgtaaaatccacccaacccatctcctccgtgggcaagccagctagtgtgattaagaacgtttccactaagcccagcaatatcgtgaagtatcccgagaaggagtctgaaccatctgagaagatccagaaattcactaaggacgtgagtcatgaaattatccagcacgaggtgaaatcctcgaagaactctgcctcctctgagaaggggaagactaaagatagggactatagtgtgctggaaaaggagaacccggagaaacggaagaatagcacacagcctgaaaaagaatccaatctggacagattaaacgaacaaggcaatttcaaatccttgtcccagagcagcaaagaggcgagaacctcggataagcacgattccactcgggctagcagtaacaaagactttacacccaatcgtgacaagaagacagactatgacacgcgggaatactccagttccaagaggcgcgatgagaaaaacgaactgaccaggcgcaaagacagccccagccggaataaagacagcgcttccgggcagaaaaataaacctcgtgaagaacgggacctgcccaaaaaaggaacaggagacagcaaaaaatctaattctagcccatcaagggaccgcaagccccatgaccacaaggctacctatgataccaaacggcctaatgaggagactaagtctgtcgacaagaatccatgcaaagatcgagagaagcacgttttagaagcacgcaacaacaaagaaagcagcggaaataaattattgtacatcctgaatcctccagaaacacaggtcgaaaaagaacagataaccggacaaatcgataagtcaacagtgaagccaaaaccccagctgtcccatagctctagactgtcaagcgatttgacaagagagaccgacgaagccgctttcgaacctgactacaacgagtcggattccgagtcgaacgtgagcgtcaaagaagaggagtcatctggcaatatctcaaaggaccttaaagacaaaattgtggaaaaggctaaagagagcctcgataccgcagccgtggtgcaggtggggatatctcggaaccagagccatagctcaccgtcagtgtcccccagcaggagccattctccttcaggtagccagaccagatctcattcttcttcagctagctccgccgaatcccaggatagcaagaagaaaaagaagaaaaaagagaaaaagaagcacaagaaacataagaaacacaaaaagcataagaaacatgccggaactgaagttgagcttgagaagagtcagaagcacaagcataagaaaaagaagtccaaaaagaataaggacaaggagaaggagaaagagaaagatgatcagaaagttaaaagcgttaccgtttag

SEQ ID NO: 238470 - DNA, 357 bp, Artificial Sequence
  Description of Artificial Sequence: Synthetic coding sequence
atgagttgtgtccactacaaattttcttccaaactgaattacgatacagtgacgttcgacggtctccatatttctctgtgtgatctaaagaaacagattatgggtagagaaaaactaaaagctgctgactgtgatctccagattacgaacgcacagacgaaagaagagtatactgacgataatgcactaatcccaaagaactcatcagtgatcgtcagaaggatccccatcggtggggtgaagagtacctcaaagacatatgtgatatctaggactgagccagccatggcgacgacaaaagcggtgtgcaagaatacaatcagccattttttttacacactccttcttccgctgtag

SEQ ID NO: 238471 - DNA, 1410 bp, Artificial Sequence
  Description of Artificial Sequence: Synthetic coding sequence
atggccgcagaggccggagtcgttggcgcaggcgcatcccccgacggagactggcgcgaccaggcgtgcgggctgttgctgcacgtgcacctctcaagccggctcgggcgagcagccccagtgcggacggggaggcaccttagaacagtgttcgaggatacagtagaagagcgcgttattaacgaagagtacaagatttggaagaagaataccccctttctctacgacctggtgatgacgcatgcccttcagtggcccagtctcactgtgcagtggcttcccgaagtgaccaaacccgaaggaaaggactatgcactgcactggctagtactgggcacacatacatcagacgaacaaaatcatttggtagttgctagggtgcacattccaaacgacgatgcacagttcgatgcttcacactgcgactctgataagggtgagtttggtgggttcggctccgtgaccgggaaaatagagtgtgagatcaagatcaatcatgagggcgaggtgaaccgggcacgctacatgccccagaaccctcacatcattgcaactaaaacgcccagtagcgacgtgctggtcttcgactatacgaaacatcctgcgaagccggatcctagcggggagtgtaaccccgacttacgcctgaggggccatcaaaaggaggggtacggcctgagctggaacagtaatctttcagggcacctactaagtgcctcagatgaccatactgtttgtctctgggatataaacgctggacctaaggagggcaagatcgtggatgccaaggcaatattcactggacattccgccgttgttgaggatgttgcctggcacctgttgcatgagtcacttttcggtagcgtcgccgacgaccagaaactaatgatctgggacaccaggagcaacaccaccagcaaaccttcacatctcgttgacgcccacaccgccgaggtaaactgtcttagttttaatccatatagcgaatttatcctggcaaccggctcagctgacaagaccgtcgctctgtgggacctgaggaatctgaagcttaagctgcacacattcgagagccacaaggatgagatcttccaggtccattggtctccacacaacgaaaccatcctggcttcaagtggaacagaccggaggctgaatgtgtgggatctgtccaaaatcggggaagaacagagcgccgaggatgcagaggacggcccacccgagctcttgtttatccatggaggtcacacagcgaagattagcgatttcagctggaaccctaatgagccttgggtgatatgctccgttagtgaagataatataatgcagatctggcaaatggcagaaaatatatacaatgacgaagagagcgacgttacaacatcagagctggaaggccagggtagttag

SEQ ID NO: 238472 - DNA, 1278 bp, Artificial Sequence
  Description of Artificial Sequence: Synthetic coding sequence
atggcgtccaaagaaatgtttgaagacactgtcgaggaacgcgtgataaatgaagagtataagatctggaagaagaacactccttttttatatgatctggtgatgacgcatgcactgcaatggccaagcctgactgtgcagtggctacctgaggtgactaagccagagggcaaagactatgctctgcactggctggtgctggggacacacacaagtgatgagcaaaaccatctagtcgttgctcgggtgcacataccaaacgacgacgcacagttcgacgcatcccactgcgactcggacaagggagagttcggcggattcggaagtgttaccggcaaaatcgagtgtgaaatcaagattaaccatgaaggcgaggtcaaccgggcacgctacatgccccagaatccacacatcatagcaactaagacaccttcctcagacgtgctcgtgtttgactacaccaaacatcctgcgaagcctgatccgagcggggagtgtaaccccgatcttcggcttagagggcaccagaaagagggttacggcctgtcatggaacagtaacttgtccgggcacctcctatctgcctcagacgatcataccgtttgtctttgggacataaacgcgggtcccaaggagggcaagatagtcgatgctaaagccatttttactggtcactcagcagtggtcgaggacgtggcctggcatctgcttcacgaatcactattcggcagtgtggctgacgatcagaagctgatgatctgggataccaggtccaatacaacttccaagccctcacatctcgtggatgcgcacactgctgaagtgaattgcttgtcttttaacccttacagtgaattcatcctggcaaccgggtcagccgacaaaactgtggccttgtgggaccttcggaatcttaaactgaagctgcatactttcgagtctcataaagatgaaatctttcaggtccactggagtccccacaacgagaccatactggcctcctcaggcacagataggcggttaaacgtgtgggacctgagcaagattggagaggaacagtccgccgaggacgccgaggatgggccacccgaacttctctttattcatggtgggcacactgctaaaattagtgacttctcctggaatccgaacgagccatgggtgatctgctctgtgtccgaggataatatcatgcagatctggcaaatggcggaaaatatctacaacgatgaggagtccgacgtcacaactagcgagttagaggggcaaggaagctag

SEQ ID NO: 238473 - DNA, 1251 bp, Artificial Sequence
  Description of Artificial Sequence: Synthetic coding sequence
atggccagcaaagagatgtttgaggatactgtggaggagagggtgatcaacgaggaatacaaaatctggaaaaaaaacacgccctttctgtatgacctggtaatgacccacgcactgcagtggccctcactgacggtccagtggctgcccgaggtgaccaagcctgagggcaaagattatgctctccactggctggtcctgggaacacataccagcgacgaacaaaaccacctggtcgtggccagggtgcacataccaaatgacgacgcgcagttcgatgcctcccattgtgatagtgataagggtggcaaaatcgagtgtgagattaagatcaaccacgaaggagaggtgaacagggccagatacatgccccagaacccacatattattgcaacgaagaccccaagttctgatgtcctagtttttgattacaccaagcaccctgcgaaaccggatccctccggcgagtgcaacccagacctgcgtttgcgagggcatcagaaggagggctacggcctatcttggaactcaaacctgtccggccacctgctgtcagcctcagatgatcacacggtttgcctgtgggatatcaatgctggaccaaaagaggggaagatcgtagacgctaaggctatctttacaggccactctgccgtggtggaagacgtggcatggcacctcctccatgagtccctatttggctcggtggccgacgaccagaaactaatgatctgggacactagaagcaacacaacctccaagccatcccatcttgttgacgcccacaccgcggaagtcaactgcctctcgtttaatccctacagcgaatttatactagccactggctcagccgataagacagttgccctgtgggacctgagaaaccttaaactgaagctgcatacctttgagagccacaaagacgagatattccaggtccattggtctccccacaatgaaacaattctagccagttccgggacggacaggcgcctgaacgtttgggacctgtctaaaataggcgaggagcaatctgctgaagatgctgaagacggcccaccggagctgctcttcatccatggcggtcatacagccaaaatcagtgactttagctggaatccaaatgagccttgggtaatctgcagtgtgagtgaggataatattatgcagatttggcaaatggccgagaatatttacaatgatgaagaaagtgatgtcacaaccagcgagctggagggccaggggtcttag

SEQ ID NO: 238474 - DNA, 561 bp, Artificial Sequence
  Description of Artificial Sequence: Synthetic coding sequence
atggcgtctccaagtaaggcggtgatcgtgcccggtaacggtgggggtgacgtcactacccacggttggtacgggtgggtcaagaaagaactcgaaaagatccccggttttcagtgcttggccaagaacatgcctgaccctatcaccgccagagagtctatttggctgccctttatggagacagaactgcattgtgacgagaagacgattattatcggccacagcagtggtgccattgcagctatgagatacgctgaaactcacagagtctatgctatcgtgttagtgtccgcctatacatctgacctaggagacgaaaacgagcgagcttccgggtatttcacgcggccatggcagtgggaaaaaatcaaagccaattgcccctatatcgttcaattcggcagtacagatgatccttttctgccatggaaagagcagcaggaagtcgccgaccggctggaaaccaagctgcacaagttcacagactgcggtcatttccagaacaccgagtttcacgagcttatcacagtggttaaaagtttactgaaagtaccagcatag

SEQ ID NO: 238475 - DNA, 519 bp, Artificial Sequence
  Description of Artificial Sequence: Synthetic coding sequence
atggcctctccttcaaaggcagtgattgtgcccggaaatggcggtggagacgtgacaacccatggatggtacggctgggtgaaaaaagagctggaaaaaatacctggtttccagtgcctcgcaaagaacatgcctgatcccatcacagcccgagagtccatttggctgccatttatggaaacagaactccactgtgacgaaaagacaataattattggccacagcagcggcgctattgccgctatgcgatacgctgaaacccatcgggtgtatgccattgtgttggtaagtgcctacacttctgatctcggcgatgagaatgaacgcgcttcaggctattttacccgaccctggcaatgggaaaaaataaaggccaactgcccatacattgtgcaattcggaagcacagatgaccccttcctgccatggaaggagcaacaggaggtggctgattggaagccaaactgcactaactctctgacagtggccacctttagaacgcagagctttatgaattag

SEQ ID NO: 238476 - DNA, 741 bp, Artificial Sequence
  Description of Artificial Sequence: Synthetic coding sequence
atggctgccgcagccattcccgcactacttttgtgtcttccgctgttgtttctgctatttggttggtctcgcgctcggagggacgacccacattcactgtgttacgatattaccgtaataccgaagttccgccctggccctagatggtgcgcagtgcaggggcaggttgacgaaaagacatttctacactacgactgtggaaacaaaactgtcacacctgtgagcccactcgggaagaaacttaatgtgacaatggcgtggaaagcgcagaatcctgttttaagagaggtggtcgacatactgactgagcagctgctcgacattcaactggagaactatacaccaaaggaaccgctcactctccaggctaggatgtcttgcgaacagaaagccgaggggcatagctccggctcctggcagttttccatcgatggtcagacatttctgctgttcgatagcgagaagcgcatgtggaccacagttcaccctggagccagaaagatgaaagagaaatgggagaatgataaagatgttgccatgtccttccactatatatctatgggggactgtatcggttggttagaagactttcttatgggtatggattcaactctggagcccagcgcaggagctccacttgccatgtctagcggtaccacccagctgagggctacagccacaaccctgatcttgtgctgcctgctgatcattctcccctgctttattctgcccggaatctag

SEQ ID NO: 238477 - DNA, 741 bp, Artificial Sequence
  Description of Artificial Sequence: Synthetic coding sequence
atggccgctgcagccatccccgctctgcttctgtgtttgccattactatttcttctgtttggatggtctcgcgctaggagagatgatcctcactccctctgctacgacatcactgtgatccccaaattcaggccaggaccacggtggtgtgcggttcagggacaggtggacgagaaaacattccttcattatgactgcggaaacaaaactgtgacaccagtgtctccactaggaaagaaactgaatgtaacgatggcctggaaggcacagaaccccgtattgcgagaggttgtggatatcctaaccgagcagctattggatatccagctcgagaattatacacccaaggagccacttacactgcaagccagaatgtcgtgcgagcagaaagccgaaggccattcaagtggaagttggcagttttccatcgacgggcagacctttctcctttttgacagcgagaaacgaatgtggaccacagtgcacccaggcgctcgcaagatgaaagagaagtgggagaacgataaggacgtggcaatgtcattccactacatttccatgggggactgcataggctggctagaggatttcctgatgggcatggactctacgctagaaccaagcgctggtgccccacttgccatgtcttccggaactactcagctgagagccaccgccaccacactgattctttgttgcctgcttatcatcctgccgtgcttcattctcccaggcatttag

SEQ ID NO: 238478 - DNA, 4923 bp, Artificial Sequence
  Description of Artificial Sequence: Synthetic coding sequence
atgcagagctttagagagaggtgcggattccacggaaaacagcagaattaccagcagactagccaagaaacgtccaggctggagaactacaggcagccctcgcaagccggtctttcgtgcgaccggcagcggctactggcaaaggattattacaaccctcagccctaccctagctacgagggcggagccggaactccatctggcaccgccgctgccgtggccgcagacaaatatcacagggggtctaaggctcttcccacccaacaagggctgcaaggtcgccctgcttttcccggttacggggtccaggatagctctccctatccaggacgctacgcaggagaagagtcactgcaggcttggggagccccacagcccccacccccacagccacaacccctgcccgcaggagtggcgaaatatgacgagaatctcatgaaaaaaactgcggttcctccatccaggcagtacgcagaacagggagctcaagtgccctttaggacacactctctacatgttcagcaaccacctccaccacagcagcctttggcatatcccaaactgcaacggcaaaagctgcagaacgatatcgcatcccccctgccttttccacaggggacccatttcccccaacattctcagtctttccccacctcttcgacatattcatctagtgttcagggcggaggtcagggggctcatagctacaaatcttgcacggcccctaccgcccaaccccatgatcggccattgacagcgtcatctagtctcgcgccaggacagcgcgtccagaacctccatgcttaccagagcggtcgactctcgtacgaccagcaacagcagcagcaacagcagcagcaacagcagcagcaggctttgcagagcaggcatcatgcccaagaaacactccactaccagaatctggccaagtaccagcactacgggcagcaggggcaaggctattgtcagcccgacgctgccgtcaggacacctgagcagtattaccagacattctccccctcctcctcacacagcccagcacggagcgtgggaagatcaccaagctatagctcaacccccagccctcttatgccaaatctggagaattttccatattcgcagcagcccctatccactggagctttccccgcaggtattaccgatcacagtcatttcatgcccctgttgaatcccagccccactgatgctaccagttccgtcgacacacaagccggaaattgcaaacccctgcagaaagataagttgccagaaaatctccttagtgacctctctctacaaagcctgaccgccctgacgagccaggtggagaatattagtaatactgtgcagcagctgcttctgagcaaggccgcagtgcctcagaagaagggtgtcaagaacctagtctcacgcacacccgaacaacataaaagccagcactgcagccccgaaggaagcggctattctgcagaaccggctggaaccccactgtctgagccgccatcttccactccccagagcactcacgcagaacctcaggaagccgactatttaagcggctctgaagaccctctggagaggtcctttctctactgcaaccaagccagaggaagtcctgctagggtgaacagtaattcaaaggccaagccggaaagtgtatcaacatgtagcgtgactagcccagacgacatgtctaccaagtccgatgacagtttccagtctttacatggctctcttcccttggactcatttagtaagtttgtggcaggcgaacgggactgtccacgtttactcctgagcgccctagcccaagaggatctcgcttcggagattttagggctgcaggaagcaatcggagagaaggcagataaggcctgggccgaggctccatcactggtaaaagatagttcaaaaccaccttttagtctggaaaaccacagcgcttgtcttgattcggtcgctaagtccgcctggcctaggccaggggagcctgaggctctgcccgacagcctccagctggataaaggcggtaatgccaaagacttctcgcctggcctgtttgaggatccttccgtggcttttgcgacgcctgatccgaaaaagaccaccggtccactgtccttcgggacaaaacctaccctgggtgttcccgctccagatcctaccaccgccgcattcgattgtttccctgatacaacggctgcttccagtgcagactctgccaaccctttcgcttggccagaagagaacctgggagatgcgtgccctaggtggggattacaccccggagaacttaccaaggggctcgaacaaggcggtaaggcatcagatggtatatctaaaggagacacgcatgaggcatctgcctgcctgggattccaggaggaggatcctccaggggaaaaagtcgcttctcttcctggagacttcaagcaagaggaagtggggggtgtcaaagaggaagcaggcggtctgctgcaatgccccgaggtggccaaagccgacaggtggctggaggattctaggcattgctgctctacagccgacttcggggacctcccattactcccacctacaagccgtaaagaagacttagaagccgaggaggagtattcatccctgtgtgaactcctggggtctcctgaacaacgccctgggatgcaggaccctctgtcccccaaagcccctcttatctgtacaaaggaagaagtcgaggaggtgttggattctaaggcgggatggggatcaccctgccacctgagcggcgagtcagtaatactcctgggaccaaccgtcggaaccgagtcgaaggtccaatcttggttcgaatccagcctgagccacatgaagcccggagaagaagggccagatggagaacgcgctcccggagattccaccacaagcgacgctagcctcgctcaaaaacctaacaaaccagccgtgccggaagcgcctatagccaagaaagagccagtgccaagggggaaatccctgaggtccaggcgagtgcacaggggcctgccagaggctgaagatagcccttgcagggcgccagttctcccaaaagacctactgcttccggagagttgtaccggccctccacagggacaaatggagggagctggcgcacctggaaggggggcttccgagggacttccgagaatgtgtaccaggtctctgacagctctttctgaacctcgaacccccggaccacccggactgactactacacccgctccacctgacaaactggggggaaagcagagagccgctttcaaaagcggcaagcgtgtggggaaaccctcgccgaaggcggcaagcagccctagcaaccctgcagcgttacctgtggcgtcagattcctcccccatgggatcgaaaacaaaggagactgactcaccatctacccctggaaaagaccaacgctctatgattctgcgctccagaactaagactcaggagattttccacagcaagaggagaaggcccagcgaaggccgactgcccaactgcagggctacaaagaaactgctcgacaactcacatttgcccgctaccttcaaagtctcctctagcccacagaaagaagggagggtgagtcagcgggctcgcgtacctaagcccggagcgggatctaaactgagtgatcggcctctgcatgctcttaagcgcaagagtgcctttatggcacccgtccccactaagaaacgaaacctggtattaaggtcgaggagctcgagctcaagcaacgcgtccggaaatggcggagacggaaaagaggaacggcctgagggcagcccaacactgttcaaacgaatgtcctcacctaagaaggccaaacccacaaagggtaatggggaacccgcaaccaagctgccccctcctgagacccccgacgcctgcctgaaactcgcgagccgagcagcatttcagggagcaatgaagacaaaggtgctacctcctcggaagggacgtggattaaaactcgaagccatagtgcagaaaattaccagcccgtccctgaaaaaatttgcttgcaaggcacccggtgccagcccaggcaatcctcttagtcctagcctttctgataaggataggggcctaaaaggagccggaggatcccctgtcggagtggaagaggggctcgttaacgtgggtaccggacagaaactcccgaccagcggagcagaccccctgtgtcggaatccgacaaatcgcagccttaaaggaaagctgatgaactctaagaaattaagttccaccgattgctttaaaaccgaagccttcacaagcccagaagcgctccagcccggtggcacggcgctggctcctaagaagaggagtcgcaaagggagggctggagcccacggcctgagcaagggtccgctcgaaaaacggccatacctgggacctgccctgttgctgacccccagagacagggccagcggaacacagggagcctctgaagacaacagcgggggtgggggtaagaagcccaaaatggaggagctgggccttgcctcccaacccccagaagggagaccctgccagccacagaccagggcacaaaaacagcccggtcacacaaactatagttcatactcaaaaagaaagcgactcacacgaggaagggccaagaatactaccagcagtccttgcaagggcagagcaaagagacgccgtcaacagcaggtactacctcttgacccagctgaaccagagatccgtctgaaatatataagttcgtgcaaaaggttgaggagcgacagccgtactcccgcatttagcccttttgaacccagtctcggcgcacagaatcctagaagtggccagaacgcgcctcccgcaccagccgacgccagacccctctgtactacccgggataggagggcctattcagcgcgagagcagggacagcgttag

SEQ ID NO: 238479 - DNA, 5588 bp, Artificial Sequence
  Description of Artificial Sequence: Synthetic coding sequence
atgcaatcttttcgcgaaagatgcgggtttcatggaaaacagcagaattaccagcagacatcacaagagactagccgacttgagaactaccgacagccgagtcaggctgggctgagttgtgacagacagcgattacttgctaaagactactacaacccacaaccttacccgtcctatgaaggaggggctggcaccccctccgggacagccgcagcagtggctgctgataaatatcatagagggagcaaagcgctcccaactcaacaaggcctgcagggcagaccagcttttcccggttacggtgtgcaggactcgtcaccgtatccagggagatatgctggcgaggaatctctgcaagcttggggggcaccacagcccccaccccctcaaccgcagcccttgccagctggtgtggcaaagtatgacgaaaatctcatgaagaaaaccgcagtgccgcctagccgccagtacgctgagcagggagcacaagtcccattccgcacacattccttacacgtgcaacagcctcctccccctcagcagcctctcgcttacccaaaactacagagacagaaactgcaaaatgatattgcctccccattgccgttccctcaaggatggtgggccggacacagctacaaatcctgcactgccccaacggctcaaccacacgacagacccctgactgccagcagctccttggcacccggacagagagtgcagaatctccacgcatatcaaagcggaagattgtcttacgatcaacagcaacagcagcaacagcagcaacagcagcaacaacaggcgctgcaaagtcggcaccacgcccaggagacactgcactatcaaaaccttgccaagtaccagcactatggccagcaaggccagggatattgtcagcctgacgcagctgtgcgtacaccggaacagtactaccagacatttagccctagcagtagccactcacctgccagatcagtcggacgttccccttcttactcatccaccccatcccctctgatgccaaacctcgagaatttcccctacagtcaacagccattgtcaactggagcttttcctgctggtatcacagaccattcgcattttatgcccctactcaacccgtctcccactgatgccacgtctagcgtggatagcctgacagccttgacctcccaggtggaaaacatatctaatacagtacagcagctgctgctctctaaggctgccgtgccccaaaaaaagggcgtgaagaacctcgtttccagaacccccgaacagcacaaatctcagcactgctccccggagggctcaggttactctgccgagcctgcaggaacaccgctgtctgaacccccttcaagcacccctcaatcaacacacgccgagccccaggaagcagattacctcagtggctcagaggatccactggagcggtctttcctgtattgcaatcaagcacgcggatctcctgcacgggtcaattctaactctaaagccaaacccgaaagcgtgagcacctgttctgtgacatccccggacgacatgagcactaagagtgacgacagcttccagtctctccatggctctctgcctctcgactcattctctaagtttgtggccggagaacgcgattgtcctagactgctcctctccgcattagcccaagaggacttggcaagcgagatccttggactgcaggaggcgattggagagaaagctgacaaggcctgggcagaggccccttccctcgtcaaagattcctcaaagccacccttctctctggagaaccattcggcctgcctggacagtgtagcgaaaagtgcatggcccaggccaggagagccagaggccctcccggattcgctgcagctagacaaaggcggtaatgctaaggacttctctcccggtttgttcgaggacccatcagtcgccttcgccacccccgaccctaagaagaccactggcccattaagcttcggaacaaagccaactctgggtgttccagctcctgatccaacaacagcagcttttgattgcttcccagataccactgcggctagttccgccgattctgctaatcccttcgcgtggccagaggaaaatttgggcgatgcctgcccgaggtgggggctgcaccccggtgagctgactaaggggctggaacaggggggtaaagctagtgatggtatttctaagggggatactcacgaagcctcagcatgccttggcttccaggaagaggatcctccaggggagaaagtagcttccttaccaggcgactttaagcaagaggaggttggtggagtcaaggaggaagctggcggtctcctgcaatgtcccgaggtcgccaaagccgacaggtggctggaggattcaagacactgttgtagtactgctgacttcggcgatctgcccctgttgccacctacctctcggaaggaagatctcgaggccgaagaggagtactcctcactctgtgagctgctgggctctcctgaacagcgtccgggaatgcaggacccactctcccccaaggccccactgatctgtaccaaggaagaggttgaggaggttcttgatagcaaggccggatggggatctccttgccacttgtctggggagtctgttatcttactgggacccactgtaggcacagaaagcaaagtgcagtcatggttcgagagctcacttagccatatgaagcccggagaggaggggccagacggtgaacgggctcccggagactccacaacatcggatgcaagtctcgctcagaaaccaaacaagccggctgtgcctgaagctccaatcgctaaaaaagagccagtcccacgcggtaaaagcttgaggtctcggagggttcatcgagggctgccagaggccgaggatagtccgtgtagagcgccagtcctccctaaggacctgctcctcccggaaagctgcacaggtcctccacaagggcagatggaaggcgctggagcacctgggcgaggcgcttctgaagggctaccacgaatgtgcactcggtccttaactgcactctccgagccccgaacgcccggtcccccagggcttacaacgactcctgctccacctgacaagttaggaggaaagcagcgagccgcattcaagagtgggaagagggtgggaaagccctcccctaaggccgcttcctcacccagtaaccccgcagctctcccggtggccagcgattcatcccccatggggtcaaagactaaggaaacagacagtccctctacaccaggtaaggatcagcgctcaatgatcctgagatcacgaacaaaaacacaggaaatattccactctaagcgcaggcgcccaagcgaaggacggctgcctaattgcagggccaccaagaagctcctggataactctcaccttcctgccacctttaaagtgagctcttctccacagaaggaaggaagggtgagccaacgtgcacgagtgcctaaacctggtgccggaagcaaactctcagatcggccactacacgctctcaagcggaaaagcgcatttatggctcctgtgccaacgaagaagcggaatctggttctgcgcagtcgctccagctcaagttctaacgccagcggtaacgggggtgatggaaaggaagagcggccagagggttcccccacactgttcaaacggatgtcctcacccaaaaaggctaaacctacgaagggaaatggtgagcctgccaccaagcttcctccacccgaaacacccgacgcctgcctgaagctggcaagtcgcgctgctttccagggtgctatgaagacaaaggtgctgccccctcgaaagggccgtggtctcaaacttgaagctattgtgcagaaaatcaccagtcccagcctcaagaagttcgcttgcaaggctcctggagctagtccgggaaatccactttcaccatccttgagcgacaaggatagagggctgaagggggcaggtggatcccctgtgggcgtcgaagaaggcctcgtgaatgtaggaaccggccaaaaacttcccacatctggcgctgaccctctgtgtagaaatcctacgaacagatcactgaaaggaaagttaatgaataaccgcgctagcggaacccaaggggcatcagaggacaactccggcggtggaggtaagaaacctaagatggaagagttggggctcgcttcccagccacccgagggacgtccgtgtcagcctcagacccgagctcaaaagcagccgggacataccaattattcctcatatagcaaacggaaaagactgaccagaggcagagctaaaaatacaaccagtagcccttgcaaaggccgagccaaaaggaggcggcaacaacaagtgctccccttggatccggctgagcccgagattaggttgaaatatatttctagttgtaagagactgagatcagattccaggacacctgctttctcaccgttcgtgcgagtcgagaagcgcgatgctttcacgaccatttgtaccgttgtcaattcgcccggagacgcacctaaaccccataggaaaccgtcatcatctgcctcatcatcttcttcctcatcgagcttctctctggatgctgcaggcgcaagccttgccaccctgcctgggggttcgatcctgcagcccaggcccagcctccccctcagctccaccatgcacctggggccagtcgtgagtaaagccctctcaaccagctgtctagtatgttgtctctgtcaaaaccccgctaattttaaggatctaggtgacctgtgtggcccatactaccccgagcactgtctgcccaaaaaaaagcctaagctgaaagaaaaagtgcgtccagagggtacgtgcgaagaagcttcactgccattggaacgtaccctcaagggtccggagtgtgccgcagccgcaaccgctggcaagccgcctcgccctgatggcccagctgatccagcaaaacaaggcccacttaggacaagtgccaggggactgagccgacgcctccagtcctgttattgctgtgacggacgtgaggacgggggtgaggaagcggctcctgctgacaagggtcactgggtccatgaggcctgcgctgtttggacaggtggagtttaccttgtagctgggaaacttttcggactccaggaggcaatgaaagtggcagtcgatatgcatggagggacagttgcactcgcacctggggatttttcccttcccggattgaggtttgcaagtctgttccagggcccatcttggtgtgactgtcctgtactggcaacttctaccccttcatcatggtcccgatgcgtgcccgctgccaagaaacccggaccacctctgggcgcagcaaccaaggacgcttccacgcctactacgacacgcgtccccgcaatgcaagtgcgggcacgcccaggaacaggcggtcactggagccctagtaaacagtcacgcggaacactgcccggacactccagtcctaaccctggtcctatctccttgttcagctttcctccactcctgccccaacagttcttctatccatccgtttgtcttgacctgtgctgggcgatgccaggcacctggaagta

SEQ ID NO: 238480 - DNA, 5720 bp, Artificial Sequence
  Description of Artificial Sequence: Synthetic coding sequence
atgcagagtttccgcgagcgatgcgggttccacggcaagcaacagaattatcagcaaacctctcaggaaacgtctcgcttggagaattacagacaaccatctcaagcagggctatcatgtgaccgccaacgccttctggccaaagactattataatcctcagccatacccatcctatgaggggggtgcaggcacccccagcggcaccgcagccgctgtcgccgctgataagtatcatcgcggatcgaaagccctcccaacacagcaagggctgcagggaaggcccgcatttcctggttatggggtgcaagatagttcaccttaccctgggcgatatgcgggtgaggaatcgctgcaggcctggggcgctcctcagccccctccccctcagcctcagcccctgccagctggcgtggctaaatacgacgagaatctgatgaaaaaaacagccgtccccccatctcgacagtacgctgagcagggtgcacaagtccctttcaggacgcacagcctgcacgttcagcaacctccaccaccacagcaaccgctggcttatccaaagcttcagcggcaaaagcttcagaatgatatcgcatccccgcttccctttccccagggtactcacttccctcagcacagccagtcgttccccactagttcgacgtatagctcttctgtacaggggggtgggcagggcgctcacagttataaatcatgcacagcaccaactgcccagcctcacgaccgaccgttgaccgcatcctcttctcttgcacccggacagagagtgcagaatttgcatgcctaccagagtggacgcttgtcctatgatcagcagcaacaacagcagcagcagcagcagcagcagcagcaagccctgcagagcagacatcacgcgcaggaaaccctccactatcagaatttggccaagtaccaacactacgggcagcaggggcaaggatactgccagcccgatgccgctgtgaggacacccgagcagtactaccagaccttttccccttcaagtagccacagtcccgcacggtctgtcggacgaagtcccagctattcaagtactcccagtccactcatgccaaacctggagaacttcccgtacagccagcagcccttaagcactggcgctttcccagccggaataacagaccactcgcattttatgccccttcttaatcctagccctacagacgccacgtcatcagtggacacgcaggccggaaactgcaaacccctgcaaaaagataagctccccgagaatctgctgagcgacctgagcctgcagagtttaaccgcgctaacttctcaggttgagaatatcagcaacaccgtccaacaactactgctttccaaagctgcggttccgcagaagaaaggagtgaaaaacctggtctcacggacaccggaacagcataagagtcaacactgtagccctgaggggagcggctacagcgcagagcccgcaggcacccccctgtctgagccgccttcatccaccccacagtcgacgcacgccgaaccccaggaagcagattacttgagtggctccgaagaccctctggagcgctcatttctgtattgcaaccaggctagaggttcccccgcacgggtcaactctaatagtaaagccaaacccgagtccgtgagtacatgtagcgtgaccagccccgatgacatgtctacaaaaagtgatgactcttttcagtccttgcatgggagtttgcctctggattctttctcaaaattcgttgcgggagaacgtgattgcccacgtctgcttctctccgccctggcccaggaggatctggcaagcgaaattcttgggctgcaggaagcaatcggagaaaaagctgacaaagcatgggcggaggccccatccttagtgaaggattcctctaagccgcctttttctttggaaaatcacagcgcatgcctggacagcgttgctaaatcggcgtggcctcgccctggggaacccgaagcgctcccggattccttacagctggataaaggaggcaatgccaaagacttcagtcccggactgttcgaggacccaagcgttgcgttcgctactcccgatcccaaaaaaaccacaggaccacttagcttcggcaccaaacccaccctgggggtgccggcacctgatcccacgacagcagctttcgattgcttcccggacacaaccgcggcaagctccgccgactccgctaacccctttgcctggccagaagagaatttgggagatgcttgcccacgttggggcctccatcctggggaactgaccaaaggactggagcagggaggaaaggccagcgatggaatttccaagggggatacacacgaggcatcagcctgcctcggctttcaagaggaggatccgcctggagagaaggtggcatcgttaccgggtgacttcaaacaggaagaagtaggcggagtcaaggaggaggcaggtggactcctgcaatgtcctgaggttgcaaaagccgaccgatggttagaggattcccggcattgttgtagcacagccgacttcggggatctacctctgctgccaccgacaagccggaaggaggatttggaggccgaggaggagtattcttctctttgtgagttgctgggctctcctgaacaaaggccaggtatgcaagaccctctgagccccaaggcaccactcatctgcaccaaggaagaagtggaggaagtgttggatagcaaggccggatggggttcaccctgtcacctgagcggcgaatctgttatcctgttgggcccaaccgttggtacggaatccaaagttcaatcgtggtttgaatcgtctctgtctcacatgaaaccaggcgaagagggaccggatggcgagagggcccctggcgactctacaaccagcgacgcatccttggcacagaagccaaataagcctgcggtgccagaggcccctatcgcaaagaaggaacccgtacccagaggcaaatctctgaggtccaggcgagtccacagaggacttcccgaagccgaagattccccttgccgcgcacctgtgctacccaaggatctgttactgcctgagagctgcacaggccctcctcaaggtcagatggaaggcgcaggcgctcccggacggggtgcttcagaggggctgcctcgtatgtgtactagatcccttacggcattgtcagaacctagaactcccggacccccaggacttacgacaactcccgctccccctgacaaactgggaggcaaacagagggctgccttcaaatcgggcaaacgcgtgggcaagcccagcccaaaagccgctagtagtcctagtaatccagcagctttacctgtggcaagtgacagctctcctatgggttcaaaaacgaaggaaacagattctccgtcaaccccaggcaaggatcagaggagtatgattctccgatctagaaccaagacccaggaaatcttccatagtaagaggcggaggccctctgagggacgcctgcctaactgccgcgctaccaagaaattactcgacaactcccatctcccggcaacatttaaggtgtcctcttctccccagaaagagggccgtgtgagccagcgagctagggtacctaagcctggggctgggtctaaactgagcgaccgcccactccacgcactcaagaggaagtccgcatttatggctcccgtccccacaaagaagcggaatctggtgctcagaagccgttcctcatccagttctaatgctagtggcaacgggggagatggcaaggaggagcgccctgaagggagccctaccctgttcaaaaggatgagttcacccaagaaagcaaaaccaacgaagggcaacggagagcccgctacaaagctccctccacccgagactccagacgcttgtctcaaacttgcgtctagggccgctttccagggggctatgaagactaaagtcctgccccctcggaagggcagggggctaaaactcgaggcaatcgtgcagaagattacaagcccgtccctcaaaaagttcgcttgcaaggcaccaggtgcctcacctggaaatcccctgtctccaagcctttcagacaaagacagaggcttgaaaggtgccggaggatcccctgtgggtgtggaagagggcttagtcaacgtggggaccggccagaaactgcccacatcaggggcagaccccttatgtagaaaccctaccaataggtcactcaagggtaagttgatgaatagtaagaaactcagcagcacagactgctttaaaactgaggccttcacctccccggaagccctccagcccggaggcacagccctcgcaccaaaaaagcgtagccggaagggaagggccggagcgcacggcctcagcaagggtccgcttgaaaagcggccatacttgggacccgctctccttctaaccccccgagatcgtgccagcggcacacagggagcatccgaagataacagtgggggaggaggtaagaagccaaaaatggaggaactcggcctggcttctcagccacccgagggcaggccttgccagccccaaacgcgggctcagaaacagccaggccacaccaactatagctcctattccaagcggaagaggttgactcgcggacgggcaaaaaatacaactagctcaccatgcaaaggtagagcgaagcgaaggcggcagcagcaagttctgccactggacccggctgagcccgaaatcagactaaagtatatatcgtcatgcaaacggttgaggtcggattcacgcactccggcattttctcctttcgtgcgggtggagaagcgggatgcctttacaacaatctgcactgtagtgaacagccctggcgacgcccctaaacctcacaggaaaccgtccagcagcgcttcatcatcttcatcatcaagctctttctccttggatgctgcaggggcaagcctggccaccctgccgggagggagcatcttgcagccacggccatcgttaccactgagtagcacgatgcatctggggcctgttgtttctaaagcactgagtacttcttgcctcgtgtgctgcctgtgtcagaacccagccaactttaaggacctgggagatttatgtggcccttattatccagagcactgcttgcccaaaaagaagcctaagttaaaagaaaaggtccgtcctgagggcacatgcgaggaggcctcccttccactagagcgcacactcaagggccctgagtgcgccgcagctgctactgccggtaagccacccagaccagacggaccagccgatccggctaagcagggaccgcttcgcaccagcgcaaggggcctgagccggcgattgcagtcttgttattgttgcgacggcagggaagacgggggagaggaggccgcacccgcagacaagggtagaaaacacgagtgctccaaagaggcaccagccgagccgggaggcgaggctcaggagcactgggtacacgaggcgtgtgctgtgtggacaggtggggtgtatctagtagctggaaagctgttcggccttcaagaggccatgaaggtcgcagttgacatgatgtgtagttcttgtcaggaggccggagccaccatcggctgttgccacaaaggctgcctgcacacgtatcactacccttgcgccagcgatgctgggtgcatatttattgaagaaaacttttccttgaagtgccccaagcataagaggctccccta

SEQ ID NO: 238481 - DNA, 2901 bp, Artificial Sequence
  Description of Artificial Sequence: Synthetic coding sequence
atgcagagctttcgggagagatgtggattccatggaaaacagcagaattaccagcagacatctcaagaaacaagccgtctagaaaattaccgacagcccagccaggcgggattgtcctgtgaccgccagaggcttctcgcaaaagattactataatccacaaccctatccatcttatgagggcggagccggaacgccaagcggtacagccgcagctgtagccgctgataaatatcatagagggtccaaagccttaccaacccagcaagggcttcagggcaggccggcttttccgggatatggcgtgcaggactcaagcccttaccccggtcggtacgcgggagaggagtccctccaggcttggggcgctccgcagccccctccaccccagcctcagccgctgcctgccggtgtcgctaaatacgatgagaacttgatgaagaagactgctgtccctccaagtcggcagtatgcggagcaaggagcccaagttccattcaggacccactctctccacgtacagcagccccctccaccccagcagcccttagcttacccaaagcttcagcggcaaaagcttcagaatgacatagcttctccgctgccctttccccaagggacgcatttccctcaacacagtcagtctttccctactagctccacgtacagcagcagcgtccagggaggagggcaaggggcacattcgtataaatcctgtacggccccaactgctcaaccccatgaccggcctctgaccgcgtcatcaagtctagctccaggccagcgagttcagaatctgcacgcctaccagagtggacgactcagctatgaccagcagcagcagcagcagcagcagcagcagcaacagcagcaggccctgcagtctaggcaccacgctcaagagactttgcactaccaaaacctggccaagtaccagcactacggccagcagggccagggttactgtcagccggatgcagcggtgaggacccctgagcagtattatcagactttctctccctcatcatcgcactcccccgcacgctcggtagggcgaagccccagctacagttccaccccatccccactgatgcctaatctggagaacttcccttattcgcagcagccactgtccactggcgcatttcccgctggcattacagaccattctcactttatgccacttctcaacccatcaccaacagacgcaacgagctccgttgatacccaggctgggaactgcaagcctctgcagaaggacaaactgcctgaaaatttgctgagcgacctgtccctgcagtccttgacagccttgacctcacaagttgagaatatcagcaacaccgtgcagcagctgctgctttcaaaggccgctgtcccgcagaaaaagggagtcaagaatttagtgagtcggacacctgaacagcacaaatcacagcattgtagtccagaaggcagcggatacagtgctgaacccgctggtacccccctatcggagccaccatcttcaactcctcaatctacacatgctgaacctcaggaagcagactatctgagtggctcagaggatcccctcgaaagatcatttttatactgcaaccaggcacgcggtagccctgcaagagttaactccaatagtaaagccaaacccgagtccgtttcaacgtgttccgtgacctccccagatgatatgagcaccaagtctgatgactcgtttcaatctctccacggaagcctgccattagacagcttttctaagtttgtggctggggagcgcgattgtcctaggctcctactaagcgcgctcgcccaggaagatctcgcaagcgaaatcttaggactgcaggaggccatcggagaaaaggcggataaggcctgggctgaggcccctagcctggtgaaggacagttccaagccccctttcagcctggagaatcactctgcttgtctcgacagtgtggctaaaagcgcgtggccgagacctggggagcctgaggcccttccggactctctgcagctcgataaggggggaaatgccaaggatttctctccgggactgtttgaagatccaagcgtggctttcgcgacaccagatccaaagaagaccaccgggcctctgtctttcggaactaaaccgaccctaggcgtaccggctcccgatccaacaactgccgctttcgattgctttccggacacgacggcagcctcgtccgcagatagcgcgaacccatttgcctggccagaagaaaatttgggcgacgcttgtcccaggtggggcttacaccctggcgagttaaccaagggcttggaacaggggggaaaagcgagtgacggaatttcgaaaggcgatacacacgaggcctccgcatgcctcggatttcaggaggaggatccccctggcgagaaagtggcatccttaccaggcgatttcaaacaggaagaggtcggaggggtcaaggaggaagccggaggactcttgcagtgccctgaggtcgccaaggccgaccggtggctggaggacagcaggcattgctgcagcactgccgactttggtgatctaccgctgttgccccctactagccggaaagaagatctcgaggccgaggaagagtattcctcactgtgcgagcttctcggatccccagagcagagacccggtatgcaagatccgctgtccccaaaggcgcctctgatctgcacgaaagaggaagtagaagaagtcctcgacagcaaagcaggctgggggagcccatgccatctgagcggggagtctgtgattctcttggggcctacagtgggcacagaatcaaaagtccagagctggtttgaagcctcactctacagcgtctacatctgcatccacatccacatttataacatctacgaggactgtaagtgctag

SEQ ID NO: 238482 - DNA, 2829 bp, Artificial Sequence
  Description of Artificial Sequence: Synthetic coding sequence
atgcaatcttttagggagaggtgcggttttcatgggaaacagcagaattaccagcaaacatcccaggagacaagtcggttggagaactatagacagccttctcaggccggactgagttgcgatagacagagactgctcgcaaaggactattacaacccgcaaccctatccttcgtatgagggaggggctggaaccccgagcggaactgccgctgccgtggctgccgacaagtatcatagaggctccaaggccctccctacccaacagggactccaaggacgtccagctttcccaggctatggagtccaggacagctctccctatcctggaaggtatgctggagaggagtcactgcaagcttggggcgctccacaacctccaccccctcagccacagccgctgcccgcaggagtggctaaatacgatgaaaacctgatgaagaagacagcagtacccccatccagacagtacgcggaacaaggggctcaagtgcccttcagaacccattctctccacgtgcagcaaccaccacccccacagcaaccattggcttaccctaaattgcagcgacagaagctgcaaaatgacatagccagtcctttgccattcccccagggtacgcacttcccccagcacagccaatccttccctacaagttcaacatacagcagctctgtccagggagggggacagggtgcacatagctataagagttgtaccgccccaactgctcagcctcatgataggccactgactgcaagcagttcactagccccagggcagcgtgtgcagaatcttcatgcctatcaatccggccgactgtcttacgaccagcagcagcagcaacagcagcagcagcagcagcagcagcaggcccttcagagtcggcaccatgcccaggagaccctccactatcagaacctggctaagtaccagcactatggccagcaaggacagggctattgccagcccgatgccgcagtccgaacccctgaacagtattatcagaccttctctcccagctcatcccacagccctgctaggagtgtcgggagatccccaagttacagtagtacaccttctcctctgatgccaaatctcgagaatttcccgtacagccagcagcctctgtccactggcgcatttcctgccggaattactgaccacagtcatttcatgcccctgctcaatccgtcccccactgacgctacctcttctgtggacacccaggccggaaactgcaagcccctccagaaggacaagctgcccgagaaccttctctcagatctcagtcttcagtcacttacagccttgacatctcaggtggaaaacatttctaacacggtgcagcagttgcttctgtcgaaggctgccgtgccacagaagaaaggagtgaagaaccttgtctctcgcacccctgaacaacataagtcccaacactgctcccctgaaggctccggatactctgccgagcctgctggaacacccctcagtgagccaccatcttctacgccacagtcaactcatgcagaaccgcaagaggcggattatctgtccggctcggaggaccccctggaacgctccttcctgtactgtaatcaggcacgcggttcccccgctcgcgtgaattcaaactccaaggccaagcctgagtccgtctctacatgtagcgtgacttcccctgacgacatgtccaccaaaagcgacgacagcttccagtcactgcacggatctctacccctggactcattttccaagttcgtcgctggtgaacgagactgtcccaggctgctcctcagcgctctggcccaagaggacctggccagcgagattctgggcctgcaggaggcaatcggcgaaaaggctgataaggcctgggcagaagcgccttccctggtgaaagacagctccaaaccaccatttagccttgaaaatcatagcgcttgcctggacagcgtagccaaaagcgcctggcctcgacctggagagcccgaagccctgccggacagtctgcagcttgacaaggggggaaacgcaaaggacttctctccgggtctgtttgaggacccctcggtcgccttcgctacccccgaccctaaaaagacgaccgggccactgtcatttggcaccaagcctaccctcggagtcccagcacccgaccctacaacagccgcatttgattgtttccctgacactacggcggcaagttccgccgattccgcgaacccatttgcctggccagaggagaacctaggcgacgcctgcccacgttggggactgcaccctggggagctgaccaagggactggaacagggtggtaaagcgtcagacggcatcagtaagggcgatacccacgaagcttctgcttgcctgggctttcaggaggaagaccccccaggagaaaaggtagctagcctcccaggagacttcaaacaagaggaggtaggaggtgtcaaggaagaggccggaggacttctgcagtgcccagaggttgctaaggctgatagatggctggaagacagccggcactgttgttctaccgctgacttcggagatttacctctcctgccacccactagccgcaaggaggatctggaagccgaggaggaatattcatccctgtgtgaattgctgggatctcccgaacaacgtcctgggatgcaggaccccctctcgcccaaggcaccactgatctgtactaaggaggaggtggaggaggtgctcgactctaaagcagggtggggatcaccttgtcatctgagcggagaaagtgtgattctcctggggccaactgtgggtaccgagagcaaagtgcaatcctggttttag

SEQ ID NO: 238483 - DNA, 5981 bp, Artificial Sequence
  Description of Artificial Sequence: Synthetic coding sequence
atgcagtcattcagggagaggtgcggattccacggaaaacaacagaactaccagcaaacttcccaggagaccagccggttggaaaattaccgccagccatcacaggcaggtctctcttgtgacaggcaaagactccttgccaaagattactacaacccccagccctacccctcctatgagggcggtgctggaactcccagcggcacagcagcagctgtcgctgccgacaagtaccaccgtggctctaaggcacttccaactcaacagggactgcagggcaggcccgcattccctggctatggcgtgcaggatagttccccatacccaggcagatacgctggagaggagtcactacaggcttggggcgcaccccaaccacccccaccacaaccccaaccgctgcctgcaggggtggctaaatatgacgaaaatctgatgaaaaagacagcagttccacccagcaggcagtatgcagagcagggagcccaggtgccgtttagaacgcatagtctgcacgtccaacaaccgcctccaccacagcagcccctcgcctaccctaagctccaacgtcagaaattgcagaacgacatcgccagccccctacctttcccacaggggacccatttccctcagcattctcagagcttccccacttcaagtacgtacagctccagcgtccaaggaggtggacagggggctcactcatacaaaagctgcacagcacccactgcacaaccacacgaccggcctttgacagcatccagcagcctggcgccaggtcaacgcgtgcagaacctccatgcctaccagtcggggagacttagttatgaccagcagcagcagcagcagcaacaacaacaacagcaacaacaggcgctgcagtcgcggcaccacgcccaggagactctccattatcagaatcttgccaagtaccaacactatggacaacagggccagggctactgccagcccgacgccgcagtgcggaccccagaacagtactaccagacctttagcccctcgtccagccatagccccgcaagaagcgtcgggagatcccccagttattccagcaccccctctcctcttatgccaaacctcgaaaacttcccatattctcagcaaccgctgagtactggcgcatttccagctggaattactgatcactctcactttatgccattgctgaatccatctcctaccgacgctacaagttccgtggacacacaggccggtaattgtaaacctttgcaaaaggataaactgcctgaaaacctcctatctgacctcagtttacagagcctgacagcacttaccagccaggtggaaaatatcagcaacacagtccaacagttgctgctctcaaaggccgcagtcccacagaagaaaggcgtgaaaaatctcgtgtcccgcactccagaacagcataaaagccagcattgctctccagaaggttccgggtactcagcggagcctgcaggcaccccactctcggaaccgccaagtagcacaccgcaatccacccacgcagagccccaggaagctgattacctttctggctctgaggaccctcttgaaaggagttttttatattgtaaccaggctcgaggtagtcccgctagggtgaatagcaattctaaggcaaagccagaatccgtcagcacatgttccgtgaccagcccagacgatatgtccactaagtccgacgacagctttcagtctttgcacggaagtctcccgctggattccttttctaagttcgtagccggtgagcgtgactgtccaagactgctgctttctgcccttgcccaggaagatctagccagcgaaatattaggcctgcaagaggccattggggagaaagcggacaaggcctgggcagaggctccatcactggttaaagacagctcaaaaccaccattttccctggaaaatcactccgcatgcctagactccgtcgcaaagagcgcctggccacgccctggagagcccgaggccctgccagatagcctgcagctggataagggtggcaatgcgaaagatttttctcccggtctatttgaggatccatcagtggcgttcgcaaccccagaccccaaaaagactactggccctctgtccttcgggaccaagcccacactgggagtgccagcaccggatcctaccactgcggctttcgactgcttcccagacaccaccgccgcttcctcggccgattcagcaaacccatttgcatggcctgaggagaatctcggggatgcttgcccacggtggggtctgcatccgggtgagcttaccaagggactggaacaggggggaaaagcctccgacggcatatcaaaaggggatacacatgaggcttccgcgtgcctcgggttccaggaagaggacccccctggagagaaagttgcaagcctgcctggggacttcaagcaagaggaagtagggggtgtaaaggaagaggcaggcggtctgctgcagtgccccgaggttgctaaggctgatcgttggttggaagacagccggcactgttgttccaccgctgacttcggcgacctgcccctccttcctccgacgtcgcgtaaggaagatttagaagccgaagaggagtacagttccttatgtgaactccttgggtcccctgagcaacgcccaggcatgcaagatcctctttcccctaaagcaccccttatttgcaccaaagaggaggtggaagaggtgctggacagcaaggcaggatggggaagcccctgccacttgtccggcgagagcgtgatcctcttgggtcctaccgtgggcaccgagtccaaagtgcagagctggttcgaatcttcgctttctcacatgaagcccggagaggaaggccctgatggcgaaagagccccaggggattccacgaccagcgatgccagcctcgcacagaagcccaataaaccagctgtgcctgaggctcccatcgccaaaaaggaacctgtgcctcgcggaaaaagcctgcggtcccgccgagttcaccgcggattacccgaggcggaggacagcccttgtagggcccctgtcctcccaaaggaccttctcttacccgagagctgcaccggccctccacagggtcaaatggagggtgcgggtgcccctgggagaggcgctagcgaggggcttcccagaatgtgcacccgctctcttacagccttatctgaacccagaacacctggccctccaggcctgacaaccacccctgcaccccctgataaactgggcggaaagcagcgggctgcctttaaaagcgggaagagggttggcaagccatccccaaaggcagcctcctcgccctccaatcccgctgctctccctgtggcaagcgactcctcacccatgggatccaagactaaggaaacagacagtccttccacccctggcaaagaccagagatccatgatacttcggagcaggaccaagacccaggagatttttcacagtaaacggagacgccctagtgaagggagacttccgaattgtcgggctactaaaaaacttttagacaacagccatctgccagcaactttcaaggtgagctcgtcccctcaaaaagaggggcgagtctcccagagggcgagggtgcccaagcctggggctggcagcaaactgtcagacagaccgttgcacgcactgaaacggaagagtgcgtttatggcacccgtgcctactaaaaaacgtaaccttgtcctgcggagccggtctagctcttctagtaatgctagtgggaacggcggtgatggaaaggaggaaaggcctgaaggctctcctactctgtttaagcggatgtcttcccctaagaaagctaagccaaccaagggtaatggtgagcctgcaactaaactccctcctccagaaacgcctgacgcttgtctaaagctcgccagccgcgcagctttccaaggcgcaatgaaaaccaaagtcctgcccccaagaaaagggagaggacttaagctggaagcgatagtgcagaaaataacctccccgtctttgaagaagttcgcatgcaaagcacctggagcctcgcccggaaatcccctatcgccttccctgtcagataaggatcggggattgaagggcgcaggaggttccccagtcggcgtggaggaaggcctggtgaatgttggcaccggtcagaagctgccaacgtctggcgcagatccactctgccgcaaccctacaaatagaagcctgaagggcaagttaatgaactctaagaaactgtcttcaacagactgctttaaaacagaggcattcacctcccccgaggctctccaaccaggtgggaccgctctcgcacctaagaagcgcagtcggaaaggtagagcaggcgctcatgggctgagcaaggggccattggagaaaaggccatacctgggcccagctctcttgttaacccctcgcgatcgggcatccggaactcagggcgcatcagaggacaactcaggcggtgggggtaaaaagcctaagatggaagagctgggcctggcctcccagcctccagaaggccgaccatgtcagccacagacgcgggcacagaaacagcccggacacacaaactactccagttactctaagcgaaagcgtctgacaaggggtagggccaagaacacaacttcgagcccttgcaaaggaagagccaagcgtagacgacagcagcaggtgctgcctctggaccccgctgagccagaaatccggttgaaatacatcagttcatgcaagcgattacgcagcgactccagaactcctgcattttcacccttcgtacgagtcgagaagagagacgcatttactacaatctgcaccgttgtgaactctcctggtgatgcaccaaagccacacaggaagcccagctcatctgccagttcgtcatctagtagttcaagtttctcactggatgcggctggcgcttcactagcaaccctgccaggcggatctatcctccagcccaggcccagccttccccttagtagcaccatgcatttgggaccagtagtttcgaaagccctgagcaccagctgtctcgtctgttgcctgtgtcaaaatccagctaacttcaaagacttaggagatctctgtggcccttactaccctgagcactgcctgcctaagaaaaagccaaaattgaaagagaaagtgcgtccagaggggacatgcgaggaggctagtctccccctggaacggacacttaagggacccgaatgtgccgctgcggctacagcgggaaagcctccacggcctgacggtcccgcagaccctgccaagcagggccctctccggaccagcgccaggggattatcaagaaggttacaaagttgttattgctgcgacggaagggaggacgggggagaggaggctgcgcctgcagataagggaagaaagcatgagtgttctaaagaggcccctgctgaaccaggtggcgaggcccaggagcactgggtacatgaagcgtgtgccgtctggaccggtggagtgtaccttgtggcaggaaagttgtttgggttgcaggaggccatgaaggtcgccgtggacatgcacggcggtacagttgctctcgcgccaggagatttcagcttgcctggcttgagattcgcgtccctgtttcagggaccctcctggtgtgattgcccagtgctggctacgtccacgccttcctcttggtctcggtgtgtacctgccgctaagaaaccagggcctcctctcggtgccgctaccaaggacgcctcaacacctaccaccactcgcgtccccgcaatgcaggtacgggctcgcccaggtaccggaggccactggagtccatctaaacagagtaggggcaccctgcccggacattcatcacccaatcctgggccaataagtttgttcagttttccgccactactccctcagcagtttttctacccttctgtgtgcctcgacctctgttgggccatgcccggaacctggaaata

SEQ ID NO: 238484 - DNA, 2943 bp, Artificial Sequence
  Description of Artificial Sequence: Synthetic coding sequence
atgaagtcgttaaaggcaaaattcagaaagagcgataccaatgaatggaacaagaatgacgataggctgcttcaagccgtagagaacggcgacgcagaaaaagtagcctctttattgggcaagaagggagcaagcgccacaaaacatgacagtgagggaaagacggctttccatctggcggcagcgaagggccatgtagagtgtctcagagtgatgattacacatggggtggacgtgactgcccaggacactactggacattctgctctgcatctcgctgcaaaaaactctcaccatgagtgcatacggaaactgctgcagtcgaaatgtcccgctgagagcgtagacagttctggcaagaccgctctgcattatgccgcagcgcaggggtgcctgcaggcggttcagatcttatgtgagcataaaagccctatcaatctgaaggatctggatggcaacattccacttttgctggccgtacagaacgggcatagcgagatttgccatttcctattggaccatggtgccgatgtcaattccaggaataaatccgggaggaccgctctgatgctggcttgtgagataggctcttctaacgcggtcgaggccctgattaagaaaggggctgacctcaatctggtggactccctcggatataacgctctgcactatagcaagctaagcgaaaacgctgggatccagagtctgcttttaagtaagatctcccaggatgcggatctcaagaccccaactaagcccaagcagcacgatcaggtcagcaaaatcagcagtgaacgcagcggcacacctaaaaaacgcaaggcacctcctccacccatttctccgactcagctgtccgacgtaagttcaccccgatctattacgtccacaccattgtccggaaaggaatccgtgtttttcgcagagccccctttcaaggccgagatcagctccattagagagaacaaagatcggctgtcagatagtactacgggcgcagactctttgctcgacatctcttccgaagcagatcaacaggacctgttaagcttgcttcaagccaaagtcgcgtccctcacgctgcacaataaagaactgcaggacaaactgcaggcgaaatcacctaaggaagcggaggcagacctgagttttgacagctatcactccactcagaccgacctgggcccatcattgggaaagccaggcgaaacctcacctccagactctaaatcgtcaccatctgtgctaatccacagcctgggaaagtcaacaacagataatgatgtccgaattcagcagctgcaggaaattctccaggatctgcaaaaaaggctcgaaagctcagaggccgagaggaaacagctgcaggttgaattgcagtcccgcagggcagaactcgtgtgtctcaataacaccgaaattagtgagaactccagcgacttatcccagaaactgaaagagacacagtcgaagtacgaagaggcaatgaaagaggtgttgtcagttcagaagcagatgaagctgggattagtgtcccctgaatcaatggacaattactcacactttcacgagttacgcgtcacagaggaggagatcaacgtcctgaaacaagatcttcagaatgcactggaagaaagcgaacgcaacaaagagaaggtccgtgagctggaagagaagttggtcgagagagagaaaggtaccgtgattaagcccccagtggaagaatatgaggagatgaagtcttcctattgcagcgtcattgaaaacatgaacaaggagaaggcatttctgttcgagaaataccaggaggcccaggaggagatcatgaagttgaaggatacactcaagtcgcagatgactcaggaggctagtgacgaggctgaggatatgaaagaagccatgaacagaatgatcgacgaactgaataaacaagtgtcagagctgagccagctatataaagaggctcaggctgagttggaggactaccgtaagagaaagagtttggaggatgtgacagctgagtacattcacaaggccgagcatgagaagttgatgcaactcacaaatgtctctcgcgctaaagccgaggacgctctgtctgagatgaaatcccagtatagcaaagtgttgaacgagctgacccagctcaagcaattggttgacgctcagaaggagaattctgtgagcatcactgagcaccttcaagtgataactactttgcgtactgccgcaaaggagatggaagaaaaaatatcgaacctgaaggaacatctggccagtaaggaggtggaggtggctaagttagagaaacagctgctggaggaaaaggcagcgatgaccgatgctatggtgccccgatcgagttacgaaaaactgcagtcctcactcgaatcagaagtctctgtgttggcaagtaagctcaaggagagtgtgaaagaaaaggagaaggttcacagcgaggttgtgcagatccggtctgaagtgagtcaggttaagcgggaaaaagaaaacatacagacgctcctgaaatccaaagagcaggaagtaaacgagctgctgcagaaattccagcaggcgcaggaggagctggccgagatgaaaaggtacgcggagtcctcttctaaactggaagaagataaggacaagaagatcaacgaaatgagcaaggaggtaaccaagctcaaagaggctcttaatagtttgtctcagttatcttatagtacatcctcttctaagcggcagagtcaacaactggaagcgctccaacagcaggtaaagcagctccagaatcagctggctgagtgtaaaaaacagcaccaggaagtcatttcagtttaccggatgcacctcctctatgctgtgcaggggcagatggacgaagacgtgcagaaggtcctgaaacagatattgacaatgtgtaagaatcagagccagaagaagtag

SEQ ID NO: 238485 - DNA, 2922 bp, Artificial Sequence
  Description of Artificial Sequence: Synthetic coding sequence
atggtcaaaggtaagaccaatgaatggaacaaaaacgacgataggctcttgcaggcagtggaaaatggggatgctgaaaaggtagcgtcactgctgggcaaaaaaggtgcctccgccaccaaacacgatagtgagggtaagaccgccttccatctcgcagccgctaaaggtcatgtggagtgtttaagagttatgatcactcatggggtggatgtgacagcgcaagacaccacaggtcactccgctcttcacctggccgctaagaatagccatcatgaatgtattcggaagttactgcaaagcaagtgccctgccgaaagtgtggattctagcggaaagacggccctgcactatgccgctgcccaggggtgtttgcaggcggtgcagattttgtgtgagcacaaatctcctattaacctcaaagacctggacgggaacatcccactccttcttgccgtacagaacgggcactctgaaatctgtcatttcctgttagaccacggagccgacgtcaattctagaaataaaagcggtcgtaccgcgctcatgcttgcatgtgagatcggaagctctaacgcagtcgaggccctgatcaagaaaggcgcagacctgaatctcgttgactcattgggctacaatgcactgcactatagcaagttaagcgagaacgccggaattcagagcctgctgctcagcaaaatctctcaggatgctgacctgaagacccccactaagcccaagcagcatgatcaggtgtccaagatttcttcagaaaggtcaggcacgcctaaaaaacggaaggctccccctccccctatatcccccacacagctgtctgacgtctcgtcccctaggtcaatcacctcgactcctttgtcaggcaaggaatccgtcttttttgcggaaccgccttttaaagccgaaatcagctctataagggaaaataaagatcggttgtcagattccacgacaggggcagattcattactggacatctcaagcgaggctgatcagcaggatttactgtccttgcttcaagccaaggttgcctcactaacactgcataacaaggaactgcaggacaagctgcaagcgaagtcccctaaagaggctgaagccgatctctcttttgacagctatcatagcactcaaactgacctgggccctagtctaggtaagcctggcgaaacgagcccacccgactccaaatcctctccctctgtcctgattcactctctgggcaaaagtacgactgacaacgatgtgaggatacaacagttgcaggagatcctccaggacctgcaaaagcggctggaaagcagcgaagccgaacgcaaacagctgcaggtggagttacagtctagaagggctgagttagtgtgtctgaacaatacggaaatctcagaaaacagctcagatttgagccagaagttgaaggaaacacagtccaaatacgaagaagccatgaaagaggttcttagtgtccaaaaacagatgaagttgggattggtctcccctgagagcatggataactatagccatttccacgaacttagggtaactgaagaggaaatcaacgttctgaagcaagatctgcaaaatgccctggaggaatctgaaaggaacaaggagaaggttcgcgagctcgaggagaagctggtggagcgtgaaaagggcacagtaatcaagccacccgtggaagaatatgaagaaatgaagtcatcatactgctcggtgatcgagaatatgaataaagagaaagcattccttttcgagaagtatcaggaagctcaggaagagataatgaagttgaaagataccctgaaaagccagatgactcaggaagcttctgacgaggccgaagacatgaaagaggctatgaaccggatgatagacgagctgaacaagcaggtgagtgaactgtctcagctgtataaggaagcccaggccgagttggaggactatcgtaagcgcaagagtctcgaagatgtaactgccgagtacatccacaaggctgagcacgagaagcttatgcaactcactaatgtgtcccgagcaaaagccgaagatgccttgagcgaaatgaagtcgcaatactccaaggtcctgaacgagctgacacagctcaagcagctcgtcgacgcgcagaaggagaactccgtttcaattacggagcatctgcaagtgattacgacacttaggactgccgcaaaggagatggaggagaaaatatctaacctgaaagagcatcttgccagtaaagaggttgaagtggctaagctggagaaacagttacttgaggagaaagcggctatgaccgacgctatggtgccgagaagtagctatgaaaaactacaaagttctctggaatcagaagtctcggtcctcgcctctaagttaaaagagagtgtcaaagagaaagaaaaagttcattcagaggtagttcagatacgaagtgaggtcagccaagttaaacgagaaaaggaaaacattcagactctactgaagagtaaggagcaagaggtgaatgaacttctccagaaatttcagcaggctcaggaagagttggccgaaatgaagcgatatgccgagtcatcctcaaagctcgaggaggacaaggacaagaaaatcaatgagatgtcaaaagaggtcaccaagctgaaagaggccctgaatagtctgagccaactgtcatactccacctcctccagcaagcgacagtcccagcaactggaggcattgcagcagcaggtcaagcaattgcagaatcaattagcggagtgtaagaaacagcaccaagaggttatctcagtgtataggatgcacttattgtacgccgtgcaagggcaaatggacgaggacgtgcagaaagttctcaagcagatcctcacgatgtgtaagaaccagtctcaaaaaaagtag

SEQ ID NO: 238486 - DNA, 2943 bp, Artificial Sequence
  Description of Artificial Sequence: Synthetic coding sequence
atgaagagcttaaaggccaagtttcggaagtcagatacgaacgagtggaacaagaacgatgaccggctgctgcaagccgtcgagaatggagacgcagagaaagtggcctcgctgttggggaaaaagggcgcttctgctacgaaacacgactccgaaggcaaaaccgccttccacctggccgctgcgaagggccacgtcgaatgtttgcgcgtcatgattacacatggggtggatgtgacagcacaggacactacgggccactccgccctgcacctggctgcaaagaatagccaccacgagtgtatccggaaactgctccagagcaagtgcccggcagaaagcgtggacagctcaggtaagaccgcgttgcactacgctgccgctcagggatgtctacaggcagtgcagatcttgtgcgagcacaaatcaccgatcaacctgaaggacttggatggcaatatcccacttctgctggccgtacagaatggacacagcgagatctgccactttctcctggatcacggtgccgacgtgaacagtagaaataagtcagggaggacagcgttgatgctggcctgcgagatcggatctagcaacgctgtcgaagcgctgattaagaaaggtgcagatcttaacttggtagatagccttggctacaatgccctacactactcaaagctgtcagaaaatgccggaattcagtccctgctcttgtccaagatctcacaggatgcagatctgaagacgcccacaaagccaaaacagcacgatcaggtgtctaagattagtagcgagaggagtgggactcccaaaaagcgcaaggctcctccaccgccaatctctccaacccagttgtcagatgtgtcctcaccccgtagtataacaagcactcctctgagcgggaaagaatctgtgttttttgccgaaccaccctttaaagctgagatcagttctattcgcgagaacaaggataggttgagcgactccaccaccggtgcggatagtttactggatatctcaagcgaggccgaccagcaagatctgctctccttgctccaggctaaagtcgcttccctcactcttcataataaagaactgcaagataagctccaggccaaatccccaaaggaagctgaggccgacttgtccttcgactcctaccactcaacccagacagacctcgggcctagtctgggaaagccaggggaaacgtcaccccctgattccaaatctagcccctccgttttgatccactccctgggcaaatccaccaccgataacgatgttcgcattcaacagcttcaagaaatcctccaagatttacagaagcggctggaatcctcagaggccgagaggaagcagctccaagtcgagttgcagagccgcagagccgaattagtgtgcctgaataacactgagatatctgaaaatagtagtgatcttagccagaagctgaaagaaacacagagtaaatacgaggaggctatgaaagaagtgctgagcgtgcagaaacagatgaagctcgggcttgtttccccagaaagcatggacaactactctcatttccacgaactcagagtaactgaggaagagatcaacgtcctcaagcaagatttacaaaacgccctggaagagagtgagcgtaacaaggagaaagtgcgcgagttagaagaaaaattggtggagcgtgaaaagggcacagttatcaaaccgccagtggaggagtatgaagagatgaaatcaagctattgctctgtgattgaaaatatgaataaggagaaggccttcctgtttgagaagtatcaggaggcccaagaggagatcatgaagttgaaagacacgctgaaatcgcagatgacccaagaggcctcagacgaggcagaggatatgaaagaagcaatgaaccggatgatcgacgaactcaataagcaggtgagcgagctgtcccagctgtacaaagaagctcaggctgagttggaggattatcgcaaaaggaaaagcttagaagatgtgacagccgaatatatacataaggccgaacatgagaagctcatgcaactcactaacgtgtcacgcgcaaaggctgaagatgcgctgtccgagatgaagtcgcagtattctaaggttcttaatgagttgacacagctgaagcagctcgttgacgcacagaaagagaattcggtgtcgatcactgagcatttgcaggtgatcacgacgctccgcaccgccgcaaaggaaatggaggaaaaaatttcaaacttaaaagaacatctagcctccaaggaggtggaggtggctaagcttgagaaacaactgttagaggagaaagcggcaatgaccgatgccatggtaccaagatcgtcctatgagaagctccaatcctctctggaaagcgaagtatccgtgttggcgagcaaactcaaagagagtgtaaaggagaaggagaaagtgcattctgaagtggtgcaaatccgtagcgaggtatcacaggtgaaacgggagaaagagaacatacagactctcttaaaaagtaaggaacaggaggtcaacgaactcttacaaaagttccaacaggcgcaagaggaacttgccgaaatgaagcgatacgctgagagtagcagtaagctggaagaagacaaggataagaagattaacgagatgtccaaagaggtcacgaagttgaaagaggcactgaactcgctgagccagctgtcatattctacctctagtagcaagcggcaatcccagcagctggaagctctgcagcaacaggtaaagcaattacagaaccagctggctgaatgtaagaagcagcatcaagaggttattagcgtttataggatgcacctcctgtacgccgtgcagggccagatggatgaggatgttcagaaagttctaaagcagatactgactatgtgtaagaaccagagtcaaaagaagtag

SEQ ID NO: 238487 - DNA, 2943 bp, Artificial Sequence
  Description of Artificial Sequence: Synthetic coding sequence
atgaaaagcttgaaggctaaattccgtaagagtgatacaaacgagtggaataagaatgacgaccggttgctgcaggcggttgagaacggcgatgcagagaaagttgccagtttactcgggaagaaaggtgcaagcgcaacaaaacatgatagtgagggtaagacagcctttcacttggccgctgccaaggggcatgttgaatgtctcagggtgatgatcacgcacggtgtggatgtcaccgctcaggacactaccggacactctgcgctccatctcgcagcaaaaaattcgcatcacgagtgcatcaggaagttgttgcagtctaaatgtcctgcggagtctgttgactcatcggggaaaacggctctccattacgccgctgcccagggatgtcttcaggccgtgcaaatactctgtgagcacaagtctcctattaatcttaaagatctggatgggaacatacccctgctcctcgccgtgcagaacggccattcagaaatctgccatttcctgctcgaccacggagctgatgtgaattctcggaacaagagtgggagaactgccctgatgctggcctgtgaaataggtagtagcaacgcggtggaagctctgattaaaaaaggcgctgacctcaatcttgtggactccctgggatataatgcgctccattactcgaagttatccgagaacgcagggatccaatcgctgcttctatcaaagatcagccaagatgctgacctgaaaactccaacaaagccaaagcagcatgaccaggtttccaaaatttctagcgaaaggagcgggactcccaaaaagaggaaggctccacctccccctattagccccactcagttgagcgacgtcagcagcccgcgatctattacgtcaacccctctgagtggcaaggagagtgtcttcttcgctgagccgccattcaaagctgagatatctagcattcgcgagaacaaagaccgactaagcgacagcaccaccggcgctgattcactgctcgacatcagtagtgaagctgatcagcaggacctactgagtctgctccaagctaaggttgcttctctgaccctccataataaagagcttcaagacaaactgcaagccaaatctcctaaggaggccgaggcggatttgagctttgactcttaccacagtacacagactgacctaggcccttcgctgggcaagcccggagagacttcacccccagactccaagtcttccccctccgtgttaattcacagcttaggaaagtccacgaccgataatgacgtccgtatccagcaactccaggagatcctgcaggatctccaaaaaagactcgaaagttctgaagcagagcgcaagcagctccaagtggagctgcagtcccgaagagccgagctggtgtgcctgaacaataccgaaattagcgagaattcctctgatctttctcaaaaactgaaggagactcaatctaagtacgaagaggcgatgaaggaggtgctttcagtccagaagcagatgaagctcgggttggtgtcgcctgaatcaatggacaattattctcatttccatgagctgcgagtcaccgaagaagagatcaacgtactgaagcaagatttgcaaaacgctctggaagaatcagaaaggaataaagagaaggtgagagagctggaagaaaaactggttgagagagagaaagggactgtgattaagccacctgtggaggagtacgaagaaatgaagagtagctattgttcagtcatcgagaacatgaataaggagaaggcctttctttttgagaaatatcaggaagcgcaagaggaaatcatgaagctaaaggacaccctcaaaagccaaatgacacaggaggcaagtgacgaggcggaagacatgaaagaagccatgaatagaatgattgatgaacttaataaacaggtctcggagttgagtcagctttataaagaggcacaagctgagctggaggattacagaaagagaaagtccctagaggatgtgaccgcggaatacatacataaagctgagcatgagaagctgatgcaactgaccaatgtcagtcgggctaaagcagaggacgctttgtcggagatgaagtcacagtacagtaaagtattaaatgagctgacacaactgaagcagctggtggatgctcagaaagaaaactccgtgagcataacagagcacttgcaagtgattaccacgcttaggactgcggcaaaagagatggaagaaaaaatcagcaatctcaaggaacatttggcctctaaggaggtggaggtagcgaaactggagaagcagcttctcgaagagaaggccgctatgaccgatgccatggtgcccaggtcttcctacgagaaattgcaatctagcctggaatctgaagtgagcgttctggcatctaaattgaaggaaagtgtcaaagaaaaggaaaaagtccatagcgaagtggtgcagatccgatccgaggtatcccaggttaagcgagagaaagagaatattcagacattgctcaagtccaaagagcaagaggtcaatgagctgctgcagaaattccagcaagcacaggaggagcttgccgagatgaaaaggtacgctgaaagcagcagcaagttggaagaggacaaagataagaaaattaacgagatgagtaaggaggtgacaaagctgaaagaggctttaaacagcctatctcaactcagttactctactagctcatctaagcgacagagtcagcagctcgaggccttacagcagcaggtgaaacaactccaaaatcagctggctgagtgtaaaaaacagcaccaggaagttatctccgtctatcgtatgcatttactttacgctgtccaaggtcagatggatgaggatgtgcagaaggtgttgaagcagatcctgacgatgtgtaaaaaccagtcccagaaaaaatag

SEQ ID NO: 238488 - DNA, 345 bp, Artificial Sequence
  Description of Artificial Sequence: Synthetic coding sequence
atgaaatctttaaaggcaaaatttaggaagagcgacacaaacgagtggaacaaaaatgatgatcggcttttgcaggccgttgagaatggggacgccgaaaaggttgccagcctcctggggaagaagggtgcgtccgctacaaagcacgatagcgagggtaagacagcattccatctggccgcagccaaaggccacgtggagtgcttgagggtgatgataacacatggcgtggatgtgacggcacaagacaccactggacactccgctctccacctggcggcaaaaaactctcatcacgagtgtataagaaagcttctacagtcaaagtgtccagccgagagctag

SEQ ID NO: 238489 - DNA, 2919 bp, Artificial Sequence
  Description of Artificial Sequence: Synthetic coding sequence
atggaagccaaaacaaacgaatggaacaagaatgacgaccgtcttctgcaggccgtagagaacggcgatgcggagaaagttgcaagcctactgggaaagaagggtgcaagtgccaccaagcacgatagcgagggcaaaactgcgttccatctggcagccgctaagggccatgtagaatgcttgcgggttatgataactcatggtgtagatgttactgcccaggacaccactggccatagcgcactgcatcttgcagcgaaaaactctcatcacgagtgcatcaggaagcttctccagagcaaatgtcctgctgagtccgtagattcatcagggaaaacagccctgcactatgccgcagcccaggggtgccttcaggccgtgcaaatcctctgcgaacacaaatcaccgattaatctgaaggacctagatgggaacataccactgctgctggctgtgcagaatggtcattctgagatctgtcattttctgctggatcatggggcagatgtcaattctcgcaacaagagtgggcgtacggcactgatgctggcatgtgagatcggaagctctaacgccgtggaagcacttatcaaaaaaggcgcagatctgaatcttgtggactcactagggtataacgctctacactactccaaactctcggaaaacgctgggatacaaagcctcctgttgtctaagataagtcaggacgccgacctgaagacacctacaaagccaaaacagcacgaccaggttagtaagataagtagtgagcggagcggaacaccgaagaagcgcaaggcccctccgccaccaataagccctacccagctgagtgacgtctcatcgccacggagtattaccagcacacctctgagtgggaaggagtctgtttttttcgccgaaccccctttcaaggccgagatcagcagtatccgggaaaataaggatcggctgagcgattctaccactggcgcagactcacttctggacattagcagcgaagcagatcagcaggacttactctcactcctgcaagccaaggtcgccagtctgacgttacacaataaagaactgcaagataaactgcaggctaagtctcccaaagaggctgaagcggatctgtcgttcgactcttatcactctacacaaaccgacttgggaccaagcctgggcaagcccggagaaaccagccctcccgattctaagagttctccgtccgtcctgatacattccttgggtaagagcactacagataatgatgtgagaattcaacagctccaagaaatcttgcaggacctgcagaagcggctcgagtcgagcgaagcggagcgcaagcagttacaggtcgaattacagtccaggagggcagaattggtgtgtctgaataacacagagattagcgaaaatagctccgatctgtcacagaaattaaaagagacgcagtctaagtatgaggaggccatgaaagaagttctgagcgtccagaaacaaatgaagctgggtctggtcagtcccgagtctatggataactactcccactttcatgagctgagagttacagaggaggaaataaacgttctgaaacaggacctgcagaatgcactggaggagtcagagcggaacaaagagaaggtccgggaactcgaggaaaagctagtcgagcgagagaaagggacggtgatcaagcctccggtggaggagtatgaggaaatgaagtcttcctactgctctgtgatcgaaaatatgaacaaggagaaggccttcctcttcgagaagtatcaggaggcacaggaggagattatgaagcttaaggacaccctcaaaagccagatgacacaggaggcctccgacgaagcagaggatatgaaggaggcaatgaatcggatgattgacgaattgaacaagcaagtgtctgagctctcccaattgtacaaagaggcacaggccgagttggaggattacagaaaaaggaagagtctcgaggacgtcacagcagaatacatacataaagctgagcatgaaaaactcatgcagcttaccaatgtgtctcgagcgaaagccgaagatgcactgtctgaaatgaagtcacagtattccaaagtcttgaatgagctgactcagcttaagcagctggtggatgcgcagaaggaaaactcagtgtccatcaccgagcacctgcaggtgatcacaaccctccgcaccgccgcaaaggagatggaagaaaaaatctcaaatttaaaggaacacctcgccagtaaggaggttgaggtagcgaagctcgagaagcagctcctggaggaaaaagcggcaatgactgacgcaatggtgcctcgctcatcttatgaaaagctccaatcctctctggagagtgaagtgtctgtactggcctccaaactgaaggagtctgtgaaggagaaagaaaaagtgcactccgaagtcgtccaaatccgctccgaagtgtctcaggtgaaaagagaaaaggaaaacatacagaccctgctgaaatcaaaagaacaggaggtcaatgaacttttgcaaaagttccagcaagcgcaagaagaactcgctgagatgaagagatacgccgagtcttccagcaagctggaagaggataaagacaagaaaatcaacgaaatgtccaaggaggtcaccaaactcaaggaagcactgaactccctaagccaattgagctattctacctcctcctcaaagaggcagtcacagcaactggaagctctccaacaacaagtcaaacagcttcagaaccagctggccgagtgcaagaagcagcatcaggaagtcatctcggtgtatcgcatgcacctgttatatgcggtgcagggccaaatggacgaggatgtgcagaaggtcctgaagcagatcctgacaatgtgtaaaaatcagtctcagaagaagtag

SEQ ID NO: 238490 - DNA, 378 bp, Artificial Sequence
  Description of Artificial Sequence: Synthetic coding sequence
atgaaaagcctgaaagccaaatttaggaagagcgacacaaatgaatggaacaagaatgatgatcgcctcctccaagctgtggaaaatggggacgccgagaaggttgcatccctactcggaaaaaagggagcctccgccaccaagcacgatagtgagggcaagaccgctttccacctcgcggcagcaaaagggcacgtggaatgcctgagggtgatgattactcatggagtggatgtgactgcccaggacaccaccggacactccgccttacacctggccgctaagaactcccaccacgaatgtattagaaagttgctgcagagtaagtgcccggcagagtcggtggactcgtcgggcaaaaccgctctccactactag

SEQ ID NO: 238491 - DNA, 324 bp, Artificial Sequence
  Description of Artificial Sequence: Synthetic coding sequence
atgaaatctttaaaagctaaattccggaagtcagatacaaacgagtggaataaaaacgacgacaggctgctgcaggccgtggaaaatggcgatgctgaaaaagttgcgtcactcctaggcaagaagggagcttccgctacaaaacatgactctgaggggaagaccgcgtttcacctggcggctgcgaagggccatgtggagtgcctgagagttatgatcacccatggagttgatgtaaccgcacaagatactaccggacatagcgcccttcacttagctgcaaagaactcgcatcatgagtgcattcggaagctactccagtag

SEQ ID NO: 238492 - DNA, 453 bp, Artificial Sequence
  Description of Artificial Sequence: Synthetic coding sequence
atgaaatcgctgaaggctaagtttaggaagtccgacaccaatgagtggaacaagaacgatgaccggttgttacaggctgtcgaaaatggggacgcagaaaaggtggcgagtctactgggcaaaaagggagcttcagccaccaaacacgattctgaaggtaaaactgccttccacctggcagcagccaagggtcacgtggagtgcctgcgcgtgatgatcacacatggcgtcgatgtcacagcccaagacaccactggtcactcagccctgcacttagcggcaaagaactctcaccatgagtgcatacgaaagctgttgcagtctaaatgccccgcagagtccgtagacagctccgggaagaccgccctccactatgccgctgcccaaggctgcctgcaggccgtgcagattctctgcgagcataaatctccgataaatcttaaggacctttag

SEQ ID NO: 238493 - DNA, 381 bp, Artificial Sequence
  Description of Artificial Sequence: Synthetic coding sequence
atgaagagcctcaaggccaagtttcgaaaatccgataccaacgagtggaataaaaatgatgatcggcttctgcaagctgtagaaaacggagatgcagagaaggtcgcctctctgcttggcaaaaaaggcgcttctgctactaaacacgactctgagggcaagactgcattccacctagccgcagctaaagggcatgttgaatgcctcagggtgatgattacacatggagtcgatgttacagcacaagataccacaggacatagtgcgttgcacctggctgccaaaaactcccaccacgagtgcatccgaaagctgcttcagagcaaatgcccagccgaaagcgtagattctagtggcaagaccgctctgcattacgcttag

SEQ ID NO: 238494 - DNA, 315 bp, Artificial Sequence
  Description of Artificial Sequence: Synthetic coding sequence
atgaagagtctgaaagccaaattccggaagagtgacacaaatgagtggaacaaaaacgacgatcgtctcctgcaggccgtcgagaacggagatgctgaaaaggtcgccagcctgctaggaaagaagggggcatccgctaccaagcacgacagtgaaggcaagaccgcgttccacctcgccgctgcgaaggggcacgttgaatgcctgcgcgtcatgataacacatggcgtggatgtgactgcccaggacaccaccgggcactccgccctccacctcgccgcaaagaattcccaccacgaatgcattcggaaatag

SEQ ID NO: 238495 - DNA, 420 bp, Artificial Sequence
  Description of Artificial Sequence: Synthetic coding sequence
atgaagagtctaaaagcgaaattccgcaagtccgatactaacgaatggaataagaatgatgaccggctgctgcaggcggtggaaaatggagatgccgaaaaagttgccagcctgttgggtaaaaagggggcttcagcaacaaagcacgactctgaggggaagacagcgttccacctagctgccgctaaaggtcacgtcgaatgcctacgcgtcatgatcacacatggagtggacgtgaccgcccaggatacaacaggccattccgccctgcacctggctgctaagaactctcaccacgaatgcattagaaagctgttgcaaagcaagtgccctgcagagagcgtggattcaagtggcaagacggcgctccattacgcagctgcacagggctgcctccaggccgtgcagattctctgctag

SEQ ID NO: 238496 - DNA, 381 bp, Artificial Sequence
  Description of Artificial Sequence: Synthetic coding sequence
atgaaatctctgaaggctaaatttcgcaagagcgacaccaatgaatggaataagaacgacgaccgtttacttcaggccgttgaaaacggtgacgcagagaaggtggcaagcctgctgggcaagaaaggcgctagtgccaccaaacacgattccgaagggaaaacagcctttcatctagccgctgcgaaaggccacgtagaatgcctccgagtgatgataacgcacggtgtggatgtgactgcacaagacaccacagggcactccgcgttgcacctggcagcgaagaattcccaccatgagtgcatacgcaaactgttgcaatccaagtgtcccgctgagtcagtggacagttcaggtaagacagccctacattatgcatag

SEQ ID NO: 238497 - DNA, 2952 bp, Artificial Sequence
  Description of Artificial Sequence: Synthetic coding sequence
atgcaaccgacttacttgccctggctttccgccaaggagaaaaagaccaacgaatggaacaaaaatgatgaccgccttttacaggccgtagagaacggagacgcagagaaggtagcctcactcctcgggaaaaaaggtgcttcagccaccaaacacgactcagaaggtaagactgcattccacctggccgcagcgaaaggccacgtggagtgtctgagggtgatgatcacccacggcgtggatgtgaccgcgcaagacaccacggggcacagtgccctccacctagctgccaaaaattctcaccatgaatgtattagaaaactcctgcagtctaagtgtcctgcagagagtgttgacagctctggcaagacagccctccattacgcggcagcgcagggttgcctgcaggccgttcagatcctctgcgagcataaatcccccatcaatctgaaggacctggacggcaacatccctttgctgctggcggtgcagaacggtcactccgagatttgtcacttcctcctcgatcacggggcagacgtgaattcccggaacaagagcgggagaacagccctcatgctagcttgtgaaattgggtcctcgaacgctgtggaagctttaattaagaagggggctgatttgaatctggtcgactcactgggctacaatgccttgcactacagtaagctcagcgagaatgcaggcatacagtcactcctgctatctaaaataagccaggatgcggatctaaaaaccccgactaagccaaaacagcacgaccaggtgagcaagatctcctccgaaagaagcgggacccctaagaaaagaaaagcaccaccccctcctatttcgccaactcaactctcagacgtgtctagtcctagaagtattacctccacacccctctcgggcaaagaaagcgttttcttcgccgagcccccatttaaagcggagatatcatcgattagagaaaacaaagaccgtctttcagatagtaccaccggtgccgactccctcctggacattagctctgaggcagaccagcaggatctgctctcactgcttcaagcaaaggtggctagtctgactttgcacaacaaggaacttcaggataaactccaggctaaaagccccaaggaagccgaggccgatctctcctttgatagttatcactctacccaaacagatctcggtccaagtctagggaagcctggagaaactagccccccagattccaagagttcacccagcgtcctgatacatagcctcggaaagtcaacaactgataatgatgttaggatccagcagctccaagagatattacaggatctccaaaagcgtcttgagagtagtgaggcggaaaggaaacaacttcaggtggaactccaaagccggagggctgaactggtatgtctcaataatacagaaatatctgagaattcctctgacctgtcacagaagttgaaggaaactcagtccaaatacgaggaggccatgaaggaggtgctttcagtgcaaaagcagatgaagctgggactggtatcaccagagagcatggacaactacagtcatttccacgagctccgagtaactgaggaagaaattaatgtgttaaaacaggacttgcagaacgccttagaggaaagtgaacgaaataaggaaaaagttcgggaattagaagaaaagttggtggagcgcgagaagggcaccgttatcaaacctccagtagaggagtacgaagagatgaagagtagctactgttctgttattgaaaatatgaacaaggagaaggctttcctatttgagaagtaccaagaggcacaggaggagatcatgaagctcaaagacacactcaaatcccagatgacccaagaggcctccgatgaggctgaggatatgaaggaggccatgaaccggatgattgacgagttgaacaagcaggtgtctgagctaagccaactgtataaagaggcacaggccgagctggaggattacagaaagcgcaaatctctcgaggatgtgacagcagaatatatccacaaggccgaacacgagaagctgatgcaactaactaacgtgtccagagctaaagctgaagatgccctgtccgagatgaagtcacaatacagtaaagtgctgaacgaattgacacagctgaagcagctcgtcgatgcccagaaggaaaacagtgttagcatcacagagcacctacaagttattacgacactcagaaccgcagctaaggagatggaggagaagattagcaacctgaaggagcacctggcttctaaagaagttgaggtcgctaaacttgagaaacagctcctggaagaaaaggccgctatgaccgatgccatggtgccccgttctagttacgaaaaacttcaatcaagtctcgaatctgaagtgagcgtgctggcgagcaaactgaaggagtctgtgaaggaaaaggaaaaggtacattcagaggtggtgcagatccgttcagaggtttctcaggttaagagggagaaagagaacatacagacactgttgaagagtaaagaacaagaggttaatgagttacttcagaagtttcaacaagcccaggaggagctggctgagatgaaacgctatgcggagtctagcagcaaactcgaagaggacaaggacaaaaagatcaacgaaatgtccaaggaggtcaccaagttaaaggaagccttgaactctctctcccagctgagttatagtaccagctcttccaagcggcaaagccaacagctggaggcgctccagcagcaggtcaaacagctgcaaaaccagctggctgagtgtaaaaagcagcaccaagaggtgattagtgtgtaccgaatgcacctcctttacgccgtgcagggacagatggatgaagacgtgcaaaaggttctcaaacaaatcctgaccatgtgcaagaatcagagccagaagaagtag

SEQ ID NO: 238498 - DNA, 2856 bp, Artificial Sequence
  Description of Artificial Sequence: Synthetic coding sequence
atgaaaagtctcaaagccaagttccgaaagtccgatacaaacgagtggaataagaacgacgatcgcttgctgcaagccgttgagaacggggatgcagaaaaggtcgctagccttcttgggaagaaaggcgcaagcgctaccaaacatgactccgaggggaagaccgctttccacctcgctgctgccaaaggccatgtggagtgcctgagagtgatgatcacacatggagttgacgttacggctcaagacaccaccggtcattccgcactgcacctggctgctaagaacagccatcatgagtgtatcagaaaactgctccaatctaagtgccccgctgagagcgtggatagctcaggtaaaaccgctctccactacgccgcagcccaggggtgcttgcaggcggtccagattctttgtgaacacaaatctcctataaaccttaaagatcttgacggtaatatacccctcctgctggccgtgcagaatgggcactctgagatctgccacttcctgctggaccacggcgcagacgtgaattcacgtaacaagagcggcaggacagccctcatgctcgcttgcgagattggctcgtcgaatgccgtcgaagccctgattaaaaagggcgctgaccttaatctggtggactccctgggatataatgctctccactattctaagctgtccgagaatgcaggcattcagagtctcctgctttcaaagattagccaggatgccgacctgaaaacacccactaaacctaagcagctgagcgacgtgtcctcacccaggagcattacctccacccctctaagcggcaaggaaagcgtgttttttgcagaaccccctttcaaagctgagatcagttctatccgcgaaaacaaggaccgcttgagtgatagcactacaggtgcagactccctccttgacatttccagcgaagctgaccagcaggatcttttgagtctcctccaggcaaaggtggcctcccttactctccataataaagaactgcaggacaaactccaggcgaagagtcccaaagaggctgaagccgatttatcatttgattcttatcacagtactcagacagatctgggaccatctttggggaagccaggggaaacatcccctcctgatagtaagtcttctccttctgttcttattcacagtttggggaagagtaccacagataacgatgttcgtatacagcagctccaagaaatcctgcaggatctgcagaaacgccttgagagtagcgaggccgagagaaagcagttgcaggtggagcttcagagccgcagggctgagctggtgtgcctgaataacaccgaaatcagtgagaactcgagtgatctgagtcagaagcttaaagagacccagagcaagtatgaggaggctatgaaggaagtactttcagttcagaaacaaatgaaactcggcctggtctcccccgagagcatggataactacagccacttccacgagctgcgtgtgacggaggaagaaatcaacgtcctcaaacaggacctccaaaatgcccttgaggaatctgaaaggaacaaggaaaaagtcagggaactcgaagagaaactcgtggagcgcgagaagggaaccgtgattaaaccacccgtagaagagtatgaagaaatgaaaagctcctattgctcagtaatagagaacatgaataaggagaaggcttttttgtttgaaaaatatcaggaggctcaagaggagatcatgaaactgaaggataccctgaaatcacagatgacgcaggaggctagcgacgaggccgaagatatgaaggaggcgatgaaccgtatgatcgacgaactgaataaacaggtgagcgaattgtcccagttgtacaaggaggcacaggcagaattggaagattaccgtaaaagaaagagtctggaggacgtgacagccgagtatattcacaaggcggagcatgagaaactcatgcagctcaccaacgtgagtcgggcaaaggcggaggatgctttgtccgaaatgaaatcccaatacagcaaggtgctgaatgaattgacccagctcaagcagctcgtggatgctcaaaaagagaactcagtgtctattacagagcacctccaggtgatcacaaccctgagaactgccgctaaggagatggaggaaaagatctcaaatctcaaagagcaccttgccagcaaagaggtggaggtcgcaaagctggagaaacaactcctggaagaaaaggctgctatgactgacgcaatggtgcccaggagcagctatgaaaaacttcagtcatcactcgaaagcgaggtatctgtgctagcttctaagctaaaagaatctgtgaaggaaaaagagaaggtgcattccgaggtagtccagatacgctctgaggtctcgcaagtcaaaagagagaaagaaaatatccagacgcttttaaagagcaaggaacaggaagtcaatgagctgctccaaaagttccaacaggcacaggaagaactggccgaaatgaagagatacgcagagtccagctctaaactggaagaagataaggacaagaagataaatgaaatgagcaaggaagtgacgaagttgaaggaagcattgaacagtctgtcacagctgagttatagcactagctcctccaaaagacagagccaacagttagaggcattgcagcagcaggtcaaacagcttcagaaccaactcgccgaatgcaaaaagcagcaccaggaagtgatttccgtctataggatgcacctactgtacgccgtgcagggccagatggatgaggacgtccaaaaggttctgaagcaaatattgaccatgtgtaagaatcaatctcaaaagaaatag

SEQ ID NO: 238499 - DNA, 1593 bp, Artificial Sequence
  Description of Artificial Sequence: Synthetic coding sequence
atggatgacctgcagagtcagaacttatctatggatatgacggactctccacccgctctggccaataaccgactggagaacggtatggcccagttgattaccacagaagcttggaacatcaattccacggacctcgtcaagaaggccctcgttaccgtgccggcaccttctattcttaacccccctgctgaatcccagtccggaatggctctaaaggtggcagccacagtcctgcagccattatgcctgggggaaagtcctgtcgttatgccaattcatatgcaagtcgagggtagcagcgcccctgagcttaacccaaatggaaacgccacatacgtcatgaccactcaggggcctgtgcagctgcctgtggtactggaacagcacgtctttcagcatctaaatagtcccttggtactgccgcaggaagcaccctgttcttcctcaactatacacaacaacctctttcagggggcagaggacccagaggcccagccgcagcttctggacctccggataccaagccagccccaagagcctacactacccttcgaggccgttctgcagaacctgttcccttcacagggcaccctagggcctcctccatgccagccaccccctgggtacgctcccgttcctccgcagcctttttcaagtcctctgtccccccttgtgccccctgcgactttactggtcccctatcccgtgatagttcctctccccgtgcccgtgccaatccctatccccattccaatgcctcagtcctccgagagcaaattcagtagcagttttccgaaacccccttcatcattcggtcttcaccctttcaagggaacacaaactcctctagagaaggacgagctcaaaccctttgacatactgcaacctaaggagtatttccaactgagcagacatacggtgattaagatgggtagcgagaacgaggctttagacttatccatgaagagcgtgccttggttgaaggcaggtgaggtgagtccccctattttccaggaggatgctgcgctcgacctttcggtggccgcacaccgaaagagcgagccgccacctgagactctttatgactctggcgcatcagtggactccagcggccacacagtcatggagaagttaccttcagggatggaaatctcttttgcccctgcgacctcacacgaggcacctgctatgatggattcccacatttcttccagtgacgccgctacagagatgctctctcagcccaatcatccctctggggaggtgaaggccgagaataatatagagatggtaggtgagtctcaggccgctaaggtgatcgtgagcgtagaggacgcggtgcctaccattttctgtggcaaaatcaagggactgtcaggcgtctcaaccaaaaacttctcgttcaaacgggaggactccgttctgcagggttatgacatcaatagccagggcgaggagagcatgggcaacgccgagccactgcggaagccaattaaaaaccgtagtatcaaattaaagaaagttaactcacaagagatccacatgctgcctatcaagaagcagcgacttgccaccttttttcctcgaaagtag

SEQ ID NO: 238500 - DNA, 1593 bp, Artificial Sequence
  Description of Artificial Sequence: Synthetic coding sequence
atggatgacctgcagagccagaacctgagcatggatatgactgatagtccaccggctttggccaacaatcgcctggagaatggaatggcacagctgataaccaccgaggcatggaatattaatagcaccgacttggttaaaaaagctctggtaactgtccctgccccaagcatcctgaaccctccagccgagagccagagcggaatggcccttaaggtggcagctaccgttcttcaaccgctttgcctcggagagtcaccggtggtaatgccaattcacatgcaggttgaaggctcctcagctcccgagttgaatcccaatggcaatgcaacctacgttatgaccacgcagggacctgtgcagttgcctgttgttctggagcagcatgttttccagcacctcaattctcctcttgtcctgcctcaggaggccccatgtagctctagcacaatccacaacaatctttttcaaggcgctgaggaccctgaggcacagccacagctgctggacctgcggattccatctcagccccaggaacccacgctcccattcgaggcagtgctccagaatttattcccttctcagggaactctgggtccacccccatgccagccaccaccgggatatgctcccgttccgcctcagcccttcagttcccccctgtcccctctggtgcctccagcaaccctgctggtcccatatcctgtcatcgtaccattgccagtgccagtgccgattcccattcccattcctatgccccaaagtagcgagtcgaagtttagttccagttttccaaagcctccctcaagtttcggactacaccccttcaaaggaacccagacacctctagaaaaggacgaactgaagccatttgatattcttcagccaaaagagtacttccagttgtcccgtcatactgtgattaaaatggggtccgaaaacgaggcacttgatctatccatgaagtctgtgccctggctgaaggcaggtgaagtctcccccccaatcttccaggaagacgcggcactggatttgagcgtcgccgctcatcgcaagagcgaacctccccctgagaccctctatgactccggtgcatctgtggactcgagtgggcacaccgtcatggagaaattgccttccggcatggaaattagcttcgcgcctgccaccagtcatgaggcacctgctatgatggattcacacatttcctcttccgacgctgcaaccgagatgctgtctcaacctaatcatcccagcggagaggtgaaagcagagaataacattgagatggttggcgaatctcaggccgctaaggtgattgtttcagtcgaggatgcagttccaacaattttctgtggaaaaatcaagggcctttcgggggtgtcgaccaaaaacttctccttcaaaagggaggatagcgtgctgcagggatacgatattaacagtcagggtgaggagtcaatgggcaacgcagagcccctgcgtaagcctatcaaaaaccgctccatcaagttaaaaaaggtgaattctcaggaaatacacatgttgccgattaagaagcagcgccttgcaacctttttcccaaggaaatag

SEQ ID NO: 238501 - DNA, 1443 bp, Artificial Sequence
  Description of Artificial Sequence: Synthetic coding sequence
atggatgatctccaatctcagaatctgtcaatggatatgacagactctcccccagcactggcaaacaatcggctagaaaacgggatggcacaactcataaccaccgaagcatggaacatcaatagcacagacttagtggagggaagttctgctcccgaactcaacccaaatgggaacgccacctatgtaatgaccactcagggccctgtgcagcttccagtagttcttgaacagcacgtgtttcagcatctgaatagtcccctggttctaccacaggaagccccatgcagctctagcactattcataataacctgttccagggggcagaagaccctgaggcccagccccaactgctggatctccggatcccaagccagccgcaggaacctacgctaccttttgaggccgttctgcagaacctctttccttcccaagggacgcttggccctccaccctgccagccccctccagggtatgcccctgtgccaccccaaccctttagctcccctctttctccacttgttcctcccgcaactctgttggtcccatacccagtcattgtgccactgccggtgcccgttccaattccaatcccgatccccatgcctcagtcatctgagagcaagttcagctcgagcttccccaaaccaccctcctcattcggcctccatccttttaaaggaacccagacccccttagagaaggacgaactgaagcccttcgatattctgcagcctaaggagtattttcagcttagtaggcatacggtgatcaaaatgggaagtgaaaatgaagccctggatctgagcatgaagtccgtcccttggctaaaggccggtgaggttagccctcctatttttcaggaagatgcagcactggacctgtcagtggccgctcacaggaagtccgaacctccccctgaaaccctatatgacagcggggctagcgtggactctagtggtcacacggttatggagaagctgccatccggcatggagatctcgtttgcacctgccaccagccatgaagctcctgccatgatggattcccatataagctcttccgacgccgctactgaaatgctgtcacagcctaaccatccatcgggcgaagtcaaggccgaaaacaacatcgagatggtaggcgagtcccaggctgccaaagttatagtgtcagttgaagatgccgtgcccaccatcttttgcgggaaaattaagggactgtccggtgtgtcaactaagaacttctcctttaagcgggaagattctgtgctgcagggatacgatatcaacagccagggcgaagaatctatgggtaatgcggaacccttgcgaaaaccgatcaagaacaggagtatcaagctcaagaaagtcaatagtcaggagatacacatgcttcctatcaaaaaacaacggctggcaacattttttcccaggaaatag

SEQ ID NO: 238502 - DNA, 1593 bp, Artificial Sequence
  Description of Artificial Sequence: Synthetic coding sequence
atggatgaccttcaaagccaaaatctctccatggacatgacggactccccccctgccttggctaataaccgcttagagaacggcatggcccagctcatcactacagaagcctggaacattaacagcaccgacctagtgaagaaggcactggtcaccgtgcctgccccatctatattaaatccacccgctgagtcgcaaagtggcatggctttaaaggttgcagcgactgttctacagcccctgtgcctgggggaatctccggtggtgatgccaattcacatgcaagtggagggcagttctgcacctgaacttaatcccaacggcaatgccacatatgtaatgacaacccaggggcctgtgcagttgcccgtggttctggaacagcacgtgttccagcacctcaactctccactcgtccttcctcaggaggcaccgtgttcatcctcaactatccacaataatctgttccaaggtgcagaggaccccgaagcccagcctcagctgcttgacctccgaatccctagtcagccccaggaacctacactacccttcgaagctgtattgcaaaatctgttccctagccagggtaccctgggtcccccaccttgccagccacctccagggtatgctcccgtccccccacagccctttagctcccccctgtcccccctcgtccccccagcgacactgctggtaccgtacccggtcatagtgcctctgccagtccctgtccccattccgattcccattcccatgccccagtcctcggagtccaaattcagttccagttttcctaaacctcccagttcctttggtcttcatccctttaagggcacacagacaccacttgagaaagacgagctaaagccctttgatatcttgcagcctaaagaatacttccaactcagtcgccataccgtgattaagatgggctctgagaatgaggcacttgatcttagtatgaagtctgtgccgtggctgaaggctggggaagtttctcccccaatcttccaggaggacgccgcactggatctgtcagtggctgctcaccggaagagcgaaccccctcctgaaactttgtacgacagcggcgcaagcgtcgactcgtccggtcacacagttatggaaaagctaccatctggaatggagatcagctttgccccagccaccagccacgaagccccagcgatgatggattctcacataagtagcagcgatgccgcaaccgaaatgctcagtcaacctaatcacccctcaggagaagttaaggccgagaacaacattgagatggttggagaatctcaggcagcaaaggttatcgtctcagtcgaggacgccgttcccaccatattttgcggaaaaatcaaagggctaagcggtgtgtcaaccaagaatttttcgttcaaaagagaggactcagttctacagggatatgacataaactcacagggggaggaatctatgggtaacgcagaacctctgcggaaaccgataaaaaatcgctcaataaagctcaagaaagtgaactcccaggaaattcacatgctgccgatcaagaaacaaagacttgcaaccttcttcccacggaagtag

SEQ ID NO: 238503 - DNA, 1593 bp, Artificial Sequence
  Description of Artificial Sequence: Synthetic coding sequence
atggacgatcttcagtcacagaacctctcaatggacatgacagactcgccacccgctttagccaacaataggcttgagaacggtatggcacagctgattaccacagaggcctggaacattaacagtactgatctggtgaagaaagctctcgtgaccgtgcccgctccaagcatcttgaatcccccagctgagtctcaatccggtatggcccttaaggttgcagcgaccgttctgcagcctctttgcctcggcgaatcgcccgtggtcatgcctattcacatgcaagtggagggttcttcggcaccagagctaaatccaaatgggaacgctacttatgtcatgacaactcagggcccagtgcaactgccagtcgttctcgagcagcacgtgtttcagcacttaaatagccccctcgtgctcccccaggaagcaccctgctccagcagcacgatccacaataatcttttccagggtgcagaagatccagaggcacagccacagttactggacttaagaatcccctcccagccccaagagcccactctgccgtttgaggccgtgctgcagaacctgttcccttctcagggcactcttggaccacctccatgtcaacctccgcctggatacgccccagtgccccctcagcccttttcaagtcccttgtctcccctggtgccaccagcaacgctgctggtgccttaccccgtgatcgtgccactaccagtccctgttccaattcctattccaatccccatgccccaaagtagcgagtccaaattctcttccagcttcccaaagccccctagcagcttcggcttacacccatttaagggcacccagacacctcttgagaaggatgagttaaaaccattcgatatacttcagcctaaagaatattttcaactgtctagacacactgtaattaaaatggggtcagagaacgaggccctggatctttctatgaaatctgtgccatggctaaaggccggagaagtcagcccccctattttccaggaggatgccgctctggacctctccgtggcagctcatcgcaagtcagaaccacctcccgagaccctgtacgactcgggtgcctcagtagacagttccggccatacagtaatggagaagctgccttcaggaatggaaatcagcttcgccccagccacgtcacacgaagcaccagccatgatggattctcacatcagcagttccgatgctgccacagaaatgctgagtcagcccaatcacccctccggtgaagtgaaggccgagaataacatcgaaatggtcggagagtctcaggctgcaaaggtgattgtctcagttgaggacgccgtccctacaattttctgcggcaagatcaaggggctgtctggagtcagtacaaaaaatttttctttcaagcgcgaggatagcgtcttgcagggctacgacatcaatagccaaggggaggagtccatgggtaatgccgagccgctgcggaaacccattaaaaatcgctctataaaacttaagaaagtgaacagccaggagattcacatgcttcctatcaaaaagcaaagactagcgacattctttcctcgaaagtag

SEQ ID NO: 238504 - DNA, 885 bp, Artificial Sequence
  Description of Artificial Sequence: Synthetic coding sequence
atgcagcctcggaggcagcgtctgcccgcaccctggtccggtccgagaggacctagaccgactgctcccctgctggcgcttctgctgttgctcgcacccgtggcagcccctgctggatctggggatccagacgacccaggtcagccccaggatgccggtgtccccaggcgcctcctgcagcaagccgctagagccgcactacatttttttaactttaggtcaggctcgccatcggccctgagggtccttgcggaagtgcaggagggtagagcctggattaacccgaaagagggatgcaaggtgcacgttgtgtttagtacggagaggtataatcctgagtctcttctgcaggagggagaggggagactggggaagtgctctgctcgcgttttttttaagaatcagaagccaaggcctactatcaatgtcacttgcaccagactgatcgaaaagaagaagcggcagcaagaagattacctgctgtataagcagatgaagcagttaaagaaccccctcgagattgtgagcatccccgataaccacggccatatcgacccctccctgcgcctgatctgggatctagccttcctggggagctcctacgtgatgtgggaaatgactactcaagtgtcccactactacttagcccagctaacctcagtgcggcagtggaagacaaatgatgacaccattgacttcgactacactgtgttactacatgaactttcaacccaagaaattattccatgtcgcatccaccttgtgtggtacccaggcaagccactaaaggttaaatatcattgccaggagctccaaacaccagaggaggcgtccggtactgaagagggctccgctgtcgttcctaccgaattatccaacttttag

SEQ ID NO: 238505 - DNA, 687 bp, Artificial Sequence
  Description of Artificial Sequence: Synthetic coding sequence
atgcaaccacggagacagaggctgcccgctccctggagtggaccaagagggcctaggcctaccgccccacttctagccctgcttctgctgctggccccagtcgcagcaccggcaggatccggcgaccctgacgatcccggacaaccccaagatgccggagtccctcggagacttcttcagcaggccgctcgtgccgcactgcattttttcaatttcaggagtggatcaccctcggcgttgcgagtgttggctgaagtacaagaaggcagagcttggatcaaccccaaggaggggtgtaaagtgcacgtagtcttcagcacagaacggtacaatccggaatctcttctgcaggaaggggaaggcaggttgggcaagtgtagcgccagggtcttctttaaaaatcagaaacctaggccaacaataaacgtcacgtgcactcgcttgatcgaaaagaaaaagagacaacaggaggactacttgctttacaagcagatgaagcaattaaagaaccctttagagatcgtatcaattcccgataatcatgggcatatcgaccccagtctccgcttgatttgggatctggctttcctgggaagttcatacgtcatgtgggaaatgaccacgcaggtctctcactactacctggcgcagctgaccagcgtgaggcagtgggtgaggaagacctag

SEQ ID NO: 238506 - DNA, 1008 bp, Artificial Sequence
  Description of Artificial Sequence: Synthetic coding sequence
atggtccgccgtgatcggctgcgcaggatgagggagtggtgggtgcaggtaggcttactggccgtccctttgcttgcagcttacctgcacattccaccaccccagctctcaccagccctgcacagctggaagtctagcggcaagttcttcacgtacaaaggcttaagaattttttatcaggattcagtgggcgtggtaggatccccagagatcgtcgttctgctgcacggatttcctacatcgtcttatgactggtacaagatttgggaaggactgaccttgaggttccatagagtgattgctttagactttctggggttcggcttttccgacaagccccgtcctcaccactatagcatattcgagcaggcctctattgtcgaagcactcctaagacatcttggtctacagaataggcgaataaatttgctgtcgcatgactacggcgatattgtcgcccaggaattactctatagatacaagcagaatcggtcagggagactgacaattaagagcctctgcttaagcaatggcggaatcttccccgaaacccaccggcctctactattacagaagttgctcaaagacggcggtgttctcagccccattctcacccggctgatgaacttcttcgtgtttagcaggggactgacacccgtgtttgggccatacactaggccaagcgaatctgaactttgggacatgtgggccggtattcggaacaatgatggcaacctggtcattgattctctgttgcagtacatcaatcaaaggaagaagttccgccgaagatgggtgggagctctggcgagcgtgaccatccccatccatttcatctacggccctcttgaccccgtgaacccatatccggagtttctcgagctgtatcggaagaccctgccgcgatcaacggtttccattctggacgatcacattagtcattatcctcagctggaggatccaatgggcttcttaaacgcgtatatgggcttcattaatagcttttag

SEQ ID NO: 238507 - DNA, 492 bp, Artificial Sequence
  Description of Artificial Sequence: Synthetic coding sequence
atgcggaggctgctgattccactggcactgtggctaggcgctgtgggcgtcggcgtggccgaactaacagaggcccagcgtagaggactgcaggtcgccctggaggaattccacaaacaccccccagttcagtgggcctttcaggagacatcagttgagtctgccgtggacacgccctttcctgccggaatcttcgttaggttggaattcaagctgcagcaaactagctgccgaaagagagattggaaaaagcccgagtgtaaagtcagacccaatgggaggaagagaaaatgtctggcgtgcataaaattaggcagtgaggacaaagtgctgggccgactcgtccactgcccaattgaaacccaggtactaagagaggcagaggagcaccaggagactcagtgtctgcgggtgcagcgagccggagaggacccacattccttttacttcccaggacagttcgcattctcaaaagcgctgccacgttcttag

SEQ ID NO: 238508 - DNA, 492 bp, Artificial Sequence
  Description of Artificial Sequence: Synthetic coding sequence
atgaggcggctccttatcccattagccctatggctgggtgctgtgggtgtcggcgtagccgaactgacagaggctcagaggcggggactgcaggttgccctcgaagagttccataagcaccctcctgtccagtgggcgttccaagagactagtgtggagtcagccgtcgataccccttttcccgcaggaatcttcgtaagattggagtttaagctccagcagacttcttgcaggaaacgcgactggaagaagcccgagtgtaaggtacggccaaacggtcgtaagagaaaatgcctcgcctgtatcaagcttgggtctgaggataaggtgctcggcagactggtgcattgtccaatcgaaacacaagtgctgcgcgaggctgaggagcaccaagagacacagtgcctacgagtgcagagagccggagaggatcctcatagcttctactttccaggacaattcgcattctccaaggccctcccgaggagttag

SEQ ID NO: 238509 - DNA, 495 bp, Artificial Sequence
  Description of Artificial Sequence: Synthetic coding sequence
atggcctctccgcaccaggagccaaagccaggtgacttaatcgaaattttcaggctggggtacgaacattgggccctttatatcggggatggatatgtgatacacctagcccctcccagcgagtatcctggcgctggaagctcgagtgtatttagcgtgctgtctaattcagcagaagttaaaagggaaagactggaggatgttgttgggggatgctgctatcgcgtcaataattccctcgatcacgagtatcagccccgtcctgtggaagtcatcattagctccgcaaaggagatggtggggcagaagatgaaatatagcattgtgtccagaaactgtgaacatttcgtaacccaactccgctatggcaaatccagatgtaagcaggtcgaaaaggccaaggtggaagtaggtgtcgcaacagccctgggcattctggttgtcgctggatgttcgttcgccatccgccgttatcagaaaaaggccacggcgtag

SEQ ID NO: 238510 - DNA, 495 bp, Artificial Sequence
  Description of Artificial Sequence: Synthetic coding sequence
atggggctcccagagcctaagcccaagccaggcgacctgatcgaaatcttcagactagggtacgaacactgggcactatacatcggcgacggctacgtgatccatctggccccaccttctgagtatccaggagccggtagcagttctgtgttcagcgtgttatcaaactctgcagaggtaaagagagagaggctcgaggacgttgtgggcggatgctgctatcgggtcaacaactcgctcgatcatgagtatcagcctcgccctgttgaggttatcatttctagcgctaaagagatggtgggtcagaaaatgaagtattctattgtatcacggaattgcgaacactttgtcacccagttgagatacgggaaaagccggtgcaaacaggtggagaaggctaaggttgaggtcggcgtggccactgcgctaggaatcctggttgtcgctggttgctccttcgccatacggagataccaaaaaaaagccactgcttag

SEQ ID NO: 238511 - DNA, 1389 bp, Artificial Sequence
  Description of Artificial Sequence: Synthetic coding sequence
atggcttcaaatagcagcagctgtcctacacctgggggtgggcatctgaacggttacccggtgccgccttacgcctttttctttcctcccatgttgggaggacttagcccacccggagctctgactacactccagcaccagcttccagtgagcggatactccacaccctcaccagccactatcgagactcagtcctcctcctccgaggagatcgttccctcccctccatctccgccacctctccctcgtatatacaaaccctgtttcgtctgccaggataagtcttctggatatcactacggggtgagcgcctgtgaggggtgcaaaggattcttccgccgatcaatacaaaagaatatggtatacacttgccatcgggataaaaattgcatcattaataaggtcacccggaatcgatgccagtattgtcgactgcagaaatgcttcgaggtggggatgtctaaagagagcgttcgcaatgacagaaacaagaagaagaaggaagttcctaaacccgagtgctccgagagttacactttaactcctgaagtgggcgaacttattgagaaagtgaggaaggcccaccaggagaccttcccagcgttgtgccagctgggaaaatacacaaccaacaattcatccgagcagcgcgtttccctagatattgatctctgggataaatttagtgagctgtcaactaagtgcataatcaaaactgttgagttcgctaaacaacttccgggtttcaccaccctgactatcgccgatcagatcaccctcttgaaagcagcttgtttagacatcctgatcctcaggatatgtacccggtatacacccgaacaggataccatgacattttcagacggtctgacgctgaacaggacacagatgcacaatgcaggttttggacccctgaccgacctggtttttgccttcgccaatcagctgctgcctctagagatggatgacgcagagaccgggctgttgtccgctatatgcctcatttgtggagatcggcaggacctggagcaacccgatcgggtcgatatgctgcaggaacccctgctagaggctctcaaggtgtacgtgcggaagcgcaggcctagcaggccccatatgttcccaaagatgctgatgaagataaccgacttgcggtcgatttccgccaaaggggctgaacgagtcattactctgaaaatggagatccctgggtcaatgccccctttgatccaggagatgctcgagaattctgaaggcctggacactctatctggacagcccggaggcggtggacgagacggcggagggctagctccaccccctgggagttgtagtccttccttgtcgccgagtagcaatcgctcctccccggcaacgcattcaccttag

SEQ ID NO: 238512 - DNA, 1902 bp, Artificial Sequence
  Description of Artificial Sequence: Synthetic coding sequence
atgtacgagtcggtggaggtgggagggcctacacccaacccattcctcgtggtggacttttataatcagaaccgcgcttgcctcctccccgagaagggactgccggctcctgggccttactccacgcccctgaggacccctctttggaacggaagtaatcactctatcgagacccagtcctcctcttccgaagagatcgtgccttcacctcctagtccacctcccctgcccaggatttataagccctgttttgtctgccaagacaaatcaagcgggtatcactacggagtaagcgcttgcgagggttgtaagggattttttaggcgatcgatccaaaaaaacatggtgtacacctgccacagggacaaaaattgtataataaacaaagtaactcggaacaggtgtcaatactgtcgcttgcaaaaatgcttcgaggtgggcatgagtaaggaatcagtgcgtaatgaccggaacaagaaaaaaaaggaggtgccaaagccagagtgcagcgagtcttataccctgacgccggaggtgggagaattgatagaatgcgccaaaagaaccagaaaaccatctctgccttcagcatcttgggcaaataccctgcgaaccacagctcagaacaacgttagcctgtggaccctgacaagtggcacctcatcggtgaatagccctaagtgtatcattaagacagtcgagttcgccaagcaactgcccggattcacaactctcaccatagccgatcagattaccctgttgaaagcagcatgtctagatatcctgatcctgaggatatgcacacgctatactccagagcaggataccatgacattctccgatggtcttactctcaatagaactcagatgcacaatgccggatttggccctcttacggatctggttttcgcattcgcgaatcagcttctgcccctggagatggacgatgccgaaacgggcctcctcagcgccatatgcctgatctgtggggaccgacaggacttggaacagccggatcgagtcgacatgcttcaggagcctctgcttgaagccctaaaagtctatgtgcggaagcggaggccctcaagaccacacatgttccccaagatgctaatgaaaatcactgatctgagaagcatttcggccaaaggagccgaacgcgtgataactctaaaaatggaaatccccggttcaatgcccccattgattcaggagatgctcgagaattctgaaggactggatactctgtctggccagcccggtggaggaggacgagacggagggggacttccgaggcaggctgcggtggcaccagccagcgcacctgccccaaccgaggcggcaaggcctcctaccccccgtgacagacccaggcacatggatacagcgctagcgctcagacccggtttcagcctgcctttctatagaccctgcgaccctgcaccagctctacccccacctgcgttgccgggaagtaccggagacttaccttggggtactggccgagaagaagcggcaacaccttggacggaggcctgggccctgtctggccttccagctccaacagcgtgggccgacgtgcgcggtcggggacaagaactgtccgaagctcccggtccgggaagccaggatggatcctggggaccgagggtgcatcaagacacacctctgcccagctcaccacacctgcaccaccagcaaactcctggcttggggtcaccgatcttgagaacacataaacctttgcttccatcatggggcaccagcaccagtcccctgccccgacttgtgacggagggggtgggccaggggagaggggtaccacctgttcataccctcccttaccagcctcaggtacttatcctcgcaggcttcgtgttcatcttaatcttcctcttctag

SEQ ID NO: 238513 - DNA, 1374 bp, Artificial Sequence
  Description of Artificial Sequence: Synthetic coding sequence
atgtatgagtcagttgaggtgggcggacccacaccgaacccatttctggtggtggatttttataaccagaacagagcttgcttgctgccggagaaggggctccccgctccaggtccttattctacaccactgagaacacccctttggaacggatccaaccactccatcgagacacagtcctccagcagcgaagagatcgtgccgtcaccgccaagtccacccccattacctcgcatctacaagccctgtttcgtatgtcaagataaaagctctggctaccattacggagtttctgcatgcgaaggctgtaaagggtttttccgcaggtccatccagaaaaacatggtgtacacatgccaccgggacaaaaactgcattataaataaggtgaccaggaaccggtgccagtactgccgtctgcaaaaatgtttcgaggtgggaatgtctaaggagagcgttcgcaatgataggaataaaaagaagaaagaggtacctaaacccgaatgtagcgagtcctatacactcactccggaagtgggcgagctcatcgagaaggtgcgaaaggcgcaccaagagacgtttcctgctctgtgtcaattaggaaaatacactacaaacaatagctctgaacaacgcgtgtctctagatattgacctttgggacaaatttagtgaactgtcaaccaagtgcattatcaaaaccgtggagttcgcaaagcaactgccaggcttcaccacattaaccattgccgatcagattacactccttaaagccgcttgcttagatatacttattctgaggatctgcacacgttatacccctgagcaagatacaatgaccttcagcgacgggctgactctcaacaggacccagatgcacaatgcaggctttgggcctctgacggacctagtgtttgccttcgctaatcagttgctcccattggagatggacgacgcagagaccggacttctgtccgcaatttgcctgatctgcggcgaccgacaggacttagaacagccagaccgggtcgacatgctgcaagagccattactagaggcgctcaaggtttatgtgaggaaacgcagaccgtcccgacctcacatgttccctaaaatgctgatgaaaatcaccgatctgcggtccatatcggcaaaaggagccgaaagagtcatcactcttaagatggagattcccggttctatgccacccctgatacaggaaatgttagagaattccgagggtctcgatacactcagtggtcagccaggcggtgggggacgtgatgggggaggcctcgctccaccccctgggagttgctcaccatccctgtctccttcgagcaaccgtagtagtcctgccactcatagcccttag

SEQ ID NO: 238514 - DNA, 1437 bp, Artificial Sequence
  Description of Artificial Sequence: Synthetic coding sequence
atgatgagtcagactatgacacaggctggagtgagctttcggcactcagtaagagctgcccagtgccatactcgggtgcccaacacatggcctcgcgctactcgcccatacgcatcatgcaggcggagtccgaggcttcgcggaagatggccgggaagtgctgggcagggtgccggaggtcgggctcccagagccggatggcgggctggggacgtgacagggtccgccatagaaacacagtcgagttcaagtgaagaaatcgtgcccagccctccatcccccccaccactgcccaggatctataaaccctgctttgtctgtcaggacaagtcctcaggttaccactacggggtgtccgcgtgcgagggctgcaagggattcttccggaggtcaatccagaagaatatggtttatacctgccatcgcgataagaactgtatcataaacaaggtcactaggaatcgatgtcagtattgccgtttacaaaaatgttttgaggtgggaatgtcaaaggagagcgtccggaacgaccggaacaagaaaaagaaggaggtgcccaagccggagtgctccgaatcctataccctgacaccggaagtgggcgaactcatcgaaaaggtgcggaaagcccaccaagagacctttccggctttgtgccaattgggtaagtacaccacaaacaattcttccgaacagagagtgagtctggacattgatctctgggacaagttcagtgagttgtctacgaaatgcattattaaaactgtggaatttgctaagcagctgcccggttttactacattgactatcgcagaccaaattaccctgttgaaggcagcctgtttggacatactgattctgcggatttgcactcgatatactcccgagcaggatacaatgaccttttcagatggcctcaccctgaatcgcacccagatgcacaatgccggatttggccctctgactgacctggtgttcgcctttgccaaccagctgctgccactagaaatggatgatgcagaaactggcctgctgtccgctatctgccttatttgcggagatcgccaggacttggagcagcctgatcgggtcgatatgcttcaggaaccgttacttgaagccttgaaagtgtatgtgaggaagcgacggcctagccggcctcacatgttcccgaaaatgctcatgaagatcactgatctgcgcagcatctcagctaagggagccgagcgggttatcactctaaaaatggaaattcctggatccatgccaccgcttatccaggagatgctggagaattcagaggggctggatacactctcagggcagccaggagggggtggaagagatgggggtggcttagcaccaccgcctgggagctgcagccctagtctatctccatcttctaaccgtagctctcccgcaacacacagtccttag

SEQ ID NO: 238515 - DNA, 1389 bp, Artificial Sequence
  Description of Artificial Sequence: Synthetic coding sequence
atggccagcaattcttccagctgccccactccaggaggcggtcacctgaacggatatcccgtccccccatacgcgttcttcttcccacctatgctgggcggactgtcccctcccggtgcgctaacaaccctgcagcaccagcttccagtgtctggttactccaccccatcacctgccactattgaaactcagtcttcgagcagcgaggagatcgtgcctagtcctccaagtccacccccactgcccaggatctataagccatgttttgtgtgccaggacaaatcatccggctaccattatggagtgtccgcttgtgagggctgtaagggtttcttcaggagaagcattcagaaaaatatggtctatacatgccatagagacaagaattgtatcataaataaagttactcgcaatcggtgtcagtattgccgcctgcagaaatgcttcgaagtcgggatgagcaaggagtcagtccgaaatgatcgaaataagaagaagaaagaagtgccaaagccagagtgctcagagtcctacaccctgacccccgaggtgggtgagctaatcgaaaaggtgcgtaaagcgcaccaggaaacctttcctgcattatgtcaactggggaagtacacaactaacaactcctccgagcagcgcgtgagtcttgatattgacctatgggacaagtttagcgagctgtccaccaagtgtattatcaagaccgtagagttcgcaaaacagctccccggtttcacaacactcaccatcgccgaccagatcacactgcttaaagccgcatgcctggatatattgatcttacgcatctgtactcggtatacgcctgagcaggatactatgactttttctgacggactgaccctgaatcggacccagatgcataatgcaggctttggtccacttaccgacctggtgttcgcgtttgccaatcagctgctgcctcttgagatggatgacgcagaaaccgggcttctgagcgcaatttgcctgatatgcggagacaggcaggacctggaacagcccgacagagtggatatgctccaggaaccattgttagaggctctcaaagtgtacgtccggaaaaggcgcccttccagacctcatatgttccctaaaatgctcatgaagataaccgatttgcggtcaatttcagctaagggagccgagagagtaatcactcttaaaatggagattcccggatccatgcccccattaatccaggaaatgttggagaacagtgagggactggatacacttagcggccagcccggtggaggagggcgtgatggagggggtcttgcgcctccccctggtagctgctcaccatcactgtctccaagctcaaatcgttccagtccagccacccattccccatag

SEQ ID NO: 238516 - DNA, 1041 bp, Artificial Sequence
  Description of Artificial Sequence: Synthetic coding sequence
atgggtcaagagatccttcccgcacgatctcccaccctgcggcttggctcgcctaccccccacctgcctcaggaactactgcgcgcatccccaaagggacccccaggacggttacaactgggagggctggctgtgcgtaatgaccgtaataaaaaaaaaaaggaggtgcccaagccagaatgctccgagagttacacccttaccccagaggttggagaactgatagaaaaggtccgaaaggcccaccaagagaccttccccgctctgtgtcagttaggcaagtataccaccaataactcatcagaacagcgagtcagcctggacatcgatctgtgggacaaattctcggagctgagcaccaaatgcatcattaagaccgtggagtttgcaaagcagttgccagggtttaccactctgactattgccgatcagatcacgttattgaaggcagcgtgcttagacatcctgattttgaggatttgcacacgttacactcccgaacaggacacgatgactttctccgatggattgactctaaatcggacacagatgcataatgccggatttggccctcttacagatcttgtgttcgcttttgccaatcagctgctcccacttgagatggacgatgcagagaccggtcttttaagcgccatctgtctgatttgcggcgaccggcaggatctggagcagccggaccgggtcgacatgctacaggagccactgttggaggccctgaaggtctacgtacgaaaacgtagaccctctcgcccacatatgttccccaaaatgttaatgaaaatcaccgacttgaggagcatatccgctaaaggtgcggagagggtcattaccctgaaaatggaaatcccgggaagcatgccaccactaattcaggagatgctggagaacagtgaaggtctggatacattatcaggacagccaggcggaggaggcagagatggaggtggactcgcgccaccacccggaagctgtagtccctccctgtccccttcatccaatagatccagtcccgctacttag

SEQ ID NO: 238517 - DNA, 1098 bp, Artificial Sequence
  Description of Artificial Sequence: Synthetic coding sequence
atggcctctaattcctcctcttgtcctacaccaggtgggggtcacttaaacggatacccagtgcccccttatgcatttttttttcctccaatgttggggggtctgagtcccccaggagcattgaccactttgcagcatcagctgcccgtttctgggtactccactccttctccagctaccgtgaggaatgatagaaataagaagaaaaaggaagtgcctaagcctgaatgctcagagagctacactctgacacctgaagtgggtgaactgatagagaaagtcagaaaagctcaccaggagacatttcctgctctgtgccagctgggtaagtatactacgaataactcaagcgagcaacgcgtgtctttggatatcgacctctgggataagttttccgagctcagtaccaaatgtattataaagactgtggagtttgcaaaacagttgcctgggttcactaccctgactattgcggaccagatcacattactcaaagccgcatgcttagacatcctcatcctgagaatctgcacaagatatacccctgaacaagatacaatgaccttctctgatggcctcacactgaaccggacacagatgcacaacgctgggttcggtcctctcacggatctggtgtttgcattcgcaaaccaattgttaccacttgagatggacgatgcggagaccgggctgctgagtgccatttgcttgatttgtggggatcgccaggacctcgagcaacccgaccgggtggacatgttgcaagagcccctcctcgaagccctgaaggtatatgttcgtaagagacgaccatcccggcctcatatgttccctaaaatgttaatgaagatcaccgacttacgtagcatcagtgctaaaggtgccgaaagagttatcacgctgaaaatggagattcctggatccatgcctcctctaattcaggagatgctcgagaactccgaaggcctggacacactttctgggcagccaggcggaggaggtcgcgatgggggaggcctcgcccctcctcctggctcgtgctcaccctccctgtctccttcaagcaatagaagctcccccgctacgcacagtccatag

SEQ ID NO: 238518 - DNA, 1149 bp, Artificial Sequence
  Description of Artificial Sequence: Synthetic coding sequence
atggtgccaagttccccaagcccgccacccccacctcgcgtgtacaaaccttgctttgtgtgcaatgataagtccagcggctaccactacggagtgtcctcatgcgagggatgtaagggtttctttcgcagaagcattcagaagaatatggtgtacacatgtcatcgcgacaaaaactgcatcattaataaagtcactagaaaccggtgccaatactgtcgtcttcagaaatgcttcgaagtcgggatgtctaaggaagcagtgcggaatgaccgaaacaaaaaaaagaaagaagtcaaagaagaaggaagccctgatagctatgagctgagccctcagctggaggaactgatcacaaaggtgagcaaggcgcaccaggaaaccttcccatctctgtgccagctgggaaagtacaccactaatagtagcgcggaccatagggtgcagttagacctgggcttatgggacaagttctctgagctagcaactaagtgtattatcaagattgtcgagttcgctaaaaggttacccggatttacaggtctatccattgccgatcaaatcacactgctcaaggccgcttgtctggacatcctgatgctacgtatctgtacccgatatacacccgagcaggacacaatgacctttagtgacggactaactctgaatagaacccaaatgcacaacgccggtttcgggcctttaaccgatctggtgttcgcgttcgctggacagcttttacctctcgagatggatgatacggagaccggactgctgtccgcaatttgcctgatttgcggcgaccgcatggatctggaagagccggaaaaagtggataagctgcaggagccattgctcgaggcattgagactgtatgcacgaaggcgcaggccatcacagccatatatgtttccgcgaatgttgatgaaaatcacggacctaaggggcatctcaaccaaaggtgccgaaagagctatcacgctgaagatggagattccgggtccaatgccacccctgatccgggaaatgctggagaatcctgaaatgtttgaggacgacagctcccagcccggaccacaccctaacgcgtccagtgaggacgaggtccctggaggccaaggaaaaggcggactaaagtcacctgcctag

SEQ ID NO: 238519 - DNA, 1332 bp, Artificial Sequence
  Description of Artificial Sequence: Synthetic coding sequence
atgtacgactgtatggagactttcgctcctggaccacgccgactgtacggcgcagcaggccctggcgctgggctactccgcagagcgactggtggttcttgtttcgcaggtctggaaagttttgcttggccacagcccgcaagtctgcagtcagtagaaacgcagtccaccagctctgaggaaatggttccaagctctccttcacctcccccacctccaagggtgtacaagccctgctttgtctgcaacgacaaatcaagcggatatcattatggcgtttcttcttgtgaaggctgtaagggtttctttcgtcgaagcatacagaagaacatggtgtatacatgtcatcgggataaaaattgcataatcaacaaagtaacacgaaatcgctgccagtattgtaggctgcagaaatgttttgaagtggggatgagcaaggaagctgtacgcaatgacagaaataaaaagaagaaagaagtcaaggaggagggcagtccagacagctatgagctgagtcctcagctagaggaacttatcactaaggtttcgaaggctcatcaggaaaccttcccatccctgtgccagctggggaaatataccactaatagtagcgctgaccacagggtgcagctcgatctgggcctgtgggataagttttctgagctggctacaaagtgcattataaaaattgtggagttcgctaaacgcctcccaggattcacaggattaagtattgccgatcagattactctgctgaaagccgcttgcctggacatcctgatgttgcgcatctgtacacggtatacccccgaacaggatacaatgaccttttctgatggacttacactgaaccggactcaaatgcataacgcaggcttcgggccactgacagatcttgtcttcgcgttcgctgggcaactcttaccactggaaatggacgacacggaaacaggtctgctgtcagcgatttgcctgatctgcggcgacaggatggacctcgaggagccagaaaaggtggacaagctccaggaaccacttctggaggccttgcgcctgtacgcacggagaagaaggcctagccaaccttacatgttccccaggatgctcatgaagataactgacctgcgcggtatctccaccaaaggcgctgagagggctattaccttgaaaatggaaataccgggacctatgcccccactgataagagagatgttggagaatcctgaaatgtttgaggacgatagttcccagccaggaccacatcccaatgcctcaagcgaagatgaggtgcctggcggacagggcaaaggtgggttgaagtcacctgcctag

SEQ ID NO: 238520 - DNA, 1365 bp, Artificial Sequence
  Description of Artificial Sequence: Synthetic coding sequence
atggctacgaacaaggaaagactgttcgctgcaggcgcactgggcccagggtcaggttatccaggagctgggttcccgtttgcgtttccaggcgcactaaggggatcccctccatttgaaatgctgagcccatcttttagaggtcttggccagcccgatctccctaaagagatggcgtccctatccgtggaaacacagtctacgtcaagcgaggaaatggtccccagctccccatcacctccgcctcccccaagggtttataagccttgcttcgtatgcaatgataagagttctggctaccactacggggtgagttcctgtgaaggctgtaaaggcttcttccgacggtctatccagaaaaacatggtttacacttgccatcgtgacaaaaactgtatcattaataaggtgaccagaaacagatgccagtactgccggctacagaagtgcttcgaggtgggaatgtccaaggaagccgttaggaacgacaggaacaagaaaaaaaaagaagtgaaagaggaaggcagccctgattcatatgagctgtccccacagctggaggagttaatcactaaagtaagcaaagctcatcaggagacattccctagcctctgtcagctgggcaagtatacaaccaatagcagtgccgaccatcgagttcagttggacttgggcttgtgggataaatttagcgagctggctacaaagtgcatcataaaaatcgtggagttcgcgaagcgcctgcctgggtttacaggtctttccatcgcagatcagatcacactgctgaaggccgcttgcttggacattctgatgctcagaatctgtacacgatatacccctgaacaggacactatgaccttttcagacggtcttactcttaatagaacccagatgcataatgcaggctttggcccactaacagaccttgtatttgctttcgcaggacagctcctccctttggagatggatgacaccgagactgggctgttgtccgccatctgcttaatctgcggcgataggatggatctggaagaacccgagaaggttgacaagcttcaagaacccctgctggaagctcttcgcctgtatgctagacgcaggcgaccatctcagccctacatgtttcccaggatgttgatgaagatcacagacctgcggggaatttctacaaaaggggcagagcgtgcaattacgttaaaaatggaaattcccggacctatgccacccctgattagggaaatgctggagaatccagaaatgtttgaggatgactcatcccagccagggcctcatcctaacgcatcaagcgaggatgaggtgcctggaggccaggggaaaggaggtttaaaatcccccgcatag

SEQ ID NO: 238521 - DNA, 1365 bp, Artificial Sequence
  Description of Artificial Sequence: Synthetic coding sequence
atggcaacaaataaagagcgactcttcgccgctggcgctctggggccaggaagcggatatcctggtgctggcttcccatttgccttccctggggctctcagaggatccccaccattcgaaatgctgagccccagtttccgaggattgggccagcctgatcttcctaaagaaatggcttccctgtctgtagagactcagtcaacatcgtctgaagagatggtgccatcatctcccagcccaccacctcctcccagggtgtacaagccctgcttcgtctgcaacgacaaatcctctggctaccactatggcgtttcttcctgtgaggggtgtaagggcttttttagacggagcatccagaaaaacatggtctatacctgccacagagacaagaactgtatcattaataaagttacgagaaatcgctgccagtactgcagacttcagaaatgctttgaggtagggatgtccaaagaggctgtcaggaacgaccgtaacaaaaagaaaaaggaggtgaaggaagaagggagtcccgactcttatgagctctcgccccaactggaggagctcataactaaagtcagcaaagcacaccaggagacatttccaagcttgtgtcagctcggaaagtataccaccaactctagtgcggatcatcgggtgcagctggacctcgggctatgggacaagtttagtgagttagcaacaaagtgcatcataaagattgtcgaatttgcgaaacggctcccagggttcacaggccttagtatagcagaccaaattactctcctgaaggcagcatgccttgacatactcatgctaaggatatgtactcggtacaccccagagcaagacaccatgacgttttccgatgggctaacattgaaccggacgcagatgcacaacgctggcttcgggccactgaccgatctagttttcgcgttcgctggccagcttctgccactggaaatggatgacaccgaaaccgggttactgagcgccatctgtcttatatgcggtgatagaatggacctggaagaaccagagaaagtagataagctgcaagagcctctgctggaagctctgcggctctacgctaggaggaggcgacctagtcagccctatatgttcccaagaatgctaatgaagatcactgacctgcgcggtatatctaccaaaggagctgaacgggctatcacattaaaaatggaaattcctggccctatgccgcctctcatacgcgaaatgctggagaacccagagatgttcgaagacgattctagccagcccggaccccatccaaatgccagttcagaggacgaagtgcctgggggacagggtaagggcggacttaagagccccgcttag

SEQ ID NO: 238522 - DNA, 306 bp, Artificial Sequence
  Description of Artificial Sequence: Synthetic coding sequence
caccaccaggacgagtttgccaagcggctgccgggattcacaggcctctcaatagccgaccagatcaccctgctaaaggcagcttgcctggatatcctgatgttacgaatctgtacccggtatacgccagaacaggataccatgacgttctctgatggactgacactgaaccgcacccaaatgcataacgccggtttcggcccactcaccgacctcgtgtttgcctttgctggccaacttctgccactggaaatggacgacacagaaactggactgctgagtgctatttgtctgatttgtggctag

SEQ ID NO: 238523 - DNA, 1299 bp, Artificial Sequence
  Description of Artificial Sequence: Synthetic coding sequence
atgctggcattgcctctgcctccctgctggtccggtgcccctccaggcgaggagggtgaaagcgccgctgggccatggtgcttccagcaccccgtgagccttcaagcgggtagtaggtgtaccacagtgtggaagcgcttgcccagggtgcgcgacggctgtaccggtaggccaggcccaggcccagcttgttgcgccgaaccacccgctgctccggtgtcgccggatctgaacctgttacccggacggaaccccccagcctgcaacggattcttcaggcgatccatacaaaagaatatggtgtacacatgtcacagggacaagaattgcatcattaataaggtgacccggaacagatgtcagtattgccggctgcagaagtgctttgaggtcgggatgagtaaggaagctgtcagaaatgatcgaaacaagaaaaaaaaggaggttaaggaggaaggtagtccggactcctacgagctgtccccccagctcgaagaacttatcactaaagtaagcaaggcccaccaggagaccttccctagcttatgccagctgggaaagtataccacaaattcatctgctgaccacagggtgcagcttgatctcggattgtgggataagtttagtgagttggctactaagtgtattatcaaaattgtggaatttgcaaagagactccccggattcacgggactgtctatcgccgatcagatcacactcctgaaggctgcctgtttggatatcttaatgctgcgaatttgcacacgctacacacccgagcaggacaccatgacattcagcgacggacttactttgaacagaacccagatgcacaatgcaggctttggcccactgacggatctcgttttcgccttcgcgggacaactactccccttggaaatggacgataccgaaacagggctgctttctgcaatttgcttgatatgcggcgatagaatggacctcgaggagccggagaaggtggacaaattacaggagccactcttggaggccctccgactgtacgctagacgcaggagaccatcccagccctatatgttccctagaatgctcatgaagattaccgacctgcgtggcatctctaccaagggagccgaacgggcaataacccttaaaatggaaatccccggtccaatgcctcctttgattagggagatgctggaaaacccagagatgttcgaagatgactcttcccagcctggtccacaccccaacgcctccagtgaggatgaggttcccggtggtcaaggaaagggcggactgaagtcacccgcatag

SEQ ID NO: 238524 - DNA, 1389 bp, Artificial Sequence
  Description of Artificial Sequence: Synthetic coding sequence
atggataccaagcactttctacccctggatttcagtacccaggtgaatagctctctaacctccccaactggacgcggatccatggcagccccttcgttgcacccctcactaggtcctggcatcggttcacccggacagttgcacagcccgataagcaccctctcatcccctatcaacgggatggggccaccgttctccgtcatctccagccctatgggccctcacagcatgagtgtaccaacaacgcctactcttggcttctccacaggaagcccccagctttcctcgccaatgaaccctgtgagttcatcggaggatattaaacccccactggggttgaatggggtccttaaagtacccgcacaccccagcggtaatatggccagttttacaaagcatatttgcgccatctgcggtgataggtcatcaggcaaacattatggagtttatagctgcgagggctgtaaaggcttctttaaacgcacagttcgcaaagatctaacttatacatgtcgggacaacaaggattgcttgatcgacaagcgacagcgtaatcgctgtcaatactgcagataccagaagtgtctagcgatggggatgaagcgggaggctgtgcaggaggaaaggcagcgtggcaaagatcggaatgagaatgaggtggaatccaccagttctgctaacgaagacatgcccgtcgagaggatcctagaggccgaactagcagttgagcctaagactgaaacctacgttgaggcgaatatgggtctgaatccatcttctccgaatgatccagtgactaacatctgccaggcagcagataagcagctgtttacactggtcgaatgggccaagcgcattccacacttctccgaacttcctctggacgaccaggtgatccttcttagagcaggctggaacgaacttctgattgcttcctttagtcatcgctctattgcggtcaaggatgggatcctgctggctaccggtctgcatgtgcaccgaaatagtgcacacagcgccggtgtcggcgctattttcgaccgcgtgttaaccgaactggtgtcgaagatgagagatatgcaaatggacaagactgagttaggatgcctccgcgcaatcgtcctgttcaatcccgattccaaagggctgagcaatccagccgaagtggaggccctaagggaaaaggtttatgccagcctggaagcctactgcaaacacaaataccccgagcagcctgggaggtttgccaagttactgcttaggctgcctgccctcagaagcatcggcctcaagtgtttggagcatctgtttttttttaagctaataggcgatacccccatcgatacgtttctgatggagatgctagaagcaccacaccagatgacatag

SEQ ID NO: 238525 - DNA, 1098 bp, Artificial Sequence
  Description of Artificial Sequence: Synthetic coding sequence
atgaacccggtaagtagctcagaggacataaagcctccactggggctcaacggagtactcaaggtccctgctcatccatccgggaacatggcctctttcaccaaacatatttgcgccatctgtggtgaccggtcgtcaggcaaacactatggcgtttactcctgcgaaggctgtaagggatttttcaagaggactgttagaaaggatcttacgtacacttgtcgtgacaacaaggactgcctgattgacaaacgtcaacgaaataggtgccagtactgcagatatcagaagtgcctagcaatgggcatgaagcgcgaggccgtgcaggaagaacggcagcgtggaaaagaccgcaatgagaacgaggttgagtccactagctcggcaaatgaagatatgccagttgagaggatcctggaagccgagcttgccgttgagcctaagacagagacctatgtggaagccaatatgggcttaaatccttcttcacctaacgatcccgtgacgaacatatgccaggcggctgacaagcaactgttcacattggtcgaatgggccaagagaattccacattttagcgaactccctctggacgatcaggtgatacttctgagggcaggttggaatgaattgctgatagcatccttcagccacaggagtatagcagtgaaggatggcatactgttggccacaggtctgcatgtgcaccgcaacagcgcgcattccgcaggcgtgggggcaattttcgacagggtgctgactgagttggtgtccaagatgagagacatgcaaatggataaaaccgaactcggctgcttacgagctatcgttctctttaatcctgacagcaaaggactctctaaccccgctgaagtggaggcgttacgtgaaaaggtatacgcatccttggaagcctactgcaagcacaagtaccctgaacaacctggaagattcgctaaactacttctgcgtctccctgccctaaggagtatcgggctcaagtgtctcgagcatctgttcttttttaagctgatcggagacactcccatcgatacattcctaatggagatgctcgaggcccctcatcaaatgacttag

SEQ ID NO: 238526 - DNA, 1602 bp, Artificial Sequence
  Description of Artificial Sequence: Synthetic coding sequence
atgagctgggccgcaagacccccatttctgccacagcggcacgccgcaggccaatgtggccctgtgggggtccgcaaggagatgcactgtggagtggcatcccgttggaggcgccgtagaccctggttggatcccgctgccgctgccgcagctgcagtggccggaggcgaacagcagactcctgagcctgagcccggagaggccggtcgcgacggcatgggagatagcggtcgggattcaaggtccccagactcttcaagccccaacccgctccctcaaggggtccctccgccttctcccccaggtcctccgcttccccctagcaccgcaccttcattgggcggaagtggggcacctcctccccctcctatgccacctcccccactggggtccccttttcccgtcatcagcagcagtatgggaagtcctgggctgccgcctcccgcaccaccaggtttttcaggtcccgtctcctcccctcagattaattccaccgtgtcccttccaggagggggatccggacctcctgaggatgtgaagcccccagtgctaggggtaaggggcctccactgcccgcctcccccaggtggcccaggggcaggaaagcgactgtgcgctatatgcggggacagatcctcggggaagcactatggtgtgtactcatgcgagggatgcaaagggttttttaaacgcacgatcagaaaggacctgacctacagctgccgggacaataaagattgtaccgtcgacaagcgccaaaggaacagatgtcagtactgcagataccagaaatgcctggctacagggatgaagagagaagccgtccaggaggagaggcagcgcggaaaagacaaggatggggatggagagggagccggtggggcaccggaggagatgccagtggatcgaattctagaggccgagctcgctgtagagcagaagtccgatcagggtgtcgaaggcccaggaggcacaggaggttctggttcctctcccaacgacccagtgactaatatatgtcaggctgccgataagcaactctttacattggtggaatgggccaagaggatccctcacttctcatctcttcccctggatgatcaagttattctgctgcgcgcaggctggaatgagctgcttattgcctctttcagccataggagcatcgatgtaagagatgggattctgctcgccaccggattacatgttcacaggaactccgcccattccgcaggggtgggggctattttcgacagggtcctcacagagctcgtcagtaaaatgcgagatatgagaatggacaagaccgaactgggctgcctgcgagcgatcattctgttcaaccctgacgccaaagggctctcaaatcctagcgaggtggaggtgctccgcgaaaaggtttatgcttccctggaaacttattgtaaacagaaataccctgaacagcaagggaggttcgccaagttgctgttgaggctacccgcactgcggtctattggtcttaaatgtttggagcatctgttcttcttcaagcttatcggggatactccaatagacactttcttgatggaaatgctggaagctcctcatcagctggcctag

SEQ ID NO: 238527 - DNA, 1614 bp, Artificial Sequence
  Description of Artificial Sequence: Synthetic coding sequence
atgagctgggctgccagacctccatttctgccccagagacatgctgcagggcagtgtggcccagtcggcgtgcggaaggaaatgcattgcggagtagcgtcgaggtggcggcgacgacgcccatggctagaccctgccgcagcagcggcagctgccgtcgccggtggggagcaacagaccccagaacctgaaccaggggaggccggacgggacggaatgggcgactccggaagggactccagatccccagattctagttctcctaaccctctaccgcagggggtaccccctccatccccccctgggccacctcttcctccgtccactgccccatctctcggtggaagtggggctccgccaccacccccaatgcctccccctcccctgggaagtccgtttcccgtcatctcttcttccatgggaagtcctggtctcccacctcccgctcctcctggattcagcgggccagtgagcagtccacagattaatagtaccgtcagtctgcctggaggcggaagtgggcctcccgaggatgtgaaacccccagtgttaggcgtgagaggccttcattgcccgcctcctccagggggtcccggtgccggtaaacgtctatgcgcaatctgcggcgataggtcttctggtaagcattacggggtgtacagctgcgaagggtgcaagggcttcttcaaacggaccatccgcaaggatctgacctactcctgtagagacaacaaggactgcacagtggataagcggcaacgaaaccgctgccagtactgcagataccagaagtgccttgcaacagggatgaaacgggaggcagtgcaggaagaacgacagcggggaaaagataaggatggagatggagaaggggctggcggagctccagaggaaatgcctgtagatagaatactggaggcagagctggcagtagagcagaagagcgaccagggagttgagggcccagggggaaccggagggagtggttcgtctcctaatgaccctgttacaaacatatgccaagcagcagataagcagttatttaccctggtagaatgggcaaagcgaatacctcatttctcaagcctaccgctcgatgatcaggtcattctcctgagagctggttggaatgagctgctcatcgcatccttctctcatcgaagtattgatgtgcgggatggaattctgttggctaccggcctccacgtgcataggaacagcgcccatagcgccggagttggagccatctttgacagatcattatcacgtgtgctcaccgaactggtctcaaaaatgcgggatatgcgcatggacaagacggagctagggtgtctacgcgcaatcattctctttaacccagacgccaaaggactaagcaatccatccgaggtggaggtactgagggagaaagtttatgcaagtctggaaacctactgtaagcaaaagtacccagagcaacagggcaggtttgcaaaactgctcctgcgcttgccagcactccgctcaattgggttaaagtgcctggagcacctgttttttttcaagttaattggtgatacgccaatcgacactttcttgatggagatgctggaagctccccatcagctcgcttag

SEQ ID NO: 238528 - DNA, 1614 bp, Artificial Sequence
  Description of Artificial Sequence: Synthetic coding sequence
atgtcttgggccgctagaccgcctttcctcccgcaaaggcatgccgcaggtcaatgtggccctgttggagtccgcaaagagatgcattgtggcgtcgctagtcgttggagacggagacggccttggctggatcctgctgcagcagccgctgccgctgtcgccggaggcgagcagcaaacgcctgagcctgaaccaggagaggctggcagagacggaatgggggattcaggcagagacagccgctctccagacagctcctccccaaatcctctcccacaaggcgtgcctcccccatctccaccagggccacccctgcctccaagtaccgctcctagtttagggggatccggtgcacctccccctccccctatgcctcccccacccttaggcagtcctttccccgtgatttctagctcgatgggctcaccaggactaccaccccctgcgcctccgggttttagcggcccagtgagttctccgcagatcaacagcacagtttcactgcctggtgggggatccgggcctccggaggatgtaaagcccccagtgttgggtgttaggggcctccattgccccccaccacccggaggcccaggcgcagggaaacgactgtgcgccatctgcggagatagatcgtcaggcaagcattacggcgtttattcgtgtgaaggctgtaagggttttttcaagaggacaattcgcaaggatcttacgtactcttgtcgagacaacaaggattgcacggtcgataagagacagcgcaacagatgtcagtactgcaggtaccagaagtgcttagccaccgggatgaagagggaagccgtccaggaggagcgtcagcgaggcaaggacaaggatggagacggcgaaggcgctggtggagccccagaggagatgcccgtggatcggattttagaagctgagctggcagtggagcagaaatcagatcagggcgtggagggccctgggggtacagggggaagcgggtcttctcccaatgatcctgttactaacatttgccaggccgctgacaagcagctatttacgttagtagaatgggccaagaggattcctcacttttcttcgttgcccctcgatgaccaggttatacttctcagggctggatggaacgagctgctcattgcttccttcagccacaggagcatcgacgtaagggatggtatcctcctcgctacgggtttgcacgtgcaccgaaacagtgctcattcggctggcgtcggggctatcttcgaccgcagcctctctagggtgctgacagagctggtgtcaaagatgcgggatatgcggatggacaaaacagagttggggtgtctgagggctatcatactgtttaatcccgacgccaaaggtctgtctaacccttccgaggtcgaggttctccgcgaaaaggtgtacgcaagtcttgaaacatactgtaagcagaagtaccctgagcagcagggcaggtttgccaagctgctgctccgcctccctgcactgaggagtattgggctaaagtgcctcgaacacctgtttttcttcaaacttatcggggacactcccatcgatacttttctcatggaaatgctagaggccccacaccagcttgcttag

SEQ ID NO: 238529 - DNA, 1602 bp, Artificial Sequence
  Description of Artificial Sequence: Synthetic coding sequence
atgtcctgggccgcaaggcctccatttctccctcagaggcatgcggcaggccagtgtggtccagtaggcgtaagaaaagagatgcattgcggtgtcgcctccaggtggagacggaggagaccctggctggacccagccgcagcagcggctgccgcagttgccggaggagaacaacagactccagaacctgaacctggcgaggccggacgtgatgggatgggagacagcggacgggactcgcggtctcccgatagcagctcacccaatcccttaccccagggtgtgcctccaccaagccctccgggaccccctctgcctccatctaccgccccatcactcgggggatcaggggctccccctccccctccaatgcccccacctcctcttggctcgccattccccgtcatttccagtagcatgggaagccctgggttaccacctcctgcaccccctggatttagcgggcctgtgtcaagccctcagatcaactcaaccgtgtcccttcctggcggaggatctgggccacccgaggacgtgaaacctccagttctcggggtcagggggttgcattgccccccacccccaggaggacctggtgccggaaaaaggctatgtgcgatctgcggtgatcgatcatctggcaagcactatggggtgtactcctgtgagggctgcaagggcttttttaagagaacgatacggaaggacctgacctattcctgtcgcgacaataaagattgcacagttgacaaaagacaacggaatcggtgccaatattgcaggtaccaaaagtgcctggcaactggcatgaagagagaggctgtccaggaggaacgccagagagggaaggacaaggatggagatggggagggcgcaggcggagcacccgaggagatgccggtggatcgaattcttgaagccgagcttgcagtggagcagaaatcagatcagggtgtagagggccctggagggacaggtgggtcagggtcatctccaaatgatcccgtcaccaatatttgtcaggccgcagacaagcagctgttcacactcgtggagtgggcaaagcgcattccacacttttcctcacttcctctggacgatcaagtgattctactcagggcaggatggaatgaactgctaattgcgtcttttagccaccgctctatcgatgttagagacggaatccttttggccactggcctgcacgtgcaccgaaattctgctcactctgctggcgtgggtgccatcttcgaccgggtcctcactgaacttgtgtctaaaatgcgagacatgagaatggataagactgaactgggttgtctgcgagcaattatacttttcaacccggacgccaaggggttaagcaatccgtccgaagtggaggtcttgagggaaaaagtgtacgccagtctcgagacttattgcaaacagaagtatcctgagcagcaaggacgattcgccaaactgctcctgaggctgccagccctgcggtctataggactcaagtgtctcgagcacttgttcttttttaaactgattggggatacccccatagacacatttctgatggagatgttggaagcaccccatcagttagcgtag

SEQ ID NO: 238530 - DNA, 861 bp, Artificial Sequence
  Description of Artificial Sequence: Synthetic coding sequence
atgccccagggaagcgttggtcgatggggctgcgaaaagaagtgtatagtgggctccagaccaggcggtggaggcgacgggccaggatggataccacagagaagacggcgtcggcgatggcaggcagagaataacaaacccagaagtagaagccaaggaaggctggacggcactgggtgggccacggccggtgggattaacagcactgtttcactcccagggggaggttccggaccacctgaagacgtgaaaccacccgtgctgggggtaaggggactacactgtccgcctcctcccggaggcccaggcgctggaaagaggctatgcgctatctgtggtgatcggtccagcgggaaacactacggagtgtactcctgtgaggggtgcaaggggttctttaaaaggactatccgcaaagacctcacatactcctgtcgcgataataaggactgcacagtggataagaggcagcgcaataggtgccagtattgccgctaccaaaaatgcctggctaccggaatgaagcgtgaggctgtccaggaggaacgccagcgcggaaaggacaaggatggggacggagaaggagccggaggtgcaccggaagagatgccggtggaccggattctggaggcggaactcgccgtggagcaaaaatccgatcagggcgtcgaagggcctggtggcaccggcggaagtgggtcttcagtctccgtgggcgtaaacccattaagcttcgtgatgggcgttgggggagggtccctgggtctcttttacattcctagcccttcctttccccttattacttttctgacccttttaggcactggaggcgcagcaaagcaaggtctgtctaatatctag

SEQ ID NO: 238531 - DNA, 1602 bp, Artificial Sequence
  Description of Artificial Sequence: Synthetic coding sequence
atgagctgggcagcaagacccccattcctacctcaaaggcatgccgctggtcaatgcggtccagtgggcgttagaaaggaaatgcattgtggtgtggcctccaggtggcggaggagaagaccttggttggacccagctgcagccgctgcagcagcagtggccggaggtgaacaacagactcctgagccggaaccgggagaggctgggagggatgggatgggggactccgggcgtgactcccgatcccccgactcaagttccccgaacccgctcccccagggggtcccgccaccttcgccacctgggccaccactgcccccatctaccgcaccttcactgggtggctctggcgcaccacctccacctcccatgcccccaccgcctctagggtccccgttccccgtcattagcagttcaatggggtcaccagggctgccccctccagctcctcccggattctcaggacctgttagtagcccgcaaatcaatagtactgtcagcttacccggaggcggttccgggcctcccgaagatgttaagccaccagtactaggtgttaggggcttacactgcccaccaccacccggaggccctggagccggtaaacggttgtgtgctatatgtggggacagatccagcgggaagcattatggagtttactcttgtgaggggtgcaaaggattctttaaacgcactataagaaaagacttgacctatagctgcagggacaacaaagattgtaccgtcgacaagaggcaaaggaaccgatgccagtactgccggtatcagaaatgtctggccaccgggatgaaacgggaagcggtacaggaggaaaggcagaggggtaaggataaggatggggatggggaaggagctggcggtgccccagaggagatgccggttgatcggatccttgaggcggagcttgctgttgagcagaagtctgatcagggcgtggagggaccaggcggtacgggaggtagcgggtcatcacccaacgaccctgtgaccaacatttgtcaggctgccgacaaacaactctttaccttggtggaatgggcgaagcgaatccctcacttttcctctcttcctctggatgaccaggtcatcctgctgagggcaggttggaacgagctgttgatagcttccttttctcaccgttcaattgatgtgcgggacggcatcctccttgcgacagggctgcatgtacatcgaaacagcgctcattcggccggagtcggcgcaatttttgatcgcgttctgacggagttagtgtctaaaatgcgagacatgcgtatggataaaacagaactcggatgtctcagagcgattattctgttcaatcccgacgccaaaggtctttcaaatccctccgaagtggaggtgctccgcgagaaggtctacgcctcattagagacttactgcaagcagaaataccctgaacagcagggcagattcgctaaactgctgctgcggctccccgctctgcgcagcattgggttgaagtgcctagagcatctcttttttttcaaacttatcggagatactccaatcgacacctttctgatggaaatgctagaggccccacatcagttggcttag

SEQ ID NO: 238532 - DNA, 291 bp, Artificial Sequence
  Description of Artificial Sequence: Synthetic coding sequence
taatcaccaaacgaccccgtcaccaatatctgtcaggctgctgataagcaactcttcaccttggttgagtgggcgaagcgaattcctcacttcagtagcttgcccctggacgaccaagtgatcttactgcgcgctggactccacgtccatagaaattccgcccattcagccggagtcggcgctatttttgatagggttctgacagagctggtcagtaagatgagagatatgaggatggacaaaactgaactcggatgtcttcgagccattatcctttttaatccggattag

SEQ ID NO: 238533 - DNA, 1602 bp, Artificial Sequence
  Description of Artificial Sequence: Synthetic coding sequence
atgtcatgggccgcaaggcctcctttcctgcctcagcggcatgctgcgggacagtgcggaccagtgggggtgcgaaaggaaatgcactgcggtgttgcctcacggtggaggagacgcaggccatggctcgatccagccgctgctgcagccgcagccgtggcgggaggagagcagcagacacccgagcccgagcctggggaggccggaagagacggcatgggcgacagtggtcgggattcccgctccccagacagtagtagtcccaatccgctgccacagggagtgcccccaccttctccgccaggtcccccactgcctccaagtacagccccttcactcggcggaagtggtgctcctcctcccccacctatgcccccaccaccactgggcagtccatttcctgttatcagttccagcatgggatcccccggactgccacccccagctccaccaggtttctcagggccagtatcttctcctcaaatcaatagtacagtttccctacctggtggtgggtctggaccccctgaggacgtcaagcctccagtgctcggagtccggggtctgcactgccctccaccccctggcggacccggagctggcaagaggctgtgtgcgatttgcggggatcggtcctcagggaaacactatggcgtttacagttgcgagggttgcaaaggattctttaaaagaaccatccgcaaagatctcacctatagctgccgcgataataaggactgtacggtggataagagacaacgcaataggtgtcagtactgccgctaccaaaagtgccttgccactgggatgaagagagaagccgtgcaggaggagcgccagagaggcaaggataaggacggcgatggggaaggagctgggggagcaccagaggagatgccagttgacagaattttagaggccgaactggctgtcgagcagaagagcgatcaaggtgtggaaggtcctggaggtaccggtggttccggaagctcacccaacgacccagtgactaatatttgtcaagcagcagataaacagctgttcaccttagtagaatgggctaaacgaataccccattttagctctctgcctctggacgaccaggtgatcctgctgcgcgctggatggaatgagctgctcatagcatctttcagccataggagcattgacgtgagagatgggatcctgctggctacgggactgcacgtccacagaaactctgcacatagtgccggagttggagccatcttcgaccgcgtgctgaccgaacttgtgtcaaagatgagagatatgcggatggacaaaacagagctcggctgtctgcgcgctatcattctgtttaaccctgacgcaaaggggctcagtaaccctagtgaggtcgaagtcctgcgggaaaaggtgtatgcctccctggaaacatattgtaagcaaaagtatcccgagcaacagggccgtttcgcaaagctgctgctgcggctgccagctttgcgctcgatcgggctcaagtgtctggagcacttatttttctttaagctgattggcgacacccccattgacaccttcttaatggagatgctggaagcccctcaccagctagcttag

SEQ ID NO: 238534 - DNA, 291 bp, Artificial Sequence
  Description of Artificial Sequence: Synthetic coding sequence
tgatctcctaatgaccccgtcactaatatctgccaggcagcagataaacaattgtttaccctggtcgaatgggctaagcgcatcccccacttttcctccctccccctggatgatcaagttattttgctgcgggctggtctgcatgtgcataggaatagtgcacatagtgctggagtaggggcaatcttcgatagagtgctgacagaactggtatctaagatgagggacatgcgcatggataagacggagctgggatgtctcagggcgataattcttttcaaccctgactag

SEQ ID NO: 238535 - DNA, 1614 bp, Artificial Sequence
  Description of Artificial Sequence: Synthetic coding sequence
atgagctgggccgcacgcccaccgtttctgccacagaggcacgcggcagggcagtgcggtcccgtgggggttcgcaaggaaatgcactgtggcgtagccagccggtggcgcaggaggaggccgtggttagacccggcagccgctgctgccgctgctgtcgcaggtggcgaacaacaaactcccgagcctgaaccaggcgaggctggcagggatgggatgggggatagcggacgagactccagatccccagacagctcgagtccaaaccccctcccccagggagtcccgcctcctagcccaccagggccacccctccctcccagcacagccccttcattaggtggttccggtgcccctccgccaccccctatgccgcctcctcccctgggtagcccatttcccgtgatcagttcttccatgggctcccctggcctgcctccccctgcgccaccaggctttagtggaccagtgagcagccctcaaataaactctacggtgtcactgcctgggggtggctctggacctcctgaggacgtgaagccgcctgtgttgggagtccgcggtctgcattgtccaccaccacccggtggtcccggagcagggaaacgattatgcgctatctgcggagaccgcagttctggaaaacattatggagtatatagctgtgaagggtgtaagggcttttttaagcgaactatccgtaaagacctcacatactcttgcagagacaataaagactgtacagtagacaaacggcagaggaaccgttgtcagtattgcaggtatcagaaatgtttggccactggaatgaaacgggaagcagtccaggaggagaggcaacgcggtaaagacaaagatggtgacggggagggcgctggcggagccccagaagaaatgccagtggaccgcattctcgaggccgaacttgcagtggaacagaagtcggatcaaggtgtggaaggaccaggagggacaggtggatcgggaagttctccaaatgacccagtgaccaacatttgccaggctgcagataagcagttattcactttggtggagtgggcaaaacgtatccctcacttcagtagtttgcccctcgacgaccaggttatcctgctcagagctggttggaacgagttactgatcgcatcgttctcacaccgcagtatcgacgtgcgtgacggaatcctccttgcaaccgggttacacgttcatcgaaattctgctcacagtgctggtgtgggggcaattttcgaccggtccttgagcagagttttgacggagctcgttagtaaaatgcgtgacatgcggatggacaagacagagctggggtgtttgagagctattatcctgtttaaccccgatgccaagggcctatccaatcccagcgaggttgaagtgttacgcgaaaaggtgtacgctagccttgaaacctactgtaaacagaagtacccggagcagcaaggtcgcttcgcaaaacttcttcttagattgcctgccctgcgcagcataggtctgaagtgcctggagcatcttttctttttcaaactgattggggatacaccaatcgatactttccttatggaaatgttggaagctccccaccagctagcgtag

SEQ ID NO: 238536 - DNA, 1602 bp, Artificial Sequence
  Description of Artificial Sequence: Synthetic coding sequence
atgtcttgggccgctcggcctccttttctgcctcagaggcatgccgcaggacaatgcggtcctgtcggagtgcgcaaagaaatgcactgcggcgttgcctctaggtggcgcaggagacgcccatggttggatccagctgctgctgccgcagctgcagtcgcgggaggtgagcagcagaccccagagccagagcctggcgaggcgggacgtgatggaatgggcgactcaggcagagatagccgcagccctgacagttcaagtccaaatcccctgccccagggagtcccgcctccttcccccccaggccctccactgcccccatcaactgccccatctctcggcggatctggggcaccgcctccccctcctatgcccccaccaccgctggggagccccttcccggtgatttccagctctatgggttcacctggtttgccaccccctgcacctccgggattctctggtcccgtgagctccccacaaatcaacagtacggtgagcctgcctggcggtggctctggccctcctgaagatgtgaagccccctgtgctgggtgtaagggggcttcactgcccacctccgccaggcggacctggagccggtaaacgcctatgtgccatttgcggggacaggtcaagtggcaagcactatggagtgtactcttgcgagggatgtaagggcttctttaagcgcactatccgaaaggatctgacatactcctgcagagataacaaggactgcacagtcgacaagcggcagcgcaacaggtgtcagtattgtcggtatcaaaagtgtctggcaacaggcatgaaacgggaggccgtgcaggaggagcgccagcgcggaaaagacaaggacggtgacggcgaaggcgcaggtggcgctccggaagagatgcccgtagacaggatcttagaggccgaactcgctgtggaacaaaagtctgaccaaggggtggaggggcctggaggtacaggcggatcaggtagttcccctaatgacccagtgaccaatatatgtcaggccgctgataagcaactcttcaccttggtggagtgggcaaagcgcatcccacacttttctagccttcccctggatgaccaggtcatccttcttcgggcaggatggaacgagttgcttatcgcctccttttctcatagatccatcgatgttcgggacggcatactcctggcaacgggcttacatgtgcaccgtaactcggcccactcggctggggtgggggctatctttgatagagttcttaccgagctcgtaagcaagatgcgcgacatgcggatggataaaacggagctgggatgcctgagagccattatcctgttcaaccctgacgccaaaggtttgtccaatcctagcgaagtggaggttctcagagagaaggtatacgcaagcctcgaaacttactgcaaacagaagtatcccgaacagcaggggaggttcgctaagctgctgctgcgtctgcccgctctgcggagcattggacttaaatgcctggagcacctgttcttcttcaagctcatcggtgatacacctatcgatacatttctcatggagatgttggaagctccccatcaactggcctag

SEQ ID NO: 238537 - DNA, 1602 bp, Artificial Sequence
  Description of Artificial Sequence: Synthetic coding sequence
atgtcatgggctgcgagacctcctttcttgccccaaagacatgccgctggtcaatgcgggcctgtgggggtcaggaaagagatgcattgcggggttgcgtcaaggtggcgtagaagacgtccatggctggacccagctgcagccgcagcagcagcggtggccggtggcgagcagcagacgccagaacccgagccaggcgaggcaggcagggatggaatgggcgactctggacgcgattcacgaagtcctgattcaagtagccccaatcccctacctcagggagtgccaccaccatcgcctccaggaccacccttgccaccctctactgccccttcccttggcggatccggtgcccctccacccccacctatgcctccaccaccgttgggaagcccattccctgtaatctctagtagcatgggttccccagggctccccccacccgcaccccctggcttctcagggcctgtgagctctcctcagatcaatagcacagtctctctgcctggcggaggttcggggcctcccgaagacgtaaaaccccctgtgctgggcgttaggggattacattgtcctccgccacctggtgggcctggcgctggaaagaggctctgtgccatctgtggagaccgaagttccggcaagcactatggcgtttattcatgtgagggctgcaagggtttctttaaacgcacaatccggaaggatctgacttattcgtgtcgagacaacaaagactgtactgtggacaagcgccagcgaaaccgatgccagtattgtaggtatcagaagtgcctagctactggcatgaagcgggaggcagtgcaggaggagcggcagcgaggcaaagataaggatggggatggagaaggcgcaggcggagctccggaggagatgccggtggatagaatcctcgaagcagagctagcggtggaacagaaatcggaccagggggtggaaggcccagggggtaccgggggatcgggatcttctcctaatgacccagtgaccaatatatgccaggccgctgataagcaattgtttacactggtagaatgggctaagcgcataccccatttctccagtctccctttggacgaccaggtgattctcctcagagctggatggaatgagttattaattgcatcattcagtcatcggagcatcgacgttagagatggtatcctcctcgctacagggttacacgtacacagaaattcagcccactctgccggagtgggtgctatatttgacagagtgctgactgagctcgtctccaaaatgagagacatgagaatggacaaaacggaactgggatgcctgagggccatcattctgttcaatcctgacgcgaagggcttgtcaaacccgagcgaggtggaggtactccgcgaaaaggtctacgcttctttagaaacatactgcaagcagaagtaccccgagcagcagggacggttcgctaaactcctactaagacttcctgcactgagatccatcggtttgaaatgcctggaacacctttttttttttaaactgatcggagacactcccattgacacattcctcatggaaatgctggaggcccctcaccagctcgcctag

SEQ ID NO: 238538 - DNA, 291 bp, Artificial Sequence
  Description of Artificial Sequence: Synthetic coding sequence
tgatccccaaacgatcccgtgacaaacatatgtcaggccgcagacaagcagctgtttacgctggtggaatgggctaaacgaattccacatttctctagtctgccactggacgaccaagtcattctgctgagagctggtttacacgtccacagaaactctgctcattcggcaggtgtgggtgcaatctttgatagagtccttacagaacttgtctcaaagatgcgagatatgaggatggataagacagagttgggttgcctccgagcgataatcctttttaatcccgactag

SEQ ID NO: 238539 - DNA, 291 bp, Artificial Sequence
  Description of Artificial Sequence: Synthetic coding sequence
tgatcgcctaatgatccagtcactaacatatgccaagctgctgacaaacagttgtttacgcttgtagagtgggccaaaagaatcccccacttctctagtttacctctggacgaccaggtgatattactgagagccggtctgcacgtgcaccgcaatagcgcgcactccgcaggggttggtgcaatcttcgatcgggtgctaaccgaattggtctcaaagatgagggatatgcgtatggacaaaaccgaactgggttgtttgagagccattatcctctttaaccctgattag

SEQ ID NO: 238540 - DNA, 1614 bp, Artificial Sequence
  Description of Artificial Sequence: Synthetic coding sequence
atgagctgggccgctaggcccccatttctccctcagcgacacgcagctgggcagtgcggaccggtcggagtcagaaaggagatgcattgtggcgttgcaagccgatggcgtcgaagaagaccatggctggatcccgcagcagccgctgccgcagctgtcgcgggtggcgaacagcagacacccgaaccggaacctggtgaggcagggcgagacggcatgggggattccgggcgagatagccggagtcctgattcgagcagtccaaacccccttccccagggcgtgccccctccatcaccacccggtccaccccttcccccttcaaccgctccaagtttaggtggaagcggcgcacctccccctcctccaatgccaccccctcctcttggctctcccttcccagtgatatcatcatctatgggaagccccggtctccctcccccagcgcctcccggtttctccggcccagtcagttctcctcagataaatagcaccgtgtcccttcccggtggagggtcgggcccaccagaagatgtcaagcctcctgtcttaggggtgaggggtcttcactgcccaccccctcccggtggtccaggagctggtaagcggctgtgcgctatatgcggagatagaagctcagggaagcactatggggtctatagttgtgagggctgcaagggattcttcaagagaacgattcggaaggatcttacctactcatgtcgcgacaataaggactgcactgtggataagcgtcagaggaacagatgccaatattgccgctaccagaaatgcctggcaacaggaatgaagcgtgaagctgttcaagaggagagacagcgtggaaaagataaagatggtgatggagagggtgccggtggtgccccagaggaaatgcccgtcgatcgcatcctcgaggccgaattggccgtggaacagaagtccgaccagggagttgaaggaccaggaggtactggcggtagtgggtcctcaccaaatgatcctgtgaccaatatctgccaagctgcagataagcagctatttactctggtggagtgggccaaacgaattccccatttcagtagcttgccactggatgaccaggttatactgctcagagctggttggaatgagctgctcatcgctagctttagtcaccgctccatcgatgttagagacggaatcctgctggctacgggactccatgtgcatcgtaattccgctcactctgcaggagttggtgcaatattcgataggagcttatcacgcgttctcacggaactggtgtcaaagatgagagacatgcgcatggacaaaactgaactagggtgcctaagggcgatcatcctgtttaatcccgatgccaagggcctctccaatccatccgaagtggaggtactcagggagaaggtctacgcctccctcgagacttactgcaaacagaagtacccagagcaacaagggaggttcgctaagcttctgcttcgactgccagccctgaggtccatcgggctcaagtgcctggaacacctgttcttctttaaactgatcggggatacgcctattgacaccttcctgatggaaatgttggaggcacctcaccagcttgcctag

SEQ ID NO: 238541 - DNA, 291 bp, Artificial Sequence
  Description of Artificial Sequence: Synthetic coding sequence
taatcccccaacgacccagtgacgaatatctgtcaagctgccgataaacagctcttcacactcgtagagtgggcgaagagaatcccccacttctccagcttgcctttggacgaccaggtcattttgctgagggccggtttgcacgtacaccgaaatagcgctcacagcgctggcgtaggcgctatctttgaccgagtgctaaccgagctcgtgtcaaagatgcgagacatgaggatggataagaccgaactgggctgtctgagagccatcattctgtttaatccagactag

SEQ ID NO: 238542 - DNA, 1614 bp, Artificial Sequence
  Description of Artificial Sequence: Synthetic coding sequence
atgtcctgggccgcacgcccacccttcctgccacaacgacatgccgcaggtcagtgtgggcctgttggcgtacgtaaggagatgcactgtggggtcgcaagtcgatggaggcggagacggccatggctggacccggctgctgcagccgctgctgccgtggccggaggcgaacagcagacaccagagcccgaaccgggagaagcgggaagggatgggatgggcgactcgggccgtgacagccgatcccctgactcatccagccccaatccactcccccagggcgttcctcccccaagccctcctggaccacccctgcccccatcaaccgcaccctctcttgggggttcaggtgctccccctccgccaccgatgccgcctccgcctctggggagtccctttcctgtaatttcctcctccatggggagccctgggttacctccacccgctccacctgggttcagcggccctgtcagctctccccaaatcaatagcaccgtctcgctgcctggcggaggcagcgggccacctgaggatgtgaagcccccagtattgggcgtgcgcggattgcattgcccaccacctcctgggggtcccggagccggtaagcgtctgtgcgctatttgtggagatcgcagctccggaaagcactatggcgtctattcatgcgagggctgtaagggattctttaagagaactattagaaaggacttgacctatagctgccgagataataaggactgcaccgtagataaaaggcagagaaaccgctgccagtactgccggtaccagaaatgcttggccacaggaatgaaaagggaggccgtccaggaagaaaggcagcggggtaaggacaaggatggcgacggtgaaggagctggcggtgccccagaggagatgccagtagaccgaatactagaagcagagctggcggtggaacagaagagtgaccaaggagtggagggtcctggaggaaccggagggtccggatcgagcccgaacgaccccgtgaccaacatttgccaggccgcagataagcagctctttaccctggtggagtgggcaaaacgcattccacacttctcaagcctgcccttggatgaccaggtgatcctcctgcgggcaggttggaatgagctgctcattgcctccttttcgcaccgtagtattgacgtgagggatggaatactgttggcaaccggccttcacgtgcaccggaattccgcacactccgcaggcgtgggagccatattcgatcggtcactctcaagggtcctaaccgagctggtgagcaagatgagggatatgcggatggacaagacagagctgggctgcttgagggcgatcattctcttcaatcccgacgcaaagggactgtcaaatccctctgaggttgaggtgcttcgggaaaaagtgtacgccagcctggagacctactgtaaacagaagtaccctgagcaacaagggcgattcgccaagttgctcctgcgccttccagccctgaggtccatcggtcttaagtgtctcgagcacctgttcttctttaaacttatcggggatactccgatagatacatttttgatggaaatgcttgaggccccacaccagcttgcctag

SEQ ID NO: 238543 - DNA, 1614 bp, Artificial Sequence
  Description of Artificial Sequence: Synthetic coding sequence
atgagctgggccgctcgcccaccctttcttccccagcgtcacgcagccggacagtgtggtcccgtgggggtgaggaaagagatgcactgtggtgtggcgtctcggtggcgacgcaggagaccctggctggatcccgctgctgctgcagcagctgcagtggctgggggtgagcagcagactcccgaaccagaaccaggagaggccggacgggatggtatgggagacagtggacgagactcaagaagccctgattcatcctcccccaatccattgccccagggagtccctcccccatcacctccaggccctcccctcccgccatccaccgcaccttcacttggaggtagcggtgcaccaccccctcctcctatgccaccaccacctctcggcagtccattccctgtcatttcctcaagcatggggtctcccggtctgccacctccagcacccccaggctttagtggcccagtatcttcaccacagatcaattcaacagtctccttgcccggaggaggcagtgggcctcccgaggatgtgaaacctccagtattgggtgtgcgagggttgcactgccctccgccaccaggcggacctggtgctggaaaacggctctgcgccatttgtggcgacaggagctcaggaaaacattacggagtatatagctgcgagggctgcaagggcttttttaagcggacaattcgcaaggatctgacttattcctgcagagacaataaggactgtactgttgataagaggcagcgtaaccggtgccagtattgcagatatcaaaagtgtctggccacaggaatgaagcgtgaagcggtgcaggaggagcggcagcggggaaaggataaagatggtgacggtgagggcgctggaggtgcccctgaagagatgcctgtcgatcgaatcctcgaggctgaactcgccgtggaacagaagtctgaccagggtgttgaaggtccgggaggcacaggtggaagtggcagtagccctaacgaccccgtgactaacatttgtcaggccgcagacaaacagctgttcactcttgttgaatgggcaaagcggattccccacttttcctccctcccattggacgaccaggtaatcctccttcgtgccggttggaacgaactcctgatcgcttcgttcagccacagaagtattgatgtgcgggatggaatcctcttggcaaccggcctgcatgtccaccgaaattccgcccattcagccggagtcggcgcaatctttgataggtcactgtccagagttctcacagaactggtatctaagatgcgggacatgagaatggataagactgagctcgggtgtcttagggccatcatcctcttcaaccctgatgccaagggactctcaaatccaagtgaagtggaggtgttgcgcgaaaaagtgtatgcatcccttgagacatattgtaagcagaagtatcctgaacagcagggacgattcgctaagttgttgcttaggctacccgctttgcggagcattggtcttaaatgtctggagcatctgttttttttcaagctaatcggcgataccccaatagatacattccttatggagatgctggaggcccctcatcagctggcatag

SEQ ID NO: 238544 - DNA, 1044 bp, Artificial Sequence
  Description of Artificial Sequence: Synthetic coding sequence
atgcgcgaatgcggcggtggccctggcgctggaaagagactatgcgcgatttgtggtgaccgaagttccgggaagcactatggcgtgtattcctgcgaaggttgcaagggcttcttcaaaaggactattagaaaggacctgacttacagttgccgtgataacaaggattgtactgtagataagcggcagcggaatagatgccaatactgtcgttatcagaaatgtctggccaccggcatgaaaagagaggctgtgcaggaggagcgtcagcgaggcaaggacaaggacggtgacggtgagggcgcaggaggtgccccagaagagatgccggtcgacagaattctggaggctgagcttgctgtagaacagaagagcgatcagggggtggaaggacctgggggtacagggggatccggatcctcaccgaacgacccagttaccaatatctgtcaggccgctgacaaacaactgtttacgctggttgagtgggctaaaagaattcctcacttctcctccctgcccttagacgaccaggtcatactgcttagagccggttggaatgaattgctgattgcaagcttttcccaccgcagcattgacgtaagggatggtattctgttagccacagggttgcatgttcacaggaactctgctcattcggcaggagtgggagccatcttcgatcggtctctgtccagagtgctgaccgaacttgtgtccaagatgcgggacatgcggatggataagactgagctgggatgcctaagggctattatattgttcaaccctgacgcaaaaggtctctcaaacccaagcgaagttgaagtgctgagggaaaaagtttatgccagcctcgagacatattgtaagcagaaataccccgagcagcagggcaggtttgctaaactgctgctgcggttgcccgctctgaggagtataggtctgaagtgtctcgaacacctctttttttttaagcttattggcgatacccctatcgataccttccttatggaaatgctggaggctccgcaccagctggcctag

SEQ ID NO: 238545 - DNA, 1179 bp, Artificial Sequence
  Description of Artificial Sequence: Synthetic coding sequence
atgggctccccaggactacctccccctgcaccgcctggatttagtggccctgtaagtagccctcagatcaactcgacagtcagtctcccaggcggagggagcggccctccagaagacgtcaaacctccggtcctgggagtgagaggactacattgccctcctcctcccggaggccctggagctggcaaacgcctctgtgccatctgcggcgatagatcttctggaaagcactatggagtatatagctgtgaaggttgtaagggcttcttcaagcggaccatccggaaagacctaacctactcttgtcgggacaataaggactgtacggtggataaacggcagaggaacaggtgccagtactgtaggtaccagaagtgccttgctaccggaatgaagcgcgaagcagtacaagaagagcgccagagggggaaggacaaggacggggatggcgagggcgctggcggtgcacctgaggaaatgcctgtagaccgcattttagaagcagagctggccgttgaacagaagtcggatcagggtgtggagggcccagggggaacaggagcccctagtcccaatgatccagtcaccaatatctgccaggcagccgacaagcagctgttcaccctggtggaatgggccaagcgaattccgcacttctcaagcctgcctttggacgaccaggttatcctgctgagagccggttggaacgaactcctgatagccagcttcagccacagatcgatcgatgtgagggacggaatcctcttggccaccggattacatgtgcacagaaatagtgctcactctgccggtgtgggcgctattttcgaccgcgtcctgaccgaactggtgtccaaaatgagagacatgcggatggataaaacagaacttggctgcctgagagccatcatcctttttaaccccgatgccaaagggctgtccaacccgtcagaggtggaagttcttagggagaaggtgtacgcaagcctggagacttattgtaaacagaaatatcctgagcaacagggcaggttcgccaagttgcttctccgccttcctgcgttaagatccatcggcctgaagtgtcttgaacatctcttcttcttcaaactgattggagatactccgattgatacattcctgatggagatgctggaagcgcctcaccagctggcatag

SEQ ID NO: 238546 - DNA, 1170 bp, Artificial Sequence
  Description of Artificial Sequence: Synthetic coding sequence
atggggtctcctggactcccaccgcctgccccacctggcttctccggcccagtcagcagcccgcagatcaatagtactgtgtctcttcccggaggaggtagcggtccaccagaggacgtgaagccaccagtactgggtgttcgagggctgcactgccctccccctcccggtggtcctggcgcaggcaaacgtctttgtgctatctgtggcgaccgatctagcggtaagcactacggagtgtatagttgcgaagggtgtaaaggcttctttaagcgcacaattcgcaaggacctgacatatagctgccgggataataaagactgcactgtggataagcggcaacgcaatcggtgccagtactgtcgataccagaaatgtcttgcaacgggcatgaagcgcgaggctgtacaggaggagaggcaacggggaaaagacaaagatggagatggagaaggcgctggaggggctcctgaggaaatgcctgttgacagaattctcgaggcagagctggcggttgagcagaagtctgaccagggaggaagccagcacatttctaaatctcctaatgaccctgttacaaacatttgccaggctgccgataaacagttatttaccctggttgagtgggccaagcgaatcccacacttctcctccctgccattggacgatcaagtcattctgcttcgcgcaggctggaatgagctgctgattgcctctttttcacaccggtctatagatgtgcgtgacggcatcttgctggccaccggcctccacgtgcaccgcaatagtgcacatagcgcgggagtgggagccatctttgaccgcgtactgaccgaactggttagcaagatgcgagacatgagaatggacaaaacagagctgggatgcctgagagccataattcttttcaaccccgacgccaaaggattaagcaacccatcagaggtcgaagtgctcagagagaaagtctacgcctcccttgaaacttactgcaaacagaaataccccgagcagcagggcaggttcgccaagctgttgctacggttgcccgcactcaggtcaatcgggctaaaatgccttgaacatctcttctttttcaaactcatcggagacactccaattgatactttcctcatggagatgttggaggctccccaccagctggcatag

SEQ ID NO: 238547 - DNA, 1044 bp, Artificial Sequence
  Description of Artificial Sequence: Synthetic coding sequence
atgagagaatgcggagggggtcccggagctggcaaacgactatgtgccatctgcggcgatagaagcagtggaaaacattacggggtctactcctgcgagggatgtaagggctttttcaagcggacaattagaaaggatttgacatactcctgccgtgacaacaaagactgtaccgtggacaagaggcagcggaaccgttgccagtattgcaggtaccagaagtgcctcgccaccgggatgaaaagagaagctgtccaggaggaacggcagagggggaaagacaaagatggagatggcgaaggagccggtggcgcaccggaagagatgcccgtggaccgcatcctagaagccgagctggctgtggagcagaagtccgaccaaggagtggagggacctgggggaacagggggaagtggctctagtcctaatgatcctgttaccaatatctgccaggccgcagataagcagctcttcacactggttgaatgggcaaagcggattccccatttcagtagccttccccttgatgaccaggtgatcttactgcgcgctggatggaacgagctgctgattgcgagtttctcacatcggtccatagacgtaagggatggaatccttttggcgacaggcttacatgtgcaccggaatagtgcccacagcgcaggcgttggcgctattttcgatagaagcctctctagggtgctgacagagctcgtgtccaaaatgcgagatatgcggatggacaagactgaactagggtgcctgcgcgctataatcctgtttaacccggacgcaaaaggactgagcaacccttctgaggtggaggtcctcagagagaaggtttacgcctccctggaaacttattgcaaacagaaataccctgaacagcaggggaggtttgccaaacttctgcttaggttacccgctttacggagcattggtttgaaatgtctagaacatctcttcttctttaagctgatcggagacacaccaattgacaccttcctcatggagatgctggaagctccccaccagcttgcttag

SEQ ID NO: 238548 - DNA, 1179 bp, Artificial Sequence
  Description of Artificial Sequence: Synthetic coding sequence
atgggcagcccaggcctgcccccacccgcaccccctggcttctccggacccgtgtcctccccgcagatcaactcaaccgtgtcattgcccggagggggttccgggccacccgaagatgtgaagccccctgttctcggggtccgcggtctgcactgcccgcctccccctggcggacctggcgctgggaagagactgtgcgcaatatgcggggatcggagctcaggaaaacactatggcgtgtacagttgcgaaggctgcaaggggtttttcaagcggaccataaggaaggacctgacatactcatgcagggacaataaagactgtacagtcgacaagcggcagcggaataggtgtcagtattgccggtaccaaaagtgcctggctaccggtatgaaaagagaagcggtgcaggaggaacggcagcggggaaaggacaaggacggagacggcgaaggggctggcggtgcacccgaggaaatgcccgtggacagaattttagaagccgaattggcggttgagcagaaatcagaccagggagtggaaggtcccggaggcacaggtgcaccaagtcctaatgatccggtcacaaacatctgtcaggcagccgataagcagctgttcacattagtggagtgggccaaacgcatcccacacttctccagcctgcccctcgacgatcaggtgattctcttacgagctggatggaacgagcttttgatagcctctttctcccacagaagcattgacgtgcgagacggtattttactagctacaggattgcacgttcaccggaatagtgcccacagtgcgggagttggggcaatcttcgaccgcgtgctgactgaactggttagcaagatgcgtgacatgcggatggacaagactgaattgggatgcctcagagccattatattgttcaacccagacgcaaagggtctaagtaacccatccgaagttgaggtgctccgcgagaaggtatacgctagcttggagacctattgcaaacagaaatatccagagcagcagggtaggtttgccaaactgctattacggcttccagcattgcggtccatcggtctgaaatgtttagagcatctattctttttcaaactaatcggggatacccccatcgacacttttctcatggagatgttggaagcaccacaccagctagcgtag

SEQ ID NO: 238549 - DNA, 1170 bp, Artificial Sequence
  Description of Artificial Sequence: Synthetic coding sequence
atgggctcccctgggctgccgcctcccgctcctcctggctttagcggtcccgtgtcttcaccccagattaattccactgtgagcctgcccggtggtggcagtggacctccggaggacgtgaaaccacccgtcctgggagtgagaggcctacattgccctcctcctccgggagggcctggtgccggtaagcgcctttgcgctatctgcggcgacagatcctcaggcaagcattacggggtttactcctgcgagggctgcaagggattctttaagagaaccatacggaaggacctgacatacagctgtcgtgacaacaaggattgcaccgttgacaaacggcagcggaacaggtgccagtattgtaggtatcaaaagtgcctggccacgggaatgaagcgcgaggccgtgcaggaagagcggcagcgcggaaaggacaaggacggagatggggaaggcgcaggaggagcacctgaggagatgcccgttgaccgcattctggaggccgaactcgccgttgagcagaagagtgaccagggcggttcacagcacatcagcaaatctcctaacgatcctgttaccaatatctgtcaggccgcagataaacagttgttcaccctagtcgagtgggccaagcggataccccatttcagttcactcccattagacgaccaggtaatccttcttcgggctggatggaatgagctactcatcgcatccttttcccatcgttcgatcgatgttcgcgacggaattctgctggcaaccgggcttcatgtccaccgcaacagtgctcatagtgccggtgtgggagctatttttgatcgggtcctgactgagctcgtgagcaagatgcgggacatgaggatggacaaaaccgagctgggatgtcttagggcaatcattctgttcaatccagatgctaaggggcttagcaacccctcagaggtggaggtcctgcgcgagaaagtttatgcctccttagaaacctactgtaaacaaaaatatcctgagcagcagggaagatttgccaagttactgctgcgtctgcctgcattgcggtccatcggcctgaagtgtctagagcatctcttcttttttaaattgatcggcgatactccgattgacaccttcctcatggagatgctggaggctccacaccagctggcttag

SEQ ID NO: 238550 - DNA, 861 bp, Artificial Sequence
  Description of Artificial Sequence: Synthetic coding sequence
atgcctcagggttccgtcggaaggtgggggtgtgaaaaaaaatgtatagtcggaagccgacccggtggaggaggcgacggccctgggtggattccccagagacgacggaggcgaaggtggcaagctgagaacaataaacctcggagccgttctcaaggcagactggacggaaccggctgggccacagcaggcggaattaactccacagtttcgcttcccggaggaggatccggccctcccgaggacgtgaaaccgcctgttctgggagtgagggggctccattgcccccctcccccagggggtccaggagccggtaaacggctctgtgcaatttgcggagacagatcctctgggaagcactacggagtatactcatgtgagggctgcaaaggtttctttaagagaacaattagaaaggaccttacctacagttgccgcgataacaaggattgcacggtcgataaacgacaaaggaacaggtgccagtattgcaggtaccagaagtgcctcgcgaccggcatgaagcgagaggctgtgcaagaggagaggcaacggggaaaggacaaagacggtgacggcgagggtgcgggaggcgcaccagaggagatgcccgtggaccgcattctcgaggctgagttggccgtggaacagaaaagcgatcagggcgtcgaaggccctggaggtacaggcggatccggttccagcgtgtctgtaggagtgaaccccctatcctttgtcatgggtgtcggaggcggtagcctggggctcttctatatcccttcgccttcttttccgctcattactttcttaaccttgctgggcaccgggggagctgcaaagcaggggctatccaacatctag

SEQ ID NO: 238551 - DNA, 1170 bp, Artificial Sequence
  Description of Artificial Sequence: Synthetic coding sequence
atgggaagccccggtcttccccctcccgcaccccctggattcagtgggcctgtaagttccccgcaaatcaattctactgtgagcctacctggcggaggttccggaccaccggaagatgttaaaccaccagttctcggggtgcgcggattgcactgccccccaccaccaggaggtccaggggctgggaagcggttatgcgcaatatgcggtgacagaagctctggcaaacactatggggtgtattcttgcgagggctgcaaagggttctttaagaggacaattaggaaggacctaacgtactcttgccgtgacaataaggactgtaccgtcgacaaaagacagcggaatcgttgccagtactgtcggtaccagaaatgcctggctacgggaatgaagcgggaggcagtccaagaggaaaggcaacgaggcaaggataaagacggagatggagagggtgccggaggggctccggaggaaatgcccgtagaccggatattagaagccgagctcgccgtagaacagaaatccgatcaggggggatcccagcatataagtaagtctcctaatgacccagtgacaaatatctgtcaggctgctgataaacagctttttacattagtagagtgggcaaagaggatcccgcattttagctccctgccgctggacgatcaggtgatattgttgcgcgctggatggaatgaattgctgatagcttccttttcacaccgaagtattgatgttcgggacggaatcctgctagcaaccggcctgcatgtccacagaaacagcgctcattccgctggggtgggagccattttcgatagggtcttgacagagctcgtttccaagatgagggacatgcgcatggacaaaaccgagctaggttgcctgagggccatcatcctgttcaatcctgatgcaaaaggcctttctaacccgtccgaagtcgaggtgctccgagaaaaggtgtacgccagcctagagacgtactgcaagcaaaaatacccagagcaacaggggagattcgcaaagctgctgctacggcttcctgctcttcggagcatcggactcaagtgcctcgagcacctgttcttctttaaattgattggggatactcctatcgacacgttcctgatggaaatgctggaggccccacaccaactcgcgtag

SEQ ID NO: 238552 - DNA, 861 bp, Artificial Sequence
  Description of Artificial Sequence: Synthetic coding sequence
atgcctcaaggtagcgtcggtcggtggggttgcgagaagaagtgcatagtcggctcccggccaggcggaggcggagacgggcctgggtggatcccacagagaagaaggcggcgtcgctggcaagctgagaataataagcccagaagcagaagccagggacgccttgatgggacgggatgggccactgccggaggcataaattccaccgttagtctgcccggagggggtagcgggccacccgaagatgtcaagccacccgtgctgggagtcaggggcctacactgtccgcctcccccaggcggaccgggagccggaaagcggctatgcgctatctgtggcgataggagcagcggaaaacattatggagtctattcctgcgagggctgtaaaggtttctttaaacggacgatacgtaaggatctgacttatagttgtcgcgacaacaaggactgcaccgtggataaaaggcagaggaatcggtgccaatactgccgctatcagaaatgtctggccacaggcatgaagagggaagcggttcaggaggaacgccaaagaggtaaggacaaggatggcgatggcgaaggggctggtggggcacccgaggaaatgcctgtggatcgtatcctagaggccgagcttgcagtcgagcaaaagtcggatcagggagtggaggggcctgggggaaccggaggcagcgggtccagcgtctccgtgggagtcaatcccctgagcttcgtcatgggggtgggagggggaagtctaggtctgttctatattccctctcccagttttcctctgatcaccttcctcactctgctggggacgggcggagcggcaaagcagggtctctcgaacatttag

SEQ ID NO: 238553 - DNA, 1179 bp, Artificial Sequence
  Description of Artificial Sequence: Synthetic coding sequence
atgggtagtcctggcctcccgcctcccgcaccgccaggcttctccggcccagtatcgagtccacagattaacagtaccgtctccctgcccggaggcggatctggccctcctgaggatgtcaaacctccggtgttgggagtgcgcggacttcattgtccacctcctccaggcggtcccggtgcgggaaagcgtctctgtgccatctgtggggatcggtcatcaggtaagcactatggcgtgtatagctgtgaaggatgcaaaggtttcttcaaaaggactattcggaaagacctaacatacagctgcagggacaacaaggactgcacggtcgataaacgtcagcgcaacagatgccagtactgccgctatcaaaaatgcctagccactggcatgaagagggaagccgtccaggaggagcgccagcgcggaaaggacaaggacggcgacggagaaggtgctggaggggcacccgaggagatgcccgtggaccgcattctggaagccgagctggctgttgaacagaagtcagatcagggggtggagggtcctggagggacaggtgctcccagtcccaacgacccagtcacaaatatctgtcaggcagcagataagcagttattcacattggtcgagtgggccaagagaatcccacatttttcaagtctgcccctggatgatcaggttatactgctgagggccggatggaatgagctccttattgcctctttctcacatcggtccatcgacgttagggatggaatcttgcttgctaccggccttcacgtacaccgcaatagtgcccactcagctggggttggggctatatttgaccgggttctgacagagctggtgagtaagatgagagacatgcgcatggataagacggaattgggctgcctacgggcaataatacttttcaatccagacgccaaagggctctcaaacccctctgaggttgaggtgctccgggaaaaagtctatgcatcactggagacctactgtaagcagaagtaccccgaacagcaaggcagatttgccaagttgttgctgagactccctgctctgcgatcaatcgggttgaagtgcctcgaacatttgtttttttttaaattgatcggggacactcccattgacactttcctgatggagatgctcgaagcgcctcaccagctggcctag

SEQ ID NO: 238554 - DNA, 1044 bp, Artificial Sequence
  Description of Artificial Sequence: Synthetic coding sequence
atgagagaatgtggtgggggacctggagccggaaagaggctttgtgccatctgtggcgaccggagtagcgggaaacactatggcgtgtacagctgcgagggctgtaaaggtttttttaagaggacaatcagaaaggacttgacctacagctgccgcgataataaagactgcactgtcgacaagcggcagagaaatcggtgccagtactgccgctatcagaagtgtctggctacaggtatgaaaagggaagccgtgcaggaggagcgacaacgcggaaaagataaggatggcgacggagagggagccggaggcgcacccgaagagatgcctgttgaccggattctggaggctgagctggcagtggagcagaagtcggatcaaggagtagaaggacctgggggtactggcggatctggaagctcacccaacgatccagtcacaaacatctgtcaagccgcagataagcagctcttcaccctggtcgaatgggcaaagagaattccccactttagttccttacctctggacgaccaggtgatccttcttcgcgctggttggaacgagctgctcatcgcttccttttcccacaggagcatcgacgtccgggacggaatcctgctggcaacgggtctgcatgtacatcgcaattcggcacattcagctggagttggtgccatctttgaccgcagcctgtctcgggtcctgacagagctggtttctaagatgcgtgacatgcgaatggacaaaactgaattgggatgtctgcgggcaattattctgttcaacccagacgcaaagggtctctccaacccaagtgaggtagaggtgctacgcgaaaaagtgtatgccagcctagagacttattgtaaacagaagtatccagaacagcagggcagatttgctaagctgctgttgaggctgcccgcactgcgaagcatcggacttaagtgcctggaacacttatttttctttaaactcataggcgatacgcccatcgacacattcctcatggagatgctcgaggcccctcatcagctcgcctag

SEQ ID NO: 238555 - DNA, 1179 bp, Artificial Sequence
  Description of Artificial Sequence: Synthetic coding sequence
atggggtcacccggtctgccaccgccagcccctccgggattttctggtcctgtcagttccccacaaatcaacagcacagtatccctgcccggagggggaagtggaccccctgaggatgttaaaccccctgtgctcggtgttagagggttacactgtccaccacctcccggaggcccaggcgcaggaaagagactgtgcgctatttgcggagatagatcttccgggaagcactacggcgtctacagctgcgagggctgtaaaggatttttcaaaaggaccatacgcaaagatcttacttatagttgcagagataacaaagactgcacggtagataagcggcagcgtaacaggtgccagtactgcaggtatcagaagtgcctggctacaggaatgaaacgggaggccgtccaagaagagagacagcggggaaaagacaaagacggtgacggcgagggcgctggcggtgcccctgaggagatgcccgtcgatcgcatcttagaggccgagctcgctgtagagcaaaaatcggatcaaggcgtggaggggcctggcggaaccggtgctcccagccctaacgaccccgtgacgaacatctgtcaggccgctgacaaacagctgtttactctagtagaatgggcaaaacggattccccatttttctagtctgccccttgacgatcaggtgattctgcttcgtgcgggttggaacgagctgctgattgccagtttcagtcataggagtattgatgttagggatggcatactgctggcgactgggctgcacgtccatcgcaactcagctcactcagccggtgtgggggctatctttgacagagtcctgaccgaactcgtaagcaaaatgcgcgatatgaggatggataaaaccgagctaggctgcttgagggcgatcattcttttcaaccctgacgctaagggactgtccaatccttccgaagttgaggtcctaagagaaaaggtttacgcctctctagagacctattgtaagcagaaatacccagagcaacaggggcgttttgcaaaacttctgttacggctgcctgctctgcggagtatcggtctgaaatgtcttgaacacctctttttctttaaacttattggcgatacgcctatcgacacttttttaatggagatgctggaggcccctcaccaactagcctag

SEQ ID NO: 238556 - DNA, 1179 bp, Artificial Sequence
  Description of Artificial Sequence: Synthetic coding sequence
atgggatcccccggtttaccaccgcctgccccaccaggattctcaggccctgtaagctcaccccaaatcaacagtacagtttctcttcctggcggaggatcaggaccacccgaggatgtaaaacctcctgtcctgggtgtgcgaggcttacattgcccgcctccacctggtggcccaggcgctggaaagcgcctatgtgcaatctgcggtgaccgttccagtggtaagcattacggagtatacagctgcgaggggtgcaagggtttcttcaaacgcacaatcaggaaagacctgacatactcctgtagagacaacaaagattgtactgttgataaacgtcaacgcaacagatgccagtactgcagatatcagaagtgtctggctaccgggatgaaaagggaggccgtgcaggaggaaaggcaaagaggcaaagataaggatggagacggggaaggggcaggcggtgcaccggaagagatgccagtggatcggattctggaggcagaacttgcggtggagcagaagtccgaccaaggggttgagggaccgggaggcacaggggctccgtctcccaacgaccctgttacgaacatttgccaagctgccgataagcaacttttcactctggtggaatgggcaaagaggatcccccacttttcatccctacctctggacgatcaagttatcttgctgcgcgcaggatggaacgaattactgattgcctccttttcgcacagaagcatcgatgttcgggatggcatcctcctggctacaggcctgcatgtgcacaggaacagtgctcacagtgctggagtgggagctatctttgaccgcgttctgacagagcttgtttctaaaatgcgcgacatgcggatggataaaacggagttgggatgtctccgggcaataattttgtttaatcctgatgccaaaggattatccaatccttcggaggtagaagtcctgcgagaaaaggtgtatgcctcacttgaaacctactgtaaacaaaaataccccgagcagcagggacgctttgccaagctgcttcttcggttacccgcattgcgaagtatcggcttgaagtgcctagagcacctctttttttttaagcttatcggcgatacaccaatcgacacttttcttatggaaatgttagaggctcctcatcagctggcgtag

SEQ ID NO: 238557 - DNA, 861 bp, Artificial Sequence
  Description of Artificial Sequence: Synthetic coding sequence
atgccacagggcagcgtgggcagatggggttgtgaaaagaagtgtatcgtgggaagccgtcccggaggcggtggggacggcccaggttggatcccacagagacgacgtcgcaggagatggcaggctgagaataataaacccagaagccgcagtcaaggcaggctggacggtactggatgggcaactgcgggaggaatcaattctaccgtaagccttccgggtggtgggtccggccctcccgaagacgttaaacctcccgtcttaggggtacgcggattgcactgtccgccacccccaggaggtcctggagcaggaaagagactttgtgctatctgtggagacaggagttcaggcaaacattacggagtgtatagctgcgagggctgtaagggtttcttcaaaaggaccattcggaaagacctgacctactcgtgtagagataacaaggattgtaccgtggacaaacggcaacggaaccgatgtcaatattgcagatatcagaaatgtcttgccacaggcatgaaacgggaggccgtacaagaggagcggcagcggggaaaggataaggacggggacggcgagggggctgggggtgccccagaggagatgcctgtagacaggattttagaggctgaattggcagttgaacaaaagagtgaccagggcgtggaaggtcccggagggactgggggatcaggtagctccgtaagtgtgggcgtaaatcctctgagctttgtgatgggagtgggcggtggcagcctgggcttgttttacattccgagcccttcttttcctttgatcacatttcttaccctactggggacagggggtgcagccaaacagggacttagtaatatctag

SEQ ID NO: 238558 - DNA, 1170 bp, Artificial Sequence
  Description of Artificial Sequence: Synthetic coding sequence
atggggagccctggtctccctcctccagcacctcccggtttcagcgggccagtgtcttccccccaaatcaacagcactgtgagtctgcccggtggcggtagcgggcctccagaggatgtgaaaccaccggtcctgggggtcagagggctgcattgtcctcctccccctggcggtcctggagctggcaaaaggttatgtgctatctgcggagatcgtagctcaggtaagcactacggcgtttacagctgtgagggctgcaagggctttttcaagagaacaatcagaaaggatcttacctactcctgccgcgataataaagattgcactgtcgacaagcgccagcggaatcggtgccaatactgcaggtaccaaaaatgcttagctaccggcatgaagcgcgaggctgtacaagaagagaggcaacgaggaaaggacaaagatggcgacggtgaaggcgctggcggtgcgcctgaagagatgcccgttgatagaatcttggaggcagagttggccgtcgaacagaaaagtgaccaggggggaagccagcatattagtaagtctccaaatgaccccgtaacgaacatttgccaggctgctgacaaacaactgtttacactcgtcgagtgggccaagcgcattcctcacttttctagcctcccacttgacgaccaggtcattttactcagagcaggatggaacgagctattgattgcttccttctcacacaggtccattgacgtcagagatgggattctccttgccacgggcctccacgtccatcgcaactccgcccattcagcgggagtcggcgcaatcttcgatagagttctgacagaactggtgagcaagatgagggatatgcgcatggataaaacggagcttggttgcctgagggccatcattttgttcaatccggatgcaaaggggctgagtaatccttctgaagtggaagtccttcgagaaaaggtctacgcgtctttggaaacatactgtaaacagaaatacccagagcaacaggggagattcgccaaactgctcctgaggctgcccgctctgcggtccattggactcaagtgcctcgagcatctcttctttttcaagctgattggcgacaccccaattgacacatttttgatggagatgctggaggcccctcaccagctggcttag

SEQ ID NO: 238559 - DNA, 1044 bp, Artificial Sequence
  Description of Artificial Sequence: Synthetic coding sequence
atgcgcgaatgcgggggtggtccgggagctgggaagcgtctttgcgccatctgtggggatcggtccagcggcaaacattatggtgtttactcttgtgagggatgtaaaggcttcttcaaacgcaccattcggaaagatctgacttattcttgtcgtgataataaggactgtacagtggataagcgccaaagaaatcgttgtcagtattgcagatatcaaaagtgcctcgcaactggaatgaaacgtgaagccgtgcaggaggaacggcagcgaggaaaagataaagatggcgatggcgagggagcgggtggagccccagaggaaatgcccgtggatcgcattctggaagctgagctggccgtggaacaaaaatctgatcagggggttgagggcccaggagggactggaggcagcggcagctctccgaatgacccagttactaatatttgccaggcagccgataagcagctgttcacactggtggagtgggccaaacgcataccccactttagctcactgcctctggacgaccaggttatcctcttgcgggcaggctggaatgaactgttaatcgctagtttcagccacagaagcattgacgttcgagacgggatcttattggcaacaggtctccacgtgcacaggaattcagcccatagcgccggtgtaggcgcaatcttcgacaggtcactctcccgagttctgaccgagctggtgagtaaaatgcgcgacatgcgaatggacaaaaccgaactaggttgtttgcgagccattattctctttaatccggatgccaagggcctgagtaacccttctgaggtggaggttctccgggaaaaggtgtatgcttctctggagacatattgcaaacagaaatatccagagcaacagggaaggttcgcaaaactcttgttacggctcccggcattacggagcataggcctcaagtgccttgaacacctgttctttttcaagttaattggcgataccccaatcgatactttcctgatggagatgctcgaggcaccacaccagctggcttag

SEQ ID NO: 238560 - DNA, 1170 bp, Artificial Sequence
  Description of Artificial Sequence: Synthetic coding sequence
atgggaagccccggtttgccaccacccgctcctcctggcttttccggtcccgtgagcagcccgcagatcaattctacagtttctttgccgggaggtggaagcggaccaccagaggatgtcaaacctcccgtgctgggtgtcagaggactgcactgccctccacctccaggcggtcccggagctgggaaacggctgtgcgcaatctgtggggacaggtctagcggcaagcactatggcgtttatagctgcgagggttgcaaggggtttttcaagagaactattaggaaggacttgacttatagctgcagagataataaggattgcactgtagataaacgtcagcgaaatcgatgccagtactgcagatatcagaagtgtttggcaacagggatgaagagggaggctgtgcaggaggagaggcaacgcggtaaggacaaagacggagacggcgaaggggctggcggagcaccggaggagatgccagtggatcgaattctggaggcagagctggccgtggaacaaaagtccgatcaggggggttctcagcacatctcaaaatccccaaacgatcccgtgactaatatctgtcaggcagctgataaacaactgtttacattggtggagtgggcaaaaagaatcccacattttagctcattgcctctcgatgaccaggtcatactgttgcgggcaggctggaatgaactattgatcgcctccttcagtcaccggtccatcgatgtccgcgatggcatcctcttagccaccggactccacgtccaccggaactcggcacactcagcaggggtaggtgctatcttcgacagggtgttgacagaactcgtatccaagatgcgtgatatgagaatggacaagacagagctggggtgtctccgcgctatcattctgttcaaccccgacgccaagggcctgtccaacccttccgaagtagaggtccttcgcgagaaggtttacgcaagtctggagacttattgcaaacaaaagtatcctgagcagcagggaaggttcgcaaaattattgctgcggctacctgcactgcgatctatcgggctgaaatgcctggaacatctttttttcttcaaactgattggagacacccctattgacacctttttgatggagatgcttgaagcccctcaccagctggcgtag

SEQ ID NO: 238561 - DNA, 1044 bp, Artificial Sequence
  Description of Artificial Sequence: Synthetic coding sequence
atgcgagagtgcggagggggaccaggggctggaaagcgtctctgtgcaatttgtggagacagatccagtggtaagcactacggagtttactcctgcgagggttgcaagggattctttaaacgtacaatccggaaggacctgacttactcctgccgggataacaaagattgtactgtcgataaacgtcaacgtaatcgctgtcagtactgcaggtaccagaagtgtctagccactggcatgaaacgggaggcagttcaagaagaacggcaaagggggaaggacaaagatggagatggggaaggggcaggcggagcccctgaagagatgcccgtggaccggattctggaagcggaattggccgtagagcagaaatctgatcagggcgtcgagggcccaggcggtaccggcggaagtggctcctctcctaacgacccagttaccaatatctgccaggcagccgataaacaactcttcaccctggttgaatgggctaaacggatcccccacttttctagtcttcccctagatgaccaagtcatccttctgcgcgctggttggaatgaacttctgatcgcttctttctcacaccggtcaatcgatgtccgtgatggcattttactcgccaccggtctacatgtccaccgcaacagcgctcactcagctggcgttggggcaatatttgatcgcagcttatctagagtattgactgaactggttagtaagatgcgcgatatgagaatggacaaaaccgaactggggtgtctgcgtgcaattatcttattcaaccctgacgccaagggcctgtctaatcccagcgaagtggaagtgttgcgtgaaaaggtatacgcctcgctggaaacgtactgtaaacagaagtacccggagcaacaaggaagatttgcaaagctcctactgcggctgcctgcactgagatctatcggtcttaaatgcctggagcacctcttcttttttaagctgattggagataccccaatagatacttttttaatggagatgctggaggctcctcatcagctggcatag

SEQ ID NO: 238562 - DNA, 861 bp, Artificial Sequence
  Description of Artificial Sequence: Synthetic coding sequence
atgcctcagggctcggttgggcgatggggctgtgagaaaaagtgtatcgtgggatcacggcctgggggtggcggagatgggcctggatggatccctcagcgtcgtcgaaggcggaggtggcaagcagaaaataataagccacgctctcgcagtcagggccgtctcgatgggacagggtgggcaactgcaggtggcattaatagcacagtgagtctgccaggaggtgggagtggaccacctgaagacgttaaacccccagtactgggggtccgaggactccactgccctccccctccgggagggccaggcgcagggaaacgcttatgtgctatttgtggagaccggtctagtggcaaacactatggcgtgtacagttgcgaggggtgcaagggcttttttaagcgaacaattagaaaggaccttacgtacagctgcagggacaataaagattgcaccgtagataaaagacagcggaatcgttgtcaatactgtagataccaaaaatgcctggccacaggaatgaaaagagaggccgtccaggaagagcgccagagaggaaaagacaaggatggggacggtgaaggggctgggggagcgccagaagagatgccagttgaccgcatcctagaagccgagctggcagttgaacaaaaatccgatcagggagtcgaaggtccaggtggcaccggtggatctggttcatctgtctctgtgggagtcaaccctctgtcattcgttatgggagtgggcggaggctccctgggtctcttttatattcccagcccttctttccccctgatcacctttctcaccctgctaggcaccggcggtgccgcaaagcagggactgtctaatatctag

SEQ ID NO: 238563 - DNA, 1392 bp, Artificial Sequence
  Description of Artificial Sequence: Synthetic coding sequence
atgtatggcaactattcccattttatgaagttcccagccggatacggcggttctcccggacacacagggtcaacctccatgtctccttctgccgcattgtctaccggaaagccaatggactcccatcctagctacaccgacacacctgtgtctgcacctaggaccctgagcgcggtcggcactcctctgaatgccctgggctccccttaccgggtaatcacgtccgctatgggtccaccaagcggtgccctggccgcaccgccaggtattaatcttgtcgctccaccaagctctcaactgaacgtagtgaacagtgtaagcagcagtgaggatattaagcctttgcctgggctccccggtatcggcaatatgaactacccaagtacgtcacccggtagcctggtgaagcacatatgcgctatctgtggcgatcgctcgtcagggaagcactatggggtgtatagctgtgagggatgcaaaggcttctttaaaagaaccatccgcaaggatctgatctacacatgcagggacaacaaggactgcctgattgataagagacagaggaacagatgtcagtactgccggtaccagaaatgcttagtgatgggaatgaagcgggaggccgtccaggaggagaggcagcgctcccgggaacgggctgagtcagaagcagaatgcgctactagcggtcacgaggacatgccggtcgaaagaatactggaggctgaattggctgtcgagccgaagaccgagtcctacggggatatgaatatggaaaattccactaacgatcctgtaactaatatctgccacgctgctgataagcagctatttacattagtggagtgggccaaacgtatcccgcacttcagcgacctgacactcgaagatcaggtgatcctgctcagagccggttggaacgaactactgattgccagctttagccaccgctcggttagcgtccaggatggtatcttactcgccaccggacttcacgtgcataggtcatccgctcactctgccggtgtcggctcaatttttgatagagtcctgaccgagctcgtgtccaagatgaaggacatgcagatggataagagtgaactggggtgtctgcgcgctattgtgttgttcaaccccgacgcaaaaggcttgagcaaccccagcgaagtcgaaaccctccgtgagaaagtgtatgcgaccctcgaggcttacaccaaacagaagtaccctgagcagccaggtagattcgctaaactgctgctccgcctccccgctttgcgctctatcggactgaagtgtttggagcatttgttcttctttaagttaattggggacacacccatagatactttcttgatggagatgttagaaacccccctgcagataacctag

SEQ ID NO: 238564 - DNA, 2619 bp, Artificial Sequence
  Description of Artificial Sequence: Synthetic coding sequence
atggcaaccgcctgtaaacgttcaggcgagcctcaatcagatgatatcgaggcttccagaatgaaacgggctgcggcaaaacacctgatcgagaggtactatcaccagttgaccgaggggtgtgggaacgaggcatgcacaaacgaattctgcgcctcttgccctacattcctccgcatggataacaacgcggcagcgattaaagctctggagctatataagataaatgctaagctgtgtgatccccacccctctaaaaaaggtgcttcaagcgcatacctggaaaactcaaagggtgctcccaacaactcctgcagcgaaatcaagatgaacaaaaaaggcgcacgaatcgacttcaaggatgtcacctacctgactgaggagaaggtttacgaaattttggaactgtgtcgggaaagagaggattatagcccgttaattagggtgattggcagggtgtttagcagtgccgaggcactcgtgcaatctttcaggaaggtgaagcagcatactaaggaggaattgaaaagtctgcaagccaaggatgaggacaaggatgaggacgagaaggagaaggccgcatgtagcgccgcagccatggaggaagatagtgaagcttcatcctcacgcattggcgacagttcacagggtgacaacaacctacagaagctcgggccagacgatgttagtgttgacatagacgcaattcgtagggtttatactcggctgttgagtaacgaaaaaattgaaactgctttcctcaacgcacttgtgtatctgagccccaatgttgagtgtgacctcacttaccacaacgtctactcccgcgatccaaactatctgaatttatttatcattgttatggagaaccggaatctgcacagtcccgagtacctggagatggcactccccctcttttgcaaggcaatgagtaagctgcccctggctgcccagggtaaactgatccgcctgtggtcgaaatacaacgccgatcagattcggcgtatgatggagactttccagcagctgataacttataaggtaatttctaacgagtttaactctaggaacctcgtaaatgacgatgatgccatagtcgcggcatccaagtgcctgaaaatggtgtattatgcaaacgttgtaggaggggaggtcgacactaatcacaatgaggaggacgacgaggagcccattcctgagtcttccgagctcacccttcaggaattgcttggggaggaacggaggaacaagaagggtcccagggtggacccactcgaaacagagcttggggtcaaaactctggactgccgcaaaccacttatcccatttgaagagttcattaatgaaccccttaatgaagtcctcgagatggacaaggactacaccttcttcaaagtggagactgagaacaagttttccttcatgacttgtccattcatcttgaatgcagttacaaaaaaccttgggctgtactatgacaaccgcattaggatgtactctgagaggcggatcaccgttctctattccctagtgcagggccagcagctgaatccttatctgcgcctgaaggtgcgacgagaccatataatcgacgatgccctggttaggctggagatgatagccatggaaaaccctgccgacctgaaaaagcaactgtatgttgagtttgagggtgagcagggtgtggatgaaggtggcgtgtccaaggagttctttcagcttgtcgtagaggagatatttaacccagacattggcatgtttacatacgacgagtcaaccaagttgttttggtttaatccatcaagctttgaaactgagggccaattcacactcatcggaatcgtactggggctcgccatttataataactgcattctggacgtgcattttcctatggtggtctaccggaagctcatgggtaagaagggtactttccgggacctaggcgatagccatccagttctctatcagagcctgaaggatttgctggaatatgagggcaacgtggaagacgacatgatgatcacttttcagatatctcaaactgacctttttggaaaccccatgatgtacgacctcaaagagaatggtgataagattccaatcacaaatgagaaccgcaaagagtttgttaatttgtattcagattatatcctaaacaaatccgtggaaaaacagtttaaagcattccgcagaggatttcatatggtcacaaatgagagcccgttgaagtatttattccgccctgaggagatagaactgttgatctgtggatcacgcaatctggactttcaagcactggaagaaacaaccgagtatgatggaggatatacccgcgattctgtgctcatcagagaattttgggagatcgtgcactctttcactgacgagcagaagcggctttttctccagttcacaaccggcaccgaccgtgccccagtcggcggattaggtaaactcaaaatgatcatcgctaagaacggcccagatacggaacggctccccacctcacacacctgcttcaatgtactcctcctgcccgagtattcgagtaaggagaagttgaaggaacgactcctgaaagcgataacttacgccaaaggattcggaatgctttag

SEQ ID NO: 238565 - DNA, 75 bp, Artificial Sequence
  Description of Artificial Sequence: Synthetic coding sequence
atgactcgcgatcagaacggaacctgggaaatggagtcgaatgagaattttgagggatacatgaaagccctgtag

SEQ ID NO: 238566 - DNA, 312 bp, Artificial Sequence
  Description of Artificial Sequence: Synthetic coding sequence
atgacgcgggaccaaaacggtacttgggaaatggagtcaaacgaaaacttcgaggggtatatgaaggctttggacatagattttgccaccaggaagattgctgtgagactgacccaaacaaaggtgattgatcaagatggtgacaactttaaaacaaaaacgacatcgacattcaggaattatgacgtagactttacagtgggagtggaatttgacgaatatacaaagtccctagataaccgccatgttaaggctctcgtcacttgggaaggagatgtactcgtctgcgtccagaagggagaaaaggagtag

SEQ ID NO: 238567 - DNA, 1494 bp, Artificial Sequence
  Description of Artificial Sequence: Synthetic coding sequence
atgggcctccccgcattactggcatcggccctgtgtacatttgttctgcccttactactgttccttgccgctatcaagttgtgggacctctattgtgtctccggacgggacaggagctgtgctctccctctgccgccaggtacgatggggtttccctttttcggagaaacactgcagatggtgctgcaaagacgaaaatttctgcaaatgaagagaagaaaatatggcttcatttataaaacccacctcttcggaaggcctaccgtccgtgttatgggtgccgataatgtgcgcaggatccttttgggagagcacaggctcgtatccgtacattggccagcatctgtcagaactattctggggtctggatgcttgtccaacctccatgattctagccataagcagagaaaaaaggtgatcatgcgtgctttctccagggaagccctggagtgctacgtacctgttatcacagaagaggtcgggtcgagcctggaacagtggctgtcctgcggggagaggggtctgctggtgtatccggaggtgaagcgcctcatgttccgaatagccatgcgaattctgctagggtgcgagccccagctggccggtgacggtgactccgaacagcagcttgtcgaggcatttgaggaaatgacccgtaatctgttttccctccctatcgacgtgcccttttccggcttgtatcggggaatgaaagctcgcaatctaatccacgccaggatcgagcagaatatcagggcaaagatctgcgggcttcgcgcatccgaagctggacaggggtgtaaagacgccctacaactgctcatagagcatagctgggaacgtggggaacgcttggacatgcaggctctgaaacagtcttccaccgagcttctgtttggaggtcatgagactactgcttctgcagcgacatctctcataacctatctcgggctctatccccacgtgctgcagaaggtgagagaggagctgaagagcaagggcttactgtgcaagagcaatcaagacaataagctcgacatggaaattctggagcaactaaagtacatcgggtgcgtgatcaaggagacgctgcggttgaatcctcccgtgcctggcggtttccgtgttgcactgaaaacttttgagctcaacgggtatcagattcctaaaggatggaacgttatctattcaatctgcgatacacatgacgtagctgagatctttactaataaggaggaattcaaccctgaccggtttatgttgccacacccagaggacgcctcacgattttcattcatccccttcggcggtgggctgcgttcctgcgtgggcaaggaatttgctaagatccttttgaaaattttcacggtggagttggccaggcattgtgactggcagcttctgaacggcccaccaacaatgaagacttccccaactgtttacccggttgataacctaccagctagatttactcattttcatggggagatctag

SEQ ID NO: 238568 - DNA, 600 bp, Artificial Sequence
  Description of Artificial Sequence: Synthetic coding sequence
atgaattactccaagatccccgctcaggtggacctgcgcagacagacagagcgggattgtagggtctcgtccttccgggtgaaggagaatttcgacaaagccagattctcagggacttggtacgccatggccaagaaggaccccgagggtctctttcttcaggacaatatcgtagctgagttcagcgtggatgagacaggacagatgagcgctaccgcgaaaggtcgtgtaagacttcttaacaattgggatgtgtgtgccgacatggtcggcactttcaccgacacggaagacccagctaagtttaagatgaagtattggggcgtcgcgagttttctacagaagggcaatgacgatcactggatcgtagacactgactatgatacttatgccgttcaatattcgtgtagacttctaaacctggacgggacctgcgccgatagctactcattcgtgttctctagagatcccaacggactgcctcctgaggcacagaagattgtcagacaacgtcaagaggagctttgtctcgctcggcagtatcgtctgattgttcataacggttattgtgatggcagaagcgagcgaaatctgttgtag

SEQ ID NO: 238569 - DNA, 606 bp, Artificial Sequence
  Description of Artificial Sequence: Synthetic coding sequence
atgaaatgggtctgggccctattactgctagccgcactgggtagcggtcgagcagagagagattgtcgcgtgagttccttccgagttaaggagaattttgataaggctaggttcagcggcacgtggtacgcaatggcgaagaaagaccccgaaggcttattcctgcaggataacatcgtagctgagttctccgtagacgagaccggccagatgtctgccactgctaagggaagggtgcgcctgctgaacaattgggatgtgtgtgccgatatggttggtacgtttaccgacactgaggacccagcaaagttcaaaatgaagtactggggggtcgcctcatttttacaaaaaggaaatgacgatcactggatcgttgacaccgactacgacacatatgccgtccaatattcctgtagattgctgaacctggacggtacttgtgcggattcctactctttcgtattcagtagagacccaaacggcttgccaccggaggcccaaaagatcgtacggcaacggcaggaggagctgtgcctggccaggcagtaccgtctgatcgtgcacaacggatattgcgacggtcgctctgaacggaacctgctgtag

SEQ ID NO: 238570 - DNA, 606 bp, Artificial Sequence
  Description of Artificial Sequence: Synthetic coding sequence
atgaaatgggtatgggcactgctgcttctggccgctcttgggtcgggcagagcagagagggattgtcgggttagctcatttcgggtgaaagaaaatttcgataaagcacggttcagcggcacatggtacgcaatggccaaaaaggacccagaagggctgttcctccaagacaatatagtggccgagttcagtgtggacgagacagggcagatgagtgcgaccgcaaagggcagagtgcgcctgctgaacaattgggatgtgtgcgccgatatggtaggtaccttcacagatacagaagatcccgcaaaatttaaaatgaaatactggggcgttgctagcttcctccagaaaggcaatgacgaccattggattgtcgacacagattacgacacatacgccgtccagtatagttgtcgcctgctgaacctggacggcacctgtgccgatagttactcgttcgtgttttcgcgggaccctaacggtttgccccctgaagcccagaaaatagttcggcagaggcaagaagagctctgtctagctcggcagtatcggctcatcgtccacaatggctattgtgacggtaggtctgagcggaatctgctttag

SEQ ID NO: 238571 - DNA, 600 bp, Artificial Sequence
  Description of Artificial Sequence: Synthetic coding sequence
atgaactacagtaagatcccagctcaggtggacctgcgtcgccaggctgagagagattgcagggtttcttcttttcgggtcaaagaaaactttgataaagcaagattttctggtacttggtatgctatggccaagaaggaccccgagggcctgttcctgcaagataatatcgtggcggagttcagtgttgacgagacaggacagatgtccgccacagccaaaggtagggtccgactcctgaacaactgggacgtgtgcgccgatatggttggtaccttcactgacaccgaggacccagccaagtttaaaatgaagtactggggcgttgcttctttcctccagaaaggaaacgatgatcattggatcgtggataccgattacgatacatatgcggttcaatatagttgccgccttctgaacctcgacggcacttgtgcagacagctattcattcgtgttctctagagacccaaacggtctcccccctgaagcccagaagatcgtccgacagagacaggaagaactgtgcctggcccgtcagtaccgattgatcgttcacaatggttactgtgacgggcgttccgagcgcaaccttctatag

SEQ ID NO: 238572 - DNA, 408 bp, Artificial Sequence
  Description of Artificial Sequence: Synthetic coding sequence
atgcctcccaatctgaccggctattataggtttgtgtcgcagaagaacatggaagactatcttcaggccctcaatatctcgctggccgtcagaaaaatagcgctgctcttaaagcccgataaagagattgaacatcagggcaaccatatgacggtgagaacgctgagcaccttccgcaactatacagtccagttcgatgtgggagtggaattcgaagaagacctgaggagcgtggacggcagaaagtgtcagacgatcgtgacctgggaggaagagcatttggtgtgtgtgcagaagggagaagtacccaaccgtggctggaggcattggctggaaggcgagatgctgtatctggagctgacggctcgagacgctgtgtgcgaacaggtgtttaggaaagtgaggtag

SEQ ID NO: 238573 - DNA, 1026 bp, Artificial Sequence
  Description of Artificial Sequence: Synthetic coding sequence
atgaacatagtcgtagaattctttgtggttaccttcaaggtgttgtgggcatttgtgctcgcagctgcgaggtggctcgtgcgccctaaagagaagtctgtggcaggacaagtatgtttgatcaccggggcagggagcggcctcggaagactctttgccctagagttcgccagaaggagagcattactcgtactgtgggacataaacacccagtccaatgaggagactgcaggaatggtgaggcacatttatcgggatctagaggcagccgatgcggctgctctgcaggccggaaacggagaggaagagatcttgccacattgcaatttgcaggtgttcacctatacctgcgacgtaggcaagagggagaatgtttacctgacggctgagagagtgagaaaagaggtcggagaggtgagtgtgttagtgaacaatgcaggcgttgtcagcggccatcacctcctggaatgtcccgacgaattgatcgaaaggacgatgatggtgaactgtcatgctcatttttggactactaaggcctttcttccaacaatgctggaaattaaccatgggcatatcgtcacagtggcgagttcactgggcctgttcagtacagcgggagtggaagactactgtgcctccaaattcggagtggtggggtttcatgagagtctgtctcacgaactaaaagccgctgaaaaagatggcattaaaactacccttgtgtgcccttatctggtggacaccggcatgtttcgaggttgccgtatccggaaggaaatcgagccctttttgcctcccttgaagccggactactgcgttaaacaggccatgaaggctatcctcactgaccagcctatgatatgcacaccaagacttatgtacatagtgacctttatgaagtcgatcttgcctttcgaagctgtggtgtgtatgtacaggttcctcggagctgacaagtgcatgtatccattcatcgctcagaggaaacaagcaactaataataatgaggccaagaatgggatctag

SEQ ID NO: 238574 - DNA, 957 bp, Artificial Sequence
  Description of Artificial Sequence: Synthetic coding sequence
atggtggagcttatgttccccctcctcttgttgctactgcccttcctgttatacatggccgcacctcagatacggaaaatgctctccagcggtgtgtgcaccagtaccgtgcagttgcccggtaaggtggtcgtggtgacaggggctaacactgggatcgggaaagaaacggcaaaggagctggcacaaaggggagctagggtgtacctggcctgtcgcgatgtcgaaaaaggcgagctggtagctaaagaaatccagactaccactgggaaccagcaagtgttggtgagaaagctcgaccttagtgatactaaaagtattcgagcattcgcgaagggctttttagcagaagagaagcatcttcacgtgttgataaataatgccggagtaatgatgtgcccgtactccaaaacagccgacgggtttgaaatgcatatcggtgtcaaccatttgggacactttctcttaactcacctcctgctggagaaactgaaagagtcagccccaagcagaatagttaacgtgtcgagccttgctcatcatctcgggaggatccactttcacaatctccagggcgaaaagttttataatgcaggacttgcctactgccactccaagctcgccaatattctgtttactcaggaactagcgcgaagattgaagggaagtggggtgactacttactccgtgcatcccggaacagtgcaaagcgagctagtgaggcacagctctttcatgcggtggatgtggtggttattttcattcttcattaagacacctcaacagggcgctcaaacttccctgcattgcgctctgaccgagggcctcgagatcctgagcgggaaccactttagtgactgccacgtagcctgggtctcggcccaggccaggaatgaaacaattgcgagacgactgtgggatgtgagttgtgaccttcttggactccctatcgattag

SEQ ID NO: 238575 - DNA, 918 bp, Artificial Sequence
  Description of Artificial Sequence: Synthetic coding sequence
atggtggaactcatgttccccctcctacttctgctcttgccgttcctcttgtacatggcggcaccacaaatcaggaaaatgctgagcagcggcgtttgtactagcacggtccagttgcctggcaaagtagttgtggtcacgggggctaacactggggctagagtgtatcttgcctgtagggatgtagagaagggtgaacttgtggctaaggagattcagaccacgactggtaatcagcaagtgctggtcaggaaattagatctgtctgacaccaagtcaattagagcattcgcgaagggctttctggcagaggaaaaacatctgcacgtacttattaacaacgccggagtgatgatgtgtccctacagtaaaaccgccgatggattcgagatgcacatcggtgtcaaccacctgggccacttcctgctcactcacctgctgttggagaagctcaaggaaagcgcaccatcgagaatcgtgaacgtgtcttcactggctcatcaccttggacgcatccattttcacaacttgcagggcgagaagttttacaatgccggacttgcttattgccactccaaactcgctaacatcctatttacccaagagctggccaggcgccttaaagggagtggtgtcaccacatactcagtccaccctggtactgtccagagcgaattagtgcggcattcttcttttatgagatggatgtggtggctcttctccttctttatcaagaccccacagcaaggtgcgcaaacctcactgcattgcgccctgaccgagggcctcgaaatcttatctggtaatcacttcagcgattgtcacgtcgcgtgggtctctgcgcaggctcgtaacgagactattgcgagacgactgtgggatgtttcatgcgacctgctcggactgccgatcgattag

SEQ ID NO: 238576 - DNA, 951 bp, Artificial Sequence
  Description of Artificial Sequence: Synthetic coding sequence
atgctggttacacttgggctgctgaccagctttttctcatttctttatatggttgctccaagcattagaaagtttttcgccggaggtgtctgtcgcaccaatgttcagctgccgggtaaagtggtggtgatcacgggtgctaacaccgggatcggaaaggagactgcgcgtgagctggcttcccgcggagcccgagtatatatagcttgtcgagacgttttaaagggagagtcagccgcttccgagattcgcgttgacactaaaaacagccaagtgctggtcagaaaactcgacctgtctgacacaaaaagcatcagggcctttgcagagggcttcctggcagaggaaaaacagctccacattctcattaataacgctggcgtgatgatgtgtccctattcaaaaacagccgacggttttgagacccacctcggggtgaaccacttgggacatttcctcttgacgtacttgctccttgaaagactgaaggtgtccgcccctgcgcgtgtcgtgaacgtgtcctcagtagcacaccacatcggcaagatcccatttcatgacctccagtccgaaaagaggtattcacggggtttcgcctattgccactccaaattagcaaacgtgctgttcactcgcgagcttgctaaacgcctccaaggcaccggcgtcaccacatatgccgtgcaccccggagtggtgcgctcggagctggtgcgccattcttctctgctgtgtttgctctggcgcctgttcagccccttcgtcaagactgccagggagggagctcagacatcactacattgtgcgttagctgaagggctcgaaccgctcagtggtaagtacttttccgactgtaagcgcacctgggtttctccacgggctcggaacaacaaaactgccgaaagactttggaacgtctcctgcgaactgctggggattaggtgggagtag

SEQ ID NO: 238577 - DNA, 951 bp, Artificial Sequence
  Description of Artificial Sequence: Synthetic coding sequence
atgttggtaaccctgggcctgctgacctctttttttagttttctgtacatggtagccccatcgatacgtaagttctttgctgggggtgtttgccggaccaatgttcaattgccagggaaggttgtagtgatcacgggcgctaatactggcattgggaaagaaacggccagagaattagcatccagaggagcaagggtctatatagcttgcagagacgttctgaagggcgaaagcgcggcatctgagatcagggtggacactaaaaactcccaggtgctcgtacggaaactcgatctttctgatacaaaaagtataagagcattcgcagaaggattcctcgcagaggagaaacagttgcacattctgatcaacaacgccggagtgatgatgtgtccttattcgaagacggccgatggttttgagacacatctcggagttaaccatcttggtcatttccttctgacgtatttacttctcgaacgcttaaaagtgagcgcccctgccagagtcgtcaacgtctctagcgtagcccatcacatcgggaaaatcccatttcacgatttgcagtccgaaaagcggtattctcgtggttttgcatactgtcacagtaagctggcaaacgtgctcttcacacgggagctggctaagcgcctgcagggaaccggtgtcactacgtacgcagtccaccctggagtggtcaggagtgaactggtgaggcacagctctctgttgtgcctgttgtggcgtctattctctcccttcgtgaagaccgcccgagaaggcgcacagacttcgttgcattgcgcactggccgaagggcttgagcccctgtctggtaagtattttagcgactgcaaacggacctgggttagcccaagagccaggaataacaagactgccgaacgactctggaatgtgtcctgtgaactactaggcataagatgggaatag

SEQ ID NO: 238578 - DNA, 951 bp, Artificial Sequence
  Description of Artificial Sequence: Synthetic coding sequence
atgctggttactctgggactgctgacttcctttttcagcttcctatatatggtggcccctagtatacgaaagtttttcgccggtggcgtatgccgaactaacgtgcagctgccgggtaaggtcgtggtaataaccggggctaacaccgggataggtaaggaaacggcgagagaattagcatctcgcggagccagagtgtatatcgcctgccgcgacgtactgaaaggcgagtctgcagcatcggagatcagggttgacaccaaaaacagtcaagtgctcgtcaggaagttagatctgagcgacactaaaagtatccgggcatttgctgaggggttcctggcggaagaaaaacagcttcacattttgatcaataacgccggagtcatgatgtgcccgtatagcaagactgccgacggctttgaaacacatctcggggtgaatcacttgggacacttcttgcttacttacctccttctcgagaggctcaaggtctcggctccagccagggtcgttaatgttagcagtgtagcgcaccatatcgggaaaattccgtttcatgacctccagtctgagaaacgctactcgcggggttttgcgtactgtcactctaagctcgcgaatgtcctattcaccagagagttagccaagagacttcagggcacgggcgttacaacgtacgctgtgcatccaggcgtagtcaggagtgagctggttaggcactcatctctgctctgtctgctgtggcggctgttttccccctttgtcaagactgctagggaaggcgcacagacttccctgcactgcgctctggctgaaggattggaacccctgtctggcaagtacttttcggactgcaagcggacctgggtgagccccagagccagaaacaacaagaccgcagagcgattgtggaacgtttcatgtgaactgcttggcataagatgggaatag

SEQ ID NO: 238579 - DNA, 957 bp, Artificial Sequence
  Description of Artificial Sequence: Synthetic coding sequence
atgtggctgccattgctgttaggcgcactattatgggctgtcctctggcttctgcgtgaccgacaatcgcttcctgcttcaaacgcttttgttttcataactggttgtgattcagggtttggcaggttgctggcacttcaattggatcaaagaggctttcgtgttcttgccagttgtctcacgccaagtggcgctgaagacctgcagagggtcgctagctctcgattgcacactacactcctggatattaccgatccccagtctgtccagcaggctgccaaatgggttgagatgcacgtgaaagaggccggactttttgggttggtgaataacgcaggagtagcagggatcatcgggccaacaccgtggctgaccagggatgactttcaacgcgtccttaacgtgaacacgatggggcctattggcgtgacccttgctctactgcccctcttgcagcaggcccgaggacgggttatcaacattacatccgttttaggcaggttggcggcaaacggcggaggatactgcgtttctaaatttggcctggaggctttttctgacagtcttaggcgcgatgtggctcatttcggcattcgagtgtcgatcgtggagccaggattcttccgaaccccagtgaccaacctggagtccctagagaaaacccttcaggcctgttgggcccgactgcccccagccacccaggcccattacggcggagcctttctgaccaagtatctgaaaatgcagcagcgtataatgaatttgatttgtgacccagatctgactaaagtgagccgctgcctcgagcatgcgctgaccgccagacatccccgaacaaggtatagcccaggttgggacgctaagttgctgtggcttccagcatcctacctgcccgcttctctggtcgatgcagttctcacctgggtgttgcccaagccggcacaagcagtctactag

SEQ ID NO: 238580 - DNA, 957 bp, Artificial Sequence
  Description of Artificial Sequence: Synthetic coding sequence
atgtggcttcccctcctcttaggggctctgctttgggccgttctgtggctgcttcgagaccggcagtccctgcccgctagtaatgcatttgtgtttatcacaggctgtgacagcggattcggcagactgcttgctctacagcttgaccaaagaggctttagggtgcttgcttcctgtttgactccttctggcgctgaagacctccagagggtggcatccagccgtctgcatacaacactattggacattaccgacccccagagcgtccagcaggctgccaaatgggttgaaatgcatgtgaaagaggctggactgttcggcctggtcaataacgcaggtgttgctggaatcatcgggcctacaccttggctgacccgtgacgactttcagcgcgtccttaatgtgaacaccatgggacccattggcgtgacattagctctgctgcccctgctgcagcaggccagggggagggttatcaatattactagtgtactcggtcgcctggctgccaacgggggaggatactgtgtttccaagtttggtttagaagcattttctgatagtctccggagggatgtagctcacttcggaattcgcgtttcaattgtcgagcccggtttttttcgcacaccagtcaccaatttagaatctctcgagaagacattgcaagcttgctgggcccgattgccacctgcaactcaagctcactatggaggcgctttcctgacgaaatacctgaaaatgcaacagcggattatgaacttgatttgcgaccctgacctgactaaggtgtctaggtgcctggagcatgcacttaccgctcgtcatcccaggacccggtatagcccaggttgggacgcgaagctgctatggctccctgcatcttatctgccagcctctctcgttgacgcagtattgacttgggtccttccaaagccagctcaagctgtttactag

SEQ ID NO: 238581 - DNA, 936 bp, Artificial Sequence
  Description of Artificial Sequence: Synthetic coding sequence
atggctgctgcgcctcggacggtgcttatatcaggatgttcttctggtatcggtctggaattagccgtgcaactggcccatgaccccaagaagagataccaggtggtggcgactatgagagacctagggaaaaaagagacccttgaggctgcagcaggcgaagccctggggcagacacttactgtggcacaactcgacgtgtgttcggacgaaagcgttgctcagtgcctcagttgcattcagggagaagttgacgtcctcgtgaacaacgccggtatggggttggtgggcccactagaaggcctgtctctagcagcaatgcagaatgtcttcgacacgaacttttttggggctgtacggcttgtcaaagccgttttgccaggaatgaagcggagaagacagggtcacattgtggtcattagctccgtgatggggctccagggtgtgatcttcaacgacgtgtatgctgcatcaaagtttgctttggagggtttttttgaaagcctcgcgattcagttactccaatttaacatctttataagcttggttgagcccggtccagtggtcaccgagtttgaaggcaagttgctggctcaggttagtatggcagagtttcccggaaccgaccctgagactctacactacttcagggatttatacctgcctgcctcaagaaaactgttctgttctgtgggccagaacccccaagacgtggtccaggcaatcgtgaatgtgatctcctcaacgcgccctcccttaagacggcagaccaatatccggtactctcccttaacaactctgaaaactgtggattcttctggctccctttatgtgcgcaccactcaccggctgctcttcaggtgccctagactcctgaatctgggacttcagtgtctttcttgtgggtgtctgccgacacgggtgcgacccagatag

SEQ ID NO: 238582 - DNA, 675 bp, Artificial Sequence
  Description of Artificial Sequence: Synthetic coding sequence
atgtccagaaaaatcgagggtttcttgctactcctgctcttcggctacgaagcgacactgggtcttagctccacagaggacgagggagaggacccctggtaccaaaaagcgtgtaagtgcgactgtcaaggcggtccaaacgccctgtggtctgcaggggcaacttcactggactgcattcccgaatgtccctaccataagcccctgggctttgaaagcggggaggtgacacccgaccagattacctgctccaaccctgaacagtatgtggggtggtacagttcctggaccgccaataaggcccgactcaacagtcaaggatttggttgtgcttggttgtcaaaattccaggactcctctcaatggctccagatagatctgaaggagatcaaggtcattagcggaatcctgactcaagggagatgcgacatagatgaatggatgaccaagtattcagtgcagtaccgaaccgacgaacggctaaactggatctattataaagaccagacggggaataacagagttttctatgggaattctgatagaacttccactgtacaaaacctcctgcgacccccaattatcagcaggttcatcaggttaattccactggggtggcatgtgcgcatcgccattcgcatggagcttctagagtgcgtgtcgaaatgcgcttag

SEQ ID NO: 238583 - DNA, 4077 bp, Artificial Sequence
  Description of Artificial Sequence: Synthetic coding sequence
atgattgagccaagcgaggactcattcgagaccatgatggaacacaagaacccatcttccaagcagatggagtccagtgagggtagctcgaacactacagaggcaacttccggaagcggcgtacgtggcgaggctggacccgcaagtggaccagcccaggagaagaaggagcccccttctggtccccttcaagaaatggaagagttacctaccgacctgctacaggacatggaagagccaagctctggcccaaggaaggagatcgaggatcccccaaacgacctcctgcaggacctggaagagagctgcaacggctctcaccaggctcggggagatcccctgagcggagcatccgacaggatgaaggaagcatccgttaacccttcaggcgctagagaggaacaggaggcccataccgatctgaaagagagtggacgagaagaaacacctcaagaacagaatcagacggaacatagcacagctgaactcatggctatggtcagatccattatctcactctactttagaatgcaggacctgaaagaacagcagcgcgtcgctgaagaaattttgattaaaggcataaatgctgggcaacttcccgcaccaaaacacttctccggggaccgcagagaatttcacgaatttatcgtgttatgtcagctgacccttcagagttatccaagaatgttttataacgatcgccttcgcgttggttacgtcattaatcatctgagtgggttggccctggagtgggcaaaggcacttctacaggaaaactctccgctgattggcgatttccctgcttttctcgaagctatgagcgaagtgttcgaataccgccaagccctccgagtagctgaagaggctatgtttacaattcggcaagggggacgatctgctacagagtatattgatgagtttcagtcccttgttcccatcttgggctggcccgatgaagttcttcaggctcatttgtgccagggcctgaatgaggaaatacggcactacctattcagagtgcctcagcccgacagtctggatagcttaatcgtgctgatactgcagatagaggaaaaacttgccgaacggagagctatgttaaggttgccacctgaagcccgacccagaaatctgacatggattgacagtcctgcccctgaacggtggatggtctcaagctggctccctagtgaggtgcatcctgacatcaaccgggctcacctcttcctgctcctgatggtgagggttaatccataccacagtgttgcggtccaagctctggtcgattccggagcagacggtaactttatggacgagaaatttgcccaggagcattacgtagagctctacgagaaaccatatcctcagccggtgcagagtgtagatggctcccttatcggtaacgagccagtgtggttgtacactgaaccattggtgtgtatacaccagaatcaccaagagtctattgaatttgatatcgttccttcacctaacttttctgttgtcctgggaatccgatggttacgggtgcatgcgccagaggtggattggattaaaggtcgttgcacgtttcattcgccttactgcctgaagaactgtttcaggccccctccaccttgcatcgcattagagagacacggtatgagccttctgcctggactgccccatccatatagcgacctcgccgatgtgttcaaccccaaggaggcagacgatgagactagcgaccagcctagctctgatggaagcgatgatctgtccgaatccgaacctagcgaactgcagcaggccggtgacagtgatcattcagagactttctatgaatgtccgagcacggccccatgggaaccagtgggcgctagaatgcaggaacgcgcaagactgcaggaggagtactgggatttgcaagacatgctgactaaccggcaggactatatacaaatgatccccgagctcttcgatcaactccatggtgccgagtggtttactaagctggaactcaggggcacgatcgtagaggagagtgtcaacggacacaggacagaagatgtgtggaaggccgcttttggcctggagctggaggaaatgaagtcttatcagcccttcgcattatccccggatcctatcatccctcagaatgtgatccacttcattctgaaagacatgctggggtttttcgtgctttcctatggccaggaggtcttgatatattccatgagccaggaggaacacctacatcacgtaaggcaggtcctagttaggttccggcatcataacgtgtactgtagtttggacaaatcacagtttcaccggcagaccgtggaatttctcggtttcgtggtcacacccaagggagtcaagctgaataagaacgtgatgacaatcattacgggctatcctacaccaggcagtaagctgtccctccgcaactttatcgaattcgtctttccctatcgccacttcgttgaacgatttagtattatcgctgagcccctggttagacaactcctctcgagttaccagttctattggggcgtggaggaacaggaagcatttgaatgccttaaaagggctttccgcaaagcccctctgctgcatcatcctaaacctcagaacccattttacttggaaaccggtgtcacaggtacagcactgcatgcttcattaatccagattgacgaccaaacgggcaagagggcttgctgtgccttctatagccgtaacatcagccctatcgaagtagagtatagccaggccgagatgaaaatcctccctattcgagccgcatttatggtttggtgccgatatctcgaaaatactgaggagcctatcatgatcctactgaacaccgaggatttagccagccttaataacgacaggcttaccgtcctgctcccagggcactgggtgtttttcttctcgcattttaattttgacgtgatggagctccccgaacaggatggagggagagccctccctcctgtcaggaaccttcggtggagacgtgctttccagcgcaatacagctgcccgtcagactttgctcctagcttccagaggcttcccaagggatccatccactgagagtggggaagaggagaacgaagagcaggacgaattaaacgaacagattctgcgccaagagctccttgctatgattcctattgatcagatcctcaattctttcctcgcccacttttccatggcccaaatacgggcagtgatcttgcatttcttcagggggttgctgtattggaagaacaccctggcgttggcagcaattttggtgctactgagggttagacagtgtctcagcctgcggcctgcacctgcaatgcgggttgctcggccacagccgcagcggtccctgcgacttattctggatagttcactgattgcgggatccagcatcactaccgcgataacacagctgctgactcagatgccggcattagttggcgcaaacacaatccccgctcaagagttagcagagttgttcctcggacccggtagatggcaaagaaatgccttacattcgcaagcccatcgtggccttcaattcacacccggtttttggttgaccctttgtgagttctttggcgtgagggtgacacctcaagaagggcacctgcccgctctgcgacagaaccggtatctcgaactgcacgtggtgggtgatgaggatgtggtgctacgcgaagctctgcaggatgatcttcagcgctatcggcagtgcggcctacatgatgggctgcaggatacaagtcaggataagcaagacaacgatgtgcaggaagctccaccttcccacacggccgcaacgcatcccccaagacccagacatctgatggaccctcaggtcttagagttcctcggatcccgattgttacacatccacagcgcggacggacagttgcatctactctcccgggagcaggctgcacgcgcactttcacagtttctcacattgatttaccgcagagctttgccaattcctgcatgggaaagtcaacctcgcgaacaagcgaggttggaggagctccccgacgaggacgaggacgcaaacctcgactag

SEQ ID NO: 238584 - DNA, 9392 bp, Artificial Sequence
  Description of Artificial Sequence: Synthetic coding sequence
atgtttagtgttaggatcgtcacggcagattattatatggccagtcctctgcagggattggatacttgccagtcccctctgacacaggccccagtgaagaaagtgcctgtggtcagagtgttcggagctacacccgcaggacagaaaacctgcttgcatttacacggcatctttccatatctttacgtcccctatgacgggtacggccaacagcctgagtcttatctgtcccagatggctttctccatcgaccgagctctcaacgttgcgttgggcaaccctagttccacagcccagcacgtattcaaagtgtcactggtaagtggaatgccattttatggctatcatgaaaaggaaagacacttcatgaagatctacctctataaccccacgatggtgaagcgtatctgcgagctgctgcaatccggcgctatcatgaataagttctatcagcctcacgaggcgcatattccctatcttcttcagctctttatagactacaacctgtacggcatgaaccttataaatctcgctgcagtaaaattccggaaagccagacgcaagtcaaatacccttcacgccactgggagctgcaagaatcacctctccgggaacagcctggctgacacactctttaggtgggagcaggatgagatcccaagctcccttattcttgaaggcgtggagccacagtcgacttgcgagttggaggtggatgccgttgctgcagatattttgaatagactggatattgaggctcagattgggggaaatcctgggttacaagcaatttgggaagatgagaagcaacgacgcaggaaccggaacgagactagtcaaatgtcccagccagagagtcaggatcatcggttcgtgcccgctacggagagcgagaaaaaattccaaaagagactgcaggagatcctcaagcaaaacgatttcagcgttacactttcaggtagtgtcgactatagcgacggctctcaagaattttctgctgagcttaccctgcatagcgaggtgctgtcacccgagatgctgcagtgtacacccgcaaacatggtcgaggtacacaaggataaagagtcatctaaggggcatacccgccacaaagtagaagaggccctaattaatgaggaagccattttaaatctcatggagaattcccaaacctttcagccgctcacacagagactctctgagtctccagtcttcatggattcttctccagatgaagccctggttcacctgttagccggacttgagagcgatggctaccggggagaaaggaatcgtatgcctagtccctgcagaagcttcggcaataataaatacccacagaattctgacgacgaagaaaatgaaccacagatagagaaggaagaaatggagctctcactggtgatgagccaacgatgggattctaatattgaagaacattgtgccaagaagcgcagtctgtgccgaaacacgcaccgctcttctacagaagacgacgatagctctagcggcgaagagatggagtggtctgataattcactcctgctggcatctctatccatcccccagctggacggaaccgcagatgagaactctgacaatcccctgaacaatgagaacagccgcacgcatagctctgttatcgccacatccaaactatctgtgaagccaagtattttccacaaagacgcggcaaccctggagccctcatcttccgccaagataaccttccagtgcaagcatacttcagcgctgagttctcacgtgctgaacaaggaggatctcattgaggatctcagccagacgaacaaaaacaccgaaaaaggattggataactcagtgacttcgttcacaaacgaatccacatacagtatgaaatatcctggttcactgagctccacagtgcatagcgagaactctcataaagagaacagcaagaaggaaatcttacctgtaagttcatgcgagtcttcaatttttgattatgaagaggatatcccaagcgtgaccagacaggtgccgagcagaaagtataccaatattcgaaaaatcgagaaggactccccatttattcatatgcacagacatcccaatgaaaacactctgggtaaaaacagcttcaatttcagcgacctcaatcatagcaaaaataaagtgtcctcagagggcaatgaaaaaggaaatagcaccgccttatcctccctgttcccttcatccttcaccgaaaactgtgaactgctctcgtgtagcggagagaatcggacaatggtacacagcctcaattctactgctgatgaatcgggtttgaacaaactgaaaatcaggtatgaggaatttcaggaacacaagactgagaagccgtcactgagtcagcaggcggcacattacatgttcttcccctctgtggtcctttccaattgcctaactagaccccagaagctgtcacccgtgacctataagctccaacccggaaataaaccctcaagactcaagctcaacaaacggaaactggctgggcatcaagagacatctactaaaagttcggagacgggatcgactaaggataactttattcagaacaacccatgtaatagtaaccctgagaaggataacgcgctggcttccgaccttaccaagacaaccagaggggcattcgagaataaaactcctaccgacgggttcatcgactgtcactttggggacggcaccctggagacggagcaaagtttcggactgtacgggaataaatacacgcttcgtgctaaaagaaaggtcaattacgaaaccgaggattctgagagtagctttgtaacacacaatagtaaaatttctctgccgcacccaatggaaatcggcgagagcctcgatggaacactgaaatcaagaaagcggaggaagatgtccaagaagctgcccccagtcattatcaaatacatcataattaatcgtttccgtgggcgaaaaaacatgttggtgaagcttggcaaaattgactcaaaggagaaacaggttattctcacggaagaaaaaatggagttgtataaaaagttggcccctctgaaagatttttggcctaaagtgccagatagcccggctacaaaatatcctatctaccctctgactcctaaaaaaagtcacaggcggaagagcaagcataagtccgccaaaaagaagacagggaagcaacagagaacaaataatgaaaacattaagcgcacgctgagctttcgaaagaaaaggagccatgccatcctgagtcccccaagcccttcctacaatgctgaaactgaagactgcgatctgaattactctgacgtcatgagcaagctgggattcctgtccgagcgatccacatctcctattaattcaagcccacctcggtgttggagccccacagatccaagggctgaggaaataatggccgcagccgagaaagaggctatgctgttcaaaggaccaaacgtctacaagaaaactgtcaatagccgtattggcaaaaccagtcgcgctcgggcacagatcaagaagtcaaaagcaaagctcgcgaacccaagcatcgtaactaagaagcgcaacaagaggaaccagaccaataaactcgtggatgacggaaaaaaaaaaccaagggcgaagcaaaaaactaacgaaaaggggacttccaggaaacacaccactcttaaggatgagaaaatcaaatcacagtccggggctgaggtcaaattcgtgctgaagcatcagaatgtttcagaattcgctagttccagtggtggatcgcaactgctattcaaacagaaggatatgccattgatgggcagcgccgtagaccatcccctgagcgcttctctacccacaggtatcaacgctcagcagaaactgagtggatgtttctccagcttcctggaatccaagaagtcagtggacctgcaaacctttccctcttcccgggatgatctgcacccctctgtcgtatgcaactctattggccctggggtttctaagattaatgtgcagaggccccacaatcagtctgcgatgtttacattgaaagaatccacccttatccagaaaaatatcttcgacctgtccaaccatctgtcccaggtggcccagaatactcagatctctagtgggatgtcctccaaaatcgaagacaacgccaacaacatccagaggaactacctgtccagcataggcaagttgagcgaataccggaattccctcgagtctaagctcgaccaagcttacactccaaatttcctccattgcaaagattcccagcagcagattgtgtgcatcgccgaacaaagtaagcacagcgaaacgtgttcacccggtaacaccgcatcagaggagtcacaaatgcccaataattgttttgtgacatcccttaggagtccgattaaacaaattgcatgggagcaaaagcagagaggttttatactggatatgtctaactttaaacctgagcgggtcaaaccgagatctctctcggaggcgatttcccagaccaaggcccttagccagtgtaagaatagaaacgtctcaacgccatcagctttcggggaggggcagtcagggcttgccgttctgaaggaactgctgcagaagcgacagcaaaaggcgcagaacgccaatactactcaggaccccctctccaacaagcatcagcccaacaaaaatatttctggcagcttagagcacaataaagccaataagagaacaagatcagtgaccagcccacgtaagcctcggaccccaagatctacaaaacagaaggaaaagatccctaaactgctgaaggtcgacagcctgaacctgcagaatagttcgcagctggacaatagcgttagcgatgacagccctatatttttttccgacccaggatttgagtcttgctattcgttggaggattcactatctcctgagcataattacaacttcgatatcaacaccataggacagacgggtttctgctcattctactccggtagccagttcgttcccgcagatcagaacctgccacagaagtttttgtccgatgcagtgcaggacctattccccggtcaggctattgaaaagaatgagtttctctctcatgacaaccagaaatgtgatgaggacaaacaccacactacagacagtgcctcttggatccgctcaggaactttgtcccccgagatctttgaaaaatcaacaatagacagtaatgagaatcgaagacataaccagtggaaaaacagctttcatcccttgaccacccgttcgaactccatcatggattccttctgtgtgcaacaagccgaggactgcctgtccgaaaaatcccgactaaaccgcagtagcgtatcgaaggaggtgttcctgagccttccacagcccaacaattctgattggatacagggccacacacggaaggaaatgggtcagagtctggattccgccaacacatcctttacagctatcctctcatcacctgatggtgaactcgtggacgttgcctgcgaagacctcgaactctacgtaagccggaataacgacatgctgacaccaacccctgattcttctcctcgatcaaccagctcccctagccagagcaaaaacggctcatttacaccacgaaccgctaatatcttgaaacccctgatgtcccctccctctcgcgaggagatcatggccactctacttgatcatgacctgagtgaaaccatttatcaggagccattttgcagcaatccgagcgacgtacctgaaaagcccagggagatcggaggcaggctccttatggttgaaacccgactcgccaatgatctggccgaatttgaaggggacttttctctggaaggtctgaggttgtggaaaactgctttctctgctatgacccagaaccctcgacctggctcccccttgaggtcaggccagggagtggtgaacaagggttcttcaaactcccccaaaatggtggaggataagaaaatcgtcatcatgccgtgcaagtgtgcaccaagtcggcagctcgtgcaggtgtggctgcaggcaaaggaggagtacgaacgctccaaaaagctgcctaaaaccaagccaacaggagtggtgaagtctgccgagaatttttctagttcggtaaatcccgacgacaagcctgtggtccccccaaagatggacgtttcaccttgtatactccccacaacggctcacaccaaagaggacgtcgacaatagccagatagccttgcaggcacccaccaccggttgctctcaaacagcaagtgaatcccagatgctccccccagtcgccagtgcttctgaccccgagaaggatgaggatgacgacgacaattattatatttcttacagctcccccgacagcccagtaattcccccttggcaacaaccaatcagtcccgatagtaaggcccttaatggggatgatcgaccctcttctcccgtggaggagcttcctagtttagcattcgagaatttcttgaagcctataaaggacggaattcaaaaaagtccttgttccgaaccccaggagccccttgttataagccctattaacacacgggctaggaccggcaagtgcgagagcctctgctttcacagcactcctataatacaacgtaagctgctagagagactgcccgaagccccaggtctgtcgcctctatcgacagagccgaagactcagaagctgtccaacaagaaaggatcaaatacagacactctacgcagggtactgctgactcaagctaagaatcagtttgccgctgtaaacacgccccaaaaggaaaccagccagatcgacggtcccagcctcaacaacacttatggcttcaaggtaagtatccaaaacctgcaggaagccaaagctctgcacgagattcagaacctcaccctaatcagtgtggagctccacgccagaactcgtagggacctggagccagaccctgaattcgaccccatatgtgcacttttttactgcatctcatctgatacacccctgccagacacggaaaagaccgaactgaccggtgtgattgtcatcgacaaagataaaaccgtctttagtcaagacattcgataccagacaccccttctgattagaagtgggattaccgggcttgaagttacttacgcggctgatgagaaagccttgtttcatgaaatcgcaaatatcattaagaggtatgacccggacattctgttggggtacgaaatccagatgcattcctggggttatctacttcagcgggctgcggcattgtcaatcgatttatgccgcatgatttctagagtgccagatgacaagattgagaaccggttcgctgctgagagggatgaatatggctcatataccatgagcgagattaatattgtgggtcgtatcacgctcaacctgtggcggattatgcgtaatgaggtcgccctgacgaattacacattcgagaacgtttcgtttcacgtgctgcatcagaggttcccactattcacttttcgtgtgttgagcgattggtttgataacaaaaccgatttatatagatggaagatggtggaccattacgtgtcaagggtgcgcggaaatctccagatgctcgaacagctggatttgatcgggaagacgtctgagatggcccgtctcttcggaatccagtttctacatgtcctaaccaggggatcccaataccgtgtggaatctatgatgctgaggatcgcgaagccaatgaattatatcccagttaccccctccgtgcagcagaggagtcagatgagggcccctcagtgtgtgcctctgatcatggagcccgagtcgaggttttattccaattcagtcctagtcttggacttccaatcactgtatccgtccatcgtgatcgcgtacaactactgcttttcaacgtgtctaggacacgtcgaaaatttgggaaagtacgacgaatttaaattcggctgtactagcttacgtgtcccccctgacctgctgtaccaagtgcggcatgacattacggtatcacctaatggcgtggcatttgtaaagcccagcgtacggaagggggttcttccccgaatgttggaagaaattttgaagacccgattcatggttaaacagagtatgaaggcctataagcaggatcgggctctctcaaggatgctggacgctcggcagctgggactcaagctcatagcaaacgtcacatttggatacacaagtgctaatttctcaggacggatgccttgcatcgaggtgggagacagcatcgtgcacaaagcacgcgagaccctggaaagagccataaaactcgtgaatgataccaaaaaatggggagccagggtcgtgtacggcgacaccgatagcatgttcgttctcctaaagggggctaccaaggagcaatcttttaagatcggccaggaaatcgccgaagcggtgactgccactaatcccaagccagtaaagctgaagttcgagaaggtgtacctgccctgtgtcctccagacaaaaaagcgctatgtggggtatatgtatgaaactctagaccagaaggaccctgttttcgatgcgaagggtatcgaaacggtccgccgagatagttgccctgccgtcagcaagatcctcgagaggagtctcaaattacttttcgagacccgcgatattagcttaatcaagcagtacgtccagcggcagtgtatgaagcttctcgaggggaaagccagcatccaagacttcatcttcgcgaaggaatatagggggtctttctcgtataagccaggagcatgcgtccccgctctggagctcacccggaaaatgctaacctacgatagacgctccgagccacaggttggcgagagggtgccctatgttatcatatacggcacccctggcgtccctctcatccagttagtgaggaggcccgtggaggtgctacaggatcccacccttagacttaacgcgacgtattatatcaccaaacagatactccccccactggcacggattttctccttgattggtattgatgtgttctcctggtatcatgaactgccaaggatccacaaggcgacgtccagtagcaggagtgaaccggaggggaggaaggggaccattagtcagtactttactacgttgcattgccccgtttgtgacgacctaacccagcacggcatatgttcaaaatgtcgcagccagcctcagcatgtggcggtcatccttaatcaggagatccgagaattggagcgacagcaggaacaactggtcaagatttgcaaaaactgtaccggatgttttgacaggcacataccctgtgtgtcacttaattgtccggtgctgttcaagctgtctcgagtcaaccgtgagctatctaaggcgccatacctgcgccagctccttgaccagttcta

SEQ ID NO: 238585 - DNA, 9392 bp, Artificial Sequence
  Description of Artificial Sequence: Synthetic coding sequence
atgttcagtgtccgaattgtgaccgccgactactatatggccagtcctcttcagggcctagacacatgccagtctcccctgactcaggctcccgtgaagaaggttcctgtggtgcgcgtgttcggcgctactcccgcaggccaaaagacatgcctgcacctgcatggcatcttcccgtacctgtatgtgccatatgacggatatggccagcaacccgaaagctacctgagccaaatggccttcagtatcgacagggccctgaatgtggccctgggaaatccttccagtaccgctcagcacgtttttaaagtcagccttgtctcaggaatgccgttctatggttatcatgagaaggagcggcattttatgaagatttatttgtacaaccccacaatggtgaagaggatttgcgaactactccagagtggagccattatgaacaagttttatcaaccgcacgaagcacacataccctacttgctgcaactgttcattgactacaatctgtacggaatgaacctcatcaacctagccgcagtgaagttccgcaaggccaggaggaaaagtaacaccttacacgcaacagggagctgtaaaaaccacttatcaggcaattccctggccgataccctgttcagatgggagcaggacgaaatcccctcaagcctgatccttgagggggtggagccccagagcacttgtgagcttgaggtggacgccgtggccgcagacatactcaataggcttgatatagaggcccagatcggtggaaaccctggtctccaggccatctgggaagacgagaaacagcgccgacgcaatagaaatgaaactagccagatgagccagcccgagtctcaggatcatcggttcgttcctgcaactgaaagtgagaaaaagtttcagaagcgcctccaagaaattctgaagcaaaacgactttagcgtgacccttagcggctctgtggattacagtgacggaagtcaggagttctccgctgagctcaccctccacagcgaggttctttcccctgaaatgctacaatgtactccagctaacatggtggaggtgcataaagacaaagagtcctctaaaggacacactcgccacaaagtggaagaggctctgatcaacgaggaagccatccttaacctgatggagaattcccagaccttccaacccctgacacagcgcctgtcagagtctcccgttttcatggatagttcgccagatgaagccctcgtgcatctgctcgccggtttagagtctgacggctaccgcggagaaaggaatcgcatgcctagcccttgcagaagttttgggaacaacaagtatccacaaaattctgacgacgaggaaaatgagccccagatagaaaaagaagaaatggaactatcactggtgatgtcccagcgatgggactcaaacattgaagagcactgtgccaagaagcgcagcctttgccgtaacacccatagatcctctactgaagatgacgactcttcctccggcgaggagatggagtggagtgataacagccttctgttagcatcgctatctatcccccagctcgatggaactgcggatgagaattctgacaatcccttgaataacgagaattcccgcacccattcgtccgttatagccaccagtaaactgagcgttaagccgagcatcttccacaaagatgcagccacactggaaccctccagctctgcgaaaatcacgttccagtgtaaacatacttctgcgctgagttcacacgtcttaaacaaggaagatttgatagaggatttgtcacagaccaataagaacacggaaaagggtctagacaatagcgtcacctcattcaccaacgagtcgacctatagcatgaagtatccgggtagcctctcaagcacggtccactcagagaacagccacaaggagaattcaaaaaaagagatactcccagtaagctcatgcgaaagcagtattttcgattatgaggaggatattccctcagttacacgacaggttcctagtcgaaagtacaccaacattaggaagatcgagaaggattcccccttcattcacatgcatagacatcctaatgagaatacgctgggaaagaatagctttaacttttctgacttaaaccattctaaaaacaaggtgtcaagtgaggggaatgaaaaagggaactctaccgcactgtcatctttatttccttcttcattcactgaaaactgcgagctgctctcgtgctccggcgaaaaccgtacaatggtgcatagtttaaacagtaccgccgatgagtcggggctgaataagcttaaaatcagatacgaagagtttcaggagcataaaactgaaaagccttcactgtctcagcaggccgcacactatatgttttttcctagtgtcgtcctcagcaattgcctgacaaggccccaaaaactgtcccccgtcacttataaactgcagcccggaaataagccaagccgcctgaaacttaataagaggaaactggcgggacaccaggagacttctactaagagctctgagacgggttcaacaaaggacaatttcattcagaacaacccatgtaattcaaatcccgagaaagacaacgctttagccagcgacctgacgaaaactacacgcggtgccttcgaaaacaagacgccaacggatggattcatcgactgccatttcggggatggcaccctagagaccgagcagagcttcggcctgtacggcaacaagtataccttaagggccaaaaggaaggtcaattacgaaaccgaagattctgagagcagctttgtcacccacaactctaagatttctctgccacatcccatggagataggggaatccctggatggtacattgaagtcacggaaaaggcgaaaaatgtcgaaaaagctaccgcctgtgattataaaatatatcataataaatcgcttccggggacgaaaaaacatgctggtgaagcttggcaaaatcgactcaaaagagaagcaggttattctgaccgaagaaaagatggagctgtacaaaaaactcgctcccttaaaagatttttggcccaaagtccctgactcccctgcaaccaagtatcccatctaccccctgactcccaagaaaagccataggcggaaaagcaaacacaagtcagccaagaaaaagactggtaagcagcagcggactaataatgagaatataaagagaaccctgagctttagaaaaaagcgttcgcatgcgatcctgtcgccacctagcccctcctacaatgcagaaacggaggattgtgatctgaactactccgacgttatgtcaaaactgggctttctgtccgagagaagtacctcccccattaacagcagcccaccacgctgctggtccccaactgatcccagagcagaggaaattatggccgctgcagaaaaggaggccatgctcttcaaggggccaaatgtctataaaaaaactgtgaattcccggattggcaaaacctctcgggcacgggctcaaattaaaaaatcaaaggctaagctggccaatccaagcatcgtcacaaaaaagaggaataagaggaaccagaccaataagttggtcgacgacgggaaaaagaagcctcgagcaaaacagaagactaacgaaaagggaacgtcaagaaaacataccacgttaaaggatgaaaagatcaaatcacagtctggcgcagaggtgaagtttgtactcaaacatcagaacgtcagcgagtttgcctctagctcaggcggtagtcagctactcttcaaacagaaggatatgcctttgatgggcagcgccgtggatcatccattgtcagcatctttgccaacaggtatcaacgctcagcagaagctctcagggtgtttctcctcctttctggaatccaaaaagtctgtcgatctccagactttcccctcctctagggatgacctccatccaagtgtggtctgcaatagtattggcccaggggtgtccaagatcaacgttcaacgaccgcataaccagagtgccatgttcacactaaaggaaagcacccttatccagaaaaatatcttcgaccttagtaatcacctgtcgcaggttgcacagaacactcagattagctccgggatgtcctcaaaaatcgaggacaacgccaataacattcagagaaactacctgtcctccattggaaagctttcggagtacaggaactctctggagtccaagctagatcaggcttacactcctaactttctgcattgcaaagattcacagcagcagatcgtatgtattgccgaacagtctaaacatagcgaaacttgtagtcctgggaacaccgcatccgaggagtctcaaatgccgaataattgtttcgtgaccagcctccgcagcccgatcaagcagatcgcttgggaacagaagcagagaggatttattttggatatgtctaacttcaaacctgagcgggttaagcccagaagtctgtctgaagccatctctcagaccaaggccctgagccagtgcaaaaaccgcaatgtgagtacgcccagcgcttttggagagggccaatccggactggcggtcctcaaagaactgctgcaaaagcggcagcagaaggctcaaaatgccaataccacacaagatcccctcagcaacaaacatcagcccaacaagaatatcagtgggagcctcgaacataataaggccaataagcgaactcgaagcgtaacgagtccgagaaaaccacggacaccccgaagcaccaagcagaaagagaagattcccaaattgttgaaggtggatagtctgaacttgcaaaacagcagccagctggacaactctgtgagcgacgatagtcccatcttcttttcagaccctggatttgaatcctgctacagcctcgaggactccctctcgccagaacacaactacaatttcgatattaatacgattgggcagaccggtttttgctctttctattctgggagccagttcgtgcccgctgaccagaacctaccccagaaatttcttagcgacgctgtgcaagatctgtttcctggccaggccatagaaaagaacgaatttttatcacacgataaccagaaatgcgacgaggataagcatcacaccacagatagtgcgagctggattcgctccgggacactctctcccgagatttttgagaaatcgacaattgactccaatgagaaccgaaggcacaaccagtggaagaactcctttcatcctctgactacccgcagcaattctatcatggacagtttctgtgtgcagcaggcggaggactgcctgagcgaaaagagccgacttaatcgcagttcagtgtccaaggaggtcttcctttctctaccccagccaaacaactctgattggattcaagggcacacaaggaaagaaatgggacagagtcttgattccgcaaacacctcctttactgcaattctgagttctcccgacggagaactcgttgacgttgcatgcgaagaccttgaattgtacgtgtctcgcaataacgacatgctgacacctacaccggattcaagcccgagaagtacgtccagcccctcccagtccaagaacggttcctttacaccgaggacggcaaatattttgaagcctctaatgagtccacccagccgcgaggagattatggcaacccttctggaccacgacctttccgagaccatctaccaggaaccgttctgtagcaatccctcagatgtgccggaaaagcccagggaaataggtgggaggttacttatggtcgaaacccggcttgccaatgacctggcagaatttgagggcgacttcagccttgaaggactgcgtctgtggaaaactgcctttagtgccatgactcagaatcctcgccctgggtctcccctccgctctggccagggcgtggtcaacaagggcagcagcaattctcctaaaatggttgaagacaaaaagatcgtgattatgccctgcaagtgtgcaccatcccgacaattggtccaagtgtggcttcaggccaaggaagaatatgagagaagcaagaagctaccgaaaaccaagccaaccggcgtcgtgaaatccgcagagaacttctcatcctcagtgaacccagacgacaagccagtggtaccgccaaaaatggacgtctctccatgcatccttccaactacagctcacacaaaggaagatgttgacaactcgcagatcgccttgcaagccccaaccactggctgttcccagacagccagcgaatctcagatgctgccccctgtggcaagcgcttccgaccccgagaaggacgaggatgatgacgataactactacatttcctacagttctcccgacagtccagtaattccaccatggcagcagcctatttcgcccgattccaaggccctcaatggggacgatcgacccagcagccctgtcgaggaactgccaagcctcgcgttcgaaaacttcctgaagccaataaaggatggaattcaaaaaagcccttgttccgagccacaggagccattagtgatttccccaatcaatacccgcgcaagaacgggcaagtgcgagtcactgtgtttccattctacgcctattattcagaggaaattgctggaaagattgcccgaagctccgggtctgagcccgctctccacagagcctaaaacccaaaagctgagcaataagaaaggcagtaatacagacacattgagacgagtgctcctgacccaggccaaaaatcagtttgccgctgtgaacacacctcagaaggaaacctcacagatcgatgggccttcacttaacaatacctacggcttcaaagtcagtatacagaacctacaggaagcaaaagctttgcatgagatccaaaacctgactctcattagcgtcgagctccacgcgaggacccgtcgggacctagaaccggatcctgagttcgacccgatttgtgccctgttctattgcatttcgtccgacaccccgctccccgataccgaaaaaactgagttgaccggtgttattgttatcgataaggacaaaactgttttctcgcaagatattcgataccagaccccattactcattaggagcggcatcaccggcctagaagtgacctacgcggcagacgagaaggctctgttccatgagatcgcgaatattataaagaggtatgaccctgacatccttctcggctatgagattcagatgcacagctggggatacctactccagagagcggctgccttgagcatcgatctgtgtagaatgatatcccgtgtgcctgacgacaagattgaaaatcggttcgcagcagaaagggacgaatatggctcctacacaatgagcgagatcaatattgtaggacggattaccctaaacctgtggcgcatcatgcgcaacgaggtggccctgactaattacactttcgaaaacgtgtccttccatgttctccaccagagatttccacttttcacattccgggtgctttctgattggttcgataacaaaactgatctatataggtggaagatggtcgatcactatgtgagcagggtcagggggaatctgcagatgttggaacaactggatcttatagggaagaccagtgagatggcgaggctttttggcatccaatttcttcatgtactgaccagggggagccagtatcgggttgaatcaatgatgcttcgcatcgcaaagcccatgaactatattccagtcactccatcagtccagcaacggagtcagatgagggcccctcaatgtgtccctctgatcatggagccagagtcaaggttctattcaaattccgtcctggtcctcgattttcagagcctgtatccgagcatcgtgatagcttataactattgttttagcacgtgcttggggcacgtcgaaaatctgggcaaatatgacgagtttaaattcggctgcactagccttcgcgtaccccctgacctgctgtatcaggtcaggcatgatataaccgtctccccaaacggggtcgcttttgtcaagccctccgtccggaagggggtactgcctcgtatgcttgaagaaatcctaaagacccgtttcatggtcaagcaatccatgaaggcatataaacaagacagagccctcagtcgaatgttggacgccagacagctcggcctcaagctcatagctaatgtgacattcggctatacttccgcaaatttctcaggtaggatgccatgcattgaagtgggggacagcatcgtgcacaaagcgagggaaaccttggaacgggcaattaagctagtgaacgacactaagaaatggggtgcgcgagtggtctacggtgacaccgatagcatgttcgtcctccttaagggggctactaaagaacagagcttcaaaattgggcaggaaatagcggaagccgtgactgccacaaatcccaaacccgtgaagttgaagttcgaaaaagtttacctgccatgcgtgttgcaaaccaagaagagatacgtgggctatatgtatgagacattagatcagaaagaccctgtcttcgacgcaaaagggattgagaccgtcaggcgcgacagttgcccggctgtcagcaaaattttggaaagatcactcaaacttttatttgagaccagagacatcagtttaataaagcaatatgtgcagcgccagtgcatgaagctgttagagggcaaagcctccatccaagacttcatcttcgccaaggaatacagaggttcttttagctataagcccggtgcttgcgtaccagcactggagttaacgaggaagatgctgacctacgatcgaagaagcgaacctcaagtcggagaaagagtgccatacgttatcatctatgggaccccaggcgtgccattaattcaattagtgcgccgtcccgtggaagtgctccaggaccctaccctgagactcaacgccacctattatatcactaagcaaatccttcccccacttgcaaggattttttctcttattggcatcgatgtcttttcttggtatcacgagttgccccgtatccataaggccacttcatcatctagaagcgaacccgaagggagaaaggggaccatcagccagtacttcactactctccattgcccagtttgtgatgacctcacgcaacacggcatctgcagcaagtgccgctctcagccccagcacgtggccgtcatcctgaaccaggagattcgggaattggaacgccaacaggagcagctggtcaaaatctgcaagaattgtactggatgttttgatcgtcacattccctgtgtaagcctcaattgcccagtgctgtttaagctgagtcgggtgaatcgcgagctctcgaaggccccatatctgcggcaacttctggaccagttcta

SEQ ID NO: 238586 - DNA, 9393 bp, Artificial Sequence
  Description of Artificial Sequence: Synthetic coding sequence
atgtttagcgtgcgaattgtaactgccgactattacatggctagcccactgcagggcctcgatacctgtcagtcccctctgacccaggctcccgtgaagaaagtgcccgtcgtccgggtgttcggcgcaacccctgctggccaaaaaacatgtctacacctgcacggaatcttcccatacttgtatgtcccttacgacggttacgggcagcagcccgagtcctatctgtcacaaatggcattctctatcgatagagccttaaatgtggccctcggtaacccctccagtaccgcacagcatgtattcaaagtttcgctggtctcaggtatgcccttttacggataccacgaaaaagaaagacacttcatgaagatttacttgtacaacccgacaatggtgaaacgaatctgcgaactcctccagagtggtgccataatgaacaaattctatcagccccatgaggcccatattccttacttactgcagttattcatcgactataacctgtacggtatgaaccttatcaatctggccgctgtaaaattccggaaggctaggaggaaatcaaacacactgcatgccaccgggagctgcaaaaaccacctgtctggaaactctcttgcagatactctctttcggtgggaacaggacgagatcccgagctccctgatccttgagggggtggagccacagagcacctgcgagctagaagtagacgcggtggctgccgacatccttaacagactggacattgaggcccaaattggcggaaacccaggcctccaggccatatgggaggacgagaaacaaaggcgccgtaaccgcaacgagacctcccaaatgtcccagcctgagtcccaggaccaccgcttcgtgcctgccacagaaagcgagaagaagtttcagaagagactgcaggaaattttgaagcagaatgatttttccgtcaccctgtcgggaagcgtggactactcagatggttcccaggagttcagcgctgagctcacactccactccgaagtcctctcgccagaaatgttacagtgcaccccagccaatatggtggaagttcacaaggacaaggaaagctctaaggggcacacacggcacaaggttgaagaggccctgatcaacgaggaagctatcctgaacctgatggagaattcacaaaccttccagcctctaactcagcgactgagtgaaagtcctgtgtttatggactctagcccagatgaggccctggtacacctcttggccggactcgagtctgatgggtaccgtggagaacgaaatcggatgccttctccatgtaggagcttcgggaataacaaataccctcaaaactccgacgacgaagaaaacgaaccacagattgaaaaagaagaaatggagctgtcactggtgatgtctcaacggtgggattccaatatcgaagagcattgcgctaaaaaacggagtctgtgcagaaacacccatagaagctctaccgaagacgatgattcctcctcaggtgaggaaatggaatggtcagataactcgctgctcctcgcgagtctttctattccacagctggacggcaccgccgacgaaaatagcgataatcctctgaataacgaaaacagcaggactcattccagcgtcatcgctacctcaaaactatccgtgaaaccctctatttttcacaaagatgctgccactctggaaccttcctcttcagccaagatcacctttcagtgcaaacacaccagtgcactaagctcccacgtcctgaataaagaagatctcatcgaggacctgtcccagacaaacaagaatacggagaaggggctggataactcggtgacctcgttcactaacgagtccacctatagcatgaagtatccgggtagcctgtcttccaccgtgcatagcgaaaactctcacaaggagaactcaaagaaagagatacttcccgttagctcttgtgagtcatcaatctttgattacgaggaggatataccgagcgtgactaggcaagtacccagtaggaaatacaccaacatcaggaagattgaaaaggattctcctttcatacacatgcaccggcaccctaacgagaacactctcgggaaaaattcttttaacttctcagacctgaaccactcaaaaaataaggtcagtagcgagggtaacgaaaaaggtaattccactgccctgtcttcactgttcccttcctccttcacggagaactgtgagctgctgagttgctctggggaaaacagaaccatggtgcatagcttaaacagtactgctgacgagagcgggctgaacaagctcaagatcagatacgaagaattccaggagcacaagaccgaaaaaccttccctgagccagcaggcagcccactacatgttttttccgtctgtggtgctgagcaattgcctgaccagaccacagaagctcagtccggtaacatacaagctacagcctggcaacaaaccctctcgactcaagctcaacaaaagaaaactggcaggacaccaggaaaccagcacgaagtcatccgagactggatctaccaaggacaactttattcaaaacaacccctgtaatagcaatcccgagaaagataatgccttagccagcgatttgacaaaaactactcgcggtgccttcgaaaacaagacccccaccgacgggttcatcgattgccacttcggagacgggacattagaaacagagcagagttttggattatacgggaataagtacactctgcgagccaagaggaaggtgaactatgaaacagaagattcagagtcctctttcgtaactcataactccaaaatctccttgccccatcccatggagattggcgagtcattagatggcaccctgaaatctagaaagcgccgaaagatgagcaaaaagcttcctcctgtcatcataaaatatattattatcaacaggttcaggggacggaagaatatgcttgtcaaactgggcaagatcgactccaaggaaaagcaggtgatcctgaccgaggagaagatggagctgtacaaaaagctagcaccactcaaagatttttggcccaaagtgcccgattcaccggctaccaagtaccccatatatcccctgacacccaagaaatcccacagacgtaaaagtaagcataaatccgctaaaaagaagaccggcaagcagcaaagaaccaataacgagaacattaaaagaaccctgtcttttagaaaaaaacgctctcacgctattctatcacctccttccccttcctacaacgccgagacagaggattgtgatctgaattattctgatgtcatgagcaagctggggttcctgagcgaaagatcgaccagtcctatcaattcttcgccgcctcggtgttggtcccccacggatccacgagccgaggaaataatggctgccgctgagaaagaggccatgttattcaagggccctaacgtgtataagaagacagtgaatagtcggataggcaagaccagccgtgcacgggcacagatcaaaaagtcaaaggcaaagttggcgaacccttctattgtgactaagaagcgtaataaacgcaaccaaaccaacaaacttgtggacgacggcaaaaaaaagccgagggctaaacagaaaaccaatgaaaaaggtacttcaagaaaacacactacactaaaggatgagaagattaagtcacaaagcggagccgaggttaaatttgtcttaaaacaccagaacgtctcagagttcgccagcagtagtgggggaagccagctgctgttcaaacagaaggatatgcctctcatgggttctgccgtagatcaccccctctctgctagcctgccaaccggaataaacgcacagcagaaattatctggctgcttcagttctttcttagaatctaagaaaagcgtcgacttgcagacttttcctagctctagggacgaccttcacccctcagtggtgtgtaattctatcgggcctggtgtgtccaaaataaacgttcagaggccccataaccagagcgccatgttcaccctcaaagagtcgacgctcattcaaaagaatatatttgatctgtccaatcacctgagccaggttgcgcagaatacccaaatcagctcgggtatgtcttctaagattgaggacaatgcaaataacatccagcgaaactatctctctagtatcggaaaactgtcggagtaccgaaattccctagaaagcaagctagaccaggcctatacaccaaactttctacattgtaaagatagtcaacagcagattgtgtgtatcgcagaacagtctaaacattccgagacctgttctcccggaaacacggccagcgaggagagtcagatgcccaacaattgttttgtgacctcactgcgcagtcctattaaacagatcgcatgggagcagaaacagagagggttcatcctcgatatgtctaactttaagccagagagagtcaagccccgttcgctttcagaggccatctcccagacaaaggccctgtcgcaatgcaaaaacagaaatgttagcacgccatctgcattcggcgaaggtcagagcggcttggctgtgctgaaagagctgctccagaaaaggcagcagaaagcgcagaacgccaacacaacacaggaccccctgtcgaataaacaccagcccaataaaaatatatctggatctctggaacacaataaggccaacaaacgcacccggagtgtgactagcccaagaaagcccaggacacctcgatcgactaagcaaaaagagaaaatccctaaactgctgaaagtcgactccctgaacctccaaaactctagtcagctggacaactctgtgtccgatgattctccgatcttcttttcggaccctggatttgaaagttgttattcccttgaagacagtctctcccccgaacacaactataactttgatatcaatactattggccaaaccggtttttgtagtttctatagcgggtctcagttcgttcccgcagatcagaacctgccccagaagtttttgtccgatgccgtccaagatctgttccccggacaggccatagaaaaaaacgagttcctgtctcacgataaccagaagtgtgacgaggacaagcaccatacaaccgacagcgcctcgtggatccgcagcggtacgctgtcgcccgagatttttgaaaagagcacgatcgatagtaatgagaatcgccgacataatcagtggaagaattcatttcaccccctgactactcgatcgaactctataatggactctttttgcgtgcagcaggctgaagattgcctctctgagaaaagccgcttgaatagatcttccgttagcaaggaagtcttcctgagtttgccccaacctaacaacagtgactggatccaggggcatacccgcaaggagatggggcagtccctggacagtgctaacacctcctttaccgcgatccttagttcacccgatggtgaactggtggatgtcgcttgcgaagatctggagttgtacgtgtctagaaataatgatatgttaactcccaccccagactcgtcgcctcgctccacatctagtccctcacagtccaaaaacggtagcttcacccctcgtaccgcgaacatccttaagcccctgatgagccctccttctagagaagagatcatggccaccctcctcgatcacgacctcagtgaaaccatttaccaggagcccttctgtagcaacccttccgacgtccccgaaaaaccgagggaaatcggaggtcgcctgctcatggtggagacaagactcgccaacgatttggccgaatttgagggtgacttttccctggagggtctgaggctgtggaaaaccgcattcagcgctatgactcagaatcctaggccagggagcccgctccgttctgggcaaggagtggttaataagggatcctcaaattcacctaagatggtggaagataaaaagattgtaattatgccctgcaaatgcgctccttctcgacaattagtgcaagtatggcttcaggcaaaagaagagtatgagcgaagcaaaaaactgcctaagactaaacctacgggcgtggtgaagtccgcggaaaattttagcagcagcgtgaacccggacgataagcctgtggtgcctccaaagatggatgtgtccccctgcattcttcctacaactgcacataccaaagaagacgttgataattcgcagattgcattacaggctcccacaacagggtgttcacagaccgcttctgagagtcaaatgctccctcccgtggcttctgctagtgacccagagaaagatgaagacgatgacgacaactactacatttcctactccagcccagatagccccgtgatccccccttggcagcaacccatatcacctgatagcaaagcacttaatggtgatgataggccatcatcacccgttgaggaactgccttccctggctttcgaaaattttcttaaacctatcaaagacggcatccagaaaagcccctgtagtgagccgcaagagccgctcgtaatttcccctatcaatacaagagctcgtactgggaagtgcgaaagcctgtgctttcattccacacctataatccagagaaagctgctggaacggcttcctgaggctcccggactgtcccccctcagcactgagcccaagacccagaagctctcgaacaagaaaggctctaatacagataccctgaggcgagtgcttctcacgcaagccaagaatcagttcgcggcagtgaacactccccagaaggaaacaagtcagatagatggtcccagccttaacaatacttatggtttcaaggtgtccatacagaatctccaagaagctaaagctttacacgagatccagaacctcacactgatttccgttgaacttcatgccagaacgcggcgagaccttgagccggacccagagttcgatcctatttgcgctctgttctactgtatttccagcgatacccccctgcccgacacggaaaagaccgagctcacaggcgtgatcgtcattgacaaggacaaaacggtcttctcacaggatatccgttaccagacaccactgttaattcggtcaggaataaccggcctcgaggtcacttatgccgctgacgaaaaggcattgtttcatgagatcgcaaacattataaagcggtacgatccggatatcctgttaggctacgaaattcagatgcactcctgggggtatctgctgcaacgtgctgctgcattatctattgacttgtgcaggatgattagcagggtgcccgatgacaaaattgagaaccggttcgcagccgaaagggatgagtacgggagctatacaatgagtgagatcaacattgtgggcagaatcaccctgaatctctggagaataatgcgtaatgaggtcgcactaactaattacacctttgaaaacgtttcgttccatgtgttgcatcagaggtttcctctgtttaccttccgcgtactttcagattggttcgataacaagactgacctgtaccgctggaaaatggttgaccactacgtctcccgggtgagagggaacctgcagatgctggagcagctcgacctcatcggtaagacatccgaaatggccagattgtttggaatccagttccttcatgtactcacgcgcggatcccagtacagggtggagtcgatgatgttgagaatcgcaaaaccaatgaactacattccagtcactccttctgtacaacagaggtcacagatgagggccccacagtgtgtccccctgattatggaaccagagtcccggttctatagcaattcagtgctagttttggactttcagagtctttatccctcaatcgtaattgcctataattattgtttcagcacatgccttgggcatgtcgagaacctcggcaagtacgacgagttcaaattcggttgcaccagcctgagagtgcctccagacttactgtatcaagtgcgccacgatattaccgtcagcccaaatggcgtggcttttgtcaaaccgtccgtccgcaagggcgtgctgcctagaatgttggaggaaatattgaaaacacggtttatggtcaaacagagtatgaaggcctacaaacaggacagagctttaagtagaatgcttgacgcacggcaactgggtctgaagctgatcgcaaacgtcacctttggctacactagtgcaaacttcagcggcagaatgccgtgtatcgaagtgggtgactccatcgtccataaggcccgtgagactcttgagcgcgcaatcaaacttgtgaatgacacaaaaaaatggggggctcgggttgtctacggcgacacagatagcatgtttgttctgctgaaaggtgcaacgaaggagcagtcattcaagattggacaagagatcgccgaagccgttaccgcaactaatcccaaaccagtcaagcttaagttcgaaaaggtctatctgccttgcgttctgcagacaaaaaaaagatatgtgggatatatgtatgaaaccttagatcaaaaggacccagtgtttgacgccaaaggcatcgagacagtgagacgcgatagttgcccagccgtgagtaagattctcgagcggtcactgaagctgctcttcgaaaccagggatataagtctgattaagcagtacgtccaacgccaatgtatgaagctcctggaagggaaagccagtatccaggatttcatctttgctaaagagtacagagggtccttttcatataaacccggagcctgcgtccctgcattggagctgaccagaaagatgctcacatacgaccgcagatcagagcctcaggtgggagaaagggtcccatacgtgataatctacggaacgcccggtgtgccgcttatacagttggttcggaggcccgtggaggtgctgcaggatccaaccttgagacttaacgcgacatattatattacaaaacagatcttgcctccattggcacgtatctttagtcttatcggcattgacgtcttttcctggtatcatgagttacctcgcatccataaagctacgagcagctcgaggagtgagcccgaggggagaaaagggaccatctcccagtacttcaccaccctgcattgtcccgtttgcgacgatctcacccagcatggcatctgcagcaagtgccgatcccagcctcagcacgttgcagtgatcctgaatcaggaaatcagagagctggagcggcaacaagagcagctggtcaagatctgtaaaaattgcactggatgtttcgaccgtcacattccctgcgtttccctcaattgtcctgttctttttaaactctctcgagtaaaccgcgagctttctaaggccccatacctgagacagctgctggatcagttctac

SEQ ID NO: 238587 - DNA, 9158 bp, Artificial Sequence
  Description of Artificial Sequence: Synthetic coding sequence
atggcatttagtatcgatagggcgcttaatgtggcgctggggaatcccagcagtaccgcacagcatgtcttcaaagtctctctcgtcagcggaatgccgttctatgggtaccacgagaaggagaggcacttcatgaagatttatctgtacaaccctacaatggtcaagcggatttgtgaactgcttcagtctggcgcaataatgaacaagttttaccaaccccatgaggcacacatcccttatctccttcagctattcatcgattataatctttatggaatgaatttgattaacctcgccgcagtgaaattcagaaaggccagaagaaaatcaaataccctccacgccaccgggagctgtaaaaaccatctgagcggcaactctctggccgacaccctcttccgatgggagcaggacgagattcccagctcattgatcctggagggagtggagccacagtcaacctgcgagttggaggtggacgcggtcgccgctgacattctgaacaggctggacatcgaagctcagatcggaggcaacccgggacttcaggccatctgggaggatgaaaagcaaagacggcgaaatcggaacgagaccagccagatgtctcagccagaaagtcaggaccaccgcttcgttcccgcaaccgaatcagaaaaaaagttccaaaaaagactgcaggaaatcctgaaacagaacgacttttctgtgaccctcagcggttctgtggattactcggacggctcacaggagttctccgctgaactgactctgcacagcgaggtgctgtcaccagaaatgctgcaatgcacacccgctaatatggtggaggtgcacaaagataaagaatcctcaaaaggacatacacggcataaagttgaagaagcgttgattaacgaagaggccatactgaaccttatggaaaattcccagacatttcagccactgacacagaggttgtctgagtcccctgtgttcatggactcctcacccgacgaggcactcgtccacctgctcgctggcttggagtcggatgggtaccgcggagagaggaacagaatgccgtcaccgtgtaggagcttcggaaataacaaataccctcagaactcagatgatgaggaaaatgagcctcagattgaaaaagaagagatggagctctcacttgtcatgagtcaacggtgggacagcaatattgaggaacattgtgcaaaaaagcgttccttatgcagaaacacccatcggtcctcaacggaggatgacgatagctcgagtggtgaggagatggaatggagcgacaactccctgcttcttgccagtctgtctatcccacagctggacgggacagccgatgagaactcagataacccattgaataatgaaaactcccgaacgcatagttccgtaatcgccacatctaaactctctgtcaaaccttccatcttccataaggatgcagccacacttgagccgagttcatcggcgaagattaccttccagtgtaagcatacctccgcactttcatcccatgtactcaacaaggaggacttgatcgaggatctcagtcagacgaataagaatactgagaagggactcgataactcagtgacatcctttactaacgagtcaacctactccatgaaatatccgggtagtctgtctagcacggtgcactctgagaattcacacaaggagaattctaaaaaagagatcctgccagtttcttcttgcgagtccagcattttcgattacgaggaggacattccttctgtcacccgacaggttcccagcagaaaatatacaaacatccgtaagattgagaaggatagcccctttattcacatgcacagacaccccaatgagaacactcttggtaagaactccttcaacttcagtgatctcaaccactctaaaaataaagtcagctctgaaggaaatgagaaaggtaactccacggccttgagctcgctgtttccatcctcgtttactgaaaattgtgagcttctatcttgctcgggcgaaaacagaacaatggtgcacagccttaacagtaccgcagatgagtctggattgaacaaactcaaaattcgctacgaagaattccaggagcacaaaactgagaaaccatcactgtcacagcaggctgcccactatatgttttttccttccgtggtgctctcaaattgtctcacccgtcctcagaagctgtcccctgtcacatataagctccagccaggtaacaagccatcccgactgaagctgaataagcgcaagctggccggtcaccaagagaccagtacaaagagcagcgaaactggaagtacaaaggacaattttatccagaataatccttgcaatagcaacccagaaaaggacaatgcactggcttccgatctgacaaaaacaactcggggtgcattcgagaataaaacccccactgatggattcatcgattgtcactttggcgacggcactctcgaaaccgaacagagcttcggcctgtacggtaacaagtacactcttcgggctaagcgcaaggtgaattacgaaacagaagattccgaaagtagcttcgtaacgcataacagcaaaatttctctgccccaccccatggagataggggaaagtctggacggaactctgaaatcccgtaagcgcaggaaaatgtcgaagaagttaccaccagtgattatcaaatacatcataatcaacaggttccggggtcgcaagaatatgctcgttaaactgggcaaaatcgactccaaggagaaacaggtgatcctcaccgaggagaagatggagctgtacaagaaactggcccctttaaaggacttttggcccaaagtccccgactctccagccaccaaatacccgatatacccactgaccccaaagaaatcccacaggagaaagagtaaacacaagtccgctaagaagaaaaccgggaaacagcagcgtacgaacaatgagaatatcaaacgaacattaagctttcggaagaagcgctcacatgctatactgagcccccctagccccagttacaacgccgagacagaggattgtgacctgaattattccgacgtaatgagcaagctgggcttcctgtcagaacggagcacctctcctatcaactcttcaccccctaggtgctggagtcccaccgacccacgtgcggaagagatcatggccgcagcagaaaaagaagctatgctcttcaaagggcctaacgtctacaagaagactgtcaacagtcggattggaaaaacgtcccgggcacgagctcagataaagaaaagcaaagctaaactggccaatccttcaatcgtgacaaaaaagcggaataaacgcaatcagaccaacaaactcgtcgacgatggcaaaaaaaagccccgagcgaagcagaaaaccaatgaaaagggaacctccaggaagcacacaaccctaaaagatgagaaaattaagtctcaaagcggggcagaggtaaagttcgtgcttaagcatcagaacgttagcgagttcgcctcttcttcaggcggaagtcagctactattcaaacagaaggatatgcccctgatgggatctgctgtggaccatccactgagtgcctcattaccaactggaatcaatgcacagcagaagctttctggctgcttttcaagtttcctagaaagtaaaaaaagcgtggacctgcagacctttcccagttcccgcgacgatttgcatccatcggtggtgtgcaatagcattggtccaggtgtcagcaaaatcaacgttcagcggcctcacaaccagagcgccatgttcacactgaaggagtctacactgatccagaaaaacatctttgacttgagcaatcacctcagccaggtcgcacagaacacccaaataagcagtggcatgtcatccaagatcgaggacaacgcaaacaatatacagagaaactatcttagtagtattgggaagctgagcgagtatcgcaatagccttgagtccaaacttgaccaggcttatacacctaatttcctgcattgcaaagattctcaacagcagattgtgtgcatcgcggagcaatctaagcactcagagacgtgctctcccggaaacacagcgtccgaggaatctcagatgccgaataactgctttgtaacatcactcaggtctccaataaaacagatagcctgggagcagaaacagcgcggattcatactcgatatgtctaatttcaagcccgagcgagtcaaacctaggagcttatctgaggcgatttcccaaaccaaggcattatcccagtgtaagaacagaaatgtgtcgaccccaagtgcattcggtgagggccagagcgggctggctgtcctgaaagaactgttgcaaaaaaggcagcagaaggcccagaacgccaacactacacaggatcctctgtctaacaagcaccagcccaataagaacatttcaggtagtctggagcataacaaagccaataagagaacacgaagcgtgaccagcccacggaagccacgtaccccaagaagtacaaagcagaaggaaaagatccccaagctgttgaaagttgacagtctgaatctgcagaatagttcacagcttgataattccgtgtcagatgatagcccaatcttcttttctgatcccggattcgagagctgttactcgcttgaggattcattgagccccgagcacaactacaacttcgacattaataccatcggccaaaccggtttctgctccttctacagcggcagtcagttcgttcccgcagatcagaatctgccgcagaagttcctcagcgacgccgtgcaggatctgtttcccggtcaagcaatcgagaagaacgaatttctgagtcacgacaatcagaaatgtgacgaggataaacaccacacaaccgattccgcatcatggattaggtcaggcaccctttctccagaaattttcgagaaaagcaccatagactctaatgagaatcgtcgacacaatcagtggaaaaatagcttccatcccctcacaacacggtctaacagcatcatggattccttttgtgtccaacaagccgaggattgtctgtccgaaaagtcccggcttaacagaagcagcgtctccaaagaggtatttttgtctctcccacagcccaacaactccgactggattcaggggcacaccaggaaagaaatgggccagagtttggacagtgctaatacttctttcacagcaattctcagcagcccggacggagaactcgtggatgtcgcttgtgaagacctagagctctacgtgtctcgcaacaacgatatgctgacacctactcccgatagctcacctaggtcaacttccagtccctcacagtctaagaatggttccttcactccgagaacagccaatatcctcaaacctctgatgtccccaccctccagggaggaaatcatggctacactgctggatcacgacctgtccgaaacaatctaccaagagccattctgcagtaatcccagcgatgtgcccgagaagccacgagagatagggggtagacttctcatggtggagacgagactcgccaatgatctcgccgagtttgagggagacttctctctggaaggattgagattgtggaaaaccgcattttcggctatgactcagaatcccagacctggatcgcctttgcgttcaggtcagggggtagtgaacaaaggatcatcgaattcccctaaaatggtggaggacaagaaaatcgttataatgccatgtaagtgtgctccaagccggcagctggtccaagtgtggcttcaggctaaggaggagtatgaaagatctaaaaaactgccaaagaccaaacctacaggcgtcgtgaagagtgctgaaaatttcagctcaagcgtgaatccggacgataaacccgttgttccgcctaagatggatgtatcgccatgcatcctgcctaccaccgcccacacaaaggaggatgtcgataattctcagattgcgctacaagctcctacgacaggctgttctcagactgccagcgagtcccagatgctacctcccgtggcgtcggccagcgaccccgaaaaggacgaggacgatgatgacaactactatatttcatattcttcccccgactcccccgtgatcccaccctggcagcagccgatctcccctgatagcaaggctctgaacggcgatgaccgaccttctagcccagtggaggaactgcctagcttggccttcgaaaacttcctcaagcctatcaaggacgggatccagaagtccccctgctcggaaccccaagaaccgctggtgatcagcccaattaacacccgggcaaggacggggaagtgtgaaagcctttgcttccacagcacgccaattattcagcgtaaactactagagcgcctgccagaggctcctggactcagcccgctcagtacagaaccgaagacacagaaattatcaaataagaagggtagtaatacggacacactcaggagggtcctgcttacccaggccaagaaccagtttgccgcagtgaacacgccccagaaggaaacatcacagattgatggaccaagcctcaataatacctatgggtttaaagtgtccattcagaacctacaggaagccaaggccctgcatgaaattcaaaacctgactctgatctccgttgagctccatgccagaacccgacgggatctggaaccagatcctgaattcgatcctatttgtgccctgttttactgtatttcatccgataccccactgcccgacaccgaaaaaaccgagctgacaggtgttatcgttatcgacaaggataagacggtgttttctcaggacattagataccagacacctctgctaatcagaagcggtattaccggtttagaggttacatatgcggcagatgaaaaggccctcttccacgagatcgccaatataattaaaagatatgaccctgatattctgttgggctatgagattcagatgcattcttggggctatttgctgcagagggctgccgctttaagcattgacctttgccgaatgatctcccgcgtacccgacgacaaaattgaaaatcgcttcgctgcagaacgagatgagtacggctcctatacaatgtcagaaattaacatagtgggcagaataactctgaatctctggaggattatgcgaaatgaggtagcactgaccaactatacattcgagaacgtgtcttttcacgttctgcatcaacgctttccactgttcacatttagggtactttcagattggttcgataacaaaaccgatctgtataggtggaaaatggtagaccactatgttagcagggtgcgaggtaacctgcaaatgctggagcagttagatctgatcggaaagactagcgagatggccaggctgttcggcatacaatttctgcatgtgctcacccggggaagccagtacagagtcgagagcatgatgctcagaatcgccaagcctatgaactacatccctgttaccccatccgttcagcagcggagccagatgcgcgctcctcaatgcgtgccactgatcatggaacctgagtctcgcttttattccaactcagtgcttgttctggattttcagtctctgtatccgtctattgtgatcgcctacaattattgtttctccacgtgccttggccatgtggagaacctggggaaatatgacgaattcaaattcgggtgtacaagccttcgggttccgcctgatctgttgtaccaggttagacacgacattactgtctcaccaaacggcgtggcctttgtcaagcccagtgttagaaagggagttctccccagaatgcttgaggagatcctgaaaacaagattcatggtgaagcagagtatgaaggcctataaacaggaccgcgcactttccagaatgctagacgctaggcagctgggcctgaagcttattgccaacgtaaccttcgggtacacttctgcaaatttttcaggccgtatgccatgtatcgaagtgggcgatagcattgtccataaggccagagaaacactagagagggctatcaagttagtcaacgacacaaaaaagtggggagcgagggtagtatatggagataccgattcaatgttcgtgctgctcaagggggcaactaaagaacagagttttaaaataggccaggagattgcagaggccgtgaccgccaccaacccaaagcccgtgaaactcaagtttgaaaaggtctacttgccctgcgtcctccagacaaaaaagcgctacgtcggctatatgtacgaaacactggatcagaaggaccccgtgtttgatgccaaagggatcgagacagtccggcgtgattcctgtcccgctgtttctaaaattctggagaggagcctcaagttgttattcgagacaagggatattagtcttatcaagcagtacgtacagaggcagtgcatgaaactactggagggcaaagccagtatacaggactttattttcgccaaggaatacagaggttccttctcctacaagccaggtgcttgcgttcccgcactggagctgactcgcaaaatgctaacctatgataggagaagcgagccacaggtgggtgagagggtcccgtacgtgattatctacggaactcctggggtgccgctcattcagctggttcgacggcctgtggaggttctccaggatccgacacttaggttaaatgccacatattatatcaccaaacaaatcctgcctcccctcgccaggatcttctcgttgattggaattgacgtcttttcttggtatcacgagctccctcgaatccacaaagctaccagcagctcacgctcagagcccgaaggtcgcaaaggcacaatcagccagtattttacaaccctgcactgtcctgtttgtgatgatctgactcaacacgggatctgtagtaaatgtcgctcccagcctcagcacgtggcagtcatactgaaccaagagatcagggagttggagagacagcaggagcaactcgttaagatttgtaaaaattgcaccggatgttttgatcgccatattccttgcgtcagtctgaattgcccagtcctgtttaaactgtcccgtgtaaatagggagttatccaaggcaccgtatcttcgccagctgctcgatcagttcta

SEQ ID NO: 238588 - DNA, 2289 bp, Artificial Sequence
  Description of Artificial Sequence: Synthetic coding sequence
atggtggaaactcgactggccaacgacctcgctgaattcgaaggggactttagcctcgagggcttaaggctttggaagacagcgttcagcgcaatgactcagaatccaagaccaggcagtccgctcaggtcaggccagggtgtggtgaataagggaagttctaacagtcctaagatggtggaggacaagaagatcgttatcatgccctgcaaatgcgcgccatcccgacagctggtgcaggtgtggctccaggcgaaagaggagtacgaaaggagtaagaaacttccaaagactaagccaactggcgtggtgaaaagcgccgagaattttagctccagtgtgaatccagacgacaagcccgtggtgccacctaagatggatgtgtccccctgtatcctgccaacaacagcccatacaaaggaagacgttgacaatagccagatagccctccaggcccctacaaccgggtgtagtcagacggcctcagaatcccagatgttgccgcctgtggctagcgcaagcgaccccgagaaggacgaggatgacgatgataattactacatttcctattcttctcccgactctccagttattcccccatggcagcagccaatctcgccggactctaaggccctaaacggcgatgaccgtcctagctctccggtcgaagaactgccgagtttagccttcgagaacttcctaaaaccaattaaggatggtatccagaagagtccatgcagcgagccacaggagcctctagtcatctctcccatcaacaccagagctagaacaggcaagtgtgagtccctgtgcttccatagcacccctattattcagcgaaagttactggaacgtttaccagaggccccaggattaagccccctgtcaacagagccaaagacccagaagctgagtaataagaaggggagcaacacggacacgcttagacgagttcttcttacccaagctaaaaaccagtttgctgccgtgaacaccccccagaaagaaacaagccagatagacgggccaagcctgaataatacatatgggttcaaggtgagcatacagaatctccaagaggcaaaagcactccacgagattcaaaacctcaccctcatctcggtagaactccacgctagaactaggcgggatctagagcctgacccagagttcgatcccatctgcgccctattctattgcattagcagcgatacgccactgcctgacacagaaaagaccgaactaactggcgtgatcgtgatcgacaaagacaagactgtattttcccaagacatcaggtaccagacccccctcttaatcagaagcggtattaccggactcgaggttacttatgctgcagacgagaaggccctgttccatgaaattgcaaacatcatcaagcgttatgatccggacattcttttgggttatgaaatccagatgcactcctggggctacctcctccagcgcgctgcagcactgagtatcgacttatgccgaatgatttctagggtcccagacgataaaatcgagaaccgcttcgctgcagagagagatgaatacggaagttacaccatgtccgaaatcaatatcgtaggcaggatcaccctaaatttatggaggattatgagaaacgaggtggccctcactaattatacatttgagaacgtgtcgtttcacgttttacaccagagatttccactcttcactttcagggtgctctcggattggtttgataataagacagacctgtaccgttggaagatggtggaccactacgtgagtagagtgagggggaatcttcagatgcttgaacagctcgacctgattggcaaaacttccgagatggccagactgtttggtattcagtttctgcatgtgttaactcgaggctcacagtacagagttgaatctatgatgctgcgaatcgcgaaacccatgaactatattcccgttactccttctgtgcagcagaggtcacaaatgcgagctccacagtgcgtgcctctgatcatggagccagaatctcggttctacagtaacagcgtgcttgtcctagatttccagtccctgtacccatctattgtcattgcctataactactgcttcagcacctgtctggggcatgttgaaaacctggggaaatatgatgagtttaagtttggttgcacgtctctcagagtgccacctgatctgctgtatcaggtgcggcacgatattacggttagccctaacggcgttgccttcgtaaaaatcgccaataaatgccgacccgagggtatggcatag

SEQ ID NO: 238589 - DNA, 3666 bp, Artificial Sequence
  Description of Artificial Sequence: Synthetic coding sequence
atgctgagatcaacaggattcttccgtgccatcgactgtccgtattggtcaggggcacccggaggaccatgtcgaagaccgtattgccatttcagacatcgtggcgcacggggatcaggtgcacccggagatggaggcgaagcacctcccgctgccggactgggctatgatccctacaatccagaattgcccaagccccctgcacagagagagaatgggactctgggcctgggagaggagcctcgtccagacgtgctagagctggagctcgtgaaccaggcaatcgaggccgtccggagcgaagtagaactggagcagaggaggtatcgggagctgctagaaacaacccgagaacatcggtctgccgaagctccagcactagcccctagagggccaaatgcttctcctaccgtgggccctgatgaggacgccttcccactagcatttgattactcccccggaagccacgggttgctttcgccagatgccggatatcagccgacgcctctggctgcccctgcagagccaggttccaagtattcactggcaagcctggaccgtggccaaggcaggggaggaggcggagggggtgctctcgagtacgtgcctaaagccgtgtcccagcccaggcggcactcgcgccctgtacccagcggcaagtatgtggtggacaacagcagacccccaactgacttagagtacgatcccctctctaactattctgcacggcacctctcccgagcctcctctcgtgacgaacgcgctgccaaaagacccagaggtagcaggggctccgagccctacacacccgcaccaaagaaactctgtgaccctttcggtagctgtgatgcaagatttagcgatagcgaggacgaggccgcaactgtcccgggaaatgagcccacgacggcaagcacccctaaggctcgagccgaccctgagattaaagcaaccggccagcccccatctaaggaaggcctcgaggccgaggggggtggcctccgcgaaaccaaggaaacagcagtacagtgcgatgtcggtgacttgcagcccccacccgctaagccagcaagtcctgcccaagtgcaaagcagccaggacggaggctgcccaaaggaagggaagccaaaaaagaaaaagaccggggctccgccagccccatcctgtaaagacggagcccagggcaaagacaagacaaaagataagggccgagggaggccagtggagaagccccgtgctgacaagaaagggccacaggcgtcctcaccaagacgcaaggcggagcggcctgaaggaacgaaaaagaaacctagcagcgccacacctgtggctacctctggtaaaggcaggcccgatagacctgccagaaggccttcaccaacttccggtgactcgaggccagccgctggacggggaccacctcggccactacagctccccgacaggaaaagcactaaggccccaagtggtaaattggtagaacgtaaggctaggtccctcgatgaaggcgcaagccaagatgcacccaaactgaaaaagagagctctgtctcatgcggatttgttcggcgacgaatcggaggacgaagctgccggacctggcgttccctccgtctggccctcagctctacctagtctgtctagcgattcagactcagattctgactccagcctcggctttccagaagctcagggacctcctaaaagattgaaggcctctcctccacccagtcctgctccttcttcttcctctagtagcagttcctctacatcctccgctggggctgatgttgattactccgccttggagaaggaagtggattttgactccgatcccatggaagagtgtctaagaatcttcaatgaaagtacttcagtgaagacagaagacaggggaagactggccaggcagccacctaaagaggaaaagtctgaggagaaggggctgtccggattaaccacgctgtttcctggacagaaaagacggatctcacacttgagcaaacagggccaggaggtcgagccccctcgacgtggccctgccgttcccccagctcggccaccaactgcacaagaagtgtgttatctgcgagctcagcaggctcagcgggcttccgccagtttactgcaggctccagccagactggcagagaagagtccaagcgtccacatcagcgctcctggcgagaagaggaggattgcccacatccctaatcccagactcgccgcagccccaacaggagcaaagagaacactggccgcttccggttctcaatctagtaacgggcctgaacctgggggtcaacagctgaagaccagaacgctttcaggcatggcctctaagaccacaactaccatcatacctaaaaggattgcgcattctccgtccctgcagtccctgaagaagcctattattcccaaagaatttggagggaaggtccccaccgtaatcaggcagaggtatctgaacttatttatcgaggagtgtttaaagttttgtacaagtaatcaggaggccattgagaaagcactgaatgaggaaaaagtagcgtacgatagaagcccttcaaaaaacatttatttaaatgtggccgtgaacacactgaaaaagctacgcggtctggccccatctgccgtccctggactaagcaagacttctgggcgtcgtgtagtgtcgcatgaagtggttctgggcggacgacttgctgcaaaaacaagctttagtctgtccagacccagcagtccacgagtggaggacctgaaaggtgctgctctgtacagtcggctgagagaatatctgttgacgcaagatcagctgaaagagaacggctacccttttcctcacccagaaaggcctgggggagccatcatcttcacagcagaggaaaaaagacctaaggacagctcctgccggacgtgttgtcgctgtggcaccgagtatcttgtgtcttcctctggcagatgtattagggacgaggaatgttactaccactgggggaggctgcgcagaaacagggtcgcagggggatgggagacgcagtacatgtgctgtagtgctgctgccggaagcgtcggttgtcaggttgcgaagcaacatgtccaggacgggcgtaaagaaaggctggaaggcttcgtcaaaaccttcgagaaggagttgtctggggacacccacccgggtatttacgccctggactgcgagatgagctatacaacttacggtctcgagctgacccgcgtgacagtggtggacaccgacgtccacgtggtgtacgacacttttgttaaacctgacaacgagatcgtggattacaacacccgattcagcggagtgactgaagctgacctcgccgacacaagcgtgaccctgagggatgttcaggctgtactgctcagtatgttttcagccgataccatcctgattggtcacagcctggaaagcgatttgctggccctcaaggtcatacactcaaccgtagttgacactagcgtgctgtttcctcaccggttaggtcttccttacaagcggtcactgagaaacctcatggccgattatctgcgccagattattcaggacaacgtcgacggacatagcagcagtgaagacgccggagcatgcatgcaccttgtgatatggaaggtccgcgaagatgctaagaccaagaggtag

SEQ ID NO: 238590 - DNA, 1014 bp, Artificial Sequence
  Description of Artificial Sequence: Synthetic coding sequence
atgctgccctcgtccacaagactggggtatgatccctacaacccggaattaccgaagccgccagctcagcgagagaatggcaccctgggcctgggggaagaacccaggcctgatgtactggaattggaattagtgaatcaggctatcgaggcagtgcggtctgaagttgaattggagcagcgccgatacagagagctgttagaaacaaccagggaacaccgtagtgcggaggcccctgctctggccccacggggacctaacgcttcaccaaccgtcggtccagatgaggatgctttcccactggcgttcgattattcgcccggatcccatggacttttaagccctgatgccggttatcagccgactcccctcgctgctccggctgagcctgggagcaaatatagcctcgctagcctggataggggacaaggccgaggaggaggaggagggggtgcgttagagtatgttcccaaagccgtctcccagcctagaaggcacagcaggcccgtcccctcaggaaagtatgtcgtagataacagtcgcccacccacggatctggagtatgaccccctatcaaattatagtgccaggcacctcagtagggcctcaagtagagacgagagagcagccaagcgcccaagaggtagtcgcggtagtgaaccgtatacacctgcccctaagaagctgtgtgacccttttggttcatgcgatgctaggttcagcgatagcgaagatgaggcagctaccgtacctggtaatgaacccaccaccgcctctacccctaaggccagagcagaccccgaaatcaaagccactggccaacccccaagtaaggagggactggaggctgagggcggaggtctccgggaaacaaaagaaaccgccgtgcagtgtgatgttggcgaccttcaacccccacctgcaaaacctgcctctccagcccaggtccagagctcacaggacggcggatgcccaaaggagggtaagccaaaaaagaagaagacaggagcttag

SEQ ID NO: 238591 - DNA, 1482 bp, Artificial Sequence
  Description of Artificial Sequence: Synthetic coding sequence
atgggtagccattcaccatgtgcacatacaccatgcgcacctcctgccccaacaggagctaagcgaaccctggccgcatccggctcccagtcctctaacggcccagagcctgggggacagcaactgaaaacaaggaccctgagtgggatggcctcaaaaaccacgactaccatcattccaaagaggattgcacattctccaagcctgcagagcctaaagaaacccattatcccaaaggagtttggcggaaaagtccctacggtcatccgccagagatacttgaaccttttcatcgaggaatgtctcaagttttgtacgtcaaaccaagaggctattgagaaggccttgaacgaggagaaggtcgcctacgaccggtccccaagcaaaaatatctacctgaatgtagctgtgaatacactgaaaaagctgcgaggactggcaccctccgcagtccctggcctgtccaaaacctcagggaggcgtgtggtgtcccatgaagtggtgcttggaggacgcttggctgctaagacctcatttagtctgagccgcccaagctcccctagggtagaagaccttaagggagcagccttatactctcggctgcgtgagtacttgttgactcaagaccagctcaaggaaaacgggtatccattcccccacccagaaaggccaggaggagcaatcatatttacggcagaggaaaagcgccctaaggacagtagttgccgcacttgctgtcgatgtggcaccgagtatcttgtttcctcttctggcagatgcattcgggacgaagagtgttactaccactggggtcggttacggcgtaacagagtggcgggtgggtgggagacacagtacatgtgctgcagtgccgctgccggttcagttggctgtcaggttgcgaagcagcacgtgcaagatggtcgcaaggagcgcctggaaggctttgtgaagacctttgagaaagaattgtccggcgatacacatccaggaatatatgctctagactgtgagatgagctacaccacttacggcttggagttgacccgggtgacagtagtcgacacggacgtacatgtcgtttacgacacattcgttaagcccgataacgaaatagtagactacaacaccagattctccggcgtgacagaggcagatctggctgacacaagcgttactctgagggacgtccaagccgtgttgctctcaatgttctctgcagacaccattttaattggccatagtctcgagagtgatttgctggctttgaaagtcatccactccactgtggtggacacttcagtgctcttcccacatcgcctcggactgccatacaagaggagtctgcgcaacctgatggctgactacctgcggcaaatcatccaggacaacgtggacgggcattcgtcttctgaagatgctggcgcttgtatgcatctcgtgatttggaaagtgcgggaagatgcaaaaaccaagcggtag

SEQ ID NO: 238592 - DNA, 714 bp, Artificial Sequence
  Description of Artificial Sequence: Synthetic coding sequence
atgcttgggggaagtttgggtagcagactgcttcggggtgtcggtggctcccacggcaggttcggagcacggggagtgagagaaggcggtgctgcaatggctgccggagagtcaatggcccaacgcatggtgtgggtggatctggagatgacaggtctggacatcgaaaaggatcagattattgagatggcttgtctgatcaccgattcagatctgaacatcctggctgaaggcccaaatctgatcatcaagcaaccggacgaactgctggatagcatgagcgattggtgcaaagagcatcatggcaaatccggcctgacaaaggcagtcaaggaatccacaatcaccctccagcaagctgaatacgagtttttgtcctttgtgcgtcagcagactccgcctggtttatgcccactcgccggtaatagcgttcacgaggataagaaattcctcgataagtatatgccacagttcatgaagcatttgcattatcggattattgacgtatccactgtgaaagagctgtgccgccgatggtatccggaggagtacgagtttgccccaaagaaagctgcaagccatagagctctcgatgatatttccgagagcataaaggaactgcagttctatagaaataatattttcaaaaaaaaaatcgatgagaagaagaggaagattatcgagaacggggaaaatgagaaaacggtgtcatag

SEQ ID NO: 238593 - DNA, 753 bp, Artificial Sequence
  Description of Artificial Sequence: Synthetic coding sequence
atgggaaaggctaaggtgcctgctagcaagagggcacctagctcgcccgtcgctaaaccgggaccagtcaaaacactgacacggaagaagaataagaagaagaagaggttctggaagtccaaggccagggaagtgagcaaaaagcccgcttcaggccctggcgctgttgtgagaccgccaaaggcccctgaggactttagccagaactggaaagccctccaggaagttccgcgatggaccgggggacggcagtacctcgcaccccgtccagtggagcaatctactatccgcaaagaacctcggaagggtcagatggtgatcctctttcaaaacgagggaacttcctcaataagatctggcaagctgcgacgtcagccacagcctcatccacctcgcgaggaactggaagtggtgcagaaggaagttgcagagatgttgaaaggacgaattctggttggtcatgccttacataatgacctcaaggtactgttcctggaccaccctaagaagaagattagagatacacagaaatacaagcccttcaaatctcaggtgaagagcggtcgcccttcactcaggctgctttccgaaaagatcttgggtctgcaggtgcagcaggccgagcactgctccatacaggatgcccaggctgccatgcggctctatgtgatggtgaagaaagaatgggaatctatggcaagggaccggagacctctccttaccgcgccagaccattgctctgatgatgcgtag

SEQ ID NO: 238594 - DNA, 1269 bp, Artificial Sequence
  Description of Artificial Sequence: Synthetic coding sequence
atgggtaaggccaaggtgcccgcttccaagcgcgctccttctagtcccgtggccaaaccaggcccagtgaaaacactgacccggaaaaaaaacaagaagaaaaaacggttttggaaaagtaaggcccgagaggtgagtaaaaagccagctagcggtcccggagccgtggtccggcctcctaaagcgcctgaggatttcagtcaaaactggaaggctctccaagaatggctcctgaaacagaagagccaagcccctgaaaaaccactggtcatttctcagatggggtctaagaaaaagccgaaaattatacagcagaacaagaaagagacttccccacaggtgaagggcgaggagatgcctgccggaaaagaccaagaggcttcacgaggatcagtgccctctgggagcaagatggatagacgcgctcctgtaccccgaactaaggcctccggaactgaacataataaaaaagggaccaaggaacggacaaacggagacatcgtcccagagcgaggagacatcgaacacaagaagcgcaaggcaaaagaggccgctcccgctccgccaacagaggaagacatctggttcgatgacgtggaccctgccgacattgaagccgcaatcgggccagaagcggctaaaatcgctaggaagcagttagggcagtctgaaggctctgtgtccctctctctggtgaaagaacaagctttcggcggactcacaagggcacttgctctcgactgcgagatggtgggagttggcccaaagggcgaagagtctatggccgctcgagtttccattgtgaaccagtatggtaagtgcgtttacgataagtacgttaaaccaaccgagcccgtaaccgactaccgcactgctgtgtccgggatacgccctgagaacctgaagcagggtgaagaattggaggttgttcagaaggaggtggcggagatgctgaagggaagaatcctcgttgggcacgcactgcacaacgacttaaaggtgttgtttttagaccacccaaaaaagaaaattagagatacacagaaatataaacctttcaaaagccaggtcaaaagtgggaggccctccttgaggctcctcagcgaaaaaattctcggcctccaggttcagcaggcagaacattgcagcattcaggacgctcaggctgctatgagactctacgttatggtgaaaaaggagtgggagtcaatggctagggaccgccgacctctgcttactgcccctgaccactgttccgatgatgcatag

SEQ ID NO: 238595 - DNA, 570 bp, Artificial Sequence
  Description of Artificial Sequence: Synthetic coding sequence
atgggctcaaagaagaagcccaagatcattcagcagaataagaaggaaaccagtccccaggtgaagggcgaggagatgccagccggaaaggaccaggaagctagtcggggatccgtgccaagtggctcgaaaatggatagacgcgcacctgtccccaggaccaaggctagtggcactgaacacaacaagaagggaacaaaggagcgcacgaacggagacatcgtgcccgagcgcggagacatcgagcataagaagcgaaaagctaaagaagccgctcccgctccccctacagaggaagatatctggtttgacgatgttgacccagccgatattgaggccgctataggcccagaggctgctaaaattgctcgcaagcagctgggacaaagtgaggggtcagtctcgctgagcctggtcaaggagcaagcctttgggggtctgactagagccctggcgctggactgtgaaatggtgggtgtgggcccaaagggggaagagagcatggccgcacgggtcagcatcgtgaatcaatacggtaagtgtgtctacgataagtacgtgaaaccttag

SEQ ID NO: 238596 - DNA, 1125 bp, Artificial Sequence
  Description of Artificial Sequence: Synthetic coding sequence
cctgtggccaaacccggacctgtgaaaactttaacccgaaaaaagaacaaaaaaaaaaagcggttctggaaatctaaagctagggaagttagcaaaaagccggctagtggacccggagctgtggttagacccccaaaggccccagaagacttcagccagaactggaaagccctgcaagagtggttgctgaaacagaaatctcaggccccagagaagccactggtcatttcacaaatggggagtaaaaaaaagccaaagatcattcagcagaacaagaaggagacctccccacaagtgaagggggaggagatgccggcaggtaaggaccaggaagcctctagggggagtgtcccgtctggttccaagatggaccgaagggcaccggtgccacggacaaaagcgtccggaactgagcataacaaaaaaggaacgaaggagagaactaacggagacattgtgcccgagaggggcgacatagagcacaagaagcgtaaggccaaagaggccgcacccgcacccccaaccgaggaagacatctggttcgacgatgtcgatccagccgacatcgaggctgcaattggtcctgaagctgccaaaatcgccagaaagcagctaggacagagcgaaggatctgtgtccctgagcctggtcaaggagcaggcattcgggggattaactcgtgctttagctctggactgtgagatggttggagttggtccgaagggggaagagtctatggcagccagagtttccattgtgaaccaatatggcaagtgcgtgtacgataaatacgtgaaaccaacagaacccgtgacagactataggactgctgtctcaggcatcaggccagaaaatttaaaacaaggcgaggagctcgaggtggttcagaaggaggtagctgaaatgctaaaggggcgaatcctggttgggcacgctctccacaatgacctgaagtctggccgtccatctttacgcctcctttccgagaaaatattggggcttcaggtacagcaggattccgggtgtcccggaagcaacgaggcagttcgacacggagaagaaggcgtgggagaacacggaccgcgtcaagctcctcccgcagattgctcccggccattgcagtag

SEQ ID NO: 238597 - DNA, 702 bp, Artificial Sequence
  Description of Artificial Sequence: Synthetic coding sequence
atggggaaggccaaggtcccagcctccaagcgggctccttccagcccggtcgccaagccaggaccagtgaaaaccttgaccagaaagaaaaacaagaagaaaaagaggttttggaagagcaaagctcgcgaggtgagcaagaagccagcatccggccctggggctgtggtgcgccctcccaaggcaccagaagactttagtcagaattggaaggccctgcaggaggtccccaggtggaccggcggacgtcagtatctggccccacgtccggtggagcagtcgactatacgaaaggaacccaggaaggggcagatggttatactcttccagaacgaaggaacctccagtattaggtctgggaaactgcgaaggcagccacagccacatccccctagggaagagctggaggtcgtgcagaaggaggtggcggagatgctgaaggggagaatcttagtgggccacgccctgcacaatgaccttaaggtgttgttcctggaccatccaaagaaaaagattagagacactcagaaatacaaaccgttcaaaagccaggtcaaatcagggagaccttcgcttaggttactctctgaaaagatcctgggattgcaagtccagcaggccgaacactgctccatacaggatgctcaggccgcaatgaggctgtacgtgatggttaaaaaggaatgggagtccatggcctag

SEQ ID NO: 238598 - DNA, 996 bp, Artificial Sequence
  Description of Artificial Sequence: Synthetic coding sequence
atgagtcgtgcccgaggcgcattgtgccgggcatgcctcgccctggctgccgctctggctgctctattactcttgccacttccccttcctagggctccggctccggcaaggacaccagcccctgcgcctagagctccaccatctagaccggctgctccatcactgaggcccgacgacgtgttcattgctgtaaaaactacacggaagaaccacggccctaggctccgacttctcctgcggacctggatcagccgggctagacaacagacgtttatttttaccgatggtgatgatcccgagctggagcttcagggcggagaccgggtgatcaacacaaactgtagcgctgtgcggacccggcaagctctctgttgtaaaatgtcagtcgaatacgataagttcattgaaagcgggagaaagtggttttgtcatgtagatgatgataactatgtgaacgcgaggtctctgctccacctgctgagctcttttagtcccagccaggatgtttatcttggccgaccctcacttgaccaccccatcgaagccacagaaagagtccagggaggacggactgtgacgactgtcaagttttggtttgctactggaggggctggtttttgtctgagccgtggcctggcactgaaaatgtcgccctgggcgtctcttggctctttcatgagcactgccgaacaggtgcggcttcccgatgactgtacggttggatatattgttgagggcctgcttggtgcacggctcttacacagtccgctgtttcactcccatctagaaaatctccagaggctgcctcctgacaccctcctccagcaggtgacgctttcacacgggggacctgagaacccacacaatgttgtaaacgtcgccggaggttttagtctgcatcaggaccccacgagattcaaatcgatacattgccttctctatccggataccgactggtgccctcgacagaaacagggagcgcctacatctcgctag

SEQ ID NO: 238599 - DNA, 873 bp, Artificial Sequence
  Description of Artificial Sequence: Synthetic coding sequence
atgtcaagagcccctcctagccgccctgccgcaccgagcctccggcctgatgatgtgtttatcgccgtgaagactacgagaaagaaccacgggccacggctgcgccttctcttacgcacttggatcagtagagcaaggcagcaaacctttatattcacagatggggacgacccggagctggagttgcagggcggagaccgcgttataaacacaaactgttccgcagttagaacgcgccaggcactgtgctgcaagatgtcagtggaatacgataagtttatcgaatcaggcaggaagtggttctgccacgtggatgacgataattacgtcaacgccagatccctccttcatcttctttcatccttcagtccgtcccaagatgtttatctgggcaggccgtccctggatcatcctattgaggctaccgaacgggttcaggggggtaggacagttacaactgttaaattctggtttgccacaggcggagcgggtttctgtctgtcaagagggttggcactgaaaatgtcaccttgggcctcactcggtagcttcatgtccacggccgagcaggtgaggcttcccgatgattgtaccgttggctacattgtcgaggggctgcttggcgcaagactgctgcattcccccttattccatagccatcttgagaacctgcagcggctgcctcccgacaccctgttgcagcaggtcacactaagtcatggtggccctgaaaaccctcataacgtggtgaacgtggccggtggcttctcccttcaccaggatccaacccggtttaagtccattcattgtctgctttatcctgacacagattggtgcccacgtcagaagcagggagcccctacaagccggtag

SEQ ID NO: 238600 - DNA, 1626 bp, Artificial Sequence
  Description of Artificial Sequence: Synthetic coding sequence
atggggtcccaggaggtgttgggccatgccgctagattggcctccagtgggctgcttctgcaggtgctgttcaggctcatcactttcgtgctcaatgcattcatcttgcgattccttagcaaggaaattgtgggcgtggtaaatgtaaggcttactcttctgtacagcaccactctgttcctcgccagagaagcctttcgcagggcttgtctgagtggtggcacacaaagggattggagccagaccttaaacctgctttggctcactgtgccgcttggggttttttggtccctctttctcggttggatttggctgcagctgcttgaggtgccagatccaaatgtggtgcctcattacgccaccggggtggtgctattcggcctttctgctgtggtggagctcctgggagagccattctgggtgcttgcccaggcccatatgttcgtgaaactgaaagtcatcgctgagtcattgtccgttatactgaaatcggtgttgaccgcattcttggtcctgtggctgccccattggggtctctatattttttctctggctcagctattctataccaccgtgcttgtcctgtgttacgttatctacttcaccaagctgctgggatcacctgagtccacaaagctccagactctgcctgtgagccgaatcacagacctgcttcctaatatcacaaggaacggagcttttatcaattggaaggaggccaaattgacctggtctttcttcaagcagtctttcctaaaacagattttgacagagggtgagcgctacgtgatgactttcttgaatgtcctcaacttcggggatcagggggtttacgacatcgttaataatctgggatcactggttgcccgacttatctttcaacctattgaagagtctttctatatcttctttgccaaagtgctggagcgcggaaaagatgctactcttcagaagcaagaagatgtggctgtggcagcagccgttctcgagtccctgctcaagttggccctcctcgccggactcacaattaccgtgtttgggttcgcctactcccaacttgccctggacatttatggcggtacaatgcttagcagtggttctgggccagtgcttctcagaagttattgcctctacgtacttctcctcgctatcaacggcgtgacagaatgtttcactttcgccgctatgtcaaaagaggaggtagataggtataatttcgtgatgctggccctgtcctcatcatttcttgtgctctcataccttttgacacggtggtgcggatctgttgggtttatcctggccaattgcttcaacatgggaattaggatcacccagagcctgtgtttcattcaccgctactacagaaggtcaccacacagaccactcgccggactgcatctgtctcccgtgcttctgggcactttcgccctgtcgggaggcgtcactgccgttagcgaagtcttcctttgctgcgagcaggggtggccagctcggctggcccacattgcggtgggggcattttgtttgggtgccactctcggcactgccttcttgaccgaaaccaagcttattcatttcttgaggactcagctgggcgtgccacgcagaacagataaaatgacatag

SEQ ID NO: 238601 - DNA, 1509 bp, Artificial Sequence
  Description of Artificial Sequence: Synthetic coding sequence
atgggatcccaggaggttctcggccatgcagcacgacttgcatcaagcggtctgctgctgcaggttctatttcggctcatcactttcgtgttgaatgcgttcattcttcgcttcctcagcaaggagattgtgggcgttgtcaacgtgagggttccccttggcgtgttttggtccctttttctcggatggatctggctccagctccttgaggttcccgaccccaacgttgtgcctcactacgcaactggcgtcgttcttttcggactctcagctgtggtggagttattgggcgagccgttttgggtcctggcacaagcacatatgttcgtgaagctcaaggtcattgctgagtcactgagtgtgatccttaagagcgtgttgaccgctttcctcgtgctgtggttgcctcactggggtctgtatatatttagtctggcccagcttttttacactacagtgctcgttttatgctacgtgatctacttcacaaaattactcgggagtccagagtccaccaagctccagaccctgcctgtctccaggattacggatctcctgcctaatatcacgagaaatggagccttcataaattggaaggaggcaaagctcacctggagcttcttcaagcagagctttctgaagcagatccttaccgaaggggaaaggtacgtcatgacctttcttaatgtgttgaatttcggtgatcagggcgtgtacgacattgtcaataatctcggtagcctggtggcgcgactgattttccagccaattgaagagagtttttatattttttttgccaaggttctggaaagggggaaagacgctacgctgcagaaacaggaggatgtcgccgtggccgcagccgtcctggaaagtctcctgaaactcgcactgttggcaggcctgaccatcacggttttcggctttgcttattcccaactggcactcgacatttacgggggaactatgctcagcagtggctccggtccagtcctgctccgttcctactgcctgtatgtattgctcctggctattaatggagtgaccgaatgcttcaccttcgctgcaatgagcaaggaggaggtcgatcgctacaacttcgtgatgctggctctgtcttcgagcttcttggttttaagctatctcctgacccgttggtgcggaagtgttggctttatactggctaactgtttcaatatgggaatacgcatcacacaatctctgtgttttattcataggtactaccgcaggagcccacaccgtccgctggctggtctgcatctctccccagtgctgctgggtacatttgctctttccggtggagtgacagcagtgtctgaagtgtttctgtgctgcgagcagggatggcccgcacgcctggcccacattgccgtcggggctttttgtctgggtgccaccctcggtaccgcttttttgaccgagactaaactcatccattttctgcgtacccagctgggtgtacccaggcgtactgacaaaatgacttag

SEQ ID NO: 238602 - DNA, 4308 bp, Artificial Sequence
  Description of Artificial Sequence: Synthetic coding sequence
atggctcaaaccccagatggcatctcctgcgagctgcgcggagagataacacgctttctctggccaaaagaagtagagctgttgttaaagacctggctgcctggggaaggggctgtccagaaccatgttttggccttgttgagatggcgggcttacttgctgcacactacctgcctgcccctgagggtcgactgtacttttagctatttggaggtccaggcaatggctctgcaggagactccaccccaggtgacctttgaactcgaatcactgcgcgaactggtgctggagttccccggagtggccgctctggaacagctggcccagcatgtcgccgcagcgattaagaaggtgtttcccaggagtaccctcggtaaactctttcgtagacccactccagcaagcatgctagcaagactggagcgatcatcccctagcgagagcactgatccctgttccccttgcggcggattcctggaaacctatgaggcactctgcgattataatgggtttccctttcgcgaggagattcagtgggatgttgacacaatttatcaccggcaagggtgtaggcacttctccttgggcgatttttcccatctgggctctcgtgatctggccttatctgtggccgctctgagctacaacctgtggttcagatgcctgtcttgtgttgatatgaagctgtcactggaagtgagtgaacagatcctgcacatgatgagccagagttcccatctagaggagctagtgttggaaacctgcagtctgcgcggtgactttgtcagaaggctggcccaggcattggcgggtcactcctcttccggcctgcgcgaactgtccctggccggaaatctgctcgatgataggggaatgacagcgttgtcgagacacctcgagcgatgcccaggtgcactcaggagactatcattggcccaaaccggacttaccccgagagggatgagggctcttggacgcgcactagcgaccaacgcagcatttgattccacattgactcacctggacctgtccggcaacccaggtgccctcggagcatcagaagatagcggagggctgtactctttcctctcccggcctaacgtgcttagcttcctcaacctggccggaacggacacggccctcgacactgtgcgcggatgctctgtcggtggctggatgacagggagagctgattggcgagcaggacggggaggcttgggtccacctgctggggtggctaatagcctgccccctcaattgttcgctgccgtctctaggggatgttgcacatcactgacacacctggacgcgagcagaaatgttttcagtcgaacaaagagccgggctgccccagctgcactccaattgtttctcagtagagctcgtacactgcggcatttaggactcgctgggtgcaagcttccccctgacgctttgcgggctttgctggatgggctggcactgaacacacatctgagagacttgcacctcgatcttagcgcctgcgagctcagatcggccggagcacaagtgattcaggacttagtttgtgacgccggagcagtgtcctctctggatctcgcagacaatggatttgggtctgatatggtcacactggttctggcaatagggagaagcaggtccttgagacatgtcgctctgggcaggaatttcaacgtgcggtgtaaagaaacacttgatgatgtgctccaccggatcgtgcagcttatgcaagatgacgactgcccactccagtcgctgtccgtggccgagagccggctcaagctgggcgcttcagtgctgctaagagcactggcaacaaaccccaacttgactgcattggatattagtggtaatgccatgggggacgctggggctaaactgttggcgaaagctctcagggttaatagcaggctcaggagcgttgtgtgggatcgtaaccacactagcgcattaggactactcgatgttgcccaggctcttgagcagaatcactccctcaaagcgatgcctctacccctgaacgatgtagcacaggcacagcggtcgagacccgagttgactgctagagccgtgcaccaaatccaggcttgcctgcttcggaacaacagggctgatcccgcaagctccgatcataccactaggctccagcctttggggctggtgtctgatccgagcgagcaggaggttaatgaactttgccaatccgtccaggaacacgtggagctgctcggttgtggcgcaggccctcaaggcgaggccgctgtcaggcaggccgaggacgctattcagaacgccaactttagcctttcaatccttcccatcctctacgaggctggatcaagtccatctcaccactggcagctcgggcaaaaacttgaaggtctactgcgccaggtgggggaggtgtgtcgacaggacatccaggacttcacccaggctactctagacaccgccaggagcctgtgcccccagatgctgcaaggatcgtcctggcgggagcagctggagggcgtgctagccggttcacgcggtcttccagaactgttgccagagcagctgttgcaggatgcgtttacgaggctaagggatatgagacttagtattacagggacactggcagagtctatcgtggcgcaggctttagcgggactctcggcagccagagaccaactggtggagtcacttgcccaacaagcgactgtgactatgcccccagccctgcctgcacccgatggcggtgaacctagtcttctggaacctggagagctggaaggactctttttccccgaagagaaggaggaagaaaaagaaaaagacgacagcccacctcaaaaatggcccgagttatcccacggcctccacctggtcccattcatccacagtgctgcggaagaggccgaaccggagcctgaactggctgcacccggtgaggacgcggaaccccaggccggtccatcagcacgaggaagcccatccccagctgctccagggcctcccgcagggccactgccccgaatggacctgccactggctggccaacctctcaggcatcccactcgggcaagacccaggccaagaagacagcatcatcaccggccaccaccaggtggccctcaggtgccccctgcattaccacaggaaggaaacggcttgtcagccagagtcgatgagggagtggaggaattcttctctaaaagactgatccagcaagataggctgtgggctcctgaggaggaccctgctactgaagggggagctaccccagttccgaggacattgagaaagaaactaggcaccttgtttgctttcaagaagccccgaagcacccgaggtcccaggactgacttagaaactagccccggtgccgctccaagaacccgaaaaaccacatttggcgacttactccgtcccccaacaaggcccagcagaggggaagaactgggcggagccgaaggcgatacaagctcacccgatcctgcaggtcgctctcggccacgttacactcgtgatagcaaggcctacagcatgatcctcctgcccgctgaagaagaggccacgttgggcgctcggcctgataaaaggcggccactggagcgcggagaaaccgagctcgctccttcattcgagcagcgcgtgcaggtgatgctgcagcgcatcggtgtctcacgcggaagcggaggcgctgaaggaaagagaaagcagagcaaggatggagaaatcaaaaaagcgggaagtgacggcgatattatggactcatcgacagaagcgccacccataagtatcaaaagccgcacgcattctgtcagcgccgatccatcttgtcggccaggccctggctctcagggtccagagtccgcgacttggaaaacgttgggtcagcagctgaatgccgaacttaggagccgcggttggggacagcaggatgggcctggtcctcctagcccgggtcagagcccatcgccatgtaggacaagcccttcccccgactctctggggctgcccgaggatccttgcctcgggccaaggaacgaggacggtcagctcagacctagacctctatccgctgggcgtagggctgtcagtgtccacgaggaccagctgcaggcgccagccgagcgccctctgagactgcagagaagccctgtgttgaagaggaggcccaaactggaggcgccaccttccccttccttaggaagcggcctgggaactgagcctctgccgcctcagcccactgaaccttcaagccctgaacgatctccgccttcaccagccactgaccagcggggagggggtcctaatccttag

SEQ ID NO: 238603 - DNA, 1335 bp, Artificial Sequence
  Description of Artificial Sequence: Synthetic coding sequence
atgcccccagctttgccagcgcctgacgggggtgaaccctccctgctggagcccggtgagctggagggtctcttttttcccgaggagaaggaagaggagaaagaaaaggacgactctcccccacagaagtggcccgaacttagccatggcttacatctcgtgccatttattcattcagccgcagaggaagccgaaccggagcctgagttagctgctccgggtgaggatgccgaaccacaggctgggcctagcgctagagggtctcctagcccagccgcaccagggcctcccgctggacctctgccgaggatggacctgcccctggcaggtcagcctctgagacatcccacccgagccaggccacggccacggaggcaacaccatcatcgtccgccacccggaggccctcaagtcccaccagccctgccccaagaaggaaatggtctctctgcgagagtggacgagggggtggaggaattttttagcaaacgactcatccaacaagatcgactctgggcaccggaggaggatcctgcaacggaagggggagcgacaccagttcccagaacccttagaaaaaagctcggcaccttgttcgcatttaagaaacctcggagcacgagaggaccacgtaccgacttagagactagtccgggtgccgctccacggacccgcaagaccacattcggcgacctgctgcggcctcctacgaggcccagtaggggtgaagagctgggaggggctgagggcgatacatccagccctgaccccgctgggagaagccgcccaaggtatacacgggattctaaagcctattcaatgatcctgttgccagctgaggaagaggcaacgttaggggctaggccagacaagcggagacccctcgagcgcggtgaaaccgagctggcccctagctttgagcagcgcgtccaagtgatgctacaacggattggcgtgtcacgcggatccggcggagcagaaggcaaaaggaagcagagcaaagacggcgaaattaaaaaggccggtagcgacggagatatcatggactcaagcacagaggcgcctcctatcagtatcaagagtcgcacacactccgtctccgccgatccatcttgcaggccagggcctgggtcacagggaccagagtctgctacatggaaaacactgggacagcagctgaacgctgagcttcgaagccggggttgggggcagcaggatggacctgggcctccctcccccggacagtccccctccccatgtagaaccccgccacagacggcatgggccagccagaggacacttgcgtgggcccctgagatgaagaatggcccatag

SEQ ID NO: 238604 - DNA, 4119 bp, Artificial Sequence
  Description of Artificial Sequence: Synthetic coding sequence
atggcccagacacctgatggtatatcttgtgagctgagaggcgagattacacggtttctctggcccaaggaagtggaattgctgttgaaaacttggctgccaggggagggcgctgtgcagaatcacgtgctggccctccttcgttggagggcatatttgctgcacactacctgtctgccactacgggtggactgtactttttcctaccttgaagtgcaggctatggcgctgcaggaaacccccccacaggtcacgttcgaactggagtcattgcgtgaactcgttctcgaatttcctggtgtggcagccttggagcaattggcccagcacgttgctgctgccatcaaaaaggtgttccccaggtccactctgggaaagttgttccggaggccaacccctgcgtccatgctggccagactggagagaagtagccccagcgagtccacagatccctgttcaccatgcggagggttcctcgagacatatgaggccctgtgtgactacaatggctttccctttagggaagagatacagtgggacgtggataccatctaccatcggcagggctgccggcactttagccttggcgacttcagtcaccttggaagccgcgacctggccctaagtgtcgcggcactgagctacaacctgtggtttagatgcttgtcatgcgtggatatgaaactctctcttgaggttagcgaacagattctgcacatgatgtctcagtcttctcatttggaagagttagttctggagacctgcagcctgcgcggagacttcgtgaggcggctggctcaggccctggctggacattcatcatctggcctacgggagctgagtctggcgggtaacctgctcgacgaccgaggcatgacagctctctcccgacatctagaacgatgtccaggcgcactgaggaggttgagtctcgctcagacaggactgactcccagaggaatgcgagccctcgggagagccctggctactaacgctgcctttgattctactttaacacaccttgatctgtcaggcaatcctggtgctcttggcgcatcggaagattctggaggcctgtacagcttcctgagccgtcctaacgtgttgagtttcctgaacctcgccggtaccgacaccgccctcgacacactctttgctgccgtgtcacggggttgttgtacctcactaacacacttggacgcatcacgaaacgttttctcccgaacgaagagccgcgcagcgccagctgcccttcagctgtttctgagtcgcgctcggactcttagacaccttgggttggcgggttgcaaattaccccctgacgccctgcgcgctctgctcgacggtctggctttaaacacacatttaagggacttgcacctagatctaagtgcatgcgagctgcggagtgcaggtgctcaggtgattcaagatttggtgtgcgacgcaggtgccgtcagtagtttggacttagctgacaatggcttcggttcggacatggtgactttagttctggctatcggtcggtccagaagtcttagacacgtcgctttagggaggaactttaacgtccgctgcaaagagaccctggacgacgtccttcaccggatcgtccagttgatgcaggacgacgattgtccactccagtccctgtcagttgcagaatctcggttgaaactcggcgcaagcgtgctgctgcgggcactagccacaaacccaaaccttacagcactggacatctcaggaaacgcaatgggggatgctggagccaagctgctggctaaagctctccgcgtgaatagccgtctgcggtctgtggtatgggatcggaaccacacctctgctctggggctgctggatgttgctcaggctctggagcagaaccattctctaaaagccatgcctttgccgcttaatgatgtggcacaggctcaaagatctcgcccagagcttacagctagggcagtccaccagatacaggcgtgtctcctacggaacaaccgcgctgaccccgctagttctgaccacacaactagacttcagcccctgggactagtatctgacccatcagagcaggaggtaaatgaattgtgccagtcagtacaggagcacgtggaactccttggttgcggcgctgggcctcagggtgaagccgcagtgcgacaggctgaagacgccatccagaacgcaaatttcagcctgtctattttgcctatactctatgaagctggatcttccccctctcaccactggcagctcggccagaaactggagggcttgctgaggcaggtcggcgaggtctgcaggcaggatatacaggatttcactcaggccacgctggacactgcacggtctctatgcccacaaatgctccagggttccagttggagggagcagcttgagggagtgttagcaggtagcagggggctgccggaactgctgccggaacaactcctccaggacgccttcacccgtctgagagatatgaggttgtccataaccggaacacttgccgaatcaattgtcgcccaggctcttgcaggacttagtgcagccagagatcagctggttgagtctctggctcagcaggccaccgttaccatgccacctgccctgcctgctccagacggaggagagcctagcttattggagcctggagagctggaaggcctctttttccctgaggaaaaggaagaggagaaagagaaagacgactcacctcctcagaaatggcccgaactctcgcatggtctgcacctggtgccattcattcatagcgcagccgaggaggccgagccagagcccgagctggccgctccaggcgaagacgcggaaccacaggcagggccaagtgcaagggggtcaccatccccagctgccccaggaccacccgctggtccactgcccagaatggatcttcccctagctgggcagcccctccgccaccctactcgcgctcgcccacggccacgcagacagcaccaccatagaccacctcccggaggacctcaggtaccaccagccctaccacaggaaggtaatggcctctcggcccgtgttgacgagggagtggaagagttctttagcaagcgccttatacagcaggaccgcctttgggcgcctgaggaagacccagcaacggaggggggtgcaacccccgtgcctagaactctgcggaagaagttaggaaccttgtttgcattcaaaaaaccaagaagcactaggggcccacgtacggatctcgagacttctccgggagcggcacctcggactagaaaaaccactttcggtgacctgctacggcctccaacgagaccgtcccgcggtgaggagctggggggtgccgagggggacacatcatctcccgatccagccggtcggtcgagacctagatacaccagagacagtaaggcttacagtatgatactgcttcctgcagaggaagaggctaccttgggggctaggcccgacaagagacgcccacttgaacgaggcgagacagagttggcccctagtttcgagcagcgcgtccaggtaatgctgcagcggataggagtgtcaaggggcagtggcggagctgagggtaaacgcaaacaaagcaaagacggagaaatcaagaaagcgggatcggatggcgatattatggatagttcgaccgaagccccacctatttctatcaagtcaagaacgcatagcgtgtctgctgacccctcctgtcgaccagggcctgggtctcagggacctgagagcgctacatggaagacgctaggccagcagctgaatgctgaactgaggtcaagagggtgggggcaacaggatggccctggtcctccaagtccaggccagtcaccaagcccttgtcgcacgtcccctagtcctgactccctgggactccccgaggacccatgtctaggacctaggaacgaggaacgacctctgcgactgcagcggtctcctgtgttaaagcgcaggccaaagctggaggctcccccaagcccatcattgggatcaggtcttgggacagagcctttgccacctcaaccaacagagccaagtagccctgagcggtctcctccatcccccgctactgatcaaagaggagggggacctaatccgtag

SEQ ID NO: 238605 - DNA, 1305 bp, Artificial Sequence
  Description of Artificial Sequence: Synthetic coding sequence
atggggatgggccgtggggcaggccgttccgcacttggattttggcccacgttggctttcttactgtgctctttccccgcagccactagcccctgcaagattctgaagtgtaactccgagttctggtctgcaactagcggctcacatgcacccgctagcgacgacacaccagaattctgtgccgctttaaggtcttatgctctatgtaccaggcgcacggcgaggacatgtcgcggagatcttgcttatcacagcgcagtccacggcatcgaagaccttatgtcccagcacaattgctcaaaagacggaccgactagccagcctcgcttgcgcacattgccgccagccggtgacagccaggaacgaagtgattcccctgagatatgccactacgagaaatccttccacaagcacagcgccacccctaactacactcactgcggcctattcggtgatccgcacttgcgtacgttcaccgatcggttccagacctgcaaagtgcagggagcttggcctcttatcgacaataactatctcaacgtccaagtcactaatacacctgtattacccggttctgccgcaacagcaactagtaagctgaccatcatttttaagaacttccaggagtgtgtggaccaaaaggtatatcaggcagagatggatgagctgcctgcagcttttgtggacggcagcaagaatggaggagacaagcacggggctaacagtcttaaaataactgaaaaagtttctggccagcacgtggagatacaggctaaatatatcgggaccactattgtggtgcgtcaagtgggcaggtacctgacatttgctgtacgtatgccggaggaggttgtcaacgctgtcgaggactgggattcccagggactgtatctctgcctgagaggttgccccctgaatcagcaaatcgacttccaagcatttcatactaacgccgaagggacgggtgcgaggaggctagccgctgccagtcctgccccaacagctcccgaaacattcccatacgaaactgctgtggccaagtgcaaggaaaagttgccagtggaggatttgtactatcaagcatgtgtctttgacctgctaaccaccggagacgttaattttacgctggccgcatattacgccctggaggacgtaaagatgttgcactctaacaaagacaagcttcacctctatgaccgtactcgagacctgcctggacgcgcagcagcgggacttcccttggcccctcgcccactactcggcgctctcgtgcctttgctggccttgcttcctgtgttttgttag

SEQ ID NO: 238606 - DNA, 1353 bp, Artificial Sequence
  Description of Artificial Sequence: Synthetic coding sequence
atgcagccacctcgggagagactcgtcgtcactggcagagctggatggatgggaatgggacgtggtgcgggtcggagcgctctaggtttctggccaactcttgcattcctactctgttcctttcccgcagcaacttcgccctgtaaaattctcaagtgcaattctgagttttggtctgccacttccggctcacacgcacccgcatctgatgatacgcctgagttttgtgccgctctgcgcagctacgcactttgtacacgaagaactgcccgaacctgtcggggagatttagcctaccactcagcagtccacggcatagaggatctcatgagtcagcacaactgtagcaaagacgggccaacaagccagccacgcctgagaaccctgcctccagccggtgactcacaggagagatctgactctccagaaatctgccactacgagaagtcgttccacaaacactctgctactcctaactatacccattgcgggctgtttggggatccccatttaagaaccttcactgaccggtttcagacttgtaaagtccagggagcttggccccttatcgacaacaattatcttaatgtgcaggtgacgaacacccccgtcctgccaggctccgcagcaaccgcgaccagtaagctgacgatcatttttaagaatttccaagagtgcgtggatcaaaaggtctaccaggcagaaatggacgaactgcctgccgcatttgtggatggaagcaagaacggaggcgacaagcacggcgctaattcgctcaaaataactgagaaggtatcaggccagcatgtcgagatacaggccaagtacataggaaccaccatcgtggtgcggcaagtgggacgctatttaactttcgctgtccggatgccggaggaagttgttaacgctgttgaggactgggattcccaaggtctgtatctatgccttcgcggatgtcctctgaaccagcaaatcgatttccaggcatttcataccaacgcggaaggtactggcgctcgcaggttagctgcagcctcccccgctccaactgcaccagagaccttcccttacgaaactgccgtggcaaagtgcaaagaaaagctgccggtggaggacctgtactaccaagcttgtgtgttcgaccttctgacaacaggggatgtaaatttcaccctggctgcgtactacgccctagaggatgttaagatgttgcacagcaataaagataaattgcatttatacgatcggacacgcgatctgccgggacgcgcagctgccggattgccactcgccccacggccacttctgggtgccctggtaccactgctcgctctgttaccagttttttgctag

SEQ ID NO: 238607 - DNA, 1305 bp, Artificial Sequence
  Description of Artificial Sequence: Synthetic coding sequence
atgggcatgggcagaggagccggacggagtgccctcggcttctggcctaccctcgcctttctgctgtgtagttttcctgccgcaacttcgccgtgcaagattctcaagtgcaattcagaattttggagcgcaacaagcggttcacatgcacccgcatctgacgatacgcccgaattttgcgcagccttacggtcgtacgctctgtgtaccagacgtacggctcggacttgcagaggcgatcttgcttatcactcagccgtccacggcattgaggaccttatgagtcagcacaactgttcaaaggacggccctactagccaacctcggctgagaaccctgccacctgctggggattctcaggaaagaagtgactcccccgagatctgccattatgaaaaatctttccacaaacacagcgctacaccgaactatacccattgcggccttttcggagacccccatctacgcacttttactgatcgtttccaaacctgtaaagtccagggggcttggccgcttatcgataataattacctcaacgtccaagtgacaaacacccctgtgctgcccggaagcgccgcaaccgctacatctaaactgaccattatatttaagaacttccaggaatgcgttgaccaaaaggtgtatcaagccgagatggatgagttgcctgccgctttcgtcgatggctctaagaacggcggtgacaaacacggcgctaatagcctaaaaattacagaaaaggtttcaggtcagcacgtggaaatccaggcaaaatacattggaacaaccatcgtagttcgacaggtcggcagatacctcaccttcgcagtaagaatgcccgaagaggttgtcaacgcagttgaggattgggatagccaggggctgtacctctgcttgcggggatgtccacttaaccagcaaatcgattttcaagctttccatacaaatgcggagggcaccggcgcacgaagactggccgcagcgagcccagcccctacggcacctgagaccttcccctacgagacagccgtggccaagtgcaaggagaagcttcccgtggaggacctctattatcaagcctgtgtattcgatctactgaccaccggcgacgtgaatttcaccttagctgcatactacgcactcgaggatgtcaagatgttacactcaaataaagacaagctgcatttgtacgatcgtactcgcgatctgcctggacgcgcagccgcaggcctccccttagccccacggcctctgctgggtgcgctggtgcccctgctggccctccttccggtgttctgctag

SEQ ID NO: 238608 - DNA, 1026 bp, Artificial Sequence
  Description of Artificial Sequence: Synthetic coding sequence
atgtcacagcacaactgctccaaggatgggcctacaagccagcctagactgcgcaccctgccacccgctggagattcccaggagcgcagtgactcacctgagatctgtcactatgaaaagtctttccataaacattcagcaacaccaaattatacacactgcggccttttcggagaccctcacctgcggacattcaccgatagatttcaaacttgtaaagttcagggggcttggcccctgattgataacaactacctcaatgtgcaggttacaaatacccctgtgcttccagggtcggccgcaaccgccactagtaaactcacaatcattttcaaaaacttccaggagtgcgtcgatcagaaggtgtaccaggcagagatggatgaactgcccgctgcgttcgtggatggtagcaagaacggcggtgataaacacggtgcgaatagtctaaagataacagagaaagttagcgggcagcacgtcgaaatccaagccaaatacattggcacaacgatcgtggtgagacaggtgggacggtatctgaccttcgcagtccggatgccagaagaggtggtgaacgcagtcgaagactgggattctcagggcttatatctttgcctcagaggctgccctctcaaccagcaaattgacttccaggccttccacactaatgcagagggcacaggtgctcgacgactcgcagccgctagcccagccccaaccgctccagagacctttccttacgaaacagctgtggcaaagtgcaaagagaagctgccggtggaggatttgtattaccaagcgtgtgtattcgacctgttgactaccggtgatgttaacttcaccctcgccgcatactatgcactcgaggacgtcaagatgcttcacagtaacaaagacaagttgcatttgtatgaccggaccagggatttgccagggagagctgccgctggcctgcctctagctccaagacctctgttgggcgcactcgtgcccttgctggccctgctgccggtcttttgttag

SEQ ID NO: 238609 - DNA, 1305 bp, Artificial Sequence
  Description of Artificial Sequence: Synthetic coding sequence
atgggaatgggcagaggcgcagggcgaagtgcactgggcttttggcctaccttagcgttcctgttgtgttcattccccgctgctacaagtccatgcaagatcctgaagtgcaacagtgagttctggagtgccaccagcggatctcacgcgcctgccagcgatgatacgccagagttttgtgccgcactaaggagttacgcactttgtacaaggcggaccgcgagaacttgccgaggagatctcgcttatcattcagcggtacacggcatcgaggatctaatgagtcaacacaactgctctaaggatggcccaacctcccagcctcgtctgaggacattaccacccgctggcgattcccaggagcgatcggactctcccgagatttgccactatgagaagagttttcacaagcattcagcaacccccaactacacccattgtggtttattcggtgaccctcacttacgcaccttcaccgacaggttccaaacatgcaaagtgcagggcgcttggccactgattgataacaactatctgaacgtgcaagtgaccaatactccagttcttcctggcagtgctgccaccgctacctctaaactgaccatcattttcaaaaactttcaggaatgtgtggaccaaaaggtttaccaggctgagatggacgagctgcccgcagccttcgtggatggctctaaaaacggcggagacaaacacggagccaatagcctgaagataaccgagaaagtttctggacaacacgttgaaatccaagctaaatacatcggaaccacaatcgtagtacgccaggtggggagatatctgacttttgcggtgagaatgccggaagaagtggtaaacgccgtcgaggattgggactcccagggactgtacttgtgcctccgcggttgccctctcaaccagcaaattgactttcaggcattccacacaaacgcagaaggcacaggagctagacggctggcggctgccagccccgctcccacagcaccagaaacatttccctatgaaacagcagtcgctaaatgcaaggagaagttgcccgttgaagacctatactaccaggcctgcgtatttgatctgctgacgactggagacgtaaacttcaccctggccgcatattacgctctagaggacgtgaagatgctgcatagcaataaggataagttacatctgtacgatcgtactagagacctgccgggtagagcagcagccggattgccactcgccccacggcctcttctcggcgcactggtgcccctgctggccctgctgcctgtgttctgctag

SEQ ID NO: 238610 - DNA, 1377 bp, Artificial Sequence
  Description of Artificial Sequence: Synthetic coding sequence
atgggcggtctgggcccacggagggccggaacaagtcgcgagaggcttgtcgttaccggaagagctgggtggatgggaatgggacgtggtgctgggcgatcagccctaggcttttggcccacactcgcctttctcctctgttcctttccggcagctacaagcccatgtaaaatcctgaaatgcaacagcgagttttggtcagctacctccggatcacacgcccctgccagcgatgacacccccgagttctgtgcagccttgaggtcttacgcactgtgtacgagaagaacagccaggacctgtcgaggcgatttggcttatcattcagctgtgcatggaatagaagacctcatgagtcagcataattgcagtaaggatgggccaacatctcagcctcgcttgcggacacttccaccagccggagactcccaggagcggagcgattcccccgagatctgccactatgaaaagagctttcataagcacagtgcgactcctaattatacgcattgtgggctgttcggggaccctcatcttcgcaccttcaccgatcgctttcagacctgcaaggtccagggagcatggcccttgatcgacaataactatctgaacgttcaagtgacaaatacacctgtgctaccaggaagtgccgctaccgcaacttctaagctcaccatcatttttaaaaatttccaggaatgtgtggaccagaaagtctatcaggccgagatggatgagctgccagcagcctttgtagatgggtccaagaacggaggtgataaacatggagcaaattctttgaaaatcaccgagaaagtgagcggccagcacgttgaaatccaggccaaatacatcgggacaactatcgtggtgcgccaggtggggagatatctaacgttcgccgtcagaatgcctgaggaggtggtaaacgctgtagaggattgggactcgcagggattatacttgtgtctgaggggctgccccttgaatcagcagattgactttcaagccttccatactaacgctgaaggcaccggagctcgccgtctggcagcggcttcccctgcacccaccgctcctgagacattcccctatgaaacagcagtagccaaatgtaaggagaagcttcctgttgaggacttatattaccaagcgtgtgtttttgatctcctgacaaccggggatgtgaatttcacccttgccgcttactacgctcttgaggatgtgaagatgttgcatagcaataaggacaaactgcatctctatgatcgcactagagacctgccaggtcgtgcagctgccggtctgcctctcgctcctagacctctcttaggcgcacttgtgcccctccttgcactgctgcccgtcttctgctag

SEQ ID NO: 238611 - DNA, 1437 bp, Artificial Sequence
  Description of Artificial Sequence: Synthetic coding sequence
atgatccgcaaaaagcggaaacgctccgccccaccaggaccttgtagatctcatgggcctcggccagccacagctccagccccacctccttctcccgagccaactcgacctgcgtggactggcatgggactaagggctgccccttcaagtgccgctgcggctgccgcagaagtggagcagaggagaagccctgggttatgtccaccaccactcgaactgctgctactattacttttctctctgggactgctgcatgcaggggactgccagcaaccggcacagtgtcgcatccaaaagtgtacgactgatttcgtgtccctaacttcacacctgaattccgccgtcgatgggtttgattcggagttctgtaaagcattgcgcgcttatgctgggtgcacccaacggacatctaaggcttgcaggggtaatctcgtgtaccactcagctgtgctgggcattagcgacttgatgtcgcagcggaattgctctaaggacggtcctacgtcaagtactaatcccgaagttacccacgacccatgtaattaccacagccatgccggagctcgagaacatagacgtggtgaccagaaccctccctcatatctcttttgcggcctgttcggagacccccatctacggaccttcaaagataatttccaaacctgcaaagtcgaaggagcatggccattaatagataacaattacctgagcgtccaggtgaccaacgtacccgtggttcccggttccagtgctactgccacgaataagatcaccattatcttcaaggcccaccacgaatgcacggatcagaaagtttatcaagcagtgactgatgaccttcctgccgctttcgtcgatgggactacgtcagggggagactctgacgcaaagtcgctacgcatcgtagagcgagagtctggtcattacgttgagatgcacgccagatacataggcaccaccgtgttcgtgcgccaggtggggcgatatcttacactagcaatcagaatgcccgaggatctggccatgtcatatgaagaatcacaggaccttcagctgtgtgtgaatggctgtcccttatctgagcgaattgacgatggccagggccaagtgagcgccatcttggggcattccttaccgagaacaagtctggtccaggcgtggccaggatatacattggagactgctaatactcagtgccacgaaaagatgcctgtgaaagacatctacttccagagctgcgtctttgacctcctgacgacgggtgacgcaaactttactgccgcagcacatagcgcccttgaggatgtggaagcactccacccacggaaggagcgttggcatatcttccccagttctggaaatggcacaccgcgaggtggctccgacctctccgtttcgctgggtctgacctgcctgatcctgatcgtgttcctctag

SEQ ID NO: 238612 - DNA, 1314 bp, Artificial Sequence
  Description of Artificial Sequence: Synthetic coding sequence
atgggattacgagccgctccttctagcgctgccgctgcagccgctgaggtggagcagcgccgatcccctgggctgtgtccccctccattggagctgcttctgctcctgcttttcagtttgggattgttgcatgctggtgactgccagcaaccagctcagtgcagaatacagaagtgtactaccgacttcgtgtcgctcacaagccacctcaactctgctgtcgacggatttgattccgaattctgtaaggccctccgggcatatgccggttgcacccagaggacctcgaaagcttgtcgcggaaatctggtgtaccactcggccgtcctgggaatctcagatttgatgtcacagagaaattgtagtaaggatggacctacttccagcacaaacccagaggtgacacacgacccatgcaactatcatagtcatgccggtgccagggaacaccgacggggagaccagaaccctcctagctaccttttttgcggtctctttggtgacccccaccttaggacctttaaagacaacttccaaacgtgtaaggtagaaggagcctggccgctgattgacaacaactatttatcagttcaagtgacgaatgtgccagtggtcccaggctctagcgctactgctactaataagattacgatcatctttaaagctcaccacgagtgtacagatcaaaaggtgtaccaggccgtgacagacgacctgcctgcagcctttgtcgacggtaccacctctggcggtgactcagatgcgaagtctctgaggattgtggagagagagtcaggccactacgttgagatgcacgcgaggtacatcgggaccacagtgttcgtccgtcaggttgggagatacctgacactggcaattcgcatgcccgaggacctggctatgtcatacgaggaatctcaggatctacagctatgcgtaaacgggtgtccactctccgagcgtatagatgatggccaaggccaggtctcagcgatacttgggcactcactgccgagaactagtctcgtccaggcctggccaggatacaccttggagaccgcaaacactcagtgtcacgaaaaaatgccagtaaaagacatttacttccaaagctgcgtgtttgatttactcaccacaggcgatgccaacttcactgctgctgcccattccgcattggaagacgtggaagctttgcaccccagaaaagagaggtggcacatcttcccttcaagcggtaacggcaccccaagaggcggaagcgacctgagcgtttccctgggcctgacctgtttaatcctgatagtgttcctctag

SEQ ID NO: 238613 - DNA, 1176 bp, Artificial Sequence
  Description of Artificial Sequence: Synthetic coding sequence
atgattgaagtggtagccgagctgtcaaggggcccagtttttttggccggagaagcactcgagtgcgttgtgacggtgactaatccgctcccaccaacagctacaagcgcatcatccgaggcattggcctgggcttccgctcaaatccattgccaatttcacgctagcgagtcccgggtggcactgccgccaccagacagtagtcagcccgacgttcagcctgactctcagactgtctttctaccccacagaggtgaaagggggcaatgcattttgtcaacaccacccaaaatcctgttctgcgacctgaggctagacccaggggaatctaagagttacagctattcagaggtgctccctatcgaaggcccaccgtcttttcggggacaatctgtgaagtacgtgtataagctgactattggatgtcagagagtgaactcaccaatcacactgttaagagtgcctctgcgcgtgctcgttctgacagggctgcaagatgtccgctttcctcaagacgaagctgttgccccatcgagtccgtttctggaggaggatgagggcggtaagaaggatagctggctagcagaactcgcgggtgaaaggctcatggctgccacatcttgtcggtcacttcacctgtataacatctcggatggcagagggaaggtgggaacttttgggattttcaagagtgtctacagacttggtgaggacgtggttggtacgctgaatctcggagaaggaaccgtcgcatgtctgcaatttagcgtatccctgcaaacggaagagagagttcagccggagtatcagaggcggcgtggagctggcggagtgccttccgtctcacatgtcacccatgccaggcaccaggaaagctgcctgcatactacccgtaccagtttttccctccctatcccactgtcgagcactccgggtttttgtacagccatcgtaagtcttaaatggagattacattttgagtttgtcacgtctcgggaacccggactggtgctactgcctcccgtggagcagccagaacctactacatggaccggaccagagcaagtcccagtggacacgttcagctgggatctacctatcaaagtgctgcctaccagccccacccttgctagctacgccgcacctgggccatccacatccacgattactatctag

SEQ ID NO: 238614 - DNA, 1296 bp, Artificial Sequence
  Description of Artificial Sequence: Synthetic coding sequence
atgactcgggctctgagcgggctagcttgcagagcactccccgcaggaagggacagtgcagaaggccttggtgtgccaattccttccgtggattacgccaggtccgacagtggcgctgctatgattgaagtggtggctgaactgagtcgtggaccagtgtttcttgcaggtgaggcgctcgagtgtgtggtgaccgtgactaatcctctgccccctactgctacaagtgcgtcctctgaggcactggcgtgggcctcggctcagatccattgccagtttcatgctagtgagtcccgggtggcacttccgccaccagatagcagtcagccggatgtgcaaccggattcgcagacggtgttcttgccacataggggggaaagaggccagtgcattctgtcaaccccgcctaagatcctgttctgcgatctaaggctggacccaggagagagtaaatcgtacagctacagtgaagtactcccaatcgaggggccacctagtttccggggtcagtccgtgaagtacgtctataagctcaccatcggctgccaacgagtgaactctcctataacgctactgcgcgtgcccctgcgcgtgctggttctcactggtctccaggacgtcaggttcccacaagatgaggcagtcgcgccatcaagtccctttctcgaggaggacgagggaggaaagaaagatagttggctggccgagttagccggtgagagactcatggccgcaaccagttgtcgctctctgcatctgtataacatttccgacggacgcggaaaggtggggacctttggtatatttaaatcggtgtatcgactgggagaggacgtggttggaactctcaacctgggggaagggacagtcgcgtgcttgcagttctcagtttctttgcagacggaagagcgggtgcaacccgaataccagcgtcgccgtggagctgggggagttccctctgtctcacacgtgacacatgccaggcaccaggagtcgtgtctgcataccacccgcaccagtttttctcttccgatccctctctcctctacccccggattttgcaccgccatagtcagcttaaagtggcgactgcacttcgagtttgtaaccagcagggaacccggtctggttctgctgccgcctgtcgagcagccagagcccacaacttggacgggcccagagcaagtaccggttgatactttttcttgggatctgcccattaaggtcctccctaccagcccaaccctggccagctacgccgctccagggccttcaacatccaccataaccatatag

SEQ ID NO: 238615 - DNA, 1119 bp, Artificial Sequence
  Description of Artificial Sequence: Synthetic coding sequence
atgtcctcaaagtaccctcgctcagttagacgctgtcttcccttatgcgccctgacactggaagcagctttgatccttttgttttacttttttacccattacgatgcgtcccttgaagatcagaaaggtctagtcgcctcctatcaagttggccaagacttgactgttatggccgcactgggactgggctttcttacctctaatttccgtcgacacagctggagcagcgtggccttcaatttattcatgctggccctgggagtgcaatgggccatcctgctcgatggattcctgagccagtttccgccaggcaaggtggttattaccttattcagcatcagactcgccacaatgagcgccatgtcggtgcttattagcgcaggcgcagtcctgggtaaggtaaacctcgcacagctcgttgtgatggtgctcgttgaggtgactgccctgggtacactgagaatggtgatctccaatatcttcaacacagactaccatatgaacttaaggcatttctacgtgtttgctgcatattttggcctcacagttgcttggtgcttgcccaaaccacttcccaagggaaccgaagacaacgaccagcgcgcaaccatcccttcactgtctgccatgctgggagcattatttctgtggatgttttggccttctgtgaatagcgctctcctgaggtcacccatacaaagaaagaacgctatgttcaatacttactacgccctcgctgttagcgttgtcaccgcaatcagtggctcctccctcgcgcaccctcagcgcaaaatttccatgacatatgtgcatagcgctgtactggcaggcggagtggccgtaggcacatcctgccatctgattccttcaccttggctcgcgatggtcctcgggctggtggcaggcctaataagcatcgggggagccaagtgcctccccgtctgttgcaatagggtgctggggattcaccatatttcagtcatgcatagcattttttccctgctgggattgttgggcgaaattacgtacattgtgttactagtcctgcacacagtctggaacggcaacggcatgttcgcgccaaaatctcagaacatggaaagtacgagttgtgggtag

SEQ ID NO: 238616 - DNA, 1254 bp, Artificial Sequence
  Description of Artificial Sequence: Synthetic coding sequence
atgagcagcaaatatccgcgaagtgttaggcgctgtcttccactgtgtgcactcacactggaagctgcactcatacttcttttttatttcttcactcactatgacgctagtttggaggaccagaagggcttggtggcctcctatcaggttggacaggacttaacggtgatggctgcactcgggctcggctttctgactagcaacttcaggagacactcttggagtagtgttgcctttaatctctttatgctagccctgggtgtacagtgggccattctgctggacgggtttcttagccagtttcctcctgggaaagtggtaatcactctcttcagcattcgcctggctaccatgagcgcaatgtctgtcctaatttccgctggggctgtgctgggtaaagtaaacctggctcaattagtcgtcatggtgctggtggaagtcacggctctcggcactctacgcatggtgatttccaacatctttaacacggactaccatatgaacctgagacatttctacgtgtttgctgcttatttcggtctcaccgtggcgtggtgcttaccaaaacccttacccaaaggcaccgaagataatgaccagcgcgctacgattccttctctatccgctatgctgggagcgttatttctatggatgttttggcctagcgtcaattcagccctccttcgttcaccaatccagaggaaaaatgcgatgttcaatacatactacgccctggccgtatcagtggtgaccgcgatttctgggtccagtttggctcatccacagcggaagatatccatgacctacgtgcacagcgctgtgctggctgggggagtggctgtagggacgagctgccatttgattccctctccttggctcgctatggtgctgggtcttgtcgcaggcctaatctcaatcggaggagccaaatgcttgcctgtttgctgcaatcgagtgctcggcatacaccacatttccgtgatgcactccatctttagtctgcttgggttacttggagagatcacctacattgttctcctggtcttgcataccgtgtggaatgggaacggtatgatcggcttccaggtgcttctgtctatcggcgaactctctctcgctatcgtaattgctctgacctcgggtttgctgacggggctcctgctgaatctgaagatctggaaggcgccacatgtggccaaatattttgatgatcaggtgttttggaaattcccccatctggccgtggggttctag

SEQ ID NO: 238617 - DNA, 804 bp, Artificial Sequence
  Description of Artificial Sequence: Synthetic coding sequence
atgtcttccaagtatcccagatccgtgaggcgttgtctgcctctgtgcgccctcacacttgaggctgccctgatcctgctgttttacttcttcacacactacgacgcttcacttgaggaccagaaaggactggttgcctcttaccaggtcggacaggacctgaccgtcatggcggctctgggcctcgggttcctcacgtctaacttcagacgacactcctggtcctcagttgccttcaatcttttcatgcttgccctaggcgtacagtgggcaatcctactggacggcttcctgtctcagtttcccccaggtaaggtcgtgattacgctcttttctattagactcgctaccatgagtgccatgtctgtgcttatcagtgcgggagcagtgctagggaaagttaatctggcacaactggtggtgatggtccttgtagaggttaccgccttgggaaccctccgtatggtgattagtaatatcttcaatacctacgtacattctgctgtgctcgctgggggtgtggccgtggggacctcttgccatctgatccccagcccatggcttgcaatggtgctgggactggtggccggactgatcagcataggaggagctaaatgcctgccagtgtgctgtaacagggtgctgggtattcatcacatatctgtgatgcattcaatcttctcgcttttgggcttgctcggcgagattacctatatagtactactcgttctccacactgtgtggaatgggaatgggatgttcgcacccaagagccagaacatggagagcactagttgtggctag

SEQ ID NO: 238618 - DNA, 801 bp, Artificial Sequence
  Description of Artificial Sequence: Synthetic coding sequence
atgtcctccaaatacccccgaagtgtgcgtaggtgcctaccactgtgcgcgcttaccctggaggccgcattgatccttttgttctacttttttacgcactatgacgcttcactagaagatcagaagggactcgtggcttcataccaggtcggccaggatctgacggtcatggcagcactgggccttggcttcctgacatctaacttccgacgtcattcctggtcctctgtagcctttaacctttttatgcttgccctcggagtgcagtgggcaatcctcctggatgggtttctgagtcagttcccacccggtaaagttgtcattaccctgttcagtatcaggctcgcaacaatgagcgccatgtccgtgctgatctctgctggcgctgtgctaggcaaggttaacttggcacaactcgtcgtgatggtcctggttgaagtgacagcattggggacattgaggatggtaataagcaatattttcaatgtctgttgtaatagggtgctaggcatccaccatatctccgttatgcactctatattcagcctgctgggcttgttgggtgaaatcacctacattgtactgctcgtcctacatactgtatggaacggcaacggcatgatcggatttcaggtgctactgtcaataggagagctgtccctggccatcgtcattgcccttacctctggattattaacagggctgcttctgaacctgaagatctggaaagcgccacatgttgctaaatactttgacgaccaggttttctggaagtttccccatctcgccgttggcttttag

SEQ ID NO: 238619 - DNA, 1206 bp, Artificial Sequence
  Description of Artificial Sequence: Synthetic coding sequence
atgtattttataaatcaaaggctgtttctgaggctctggagagtgcctgtgatgcgcgcttctcactgctatcaatcgcagggctggagacctgtggctgtgggccaagatcttacggtgatggcagcactcggcctgggctttctgacgtctaatttccgacgtcactcctggtcatccgtggctttcaacttgtttatgctggcattgggagtgcagtgggctattcttctggacggtttccttagccaattcccaccagggaaggtggtgattactctgttttcgatcagactcgcaacgatgagcgctatgtccgttctaatctccgccggagcagtcctaggaaaggtgaacttggcccagctcgtggtgatggtgctggttgaagtgacggccttgggaaccctgaggatggtgatttccaatatattcaacaccgactatcatatgaacctccgccacttttatgtgttcgcagcttacttcgggcttacagtggcctggtgtcttccaaagccccttcccaagggcaccgaagataatgatcagcgagcaactatcccttccctctctgcgatgttaggagctttgtttttgtggatgttctggccatctgtgaactccgcactgctccgttctccaattcagcggaagaacgccatgttcaatacttattacgcacttgcggtctcagtcgtcaccgcaatctctggcagctctctggcccatccacagcgcaagatcagcatgacctacgtgcactctgccgtattagctggaggcgtggcagtgggaactagctgccacctgatcccttcgccctggctggcaatggtgttaggactcgtagccggacttatttccatcgggggtgcaaagtgcctgcccgtttgttgtaaccgggttctcggcatccatcacatctccgtgatgcactcaatcttttccctgctgggactgctaggcgaaatcacttacatagtgctgctggtcctgcacacagtgtggaacggtaatgggatgattggattccaggtgctactgtcgattggcgagctatctctggctatagtgatagccctcacttccggtttgctgacagggctgctgctgaacctgaagatatggaaagcccctcatgtcgcaaaatacttcgacgatcaggtgttctggaagtttccacaccttgcggtcggtttttag

SEQ ID NO: 238620 - DNA, 1065 bp, Artificial Sequence
  Description of Artificial Sequence: Synthetic coding sequence
atgagcagcaagtaccccagaagcgtgaggagatgtctgccactgtgtgccctgacactcgaagctgcactcatcctcttattctattttttcacccattacgatgccagtctggaggatcagaagggactggtggcgtcctaccaggttggacaggacctgacagtgatggcagcgctgggcctgggatttctcacatctaattttcgccgacactcttggagtagcgtggcattcaaccttttcatgcttgcgttgggcgtgcagtgggcaatcctgctggatggattcctgagccagtttccaccgggaaaggttgtgatcaccctttttagtattagacttgccacgatgagcgccatgagcgtgctgatatccgccggagctgtgctaggcaaggtgaacctggctcaactggtagtgatggtcctggttgaggtaacagctctcggcacgttgaggatggtgataagtaatatctttaacactgactaccacatgaatctcagacacttctacgtttttgcggcatatttcgggttaactgtcgcctggtgcttgcccaagcccttgccaaaaggcacagaggacaatgaccagcgagctactatcccttctctgagtgccatgctgggcgctctgttcctatggatgttctggccatctgtgaatagtgcactgctgcgtagccctattcaacgaaaaaatgccatgttcaatacctattacgctctcgcagtttctgtcgttacggccatctccggctcatccctggctcaccctcagcggaagatctcgatgacatacgtgcactctgctgtcttggccggaggcgtcgctgtagggacctcttgccatctgattccttctccatggctcgccatggtcctaggacttgtggccggactcatctcgatcggtggcgctaagtgcctgcccgactggcttcccggacccccacaacattggggaacccagttgggtcaccgcgacagctcccatgtctggtcccccgaccgctttgccccaaagtctcagaatatggagtcgacatcctgtggatag

SEQ ID NO: 238621 - DNA, 1206 bp, Artificial Sequence
  Description of Artificial Sequence: Synthetic coding sequence
atgtatttcattaaccagcgattattcctgcggttatggcgagtgccagtgatgcgcgcaagccactgttatcaaagccaggggtggagacctgtagcggtgggtcaggacctaaccgtaatggctgctttaggtctcggcttcctgacatccaatttcagaagacattcctggagcagcgtagcctttaacctgtttatgctcgcgttaggggtgcagtgggcgatcttgctcgatggttttctgagccaattcccacctggcaaagttgtaataactctgttctctatcagactcgcaaccatgtccgctatgagcgtgctgatctcagctggagcagtgctgggcaaggtgaatctggcacagcttgtggtgatggtgttggtggaagttacagccctcggaaccctaaggatggtgattagcaacatctttaacacagattaccacatgaatctgcggcacttttatgttttcgctgcttacttcggacttacagtggcgtggtgtctgcctaaacctcttccaaagggcacagaggataatgaccagcgtgctaccatcccctcactctctgccatgcttggcgctctcttcttatggatgttctggccgtctgtgaattctgcacttctgcgatctcccatacagaggaaaaacgctatgttcaatacatattatgcactggctgtgtccgtggtgaccgccatttctggctccagtcttgcacacccacaacgtaaaatttccatgacctacgtgcactctgcagtgcttgccggaggcgtggcagtgggcactagctgtcacctcattccctctccgtggctcgcgatggttctgggactggtggctgggttaatctcgattggaggagccaaatgtttgcctgtatgctgtaatcgggtcctggggatacatcacatcagtgttatgcatagcatattttcacttttaggtttgttaggggagataacctacatcgtgctcctagtgcttcacacagtttggaatgggaatggtatgatcggctttcaggtccttctgtcaatcggggagctgagcctggccatagtcatcgccttaacttctggcctgctgaccggactgttactgaacctgaaaatctggaaggctccccacgtggccaagtactttgatgaccaagttttttggaaatttccacatctggccgtaggattctag

SEQ ID NO: 238622 - DNA, 1191 bp, Artificial Sequence
  Description of Artificial Sequence: Synthetic coding sequence
atgtcaagtaagtacccacggtctgtgaggaggtgtttaccactgtgcgcactgaccctggaagcagccctgatcttgttgttctacttcttcacccactatgacgctagcttagaggaccaaaagggcctcgtagcctcttaccaagtcggacaggacctgactgtgatggcagccctgggccttggctttctgaccagcaacttccggaggcacagctggtctagcgtggcattcaatctgtttatgctcgccttaggggtgcagtgggccatactgttagatggattcctctcacagttccctcctggcaaagttgttataaccctgttttcaattaggttggccactatgtcggccatgtctgtgcttatctcggcaggcgcagtgcttggcaaagtaaacctcgcccagttagtcgtcatggtcctagtcgaagtgactgcactcggcactctgaggatggtaatctccaacatcttcaatacggattaccacatgaacttaagacatttctacgtgtttgccgcatacttcgggctcactgtggcatggtgcctccccaagcccctgccgaaggggaccgaagacaatgatcagcgggctaccatcccttcactctcggcaatgctgggcgctctatttctgtggatgttctggccttccgttaattcggcccttctgcgatcgcctatccagcgcaagaatgcaatgttcaatacttactatgctctcgctgtttccgtagttacggctattagtggtagttccctcgcccatccccagcgcaaaatctcgatgacctatgtccatagtgccgtcctcgcagggggagtggccgtgggcaccagttgccacctgattcctagcccctggctggcaatggtgctcggattggttgcaggccttatttctattggcggtgctaagtgccttccagtgtgctgcaaccgggtattggggattcatcatattagcgtaatgcattccatctttagcttgctcggcctactaggcgagatcacctacatcgtgctactcgtgctgcatacagtgtggaacggtaatggaatcttcttaatctggctcttagatttcaagcagaagcaccctcgaaagacacgccctgtccaaaagcaggacaatttcctgtccctcctgcccgctttcgttcgagaaaagaggtcttag

SEQ ID NO: 238623 - DNA, 927 bp, Artificial Sequence
  Description of Artificial Sequence: Synthetic coding sequence
atgtcttccaagtaccccaggtccgtaagaagatgccttccactgtgtgcgcttactttggaggccgctctgatcctgttgttctactttttcactcattatgatgcatctctcgaagaccaaaagggcctggtggccagttatcaggtaggacaagatctgacagtaatggcagccctcggcttaggcttcctgacaagtaactttaggcgccattcttggagcagtgtagcctttaacctattcatgctagcgcttggagtccagtgggctatcctgttggatggcttcctaagccagttccccccagggaaggtggtcatcactctgttttctattaggctcgctacgatgtctgctatgagcgtcctgatctctgctggcgctgtacttgggaaggtcaatctggcccagctcgttgtgatggtgttggtggaggttactgccctcggcacccttaggatggtgatctccaacatcttcaacacggattatcacatgaacttgaggcacttttatgttttcgccgcatattttggtcttacagtcgcctggtgtcttcctaagccgctccctaaagggaccgaggataatgaccagcgggcaaccatcccatcgctaagtgcaatgctcggtgcactgtttttgtggatgttctggcctagcgtgaattcggcactcctgaggtctcctatccaacggaagaacgctatgttcaatacttattacgctttagccgtctcagtggtgactgccattagcggcagtagtctggcccatccccaacggaaaatctcaatggattggctccccggacccccacagcattggggtacccagttaggtcatagggacagctcccacgtctggagccccgaccggttcgcccctaagagtcagaacatggaatctacttcttgcggttag

SEQ ID NO: 238624 - DNA, 1197 bp, Artificial Sequence
  Description of Artificial Sequence: Synthetic coding sequence
atgagctccaagtatcccaggagcgtgcggaggtgtctgccactttgtgcactcaccctggaggccgctctcattctgttgttctatttctttacacactatgatgcctctctggaggatcagaagggcctggtggctagctatcaggttggacaggatctgaccgtgatggcggcactgggcctggggtttctgacctcaaacttccgcagacattcatggtcatccgttgcctttaacctcttcatgcttgcgctgggggttcagtgggctatacttcttgatggctttttgagtcaatttcctccagggaaagtggtgatcacactgtttagtattcgcctggcaactatgagcgccatgtccgtcctgatctctgctggggctgtgctggggaaggtgaacctggcccagcttgtcgtcatggtcttagttgaagtaactgctttgggtactttacgaatggtgatttccaacatcttcaacacagactatcacatgaatttaaggcacttctatgtatttgctgcttattttggcctgactgtggcgtggtgcctgccaaagcccctaccaaaagggacagaggacaatgaccagagggccactataccatccctctccgccatgctaggcgcactgtttctgtggatgttctggccctccgtcaactctgccctattgcgcagccctatccagcgtaaaaacgcaatgttcaatacctactatgccctggcagtgtccgtggtgacggcaatctctggctcatctctggcccatcctcagagaaaaatttcaatgacttacgtgcactccgcggtattggcaggcggtgtggcagtgggcaccagttgccaccttattcccagcccctggctcgccatggttctcggacttgttgctggacttattagcattggcggagccaaatgcttgccagtttgctgcaatcgcgtcctgggcatcccccatctacgccatgcgctccatttacaattagctggatccgcttggcgcgaccacctgcattgtgccgcaggagcgtcatattgtctcgagaggcaatggcatgactggcttcctggcccacctcaacactgggggacacagctgggccacagagatagttcccatgtgtggtcccccgatcgatttgcccctaaatctcagaatatggaatctacttcctgtggttag

SEQ ID NO: 238625 - DNA, 939 bp, Artificial Sequence
  Description of Artificial Sequence: Synthetic coding sequence
atgtcgtcaaaataccctagatctgttcgacgctgtctgcccctgtgcgccctaactctggaggcagcgcttattctccttttctatttcttcacccattatgacgcttccctggaagaccagaaaggactcgtggcgtcttatcaggttggtcaggacctgacagtcatggcggcactgggattggggtttctcactagcaatttccgtcgacactcatggtcttctgttgcttttaacctgtttatgttggcattgggggttcaatgggccatcttgttagatgggtttttaagccagttccctcccggtaaagtagtaattaccctcttctcgataaggctggccacgatgagcgccatgagcgttctcatttcggcaggtgcggttcttggcaaagtgaacttggcccagctggtggtgatggtgttggtcgaggtcaccgcgctgggaactctgcgcatggtgatttcgaatattttcaatacatacgtccatagtgcagtgttagccggaggggtagccgtcgggactagttgccatttaattccaagcccttggctggctatggtgcttggactcgtggccggtctcatcagtataggaggcgcaaaatgcttgccggtttgctgtaaccgtgtgctgggcatacatcacatctccgtcatgcacagtattttttccctgcttggtcttcttggcgagataacttacatagtactcttagtactgcataccgtatggaatggcaatggcatgatcggctttcaagtcctgctgagcattggggagctcagcctcgcgatcgtcatagccttaacctctggcctgctcactgggctactgctgaacctgaaaatctggaaggcaccgcatgtggcgaagtattttgacgatcaagttttttggaagttcccacacctggccgtcgggttttag

SEQ ID NO: 238626 - DNA, 1041 bp, Artificial Sequence
  Description of Artificial Sequence: Synthetic coding sequence
atgtcctccaagtacccccgatcagttcgacgttgcctacctttgtgtgctcttacattggaggctgcgcttattctgctcttttacttcttcactcactacgatgcaagcctagaggaccagaaaggcttggtcgcttcctaccaggtgggacaagatctcacagtcatggcagcacttggactggggtttctgacaagcaacttcagacggcacagttggtcatccgtggcttttaacctgttcatgctcgcattaggagttcagtgggccatcctgcttgacggatttctgagccagtttcccccaggtaaagtcgtgatcacactgttttccatccgcctggccaccatgagcgctatgtcggtgctgatttctgctggggcagtcctggggaaggtcaacctggctcagctcgtcgtgatggtcttggttgaggtgaccgcattgggaacgctgaggatggttatctccaatatcttcaacccatccgtgaattccgcactgcttcgctcccctatccagcgcaagaatgctatgtttaatacatactacgccctcgcagttagtgtggtaacagccatctctggttccagcctggctcatccgcagcgcaagatctctatgacctacgtgcatagtgccgtgttggcaggcggagtcgccgtgggaacatcatgccatttgataccatccccatggcttgctatggttctggggctggtggtatgttgcaatagggtcctgggcatccatcatatctctgttatgcactctattttctctttgctgggactgctaggggaaatcacatatattgtcctgctggtgctgcacacagtatggaatggtaacggcatgataggatttcaggtcctcttaagcattggcgaattgtcattggctatcgtaatcgccctgacctcaggattattaaccgggttgctcttgaacctaaagatttggaaggccccacacgtggccaagtactttgacgaccaggtattctggaagttcccccacctcgctgtcgggttttag

SEQ ID NO: 238627 - DNA, 1254 bp, Artificial Sequence
  Description of Artificial Sequence: Synthetic coding sequence
atgtcctctaagtatcccaggagcgtaagacgctgcctgccactgtgggcattaaccctggaagccgctctcatactgctgttctatttttttacacactacgacgcaagtctggaagaccagaagggcctggtcgcaagctaccaggtggggcaggacttaaccgtgatggctgccattgggcttggattcttgacgtcctccttccgaagacactcgtggtccagtgtggcctttaacttgttcatgcttgccttgggcgtgcagtgggcgattctgctggacggtttcctgtcccagttccccagcggcaaggtcgtgatcaccctgttctctatccggctcgctaccatgagtgcccttagtgtgctcatttcagttgacgccgttctaggaaaggtcaacctggcacagctcgttgtgatggtcctggtggaagtgaccgccttaggtaacctccggatggtgatttcaaacatcttcaacactgattaccacatgaatatgatgcatatctacgtttttgcagcgtatttcggcctaagcgtggcctggtgcctccccaaacctcttcccgagggtaccgaagacaaagatcaaacagccactattccgtccctctcggctatgcttggtgcattattcctgtggatgttttggccatcttttaacagcgccctcctaagatcacccatcgaaagaaaaaatgcggtgtttaatacatactacgccgtagcagtctctgtcgtgaccgcaatcagtgggtcatccctggctcaccctcagggtaagatcagcaaaacgtatgtccattcagcggtgcttgctggaggcgtcgcggtcggtacttcctgccacctgatcccaagtccctggctggcaatggtgctgggactggtggccggattgatctctgttggcggtgccaagtacctgcctgggtgttgtaacagggtgctcggcatcccccactctagcattatgggttataacttctccctcctgggcctacttggagagataatttatattgtgttacttgtattagatacagttggcgcaggaaacgggatgatagggtttcaggtactactctccatcggtgagctctctctggcaatagtgatcgcactcatgtccggactcctgacgggcctccttctgaatcttaagatttggaaagctccacatgaggctaagtattttgacgaccaagtattctggaagttccctcatctggcggtgggtttttag

SEQ ID NO: 238628 - DNA, 1482 bp, Artificial Sequence
  Description of Artificial Sequence: Synthetic coding sequence
atgtcaagtaagtatccaagatcagttaggaggtgtcttcctctttgggcacttacactggaggccgcactgattttgcttttttatttcttcacgcactatgatgcatccttggaagaccagaaaggcctggtcgcaagctaccaggtaggccaggatctgaccgtaatggccgctataggcctggggtttctgacatccagtttcaggcgtcatagctggagctccgtagctttcaacctgttcatgctggccctcggagtgcagtgggctatattgctggacgggtttctgagtcagtttccatctgggaaagtcgtgatcaccttgttcagcattcgcctcgcaaccatgagcgcccttagtgtactgatcagtgttgacgcagtgcttgggaaagtgaatctagcccagctggtcgttatggtccttgtggaagttacagctctgggcaacctccgcatggtgatcagtaacattttcaatactgattaccacatgaacatgatgcacatctacgtctttgccgcatactttgggctctcagtcgcctggtgcctgcctaagcctctacccgaagggactgaggataaggaccagaccgcgacaattccctcactctctgctatgttgggggctctatttctgtggatgttctggcccagtttcaattctgccctcctgcggagtccaattgagaggaagaatgccgtattcaacacctattacgctgtcgccgtctctgtggtaacagcaatctctggaagttctctcgctcatcctcagggaaaaatctctaagacctatgttcacagcgctgtgttggcaggaggcgtggctgtgggcacaagctgccacctgataccatcaccttggctcgccatggtcctaggattggtagcaggcttaatctccgtggggggagcaaaatacctgcctgggtgctgcaatagggtgttgggaattcctcacagctcaattatggggtacaatttctctctgctgggcttactgggcgaaattatctacatcgtcctccttgtcttagacacagttggcgctggaaatgggatgagccttggttggaacttagcggtgaaaatggcggaagctggcgacgaagagctcatgcggttggatgtgagtcagcggaaccatggcggtgccgctgtgcctacaggttcgtggatgccgagcacagagaccacgatcgcgcctaattacagggaccacattagtgttgtaagctcattcggatgttggatactgagtaagagcatccaagaaaagcaggggctgtttaaaaacaaaaccacgtcaagtcattgttgcctccacctgtatgtacgtaatgcacacgactccaaagtgtcaaatgtgcgagcagggacgggagttcgcgagaacggggtcgaaagttttctctgtcactccctccgcaggatttcacccttcatcatgcattgccggatacaacagtag

SEQ ID NO: 238629 - DNA, 1191 bp, Artificial Sequence
  Description of Artificial Sequence: Synthetic coding sequence
atgtctagcaaatatcctcggtctgtgagaagatgcctgcccctctgggcattgacgctggaggcggctctgattctgcttttctatttctttacccactatgacgcatctctggaagatcagaaagggctcgtggcaagctaccaggtcggacaggatctcactgtcatggcggctataggactaggatttttgacatcaagcttcaggcgtcactcatggagttcagtggctttcaacctgttcatgttagctttaggcgtgcaatgggctatactcctagacgggttcttgtcgcaattcccatccggaaaggtggtgatcactctgttctctattaggctggccaccatgagcgccctgtctgtgctgataagtgttgatgcagtgctgggcaaggtcaatcttgcccagcttgttgtaatggttctggtggaggtgaccgcccttggaaacctgcggatggtgatttctaacatttttaataccgactaccatatgaatatgatgcacatttatgtcttcgccgcttacttcggcctgagtgtcgcttggtgcctgcccaagcctttgcccgagggtacagaggataaggatcagacagcaactatcccatccctctccgccatgctgggtgcactgttcctgtggatgttctggcctagcttcaactctgctcttctgcggagtccaatcgaacgtaagaacgcggtcttcaatacatactacgcagtcgctgtttccgttgttaccgcaatctcgggctcgagcctcgcgcacccccaggggaagatcagcaaaacctatgtacattcagcagttctcgccggaggagtcgccgtgggcacctcttgtcatctgataccctccccttggctggccatggtccttggactcgtagccggactgatttcagtcggtggtgcaaaatatctccccggatgctgcaatcgggtcctgggcatcccacatagctccatcatgggatacaacttcagtcttttgggactcctcggagaaatcatctacattgtgctgctggtgctcgacacggttggggctgggaacggaatcttcctgatttggctcctggattttaagcagaagcacccccgaaaaacgcggcctgtacagaaacaggataatttcctctcgcttctccctgcgttcgtgcgggaaaaacgttcatag

SEQ ID NO: 238630 - DNA, 1137 bp, Artificial Sequence
  Description of Artificial Sequence: Synthetic coding sequence
atgagtagcaagtaccctagatcggtcaggcgatgcctgccattatgggctctgacactcgaggccgctctaattctactgttttacttctttacacattatgacgcctccctggaggaccagaaaggcctggtggcgtcctatcaagttggacaggatctcaccgttatggccgctattggtctggggtttctgacatccagtttcagaaggcacagttggtcttccgtggccttcaaccttttcatgctggcccttggggtacagtgggcgatcttgcttgatggcttcttgagtcagtttcccagcggcaaagttgtcattactctgttctcgattaggctagccacgatgagcgcattatcagttctgatctctgttgatgctgtgctggggaaggttaatcttgcacagttagtggtaatggtgctggttgaagtgacggccctcgggaatctcagaatggtcatatccaacatctttaacaccgactaccacatgaacatgatgcatatctatgtgtttgcagcctactttggccttagcgtcgcatggtgtctgcccaagcccttacccgaaggaaccgaggataaggaccagaccgccacaattccttccctttccgcaatgctgggtgctctgttcttgtggatgttttggccatcattcaatagcgccttgcttaggtctcctatcgaacggaaaaacgccgtgtttaatacttattacgctgtggccgtgagcgtggtcaccgccatttctgggagcagtctggcacatccgcagggtaaaatctcgaagacctacgtccattcagcagtgctagccggaggggtggccgtgggcacatcctgtcaccttattccgtcaccttggttagcgatggtcctcggtctggtcgccggtctcatatctgtgggtggcgctaagtacttgccggactggttgccaggaccccctcagcattggggaacccagctgggccatcgggattccagccacgtgtggtcgcctgacagtttcttgatctggcttttggatttcaagcagaagcatcccagaaagacgcgcccagtgcagaagcaggacaacttcttgagcctcctgcccgcttttgtgcgcgaaaagagaagctag

SEQ ID NO: 238631 - DNA, 1464 bp, Artificial Sequence
  Description of Artificial Sequence: Synthetic coding sequence
atgagttcaaagtaccccaggagcgttcgacgctgcttgcccctgtgggctctgactctggaggctgccctgattttactcttctacttcttcactcactacgacgcatctctagaggatcagaaaggtctagtcgcctcttatcaagtggggcaggaccttaccgtcatggctgctataggccttggatttctgacctcttccttccgaagacactcatggagttcagtggcatttaaccttttcatgctagctctgggagttcagtgggctatcttactggatggatttctgtctcagtttcccagcggaaaggtggtgattacactgttctcaatacggctggccactatgagcgcactatccgtcctgatctccgtcgacgcagtgttgggaaaagtgaacctggctcagctggtggtgatggtcctcgtcgaggttacggctctgggcaatctgcgcatggtgatcagcaacatttttaataccgactatcatatgaatatgatgcatatctacgtttttgcagcatactttggcctgtctgtcgcctggtgcctgcccaaacctctccctgagggcacagaggacaaggaccaaaccgcgactatcccgtcactcagtgcaatgctcggcgcactgttcctttggatgttctggccgagctttaactctgcactgctgaggagtcccattgagaggaaaaacgccgtgttcaatacatactacgctgtagccgttagcgtggtcacagcaatctctggttcttcgctagcacatccccaagggaagatcagtaaaacttacgtgcatagtgccgtccttgccggtggagtggcagtcggcacctcatgtcatctgataccttccccgtggctggctatggttctgggcttagtggcaggcctgattagcgtagggggagcaaaatacctgcccggttgttgcaatcgagtgttaggcatcccccactcgagtatcatggggtacaatttctctctcctcggtctgctgggagaaatcatttacatagtcctcctcgtgttggatactgtaggagccggtaacggcatgatcgggttccaagtgctgctgtcaatcggtgagttgtctcttgccatagtgatcgcactgatgtccgggctcctgaccggcttgctgctgaacctgaagatttggaaagcccctcacgaggcaaagtactttgacgaccaggtcttctggaagtttccccacttggcagtgggtttctccaagagcatacaggaaaaacagggattgttcaagaataagacgacaagcagccactgctgtctgcacctctacgtgaggaatgcacacgactctaaggtgagcaacgtacgcgctggtaccggagttagggaaaacggcgtcgagtcttttttgtgtcattctctaaggcgcatcagccctttcatcatgcactgccgaatacagcaatag

SEQ ID NO: 238632 - DNA, 1296 bp, Artificial Sequence
  Description of Artificial Sequence: Synthetic coding sequence
atgagttcaaagtacccacgctcagtccggaggtgtctgcctctttgggctcttaccctggaggcggcactgatccttctgttttacttcttcactcattacgacgcgagtctggaggatcagaaaggtctcgtagcttcttatcaggtggggcaagacttgaccgtgatggctgcgattggacttggattcctgacatcctcattcaggcggcacagttggagctccgtggcttttaaccttttcatgctcgccctgggggtgcaatgggccatccttctggatggcttcctttctcagtttccatcaggaaaggtagtcatcacactgtttagcatcaggctggcaacgatgtctgcgttgagcgtgcttatatctgtggacgcagtgctgggaaaggtcaacctggcccagctcgtcgtcatggtgctggtggaggtgacggccctgggcaacctgcgaatggtgattagtaacatattcaatactgattaccacatgaacatgatgcatatctacgttttcgctgcctatttcggcttatctgtggcctggtgcctccccaagccgctgcccgagggcaccgaggataaggaccagacagcaacaattcctagcttgagtgccatgctaggtgccctctttttgtggatgttttggccctcttttaactccgctcttctgaggagtccaattgaacggaaaaatgctgtcttcaacacttactacgctgtcgccgtctccgtggtgaccgccatcagcgggtcaagcctggcccacccgcaggggaagatatccaagacttatgtacatagcgccgttctcgcaggcggagttgcagtgggcacttcctgtcatctgataccttccccttggctggctatggttttgggcctggtagctggtctgatctcggttgggggtgccaagtacctgccaggatgctgcaatcgcgtgttagggatcccgcactcctccatcatgggctacaattttagcctgctaggcctgttaggggaaattatctacatcgttctgctggtattggataccgttggggctggaaatggtatgtccctgggctggaacctggcggtcaaaatggcggaggcaggggatgaagagttgatgagattggatgtgagccaaagaaaccatggaggtgctgctgtgcccactggaagctggatgcccagcactgagaccaccattgctcccaactatagagaccacatcagcgttgggctagcctctcggtcttccagcgcactggggaacagcgcttggccctcatag

SEQ ID NO: 238633 - DNA, 966 bp, Artificial Sequence
  Description of Artificial Sequence: Synthetic coding sequence
atgtcctccaagtatccgaggtcagtgcggaggtgtctgcccttatgggcactgacccttgaggccgcactcattctattgttctattttttcactcactatgatgcctccctggaggaccagaagggtctcgtggcgtcttaccaagttggacaggaccttactgttatggcagctatcggcctcggcttcctcacttcttctttcagacgccacagctggtcatcggtggcttttaacctcttcatgctcgctctgggagtccaatgggctattctcctcgatgggttcctgagccagttcccctcaggcaaggtggtgatcacattgttctccattcgcttggccaccatgtccgctctttcggtgctgatttctgtggacgctgtgttagggaaggtgaatctggcccagctcgtggtgatggtcctcgtggaagtcacggcgctcggaaatctgcggatggttatctctaacatctttaatacagattaccatatgaatatgatgcatatctacgtgttcgcggcatacttcggcctgtccgtggcctggtgcctacccaagcctctcccggagggcaccgaagacaaggatcaaaccgccacgataccctctctttcagccatgcttggcgctctctttctctggatgttctggccctcctttaattctgcactgcttcgatcccctatcgagaggaaaaacgccgttttcaacacatattacgctgtagccgtgtcagtggtcacggccatcagcggatcatccctggcccaccctcagggcaaaattagcaagacctatgtgcacagtgctgtccttgccggtggcgtcgcggtcggaacaagctgtcatcttatcccctctccctggctggctatggtgctgggattggtcgccggattaattagcgtcggcggagcgaaatatctccctttcccacatcttgccgtgggcttctag

SEQ ID NO: 238634 - DNA, 294 bp, Artificial Sequence
  Description of Artificial Sequence: Synthetic coding sequence
atggccggaagcccatcacgagcggcaggcagacgcctacagctcccattgctgtgcttatttttacagggtgccaccgcggtactctttgctgtatttgtgcgctataaccataagacagacgccgcactgtggcatagaagcaatcattctaatgctgataatgaattttatttccgctacccaaacggagttagcctgctactacccagactggaatgcaacgggacaatctcggcccaccataatctttgcctccctggatcttcggacagccccgctagcgtcagttag

SEQ ID NO: 238635 - DNA, 462 bp, Artificial Sequence
  Description of Artificial Sequence: Synthetic coding sequence
atggcaggatccccatctagggccgctggccgaagactgcagttgcccttgctatgtctctttctgcaaggtgctactgccgtgctgtttgccgtattcgtacgatataaccacaagaccgacgccgctctctggcacaggtcaaaccacagcaacgccgacaacgagttctactttcgatatccaaaggagagccattccgttgcccaagccggtgttcagcgacgcaatctgggtagcctgcagccttctcctccgagactgcccggacgggcttgccacggcttgagaggcctctggctgcctcacggcctcccagccgcactaagacttcagcagcgtggcttgcaccttcccccaggacgtctctgcccagctgtagtccacaccggacccggtctgtcacctctgctgccaaggtggcctcatccgtgctggcgcggagaacacgatcagtgttag

SEQ ID NO: 238636 - DNA, 1119 bp, Artificial Sequence
  Description of Artificial Sequence: Synthetic coding sequence
atggtgtttgtggggttcggatttttgatggttttcctccagcgctacgggtttagcagcgttggcttcaccttcctgctcgcagcttttgctctgcaatggtccaccctggtccagggctttctccactcattccacggaggtcacatacacgtgggagtggagagcatgattaatgctgacttctgcgccggtgccgtactgatctcattcggggcagtgctgggaaaaacaggccctacccagctgctcctgatggcacttctggaagtagtgctttttggaatcaatgaatttgtgctgctgcatctgctgggggtcagggacgccggtgggagtatgacgattcatacgttcggcgcttatttcgggctggtcctttctagagtcctatacaggccccagctcgaaaaaagcaaacacaggcaaggttccgtgtatcactctgacctgttcgctatgattggaacgatcttcttgtggatcttctggccctcatttaacgcagctctgacagcactgggggctggccagcatcggacagctctcaatacgtactactccctggccgctagtaccttgggaacatttgccttaagcgccctggtcggtgaagatggacgactagacatggttcacatacaaaacgcagcccttgccggtggagtggtcgtggggacctccagtgagatgatgctgactccattcggagccttggctgctggcttcctggctgggaccgttagtactctaggttataagttcttcacacccattctggagagcaaattcaaagttcaggatacatgtggtgtacacaacctccatggcatgcccggtgttctgggagcgctcttgggggtgctagtggcaggtctggccactcacgaagcctacggcgacggcctcgaaagcgtattcccactcatagccgagggccagcgtagtgcgaccagccaggctatgcaccagctttttgggctatttgtgacgctgatgttcgcttccgtcgggggaggtctcgggggactcttactgaagctccctttcttggattccccacccagattaccagccctcagagggccttcatcactggcgggtgcctggcgggcttag

SEQ ID NO: 238637 - DNA, 1374 bp, Artificial Sequence
  Description of Artificial Sequence: Synthetic coding sequence
atggcaggatccccgagccgtgctgccggtcgccgactccagctgcccctactctgtctgtttcttcagggcgctacggcagttctgttcgccgtctttgtccgatacaatcacaagaccgatgctgctctatggcacagatcaaaccattctaatgctgataatgagttttacttccggtatcccagtttccaggatgtgcacgccatggtatttgtgggctttggattcctgatggtgtttcttcagagatatggcttcagcagtgttggctttacatttctgctcgcggctttcgcccttcagtggtcaactctagtacaagggtttctgcacagcttccacggtggacatattcatgtaggtgtcgagtctatgatcaatgccgacttctgtgccggtgctgtgttgatctcttttggggcagtcctgggcaagacaggccctactcagttgctgctaatggcactgctggaggtggtgctcttcggcattaacgaattcgtgctgctccaccttctgggggtgcgggatgcaggcggtagcatgacaatccacacatttggtgcttattttggcctggtcctatctcgagtgctttaccggcctcagctggaaaaatccaaacataggcaggggtccgtttaccactctgacctcttcgctatgattggaactatttttttgtggattttttggccctcctttaatgctgcgcttaccgccctgggagctggccagcacagaaccgccctaaacacctactatagcttggccgcttccactctaggcactttcgcactgagtgccttggttggcgaagacgggaggctggatatggtccacatccagaacgcagcactggcaggtggtgtcgtagtaggcaccagttccgagatgatgttgactcccttcggcgctctggcggctggctttctggcagggacagtgagtaccttagggtataaattcttcactcccatcctggaaagcaagttcaaagttcaggacacctgcggggtacataacctacacgggatgccgggagtgctgggggcacttctgggcgtactcgtcgcaggcctggcaacccatgaagcttacggggatggactcgaaagcgtatttccgctaattgcagagggccagcggtccgccacaagtcaggccatgcaccagttgtttggcctttttgttacactgatgtttgcctcagtaggaggcggactgggcggtctgctgctgaagctccctttcctcgaccctccggactctcagcattacgaggatcaggttcattggcaggtgccgggtgaacacgaagataaggcgcagcgaccactgagggtggaggaggctgatacccaagcctag

SEQ ID NO: 238638 - DNA, 1326 bp, Artificial Sequence
  Description of Artificial Sequence: Synthetic coding sequence
atggcgggaagtcctagtcgagccgctggcaggcgactgcagttgcccttgctctgtctgttcctccagggcgcaactgccgtgctcttcgccgtttttgttaggtacaatcacaagaccgacgctgctctgtggcaccgctccaatcattctaatgccgacaatgaattttactttaggtacccatcatttcaggatgtgcatgccatggttttcgtcgggtttgggttcctgatggttttcctacagagatatggattctcctccgtgggcttcacttttctgttggcggcattcgcgctgcaatggagtaccctggtgcagggtttcctgcattcgttccacggaggacatatccatgtgggagtggaaagcatgatcaatgccgatttttgcgccggtgctgtcctgatctcattcggagccgtgctgggcaaaacaggtcctacccagcttcttctcatggccctgctggaggtggtgctgtttggaatcaatgaattcgttctcctccatctgctgggggtgcgcgatgccggaggatccatgacaattcacaccttcggagcctattttggtctggtcctgtccagagtgttataccgaccacagctagagaaatccaaacatcgccaaggctctgtttaccactctgatctgttcgcgatgattggcacgatctttctgtggatattctggccatcattcaacgccgcactgaccgccctcggggctggtcagcaccgcaccgctttaaacacatactactcccttgcggctagcacactggggacatttgccctttctgctctggtgggagaagatggcaggttggatatggtgcatatacagaatgcagctctggccggaggcgtggtcgtgggaacctcttccgaaatgatgttaaccccgttcggcgctctggccgctggcttcctggcagggactgtgagcactctagggtataagttttttactccaatccttgaatctaagttcaaagtgcaggacacatgcggcgtgcacaaccttcatggaatgcccggtgtactcggcgcactgctcggagtgctggttgccggactcgccactcatgaggcatacggggacggcctggaatcggtgttcccattgatcgctgaggggcagcggtccgctacatcccaagcaatgcatcagctgttcggtctcttcgtgacgctgatgtttgccagtgtcggaggcggactaggagggttactcctaaagctaccctttctggattctcccccacggctgcctgctctgcgcggtccatcatccctcgcaggtgcttggcgggcttag

SEQ ID NO: 238639 - DNA, 1230 bp, Artificial Sequence
  Description of Artificial Sequence: Synthetic coding sequence
atggtctttgtaggcttcggcttcttaatggtcttcctacagcggtatggcttttcatctgtaggcttcaccttcttgctcgctgcattcgctttacaatggagtactctggtccaggggtttctgcatagcttccacggcggtcatatccacgtgggtgtcgaaagcatgatcaacgctgatttttgcgctggggcagtattaatttcgtttggggctgtgttgggtaagacaggcccaacacaactcctgcttatggctctgctggaggtggttcttttcgggatcaacgagttcgttctgttgcacctgctgggcgtccgggtctgggggggaatggagagcggcgttggcggagggcaggggcagccactgtcccaggagcggggtggaggcggtggcgtactgccgcttacacctccaccacaagtgagagacgccggtggatccatgactattcacacatttggggcttacttcgggctggtgctgtcacgggtgttgtaccgccctcagttagaaaagtctaaacatcgtcagggctccgtataccactcagacctgttcgccatgatcggaactattttcctctggatattctggccgtccttcaacgccgctctcactgcgctcggcgcaggacagcaccgaaccgctctaaacacctattactctctagcggcaagtaccctgggaacttttgccctctcagcccttgtgggcgaggatgggaggttggacatggtccacattcagaacgccgcactcgccggaggtgtcgtcgtgggtacgagtagtgaaatgatgctgacaccatttggcgctctggcagccggattccttgcaggaaccgtgtccacccttgggtacaaattcttcactcctatactggagagcaaattcaaagttcaggatacatgcggggtccacaatcttcatggaatgccaggggtgctgggcgcactgctcggtgtgctagtagccggactggcaactcacgaggcatatggtgatggactggagtcggtattcccccttattgctgagggtcaaagatctgccacaagtcaggccatgcaccagctattcggactgtttgtcactcttatgtttgcaagcgttgggggaggtctcgggggattgctgctcaaactgccgttcctggatagcccaccccgtctgcctgctctgcgagggccttcatccttggcgggtgcatggcgggcatag

SEQ ID NO: 238640 - DNA, 1125 bp, Artificial Sequence
  Description of Artificial Sequence: Synthetic coding sequence
atggtgttcgttggctttggatttcttatggtattcctccaaagatacggctttagcagtgtaggctttacttttctgctggcagcttttgctctgcagtggtctaccctggtgcaagggtttctgcacagcttccacggaggtcatattcacgtcggagtggagtctatgatcaacgccgatttttgcgccggagcagtgctcatatcctttggagctgtgctcggtaagacagggcctacccagctgctgctgatggctctcctcgaggtggtgctcttcggtattaacgagtttgtactcctacacctgcttggcgttcgcgtgtgggggggaatggaatctggggtcgggggtggccaaggacagcccttatcccaagaacggggaggcggaggaggagttctccctctgactccgccaccccaggttcgggacgccggtggaagcatgactattcacacattcggtgcgtatttcggcttagtgctgtcccgggtgctgtatagaccacagctagagaagagtaaacaccgccagggcagcgtgtatcattcagatttatttgccatgatcggcacaatctttctgtggatcttctggccatcttttaacgcagcactgaccgcactgggtgccggacaacaccggactgccctcaacacatactacagtctcgccgctagcacacttgggacattcgctttaagcgcactggtcggagaggacggtaggctcgatatgcctatcctggagtccaagttcaaggtgcaagatacctgcggcgttcataacctgcacggaatgcctggggtgcttggcgctctgttgggagtgctggtcgcaggcttggccacccacgaggcatatggagacgggctggagtcggtctttcctcttatcgctgaagggcagagaagcgctacatctcaggctatgcaccagttgttcggtctgttcgtcacgctgatgttcgcaagcgtgggcggtggcttgggcggaataattttggtgctttgcctactggatccatgcgcactatggcactgggttgccccaagctcaatggtggggggtcgggaggcatctcaaattctcccatatcaccatcagggatcgtgctag

SEQ ID NO: 238641 - DNA, 687 bp, Artificial Sequence
  Description of Artificial Sequence: Synthetic coding sequence
atggccggtagcccgagccgggcagcaggcaggcggctccagctgcctctcctctgcctgttcctgcagggtgctactgccgttctgttcgctgtcttcgttagatataaccataaaacggacgccgctctgtggcaccggagcaatcattccaacgcagacaatgaattctattttcgttacccgaggactatattcctttggatcttttggccaagcttcaatgcagcactgaccgcgcttggagccggacagcaccgtacggcgctgaacacatactattctctggccgcatccactttaggcaccttcgctctatcagcactggtgggtgaggacggcaggcttgacatggttcatattcaaaacgctgctctcgcaggaggtgtcgtggtgggcacaagtagcgaaatgatgctcaccccattcggggctctagccgctggcttcctcgcaggcaccgtgagcacccttggtccgtcactgaaccagaatagcaaatcaaagacacatgtcgagagtaccacgagcatgggctgccgagggtcttgggggccatcttggggtagcttgtggctggacctccctcctatgaagctcaccgaaatgggggagttccccccaaatccttattgttctaggcacccatctgggatgacatccgtcatacttttccactgtgtctag

SEQ ID NO: 238642 - DNA, 1440 bp, Artificial Sequence
  Description of Artificial Sequence: Synthetic coding sequence
atggcgtggaacacaaacctccgctggagactgccattgacttgcttgctgctgcaggttattatggtgatcctgtttggagtgttcgtgaggtacgactttgaggctgacgcgcactggtggtcagagcgcacccacaagaatctcagtgatatggagaatgagttctactatcgctatccaagctttcaggatgtccatgtcatggtctttgtgggatttggatttttaatgaccttccttcaaagatacggattctctgcggtggggtttaacttccttttggccgctttcgggatccaatgggccctgttgatgcagggctggtttcatttcctgcaagacagatatatcgtagtgggagtcgaaaacctcattaacgcagacttttgcgtcgcttctgtgtgcgtcgcttttggtgccgttttagggaaggtctctcctatccaattactcataatgaccttcttccaggtcacgttatttgccgtaaatgagttcattcttctgaacctgctaaaggttaaagatgcgggaggatccatgactatccataccttcggggcttattttgggctcactgtgacgagaatcctctaccggcgtaacctggaacagagcaaggaaaggcagaactctgtgtatcagtctgacctctttgcaatgatcgggaccctcttcctgtggatgtactggccctccttcaatagtgcaatctcataccacggtgactcccaacatagggccgcaatcaatacttactgctcactggcagcctgcgtgcttaccagcgtggccatatctagcgctctgcacaagaagggaaaacttgatatggttcatatccagaacgccaccctagcaggtggagtcgctgtgggaacagctgctgaaatgatgcttatgccttatggcgcacttatcattgggttcgtgtgcggtattatatcaactctggggtttgtatatctcaccccttttctggaatcccgcttgcacattcaagacacctgtgggatcaacaatttacacggaattcctggaatcattgggggtatcgtgggagcggtcacagcagcttccgcctcattggaggtctacggcaaggaaggcctagtccattctttcgacttccagggattcaacggcgattggacagcgaggacccaaggcaagtttcagatctatggcctcctggtgaccctggcaatggccctgatgggcggtatcatcgttggactgatcctgcgcctgcccttttggggccaaccctcagacgaaaactgctttgaagacgctgtgtactgggaaatgccagagggcaatagcacagtgtacatccccgaggatccgaccttcaagccatccggtccctcagtaccttccgtgccaatggtgagcccccttccaatggcctcaagtgttccgctcgttccctag

SEQ ID NO: 238643 - DNA, 1413 bp, Artificial Sequence
  Description of Artificial Sequence: Synthetic coding sequence
atggcatggaatacatgccttcttctccaggtcatcatggttatcttgttcggggtcttcgtcagatatgactttgaggcagatgcccactggtggagcgagagaactcacaagaacctttccgacatggagaacgagttctactataggtatcctagcttccaggacgtgcacgtgatggtttttgttggcttcggctttctgatgacattccttcagcggtacggattttccgcagtaggcttcaatttcttgctggcagcttttggaattcaatgggcactgttaatgcagggatggttccacttcctgcaggaccggtacatagtcgtcggagtggagaacctgattaatgccgacttttgtgtggcctcagtgtgtgtcgcttttggagccgttctggggaaagtctccccaatacaactgcttattatgacctttttccaagtgactctctttgctgtgaacgagttcattctgctgaatctcctgaaagttaaggacgcgggaggaagcatgacaatccacacgttcggcgcatacttcggcctgactgttacaaggattctatatcgaagaaatttggaacagtcaaaggaacgccagaactctgtctaccagtccgacctgtttgcaatgattggcaccctatttctctggatgtactggccaagcttcaattctgcaatatcataccacggcgactctcaacacagagcagccattaatacctactgctcactggccgcatgtgtcctcacctcagtagctattagctccgccctgcataaaaaggggaaactggacatggttcacatccagaacgcaactctggccggaggtgtcgcagtagggactgccgctgagatgatgctaatgccctacggcgctctgatcattgggttcgtatgcggcatcatatctacactgggttttgtctacctgactccgtttcttgaatcccgactgcatatacaggacacctgcggcatcaacaaccttcacggcattccaggaatcatcggagggattgtcggagctgtcactgctgcttcggccagcctcgaagtgtacggaaaagagggcctggtgcactcttttgatttccaaggttttaatggcgactggaccgccaggacccaaggcaagttccagatttacggactactcgtgaccctcgcaatggcccttatggggggtataatagtgggtctgatacttcgcctgcccttttgggggcagcctagtgatgagaactgttttgaggatgcagtgtattgggagatgcctgaaggcaactctaccgtgtatatcccggaagatcctactttcaagccttctggacccagtgtgccatctgtgccgatggtgagcccattaccgatggcatcttcggtgcccttggtcccctag

SEQ ID NO: 238644 - DNA, 1338 bp, Artificial Sequence
  Description of Artificial Sequence: Synthetic coding sequence
atggcttggaacaccaatctgcgctggagactgcctcttacatgcctcctgctccaagtgatcatggtaatactgtttggggtcttcgtccgctatgacttcgaagcagacgcacattggtggtcagagcgtacacataagaatctgagcgatatggagaatgaattctactaccgctacccaagttttcaggacgtccatgtcatggtctttgtcggatttggcttcctcatgaccttcctgcagcgatatggtttcagtgccgtgggttttaattttctcctagctgcgtttggcatccagtgggcgcttctgatgcagggctggtttcacttcctccaagataggtatatagttgtgggcgttgagaacctcatcaacgctgatttctgcgtggcgtccgtttgcgtggcattcggtgcagtgctggggaaggtctcaccgatccagttattgattatgacttttttccaagtgactttgtttgccgtcaatgagttcatccttttgaacctactgaaggtgaaggacgccggtgggtccatgaccatccacacctttggcgcttactttgggcttactgtgacccgcatcctctaccgtcgcaacttggaacagagcaaggaacggcagaattctgtttaccagtcagacctttttgctatgatcgggaccctgttcctttggatgtattggccgagttttaatagcgcgattagctaccatggagattctcaacacagggccgcaattaatacatactgttcactggcagcctgtgtattgacatctgttgctattagtagcgccctgcacaaaaaggggaaactcgatatggtgcatatacagaacgctacactcgccggtggcgtagcggtcggtactgccgcagaaatgatgctgatgccatacggggcactgattattggatttgtctgcggcattatctcaaccctgggcttcgtctacctgactccatttctcgagagtcgactacatatccaggacacttgtgggatcaacaacctgcatggcatcccaggaatcatcggcggtattgtaggggctgttacagccgcttccgcttccctcgaagtgtacgggaaggagggacttgtgcatagctttgacttccaagggtttaacggggattggactgcaaggactcagggcaagttccagatctacggactcctggtgacactcgctatggctctcatggggggtattatcgtggggctaattttacgtctgcctttttgggggcaaccctctgatgagaactgcttcgaggatgcggtttattgggaggacctcgagctggccccaaatcaatag

SEQ ID NO: 238645 - DNA, 714 bp, Artificial Sequence
  Description of Artificial Sequence: Synthetic coding sequence
tgagactctcaacatcgtgcggcaataaatacctactgtagcttagcggcttgtgtgcttacatccgtagctatcagttccgccctccacaagaagggcaagctcgatatggtgcacatccagaatgcaaccctggcagggggagtggccgtcggaactgccgcagagatgatgcttatgccatacggtgccctgattatcggcttcgtttgcggcatcatctctaccctaggatttgtgtatctgactccgtttctagaaagccgtctccatatccaagacacatgcgggatcaacaacttacatgggatcccaggaataatcgggggaattgtcggggcagtcaccgctgcttctgccagtcttgaagtttacggcaaagaagggctggtacattcctttgattttcagggttttaatggagactggactgccagaactcagggcaaattccaaatctatggtctgctggtgacgttagcaatggccttgatgggtggcattatagtgggccttatcttgagattacccttttggggccagccgtcagatgagaattgcttcgaggacgcagtgtattgggagatgcccgaagggaatagtaccgtgtacatacccgaggaccccaccttcaaaccctctgggccatctgtcccctccgttcctatggttagtcccctgcctatggcgagttctgttcctctggtcccttag

SEQ ID NO: 238646 - DNA, 429 bp, Artificial Sequence
  Description of Artificial Sequence: Synthetic coding sequence
atggcagccgcagtcgccgctgccggtgctggggagccacaaagcccagacgaattgctgcctaagggcgatgctgagaaaccagaggaggagttagaggaagatgacgatgaggagctggacgaaaccctgagcgagcgtctgtggggcttgaccgaaatgttcccggaacgtgtcaggagcgccgctggcgctacattcgatctgagcctctttgtggctcagaagatgtatcggttctcaagggccgcactgtggatcgggactacatcattcatgattcttgtactgcccgtggtcttcgagaccgagaaactgcaaatggagcagcaacaacagcttcagcagagacaaatcttgcttgggccaaacacgggactctccgggggtatgcctggcgcactgccttccttacctggtaaaatctag

SEQ ID NO: 238647 - DNA, 1083 bp, Artificial Sequence
  Description of Artificial Sequence: Synthetic coding sequence
atgagccaggagagacctacattttaccgacaggagttgaataagaccatttgggaggtacctgagcgctaccagaacctgtcacccgtcgggtccggtgcttatggatccgtgtgcgcagcattcgacacaaagaccggcctgcgagttgccgtcaagaaactaagccggccattccaatcaatcatccatgctaaaagaacataccgggaactcaggttactaaagcacatgaaacacgagaatgtcattggcctgctcgatgtgtttacaccggcacgtagtctggaagagttcaatgatgtttacctggtgacacatctgatgggcgctgatcttaacaacatcgtgaaatgccagaaactgactgacgaccacgtccagttcctgatataccagatactgagaggcctgaaatatattcactctgcggacatcattcatagggacttgaaacctagtaatctggctgtgaacgaagattgtgagctgaagatcttagattttgggctggctcgccacacagatgatgaaatgaccgggtacgtcgccacacggtggtaccgagccccagagattatgctgaactggatgcattacaaccagactgtagatatctggagcgttggctgtatcatggcagagctgctcactggtcgcactctgtttcccggaacagaccatattaatcagctgcagcagataatgcggctaacaggcaccccccctgcttatttgatcaacagaatgccgtcccacgaagcgagaaattatatacaaagcctgactcagatgccgaagatgaacttcgctaatgtgtttattggcgcaaacccgctggctgtcgatctcctcgaaaaaatgctggtactcgactctgataaaaggattacagccgctcaagccctcgcccatgcatattttgctcagtatcacgaccctgatgatgaaccagtggcagatccatacgatcaatcttttgaatccagagatcttttgattgacgagtggaaatcattaacctacgacgaggtgatctcgttcgtaccgcctcccctggatcaagaggagatggaaagctag

SEQ ID NO: 238648 - DNA, 1230 bp, Artificial Sequence
  Description of Artificial Sequence: Synthetic coding sequence
atgcgcttcaccttcccgcttatggcaatcgttttagaaatcgcgatgattgtcctctttggtttatttgtcgagtatgaaactgaccagactgtgctggaacaacttaacatcactaagccaaccgacatgggcattttcttcgagctctacccacttttccaggacgtgcacgtgatgatcttcgtcggatttgggttcctcatgacctttcttaagaaatacggcttctcgtcagttggaatcaacttgctggtagccgctcttggcctccagtgggggacaatcgtacaggggatcctacagagccagggccaaaagtttaacatagggattaaaaatatgattaacgctgacttttccgctgctactgtgctgatttctttcggcgcagtgttgggcaagaccagcccaacgcagatgttaatcatgactattttggagatcgttttcttcgcacacaacgagtaccttgtgtccgaaatctttaaagcgagcgacatcggcgcatctatgacaattcacgctttcggggcttatttcggactcgccgtggctggaattctctacaggagcgggctcaggaaaggacacgagaacgaggagtctgcgtattattccgatttgttcgccatgataggcactctgttcctgtggatgttctggccctccttcaatagcgctattgccgagcctggggataagcaatgtcgtgctatcgtgaacacctacttttctctggccgcttgtgtactaactgcgttcgcattttcctccctcgtcgaacaccgaggcaaattgaacatggtccacatccagaacgctactctggccggtggcgtggccgtgggaacctgtgccgacatggctattcaccctttcggatctatgatcattgggtccatcgcaggaatggtgagcgtgctaggatacaagtttctgaccccactcttcacaactaagttgaggatccacgacacctgtggcgtgcataacctgcacggcttgcctggagtagtgggtgggctcgcgggtatagttgcggtagcgatgggagcttctaatacctctatggccatgcaggcagccgctttgggatcatctattggtacagcagtagtgggagggctcatgactggtttgattctaaaactaccactctggggacagccttccgatcagaattgttatgacgactcagtgtactggaaggtgccgaaaactcgatag

SEQ ID NO: 238649 - DNA, 1233 bp, Artificial Sequence
  Description of Artificial Sequence: Synthetic coding sequence
atgagattcacatttccattgatggccattgtcctggagattgctatgatcgtgctgtttggtttatttgtggagtatgagaccgatcagacggtgctggaacaacttaatatcactaagccgacagatatgggcatctttttcgaattgtatcctctatttcaggatgtccacgtaatgatcttcgtgggtttcggattcctgatgacttttttgaaaaagtacgggttcagctctgtcggaattaatctgctggtggccgctctgggactgcagtggggcactatagtacaaggcattctccaatcacaaggccaaaagtttaacatcggaattaaaaacatgataaatgcagatttttccgctgcaacagtcctgatatcctttggggctgtgctagggaaaacctctccgacacaaatgctgatcatgacaatcctggaaatcgtattttttgcccataacgagtatctggtctccgaaattttcaaggcttctgacattggagcaagcatgactattcatgcatttggagcctattttggcctagccgtggccggaattctatatcgctccgggctccgcaaagggcatgaaaacgaggaatccgcctactatagcgacctgttcgccatgatcggcaccctatttttgtggatgttctggccgtctttcaattcagctattgccgagccaggagacaagcagtgccgggcaattgtgaacacttacttctccctggcggcatgtgtccttacggctttcgccttcagttccctagtggagcatcgagggaaactcaacatggtgcatatacagaacgcgacattagctggtggagtggcagttggcacgtgtgctgacatggccattcatccatttggcagtatgattatcggttcaatcgctggtatggtcagcgtgcttgggtataagtttttaacccccctattcaccactaaactgagaatacatgacacctgcggggtgcacaatttgcacggcttgccaggcgtggtcggcggtctggccggaatagtcgccgtggcaatgggagcaagcaacacttccatggcgatgcaggcggcagccctgggctcctctattgggaccgccgtcgtcggcggtcttatgacggggctgattcttaagctgccactgtggggtcaacccagcgaccagaactgttacgatgatagcgtttattggaaggtgcctaagaccagagtctag

SEQ ID NO: 238650 - DNA, 1146 bp, Artificial Sequence
  Description of Artificial Sequence: Synthetic coding sequence
atgcgtttcacttttcctctcatggccatagtattagaaattgcaatgattgttttgtttgggctattcgtggaatacgagaccgaccagacagtcctggagcaactgaacattaccaagccaacagacatggggatttttttcgaactgtatccattgtttcaggatgtgcacgttatgatctttgtggggtttggctttctaatgacctttctgaaaaagtacggcttctccagcgtgggaatcaatcttctcgtcgccgcacttggcttgcaatgggggaccatagttcagggcatcctgcagagccaggggcagaaatttaacataggaattaagaacatgatcaacgccgactttagcgccgctaccgtcctgatatctttcggagccgtgttggggaagacttcccccacccaaatgctgattatgactatcttagaaatcgtgttttttgcccacaatgaatatctggtgtctgagatattcaaagcctcagacattggcgctagtatgacaatccacgcctttggtgcctattttggtcttgctgtggccggtatcttgtaccgcagtggccttaggaaggggcacgaaaacgaagaatctgcctactattctgatttatttgctatgatagggacactgttcctatggatgttttggccctctttcaactcagccattgccgagccgggagacaagcagtgtagagccatcgtgaatacctatttttccctggcagcttgcgtacttaccgcgtttgctttttctagcctggtagagcatcgaggaaaactaaatatggtccacatccaaaacgctaccttagccggtggagtggccgtaggtacctgcgctgatatggccatccacccattcggcagtatgatcatcggttcaatcgctggaatggtctccgttctcggctataagttcctaacgccactcttcaccacaaagctccgaattcatgacacatgcggcgtccacaatctgcacggtctacctggcgttgtcgggggacttgcaggaattgtggctgtggctatgggtgcatctaacactagtatggcgatgcaggccgctgctttggggtctagcatcgggaccgcagtggtagggggactgatgacaggcacttag

SEQ ID NO: 238651 - DNA, 387 bp, Artificial Sequence
  Description of Artificial Sequence: Synthetic coding sequence
atgaaaagcctgattctcctcgcgatcctcgccgcactggcggttgtgacactctgctacggcgaatggcaaaaggaggagaacttcgggtttgatatagtgagtgtgctgagcctcaactggcacagggctcaggagagtcatgaatcaatggagtcttacgagctcaacccctttataaacagaaggaatgccaacacattcatcagtcctcagcagcgatggagagccaaagttcaggagcgcatacgagagcgctccaagcccgttcacgagttaaaccgggaggcatgtgacgattacaggctgtgcgaacggtacgcaatggtgtatggctacaatgcagcctataatcgatatttccgaaaaaggagaggaaccaagtag

SEQ ID NO: 238652 - DNA, 339 bp, Artificial Sequence
  Description of Artificial Sequence: Synthetic coding sequence
atgaccgagaaagcccctgagccgcatgtggaagaagacgacgacgacgaactggattccaagctgaattacaagcctccacctcagaaaagcctaaaagagctgcaggaaatggacaaggacgacgagtccctcatcaagtataaaaagactcttcttggtgatggacccgtagtcacagatccaaaggctccgaacgtggtggtcaccagactgaccctggtgtgcgagagcgcccctggccctataacaatggacctcacaggagacttggaggcacttaaaaaggagacgattgtcctcaaagagggatcggaataccgagtgaaaattcactag

SEQ ID NO: 238653 - DNA, 606 bp, Artificial Sequence
  Description of Artificial Sequence: Synthetic coding sequence
atgaccgaaaaggctcccgagccccatgtcgaggaggatgacgatgatgaactggattcaaaactgaactataaaccgccaccgcagaaaagtttgaaagaactgcaagagatggacaaagatgatgagagtcttattaagtataaaaaaacgttgctcggcgatggtcctgtggtgacggaccctaaagcccctaatgtggtggttaccagactgaccttagtatgtgagagcgccccaggacctattaccatggacctgaccggagaccttgaggccctgaagaaggagactatagtgctgaaagaaggatccgaatatcgagtcaaaattcacttcaaggtaaacagagacatcgtatccggtctaaaatacgtccagcacacctatcgaacaggggtgaaggtggataaggctacgtttatggttggaagctacggccctagaccggaggagtatgaatttctgacccctgtggaggaagccccaaagggcatgctggcaaggggcacatatcacaataaatccttctttaccgatgatgacaagcaggatcacctgagttgggaatggaatcttagtattaagaaggaatggacagagtag

SEQ ID NO: 238654 - DNA, 606 bp, Artificial Sequence
  Description of Artificial Sequence: Synthetic coding sequence
atgactgaaaaagcccctgaaccgcacgtggaagaggatgatgatgatgaactagacagcaagttaaactataaacctcccccacagaagtctttgaaagagctacaagaaatggacaaggacgatgaaagtctaattaaatacaagaagaccttactgggggatggcccagtggtcactgacccgaaagctcctaacgtggtcgtcacccggctcacgctggtctgcgaatccgcacccggacctatcacaatggatctcactggagacttagaggccctgaagaaggagacgattgtgctgaaagaaggatcggagtatcgcgttaagatacactttaaggttaatagagacatagtctcagggcttaagtacgtgcagcatacctataggactggagtcaaggtcgataaagctaccttcatggtgggttcctacgggccaagaccagaggagtatgagtttcttactcccgtggaggaggccccaaaaggaatgctggcccgtgggacttaccacaataaatcattttttactgatgacgacaagcaagaccacctcagctgggaatggaatctgtcaattaagaaagagtggacggaatag

SEQ ID NO: 238655 - DNA, 267 bp, Artificial Sequence
  Description of Artificial Sequence: Synthetic coding sequence
atgactgaaaaggctccagagccacatgtggaagaagacgatgatgacgagctggactcgaagcttaattacaagcctccgcctcaaaaatcactcaaggaactccaggagatggataaggacgatgaatccctgattaaatacaagaagacattgctgggcgacggcccagtcgtgactgatcctaaagctccgaatgtggttgtgacaagacttacactcgtgtgtgaatcagccccaggcccaataacaatggacctgacctag

SEQ ID NO: 238656 - DNA, 480 bp, Artificial Sequence
  Description of Artificial Sequence: Synthetic coding sequence
atgacggagaaagccccagagccccacgtcgaggaggacgatgacgacgagcttgactcaaagctcaattacaaaccacctccccaaaagtccttgaaggagctgcaggagatggataaggacgacgagtcactgatcaagtataaaaaaaccctcctgggtgatgggcctgtggttacggaccccaaggcacccaacgtggtagtcaccaggctgaccctggtgtgtgaatcagccccaggacccatcacaatggaccttacaggggacctggaggcccttaaaaaggaaaccatcgtcctgaaggagggttctgagtaccgtgttaagatccactttaaagtcaatcgcgacatcgtgtcgggcctcaagtacgtgcaacacacttaccgaaccggcgtcaaggtcgacaaggcaactttcatggtcgggagttatggtccacggcctgaagaatatgagttcctaactccagtgtag

SEQ ID NO: 238657 - DNA, 1320 bp, Artificial Sequence
  Description of Artificial Sequence: Synthetic coding sequence
atggatcccctgagcgagctccaggatgacctgacactggacgatacttcggaggcactgaatcagttgaaactcgcatctattgatgagaagaattggccaagcgatgaaatgccagactttcccaaaagcgacgattccaagtcgagttcgccagaattagtcacacacttgaaatgggatgatccctattatgatatcgcaagacaccagattgtggaagttgctggcgatgataagtatggcagaaagatcattgtgttcagcgcctgccgaatgccccctagtcatcagctggaccacagcaagctcctaggatatttaaaacacacattggatcagtacgtggagtcagactacacgttgctgtacctgcatcacggactcacatctgataacaaacccagtctttcgtggctgcgcgatgcctacagggagttcgatcgcaaatataagaaaaacattaaggccctgtacatcgtgcatccaactatgtttatcaaaacactcttgatcttgttcaaaccactgatctccttcaaattcggacaaaagatattctatgtgaactacttgtccgaacttagcgaacacgttaaactggagcagcttggcattccgaggcaggtcctcaagtacgatgatttcctcaagagcactcagaaatccccagccactgccccaaagcccatgcctcctcgaccccctctacctaatcagcagttcggggtctctctccagcatttgcaggagaaaaacccagaacaggaacccatcccaatagtgctgcgggaaaccgttgcttaccttcaggcccacgctctgactaccgaagggatctttagacgtagcgccaatactcaggttgttagagaggtgcagcagaaatacaatatgggcctacctgttgatttcgaccaatacaacgaacttcatctacctgccgtcatcctaaaaacattcctgcgagagttgccagagccgctcctcacctttgacctttaccctcatgtagtggggttcctcaatattgatgaaagccaaagggtgccagccaccctccaggtgctgcaaactttgcctgaggaaaactatcaggtgttgcgtttcctgacagcctttcttgtccaaattagcgcacattcggatcaaaataagatgacaaatactaacctggctgtcgtctttggaccaaacctcctttgggctaaagatgctgctatcaccctgaaagcgataaacccgatcaataccttcacaaagttcctgctcgaccatcagggcgagctatttccctcccccgacccttccggtctatag

SEQ ID NO: 238658 - DNA, 1377 bp, Artificial Sequence
  Description of Artificial Sequence: Synthetic coding sequence
atggaccctctcagtgagctgcaagatgacttaactctggacgacaccagtgaggcactgaaccagctgaaactggcttccatcgacgagaaaaactggccctccgacgagatgccagactttcccaagtcagacgacagcaagtcatccagccccgaactagtcacccatctgaagtgggatgacccctactatgacatagccaggcatcagatcgtcgaagtggctggggacgacaaatatggacgcaaaattattgtgtttagcgcatgccgcatgccgccttctcaccaattagatcattcaaaactcctcggatatttgaagcatacgctcgatcaatacgtggagtcagactacacgctcctgtatcttcaccatggcttaacatcagataacaaaccatcactcagctggctgcgggacgcgtatcgcgaatttgacagaaagtacaaaaagaacattaaggcactgtacatcgtccaccccacaatgttcattaagacactgctgatattgtttaagcccctgatttctttcaagtttgggcagaagatattttacgtgaattacttgagcgagctctcagagcatgttaagctagaacagctcggaatccctcggcaggtcctaaaatacgacgattttctgaagtctacccagaaaagtcctgctaccgctcctaagccaatgcctcccaggccccctttaccgaatcagcagtttggcgtatcactgcagcatcttcaggagaagaatcccgagcaagagcctataccaatagtgttgcgtgagacggtggcctacctgcaggcccatgccctgacaaccgaggggattttccgtagatcggcgaatactcaggtggtacgcgaggttcaacagaaatataacatgggccttccagttgattttgatcaatataatgaattgcatcttcctgctgtgatcctcaaaacattccttcgtgaattgccggagcccctcctaacatttgacctgtacccacacgttgttggtttcctcaatatagatgagtctcagagagtgcccgcaaccctccaggtgctgcaaaccctgccagaggagaattatcaagttttaagatttctgaccgctttcctggtccaaatcagcgcccatagtgaccagaataagatgactaatacaaatttggcagtggtgtttgggcctaacctgctatgggccaaagatgcggctatcaccctaaaggccattaatcctatggccacctttttctttttctttttgcgctggagtctcgccctctcccccggttggagcgctgtagccaggtcccgccatacaagcgctttctgggtgcaggctattctgctcccacaacctccggagtag

SEQ ID NO: 238659 - DNA, 579 bp, Artificial Sequence
  Description of Artificial Sequence: Synthetic coding sequence
atggacccgctgagtgagctgcaggacgacctcacgctggacgacaccagtgaagccctgaatcagctgaagctggcctccatagacgaaaaaaactggccatccgacgaaatgcctgatttccctaagagcgatgattccaaatcaagcagtccggagttggtaacccaccttaagtgggacgacccttactacgatattgctaggcaccagatcgtggaggtagctggcgacgataaatacggcagaaagattattgtcttctctgcgtgtaggatgcccccttctcaccagcttgaccatagcaagttgcttggctaccttaaacacacgttggaccagtacgtggagagtgactacaccttgctgtacctccaccacgggttgaccagcgacaataagccatcactgagttggcttcgggatgcatatagggagtttgatagaaagtacaagaagaatatcaaagccctgtacatcgtgcacccaacgatgttcatcaagactctgctgatcttgtttaaacctctcatttcctttaaattcggccagaaaatcttttatgttaattatctgtag

SEQ ID NO: 238660 - DNA, 2361 bp, Artificial Sequence
  Description of Artificial Sequence: Synthetic coding sequence
atgggactgcaacctctggaattttctgattgttacctcgatagcccatggttcagggaacgaattcgggctcatgaggcagaactggagcggactaataagttcatcaaagagttaattaaggacggcaagaatctgatcgctgccaccaaaagtctaagcgtggcccaaaggaagtttgcccatagccttcgcgattttaaattcgagtttattggagatgcagtgacagatgacgaaagatgtatcgacgcttctctgagagagttctccaactttttgaagaaccttgaggaacagcgcgagattatggcactgtctgtgaccgaaacgctgatcaagccacttgaaaagtttagaaaggaacagctcggggctgtcaaggaggagaagaagaaatttgacaaggagacggagaaaaactactctctgatcgataaacacttgaatctatctgcaaaaaagaaggattcccacctgcaggaagctgacatccaggtggaacagaatcggcagcacttctacgagctctctttggagtacgtatgcaagcttcaagagatccaggagcggaagaaattcgaattcgttgaaccaatgctcagttttttccagggcatgttcacattttatcatcagggacacgaactggcgaaagacttcaatcactacaagatggagttacagatcaatatccagaatacccgaaaccgctttgaaggcaccagaagcgaggtggaggagctgatgaataagatcagacagaatcccaaagatcataagcgggcttcacaattcactgccgaaggctacctttacgtgcaggagaagcggccagctccgtttggcagttcttgggtcaagcactactgtatgtacagaaaggcggcaaaaaagttcaatatgattccttttgagcataggtcagggggaaagctcggtgacggcgaggttttctttctaaaagaatgcaccaagcgccacaccgattccattgacaggagattctgctttgatattgaagcagctgataggcctggcgtgtctctgaccatgcaagcttttagcgaagaggaacgcaaacagtggctggaagcgcttgggggaaaagaagccttgtcccactcatttaacacagcaataatcccccgacctgaaggtaatgcgcagttagataaaatgggcttcactattatccggaaatgcatttctgccgtggagacaaggggcattaatgatcagggactgtacagagtggtgggagtgtctagcaaagtgcagcggctcctgagcatgctgatggacgtcaaaacatgcaatgaagtggatctggagaacagcgcggattgggaggtgaagactatcacctcggccttgaagcaatatctgaggagcctccccgagcctcttatgacctacgagcttcacggagatttcattgtgccagctaaatcaggaagtcccgaaagccgcgtcaatgcaattcacttcttagttcacaaattacctgagaaaaataaggaaatgctggacattctggtgaagcacctgaccaatgtcagcaatcattcaaagcagaacctaatgactgttgccaacttgggtgtcgtgttcggtccgacactgatgcgccctcaggaggagacagtcgctgcccttatggatttaaaattccaaaatattgtcgttgaaattctgattgagaatcacgaaaaaatctttagaacacccccagacaccaccttccccgagcccacatgtctatcagcttcgcctcctaacgcccctcctcggcaaagcaagcgccagggccagcggactaagaggcccgtggccgtctacaacctctgtctggagttggaggacggagataatccatacccaagcaaagaggatacacccacaagctcgttggactccctctcctctcctagcccggttacaaccgctgtgcccggaccccctggaccagacaagaaccacctgcttgcagatggcggaagtttcggagactgggcaagcactatcccaggccagactcgctcctctatggtgcagtggctgaaccctcagtcgcccaccaccacatctagcaactccgccgtgactcctttgtcacctggctcaagccctttccctttctccccaccggctacagtagccgataagccccctgaatctatcaggtctaggaaggccagagcggtgtacccttgtgaggcggagcactcgtctgagctctcctttgagattggggctatatttgaggacgttcagacgagtagggaacctgggtggctggaaggcacactaaacggcaaaagagggctcatcccgcagaattatgtgaaactcctttag

SEQ ID NO: 238661 - DNA, 1155 bp, Artificial Sequence
  Description of Artificial Sequence: Synthetic coding sequence
atgcaggccttctcagaagaggagagaaaacagtggctagaggctctgggaggaaaagaagccctgagtcactcttttaatactgccatcatccccagacctgaggggaacgcccagctggacaaaatgggtttcacaattattcgtaaatgtatcagcgccgttgagacgaggggtattaacgatcaggggttgtatcgggtggtcggggtgagctcaaaagtgcaacgcctgctgagtatgctgatggatgtgaaaacatgtaacgaggttgacctggagaactcagcggattgggaagtcaagaccataacttctgcactgaagcagtacctccggtccctgcctgagcctctcatgacatatgaattgcatggggactttattgtcccagctaagagcggttcgccagagagccgcgtgaatgcaatacatttcctggtgcacaaactcccagagaagaacaaagagatgcttgatattctggtaaagcacctgacgaatgtttcgaaccattcaaagcagaatctgatgacggtggccaatttaggggttgtgtttggccctactttgatgagaccacaggaagagaccgtggccgcacttatggaccttaaattccagaatattgtcgtcgagatcctcattgagaatcacgagaagattttccgcactccacctgatacgacattccccgaacccacatgcttatccgcctccccacccaacgcgccacctagacaatctaaacgtcaggggcagcgcactaaacgccctgtggctgtgtacaacctttgccttgaactggaagacggtgataacccatacccaagtaaagaagacaccccaacatcatcccttgactccctctcctcaccttctcctgtcacaacagccgtgcccggaccccctggacctgataaaaaccacctgctcgctgacggcggatctttcggcgattgggcctccactataattcgatcaaggaaggcgcgagccgtgtacccatgtgaagctgaacactccagcgagttgagctttgaaattggagccatcttcgaggatgtccagacttcaagggagcctggctggttggaggggaccctgaacgggaagcgtggtttgatacctcaaaactacgtcaaactgctgtag

SEQ ID NO: 238662 - DNA, 3072 bp, Artificial Sequence
  Description of Artificial Sequence: Synthetic coding sequence
atgtgggatcagcggctggttcgccttgcccttttgcagcatctgagggccttctatggaataaaggttaagggagtgcggggacagtgcgatagacggagacatgagacagcggctaccgagataggaggaaaaattttcggcgtgccattcaacgccttgccccattccgcggtacccgagtatggccatatcccctccttcctggtcgatgcctgcactagcctagaggatcatatccacactgaaggactgttcaggaaaagtggatccgtcatcaggctgaaagcgctcaaaaataaagtggaccacggagaagggtgtctgtctagcgccccaccctgtgatattgccggactgttaaagcaatttttcagagaactgcccgagcctatcctgccagcggacttgcacgaggcattgctgaaggcccaacaactggggacagaggaaaagaataaggccaccctgctcctctcgtgtctcttagccgatcataccgtacatgtgctgcggtacttttttaatttccttcgcaacgtatcactgagatccagcgagaacaagatggactcctccaacttagccgtgattttcgcccctaatttgttacagaccagcgaaggtcatgaaaaaatgtcttcaaataccgagaaaaagctgagactgcaagcggcagttgtgcaaacgttaatcgactacgcttccgatataggccgtgtaccagactttatacttgagaaaattcccgcaatgctcggaatagatgggctatgtgctacaccatctctggagggattcgaagaaggggaatatgaaacacctggggagtacaagaggaaacggaggcaaagcgtcggggactttgtcagcggcgcactgaataagttcaagccaaaccggacacccagcatcaccccacaagaagagcgcatagcccaactgagtgaatctcccgtgatcctcacgcctaacgccaagcggacactccctgtggactcatctcatggattttcttcaaaaaaaaggaagtccatcaagcataacttcaatttcgagctgctgccaagcaatctgttcaacagcagctcaactcctgtttccgtccacatcgatacttcttcagaggggtcctcccagtctagcctttctcctgtgctaattggcggtaatcacctgatcaccgccggagtcccaaggcggagtaaaagaatcgccggtaagaaagtgtgtcgcgtggagtctgggaaagcaggttgcttctctcctaagatctctcacaaggagaaggtccgccgaagcctcaggctgaaattcaacctgggaaagaacggtcgtgaagtcaacggttgttcaggagtcaaccggtatgagtccgtcggctggaggttggccaatcaacagagtctgaaaaatagaattgaatccgtaaagaccggactcctgttctccccggatgtggatgagaagctgcccaagaagggctcagagaagatctctaagtccgaagagaccctgctcactcctgagagactggttggaactaactaccggatgtcatggacaggcccaaacaattcttcctttcaggaagtcgacgctaacgaggctagcagcatggtcgagaatctggaggtcgagaactcactcgaacctgatatcatggtcgaaaagagtcccgctactagttgcgaattgactccgtcaaatctcaacaacaagcacaactctaacattacctcaagtcccttgtcaggcgatgagaacaacatgaccaaggagaccctggttaaagttcagaaggcgttttcagagtccggctccaacttacacgctctcatgaatcaaagacagagttctgtaacaaacgtgggaaaagtcaagttaacagagccttcatatctggaggattcacctgaggaaaaccttttcgaaacaaatgatttgactatcgtggagtctaaggagaaatatgagcaccatactggcaaaggcgagaaatgcttctcagagcgagattttagtccacttcagacacagacattcaacagggaaacgacaatcaagtgttacagcacacaaatgaaaatggagcacgaaaaggatatacatagcaacatgcctaaagactatttgagcaaacaggagttctcctctgatgaagaaatcaaaaaacagcagtctccgaaggataaactcaataataagttaaaggaaaacgagaacatgatggagggaaacctcccaaaatgcgccgctcactcaaaggatgaagccaggtcctccttctcacagcagtcaacctgcgtcgtgactaacctgagtaagccgcgaccaatgcgcatcgccaagcagcagtctttagagacgtgtgaaaaaactgtgtccgaatctagccagatgacagaacatcgcaaagtgagcgatcacatccaatggttcaacaagctgtctttgaatgaacccaataggattaaagttaagagtcctctcaaatttcagcggactccagtgaggcagtctgtgcggagaatcaatagcctcctggaatatagcagacagccaacagggcataaacttgctagcctcggcgacaccgcaagcccacttgtcaaaagtgtgtcatgtgatggggcactcagcagctgtatcgagtcagccagcaaggatagctctgtcagctgcatcaaaagtggaccgaaggagcaaaaatccatgtcttgcgaagagtccaatatcggggcaatctcaaagtcctcaatggaactgccatccaaatcctttttgaagatgcgcaagcacccagatagtgtgaatgcttcacttaggtcgacaaccgtgtacaagcagaagattcttagcgatggtcaggtgaaagttcctcttgacgatttgacaaatcatgatattgtgaaaccagttgtaaataacaacatgggcatatcctccggaataaataatagggtgctaaggcgcccatcagagcggggaagggcctggtacaaaggctcacccaaacatcccataggtaaaacccaactcctccccacgtccaaacccgtggatctgtag

SEQ ID NO: 238663 - DNA, 2505 bp, Artificial Sequence
  Description of Artificial Sequence: Synthetic coding sequence
atggacagctccaatttggcagtgattttcgctcccaacctcctgcagacctcagaaggccacgaaaagatgtcatccaacactgaaaagaagctgcgccttcaagctgcagtcgtccagacactgatcgattacgcaagcgacataggcagggtgcctgatttcatactggaaaagatcccagcgatgttgggaatcgatgggctttgtgcaaccccatctctggagggatttgaggagggcgagtacgaaacgccgggtgagtataagcgaaagcgcagacaatcagtgggagattttgtgtccggagctctgaataaattcaagcccaatagaactccctccataacaccacaggaagagagaatcgctcagctgtctgaatcacctgttatcctcactcccaacgccaagaggacactcccagtcgactcctcccatggctttagtagcaaaaagaggaaaagcatcaagcataacttcaactttgaacttctccccagcaacctgttcaactcttctagcaccccagtgtcagtgcatattgacacatcctccgagggatcctcgcagtcctcacttagtcctgtacttattggagggaatcatttgataacggccggtgtccctcgccgttcgaagcgcatcgccggtaagaaggtttgtcgggtggagtcagggaaggcaggatgctttagtcccaaaatctcccacaaggagaaggtgaggcggagcctgcgtttgaaattcaacctgggaaagaacgggagggaggtcaacgggtgcagtggcgttaacaggtatgaaagtgttggatggagactggctaatcagcagtctttaaagaataggatagaatccgtgaaaacgggattactctttagcccagatgtcgacgagaaactaccaaagaagggctccgaaaaaatctccaagagtgaagagaccttactgacacccgaaagattggttggtacaaattaccgcatgtcatggaccggacctaataatagcagctttcaggaggttgacgccaatgaagctagcagcatggtggagaatctcgaggtggaaaattccctagaacccgacatcatggtggagaagtcccctgccacctcgtgtgaattgacgccatccaacctaaataataaacacaattctaacataacctcctccccactttctggagatgaaaacaatatgacaaaagaaacacttgtaaaggtgcagaaggctttttccgagagcggctcgaacctccatgcccttatgaaccaaagacagtcttccgtcacaaacgtcggaaaagttaagctgaccgagccgtcttacctggaggatagccctgaggaaaacctctttgaaaccaatgacctgaccattgtagagtccaaagagaaatacgaacatcataccggaaaaggagaaaagtgcttcagcgagcgcgacttttcccccttacagacgcaaaccttcaatcgcgagacaactatcaagtgttattctacccaaatgaagatggagcacgagaaggacatccactcaaatatgcccaaggattacttgtccaaacaagagttcagcagtgacgaggaaattaagaagcagcaatctccaaaggacaaactgaacaataagttgaaggagaacgaaaacatgatggaggggaacctacccaagtgtgccgcacactcaaaagatgaggctagatcatccttttcgcagcagagtacatgcgtggtcactaacttgtctaagcccagaccgatgcggattgcaaaacaacagtcactcgagacctgcgaaaagaccgtatcggagtcttcgcagatgaccgaacaccgcaaggtcagtgaccatattcagtggtttaataaactgtccctgaatgagcctaatcgcattaaagtcaaaagccccctgaaatttcagcgcacccccgtccgtcagtcggtaaggagaataaacagtctgcttgaatactcacgacagcccacaggacataagctcgcgtcactgggggataccgccagccctttggtgaaatcagtcagctgcgatggagcactgagcagttgcattgagagtgccagcaaagacagcagtgtgagttgtatcaagtccggtcctaaagagcagaagtccatgagctgcgaagagtctaacatcggcgcaatcagcaagtcctccatggaactcccctcaaaatcattcctcaagatgaggaaacaccccgattcagtgaacgcgtctctccggagcacaaccgtttacaagcagaaaattctgagtgacggccaagttaaagtacccctggatgacctaaccaatcacgatatcgtcaagcctgtggtgaataataatatgggtatatcttcagggattaataatagagtgctacggcgtccgtctgagcgcggtagggcctggtataagggctctcccaagcatcctatcggcaagactcagctgctgccaactagcaaacccgtcgacttgtag

SEQ ID NO: 238664 - DNA, 1506 bp, Artificial Sequence
  Description of Artificial Sequence: Synthetic coding sequence
atgtgggatcaacgactggtgcggcttgccctgttgcaacacttacgggctttttacgggataaaggttaaaggcgtgcgcggtcaatgcgacaggcgacggcatgagaccgctgcaactgagatcggagggaaaatcttcggtgtgcctttcaatgccttacctcattctgccgttcctgagtacgggcatattccctccttccttgtggatgcctgcactagtcttgaagatcatatacacacggaaggtctgttccggaagagcggatcagtgataaggttgaaagcccttaaaaataaggtggaccatggtgaaggatgcctgagtagtgcacctccttgcgacatcgccggtctacttaagcaattcttcagggaactgcccgagccaattttgccggcagatctgcatgaagcactcctgaaggcccagcaactgggaacagaagaaaaaaacaaagcgacgctcctactgtcttgcctccttgccgaccataccgtacacgtgttacgctactttttcaattttctgagaaacgtgtcccttcgctcttcagaaaataagatggactcctcaaacctcgcagtcatcttcgcacctaacctgttgcaaacatctgaaggccatgaaaagatgagttccaacacagaaaaaaagttacggcttcaagcggcagtcgttcagaccctgatcgattatgccagcgacatcggccgagtgcccgactttattctggagaagatccccgcaatgcttggcattgatggcctttgtgctactccgagtctagaaggctttgaagaaggcgaatacgaaacacctggggaatacaagagaaagaggaggcagtccgtgggtgacttcgtttccggggctctcaacaagtttaaacccaacagaacaccctcaatcaccccccaagaggaacgcatagcccagctttcagagtcccccgtgatcctgactcccaacgctaaaaggactttaccggtcgactcaagccacggcttcagtagtaagaaacgcaagtctatcaaacacaactttaatttcgagcttttgccatcaaatctgtttaactccagtagcacccctgtatctgtacatatcgatacctccagcgagggttcctcgcagtcatctctatctcccgtgctcataggcggtaaccacctcattaccgcaggcgttccaagacgttcaaaaaggatcgcagggaagaaagtgtgtcgcgtggagtcagggaaggcgggttgttttagccccaagatatcccataaagagaaggtgaggcgctctctgcggctgaagttcaacctgggaaaaaatggccgagaggtgaacggatgttcaggcgtgaacagatacgaatccgtaggttggaggctggcgaaccagcagagcctcaagaaccggatagagtcagtcaagactggcctcctgttttcaccagacgtggatgagaagttgccgaaaaaaggaaccttcacctattattgttag

SEQ ID NO: 238665 - DNA, 2385 bp, Artificial Sequence
  Description of Artificial Sequence: Synthetic coding sequence
atgaagatggcggatagatctggaaaaattattccagggcaagtgtatatcgaggttgagtacgattatgagtacgaggcgaaggacaggaaaatcgttatcaagcagggggagcggtacatcttggtgaaaaagacgaatgacgactggtggcaagtgaaaccagatgaaaattccaaagccttctacgttcccgcacagtatgtgaaagaagttaccaggaaggctctgatgcctccagtcaaacaggttgctggacttccaaacaactcaactaagatcatgcagagtctgcacctgcagaggtccaccgagaacgtcaacaaacttcccgaactgagttcctttgggaagccaagctcgagtgttcagggaaccggccttatcagggacgcaaaccagaacttcggaccgtcatataatcaggggcagaccgtcaatctttcacttgatctgacgcataacaacggcaaatttaataacgacagccatagtcctaaggtatctagccagaatcggactagatcttttggccatttcccgggaccagaatttctggatgtcgagaaaacgtcattcagccaggagcagagctgtgacagcgccggagagggctcagagcgcattcatcaggattctgagtccggagatgagctcagcagctcctcgacagaacaaattcgggctacgactccccctaatcagggtagaccggatagcccagtctatgccaacttgcaggagctgaaaatatcacagtctgccctgcccccactgcccggttcccctgccatccagataaacggggagtgggagacacataaggatagcagcggccgatgttattactacaaccggggaacacaagagagaacgtggaaacctccacgatggaccagggacgcgtcaatctccaagggcgatttccaaaacccaggggatcaggagtggctcaagcacgtcgatgaccaagggagacagtattattactccgcagatgggagccgatctgagtgggaactgccaaaatacaacgcatcatcacagcagcagagggaaattataaaaagccgcagcctggataggagacttcaggaacctatagtgctgacaaagtggcggcattccaccattgtgctagatacaaacgataaggagagtccaaccgcctccaagccttgttttcccgaaaacgaaagcagcccctctagccctaagcatcaggatacggatcaggaaaaatacggattgctcaacgtcaccaagatcgccgagaatggtaaaaaggtgcgtaagaattggctctcatcatgggcagtcttgcaggggtccagtctgttgtttactaaaactcaggggtccagcacctcctggttcggaagtaaccagtcgaagcctgagtttacagttgacctcaagggagctacgattgagatggctagtaaggacaagtccagcaagaagaatgttttcgagctgaaaaccagacagggaactgaactcctgatccagagcgacaacgacactgtaattaatgactggttcaaggtcctgagcagcactatcaataatcaggcagtggaaaccgatgaggggatcgaagaggagatccccgattctccaggcatcgaaaaacatgacaaagaaaaagaacagaaagatcctaagaagttacggagcttcaaggtgtcaagcatcgactcctcggaacagaagaaaacaaaaaagaacctgaaaaaattcctgacccgacgcccaactctccaggccgtgagagagaaaggttacataaaggaccaggtgttcggctccaacctggcaaatctgtgtcagagagagaacggaacagtacctaagttcgtgaaactgtgtatcgagcatgtggaagagcatggcttggatatagatggtatttaccgcgtaagcggcaacctagctgtcatccagaaactgagatttgctgtcaaccacgatgagaagctcgatctgaatgacagcaagtgggaggacatccacgtgatcacgggggcattaaagatgttctttcgcgagctccccgagcccttatttacatttaaccatttcaacgacttcgtgaatgccatcaaacaggaacctagacagcgggtcgccgctgttaaggacctgattcgacagctgcccaaacccaaccaggacaccatgcagatcctgttcaggcaccttcggagagtgatcgagaacggggagaaaaaccgcatgacttatcaatctatcgccatcgtgttcggtcctaccctgttgaaacctgagaaggaaactgggaatatcgccgttcacacagtgtaccaaaaccagattgtcgagctgattttactagagctgagtagcatttttggtaggtag

SEQ ID NO: 238666 - DNA, 2541 bp, Artificial Sequence
  Description of Artificial Sequence: Synthetic coding sequence
atgaagatggccgatcggagtgggaagattatcccaggccaggtctatattgaggtggaatatgactatgagtatgaggcaaaagatagaaagatcgtgataaagcaaggtgagcggtatatccttgtcaagaagacaaatgacgactggtggcaagtgaaacctgacgaaaactccaaggctttctatgtccccgctcagtacgtgaaagaggtcacccgcaaggcactcatgccaccggttaaacaggttgccggtttgcccaataactctacaaaaatcatgcagtctctgcaccttcaacgaagcacggaaaacgttaataagcttcctgaactcagctccttcgggaagcctagctccagcgtacaaggaaccggactgatccgtgatgccaatcagaatttcggcccatcctataatcagggacagacggtgaacctctcgctcgacttaacacataacaatggcaaatttaacaatgacagccactctcctaaggtgtcaagccagaatcgtaccaggagttttggtcatttcccaggacccgaattcctcgacgtcgagaaaacctctttttcacaagaacagtcatgtgatagcgccggtgaaggtagcgagagaatccatcaagacagcgagagtggtgatgagttatcttcctcgtcaactgagcagatccgagcaacaacaccccctaaccagggcagacccgattctccggtctacgctaacctgcaggagcttaagatctcccagtcagctctcccacccctgcctggctctcctgctattcagataaatggggagtgggagacacacaaggattcctcaggccgatgctattattacaacagggggactcaggagcgcacttggaaaccccctagatggactcgcgacgccagtatcagcaaaggagactttcagaaccccggagaccaggaattgcttagctctgaggaaaactattattccacctcatactcccagtccgactctcagtgcggatcgccccctcgaggttggtccgaagaactggacgagcgagggcatacactctacacatctgactataccaatgagaagtggttgaagcacgtggatgatcagggccgacagtattactacagcgctgatggctctcggtctgagtgggagcttcctaagtataatgcatcctcccagcagcaaagggagattatcaaatcccgctcattggatcgtcgcctgcaggagcctatcgtgctcacaaagtggcggcactcaacaattgttctggacacaaatgacaaggaatcgcctaccgctagtaagccttgtttccctgagaacgagagttcaccttcaagtccaaagcatcaggatacggcgtcatcacccaaggatcaggaaaaatacggactgttgaacgtcacaaaaatagccgaaaacggcaagaaggtaagaaaaaactggctaagctcttgggccgtgttacagggttcgagccttctgttcacaaagacccagggctcatcaaccagctggttcggctctaatcagtctaagcctgaatttaccgtggatctcaagggggctaccatcgaaatggcttctaaagacaaaagctcaaaaaaaaatgtattcgaactgaagacccggcaaggaacagaacttcttatccaatcagacaatgacaccgtgatcaatgactggtttaaggtgctttcgagtacaattaataatcaggcagtggagacagatgaaggcatcgaggaggagatccctgactccccaggaattgagaagcacgataaggagaaggaacagaaagatcccaaaaagctccggtcatttaaggtgagctcgattgacagcagcgaacagaagaaaacgaaaaaaaacctgaaaaaattcctgactcgccgtcccactctccaagcagtccgtgaaaaggggtacattaaggaccaggtgtttggatctaacctggccaacctttgccagagggaaaacggcaccgtccccaagtttgttaagctttgcattgagcatgttgaggagcacggccttgacatcgacggaatttaccgagtctctggcaatctggctgtcatacagaaattgcggttcgcggtgaaccacgatgagaagctagatctaaatgatagcaagtgggaggatattcacgtaatcactggagccctaaaaatgttttttcgcgaactccctgaaccattgtttacctttaatcatttcaacgactttgttaatgccattaagcaggagcccaggcagcgggtcgccgctgtgaaggacctcatcaggcagcttcccaagcctaatcaggataccatgcagattctgttccgtcacttacgtagagtcatagagaacggcgaaaaaaaccgcatgacttatcaaagcattgcaatcgttttcggcccaaccctgctgaagcccgaaaaagagacaggaaatatcgcagtgcacactgtttaccagaaccagatcgtggagctgatcctcttggaactctcatccatctttggcaggtag

SEQ ID NO: 238667 - DNA, 2385 bp, Artificial Sequence
  Description of Artificial Sequence: Synthetic coding sequence
atgaaaatggctgacagatccggcaagatcatccctgggcaggtgtacatcgaggtggaatacgattatgagtatgaggctaaggatagaaagatcgtcattaagcagggcgagcgttatattttagtcaagaagaccaatgatgattggtggcaggtaaagcccgatgaaaacagcaaggctttctacgtcccagctcagtatgttaaggaggtgaccagaaaggcgctgatgccaccagtgaaacaggttgccggacttccaaacaacagcacaaaaataatgcaatcccttcacctgcagcgctctaccgagaacgtgaacaagctgcccgaattaagtagcttcggtaaaccttccagctccgtccagggcaccggactgatccgggacgccaaccagaacttcggcccttcctacaaccaagggcagaccgtaaacctctcactggacctgacacataacaacggaaaatttaataacgatagccattctcctaaggtctcctcacagaatagaacgagatccttcggacactttccgggaccagagttcctcgacgtcgagaagacttcgttttctcaagaacagagctgcgactctgcaggcgaaggaagcgagcggattcaccaagactccgaatcgggtgacgagctctcatctagctctacagagcagattcgggcaacaacgccaccaaaccagggccgacccgacagccccgtttacgccaacttgcaggaactaaagattagccaatctgcgcttcccccactacctggcagccccgctattcagattaacggggagtgggagacgcataaagatagcagtgggaggtgctactactacaaccgaggcacacaagagaggacctggaaaccaccaaggtggacccgcgatgcgtctattagcaagggcgactttcagaatcctggagatcaggagtggctgaagcacgtggatgatcaaggtcgtcagtactactattcagctgatgggtcgcgcagcgagtgggagctcccaaagtacaatgcgtctagccagcagcaaagggagatcattaagtcaagaagtctagatcgacgcctccaggaacccattgtcttaacaaagtggcgccactccacgatcgtactcgatactaatgacaaagagagccctactgcatcaaaaccatgtttcccagagaacgagagcagcccatctagtccgaagcatcaggacacagaccaggagaagtatgggctactaaacgttacaaaaatcgctgagaacggtaagaaggtccgaaaaaactggttatcgagttgggcagtgttgcaaggctcttcattgctctttaccaaaacccaggggtcatccacgtcttggttcggatctaaccagtcgaagccagagttcacagtggatctgaaaggcgcaaccatcgaaatggcttcaaaggataagtcttctaaaaaaaatgtgtttgagctcaagacacgacaggggaccgagctcctaatccaatccgataacgatactgtcattaacgactggtttaaggtgctgtcctccacgatcaacaaccaagccgtggagacggacgaagggatcgaggaagagatcccagatagtcccggtattgaaaaacatgacaaagagaaggagcagaaagatccgaaaaaactacggtccttcaaagtatcttccattgacagtagcgaacagaaaaaaacaaagaagaacctaaagaagttcctgacaagacgtccgaccctccaagctgtcagggaaaaaggttacatcaaagatcaagtgttcggtagcaatctggcaaacctgtgccaacgggagaatggcacggtccccaaatttgttaagttgtgcatcgaacacgtggaagaacatggcttagatattgatggaatctacagggtgagcggaaacctggctgtgatccagaaactgagattcgctgtaaatcatgacgaaaaattggatctaaatgacagtaaatgggaagacatccacgtaatcactggtgcccttaagatgttttttagggagttgcccgagcccctctttacatttaaccacttcaatgacttcgtgaatgcaattaaacaggagccgaggcagagagtggccgctgtaaaggatctgatacgtcaattgcccaagccaaaccaagataccatgcagatcctgtttagacatctgcgccgagtcatcgagaacggcgagaaaaatcgcatgacttatcaaagtattgcaatagtttttggaccgaccctcctaaaacctgaaaaggaaacgggcaacatcgcagtccacacagtctatcagaatcagatcgttgaactcattctgctcgaattgtcatccatcttcggaagatag

SEQ ID NO: 238668 - DNA, 2451 bp, Artificial Sequence
  Description of Artificial Sequence: Synthetic coding sequence
atgaagatggcagataggagtggaaagatcatccctggccaggtgtacatcgaagtggagtatgactacgagtatgaggcaaaagatcgtaaaatcgtgatcaaacagggagaacgctacatcctcgttaagaagaccaatgacgattggtggcaggtgaagccagacgagaactctaaagccttttacgtacccgcacagtacgtgaaggaggtaactagaaaggccctcatgcctccagtgaaacaggtcgctggccttcctaataacagcacgaagattatgcagtcacttcaccttcagcgctcaacggaaaatgtgaacaagctgcccgaattatccagttttggcaaaccaagcagctcagtacagggtaccggtctcatcagagacgcgaaccagaacttcggaccctcctataaccagggccagactgtaaacctgagcttagatttaacccacaataacggaaagtttaacaacgatagccactcccccaaagtgtccagccagaaccggactcgctccttcggccatttccccggtcccgaattcctggacgtggaaaaaacaagcttctcacaggagcagtcctgcgactccgccggtgagggctccgaaaggatccatcaggactccgagagtggagacgagttgtcctcctcatccaccgaacagatccgcgctactacaccccctaatcagggaagacctgattctccagtatacgctaacctccaagaactgaaaatcagccagtctgcgctccctcctctgcccggaagtccagctatccagattaacggagagtgggaaacgcataaagacagttcgggcagatgctattactacaacaggggcacgcaggaacgcacatggaagccacctcgctggacaagagatgccagcatttcaaagggggattttcagaacccgggagaccaggagctgctgtcctccgaggaaaattactatagtactagttatagtcagagcgactcccaatgcgggtctccccctcgaggctggtccgaagagctggatgaaagaggtcacaccctttataccagcgactacaccaatgaaaagtggcttaagcacgttgacgatcagggcagacagtattactactcagccgacgggtcgcgatcggaatgggagttgcccaagtataatgctagcagccagcagcagcgtgaaatcatcaagagccggtccttagatcgcagactgcaggagccaatcgtgctgactaagtggagacacagcactatcgtgcttgacaccaacgacaaagaccaagaaaagtatggcttactcaatgtcaccaaaattgcggaaaatggcaagaaggtgaggaagaactggcttagctcctgggcggtactccaggggagctcactcctgttcaccaagacccaggggtcttcaacctcttggttcggaagcaaccagtctaaaccagagtttacggtcgatctgaaaggtgcaaccattgaaatggcatcaaaggataaaagctcgaaaaagaacgtttttgaactgaaaactcgccagggcacagagttattgatccagtctgataatgataccgtgataaacgattggttcaaggtgctgagttcaactattaataaccaagcggtagaaacagacgagggaattgaggaagaaattcccgattcacctggtattgagaagcatgataaagaaaaagagcaaaaggatccaaagaagctgaggagctttaaggtgtcgtccattgactcaagcgaacagaagaaaaccaaaaagaatttgaaaaagttcctgaccagacgccctacattacaggcagttagagagaaaggttacattaaggaccaggtgtttggcagcaatctggccaacctttgtcagcgagaaaatggaaccgtcccaaagtttgtgaagctgtgtatcgagcacgtggaggagcacggcctcgatatagatgggatttatcgagtgtcaggaaatctggcggtgatccagaagttaagatttgccgtgaaccacgatgaaaagttggacctcaatgattccaagtgggaagacattcatgtgatcacaggggctctgaaaatgttcttcagggaactgcccgaacccctcttcaccttcaatcactttaacgacttcgtgaacgccatcaagcaagagccccgacaacgagtggctgcagtaaaagatttaatacgacagctccctaagccaaaccaagatacgatgcagattctgtttcgccatctgcgccgtgttattgagaacggtgagaaaaaccggatgacgtaccaatctattgcaatcgtgttcggacctacactgctgaagccagagaaagaaaccgggaatatcgccgtgcataccgtgtatcaaaatcaaatagtcgaactgatcctccttgagctgtcatcaatctttggcagatag

SEQ ID NO: 238669 - DNA, 2526 bp, Artificial Sequence
  Description of Artificial Sequence: Synthetic coding sequence
atgaagatggccgatagaagcggaaagatcattccaggtcaagtgtacatcgaagtggagtatgactacgagtacgaggcaaaggatcgtaaaattgtaatcaaacaaggcgaaaggtacattttagtgaagaagaccaacgacgactggtggcaggtgaagccagacgaaaattctaaggctttttacgttccagcccagtacgttaaagaagttactaggaaggccctgatgcccccagttaagcaggtagccggtctgccaaataattcaaccaagataatgcaaagtttacacctgcagcgctccaccgaaaacgtgaacaagctcccagaattaagcagctttgggaagcctagctcttccgttcagggcacaggactaattcgcgatgccaaccaaaactttggaccctcttacaatcaaggccaaacggtgaatcttagcctggacctgactcataacaatgggaagtttaacaatgactcacattcacccaaggttagctcccagaaccgcacaaggagctttgggcactttcctgggccagaatttctggatgtggaaaaaaccagcttctcccaggaacagtcatgcgactcagcaggggagggatcagaacgcatccaccaggactccgagagtggggatgagctgtcctcaagctctactgagcagatcagggcaaccacaccgccaaatcaaggccgtccagacagccccgtatacgcaaacctccaggagctgaagatttcccagagcgcactcccaccactacccggtagtcctgccatacaaatcaacggcgaatgggagacccacaaggatagcagcggcaggtgctactactacaaccgaggcacacaggaacgaacttggaagccacctaggtggactcgcgatgcttccataagtaagggcgatttccagaacccgggagaccaagaactgctgtccagtgaggaaaactactacagtacttcctactcccagagtgacagtcagtgcggttcaccgccaaggggctggtctgaagagctggatgagcgagggcatacattatacacctcggactacacaaatgaaaaatggctaaaacacgttgacgaccagggcagacaatactattactccgccgacggctctaggtcagagtgggaacttccaaagtataatgcctcatcccaacagcagcgagagatcatcaagagccgaagcctggatcgcagactgcaagagcccatcgtcctgaccaaatggaggcactccactatcgtactagacactaatgataaagaatcacccacagcaagtaaaccttgttttcctgagaatgagtccagtccttccagccccaagcaccaggacactgaccaggaaaaatacggactgttaaatgtcactaagatcgctgagaacgggaaaaaagttagaaaaaattggttatcctcttgggcagtcctgcagggatccagcctcctcttcactaaaacacagggaagttcgaccagctggttcggaagtaaccaatctaagcccgaattcaccgtggacctaaagggggcaaccattgagatggctagcaaggacaagtcatccaaaaagaacgtgttcgaactgaaaacccgacagggcaccgaactactcatccagtccgataacgatacagtgattaacgattggtttaaagtcctgagctcaaccataaacaatcaggccgtggagacagacgaaggcattgaagaagagatcccagacagtcccggaatcgagaagcacgacaaggagaaggagcagaaggatcctaagaaactacggagttttaaggtttcttctattgatagctccgaacagaaaaaaacaaaaaagaacttgaagaaatttctgactcggaggcctacgctccaggctgttagggaaaagggttatattaaagatcaagtatttggatcaaacctggctaatctatgtcagagagagaacgggaccgtccctaagtttgtgaaactgtgcatcgaacatgttgaagagcacggtcttgatattgacggcatctacagggtgtcaggcaatctggccgtaattcagaagctgcgatttgccgtaaaccatgatgagaaacttgacttgaacgatagcaaatgggaagatattcacgttatcaccggagcccttaaaatgtttttccgtgagttgccagagcctctcttcaccttcaaccattttaatgacttcgtgaatgccattaaacaggaacccagacagcgcgtggccgctgtaaaagatctgattaggcagctgcctaaaccaaatcaggacaccatgcagatcctgtttcgacacctcagaagggtcatcgagaacggagaaaagaaccggatgacctaccagagcatcgcaatcgtgttcgggccaacactgctgaagccagagaaggaaaccgggaatatcgccgtgcatacagtgtatcagaaccagattgtcgaactgatcctcctcgagttgagttcgattttcggcagatag

SEQ ID NO: 238670 - DNA, 591 bp, Artificial Sequence
  Description of Artificial Sequence: Synthetic coding sequence
taaagcacgagctacagccaaagcgactctcaatgtgggtctccacccagagggtggagtgaagaattggatgagcgagggcatactctgtatacgagtgactataccaacgagaaatggttgaagcatgtggacgaccagggtcgccagtattattactccgcggacggttccaggtcagagtgggagctccctaagtataatgcctccagtcagcagcagagggaaattatcaaatccagatcattggataggagacttcaggagcctattgtcctaactaaatggaggcatagcacgattgtgctggacacgaacgataaggaaagcccaacagcctccaaaccatgctttcctgagaatgagtcaagtccttccagccccaagcatcaagataccgatcaggaaaaatacggcttactgaatgtaactaagatcgccgaaaatggtaagaaggtacggaagaattggctctcttcatgggccgtgcttcagggtagttctttattgttcaccaaaacccagggctcctctacgtcatggtttggttctaaccaatccaagccggagtttactgttgacctaaagtag

SEQ ID NO: 238671 - DNA, 2646 bp, Artificial Sequence
  Description of Artificial Sequence: Synthetic coding sequence
atgaagaagcaattcaatcggatgaagcagttggctaatcagacagttgggagagccgagaagacggaagtgctatcagaggacctgcttcaaatagaaagacgtctggatacggtcaggagtatttgtcaccattcgcacaagcgcctggtggcctgtttccaaggtcagcatggcactgatgccgaaaggaggcataaaaagctgccattgacagctctagcacaaaacatgcaggaagcttctacacaactggaggatagcctgttgggcaaaatgttagaaacctgcggggatgctgaaaaccagctggctctggagttatcccagcacgaagtgtttgtcgagaaagagatcgtagacccattgtacggtatcgctgaagttgaaattccaaacatccagaagcaaaggaagcagctggcccgtttggtcctggactgggactcagtgagggctcgttggaaccaggcacacaagtcaagcggtacgaattttcagggactgccatctaagattgatactctgaaggaggagatggatgaagccggtaacaaagtggaacagtgcaaggatcagctcgccgctgacatgtacaatttcatggccaaagagggcgaatatggcaagttctttgttacactcctcgaggcacaggctgattatcatcgcaaggccctagctgtgctcgagaagaccctgcccgaaatgagggcccaccaggataaatgggccgaaaagcctgcgttcggtaccccattggaggaacatttaaaacgctccggacgtgaaatcgccctaccaatcgaggcctgtgtgatgctcctccttgagaccggtatgaaggaagaggggttgttccgaattggcgctggggcttccaaattaaaaaaactgaaagctgcattggattgtagtacctctcacctcgatgagttctacagcgatccccatgctgtggcaggcgcactcaagtcatatcttagggagctgcccgagcccctgatgaccttcaacctttacgaggagtggactcaggtcgcgtccgtccaggatcaagacaagaaactccaggacctctggcgtacatgccagaaacttcctccgcaaaacttcgtgaattttcgttacctgattaaattcctggccaagcttgcacagacttcagatgtgaacaagatgacaccatctaacattgccatcgtcctcggcccaaatcttctctgggcgcgaaatgagggcacactcgctgagatggcggctgctacaagcgtgcatgtcgtcgcagttattgaacccatcatacagcacgccgattggttctttccagaagaggtggaatttaacgtttctgaggccttcgtgcctctgaccacccctagctcaaaccactctttccacactggaaatgattcagacagtggaaccctggaacggaagcggccagcctccatggcagtaatggaaggggacctggttaagaaagaatcgtttggggttaaactgatggacttccaggcacatcgaagggggggtacgttgaatagaaaacatatcagccctgcctttcagccacctctgcccccaactgacggcagtacggtggttcccgctggccctgaacccccaccacagagcagccgcgctgaatcttcatccggtggaggaaccgtgcctagcagtgccggaattctggagcagggaccaagtccaggagatggatctccacctaagcctaaggaccctgtttcagcggcagtacccgctcccggacgaaataactcacaaatcgccagtggacagaatcagccacaagctgccgcagggtcccaccaactttctatgggacaaccacacaacgccgctggaccctcccctcacaccctgcgcagggccgtcaagaagcccgcacctgcccctcccaagccgggaaaccctcccccaggccacccagggggacagagtagctctggaaccagtcagcaccctccaagcttaagccctaaacccccaactaggagcccatctcctcccacccagcataccggccaacctccaggacagccatcggcaccttcccaactatcagcacctcgacgctacagttcgtctctcagcccaattcaggcgccaaatcacccgccaccccagccgccaacacaggccacacccctgatgcacacaaaacctaattctcaaggccctccaaatcccatggcgctcccaagcgagcacgggctggagcagccaagtcataccccgccacagacaccgacacccccttcaaccccgccattgggcaaacaaaaccccagcttgcctgctccacagacccttgcgggaggtaaccccgaaaccgcccaacctcatgctggcacgctgcccagaccgaggcctgtcccgaagccgagaaatcgcccttccgtgcctcctccccctcagccacctggcgtccacagcgccggtgattcatcactgaccaatacggcccctaccgcgagcaagatcgtgacggatagcaatagcagggtgtcagagccccaccgatcgatttttcccgaaatgcatagtgactccgcctccaaggacgttcccggtagaatcctgttagacatcgacaacgatacagagagcacagcactttag

SEQ ID NO: 238672 - DNA, 2412 bp, Artificial Sequence
  Description of Artificial Sequence: Synthetic coding sequence
atgaaaaagcagtttaacagaatgaaacagctggctaaccagaccgtcggacgggctgaaaaaactgaggtactgagcgaggacctccttcagatcgaacggagactggataccgttagaagtatctgccatcattcacacaagagactggttgcatgttttcagggtcagcacggaaccgatgccgagcggagacacaaaaagctgccactcaccgcactggcccagaacatgcaggaagctagcacccagctggaggactccctgctcggcaaaatgcttgaaacctgcggggacgctgaaaatcagcttgcactagagctatcacaacatgaagtgtttgtggagaaggagatcgtggatcccttatacggaatagctgaggtggagatccctaatattcagaaacagcgtaaacaactggctagactggtgttagattgggatagcgtgagagcacgttggaatcaggcccataaatcatctggcacaaactttcagggcctgccaagcaaaatagatacattgaaagaggagatggacgaagccggaaataaggtggagcagtgcaaagatcaacttgctgctgatatgtacaactttatggctaaggagggcgaatatgggaaattctttgttactctgctggaagctcaggctgattatcacaggaaggctctagctgtcctggaaaaaactcttcccgagatgagggcacatcaagataaatgggccgaaaagcctgcctttggcacccctctggaggagcaccttaaacgctccgggagggagatcgcactccccattgaagcctgtgtgatgctgctcctggaaacaggtatgaaggaagagggactgtttaggattggggcaggcgcatcaaaattaaagaagctgaaggccgctctcgactgctccacttcacacctggatgagttttattccgatccccatgctgttgccggagcactcaagagttatctgcgtgaactgcccgagccgctcatgacctttaacttgtatgaggagtggacgcaggtggcatccgtccaggaccaggacaagaaattgcaggacctgtggagaacgtgtcagaagcttcctccacagaactttgttaactttaggtatctaattaagttccttgcgaaactcgcacagaccagtgatgtcaataagatgacaccctcgaatattgccatagtactgggccctaatctcctctgggcgagaaatgagggcactctggctgagatggccgctgctacttccgtccatgtggttgccgtcatcgagccgataattcaacatgcagattggttcttccccgaggaggtggaatttaacgtatccgaggccttcgtgcccttgaccaccccctcttcaaatcacagtttccacaccggaaatgattcagactctggcacactggagcggaaaagacccgcatcaatggccgtgatggagggagacttggtcaagaaagaaagcccacccaaaccaaaagatccagtatctgccgcagtgccggctccgggtcgcaacaactctcagattgcctctggccaaaaccagccccaggctgccgctggaagccaccagttgtctatgggccagccacacaacgctgccggaccgtccccccatactctccgaagagccgtgaaaaaacccgctcctgcaccaccaaagcctggaaacccccctccaggtcatccgggaggccagtctagctccggaacctcacaacacccaccttcactttcacccaaaccccctaccagatccccatcaccacctacccagcataccgggcagccccctgggcagccatcggccccttctcagctcagcgcgcctaggcgatacagcagcagcctctctcctatccaggctcccaaccaccctccccctcaaccgcctactcaagcaactccgctcatgcacaccaaaccaaactcgcaaggtccccctaacccgatggccctgcctagtgaacacggcctggagcagccttcccataccccaccgcagacccctacccccccatccacaccaccactgggcaaacagaacccatccctccctgcacctcagacgctggctgggggaaatcccgaaaccgcccagccacacgccggtactctccctcgacccagacctgtacccaaacctcggaaccgtccctctgtcccgccacccccacagccacccggtgtacatagcgccggtgactcctcactcacaaacacagctcccacggcgtctaagattgtgactgattctaattctcgggtatcagagcctcaccgctccattttccctgaaatgcacagcgattctgcctccaaggatgtgcctggacgcatcctgttagacattgacaacgatactgagagcactgccctgtag

SEQ ID NO: 238673 - DNA, 681 bp, Artificial Sequence
  Description of Artificial Sequence: Synthetic coding sequence
atgaaaaaacagttcaataggatgaaacagctcgccaaccaaaccgtggggagagccgagaagaccgaagttcttagcgaggacctcctccagatcgagcgcagactggacaccgttcgatccatctgccaccacagccacaagaggctggtggcatgcttccaggggcagcatggcaccgatgctgaacgcagacacaagaagttacccttaaccgccttagcccaaaacatgcaggaggcttcaacccagctggaggattctctcttgggcaaaatgctggaaacctgcggtgacgcagagaatcagttagccttagagctttcccagcacgaagtgttcgtggagaaagagatcgtcgaccctctttatggcatcgccgaggtggagattcccaatatacagaagcagcgcaagcagctcgcgcgtcttgtgctggattgggactcagtccgggctagatggaaccaggcccacaagtcgtctggcacaaacttccaaggcctccccagcaaaatcgacacactgaaggaggaaatggacgaggccggaaacaaagtcgagcaatgcaaagatcagctggcagcagacatgtacaatttcatggccaaggagggggagtacggcaagttctttgttacaatctccggcaggaagaaccaacccctgggactcccttag

SEQ ID NO: 238674 - DNA, 2523 bp, Artificial Sequence
  Description of Artificial Sequence: Synthetic coding sequence
atgaaaaaacagttcaacagaatgaaacagctcgccaatcaaacagtgggacgtgccgagaaaactgaggtcctgtccgaggacctgctgcagattgaacggcgattggacaccgtccgcagcatttgtcaccactcacataagcggctggtcgcctgcttccaaggacagcacggaacagatgccgagaggcgccataagaagctcccactgacagccctcgcccagaacatgcaggaagcctcaacccaactggaagattctctcctcggcaagatgctagagacatgtggagatgctgagaatcagcttgcgctggagctcagccagcacgaggtcttcgtggaaaaggagatcgttgatcctttgtacggcattgctgaagtcgagattccaaatatccagaagcagagaaaacaacttgccaggctcgtattagactgggatagcgtgcgcgctcgatggaatcaggcccacaagagcagcggaactaacttccagggcctccccagcaagatagacaccctgaaagaggaaatggacgaggctgggaacaaggtcgagcagtgtaaggaccagctggcagctgatatgtataacttcatggctaaagagggcgagtatgggaagtttttcgtaactttgttggaagcgcaggcggattaccatcgtaaagcattagccgtgctcgagaaaactcttcctgagatgagagcccatcaggacaaatgggccgagaaacccgcatttgggactcccttggaggaacatctgaaaagatccggcagggagatcgcactgcctatcgaagcctgcgtgatgctgttactggagaccggcatgaaagaagaggggctctttaggatcggcgcaggtgcttctaaactgaaaaaacttaaagccgctctggattgctccacatcgcacctggatgagttttatagtgacccgcacgccgtggcaggtgccctaaagagctatcttcgcgagctccctgagcccctcatgaccttcaatctgtacgaagaatggacccaggtcgcctctgtacaggatcaagataaaaaacttcaggacctatggagaacatgccaaaagttaccaccccagaattttgttaatttcaggtatctgattaagtttctcgccaagcttgcacagacatccgatgttaacaaaatgaccccaagtaatattgctatcgtgttgggccctaacctcctgtgggcgcgtaatgagggtacactggccgagatggctgctgccacatccgtgcacgtcgtggccgtaattgaaccaataattcagcatgccgattggttcttccctgaagaagttgagttcaatgtgtccgaggcttttgttcccttgacaacccctagcagcaaccactcattccacacaggaaacgacagcgactcaggcacactcgagaggaagcggccagcatccatggcagtcatggaaggagaccttgtgaagaaagagtctttcggcgtgaagcttatggactttcaagctcacagacgtggcggtacgctcaataggaagcacatttccccagcattccagcctcccctgccaccaaccgacggaagcacagtggtgcctgctggcccagagccccctccgcagagcagcagagcggagagttctagcgggggtggcactgtgccctccagtgcgggaatcctagagcagggtccaagccctggcgacggcagccctcccaaacctaaggatcctgtgtcagcagccgtaccagcacctggcaggaataattcccagatagcatccggccagaaccagcctcaagccgctgccggatcccatcaattaagtatgggccagccccacaacgctgccggaccctcaccacacactttgcgcagagctgtcaaaaaacccgctcctgccccacctaagccgggaaatccccctcccggacatccaggaggtcagagtagctctggcactagtcaacacccaccaagtttatctcctaaacctcctacacgaagcccttctcctccaacacagcatacaggacagccccctgggcagccgtccgccccaagccagcttagtgccccaagacggtattcatcaagtctgtctcccatccaggcaccaaatcaccctccacctcagccccctacacaggccacccctttaatgcacaccaaacctaactctcagggaccacccaacccgatggccctaccttcagagcatgggctggagcaaccatcacacacccctcctcagacccccacaccgccatccacaccacccctgggtaagcaaaatccctcactgccagcaccacagactctggcagggggtaacccagaaaccgcccagcctcatgccggtaccctcccacggcctagaccagtaccaaagccaaggaaccggcctagcgtgccgcctcctccacagcctcctggggtccactccgcaggcgactcctccctgactaacactgcgccaactgcgagcaaaatcgtaacaggtgtgtag

SEQ ID NO: 238675 - DNA, 1992 bp, Artificial Sequence
  Description of Artificial Sequence: Synthetic coding sequence
atgtcttggctgagctcttctcaaggtgtggtgctgaccgcgtaccatcccagcggtaaggatcagaccgtcggaaacagtcacgccaaggccggagaggaggctacaagcagcagaagatatggacagtatactatgaaccaggaaagcactaccatcaaggtgatggagaaaccgcctttcgaccggtccatctcccaggacagcctggacgaactgagcatggaagactactggatcgagttggaaaatatcaaaaaaagttcagaaaactcacaggaagaccaggaagttgtcgtagtcaaggagcctgacgaaggcgaactagaggaagaatggttaaaggaagcaggcctaagcaacctatttggggagagtgctggcgaccctcaagagtccatcgtgtttctgtctactctgactcggacccaggccgctgccgtgcagaaacgcgtggaaactgtgtctcagacactgcgtaagaagaacaagcagtatcagataccagatgtgcgagatatcttcgcccaacagcgcgagtcaaaggagacggcgccaggagggacggaaagccagtcgctgcgcaccaacgaaaataagtaccaaggtcgcgacgacgaagcgtccaaccttgtgggggaagagaaactgatccctccagaagaaacccctgcccctgagactgacatcaatttggaagtttcattcgccgagcaggcgttgaatcagaaagaaagctccaaagagaagatccagaagtctaaaggggacgacgcgacactgccatccttccgacttcccaaggataagacgggtaccactcgaattggcgatttagcgccacaagatatgaaaaaagtgtgccatctggcactcatcgaactgactgctctgtacgacgtgctcggcatcgaactcaaacaacagaaggccgtgaaaataaaaacaaaggactccgggctgttttgcgtgcctctaaccgctctcttagagcaggatcagaggaaagtgccaggcatgaggataccactgatattccaaaagctgatcagccgcatagaggagcgtggattggaaaccgagggcctgctgagaatccctggagccgctattagaattaagaacctttgccaagaactggaagctaagttctatgaagggactttcaattgggaatccgtgaagcagcacgatgccgcttctctcctcaaactgtttattagggagctaccccagcctctcttatctgtggaatacctgaaggctttccaggcagttcagaacttgcccactaaaaaacaacagttgcaggcccttaatcttctagtgattcttttgcccgatgccaatagggacacactgaaggccctgctcgaattcctgcaacgcgtgatagacaacaaggagaaaaacaagatgacagttatgaatgttgccatggttatggctccgaacctgttcatgtgtcacgcactaggactgaaatcctcggaacaaagggaatttgtgatggctgccggtacagcaaatacgatgcacctgctgattaagtaccagaagctgctctggacaattcccaagttcatagtcaatcaggttagaaaacagaacacagaaaaccacaagaaggataaacgggctatgaaaaagctcttaaaaaaaatggcctatgatcgagagaaatatgagaagcaggataagagtacgaacgacgcagatgttccacagggagtgatacgggtgcaagcccctcacctgagcaaggtctcaatggctatccagctgactgaggagctaaaggcctctgatgtgttagcccgttttttgagtcaagagtctggcgtggctcagactctgaagaagggcgaagtgtttctgtatgagattggcggaaatatcggagagaggtgcctggatgacgacacttacatgaaggacctgtaccagctgaatcctaacgccgaatgggttattaaatcaaaacccctgtag

SEQ ID NO: 238676 - DNA, 1857 bp, Artificial Sequence
  Description of Artificial Sequence: Synthetic coding sequence
atgaatcaggaatccacaaccattaaggtcatggagaagccccctttcgaccgcagtatcagccaggacagcctcgacgagcttagtatggaggactactggattgaactggagaacatcaagaaaagttccgaaaattcacaggaggatcaggaggtggtggtggttaaagaaccggatgaaggcgagctggaagaggaatggcttaaagaggccggtctgtccaatctgttcggcgaaagcgccggtgatccgcaggaatccattgtgttcttgtcaacccttactcggactcaagctgccgcagtgcagaaacgggtggagactgttagtcagactttgcggaagaaaaataaacagtatcagatcccagatgtgcgagatatctttgctcaacagcgagagtctaaggaaacggctcctgggggtacggagtcccagtccctgcggactaatgaaaataaataccaagggcgagatgatgaagctagcaatcttgtcggcgaagagaagctcatccccccagaagaaactcctgccccagagactgacatcaatctggaggtctcatttgcagagcaggctctgaatcagaaagagagttccaaggaaaaaattcagaagtcaaagggagacgacgctactttaccttcctttcgcctgccgaaagacaagacaggtactactcggattggcgacctggctccacaggatatgaagaaggtgtgccacttggcactgatcgaattgaccgctctgtatgatgtcctcggcattgagttaaagcaacagaaagccgtgaagatcaagacgaaagacagtggactcttttgcgtccctctgacagccctcctggagcaggaccaacgaaaggtacccggtatgcggatccccctgatattccagaagctgatttcaaggatagaggagcgaggactggaaacggaagggttgcttcggattccaggtgcagcgatccggattaagaacctgtgccaggaacttgaggctaaattctatgaggggaccttcaattgggaaagcgtgaaacaacacgacgccgctagcctgttaaagttgtttatcagggagttacctcaacccctgctgtccgtggagtacctcaaagccttccaggcggtacaaaacttgccgaccaaaaaacagcagctgcaggccctgaatcttctcgtaatcctccttcctgatgccaaccgcgacacactcaaggcactattggagtttttgcagcgggtcatcgacaataaggaaaagaacaagatgacagtgatgaatgtggccatggtaatggcccctaatcttttcatgtgccatgccctgggcctgaagtcctctgagcaacgggagttcgtaatggccgcaggcactgccaatactatgcaccttttaataaaataccaaaagctgctctggacaattccgaagttcatcgtgaaccaagtgcgtaagcagaatacagagaaccataaaaaggacaagcgggctatgaaaaagctgctgaaaaagatggcttatgaccgggagaaatacgaaaagcaggacaaatctacaaacgatgccgacgttcctcagggcgtcatacgagttcaagcacctcatctgtcaaaagtgtcgatggctatacagctgactgaggagctcaaggcgagcgatgtgctggctcgattcctcagccaggagtccggagtggctcagactctgaagaagggagaagtttttctgtatgaaatcgggggaaatatcggagagagatgtctggatgacgacacatatatgaaagacctctaccagctgaacccgaatgcagaatgggtgattaaatctaaaccattgtag

SEQ ID NO: 238677 - DNA, 1485 bp, Artificial Sequence
  Description of Artificial Sequence: Synthetic coding sequence
atggccactgaggcccaaagcgagggcgaagttcctgccagggaatctgggcgatctgacgccatatgctcatttgtgatctgtaatgatagctctctgcgtgggcagcccatcatctttaatcccgacttttttgtagaaaagctgcggcacgagaagccggagattttcactgagctcgtcgtgtcaaacatcaccaggctgatcgacctgcccggtacagagttggcccagctgatgggtgaggtagatctgaaacttccagggggagctggcccagcctcggggttttttcggtctttaatgagcctgaaaaggaaggagaagggcgtgattttcggttcgccactcaccgaggaaggaatcgcccagatttatcaactgatcgagtatctgcacaaaaatttgagagtcgaagggctgtttcgtgtacccggaaactcagtccgccagcagatcctgcgtgatgccctgaacaatgggactgacatcgatctggaatcaggcgagttccacagcaatgatgtcgccacactgctgaaaatgttccttggggagctgcctgagcccttactgacacataaacacttcaacgcgcatttaaagatcgccgacctcatgcagttcgacgacaaaggaaacaagaccaacatacctgataaagatcgacagatcgaggcccttcagttattatttctgatactcccaccacccaatcgtaacttgctgaagctgctactcgacttgttgtaccagaccgcgaaaaaacaggacaaaaacaaaatgagtgcatataatttagccttaatgttcgcgcctcatgttctctggcccaagaacgttaccgccaatgacctccaggaaaacataaccaagctgaatagcggtatggccttcatgattaaacactcacaaaagttatttaaggccccagcctacattagagagtgtgctcggttacactatctaggctcaagaactcaggcgtctaaggacgatcttgacttgattgcctcttgccacactaagtctttccagcttgctaaatctcaaaagcggaaccgtgttgacagttgtcctcaccaggaggagacacagcaccatacagaggaagcactgcgtgagctcttccagcatgttcacgatatgcccgagagcgctaagaagaagcaattgattcgccaattcaataaacaaagcttgactcagacccctgggagggagcccagcaccagccaggtgcagaaacgagccagaagtcggtccttttctggcctgatcaagagaaaggtattgggcaaccagatgatgagcgaaaaaaaaaagaagaatcctacacccgaaagcgtggccatcggggaactcaagggaacatctaaggagaacaggaacctgctgtttagtggcagtcctgcggtcacaatgacgccaacccgtctgaaatggtcagagggcaagaaggaagggaagaaggtattcctctag

SEQ ID NO: 238678 - DNA, 1458 bp, Artificial Sequence
  Description of Artificial Sequence: Synthetic coding sequence
atgcctcaccagaagttaagcgctctgattgacgctatttgctcatttgtgatctgcaacgatagcagtttgcggggtcagcctataatatttaaccctgatttcttcgtggaaaagctcaggcatgaaaagcccgagattttcactgagctggtggtgtcaaatattactcgcctcatagacctgccaggaacagagctggcccagttaatgggcgaagttgatttgaaactgcctggaggggcaggacctgcttccggatttttccgctcattaatgagcctgaaaaggaaagagaaaggggtgatctttggctctccccttacagaggaaggcatcgcacaaatctatcagctgattgaatatttgcacaagaacctacgagtggagggactctttcgcgtgcccggaaattctgtgcggcagcaaatcctgagggacgctctaaacaacgggactgacattgacctcgagtccggtgaattccactccaacgacgtggcaactctattgaagatgttcctgggcgagcttcctgaacccctgcttacgcacaagcactttaacgcacacctcaagatcgcggacctcatgcagtttgacgataagggcaataagaccaacatcccagacaaggaccgccagattgaggccctgcagctgcttttcctgattcttcctccccctaatcgcaatctactgaagctgttgttggatttgctctatcagacagcgaagaagcaggacaaaaacaagatgagtgcttacaatcttgcactgatgtttgcccctcacgtcctgtggcctaaaaacgtgactgccaacgatttgcaggagaatattactaaactgaattctggcatggcgttcatgatcaagcactcacagaagcttttcaaggcgccagcctacatacgagaatgcgccaggctccattatctaggatccaggactcaggccagcaaagacgacctggacctgattgcttcttgtcacacaaagtccttccagttggccaaaagccagaagcggaaccgcgtggattcctgtccacaccaggaggagactcagcaccataccgaagaagcactgagagagttgttccagcatgtgcatgacatgccagaaagtgccaaaaagaagcagctgatccggcagtttaacaaacagagtttgactcagacgccagggcgtgagccatccactagtcaggtgcaaaagcgagctcgatctcggtccttctccgggcttatcaagcggaaggttttagggaatcagatgatgtcagagaaaaagaagaagaacccaaccccagaatccgttgccatcggggaacttaaaggcacctcgaaggaaaaccggaatctgctgtttagcggttcgcccgcagtcactatgaccccaacccgactgaaatggtcagagggtaaaaaggagggcaaaaaggtgttcctctag

SEQ ID NO: 238679 - DNA, 1398 bp, Artificial Sequence
  Description of Artificial Sequence: Synthetic coding sequence
atggctactgaagcgcagtccgaaggagaggtgcctgcacgggaatctggtcgcagcgacgccatttgctcctttgttatctgcaatgattcttctcttagggggcaacccatcatcttcaaccccgattttttcgtagagaagcttcgtcatgagaagccggagatttttacagagctggttgtaagtaacattaccaggctgatcgacttgcctggtaccgaactggcccagctgatgggagaagtcgacctgaagctcccaggtggcgcagggcctgcctctgggtttttccgctctcttatgtccttgaaaagaaaggagaaaggcgtaatctttgggtcccctctcactgaagagggcatcgcacagatctaccagcttatcgaatatctgcacaaaaacctgagggtggagggcctgtttagggtacctggaaatagcgtgcggcagcaaatcttgagggacgccctgaataatggcactgatatagatctggagagtggcgaattccacagcaacgatgttgctaccttactgaagatgttcttaggcgagctcccggagcccctgttaactcataaacattttaacgcccacctgaagatagctgatctgatgcagttcgacgacaaaggaaacaagactaacatcccggataaggatcgccaaatcgaggcactgcagctactgtttctgatactacctcccccaaataggaatctgctgaaattgttgctggatttgctgtatcaaacggctaagaaacaggacaagaacaaaatgagcgcttacaacctggcccttatgttcgccccacatgtcctgtggccaaagaatgctccggcatacattagagagtgcgcccgactgcactacctgggatcgagaactcaagcgtctaaagatgatttggatttgatcgcctcctgccacacaaaaagctttcaactagccaagtcccagaaaagaaaccgggtggattcttgtccacatcaggaagaaacgcagcaccacacagaggaggccttgcgagaactgttccagcacgtgcatgatatgcctgaaagcgctaaaaaaaagcagttgatccggcagttcaacaaacagtctctcacccagacccccggaagagaaccatctaccagccaggtgcagaagcgggcaaggtctcgcagcttttcagggctcatcaaaaggaaggtacttggaaatcagatgatgtccgagaagaagaagaagaatcccacccccgagagtgtggcaatcggtgagctgaaggggacaagcaaagagaatcggaacctgctctttagcggaagcccggcagtcactatgacaccaactagactcaagtggtccgagggtaaaaaagagggaaaaaaggcctttgtatag

SEQ ID NO: 238680 - DNA, 1485 bp, Artificial Sequence
  Description of Artificial Sequence: Synthetic coding sequence
atggccactgaggcacagagtgagggtgaggtccctgctcgtgagtccggacgaagtgatgccatttgctcctttgtgatttgcaatgatagctctctgaggggacaacctatcatctttaatcccgatttctttgttgagaagctaaggcatgagaagcccgagatctttacagaactcgtggtttcgaatatcactcggctgatcgatcttcccggaacggagctagcacagctcatgggagaggtagatttgaagttgcccggaggagctggcccagctagtggcttcttccgatcgctgatgtccctgaagcgcaaggagaagggcgtaatctttggatcccctcttaccgaggagggaatcgcgcaaatatatcagctaatcgaatacctgcacaagaatttgagagtagaaggtctttttcgcgtgcccggaaatagtgtaagacagcaaattctacgagatgcattgaataatggaaccgatatcgacctcgagagtggtgaattccatagtaatgacgtggccacactccttaagatgttcttaggagaactgcccgagcccctactgacccacaagcatttcaatgcgcatcttaaaattgcagacttgatgcagttcgacgacaaaggaaataagacaaacattcctgacaaggatcggcaaattgaggcactccagctccttttcctgattctgcctcccccaaacaggaatttgttaaagctcctgctcgacttgttgtaccagaccgcaaagaagcaggataaaaacaagatgtctgcctacaaccttgccctcatgttcgcaccccacgtgctttggcctaagaatgtgacagcaaacgatctacaggagaacatcacaaagcttaactccgggatggccttcatgataaaacattcccaaaagctgtttaaagcgccagcctacatccgggagtgcgctcgactacattacctcggctcgagaacccaggcgagtaaagatgacctggacctcatagcaagctgtcacacaaagtcgtttcaactagcgaagagccaaaagcgaaatagggttgactcctgtccccaccaggaggagacacagcaccataccgaagaggccctacgcgaactgttccagcacgtccacgatatgcctgaaagcgcgaagaaaaagcaactgataagacagttcaacaagcaaagccttacacaaacaccgggacgagagccatccacgtcgcaggtccagaagcgagcaaggtcccgctcattctcaggactgattaaacgcaaggtcttggggaaccaaatgatgagtgaaaagaaaaagaaaaatcccacaccagaatctgtcgcaattggtgagcttaagggaacctcaaaagagaaccggaacctgctgttctcagggagccccgcagttaccatgactcccacaagactgaagtggtctgagggtaagaaggaagggaaaaaaggtttcctctag

SEQ ID NO: 238681 - DNA, 1458 bp, Artificial Sequence
  Description of Artificial Sequence: Synthetic coding sequence
atgcctcatcagaagctgagcgcactgattgatgctatatgctccttcgtgatatgtaacgattcatctctgagggggcagcccatcatctttaatcctgactttttcgtggagaaactgcgccatgagaaaccagaaattttcacggaactggtcgtttcaaatatcacccgcctcattgatctcccagggaccgaattggcccagcttatgggcgaggtcgacctgaagttacccggaggagcagggccagcctccgggttttttcgcagcctaatgtcactcaaacgcaaagaaaagggtgtcatcttcgggtcccccctgactgaggagggaattgctcaaatttatcaactcatcgaatatctccacaagaatctgagggtggagggtctgtttcgtgtcccgggaaacagtgtgaggcagcagattctacgtgatgccctgaataacggtaccgacatcgatctcgagtctggagagttccattctaacgacgtggcaaccttgctcaaaatgttcctaggggaactgcccgagcccttattaactcataagcatttcaatgcgcatttgaagatcgccgatctgatgcagttcgacgataaagggaacaagaccaacattcccgataaagaccggcagatagaggccttacaacttcttttcctaattctgccccctcccaacaggaacctgctcaagctgcttctggacctgctgtatcagaccgctaaaaagcaggataaaaacaagatgtctgcatataacctggccctcatgttcgctcctcatgttctgtggccgaagaatgtcaccgccaatgacttgcaggaaaatatcaccaaactcaattcgggtatggcattcatgattaaacactctcagaagctgtttaaagcccctgcttatatacgggaatgcgctagacttcactacctggggtccagaacccaggccagtaaagatgacttggacctgattgccagttgccatacgaagagtttccaattggctaaatcccaaaaaaggaacagggtggactcttgcccgcaccaggaagaaacacaacaccatactgaagaagccttgcgtgaactgttccagcatgttcatgatatgcccgaaagtgcgaagaagaagcaacttataagacagtttaacaagcaatcactgacacagacccccggtagagaaccttcaacctcgcaggtgcagaagagagccagatctaggagtttttccgggctgataaagcgaaaagtactcgggaaccagatgatgtcagagaaaaagaagaaaaatcccacccctgaatcggtggccatcggtgagctcaaggggacctcgaaagagaatcgcaatctgctgttctctgggagccccgcagtcactatgacccccacccgactgaagtggagcgagggaaagaaagaaggcaagaagggattcttgtag

SEQ ID NO: 238682 - DNA, 942 bp, Artificial Sequence
  Description of Artificial Sequence: Synthetic coding sequence
atgttcctgggtgagctccccgagcctctgctgacccataagcactttaacgctcacctgaagatagcagacttgatgcagttcgacgataagggcaataagaccaacatccccgataaggaccgacagattgaagccctccagctgctgttcctgattttaccgcctcccaatcgaaatttgctcaagttattacttgacctgctttaccagaccgctaagaaacaggataaaaacaagatgagcgcttacaatcttgctttgatgttcgccccacacgtactatggccaaaaaatgtcacggcgaacgacctacaggagaatatcaccaagctcaacagcggcatggcctttatgataaagcactcccaaaaactcttcaaggcgcctgcgtacattagagaatgcgccaggcttcattacctggggtcccgtacacaagcgagcaaggacgacctggacctgatcgcatcatgccacacaaaatccttccagcttgcgaaaagtcaaaagcggaaccgcgtggattcttgcccccaccaggaggagactcaacaccacacagaagaggccctccgtgaactgtttcagcatgtccatgacatgcccgaaagtgcaaagaaaaaacagctgatccgacagttcaacaaacaatccctgacccaaaccccaggcagagagccctcgactagccaggtccagaaacgggcaagatctcgaagcttcagcggcctaatcaagagaaaggtcctagggaatcagatgatgtctgagaagaagaagaagaatccgacgcctgaaagtgtggcgataggggaattaaaagggaccagcaaagagaataggaacttgctgttcagcggatctcccgctgtcaccatgacaccaacccggctgaaatggtcggaaggcaagaaagaaggcaaaaaaggcttcttatag

SEQ ID NO: 238683 - DNA, 1554 bp, Artificial Sequence
  Description of Artificial Sequence: Synthetic coding sequence
atggccacagaggcccagagcgaaggtgaggtgccagcccgagagtcaggacgctctgacgccatctgctcctttgtgatatgcaatgattcaagtcttaggggccagcctattatctttaatccagatttttttgtggagaagttgagacacgaaaaaccagaaatctttaccgagttggtcgtgagcaatatcacccgtctcatcgacctacctggcactgaactggcacagctgatgggggaagtcgacttaaagttaccagggggagcaggtcctgcctctggcttcttccggagcttgatgtcccttaagaggaaagagaaaggcgtaatattcggttcccccctgaccgaggaagggatcgcccagatctaccagctgatcgagtatttgcacaagaatctgcgtgtcgagggactcttccgtgtgcctggcaacagcgttaggcagcagatacttagggatgccctcaacaacggaactgacatcgacctagaaagcggtgaatttcactctaatgacgtggctactttgctgaagatgttcctgggggaactgcccgagccattgctgacgcacaagcacttcaatgcacaccttaaaatcgccgatctcatgcaatttgacgacaagggcaataaaacgaacattcccgacaaagacagacagatcgaagccctgcagttgctgttcctaatccttccaccgcctaacagaaatctgctgaaattgttactagacctgctgtatcagacagcaaagaagcaggacaaaaataaaatgagcgcctacaaccttgccttgatgttcgcaccccacgttctgtggcccaagaatgtcacggcgaacgatctccaggaaaacatcactaaactcaactcaggtatggcatttatgatcaaacacagtcagaagctgttcaaggcccctgcctacattcgagaatgcgctaggctccattacctcgggtctcggactcaggcctccaaagatgacttggatctaatcgcatcctgccacaccaagtcctttcagctggctaagagccagaagcgtaacagagtggactcttgtccccaccaggaagaaacccagcaccacactgaagaagctctgagggaattgttccagcacgttcatgatatgcccgaaagcgcaaagaagaagcaattaatacggcagttcaataaacagtctttaacacagacacccggacgcgaaccttctactagtcaggtacaaaaacgagcgaggtcccgctccttcagcgggttaattaaacgtaaggttttgggcaatcagatgatgtccgagaagaagaaaaagaacccaacacctgaatcggtggccattggagagcttaaaggtacaagtaaggaaaacagaaatttacttttctccggtagtcccgctgtgacaatgacacccacccggctcaagtggagtgagggaaaaaaagaaggcaagaaagggaattctatggcaacgacatccttggggtctatccgaatgacccttaggggaagtagttcttgcggttgttgttcatag

SEQ ID NO: 238684 - DNA, 3654 bp, Artificial Sequence
  Description of Artificial Sequence: Synthetic coding sequence
atggcacagcctgtggaaattagtcccccagattcaagcttgtcaaaacagcagaccagcacaccggtgctgacccaacccggtagggcctaccggatggagatccaagtgccaccttcaccgacggatgttgctaaaagcaataccgccgtgtgcgtgtgcaacgaatccgtgcggaccgtgattgtgcctagcgaaaaggtcgtggatcttctttccaatcggaataatcatacagggccatcgcatagaactgaggaagttaggtacggcgtgagcgagcaaacctcattgaagactgtgtcccggacaacgagcccgccactgtcaattcctaccacacacttgattcaccagcctgcgggaagtagaagcttagagccatccgggattcttctcaagagcggtaactacagtggtcactccgatggaatctcctcttcacgaagtcaggccgttgaggctccgagcgtctccgtaaaccattactccccgaattcacaccagcacattgattggaaaaattacaagacttataaagagtacattgataatcgaagattgcatattggctgtcggacaattcaggaaagactggattcactcagagctgccagccagtctacaacggactataaccaggtcgtaccaaaccgtacgacacttcagggacgacggagaagcactagtcacgaccgagttcctcaatcggtgcaaattaggcagcggagcgtctcacaggagagactcgaagactcagtactaatgaaatattgccctcgctccgcaagccagggggcactgacctctccgtcagtatctttctcaaatcaccggacaagatcatgggactacattgagggccaagacgagaccctggaaaacgtgaattctggaacacccattccggactccaacggagaaaagaaacaaacatacaaatggtctgggttcacggagcaagacgatcgcagagggatctgcgaacgacccaggcagcaggagattcacaaaagcttcaggggaagcaattttacggtggccccaagcgtagtaaactccgacaacaggagaatgtcaggacgcggtgtgggatccgtaagtcagttcaagaagattccacctgacttaaagacactccagtccaacagaaattttcagacaacatgcggtatgtctctgccacgaggcatttcccaggaccgatcgcccctggtgaaagtccgaagtaacagtctgaaagctccctctactcatgtgacaaaaccttctttctcccagaagagtttcgtcagtattaaagaccagcgcccagtgaaccacctgcaccagaactcattgcttaatcagcagacgtgggtgcggacagattccgcaccagaccaacaagtggagactggtaagagtcctagcctgtccggcgcatccgccaagccagccccacaatcatctgaaaatgcaggcacgtcagacctggagctcccagtttcgcagcgaaaccaggacctctccctacaagaggccgagactgagcaatccgacacgctggataacaaggaagcagtgatacttagggagaagccacccagtggaagacaaacccctcagcctctccgccaccagagttatatcctcgcagtaaacgaccaggaaaccggttccgatacaacttgctggctccctaatgatgctcgacgggaggtacatatcaagcgcatggaagaacgaaaggccagcagcacgtctcctccgggagacagcttagcttcgatcccatttattgatgagccgacatctccctctatagaccatgatattgctcatataccagcgtcagccgtgatatctgcctccacctctcaagtgcccagcatcgcaacagtaccaccctgtttgacaacgtccgcccctctgatccgaaggcaactctctcatgaccacgagtctgtcggcccaccatccttggatgcccagccgaattcaaaaaccgagcgtagtaaatcatatgacgagggcctggacgactatagggaagatgcaaagctgtctttcaagcacgtgtcatccttgaaaggcatcaagattgctgacagccaaaaaagctctgaagattcgggcagtcggaaggacagtagctccgaagtcttcagcgacgcagcaaaagaagggtggctgcactttaggcccctggtcaccgataaaggaaagagggtcgggggtagcatacggccttggaagcagatgtatgtggtacttcgtgggcacagcctctacctatataaggataaacgagaacaaacaacaccaagtgaagaagaacaacctatctccgtgaatgcttgtttgatcgacatctcatatagcgagacaaagagaaagaatgtattcaggctgactacctccgattgtgagtgcttgttccaggctgaggatcgcgacgatatgcttgcttggatcaagaccatccaggagtcctccaatttaaatgaagaggatacaggagtgaccaatcgggatttgattagcaggaggattaaagagtataataatttaatgagtaaagcagagcaattacctaaaacgcctagacagtccctgagcatcagacagactctgctgggagcgaagtccgaacctaaaacccagtccccgcactctccaaaagaggagtccgaaagaaagctgctgtccaaagacgatacctctccacccaaggataaaggcacgtggagaaagggcatcccgagcatcatgcggaagacctttgagaaaaagcccacggcaacgggcactttcggcgtgcggcttgacgattgccctccagcccatacgaacaggtacattcccttaatagtggatatatgctgtaaactggtggaggagcgcggtttggaatatacaggtatctaccgagtacccggtaataatgctgccatcagcagtatgcaggaagagcttaataaagggatggctgatatcgatatccaggatgataagtggcgggacctgaatgtcatatcatctctactgaagtcttttttcagaaaactgcccgagcctctttttaccaacgataagtatgccgactttattgaagccaatagaaaggaggacccgcttgacagactaaagacccttaagcgacttattcatgatctaccagaacaccattatgagaccctgaagttcctatctgctcatctgaagaccgttgccgaaaattctgaaaagaacaagatggaacctcggaatctagccatagtgtttggtccgactctggtgcgcaccagtgaggataacatgacgcacatggtaacacatatgccagatcagtacaagattgtcgagacacttatccaacaccatgattggttctttacagaagaaggtgccgaggagccactgaccactgtccaagaggaatccactgtggactcccagcctgtcccgaacatagaccacctcttgactaatatcggaaggactggggtgtctcctggcgacgtaagcggcgaggtcggaggggtctaccatacagtgatgtctttggtagactccgtgatgtcgctgatggattcttggaattgcaggaagaaggaagactgctgccctcactgctcgtgcttggtttgccggaatcctcggttcttgtag

SEQ ID NO: 238685 - DNA, 3498 bp, Artificial Sequence
  Description of Artificial Sequence: Synthetic coding sequence
atgatggccacacgcaggactgggttgagcgaaggtgatggcgacaagctcaaggcatgcgaagtcagcaagaataaagacggcaaagagcagtctgaaaccgtaagtctgtccgaggacgaaacgttttcctggcccggaccgaagaccgtgactctcaaaaggacttctcagggctttggcttcaccttaagacacttcattgtgtatccgcctgaatcagccatccaattttcatataaggacgaggagaatggcaataggggcggaaagcaaaggaaccgtctggagcctatggacacaatcttcgtcaagcaggtaaaagagggtggccctgcgttcgaagcaggcctctgcactggtgatcgcattatcaaagtgaatggggagagtgtcattggaaaaacgtattcccaggtgattgccctgatccaaaactccgacacaactcttgaactgagtgtgatgccaaaggacgaggatatcctgcaagtggcttatagccaggatgcatatcttaagggaaacgaggcttatagcggtaatgctaggaacattccagagcctcccccaatatgttacccatggctgcccagcgccccttccgctatggctcagcctgtggagattagccctcctgacagttcactcagtaaacagcagacctcaacgcctgtgctcactcagcctgggagagcttatagaatggaaatccaggtgcctcctagccctactgatgtggcaaagtcaaacacagcagtgtgtgtttgcaacgaatccgtcagaaccgtcatcgttcccagcgagaaagttgtggacctgcttagtaaccggaataatcataccggtccctcccatagaacagaggaggtgcgatatggagtttctgaacaaacctccctgaaaactgtcagtaggaccacttctcccccattgagcatccctacaacgcacttgattcatcagccggctggcagccgttccctggagccttccggcatcttgctaaagtccggcaattacagcggccattcggatggaatctcatcctcgagatcacaagccgtagaggctcctagtgtgtccgtcaaccactattcacctaattcccaccagcacattgattggaagaattacaaaacatacaaagagtatattgataaccggaggctgcacataggatgccgaacaatccaggaacgccttgactctctccgagcggcttcccagtccaccacggactataatcaggtggtcccaaacaggaccacactgcaggggcgtcgtagaagcacctcgcacgatcgggtcccccaaagcgtgcagatccgtcagcgcagcgtatcacaagagcgactggaggatagcgtccttatgaaatattgtcctaggtccgcctcccaaggcgcactgacctcaccatcggtaagtttcagcaaccaccgcactcgaagctgggattatattgaaggccaggatgagacactggaaaacgtgaattcaggaacccctatccctgacagtaacggtgagaagaagcaaacgtataaatggtcaggcttcactgagcaggatgaccggcgaggcatctgtgaaagacctcggcagcaagagatccataaatctttcagagggagtaattttaccgtggcgccaagcgttgtgaactcggacaaccggcgaatgtccgggaggggcgtcggaagcgtctcccagttcaagaaaatcccccctgatctcaagacattgcagtcgaaccgtaacttccagaccacgtgcggcatgtctctgcccagaggcatcagtcaggatcgttcacctctagttaaagtgcgtagtaactcactgaaagcccctagtacgcacgtgacgaagcctagcttctctcagaaaagttttgtctctatcaaagaccagaggcctgtgaatcatttacatcagaatagccttctgaatcagcagacctgggtccggacagattcagcacctgaccagcaggtggaaaccggcaagagcccctctctttcaggggctagtgccaagccagcaccccagtcctctgagaatgccggaacaagcgacctcgagctacctgtatcccagcggaaccaggatctgagcttgcaggaagctgagacagagcagtctgacactctggacaacaaagaagctgtgattctaagggaaaaacctccctcgggtagacaaacgccccagcccctaagacatcaaagttacatccttgcagtgaacgaccaggagactggaagcgacacaacctgctggctccctaatgacgcaaggcgggaggttcacatcaagcgcatggaagagcgtaaagcgtctagcacgagtccgcctggtgacagcctggccagtatacctttcatagatgagcctacttccccatcaatagaccatgacatcgcccacatacccgctagtgcagttatctctgcatctacatctcaggtgccctcaattgccactgtgccgccttgcctgactacatcagctcctctgattaggcggcagctctcccacgatcacgaatcagtgggtccccctagcctggatgctcagcccaattccaagactgagagatccaaaagctatgacgaaggtctggatgattatagagaggacgctaagctgagctttaagcatgtgtcgtcacttaaagggatcaagatcgccgatagccagaagtccagcgaggactctggtagccgtaaagattcctcttccgaagtcttctctgacgccgctaaggaaggctggctccactttcgtccccttgtgacagacaaggggaagcgtgtgggaggatcaatccggccttggaagcagatgtacgtcgtcctacggggtcactctctgtatttgtataaagataagcgggaacagacaacacccagtgaggaggagcagccaatctcggttaacgcctgtctgatagacatcagttattctgaaactaagagaaaaaatgtgttcaggctcaccacaagtgattgtgagtgtcttttccaggccgaagacagggatgacatgctagcctggattaaaactattcaggagagttccaatctcaacgaggaagatacaggcgtcaccaacagagacctcatttctcggcgaataaaagaatataataacctgatgtctaaggccgaacagctgcctaagacacccaggcagagcctcagcattcgtcagaccctgttaggagctaagagcgagccaaagacacagtccccacacagccctaaggaggagagcgagcgaaaactcttatctaaagacgacacatcgccccctaaagataagggcacatggcgtaaggggatcccatccataatgcggaagacattcgagaagaagcccactgccacagggacttttggagtgcgcctggacgactgcccaccagcacacacaaacagagtgggagatacatccccacccgacttcctcaaatcacttatccagttttag

SEQ ID NO: 238686 - DNA, 5876 bp, Artificial Sequence
  Description of Artificial Sequence: Synthetic coding sequence
atgatggccacacgacgcaccggcctttccgagggggacggagacaaactgaaagcctgtgaggtgtccaaaaacaaggatggcaaggaacagtctgagactgtgtctctcagcgaagatgagacattctcttggccaggccctaagacagtcacactcaagagaaccagtcaaggcttcgggtttactctgcgtcatttcatcgtttacccgcctgagagcgctatccagttttcttataaggatgaggaaaacgggaataggggcggtaaacaacggaatcgcctcgagcctatggacactattttcgttaagcaggtaaaggagggcggtcctgcttttgaagccggtctctgtaccggtgatcggatcatcaaagttaatggtgaaagcgtgatcggaaaaacgtactcccaggtgattgcgcttatacaaaactccgacacgacactcgagctgagcgtgatgccaaaggacgaggatattcttcaggtacttcagttcaccaaagatgtaacagctttggcctacagtcaggatgcgtatctgaaaggcaacgaagcctattctgggaacgcacgaaacatacctgagccgccaccgatttgctacccatggctgccctctgccccatccgcgatggcccaacccgtggagatctcacccccagattcatcactgagcaaacagcagacctctacccctgtcctgacacaacctggcagagcatacaggatggaaatacaggtcccaccctctccaaccgatgtagcaaaaagtaacaccgccgtctgtgtgtgcaacgaatcggtgcgcacagttatcgtgccttcagagaaggtggtggacctgctgtccaaccgcaataaccacaccggcccatcacatcgcaccgaggaggttcgatacggtgtgtccgagcagacttcattgaagaccgtatcaagaacgacatcaccccctctgagcatacctacaacccacctcatccatcaaccagcaggttcaaggagtctggagccaagcggaattcttcttaaatcaggcaattactctgggcattcagacgggattagttcatcccgatctcaggcagttgaggcccctagcgttagcgttaaccactactccccgaattcccaccagcatatcgactggaaaaattacaagacctataaagagtacattgacaatcgcagacttcacatagggtgtaggaccatccaggaacgccttgacagtttacgcgctgctagtcaaagtaccaccgactacaatcaagtcgtgcctaacagaaccaccctgcagggtcggaggcggagtacatcacacgatcgggttccacagtccgttcagatccgccaaaggagcgtatcacaggaacgactggaggatagcgttctgatgaagtactgccctaggtccgctagtcaaggcgctttaacgagcccttcagtgtcgttcagcaaccatcggactcgcagctgggattacattgagggacaagacgaaactcttgagaacgtgaattccggcaccccaatccctgattctaacggggaaaaaaagcagacttacaagtggtctggcttcacagagcaggatgataggaggggcatatgtgaacggcctaggcagcaagaaattcataagtctttccgtgggagtaattttaccgtggcaccctcagtcgtcaactctgacaacaggagaatgtccgggaggggtgttggaagtgtgtctcagtttaagaagatccccccagacctgaaaacactgcagagtaatagaaattttcaaactacctgcggcatgtcacttccaagaggcatcagccaggatcgtagtccgctggtaaaggtcagatctaattcgttaaaggcaccaagcactcacgtgactaagcccagtttttcccagaaatcttttgtttcaattaaggatcagagacccgtgaatcacctccaccaaaatagtctcctgaatcagcagacttgggttaggaccgacagcgcccctgaccagcaggttgaaacagggaagtccccttcgctcagtggggcaagcgctaaacctgctccgcagtcctcagagaatgccggtaccagtgacctggagcttccagtgagccagcgaaaccaggacttaagcctccaagaggccgaaacagagcaatccgacacacttgataataaggaagctgtgatcctgcgcgagaagcccccaagcggaaggcagactccacaaccccttcggcaccagtcttatatactcgccgtgaacgatcaagagacaggatctgacacgacttgttggcttccaaatgacgctcggagggaggtgcacattaagcggatggaagaacgaaaagctagctcaacctcaccgcctggcgacagtctggcatcaatcccatttattgatgaacccacatctcctagcatagatcatgatatcgcccatatccctgcctctgccgtgatttcagcaagcactagccaggtaccatctatcgcaactgtccccccttgtctgacaacatctgctccgctgattcggaggcagctatcacacgatcacgagagcgtgggtcctccctcccttgacgcacagcctaattcaaagaccgaaaggagcaaaagctacgatgagggactggatgactatcgtgaggatgccaaactgtctttcaaacacgtttcatctctgaaaggcatcaagatcgccgacagccaaaaaagttccgaggacagcggatcgcgaaaagactccagctcagaggtcttctccgacgccgctaaggaagggtggctgcatttccggccactggtgactgacaagggcaaacgggtaggcggaagtatcagaccctggaagcagatgtacgttgtactgagagggcactcgctgtatctgtataaagacaaaagagaacagaccactcccagcgaagaagagcagccaattagcgttaatgcctgtctaattgatatatcatactccgaaacgaaaagaaaaaacgtgttcaggttgacaacctcagattgcgaatgcctgttccaggctgaggatagggatgatatgctggcttggatcaaaacaatccaggaaagctcgaacctgaatgaagaagatacaggcgtgacaaacagagacttgatctcacgcagaattaaggaatataacaatttgatgagcaaggctgagcaactccctaagacaccaaggcaatctctgtctatcaggcagacgcttttaggcgcaaaatccgagccaaaaacacagtccccccactcaccaaaggaggagtcggagcgcaaactgttgtccaaggacgacacttcacctcccaaggacaaggggacctggaggaaaggaatcccctcaattatgaggaagacttttgagaagaaacctaccgccacagggacattcggcgttcggctggacgattgtcctccagcccatacaaatcggtatatccctctcattgtcgatatatgctgcaaactcgtggaagagcggggactcgagtatacaggcatatatcgggtgccaggaaacaatgctgctatctcatccatgcaagaagagcttaataagggcatggcggatattgatatccaggacgataagtggagggatctgaatgtgatctccagtctgctgaagtcctttttcaggaaactgcccgagcccctgtttaccaacgacaagtatgcagactttatcgaggccaatcgtaaggaggatccattggacagactcaaaacactaaagagacttatccacgacctccctgaacatcactatgagaccctgaaattccttagtgcccacctgaaaaccgtcgccgaaaattccgaaaagaacaaaatggagccaaggaatctagccatagtgtttggcccaactttggtgaggacaagtgaggacaatatgacacacatggtgactcacatgcccgatcagtacaagatcgtcgagacacttatccaacaccatgattggtttttcactgaggagggcgctgaagaaccacttacaacagtgcaggaagaaagcacagtcgacagtcaacccgttccaaatattgaccacctcctgaccaacattggccgtaccggggtcagtccaggcgacgttagcgacagtgcaactagtgactctacaaagtccaagggttcctggggctctgggaaagaccagtacagtcgcgaattgctggtgtcctctatatttgccgcagcctccaggaaacggaaaaagcctaaggagaaagctcaaccatccagttcggaagatgagctggacaatgtgttcttcaaaaaagagaacgtagaacaatgtcacaatgacaccaaggaggagtctaagaaggagagcgaaaccctggggagaaaacagaagattattattgcaaaggaaaacagcacacgtaaggatccatccacgaccaaggacgagaagatctccctgggaaaggagtcaacccctagtgaagaaccttccccaccccacaactctaaacacaacaaatcccccaccctcagttgccgctttgcaattctgaaagagagtcctcgttctctgctagcacagaagtctagccacctggaagagaccggaagtgactccggaacactgctctccacctccagtcaggccagcctcgcccgatttagtatgaagaaatcgaccagtcccgagactaaacactctgagtttttagccaatgtgagcaccattacttctgattatagtacaacaagctcagccacctacctaacttctctcgacagttcccgactcagtcctgaggtgcaaagtgtggctgagtctaaaggggatgaagccgacgatgagaggtctgaactcataagcgagggcaggccggtggagacggatagtgaaagtgaatttcctgtgttccctaccgcgcttacaagcgaacgattgttccgcggaaaattgcaagaagtgactaaaagctccagaagaaattctgaaggttctgaactgtcatgtacagaaggctctctcaccagtagcctagattctcgcaggcagctgttctcctcacacaagctgattgagtgtgacactctttcacgcaagaagtccgcgaggtttaaaagcgactctggtagtcttggagacgcgaagaatgagaaggaggccccttcactcaccaaagtgttcgacgtgatgaagaagggtaagtcgaccggtagcctacttacacctacaagaggggagtctgagaagcaggagccgacctggaaaaccaaaattgctgatcggctgaagttgagaccccgtgcacccgcagatgacatgttcggcgtaggtaaccacaaggtgaacgccgagaccgccaagaggaagagtattcgtaggagacacaccttaggaggacacagagacgcgacggagatctcagtgctgaatttctggaaggtgcacgagcagtcaggcgagagagaaagcgagttaagtgcagtgaacagactcaagcctaagtgtagcgctcaggacctcagcattagtgactggctggccagggagcggttaaggacgagcacaagcgacctgtctcggggtgagatcggggatccacagaccgaaaatccctctacccgggaaatagccacaaccgacacaccactaagcctacattgtaatacaggttccagctcctctactctggcctccacaaatcgtcccttgttgtccatcccgcctcagtcacctgatcagatcaacggcgagtcctttcaaaatgtgtcgaagaacgcctcatctgccgcaaacgctcagccgcataaactttccgaaacgccgggaagtaaagcagagtttcacccatgtctgta

SEQ ID NO: 238687 - DNA, 594 bp, Artificial Sequence
  Description of Artificial Sequence: Synthetic coding sequence
tgaaacaacgcggcaatctcctcaatgcaggaggaattgaataagggcatggccgacattgatatccaagacgacaagtggagagatcttaatgtgatcagtagcttgctaaaaagtttctttcggaaattgcccgagcccttatttaccaacgataaatacgcagacttcatcgaagccaaccgcaaggaagatcctctagatcggcttaagactctgaaaaggttgatccacgacctgccagagcatcactatgaaacacttaagtttctcagcgctcatctgaagactgtggcagagaattccgagaagaataaaatggaacccagaaacttggctatcgtctttggccctacactggtacggacaagtgaggataatatgacacatatggttacacacatgcccgatcagtacaagatcgtagagaccctgatacaacaccacgattggtttttcaccgaagagggagctgaggagccgcttattcagctgctggtcacccagcagaatctgagggtgctgggagatctcgaacggatctcaatcgccggaaactgcctgtgcccacccagtctccagctgctagtctag

SEQ ID NO: 238688 - DNA, 342 bp, Artificial Sequence
  Description of Artificial Sequence: Synthetic coding sequence
tatattcccctgatcgtggacatttgttgcaagttagtggaggagagaggcttagaatacaccgggatttatcgcgtgcccggtaacaacgcagctattagttctatgcaagaagagctgaacaagggcatggcggacattgacatccaggatgataagtggagggacctgaatgtgatctcctcactgctgaagtcttttttcaggaagctcccagaaccactgtttactaacgataagtacgcagattttattgaagctaaccgaaaggaagatcctctcgatcgactgaagactctaaaacgtctgtttctatcagctcacctgaagacagtggcctag

SEQ ID NO: 238689 - DNA, 2724 bp, Artificial Sequence
  Description of Artificial Sequence: Synthetic coding sequence
atgcccaaggacgaagacatacttcaggtggcttacagccaagacgcataccttaaaggtaacgaggcatactctggcaacgctcgcaatatacctgagccccctcccatttgctacccatggctgccctcagctccttccgctatggcgcagccagtcgaaatatcccctcccgattcttctctctctaaacaacagacctccacacctgtacttacacagcctggacgcgcataccgaatggagatccaggttcctccgtctccgacagacgtagccaagtctaatacagcagtgtgtgtgtgcaatgagtctgtaagaacagtgatcgtgccctctgaaaaggtggtggacctgctctccaatagaaataatcacacgggccctagtcatagaaccgaggaagtgaggtatggtgtgtcggagcagaccagcttgaaaactgtgagtcgcaccacatctcccccactctcgatccctaccactcatcttatccaccagccagcaggcagtcggagcctggagccatccggaatcctcctgaagagcggaaactacagtggtcacagcgatgggatctctagctcacgctcacaggcagtggaggccccttcagtgtccgtgaatcactatagtccaaattctcaccagcacatagattggaaaaattataagacttataaggaatatatcgacaatcggaggctgcatatcggttgccggactatccaggagcgtctggatagtcttagggcagcgagccaaagcacaacagattacaaccaagtggttcccaaccgcactacgctgcaagggaggcggaggtctacctctcatgatcgcgtcccacaatccgttcagattaggcagcgctcagtatcccaagagcgcctggaagactcggtgctaatgaagtactgcccccgttcggcatctcagggggctctaaccagtccctcggtgtcattctctaaccatcggactcgctcttgggactatatcgaggggcaggatgaaactctagagaatgtgaacagcggaacgccgataccggatagtaacggcgagaaaaaacagacctataaatggtccggatttaccgagcaggatgatcgacggggaatctgcgaaaggcctcggcaacaagagatacacaaatcttttcgagggagtaattttacagtagctccaagcgtcgtgaacagcgacaaccggagaatgtctgggaggggggtgggtagcgtcagccagtttaagaaaatccctccagaccttaagaccctgcaaagcaatagaaattttcaaacaacctgcggaatgtcacttccacgtggcatttcacaggatagaagtcccttggtgaaagtgcgatccaatagcctgaaagctccttcaactcatgtgaccaaaccgagcttctcccagaaatccttcgtcagcattaaggatcaacgccctgtcaaccatttgcatcagaattcccttctgaatcagcagacctgggtgagaactgactccgcccctgaccagcaggtcgaaactggcaaaagcccttccttgtctggcgctagtgccaagcccgctccccagtcatccgagaacgctgggaccagcgacctagaattgcccgtaagccaaagaaaccaggacctgtctctccaagaggctgaaactgagcagtcagataccttagataataaagaagcagtgatactccgcgagaaacctccaagtggcagacagacaccgcagccactccggcaccagtcctatatcctggccgtcaacgatcaggaaacggggtctgacacaacttgctggctgccaaatgacgccagacgggaagtacatattaagcgcatggaggagcgaaaagcatctagtacttctccgcctggcgatagtctcgcttccattcccttcattgatgagcccacctcaccctcgatcgatcacgacattgcccatatccccgcatctgcagtcatcagcgcatccacctcccaggtgccttcaattgccactgtgcccccatgcctgacaacttctgcccctctcattcgaaggcagctttcacatgatcacgaatcggtgggaccaccatcgctagacgcacagcccaacagcaaaactgaacgtagtaaaagttacgatgaggggttagacgattaccgtgaggatgctaagctgagcttcaagcacgtgtctagtttgaagggaattaagattgccgattctcagaaaagctctgaagactccggaagccggaaggattcctctagtgaggtgtttagtgacgcagcgaaagaaggctggcttcattttaggcctttggtgaccgataaaggtaaacgagtcggcggtagtatcaggccatggaagcagatgtatgtggtcctcaggggccacagcctctatctgtataaagacaaacgtgaacaaacaactccttctgaggaagagcagccaatctctgtgaacgcatgccttattgatattagctatagcgagactaagagaaaaaatgtgttccggctcactactagtgactgcgaatgtctctttcaagctgaggaccgcgacgatatgctggcgtggatcaaaacaatacaggaaagttccaatctgaatgaggaagacaccggagtcacaaatcgtgatttgatctcgaggcgcatcaaggagtataacaacctcatgagcaaggccgagcagcttccttag

SEQ ID NO: 238690 - DNA, 3396 bp, Artificial Sequence
  Description of Artificial Sequence: Synthetic coding sequence
atgatggccaccagaagaaccggtctttccgagggagacggtgataaactgaaggcctgtgaggtgtcaaagaacaaagatggaaaggaacagagtgaaactgtttcactctccgaggatgagacattttcttggcccggtccgaagactgtaaccctgaaacgaacttcgcagggctttggttttacgttgcgtcacttcattgtgtaccctcctgagagtgcaatccagttttcctacaaggatgaagaaaacgggaatcggggaggcaagcagagaaatcgcctcgaacccatggacacgatcttcgtgaagcaggtgaaggaaggcggtccagcgtttgaagcgggattgtgcactggagataggattatcaaagtaaacggcgagtctgtaatcggtaaaacatattctcaggtgatcgccctcatccagaatagtgatacaaccttggagctgagcgtcatgcctaaggatgaagacatcctacaggtcctgcagttcactaaagatgtaacagccctcgcctacagccaggatgcatacctcaaaggaaacgaggcatacagtgggaacgctcgtaacattcccgagccccctccaatctgctacccatggctcccttctgcaccttcagccatggcccagccggtggagatctccccacccgattcctctctgtccaaacagcaaacatctactccagtgctgacgcagccgggacgcgcataccgaatggagattcaggtgcctccctcgcccacagacgtagccaagagcaacaccgccgtttgcgtgtgtaatgagtctgtgcgcacagtgattgtcccttccgaaaaagtcgtcgatctactcagcaatagaaacaaccatactgggccttcccataggaccgaggaggttagatatggtgttagtgagcagacatctctgaaaacggtgtctagaacaacatctcctcctctgagcattccaacaacgcacttgatccatcagcccgcaggctctagaagtcttgaaccttctggaatcctactaaaaagcggtaattactctggtcatagcgatggaatctcatcaagccgctctcaagccgttgaggcgccttccgtgtcggtgaatcactatagcccaaacagccaccagcacatagattggaaaaactacaagacttacaaggaatatatagataatcggcgtttgcacatcggctgcagaacaatccaggaacggcttgactccctgagagccgctagtcagagcaccactgactataatcaggtcgtgcccaatcggaccactctgcagggtcggaggagaagcacctcccatgaccgggttccgcagtccgtccaaatccgacagaggagcgttagtcaggagcgactggaagacagcgtcttgatgaaatactgcccacgctctgccagccagggcgcacttaccagcccttcagttagtttctcaaatcatagaacccgatcatgggactacatcgaaggtcaagatgaaaccctcgagaacgtcaacagtgggacccccattcctgattccaatggcgaaaagaagcaaacctataaatggagtggatttaccgaacaagacgatcgcaggggaatttgcgaacgaccacgacagcaggaaatccataaatctttccgcggatctaacttcacagtggccccttccgtcgtcaactctgacaacagacgcatgagtggacgaggagttggatctgtgtcccagtttaaaaagataccacctgatctgaagaccctccagtctaacagaaatttccaaaccacatgcgggatgtctcttcccaggggcatcagccaggacaggagcccactggtgaaggtgcgcagtaatagcctcaaggctccaagtacacacgtcaccaagcctagcttctcccaaaagtctttcgttagtattaaagaccagcggccagttaaccacctccaccagaacagcttgctgaaccaacaaacctgggtcaggacggactccgcgccagaccagcaggtggaaacaggaaagtctccaagtctctccggggctagcgcaaaacccgctccccaatcatccgagaacgcgggtaccagtgaccttgaactgccagtgtcacagaggaaccaggacctctccctgcaggaagccgaaacagaacagtccgacactctggacaacaaagaagccgtgatccttagagagaagcctccctctggcagacagactccacagcctctgagacaccagtcatacattctagctgttaatgaccaagagaccggctctgacaccacatgctggctgccgaacgatgcgcgtcgtgaggtgcatattaagcgcatggaagaacggaaggccagctccacgtcccccccaggagacagtctcgcatctatcccatttatcgatgaacccacatctccttccatcgatcacgacattgctcacattcccgcatcagctgtaatcagcgccagtacatcgcaggtcccgagcattgctacagtgcccccttgtctgacgaccagtgctccactaatacgaaggcagctgtctcatgaccacgagtctgtggggcctccctcattggatgcccagcccaactcaaagaccgagcgaagcaaatcctatgacgaaggtctggacgattatagggaagacgcgaagctgtcattcaaacatgtgtcctcattaaagggcatcaagatcgctgattcccagaaatcatctgaggatagcggctccagaaaagattccagttctgaagtgttttccgatgccgctaaggaaggttggctccacttccggccactcgtcacagataagggaaaaagggtggggggtagcatcagaccgtggaagcagatgtacgtggtcctgcggggtcactctctctacttgtataaggacaagagggaacaaaccacgccttccgaggaagagcagcctatctccgtaaatgcatgcctgatagacatctcctattcagaaacgaagcgcaagaacgtgttccgcctaaccaccagcgattgcgagtgcctgtttcaggcagaagaccgcgacgatatgctggcctggatcaagaccatacaagaatccagcaatcttaatgaggaggataccggagttactaatcgagatcttattagtcgcaggattaaagaatataacaacctcatgtcgaaagcagagcagctcccgaaaacacccagacagagcctctctattcggcaaacgctgctgggcgctaaatcagagcctaaaacccagagccctcattccccaaaggaggaatcagagcggaaacttctgagtaaagacgatactagtccaccgaaggataaagggacctggcggaaaggaataccatcgatcatgtag

SEQ ID NO: 238691 - DNA, 4224 bp, Artificial Sequence
  Description of Artificial Sequence: Synthetic coding sequence
atggctacgaggagaactggcctttctgagggcgacggtgacaagctgaaagcttgtgaggtatcaaaaaataaggatggcaaggaacaatctgagaccgtcagcctgagcgaggatgagactttcagctggccgggtcccaagactgtaaccctgaagaggacctctcaaggcttcggatttacgttgcggcatttcatagtttatccaccagagtccgctatacagttcagctataaagacgaagagaatggaaaccgcggtggtaagcagagaaatcgactggaacctatggacaccatttttgtcaaacaggtgaaggagggtgggccagcctttgaggccggactttgtaccggagaccggattattaaggtgaatggagagagtgttataggcaagacctattcccaagtcattgccctgattcagaacagcgacacaaccttagagctgtccgtcatgcccaaggacgaggacatcctgcaggtagcttacagtcaagacgcttatctaaagggcaatgaagcttactccggcaacgccaggaacatccctgagcccccacctatctgctacccctggcttccgtctgcgccttctgccatggcccagccggtggaaatcagtccaccagattcctcactcagtaaacaacaaacctccacccccgtgctgacccaaccagggagagcttaccggatggagatccaggttccaccatctcccaccgatgtggccaagtccaacaccgccgtgtgcgtgtgcaatgagtccgtgcgtactgtgattgttccgtccgagaaggtggttgatctcctctctaatcgcaataaccacaccggtccttcgcaccgcaccgaagaagttaggtatggtgtttccgagcaaacctcccttaaaactgtctctcggacaacctcaccacccctgagcatcccaaccactcacttaatacatcagccggcaggatctcgctcacttgagccttccggcattctcctgaaatctgggaattactccgggcacagcgatggcatcagtagctcgcggtcacaggcagtggaagctcctagcgtcagtgtcaatcactactctccaaattctcaccagcatatcgattggaagaactacaagacctacaaagaatacatcgataaccgtcgcctgcatatcggatgcagaactatccaagagcggctggattcattacgcgctgctagccagtcaacaaccgactataaccaggtggttcccaacaggaccacacttcaaggccgtaggaggtccacctctcacgatcgcgtgccccagtccgtgcagattaggcagaggtcagtttcccaggaacgactggaagactccgtactgatgaagtattgcccccgatccgcatcccagggcgcactaacttctccaagcgtttcatttagtaaccatcgaacaaggagttgggattatatcgagggccaggatgaaacactggagaacgtaaacagcgggaccccgattcccgactccaacggagaaaagaagcagacctacaagtggagtgggtttacagaacaagatgaccggaggggcatttgtgagcgaccccgtcagcaggagatccacaaatcctttagaggttccaattttaccgttgctccaagcgttgtgaatagtgataacagaaggatgtcggggaggggagttggttctgtgtcccactggcggaaaggcatcccatctataatgagaaagacattcgagaagaaacctacggccaccggcacgttcggggttagacttgacgactgtcccccagctcacactaataggtacatcccacttatagtcgacatttgctgcaagcttgtggaggagcgtggtcttgaatataccggaatttacagggtccctgggaacaacgccgcaatctcttctatgcaggaagagttaaacaagggcatggcagatattgatatccaggacgacaaatggagagacctgaacgtcatctcatcgttgttgaaatccttcttccgcaaacttccagaacccctgttcacgaacgacaagtatgccgatttcatcgaagcgaaccggaaggaggacccgttggataggctcaagacactgaagcggctgatacacgatctcccggagcatcattatgagacactgaaattcctgagtgcacatttgaaaacagtcgctgagaactctgagaaaaacaaaatggagcccagaaacttggcaattgtgtttgggcctaccctagtacggacaagtgaagataacatgacccatatggtcactcacatgcctgaccaatacaagatcgtcgaaacactcatccagcaccacgactggttctttacggaggagggtgctgaggaaccactcaccacagtgcaggaagaatcaacagtggattcacagccggtgcccaacattgaccatctgctcaccaacatcggacggacaggagtctcacccggagacgtatctgacagtgccaccagcgactcaacaaaatcaaagggctcatggggttctggtaaagatcagtatagtagagagctgcttgtatcatctatcttcgccgctgccagcaggaagagaaagaaacccaaggaaaaagctcagccttcttctagcgaggatgagctggataatgtgtttttcaagaaggagaatgttgagcagtgccataacgacaccaaggaggaatccaaaaaagagtccgagacccttggcaggaaacagaagatcatcattgctaaggagaacagtactcgcaaagatcccagcaccaccaaagacgagaagatctccctcgggaaggaaagtacacctagtgaagagccatctcctcctcacaattcaaaacacaataagagtcccaccctcagctgtcggttcgcaattttaaaagagtcgcctcgtagtctgttagctcagaaatcttcccatttggaggagactggtagtgactctggcactctgttatcaacctcttctcaggcaagcttggccagattttctatgaaaaagagtacaagccccgagacaaagcactctgagttcctggcaaacgtttcgaccataacgtctgactactctacgaccagttccgccacctatctgactagccttgatagcagccgactgtcaccagaagttcagtctgtggctgagtctaagggggacgaggccgacgacgaacggtcagagctcattagtgaaggacgacctgtggagaccgattcagagtccgagttccctgtgtttcccaccgcgctcacctctgaacggctctttaggggcaaattacaggaggtcactaaaagctccagacgcaattcagagggcagcgaactgtcctgcactgagggatcgctgacttcgtctctggattcacggcgtcagttattctcctcccacaaactcattgaatgtgacacattatcccggaagaaatcagccaggtttaaaagtgattccggctctcttggcgatgccaaaaacgagaaggaggctccttcattaaccaaagttttcgacgtgatgaagaaaggcaagagtaccgggagtcttttaactccaactcggggagaatctgaaaagcaggaacccacttggaagacgaagattgcggacaggcttaagcttcggcctagggctccagctgacgatatgttcggtgtgggtaatcataaggtgaatgcagaaacggctaaacgcaagagcatcaggcgcaggcacacgttaggaggccaccgagatgccacagaaatttcagtcctcaacttctggaaagtccacgagcagagtggcgagagggaaagcgagctgtccgctgtcaatcggcttaaacctaaatgcagtgcacaggatctgagcataagcgattggcttgctagggagcggctgaggacatccacctctgacctgtcccggggagaaatcggcgatccccagacggaaaaccccagtacaagagagatcgctaccactgatacaccactaagcctgcattgtaacaccggttcatcttcttctactctagcatcgacaaaccgccctctgctgtcaatccctccgcagtcgcccgaccagattaatggggaatctttccaaaacgtgtcaaagaatgcaagctctgctgctaatgcgcagcctcataagttgtccgagacacccggatcgaaggccgagtttcatccttgcctgtag

SEQ ID NO: 238692 - DNA, 279 bp, Artificial Sequence
  Description of Artificial Sequence: Synthetic coding sequence
atggacacaatcttcgtcaaacaggttaaagaagggggtcccgcttttgaagccggactgtgcactggggaccgtattatcaaggtgaatggggaaagtgtaattggtaagacgtattctcaggtgatcgccctgattcaaaactccgatacaacgcttgagctgtcagtaatgcctaaggatgaagacatccttcaggtcaatctggaattcagcactttttacaagaataccatcgccaagtttctgcagttaagtgacatggaaatgctgtgctag

SEQ ID NO: 238693 - DNA, 4476 bp, Artificial Sequence
  Description of Artificial Sequence: Synthetic coding sequence
atgaatggagtggctttctgtctggtgggaataccccctcgccctgaacctaggcccccacagctcccccttgggcctcgcgacggttgtagccctcgtagaccatttccatggcaggggcctcggactctcctactgtacaagagccctcaggacgggttcggatttaccctgaggcactttattgtgtacccccctgaatccgccgttcactgttctctcaaagaagaagagaatgggggaagagggggtggcccaagccctcggtacaggctcgagccaatggacactatcttcgtcaagaatgtcaaggaggatggcccagcccacagggccggactgagaaccggggatagactggtgaaggtaaacggcgaaagcgtaatcggaaagacatatagccaggtaattgcgctaatccaaaattcagacgatactctggaactctcgattatgccaaaagatgaggacatcctgcagctggcttacagccaggacgcatatcttaaggggaacgagccctattctggggaggcccgatcaataccagaacccccacccatctgttaccccaggaagacatatgctccgccagccagagctagtaccagggcaacaatggtgcccgagccgacaagcgcgctgccatctgacccacgctctcctgctgcgtggagcgaccccggacttagagtgcctcccgctgctcgcgctcatctcgacaattctagcttagggatgagccagcctaggccgagcccgggtgccttccctcatttgtccagcgaaccccgtaccccacgggcttttccggagcccggttccagagtacccccatcacgtctggaatgccagcaggcactctcacattggttaagtaaccaagtccccagacgtgccggagaaaggagatgccctgcaatggctcctagagcccgaagtgcaagtcaggaccggctagaagaggtggccgctccaagaccatggccctgctccacgagccaggacgccttgtcgcagcttgggcaggagggatggcatcgagcccgttccgacgattacttgtcccgtgctaccaggagtgcggaggccctgggacctggcgctctggtcagtcccaggtttgagcggtgtggctgggctagccaacggagttctgcacgcacgcccgcttgcccgacccgcgacctgcccggaccccaggcacctccccctagcggcctccaggggctggacgatctcggatacatagggtatagatcttacagcccaagttttcagagacgaaccgggcttttacacgcactgagcttccgagactcgccatttggcggactccctacttttaatcttgcgcaaagtcctgcatcatttccacctgaggccagcgagccacccagggtggtgagacccgaacctagtaccagggcgttagaaccccctgccgaggatcggggagacgaagtcgtgctgcggcagaaaccaccgaccgggcgtaaggtgcagctcacaccagctcgacagatgaacctcggattcggagatgagagcccagaaccagaagccagtggccgaggcgagaggcttggaaggaaggtggctccgcttgcaacaacagaggattccctggcctccatcccatttatcgatgagccaacttccccatccatagatctgcaagccaagcatgtcccagccagcgccgtggtctcatcagccatgaactccgcacctgtgttgggcacaagcccaagctctccaacgttcaccttcacactcggtcgacattacagtcaagactgctcatcaattaaggcgggtcggaggtcttcctacctcctggctatcacgaccgaacgttctaagtcctgcgatgacggtcttaatacctttcgggatgaagggagggtcctgcgacgcctcccaaacaggatccccagcctacgcatgcttagatcgttcttcaccgatggctctcttgacagctggggcacctcagaggacgccgacgctcccagcaagaggcactccaccagcgatctctcagacgcaacctttagcgacattcggagagagggttggctgtactacaagcagattctcacaaagaagggcaaaaaagccggatcagggctgcggcagtggaagagggtgtacgccgcactccgggctcggtccctgagtctgtctaaagaaaggcgcgagcctggacctgccgctgcgggtgctgctgctgctggagctggggaggacgaagcggctcccgtttgcatcggttcttgcctcgtggacattagttatagcgagacaaagcggagacacgtcttcaggctaaccaccgcagacttttgcgagtacctgttccaagcagaggacagagatgatatgctagggtggatacgggcaatcagagagaattcccgggctgaaggagaagatcctggatgcgcaaatcaggctttgatcagcaagaaacttaatgactaccggaaggtgtctcacagctcaggaccaaaggctgattcctcgcctaagggctcacgcggactgggcggactcaaaagcgagttcttgaagcagtcggctgcgagagggctgcggacccaagaccttccagctggatcgaaagacgatagtgccgcagccccaaagactccatggggcatcaacattataaaaaagaataagaaggcggctccacgggctttcggcgtgcgactcgaagagtgtcaaccggctactgagaaccagagagtgcccctcatcgtggccgcttgttgtcgcatcgtggaagctagaggcctcgagtccacaggaatataccgcgtgcccggtaacaatgccgtggtgtccagtctacaggagcagcttaaccgaggcccaggcgatataaatctgcaggacgagcgctggcaagacctgaacgtcatttcttcccttctgaagagctttttccgcaaattgcctgaaccgttgtttactgacgacaagtacaacgatttcatagaagcgaacagaattgaagatgcccgagaaagaatgcgaacactccggaagttgatcagggatctgcccggtcactactatgagacgttgaagttcctcgtgggtcacttaaaaaccattgcagaccacagcgaaaagaataagatggaacccagaaatctcgcgttggtatttgggcctacactcgtcaggaccagtgaagacaacatgaccgatatggtgactcacatgccagacagatataagattgtggagactctcatccagcactccgattggttctttagtgatgaggaggataagggagagcggacccccgtcggtgacaaggagcctcaggcggtccccaatatagagtacttgctgcccaatatcggccgaaccgttcctcccggagacccagggagcgactccacgacctgctcctcagccaagtcgaagggctcatgggctccaaaaaaggagccatacgctagggaaatgctggccatatcgttcattagcgccgtcaacaggaagcgcaagaagagaagggaagcccgagggcttggttctagcactgatgacgatagtgaacaggaggcccacaaacctggtgccggtgctaccgcccctggaacacaggaaaggccacagggtcctctaccaggagccgtcgcacctgaggcccctgggagactgtcacctcctgcagccccagaagaaagacccgcagccgacacacgttccattgtatcgggatactccacactgagtaccatggatcggtctgtgtgttccggagcttcaggacggcgagctggagcaggcgatgaagctgatgacgaaaggtccgagctttcccacgtggagacagacacggaaggagccgctggagccggacccggaggtcgccttaccagaaggccgtccttcagttcacatcacctgatgccttgtgacacactcgctaggagacgccttgcccgaggtaggcctgatggcgagggcgcagggagaggtgggcctcgggctcctgagccacctggcagcgctagcagtagcagtcaggagagcctccggccaccagctgcggctctggcctccaggccgtcaagaatggaggccctgcgccttcgcttgcgaggaacagctgacgatatgttagcggtgcgtctccgcaggcctttgtcaccggagactagacgcaggcggtcgagttggcgcaggcataccgtggtcgttcaatctccactgaccgatcttaacttcaatgagtggaaagagctcggcggtggaggtcctcctgaaccagctggggctagagctcactcagacaacaaggacagcggactgtccagcctggaatcaaccaaggctcgggctccatctagcgccgctagccagccccctgcacctggtgatacaggaagccttcagagccagcctccaagaagaagcgccgcttctcgcctgcatcagtgtctctag

SEQ ID NO: 238694 - DNA, 3435 bp, Artificial Sequence
  Description of Artificial Sequence: Synthetic coding sequence
atgaacggcgttgccttctgcctcgtgggaatacccccacgtccagagccccgacctccccagctgcctttggggcctcgcgacggctgcagccctcgaaggccttttccatggcaggggccaagaacccttctactttacaagagtccccaggatgggttcggattcacacttcgccatttcatcgtgtacccacccgagagtgccgtccattgtagccttaaagaggaggagaacggaggcaggggcggtgggccatccccacggtatagactggagccaatggacacgatatttgtgaaaaacgttaaagaggacgggcctgcccaccgagctggtctgagaactggggatcggctggtcaaggtgaacggggagtcagtgattggcaagacctattcacaggtgattgcactcattcagaacagtgatgacactctggaattatccataatgcctaaagacgaggacatcctgcagctggcttacagtcaggacgcctaccttaaggggaacgagccctattccggtgaggcccgttccattccagagcccccacccatctgttatccaaggaaaacatatgctcctcccgctcgggcatccacaagagctactatggtgcctgaacctacttcagctctgccaagcgacccgaggtcacccgctgcctggtccgaccctgggctaagggttccaccagccgcacgggctcatttggataactctagcttgggtatgtctcagccgcgaccatcaccaggggcttttccccacctaagctctgaaccccgaacacccagagctttccctgagccaggaagtcgcgtgcctcctagtcgcctcgaatgccagcaggcactgtcacactggctgtccaaccaggtgcccaggagagctggtgagcgaagatgtcctgcaatggcacctcgggctagatccgcctcgcaggatagactcgaagaagtggcggctcctagaccttggccatgcagcacaagccaggacgccctgtcacagttgggacaggaaggctggcacagagcccgtagtgatgactacctctccagagcaactcgtagcgccgaagcgctcggacccggagctctggtgagtccgaggttcgagagatgtggatgggcctcccagaggtcgtctgcccgaacgcccgcatgccctaccagagatctgccaggtccacaggccccaccaccctccggcctgcaggggctggatgatcttggttatattggctataggtcctacagccctagcttccaacggaggactggcctgctgcatgccctttcctttcgggattcaccttttggaggtctgccgacgttcaacttggcccagagccctgcctccttccctcctgaggcctcagagcccccaagagtggttcgcccagaacctagcacacgcgctctagagccgcctgcggaggataggggtgacgaagtcgtactgcggcagaagcctcccacagggagaaaggtacagttgacaccagcgcgacagatgaatctgggattcggggatgagagtcctgagcccgaagcatccgggaggggtgagcgcctgggcagaaaagtcgctcccctggccaccacagaagattcgcttgcatccatcccttttatcgacgaaccaacaagcccaagcattgacctgcaggccaagcatgtccctgcgtcagccgtggtttcctcagctatgaactctgctcctgtgctcggcactagtccttcttcccctacatttacctttacactgggccgacactactcacaagattgttccagtattaaggcgggacgtcggtcttcctatctgctggctattacgaccgagaggtctaagtcctgtgacgatgggctgaatacctttagagatgaaggcagagttttacgtcgtctgcctaatcggataccgagccttcgaatgctccgcagcttttttacagatgggtccctggacagttggggaactagcgaggacgctgatgcaccaagcaaaagacacagcacatcggatctctcagacgctacattttcggacattaggcgcgagggctggttgtactacaaacaaatcttgacaaagaagggaaagaaggcagggtctggcttacggcaatggaagcgggtctatgcagcgttgcgagctcggtcactctcactcagcaaagagagacgcgagcccggaccagccgcagccggagccgctgcagccggagctggagaggacgaagctgcaccagtgtgcatcggctcttgcctcgtcgacataagctattcagaaaccaaacgacggcatgtgtttaggttgacaaccgcagacttttgcgagtatctttttcaggccgaagatcgtgatgatatgctgggatggatacgggctatcagagagaattctagggccgagggggaggatcccggttgcgctaatcaggccctgatatccaaaaagctcaatgactatcggaaggtatctcactcctctggaccaaaggcagattctagcccaaaaggctctcgcggtttagggggtcttaaatctgaattcttaaagcagtctgcagcaagaggtcttaggacacaggacttgccagcaggctccaaggacgattctgcagcggcacctaagacgccctgggggatcaacatcattaagaagaacaaaaaagctgcgcctcgggcatttggcgtcaggctggaagaatgccagccagccaccgaaaatcagcgggttcccctcatagttgctgcctgttgccgtatagtggaagcacggggactggagtcaaccggcatctacagagtacctggcaataacgctgtggtctcctcactccaggaacaactgaatcgcggtccaggagacatcaacctgcaggacgagagatggcaagacctgaatgtgatctctagcttactgaaatcattctttcggaagcttccggagcctctgtttacagacgacaagtataacgacttcatcgaagccaaccgtatcgaggatgcaagggagaggatgcgcacccttaggaaattgattcgcgacctgccaggacactactatgagaccctaaaattcttggtgggacacctgaagacaatagcagatcatagcgagaagaataaaatggagcctcgtaacttggccctggtgtttggtcctacactggtcagaaccagcgaagacaatatgaccgacatggtcacccatatgcccgataggtataagattgtggagacactgatacaacacagcgattggttcttctctgatgaggaggataagggcgagcgcacaccagtcggggataaagaaccgcaagctgtgcccaatatcgagtatctgttaccaaacataggcaggacagtgccacccggtgatccagggagtgctgacctgcttgaaatatag

SEQ ID NO: 238695 - DNA, 4194 bp, Artificial Sequence
  Description of Artificial Sequence: Synthetic coding sequence
atggatacaatcttcgtaaagaacgtaaaagaagacggtccggcacatcgagcaggcctcaggaccggcgaccgcttagtgaaggtgaacggagaatccgtgattggcaaaacatatagccaggtaatcgcactgattcagaatagcgatgacacccttgaactgagcatcatgcctaaggatgaggacattctacagctggcctattctcaggacgcatacctaaagggcaatgagccatactccggggaggctcggagcatacctgagccccctcctatctgttaccccaggaagacatatgcccctcctgcaagagcaagcacccgggctaccatggtgcccgagcccaccagcgctctgccatctgacccaagatcccccgcagcgtggtccgacccgggacttagggtccctccagcagccagggcccaccttgacaatagctctctaggcatgagtcagccacggccttcaccaggggcttttcctcacctgtcctctgaacccagaaccccgcgtgctttccccgagcccggatctcgtgtgcccccttcccgcctggagtgtcaacaggccttgtcccactggctgtctaaccaagtgccaagaagagctggagagaggcggtgcccagccatggcccctagggccagatccgcttcccaggaccgcctcgaggaggtggccgcaccccgtccttggccgtgttccacatcacaggatgcactgtcgcagctcggacaggagggatggcaccgggcacggtcagatgactacctgagtcgggcaacccggagcgccgaagctttaggccctggggcactagtgtctcctagatttgagaggtgcggttgggcttcccagcgctctagcgctaggacaccagcctgtccaaccagggatctgccagggcctcaggctcctccacccagtggcctgcagggtctggacgacctgggctacattggctacagatcctattctccgtccttccagcgcaggacaggactcctgcatgcccttagcttccgcgactccccttttggtggacttccgacgtttaatctcgctcaaagtcctgcatcgtttcccccagaggctagcgagccccctcgagtggtgcgccctgaaccttccactcgggctctggaacccccagcagaagaccgcggagatgaggtcgtgctgaggcagaagcccccaacagggaggaaggtccagctcacgcctgcaaggcagatgaacctggggttcggggacgagtcacccgagccagaagcctcgggaaggggggaacgactcggcaggaaagtggccccactggcgaccactgaggatagcctggctagcatacctttcatcgatgagccgacctccccttcaattgacctccaggcaaagcatgtgcctgcgtcagccgttgtgtccagcgccatgaactctgccccagtactcggcaccagccctagtagccctacgttcactttcactcttggcagacactactcacaggactgcagctctatcaaagctgggagaaggtctagctacctactcgccataactaccgagagatccaaatcatgtgatgatggtctcaataccttcagggacgagggacgagttctgagacgcctgcctaaccgaattccctcattgaggatgctgagatcctttttcaccgatggaagcctggactcgtggggaacttctgaggacgccgacgctccaagcaagagacactctacatccgacctctccgatgcaaccttcagtgacatacgacgagaaggatggctgtactataagcagatcctgaccaagaagggcaagaaagcaggcagtggtctcagacagtggaaaagggtctatgccgcactccgtgccagatctctctctctttctaaggaaaggcgcgagccagggccagccgcagctggagcagccgcagcaggggcaggggaagacgaagcagctccggtttgcattggcagctgcctcgtggacataagttatagcgagaccaaacggaggcatgtgtttcgcctcacaacggctgacttttgcgagtatctgtttcaagcggaagaccgcgacgatatgcttggttggatccgggcaataagagagaactctcgggctgagggtgaggatccaggatgcgccaaccaagctttaattagtaagaaacttaacgattatagaaaggtgtcccacagctcagggcctaaggcagactcaagcccaaagggatccagaggactgggcggtctgaagagcgaatttctcaagcagagcgccgctaggggtctcagaacccaggacttgcccgcaggtagtaaggacgattcagctgccgcaccgaaaactccatgggggatcaacattataaagaaaaacaagaaggccgctccacgcgcttttggagtccgcttggaagagtgccagcccgcaacggagaaccagcgggttcctctgatcgtggcagcctgttgtagaatcgttgaggccagaggacttgagtcaacaggtatctacagggttccaggcaacaacgcggttgtctcctcgctgcaggaacagctgaatcggggacccggagatatcaaccttcaagacgagaggtggcaggatctcaacgtcatctcctctctcctgaagagcttctttcgaaaactgccagaacctctgtttacggacgacaagtacaacgacttcatcgaggcaaacaggatcgaggatgcccgagaacgaatgcgaacgctgcgcaaactgattcgcgatcttcctggccattactacgagacgcttaagttcttggtagggcacttgaaaaccattgccgaccacagcgaaaagaacaagatggaacccagaaacctggctttggtgttcgggcctacattggtcaggacaagtgaagataacatgacagacatggtgacacatatgcctgataggtataagatcgtggagaccctgatccagcattctgattggttcttttctgatgaggaggacaaaggcgagcggacccccgtgggggacaaggaaccgcaggctgtgccaaatatagagtacctgttacccaacattggacgaactgtcccccctggggacccgggttcagacagcaccacatgctcttctgcaaaatctaaaggttcctgggcaccaaaaaaggaaccatatgccagggagatgctggctatctcctttatttcggccgtaaaccgaaagaggaagaagaggagggaggccagggggttggggagttccactgacgacgactcggaacaggaagcccataagcccggtgcaggagcaacagcaccaggcacccaggaaaggccacagggaccgctcccaggggctgtggctccggaggccccagggaggctgagccctcccgcagccccagaagagcgtcctgcagccgacacccggagcatcgtctcaggctatagcacactgtcaactatggataggagcgtctgctctggcgctagcggtcgacgggcaggcgcaggagacgaagcagacgatgagaggagcgagctgtcacacgttgaaaccgatacagaaggcgctgcgggagctggccctggtgggcgtctgacccgacgccctagcttcagcagtcaccacctcatgccttgcgacactttggccagacggcgtctggcgagggggaggccagacggagagggagccggaagggggggtcctcgcgcacccgagcctcctgggtccgcctcctcatctagccaagaatctttgcggccaccagcagcagccctagcttcacgacctagccggatggaggctctgaggttacgcttaagagggactgctgacgatatgctcgccgtgcgtctgcggaggcccctttcccccgagactcgacgacgccgaagctcttggcggcgacacacagttgttgttcaaagccccctaaccgatctaaacttcaacgaatggaaagagctgggaggaggcggacctcctgaacccgcaggagcccgagcacattccgataacaaggactctggcctcagctccctcgaatccactaaggcgcgagctccaagttcagccgcttcccagccacctgcgccaggagacaccggatccctgcagagccagccccctcgcaggtctgccgcttcacgcctccatcagtgcctctag

SEQ ID NO: 238696 - DNA, 1968 bp, Artificial Sequence
  Description of Artificial Sequence: Synthetic coding sequence
atgccagaagatcgtaatagtgggggatgtccagccggagcactcgccagcacaccatttattcctaaaactacatatagacgcatcaagcgctgtttctcatttaggaaaggcatttttggccagaagctggaagataccgtgcggtacgaaaaacgctacggaaaccggctagcccctatgctcgtcgaacagtgcgttgacttcattcgccagaggggtctgaaagaagaagggctgtttcgcctccccggacaggccaatctcgtgaaggagctgcaggacgcgttcgactgcggggagaagccttctttcgacagtaataccgatgtccatacagtcgcatcgttgctcaaattgtaccttcgggaactacccgagcctgttataccttatgcaaagtatgaggacttcctgagttgcgccaagctgctgagtaaggaagaagaagctggcgttaaagaactcgcaaagcaggtcaagtctttgcctgtcgtcaattataacttgctgaaatacatctgccgcttccttgacgaggtacagtcctacagtggtgtcaataagatgagcgtgcagaatcttgcaacagtgttcgggcctaatatccttagacccaaagtggaagatcctctgaccatcatggaaggcactgtggtcgtccaacagctgatgtcggtgatgatctcaaaacatgactgcctctttccaaaggacgctgagctacagagtaaaccccaggatggcgtcagtaataataacgagattcaaaagaaggcaactatgggacagttgcaaaacaaggagaacaataacacaaaggactcccctagccggcagtgttcttgggacaagtctgagagcccccagcgttcttctatgaataacgggagcccaacagccttatccgggtccaagaccaattctcccaagaactccgtgcataaattggatgtgagtagaagccccccattgatggtgaagaagaatccggcattcaacaaggggtccggcattgtcacaaacgggagcttttcgtcatccaatgccgagggacttgagaagacgcaaaccaccccaaacggctcacttcaagccagacggagctcctctttgaaagtctccgggaccaagatgggcacccactccgtgcagaacggtactgtgaggatgggcatattgaattccgacaccttgggtaacccaactaacgtccgtaacatgtcgtggttgccaaatggttatgtcactctgagggacaacaagcagaaggagcaggcaggcgagctaggccagcacaacaggctgagtacatacgataacgtgcaccagcagttttctatgatgaatctcgacgataaacaaagtattgattctgccacatggtctacctcttcctgtgaaatatcccttcccgaaaatagtaatagttgccgaagcagcacaacaacctgccctgaacaggacttttttgggggtaatttcgaggatcctgtgctagacggaccaccccaggatgatttaagccacccccgtgactatgagagtaaatccgatcaccgatccgtgggaggccgatcttcccgggcaacatcctcttctgataatagtgaaacctttgttggaaattcaagctccaaccatagcgccctacacagccttgtctcctccctcaaacaggaaatgaccaagcagaagatcgaatacgagtcaaggattaaatcattagagcagaggaatctgacactagagacagagatgatgtctcttcatgatgagcttgaccaggagcggaagaaattcactatgatcgaaattaagatgaggaatgccgaacgcgcaaaggaggacgccgagaaacgcaatgatatgctacagaaggaaatggaacaatttttttccacatttggggagctgacagtggagcctcggagaacagaaaggggcaacacgatctggattcagtag

SEQ ID NO: 238697 - DNA, 1962 bp, Artificial Sequence
  Description of Artificial Sequence: Synthetic coding sequence
atgacggccaaccatgagtcctacttgctgatggccagtacgcagaatgacatggaggactgggtgaaaagtatcagaagagtcatctggggcccttttggcggagggatcttcggacagaagctggaggatacagtaaggtacgagaaacgttatggaaacagactcgcacccatgctggtcgaacaatgcgtcgatttcatacgccaacggggactcaaagaggagggactgttccgtctgcccggacaggccaatctagtcaaagaacttcaggacgccttcgactgtggggaaaagccatctttcgacagcaatactgacgttcatacagtcgccagcctgcttaagttatacttgcgggagcttcctgaacctgttatcccatacgcaaagtacgaggattttctctcctgtgccaaactactcagcaaggaagaggaagcaggtgtgaaagaactggccaagcaggtaaagtccctgccggtggtgaactataacttactgaaatatatttgtcgattcttggacgaggtgcagagctatagcggggtcaacaagatgtccgtgcagaatcttgctactgtgttcggtcccaacatcctgcgacctaaggtggaggatcccctaaccattatggagggaaccgtcgtggtgcagcagctgatgtcggtgatgatctcaaaacacgattgtctctttcctaaagatgccgagctgcagagcaaacctcaggacggtgtgtcgaataacaacgagatacaaaaaaaagccacaatggggcagttacaaaataaggagaacaacaatactaaggactcaccctcccggcagtgtagctgggacaagagcgaatccccccagcgaagttctatgaataatggtagtcccactgccctgagcgggtctaagacaaactcgcccaagaattctgtacacaaacttgacgtgagccggagtccccctctgatggtgaagaagaacccggcttttaacaaggggtctggtatcgtgactaatggttctttttcctcttcaaatgcagaagggctggagaagacccagactacccctaacggctccctacaggctagaagaagttccagtctcaaggtaagtgggaccaaaatgggaacacattccgtgcaaaatggcactgtgcgcatgggtattctcaattccgacactttaggcaatcctacaaatgtaagaaatatgagttggctcccaaacggttatgtgactctgcgggataacaaacaaaaagagcaggcgggtgagctcggccagcataacagattgagtacatacgataatgttcaccagcagttttctatgatgaatctggacgacaagcagagcatcgactcagctacatggagtactagtagctgcgaaatttcacttcccgagaactctaactcttgtcgctccagtaccaccacttgccccgaacaggatttcttcggcggaaatttcgaagatcccgtcctcgatggacccccacaagatgacctgtcccaccctagagattacgaaagcaaaagcgatcacagaagtgtcgggggacgttcttcacgcgcaactagtagttcagataattcggagacatttgtgggcaactcaagtagcaaccattctgcactgcactccctggttagcagtttgaagcaggagatgaccaagcaaaaaatagagtacgagagcagaataaagtccctcgaacagcgcaacctgacgttggaaaccgagatgatgtctctgcatgacgaactggatcaggagcgcaagaaatttacaatgatcgagatcaaaatgcgcaatgccgagcgagcaaaggaggacgccgaaaagcgcaacgacatgcttcaaaaggagatggaacagtttttcagcacatttggtgagcttactgtcgaacccaggaggactgagaggggaaacaccatctggattcagtag

SEQ ID NO: 238698 - DNA, 2247 bp, Artificial Sequence
  Description of Artificial Sequence: Synthetic coding sequence
atggaagaaaataatgatagcactgaaaacccccaacagggacagggccgacagaacgccatcaagtgcggatggttacgtaaacagggcggttttgtcaagacatggcacactcggtggttcgtcctgaaaggggatcagttgtattattttaaggacgaggatgaaactaaaccactcggcactatattcttgccagggaataaggtgtctgagcatccttgtaatgaggaaaaccctggtaaattcctcttcgaggtggtgcccggaggagaccgggatcgtatgacggccaaccatgagtcatacttactgatggccagcactcagaacgatatggaggactgggttaagtctatacgccgtgtcatatggggaccctttggtggtgggattttcgggcagaagctggaagacacagtcagatacgaaaagagatacggaaatcgcctcgcaccaatgctggtcgaacagtgtgttgatttcatacgtcagcggggtctgaaggaagaagggctcttcaggctacccggacaggccaatctcgtcaaggagctgcaggatgcttttgactgcggggagaaaccctctttcgacagtaacacggacgtgcatacagtggcgagcctcctgaaactttaccttagggaattaccagagcctgtgatcccatacgccaaatacgaagactttctgagctgcgcaaaactgctttccaaagaggaggaagcaggggtgaaggagctcgcgaagcaagtgaaatcactccccgtagttaactacaacctgctgaagtacatctgtcggttcctggatgaggtccagtcctacagtggcgttaacaagatgagcgtgcagaacctagcaactgtgttcggacctaatattctccggccaaaagttgaggatccattgacgattatggaaggcaccgtggtggtgcagcagttaatgagcgtgatgattagtaagcacgactgcttgttcccaaaagatgccgagctacaaagcaaaccccaagacggcgtttccaataacaatgagattcaaaaaaaggctaccatgggccagctccagaacaaggaaaacaataataccaaggacagccctagccgccagtgcagctgggacaagtctgaatcgccccagaggagcagcatgaacaacggaagtccaaccgccctgtcaggttctaagactaatagtcctaaaaacagcgtccataaactggacgtgagtcgatcccccccactcatggttaagaagaacccagcgttcaacaaggggtccggcatcgttaccaatggctcgttttcatcttccaatgcggagggcttggaaaagacgcaaactacccctaacggaagcttacaggccaggcgcagcagtagccttaaggtcagtggtaccaagatgggtacccacagcgtgcaaaacggtactgtccggatgggcatcctcaatagcgacacactcggcaatccgacgaatgtccgcaatatgtcttggctgcctaatggctacgtaacgcttagggataataaacagaaagaacaggctggcgagctgggacaacacaatcgcctgagcacctacgacaacgtccaccagcagttcagcatgatgaacctggacgacaagcaaagtattgacagcgcaacgtggagcaccagctcttgcgaaatcagcttacccgaaaactcgaatagttgtcgaagcagcacgacaacgtgccccgagcaagatttcttcggcggaaacttcgaggatcccgtgcttgatggccctccacaggacgacctttctcatccacgcgattatgaatccaaatctgatcacaggagtgtaggcggtcggtcttcccgcgctacctctagctccgataactctgagacctttgtgggcaactctagttcaaatcatagcgccctccactccttggtgagtagtctgaagcaagaaatgacaaagcaaaaaatagaatatgagagtcggattaagtccctggagcagcggaatctgacgcttgaaacagaaatgatgagtctgcacgacgagctcgaccaagaacggaagaaatttacgatgatcgaaatcaagatgcgtaatgcggagcgagctaaagaagacgctgagaagagaaatgacatgctgcagaaagagatggaacagtttttttctacttttggggaattgaccgtggagcccagaaggactgaacgaggcaatacgatttggatccagtag

SEQ ID NO: 238699 - DNA, 741 bp, Artificial Sequence
  Description of Artificial Sequence: Synthetic coding sequence
atggaggaaaacaatgacagcactgaaaaccctcagcagggccagggtaggcagaacgcaattaaatgtggttggcttcggaaacagggcggtttcgtgaaaacatggcacactagatggttcgtgcttaagggggaccagttatattatttcaaggacgaagatgagactaaacccctaggaacaatattcctcccgggaaacaaagtcagtgaacatccttgcaatgaggagaatccgggtaagtttttattcgaggttgtgcccggtggagaccgggaccggatgacggccaaccacgagagctacctactgatggctagcactcagaacgatatggaggattgggtgaaatcaattcgccgtgttatctggggtcctttcgggggtgggatatttggacaaaagctggaggatactgtaagatatgagaaaaggtacgggaacagactggctcccatgcttgtggaacaatgtgtcgacttcatcaggcaaagagggttgaaggaggaggggctcttccgcctgcctgggcaggcaaacctggtgaaggaactgcaggatgcattcgattgtggggagaagccctccttcgactcaaacacggacgttcacaccgtggcgtctctactgaagctatatctcagggagttacccgagcctgtgattccttacgctaaatatgaagactttctgagctgtgctaagctgctatccaaagaggaggaggcagtttcatag

SEQ ID NO: 238700 - DNA, 249 bp, Artificial Sequence
  Description of Artificial Sequence: Synthetic coding sequence
atgactgcaaaccacgaatcctacttacttatggcctccacacagaacgacatggaagactgggttaagagcatccgcagagtgatatggggcccatttggagggggaatttttgggcagaaactggaagacaccgtgcggtacgagaaacgctatggcaaccggctggcacctatgctggtagaacagtgcgtggactttattaggcagagaggactgaaggaggaggggctgtttcgcctaccctag

SEQ ID NO: 238701 - DNA, 1938 bp, Artificial Sequence
  Description of Artificial Sequence: Synthetic coding sequence
atgtcccttaaactcccaagaaactgggattttaatttgaaggtcgaagctgccaagattgccaggagtcgatcggtgatgaccggggagcagatggcagcatttcacccctcatccaccccaaatcctttggaacggccaattaagatggggtggcttaagaaacaaagaagtattgtcaagaactggcagcagagatactttgtgctccgcgcacagcagctttactactacaaggacgaggaagacacaaagcctcaggggtgcatgtacctgccaggctgcactatcaaggagattgccaccaatcccgaagaagcaggcaaattcgttttcgagatcataccagcatcttgggatcagaacaggatgggtcaggattcttacgttctcatggcaagctcccaggcagagatggaggaatgggttaaattcttgaggagggtggctggcacaccatgtggagtgttcggtcagcggcttgacgagacggttgcctacgagcagaaatttggcccacaccttgtacccattctggtcgaaaagtgcgcagagtttattctggagcatggacggaatgaggagggcatctttaggctgccaggacaggataatctcgtaaagcaattacgcgatgcattcgatgcgggtgagaggccttcttttgatagggacaccgatgtgcataccgtggcgagcctcctgaaactttacctgcgagatctccccgagcccgtggtgccgtggagccaatacgagggatttctcctctgtggccagctcacaaacgccgatgaagctaaagcgcaacaggaattaatgaagcagctgtcaattttgccacgcgataactactctctgttaagctacatttgcaggttcctgcacgagatacagttgaattgcgcggttaataagatgtccgtggataatctggctaccgtaatcggcgtgaacctcattaggagtaaggtggaagaccccgctgtcatcatgagaggaaccccacagatacagcgcgtgatgactatgatgatcagggatcacgaggtgctgtttcccaagtccaaggatatcccactatcccctcccgcacagaaaaacgatccgaagaaggcccctgtggctagatcctctgtgggctgggacgcgacggaagacctgagaattagtcggacagattcttttagcagcatgacttcagattctgacactacatccccaacaggccagcagcctagcgacgctttccctgaggactcttcaaaggtgccaagggaaaaacctggtgattggaagatgcagtcccgaaagcgcacacaaaccctgcccaatcggaaatgctttttgacatccgccttccaaggagcaaacagcagcaagatggagatatttaaaaacgagttctggagtccgagtagcgaagcaaaggcgggagaaggtcacaggcggaccatgagccaagatctccgtcagctgagtgattcccagcggaccagcacctacgataatgtcccgagtctgcccggttcccccggtgaggaggcatctgcgcttagctcccaagcgtgcgatagcaagggagacaccctcgctagccccaacagcgagacaggacctggcaaaaagaatagcggggaggaggagatcgattccctgcagcgcatggtgcaggagctccgcaaggaaattgaaactcagaaacaaatgtatgaggaacagataaaaaatctcgagaaagaaaactacgatgtatgggcaaaggtggtgcgcctgaacgaggagctggaaaaggagaagaagaaaagcgccgcacttgaaatcagcctacggaacatggaaagaagccgcgaagacgtggagaagagaaataaagcccttgaggaagaggtgaaagagtttgtgaagtctatgaaggagcccaaaacggaggcttag

SEQ ID NO: 238702 - DNA, 1917 bp, Artificial Sequence
  Description of Artificial Sequence: Synthetic coding sequence
atgagcctgggacaatcagcttgtcttttcctttccatagcgaggagccgaagtgtgatgactggagaacaaatggcggctttccatccatctagtacaccaaaccctctagaacgcccaatcaagatgggctggctcaagaaacagcgctccatcgtgaagaattggcagcagagatatttcgtcctgcgggcacagcaactttattactataaagatgaggaagacaccaagccgcagggatgcatgtacctacccggttgtaccattaaagaaatcgcgactaaccccgaggaagctggaaagtttgtcttcgaaattattccagcatcctgggaccagaatcggatggggcaggatagctacgtcctcatggcgagttcgcaggccgagatggaggagtgggttaaatttctgaggagagtggcaggaactccctgcggagtgtttgggcaacggctggatgagacagtggcctacgagcaaaagttcggccctcacctggtgccgattctcgtcgaaaagtgtgctgaatttattttggagcatggtcggaacgaggaaggcatatttcggcttccagggcaggacaacttggtcaaacagctgagggatgcttttgatgccggagagagaccttctttcgacagggataccgatgtccacactgtggcatccttgctgaaattgtacctgagggacttgcctgaacccgttgtgccctggtcccaatacgaggggttcctcctctgcgggcagctcacaaacgctgacgaggcaaaggctcagcaggagctgatgaagcagctgagtattttgccaagagacaactacagtcttctctcctacatctgtagatttctacacgaaatccagctaaactgcgccgtgaataaaatgtccgtagacaatcttgccacagtgatcggggtgaacctgatccggtccaaagtcgaagatcctgccgttattatgagaggtacgccacagatccagagggtgatgactatgatgattagggaccacgaagtcctgtttcctaaaagtaaagacataccattgagtccccctgcacagaaaaatgatcctaagaaagccccagtcgcccgaagctccgtcgggtgggacgctacggaggatctgcgcattagccggacagattccttctccagcatgacctcggacagcgatactacatctcccacgggacagcagccttctgatgcttttccggaggacagttccaaggttccaagagagaagcccggtgactggaagatgcagtcccgcaagcgcacgcagacactgcctaacaggaagtgtttcttgacatcggcctttcaaggcgctaactctagcaagatggagatcttcaaaaatgaattctggtcacccagctctgaggccaaggccggagaaggccatcgacgaacgatgagtcaggacctccgccagctgtctgatagtcagcggacctccacatacgacaacgttccaagtctgcccggttctccaggcgaggaagcatcagcattaagttctcaggcttgcgacagtaaaggtgacaccttggcctctcccaattcagaaaccggacctgggaagaaaaattccggagaggaggagatcgactcactgcaaagaatggtgcaagagctgcgcaaagagatcgaaacccagaaacagatgtacgaggaacaaattaaaaacctggaaaaggaaaattacgacgtgtgggctaaggttgtgagactgaatgaggagctggaaaaggaaaaaaaaaagagtgctgccctggaaatcagtttgcggaatatggaacgttccagagaggatgtcgaaaagcggaataaagcattagaggaggaggttaaggaatttgttaagagcatgaaggagcccaaaacagaagcgtag

SEQ ID NO: 238703 - DNA, 1941 bp, Artificial Sequence
  Description of Artificial Sequence: Synthetic coding sequence
atgagcttgaagttacctcggaattgggactttaatctcaaggtggaggcagccaaaatcgcaaggtctcggtctgtaatgacaggcgagcaaatggccgcattccatcccagctccacccccaatcctctcgaacgtccgataaagatgggctggctcaaaaaacaacggagcatcgtgaagaactggcagcagcggtacttcgtgctgcgagcacagcagctctactattacaaagatgaagaggacacaaaaccacagggatgcatgtatttacccggatgtacaatcaaagagatcgctaccaacccggaggaggctggcaaattcgtgttcgagatcatcccagcttcttgggatcagaaccgtatgggacaagacagctacgtgttgatggcctcaagccaagcggagatggaagagtgggtgaagtttctacgtcgagtggccggtacaccctgtggcgctgtgttcggccagagacttgacgaaactgtggcttatgaacagaaattcggcccacacctagtgcctatcctcgtggagaaatgcgctgaatttattctggaacacgggaggaacgaagaaggcatcttcagactgccgggacaggataacctcgtaaagcagttacgcgacgcatttgacgccggtgaaagaccatctttcgaccgagataccgatgtgcacaccgtagccagtctgcttaaactttacctgagagacttgcccgaaccagtggttccttggtcccaatacgaggggttcctgctgtgtggacagctgaccaatgccgatgaagccaaagctcagcaggaactgatgaaacagctgtctattctccccagagacaactatagccttttatcatacatctgcagattcttgcatgagatccaactgaattgtgctgtaaataagatgtccgtggataatcttgccaccgttattggcgtgaaccttatccgttcaaaagtagaagatccagcagtgatcatgagggggactccgcagatacagcgggttatgaccatgatgatccgggaccacgaggttctgttcccgaaaagcaaggacatccccctgtcacctccagctcaaaagaatgaccccaagaaggcacccgtggccagaagtagcgtcggttgggacgctactgaagacctgcgtatttcacggaccgacagtttcagctccatgacttccgactcagatactacgtcccccaccggtcaacaaccctcagatgcgtttcccgaagattcaagcaaagtgcctagagagaaaccgggagactggaaaatgcagtcccgaaagaggacccagaccctgcctaaccgcaaatgctttttaactagcgcctttcagggggcaaattcctctaagatggagatttttaagaacgaattctggtccccctcctcagaagcgaaagccggtgaggggcacagaaggactatgtcccaggatctcagacagctctccgattcacagcggacgagcacctacgataacgtgccgtccctacccggatcaccgggtgaagaagcctctgcactatcgtctcaagcctgcgacagcaagggagatacactggccagcccgaatagcgagacgggacccggtaagaagaactccggggaagaagagatcgactcgctgcaacgaatggttcaagagctacgcaaagagatcgaaacacagaagcagatgtacgaagagcagatcaaaaatctggaaaaggaaaattatgacgtgtgggccaaggttgtgagattaaatgaagaactggaaaaagagaagaagaaatcagccgctttagaaataagcctcaggaatatggagcggagccgagaagacgtggaaaagcgcaacaaggccctggaggaagaggtcaaggagttcgtaaagtcgatgaaggaaccaaagactgaagcatag

SEQ ID NO: 238704 - DNA, 1920 bp, Artificial Sequence
  Description of Artificial Sequence: Synthetic coding sequence
atgtctctagggcagtcagcatgcctcttcctgtcaattgcccgaagtagaagcgtcatgaccggcgaacagatggcagcttttcatccgagctctaccccaaaccccctggagcgcccaataaaaatgggatggctcaaaaagcagcgctccattgtgaaaaattggcagcagaggtactttgtactgcgagctcagcaactatactattataaggacgaggaggacacaaaaccccagggatgtatgtacctaccgggatgcactattaaagagatcgcgacaaacccagaggaagcaggcaaatttgtgttcgagattattcctgcttcttgggaccaaaaccgcatggggcaagattcctatgtgttgatggccagtagtcaggcagagatggaggaatgggtaaagtttctgagacgcgtggcgggtacgccttgcggggctgtgtttggacagcgcctggatgaaacagtggcctatgaacagaaatttggaccacatctggtacctattttggtggaaaagtgcgcggaatttattctggagcacggccgaaatgaggaaggcatatttagactgccgggtcaagataacttagtgaagcaactcagagacgcgtttgacgctggagagagaccatctttcgatcgggacactgacgttcataccgtggccagtctgttgaagctctatctgagggacttgccagaaccagtggtaccgtggtcgcagtacgaaggctttttattgtgcggccagttaacaaacgcagatgaagctaaggctcagcaagaactcatgaagcagttatccatcctcccacgtgataactacagcctcctctcatatatatgtcgtttcctgcatgagatacagctgaactgcgccgtgaacaagatgtccgtcgacaatctggccactgtgatcggcgtgaacctcattcggtctaaggtggaggaccctgctgtcattatgcgaggtaccccacagatccagagagtgatgacaatgatgattcgggaccatgaggtgttgtttcccaagagtaaagatatccccctgtctccccctgctcagaaaaatgaccctaagaaggcccctgtggcacgatcatccgtggggtgggatgcaaccgaggacttaagaatctcaaggaccgactcattttcctcaatgacctcggattccgataccacgtccccgacaggccagcaaccctcagacgctttccccgaggactcttctaaggtgcctagggaaaagcccggtgactggaagatgcaaagtagaaagaggacacagactttgcccaataggaagtgttttctaacttccgcgtttcagggagccaattcatccaagatggagattttcaagaatgagttctggagtccctctagtgaagccaaagccggagagggccaccggaggaccatgtcccaggacctgaggcagctttctgacagtcagcgtaccagtacatatgataacgtgccaagccttcccggatcgccaggtgaggaggcgtctgcgctgagcagccaggcttgtgactctaaaggtgatactctagccagtccaaattcagagaccggtcccggaaagaaaaactcaggggaggaagaaattgacagtcttcagaggatggtacaggagcttaggaaggagatagagacacagaaacagatgtatgaagagcagataaagaacttggaaaaggagaactacgatgtctgggccaaggttgtgagactgaacgaagagcttgagaaagagaaaaagaaaagtgccgctctggagatctcactcaggaatatggaacgttctcgggaagacgtggagaagcggaacaaggctcttgaggaggaggtgaaggaatttgtgaaatctatgaaagagccaaagacggaagcttag

SEQ ID NO: 238705 - DNA, 852 bp, Artificial Sequence
  Description of Artificial Sequence: Synthetic coding sequence
atgacgggcgagcagatggccgcttttcatccaagcagcacacccaaccccctcgagagacccattaagatggggtggctaaaaaaacaacgctcaattgtaaaaaactggcagcaaagatatttcgtgctgagagcgcagcagctgtactactacaaagatgaggaggataccaaaccacagggctgtatgtacttaccgggatgcaccattaaggagatagctactaatcccgaagaagcagggaagtttgtgtttgaaatcatccccgcttcctgggatcagaatagaatggggcaagactcttatgtcctgatggctagcagccaagcagagatggaggagtgggtgaagtttcttagacgagtcgcgggtaccccctgtggggctgttttcggccagcgccttgacgagacagtagcctatgagcagaaatttggtcctcatcttgtgcccatcctggtggaaaaatgcgcagaatttatattggagcacggcagaaacgaggaaggaattttccgacttcccggtcaggataatctggtgaagcagctcagggatgcatttgacgccggagaacgaccatcattcgatagagacactgacgtccatactgtggcctcgcttctgaagctgtatttacgcgacctcccggaaccagtggtgccttggtcccagtatgaaggatttctcttgtgcggccagctcactaacgccgacgaggcgaaaaattatagaaataggaacgactgccagtctgtggtgtccgcacaaattcaccaattttgcccgagagtgagtctgctagctcacggtcaggctcaccttttggtgaatgatctgctggtgtag

SEQ ID NO: 238706 - DNA, 1776 bp, Artificial Sequence
  Description of Artificial Sequence: Synthetic coding sequence
atgagccttggacaatcagcgtgtttgtttctctctatcgccaggagccggagtgtgatgactggcgaacagatggccgcattccatcccagcagtacccccaacccgttggagcgtccgataaaaatggggtggctcaagaagcagcgaagcattgttaaaaattggcagcagagatacttcgttttgagggcacaacaattgtactactataaggatgaggaagacacaaagcctcaggggtgtatgtaccttccgggttgtaccattaaggaaatcgctacgaaccctgaggaagcagggaagtttgtattcgaaatcattcccgcatcttgggaccagaatagaatgggccaggattcgtacgtgctcatggcgtcatcccaagcggagatggaagagtgggtaaaattcctcaggagggtcgccggtactccttgtggcgcagtgttcggccaacgcctcgatgagaccgttgcctacgaacagaagttcggcccacacctggtgcccatcctagtagaaaagtgcgctgaatttatcctggaacatggccgaaacgaagaaggaatcttcagactacctggacaggataatctggttaagcagctgcgagatgcatttgatgcaggagagaggccctccttcgatagagatacggatgtacacacagtcgcatcccttttgaaattgtatctgagggatcttcctgaacccgtcgtgccctggagccagtatgagggttttcttctatgcggacagctgaccaatgccgacgaggccaaagcccagcaggagctgatgaagcagctgagtatcctccccagagacaattactccctcttgtcatacatttgcagattcctccacgaaatacagctgaattgtgccgtgaacaagatgtccgtggacaacctggctacagttataggtgtcaatctgataaggagcaaagtcgaggatcccgctgtgataatgcggggaacgccccagattcagcgggtgatgacgatgatgattagggatcacgaagtcttgtttcccaaatctaaggacattcccctttccccgcctgcacagaagaatgacccaaagaaggcgccagtagcacggagctctgtcgggtgggacgcaaccgaggacctaaggatcagtcggaccgactcatttagctccatgacctctgatagtgacacgacatctccgaccggtcaacagccatccgatgcctttccagaggatagttccaaggtacccagagagaaaccgggagactggaagatgcaatctcgcaaacgcacccagacccttcccaatcgaaagtgctttcttacatctgcattccaaggggctaactcgagcaagatggagatcttcaaaaacgaattctggtccccctcatcagaggctaaagcaggagagggacaccgacgcaccatgtcacaggacttgcggcagttgagtgatagccaacggacctctacatacgataacgttccctccctgcctggcagcccaggtgaagaggcatctgcactgtccagccaggcctgcgattcgaaaggtgatactctggcctccccaaactccgaaaccggccctgggaaaaagaatagtggtgaagaagagattgactcattgcagagaatggtgcaggaactccggaaggaaatcgaaacccaaaaacaaatgtatgaagaacagattaagaatctggagaaggagaactacgacgtatgggctaaagtagtgagaccgtttctcagcgccatctag

SEQ ID NO: 238707 - DNA, 1377 bp, Artificial Sequence
  Description of Artificial Sequence: Synthetic coding sequence
atgagcctaggccagtcagcctgcttattcctgtccatagcccgatcccgatccgtcatgactggggagcagatggcggcatttcacccatccagtacgcctaacccattggagcgacccattaagatgggctggctgaaaaaacagcgttctattgtcaagaattggcaacagaggtactttgttctgagggcccagcaactctattattataaggatgaagaggatactaaaccccaaggctgcatgtatcttcctggatgtactatcaaagaaatcgctacaaatcccgaggaagcagggaaatttgttttcgaaatcattcccgctagttgggaccaaaaccgaatggggcaggattcgtacgtcctgatggcctcttcccaggcagaaatggaggaatgggtaaagtttttgcgcagagttgcaggaacgccctgcggggctgtgttcggtcagaggctcgatgagactgtggcatacgaacagaagtttgggcctcatttagtgcccatactcgtggagaagtgcgctgaatttatcttagagcacggaagaaatgaagaggggatcttcaggctgcccggtcaggacaacctggtgaaacagctgcgtgacgccttcgacgccggtgaacgccctagcttcgatagagatactgatgtccatactgttgcaagtctactcaagctgtacctgcgggaccttcctgagcctgtcgtgccctggagccagtacgaaggcttcttactttgcggccagctgaccaacgcagacgaagccaaggcccagcaggaactgatgaagcagctcagtattcttccccgagacaactacagcttattgtcatatatctgcagatttttacatgagatacagctgaactgcgccgttaataagatgagcgtggataatctggcaacggtaatcggcgtgaacctcatccgctccaaagtggaagatcccgctgtgatcatgcggggaactccgcagattcagcgcgttatgacgatgatgattcgcgatcacgaggttcttttccccaaatccaaggatattcctctctcacccccagctcaaaagaacgaccctaaaaaagccccagtggcccgaagcagtgttggctgggatgctaccgaagatctgcggattagcaggaccgattcgttcagctccatggtgcggtgccgagagcccagctgtttccactgggtgctgcctctggtgcaggctattccctgcaaagcctgcagcagagtcgccatatggggcgttttaggagatgctgtggccgttggcgcagctgccacagatagttctgagcacacactgaaagcatggcctctatccaagagttctttctactggcacctttag

SEQ ID NO: 238708 - DNA, 1893 bp, Artificial Sequence
  Description of Artificial Sequence: Synthetic coding sequence
atgagtttgggccagtccgcctgccttttcttaagtatcgcccgttcaagaagtgtcatgactggtgaacaaatggctgctttccacccatcatccactcctaacccccttgagagaccaatcaagatgggctggctcaaaaaacagcgcagcatcgtgaagaattggcagcagtcctactactataaggatgaggaagacaccaagccccaaggctgcatgtatctccccggttgtacaattaaagagattgcaacaaatcctgaggaagccggaaaatttgtgtttgaaataatacccgctagctgggatcaaaatcggatggggcaggacagctatgtgctcatggccagttcacaggctgaaatggaagagtgggttaaattccttcggagagtggcgggaactccttgtggggcagttttcggtcagcggctcgatgagacagttgcctatgagcagaagttcggccctcacttggtccccatcctcgtcgagaaatgtgccgagtttattctggaacacggaaggaatgaggaaggcatcttccgcctccccggacaagacaacctggtcaagcaattgcgcgatgcctttgatgccggagagcgaccctcattcgacagggacaccgatgtacacacggtggcaagcttgcttaagctctacctccgggacttacccgagcccgtggtaccatggtcccagtacgaaggatttctcctgtgcgggcagctgacaaacgctgatgaggccaaggcacaacaggaactaatgaagcaactcagtatcttaccgcgtgataactactcccttttgagttatatctgccggttcctccacgagatacagttgaactgcgctgtcaacaaaatgagcgtggataacctcgccacagtgattggtgtgaacctcatccgttcgaaggtagaagatcccgctgtcattatgagaggtacccctcagatccagcgagtgatgactatgatgataagggaccacgaggtgctcttccctaaatctaaggatatccccctgagccctcccgcacagaagaacgacccgaagaaggcccctgtcgcccgaagtagcgttgggtgggacgccaccgaagacctgaggatctcaaggaccgactccttttcatccatgacgtctgatagcgatacaactagccccactggccagcagccatccgatgcgtttcccgaggattctagcaaagtacctcgggaaaagcccggtgattggaaaatgcagtccagaaagcggacacaaacactgccgaaccgcaagtgtttcctcactagtgcattccaaggtgcaaatagtagtaagatggaaattttcaaaaacgaattttggtcacccagtagcgaggcaaaagcgggtgagggtcacaggagaaccatgtcccaagacctcaggcagctgtccgactcgcaaaggaccagcacctatgacaacgtgccttctcttcctgggtccccgggagaggaagctagcgctctgagttcccaggcctgtgactcgaagggcgacaccctagcttctcccaatagcgagacaggcccaggcaagaaaaactcaggagaggaggaaatcgacagtcttcaacggatggtccaggagcttaggaaagaaatcgagactcaaaagcagatgtatgaagagcagattaagaacctggagaaggagaattatgacgtgtgggccaaggtggtacggctgaacgaagagttagaaaaagaaaagaaaaaatctgctgcgctggagatcagtctacggaatatggagcgctcccgcgaggatgttgagaaaaggaacaaagccctggaggaggaagtcaaggagtttgtgaagagtatgaaggagcctaaaactgaagcgtag

SEQ ID NO: 238709 - DNA, 852 bp, Artificial Sequence
  Description of Artificial Sequence: Synthetic coding sequence
atgactggagagcaaatggccgcatttcaccctagcagtactcctaacccactcgaacgccctataaagatgggatggctgaagaaacagagatccatcgtgaaaaattggcaacagagatactttgtgctgcgtgcccaacagctgtattactataaggacgaagaggataccaaaccgcaaggatgcatgtatctgccaggctgcacaatcaaggagattgctactaaccccgaggaggccggtaaattcgtatttgaaatcattcccgcatcatgggatcagaatcggatgggccaagacagttacgtgttaatggcgagtagccaggcagaaatggaggagtgggtgaaattccttcgtcgagtagcgggaactccttgtggtgctgtctttggtcagcggttggacgagacagtggcttacgagcagaagttcggacctcatctagtcccaatactcgtcgaaaagtgcgcagagtttatcctggaacacggtaggaacgaagaaggcatctttaggctacccggtcaagacaatcttgttaagcagctccgtgatgcttttgacgctggggaacgcccatcctttgatcgagatacagatgtgcataccgtggccagcttgctgaaactgtatctgcgggatttgccggaaccagtcgtcccatggagccaatacgaaggcttcctgctttgcggtcagttgactaatgccgatgaggccaagaattaccggaaccggaacgattgccagagcgttgtgagcgcgcagatccaccagttttgccctcgtgtgtcactgttggctcacgggcaggcccacctgctcgtgaatgacctcttagtgtag

SEQ ID NO: 238710 - DNA, 1821 bp, Artificial Sequence
  Description of Artificial Sequence: Synthetic coding sequence
atgtctctcaagttgccccgtaactgggacttcaacctaaaggtggaagcagcaaagatcgctcgctcgagatcagtgatgacgggggaacaaatggccgcttttcacccctcaagcacaccaaatcctttagagagacctattaagatggggtggctgaaaaagcaaagatcaatcgtgaagaactggcaacagagatattttgtgttgcgagcccagcaactgtattattacaaggacgaagaagacactaaaccacagggctgcatgtatctccccggatgtacaatcaaggaaatcgccactaatcccgaagaggctggcaaatttgttttcgagataatcccagttttcggacagcggctagacgagacagtagcctatgagcagaagttcggtccacaccttgtcccgatcttagttgaaaagtgtgcagagtttatcctcgaacacggcagaaatgaagagggaattttccggctacccggacaggataacctggtaaagcagcttagggatgcttttgacgctggggagcgaccgagtttcgacagggacactgatgtgcacaccgtcgctagtctgctgaaactctacctgcgggatttgccagagcccgtcgtgccatggagtcaatacgagggctttctgctatgcggacagttgacgaacgctgacgaggccaaggcgcagcaggaattgatgaagcaattatcgattctccccagagacaactacagtcttctcagctatatctgccggtttttacacgaaattcaattgaactgcgccgtgaataagatgtcggtggacaacttagcaaccgtgataggtgtgaatctgatccgctccaaggtagaggaccccgcagttatcatgaggggcactccacagattcagcgcgtcatgaccatgatgatcagagatcatgaggttttgtttcctaagtccaaagacattccactgtcgcctccagcccagaaaaacgatcccaagaaagctccggtagcccgttcatctgtcggatgggacgccacggaagacctgcggatttctcgcaccgactcgttctcttccatgacaagcgactctgacactactagccctacgggccagcaacccagcgacgccttccctgaagattcttcaaaagtcccacgtgagaagccaggagattggaagatgcagtccagaaaaaggacgcaaaccttgcctaacagaaagtgtttcctgacttcggccttccagggggcaaactcttcaaagatggaaatatttaagaacgagttctggagtccgagtagcgaggctaaggctggggagggtcacaggcggaccatgtcacaagatctgaggcaactatctgattctcagcgcacctctacctatgataatgtcccatcacttcccggatcccccggagaggaggctagtgccttgtcctcgcaggcttgcgacagcaaaggcgatacgctggcctcgccaaactccgaaacaggacccggtaaaaagaatagtggcgaagaggaaatcgatagtctgcaaagaatggtgcaggaactgcgcaaagaaattgagacccagaagcagatgtatgaagaacagattaaaaacttggaaaaggagaactacgatgtgtgggctaaggtggttaggctgaatgaggagctggaaaaggagaagaagaagtctgctgccctcgagatttccttgagaaatatggaaagatcccgcgaggacgtggagaaacggaataaggccttagaagaagaggtcaaggagtttgtaaagagcatgaaggagccgaagaccgaggcgtag

SEQ ID NO: 238711 - DNA, 2445 bp, Artificial Sequence
  Description of Artificial Sequence: Synthetic coding sequence
atgggcttaccggctctggagtttagtgattgttgccttgattctccccactttagagaaacccttaagagccacgaagcagaacttgacaaaaccaataagttcatcaaggagttgatcaaagatggtaaatcactcatctcagcactgaagaatctatcatccgctaaaaggaagttcgccgatagccttaacgaattcaaatttcagtgcatcggtgatgccgagaccgacgacgagatgtgtatcgcgaggtctctgcaagagtttgctacagtcctcagaaacttggaggacgagcgaatccgcatgattgagaacgcaagcgaggtgctcataaccccattggagaagtttcggaaggagcagatcggtgcggctaaggaagccaagaagaaatatgacaaagagactgagaaatactgcggtatactggaaaagcaccttaatctgagcagcaagaaaaaagaatctcagcttcaggaagcagattcacaggtggacctcgttcggcagcacttctacgaggtgagcctggagtatgtatttaaagtgcaggaagtccaggagagaaagatgtttgaattcgttgaacccctgctcgccttcttacaaggcctgttcactttctatcaccacggatatgagctggcaaaggatttcggcgacttcaagacgcagctgaccatctctattcaaaacaccaggaatcggttcgaaggcacccggtcagaggttgagtcattgatgaagaaaatgaaagaaaatccactcgagcacaaaacgatctcaccttatactatggagggatatctgtatgtgcaggaaaagagacattttggtacatcatgggtgaagcactactgtacctaccagcgggattcaaaacagatcaccatggtcccatttgaccaaaagtctggcggaaaagggggagaggatgagtcggtgattttgaaatcttgcacccgcagaaagacagacagcatcgaaaagcgtttctgttttgatgtcgaggccgtagataggcccggtgtgataacaatgcaggcattgtcagaggaagaccggcgtctttggatggaagcaatggatggtagggagcccgtctataatagcaacaaggactcccagtccgaaggtacagcccaactggactccatcggattttcaattattaggaagtgcattcatgcagtggaaacccgcggaatcaatgagcaaggcctgtaccggatcgtgggagtgaatagccgcgtgcaaaaactgttgtccgtgctgatggatcccaaaaccgcctccgaaacggagaccgacatatgtgcagaatgggagattaagaccatcacgagcgctcttaaaacttacctgaggatgcttcctggcccattgatgatgtatcagtttcaacggtctttcatcaaggcagcgaagctggaaaaccaggaaagcagggtgtcggagatacacagcctggttcatcggctccccgaaaaaaatagacagatgctacaactcctcatgaatcaccttgcgaacgttgccaataaccacaaacagaatttaatgacagtggctaatttgggcgtcgtcttcgggccaacgctgcttaggcctcaggaagagacagtggcagccattatggacatcaagtttcaaaacatcgtcatagagatactcatagagaatcatgagaagatttttaatacagtgcccgacatgcccttgaccaacgcccagctacatttatcgcgaaaaaagtcgagcgactcgaagcccccatcctgctccgaacgtccccttactctcttccacacggtgcaaagcactgagaagcaggagcagcggaacagcatcattaactcttcgctcgagagtgtgtcctcaaatcctaatagtattctcaacagctcctcctcactacaacctaacatgaattcgagcgatcctgatcttgctgtggtaaaacctacacgccctaacagtcttccacccaatcctagtccaacgtctcccctgtcaccgagctggccaatgtttagtgctccctcatcaccaatgcctacttcatccacctcaagtgatagcagtcctgtccggtcagtcgccggattcgtctggttctctgtcgctgcggtggtcttgtccctggcgagatccagtctgcacgcggtcttttccctgctggtcaactttgtgccatgccaccccaacttgcatctgctgtttgatagaccggaagaggcagtgcacgaggatagctccacaccctttagaaaggctaaggccctttatgcatgtaaagctgaacatgattctgagctaagcttcactgccggtacggtctttgacaacgtacatccctcgcaggaacccggttggctggaaggaacactaaacggcaagaccggactgatccccgagaattacgtggagtttctgtag

SEQ ID NO: 238712 - DNA, 2280 bp, Artificial Sequence
  Description of Artificial Sequence: Synthetic coding sequence
atgggtctcccagctctggaatttagtgattgttgtttggattcaccacactttagggagacactgaaatcacatgaggccgaattagataaaacaaataagtttattaaagaactgataaaggacggcaagagccttatctccgccctaaagaatttgagctccgccaagaggaaatttgctgattctttgaatgagtttaagtttcagtgcattggcgatgccgagacagatgatgagatgtgcattgccaggtcattgcaggaattcgctaccgtgctccgcaacctggaagacgagaggatacggatgatcgaaaacgcgagcgaggtgctgattactcctctggagaagttccggaaggagcagattggagcagccaaggaggcaaaaaagaagtacgacaaagagacggaaaagtattgcggaattttagaaaagcacctgaatttgagttccaagaaaaaagaaagccagcttcaagaggccgacagtcaggtggacttagtgcggcaacacttttacgaggtgagcctggagtacgtgttcaaggtgcaggaggtccaagagaggaaaatgttcgagtttgtagagcccttactcgccttcttgcaggggctttttaccttttaccaccacggctatgagttggccaaagatttcggggacttcaagacgcagctgaccatttccatccagaatacgcgaaaccgctttgagggaacccggagtgaggttgaatctctgatgaagaaaatgaaagagaacccgctggaacacaagacgatatctccatacaccatggaagggtacctgtatgtgcaggagaaacgccattttggcaccagctgggtgaagcactactgcacataccaacgggattcaaagcagatcacaatggtgccatttgaccagaaatccggtgggaaaggcggagaggatgagtccgtgatcctaaagagttgcactagaaggaaaaccgactccattgagaaacgtttctgctttgacgtggaggccgtagaccggccaggcgtgattacaatgcaggctctgagcgaggaggacagacgcctctggatggaggccatggatgggagagagccagtatataactcaaacaaggacagtcagagtgagggaactgctcaactggacagtatcggttttagcatcattcggaagtgcatccacgccgtggaaactcgcggtattaacgaacagggcctgtatcgtattgtgggcgtgaattcacgggttcagaagttactttctgtgctgatggatcccaaaaccgcaagcgagaccgagacagatatttgtgcggagtgggagattaagaccatcaccagcgcattgaaaacctacctcagaatgctgccgggtccgctgatgatgtaccagtttcagcggtcttttattaaagctgctaaattggagaaccaggagagcagagtcagcgagattcactccctagtgcatcgcctgccggaaaaaaaccggcagatgctgcagctgctcatgaatcacctcgcgaatgtagcaaataatcataaacaaaacctgatgacagttgctaatctgggagtggtattcggtcccactctcctaagaccccaggaggagacagtggcggcaatcatggatattaagttccagaatattgttatcgaaatactcattgaaaaccatgagaagatttttaacaccgtcccagatatgcccctgaccaacgcccagctgcatctgtctcgcaaaaagtcttcagattctaaacctccctcttgttctgagcggcctctgactctctttcacaccgtgcagtctacagaaaagcaggagcaaagaaatagtatcatcaacagttccctcgaatctgtttccagcaaccctaattcaattcttaactcatcgtcatcgctgcagcccaacatgaactcctccgacccagatttggctgtagtgaaaccaactaggcccaactcactgccccctaacccaagcccaacctcaccccttagcccaagctggcccatgttttctgctccttcctccccgatgcctacttccagcaccagctccgactcttcccccgtttccaccccatttcggaaggctaaagcactgtatgcctgcaaggctgaacacgacagcgagctcagttttaccgcagggaccgtgtttgataacgtccatcccagccaagagccaggatggctggagggaactctcaacgggaaaaccggcctgattccagaaaactatgtggaatttctatag

SEQ ID NO: 238713 - DNA, 885 bp, Artificial Sequence
  Description of Artificial Sequence: Synthetic coding sequence
tagcccaagaccgctagcgagactgaaacggacatttgcgcagagtgggaaataaaaacaattacttcagccctcaaaacataccttaggatgttacccggacccctcatgatgtaccagttccagagatcgtttattaaggctgcgaagctcgaaaaccaggagtctagggtgtccgagattcacagcctagtccaccgccttccagaaaagaatagacaaatgctccagttgctcatgaaccacctggccaatgtcgcaaataatcataagcagaaccttatgactgtcgctaatctgggggtggttttcggcccaacactgctgcggcctcaggaggaaaccgttgcagcgatcatggatattaagttccagaatatcgtgattgagatcctcattgaaaatcacgagaagatcttcaacaccgtgccggacatgccactgactaatgcacagttgcatctttctcgtaaaaagtctagtgacagtaagcccccatcgtgctctgaaaggcctttgactctgttccatacagtccaatcgaccgagaagcaggagcagaggaacagcatcatcaacagttcccttgaaagcgtgagctcaaacccgaatagtatcctcaactcctcgtcaagcctccagcccaatatgaacagcagcgaccccgacctcgccgtggtaaaaccaacccgccctaattcccttacgccattcaggaaagccaaagcgctctatgcatgtaaggccgagcacgatagcgagctatcctttacggccggaaccgtattcgataacgtgcaccccagtcaagagcccggatggctcgagggcaccctaaatgggaaaaccggtctgattccagaaaattatgttgagtttctgtag

SEQ ID NO: 238714 - DNA, 861 bp, Artificial Sequence
  Description of Artificial Sequence: Synthetic coding sequence
atggaccctaaaactgcaagcgaaactgaaacggacatttgcgccgagtgggaaatcaaaactatcacatcggcccttaagacctatctgagaatgctacccggacctctgatgatgtatcagtttcagcgatccttcataaaggctgctaagttggagaaccaagaaagtcgcgtctctgagatacactcattggtgcatcggctccctgaaaagaatcggcagatgctccaactgttgatgaaccacctggccaatgtagccaacaatcacaaacagaatctgatgacagtagcaaacctcggtgtggtttttggcccaacactgttgcgtccgcaggaagagactgtggctgcaataatggacataaaatttcagaacattgttatagaaattttaatcgagaaccatgagaaaattttcaataccgttccagacatgccactaacaaacgctcaacttcatctgagccgaaaaaagagtagtgatagcaagccaccctcttgctctgagcggcctttaactttgttccataccgtgcagtccacagaaaaacaggaacagaggaattcgattataaatagctccctagaatcagtgtcctctaacccaaacagtattttaaattcaagcagttcactccagcctaacatgaactccagcgatcctgatctggccgtcgtaaaacctacccgccctaacagtcttcccccaaatcctagtccgacaagtcctctttcacctagttggccgatgttttctgccccttcgagccctatgcctaccagcagtactagttctgacagctccccaagaatcacctggtcgtcctcaaatagggggcctcagcagaactgctag

SEQ ID NO: 238715 - DNA, 1167 bp, Artificial Sequence
  Description of Artificial Sequence: Synthetic coding sequence
taagctcagctggactcgataggcttcagtataatccgcaagtgcatccacgcagttgaaacgagggggatcaacgaacagggcttataccgtatcgttggcgttaacagccgtgtccagaaactgctttctgtgctgatggaccccaaaactgcttccgaaaccgagactgacatttgtgccgagtgggagataaaaaccattacgtccgccctgaaaacttacctgcgcatgctgccgggacccctgatgatgtaccaattccagcgatcatttattaaggctgcgaaacttgaaaatcaggagagtcgagtgtcagagatccattctctagtgcaccgtcttcctgagaagaatcgccaaatgctgcagctgctgatgaatcaccttgcgaatgtggccaacaaccacaagcagaatctgatgactgtcgcaaacttaggcgtggtgttcggccctactttgctgcgtccacaagaggagactgtcgccgcaatcatggatataaagtttcagaacatagtcatcgagatcctgatagagaatcacgagaaaatcttcaataccgtccctgatatgccactgaccaacgcacaactccacctgtcaagaaaaaagtcctcggactctaaaccaccttcgtgttctgagaggccattaaccttgtttcacacagtacaatccactgagaagcaggagcagcgcaactccataatcaattctagtcttgagtcagtgtcgtcaaatcctaacagcatccttaactccagctcctccttgcagccaaacatgaactctagcgatcctgatctggctgtggtgaagccaacacggccaaactccctgccacccaatcccagccctacctctccgttgtcaccaagttggccgatgttctccgcccctagctcacctatgccgacaagttctacctcatcagattcctcccctgtgagacctgaagaagcggtacacgaggatagcagcacgccattccgaaaagccaaagctctgtacgcttgcaaagctgaacacgattcagagttatccttcactgcgggaacagtgttcgataacgtccatccctcgcaggagcctggttggctcgaggggacgctaaatggcaagacaggcctgattccggaaaactatgtggaattcttgtag

SEQ ID NO: 238716 - DNA, 792 bp, Artificial Sequence
  Description of Artificial Sequence: Synthetic coding sequence
atggctgccgacgttgtcggggatgtctatgtgctggttgagcatccttttgagtacacaggcaaggacggccgacgagttgccattaggcccaatgagcgctataggttgttgagacggtctactgaacactggtggcacgtccgcagagaaccaggtggccgaccattctacctgccagctcagtatgtccgggaattgcccgcattgggaaaccctgctgcggcagcccctcctggtcctcatccaagtcccgcagcccctgagcccctggcctatgattacaggttcgtctcagccgctgccactgccggaccagacggagctcctgaggagtctggtggcagagcgtcttctctgtgtggacccgcacagcgaggcgcagccacccagcgcagcagtttggcgccaggcctaccagcttgcctgtacttgcgaccggcagccccagtgcggccagcccaatctctgaatgatctcgcttgtgcagctgtgagcccccctgccggacttctgggatcatctgggagttttaaggcttgcagcgttgctgggtcatgggtctgtccgagaccactggccaggagcgatagcgaaaatgtgtacgaggtgatacaggacctgcacgtcccccctccagaggagtcagccgagcaggtcccacccagagcattgggccgagggggtgggtggcgagctagggatcgagccagaaccgagcccggaaggaaagaaacaagatcagcgcaacggagagcccgaagacccccattgagcgaagactttgggtag

SEQ ID NO: 238717 - DNA, 1647 bp, Artificial Sequence
  Description of Artificial Sequence: Synthetic coding sequence
atgcaacccggactgtccccaggaagccctggcgatcccaggccacctacacccgagaccgattacccagagtccctaacctcttatcctgaggaggattactctccagtcgggtctttcggggagcccggaccaaccagcccactcaccacgccacctggctggtcatgtcacgtctcacaggacaagcagatgctctacaccaaccacttcactcaggagcagtgggtgcggctggaagatcctcacgggaagccttatttttataacccagaagactcctccgtcagatgggaactgccgcaagtcccagtacccgctcccaggtccatacacaagagttcccaggatggtgacactccggcacaggcctcccctccagaggaaaaagtgcctgctgagctggatgaagttggaagttgggaggaggtttcgccagcaaccgccgcagttagaacaaaaacactagataaggccggagtactccaccgaaccaaaaccgctgataagggaaaacgcttacgaaagaagcactggagcgccagctggaccgttctagagggcggagtgctcacattcttcaaagactccaagacgtccgcggctggcggactcaggcagcctagtaagttcagcacgcctgagtatacagtggagctgaggggggcaactttatcttgggctcccaaagataaatcaagtaggaaaaatgtcctggaactcagatcccgggacggctctgagtatctgatccaacacgatagcgaggctattatctccacatggcacaaggccattgcccaaggcatccaggaattatcagcagagctcccaccagaggaatctgaatccagtcgcgtggatttcgggtctagtgagcggttgggttcctggcaggagaaggaagaggatgcgaggcctaacgcagcagccccagccctggggcctgttgggttggagagcgatctttcgaaggttcggcataaactcaggaaattcctgcagcggaggcctaccttgcagtcactgcgggaaaaaggctatatcaaggatcaagtctttgggtgcgctctggcggcactttgcgagcgtgaacgatcccgtgtgccccgtttcgtgcagcaatgcattcgcgctgtggaggccagaggcctggatatcgacggcctttataggattagcgggaatctggccactatccaaaagttgcggtacaaagtggatcatgatgagagactggacctcgatgatggtcgttgggaggacgtgcatgttatcaccggggctctgaagctgttctttagagagctgcccgagccactttttccttttagccattttcgccaatttatcgcagctatcaagctccaggaccaggcccgacgcagtcgctgcgtccgtgacctcgtaaggtccctgcccgcacctaaccatgacactctgcgtatgcttttccagcatctctgccgggtgattgaacacggagagcagaataggatgagtgtccaatctgtagcgatagtctttggccctacgttgcttcggcctgaggtagaagagacaagcatgcctatgaccatggtgtttcagaatcaagtcgtggagctgatcctccaacaatgcgccgatatatttccaccacactag

SEQ ID NO: 238718 - DNA, 2670 bp, Artificial Sequence
  Description of Artificial Sequence: Synthetic coding sequence
atggccgcagacgtcgtgggtgatgtctacgtgctggtcgagcacccattcgagtacactggtaaggacgggagaagagtggcaattcgtcccaatgaacgttaccgcctgctgcggcgaagcacagaacactggtggcacgtgaggagagaaccgggtggtcgtccgttctacctacccgcacagtacgtgcgagaactgcccgcactgggcaatcctgctgctgcggctcccccaggtcctcacccgtccccggcagcaccggagcctctcgcctatgattatagatttgtaagtgcagccgcaacggcaggaccagatggagcaccagaagagtcaggagggcgtgcctctagtttatgtgggcctgctcagaggggggcagcgacacagcggagttctctggccccagggcttcctgcctgtctttatttgcgcccagccgcacccgtgaggccagcccagagcctgaacgacctggcctgtgccgctgtctcccctcccgctgggctgctcggctcttcaggttctttcaaggcctgcagcgtcgcagggtcctgggtgtgcccacggccacttgcgagaagtgatagtgaaaacgtgtacgaagtcatccaagaccttcacgtacctccgcctgaagaaagcgctgaacaagtggacgatccgcctgagcctgtgtatgcaaacatcgagcggcagccaagagcgacctcacctggtgcagccgctgcacctttgcctagcccagtctgggaaactcacacagatgctggtacaggcagaccttactattacaaccccgacacaggggtgacaacttgggagtcacctttcgaggccgctgaaggggctgcctcccctgcgacctctccagcttctgtggactcccacgttagtctggaaactgaatggggtcagtattgggatgaggagtcaagaagggtcttcttctataatcccctgacaggcgaaaccgcgtgggaagatgaggccgagaatgaaccagaagaggagttggaaatgcaacctgggcttagcccaggctcacctggggatccgcgtccgccaaccccagagaccgattaccccgaaagccttaccagttacccggaggaggattattctcctgttggaagttttggagagcctgggcctacatcgcctctgactacgccacccggatggagttgtcatgtttctcaggacaaacaaatgctgtacaccaatcattttacgcaagagcagtgggtccgcttggaggaccctcatggcaagccctatttttacaaccctgaggacagtagcgtccggtgggagctaccccaggtgccggtacccgcacccagatccatccacaagagtagtcaggacggtgacacaccagcccaggctagcccacccgaggagaaggtcccggcagagcttgatgaagtagggtcgtgggaggaagtatcacccgcaacggctgccgtgcgaactaagaccctcgacaaggccggagttttacaccggactaagacagccgataagggcaaacggctgcgaaaaaaacactggagtgctagctggaccgttcttgaggggggtgtcttaacgttctttaaagatagcaagacttccgccgctggaggcttacgacagcctagtaagttctcaactcccgagtacactgtcgagctcagaggagccaccctgtcatgggcccctaaggacaaatcgtctagaaaaaacgtgctggagctgcgatcacgcgatggtagtgagtatttaattcagcatgattccgaagccatcattagtacatggcacaaggccattgctcagggcatccaggaattgtccgcagaacttccaccagaggagagcgagtctagcagagtggacttcggctccagcgagcggctggggtcctggcaggagaaagaggaagacgcacggcctaatgctgcggctcctgctttagggcctgtgggactggaatctgatttgagcaaggtgcgccataagctgcgaaaattcctccagcggaggccaaccctacagtctctccgtgagaaagggtacattaaggatcaggtgttcgggtgcgccctggcagctctctgcgagcgggaaaggtcaagagttccgcgatttgtgcaacagtgtatcagggccgtcgaagccaggggtctggacatcgatggactttataggatctctggtaacctggcaaccatacagaagctccgctataaagtcgaccacgacgaaaggctggaccttgacgacggtagatgggaagatgtgcatgtgattacaggtgctcttaagctctttttccgggaactgcccgaacccttgttccctttctcccatttcagacagttcatcgccgctattaagctgcaggatcaagcccgacggtcccgttgtgtgcgggaccttgtgcgctccctcccggctccaaaccacgacaccctgagaatgctatttcagcatctgtgccgggtgatagaacacggagaacagaaccgtatgagcgtccagtcggttgccattgttttcggaccaacactactgaggcccgaagtagaagaaacaagtatgcctatgaccatggtatttcagaatcaggtcgtagagctcattctgcagcaatgcgcagacatcttccctccacactag

SEQ ID NO: 238719 - DNA, 2589 bp, Artificial Sequence
  Description of Artificial Sequence: Synthetic coding sequence
atggccgctgatgttgtgggagacgtgtacgtcctggtagagcacccgttcgaatacaccggaaaggatggcagaagagtggctattagaccgaacgagaggtatcgcctgcttcgcaggagcactgaacactggtggcacgtgcgcagagagcccggagggagacctttttacctgcctgctcaatatgtacgggaacttccggctttggggaacccagccgctgctgctcctcccggaccccatcccagtccagcagcccctgagccactcgcgtatgattataggtttgtgagtgccgcagcgactgcgggacccgatggagctcctgaagagtcaggcggtagagcctccagcttatgcggccctgcccagcggggagcagctacacagaggtctagtctcgcacccggactgcctgcctgtttgtacctgaggccagcagctcctgttagacccgcacagagtctgaacgacttagcttgcgcagccgtgtctcccccagctggactactgggcagctctggatccttcaaggcctgtagtgtcgctgggtcatgggtgtgtccacggccattggctagatcagattcagaaaatgtctatgaggtcatccaggatcttcacgttccccctccggaagagtccgcggagcaagtggacgacccacctgagcccgtgtatgctaacattgagcggcagcccagagcaaccagtccaggtgcagccgcagctccattgccgtcgcctgtatgggaaactcacacagatgcagggacaggaagaccatactattacaatcccgacacaggagtaacaacctgggaatccccctttgaagcagctgaaggcgctgcctctcccgctactagccccgcttctgtggattctcatgtgtccctggaaactgagtggggccagtactgggacgaggaatctcgcagagtgtttttctacaatccgctgaccggagagactgcttgggaggatgaagcagagaatgaacccgaagaagagctggagatgcagcccggactctctccaggctccccaggagatccaaggccacccacgccagaaacggactaccctgagagtctaacctcatacccggaggaggactatagtcccgtcggaagtttcggggaacctggacccacatctccattgactactcctccgggttggtcctgtcatgttagccaggacaaacagatgctgtatacaaaccactttacacaggaacaagttccggtacctgcccctcgtagtattcacaagagctcccaagacggggacacccctgcccaagcctctccccctgaggagaaagtccctgccgaattggacgaggtaggtagctgggaggaggtttcccctgccacagccgcagtgcggacaaagacacttgataaagcaggtgttttacacagaacgaagactgctgataagggcaagaggctccggaaaaaacattggagtgccagttggacagtgcttgagggcggagtgctaacattcttcaaggactcgaagacatcggctgctggaggtttacggcaaccctccaagttttctaccccagagtacacagtggaactgcgtggcgcaaccctgtcctgggcccctaaggataagagcagtcgaaaaaatgttctggaattgagatcgcgcgatgggtcagagtacctcattcagcacgattccgaagctatcataagcacttggcacaaggccattgctcagggcatccaggagctttccgcagaacttccccctgaggagtcagagtctagtagagtggattttggctcctcagaacgcctggggtcttggcaagaaaaagaagaggacgctagaccaaatgccgctgcaccagcgctgggtcccgtgggcttggaatcagatctttccaaggttcgccacaagctgagaaagtttttgcaacgtcgcccaacgctgcagtctctgcgggagaaggggtacataaaagatcaagttttcggttgcgctcttgcggctctgtgcgagcgcgagcgttctcgcgtcccccgatttgtgcagcagtgcattagggcagtcgaagcgaggggactggatatcgacggactgtaccgtatctctggaaacctggccacaatccaaaagcttcggtataaggttgaccatgatgagagactcgatctggacgacgggagatgggaagacgtccacgttatcaccggagctcttaagctcttctttagggagttgcctgaacccctgtttccctttagccacttcagacagttcatcgctgctatcaagctgcaggatcaggctcgcaggtcccgctgcgtgcgggatctggttcgctccctgcctgcgccaaatcacgacacactgagaatgctcttccaacatttatgtagggtcatcgagcacggcgagcagaatagaatgtccgtccagtccgtcgctattgtgttcggccctacactactgcgccctgaagtcgaggagactagcatgccaatgacaatggtcttccagaaccaggtggtggaacttatcctccagcagtgcgctgatatctttccaccccattag

SEQ ID NO: 238720 - DNA, 1647 bp, Artificial Sequence
  Description of Artificial Sequence: Synthetic coding sequence
atgcagcctggattatcgcctggctcccccggagaccccagacctcccacaccagaaacggactatccagagtctctgacatcctatcccgaggaggactattcacccgtagggtctttcggagagcccggtcctacttcccccttgactacacctcccggttggtcctgtcatgtgtcgcaggacaagcagatgctgtatacaaaccactttacccaggaacagtgggtcagactagaggatccgcatggtaaaccatacttctataatccagaagactcctcagtgagatgggaattgccccaggtacccgtacctgcaccccgttcaatacataaatcttctcaggacggagacactccagcacaggcatcgcctccagaggagaaggttcctgccgaactagacgaggtggggtcctgggaagaagttagtccagctaccgccgctgtcaggacaaaaaccctcgacaaggctggggtccttcaccgaacaaaaaccgccgacaagggtaagcggctgcgaaagaaacattggtcagcaagctggactgtcctggagggaggcgttctgacattcttcaaggatagcaaaacctcagccgcagggggactgaggcagcccagcaagttcagcaccccagaatatacagtcgaactaagaggggctactcttagttgggcacccaaagataagtcttcccggaagaatgtactcgagcttcgctctcgagatggaagtgagtatttgatccagcatgactcggaggctattatttccacctggcataaagccatcgcccaagggattcaggagttgagcgcagaattgccccctgaggaatctgaaagcagtagagtggactttggaagcagcgaacgtctgggctcatggcaggaaaaagaggaggacgctcgtccaaatgccgcagccccagctttgggacccgtcggcctggaaagcgacttgtccaaggtccgccacaaactgaggaaattcctccagcgtcggcctaccttgcagtcacttagggagaagggctacataaaggaccaggtctttggatgcgcattggccgctctctgtgagagggagagaagccgcgtcccgaggttcgtgcagcagtgtatcagagcagtggaagcccgagggcttgatatcgacgggctttaccggatctccggaaatctcgcgactatacagaaacttaggtataaggtggatcatgacgagagattagacttggacgatggcagatgggaggatgtgcatgtaatcaccggtgccttaaagctgttttttcgggagctgccagaacctctgttccctttctctcatttccgacaatttattgcagccatcaagctgcaagatcaagcacggagatccagatgcgttcgcgacctggtccgttccctccctgctccaaaccatgacaccctaaggatgttgttccagcatctgtgccgtgtcatagaacacggggagcagaaccgcatgagtgtccagagcgtggctattgtgtttggcccaacacttctaaggccagaagtggaggaaacttctatgcccatgacaatggtctttcagaaccaggtggtggagctgatcttgcagcaatgtgccgacatatttcctcctcactag

SEQ ID NO: 238721 - DNA, 792 bp, Artificial Sequence
  Description of Artificial Sequence: Synthetic coding sequence
atggccgcagatgtcgtgggggatgtgtatgtgctggtggaacacccctttgagtacacgggaaaggatggtcgacgagttgctatacgacctaatgagagatacaggttgctgcgcaggtcgacagaacactggtggcacgtcaggcgggagccaggaggccgtccattttatctcccggcacagtatgttcgagagctgccagctctcggcaatcctgctgcagcagctccacctggacctcatccctcgcctgccgctcccgaaccactcgcttatgattaccgatttgttagcgctgccgctactgccggtcccgacggagcaccggaagaaagcggcggacgggctagtagcctctgcggtccagcacaacgtggcgcagccactcaacgcagctcactggctcctgggctcccggcatgcttatatctgcgcccagccgcacctgtccgtcccgctcagtcgcttaacgacctcgcctgcgccgcagtctcccctccagcagggctgctgggttcctcagggtccttcaaggcttgtagtgtcgcaggatcctgggtgtgtcctcgacccttggccaggagtgactccgagaatgtctatgaagtaattcaggatctgcacgtgcctccacctgaggagagcgctgaacaagttcctcctcgggcactgggacgcggaggcggatggagagccagagaccgtgcacgcacggaacccggaagaaaggaaacgcgaagtgcccagaggagagctcgcaggcctcccctctctgaggatttcggctag

SEQ ID NO: 238722 - DNA, 1566 bp, Artificial Sequence
  Description of Artificial Sequence: Synthetic coding sequence
atgcagcccggactttccccgggatcccctggggaccctcgccctcccacaccagagactgactatcccgaatcactgacttcgtatcctgaggaggattactctcctgttggctcctttggcgagccagggccaactagcccccttacaaccccaccagggtggagctgccacgtgtcccaggacaagcagatgctgtataccaatcacttcacccaagaacaagttccggtgccagcgcctcgctccatccacaaatcttcgcaagacggtgacacaccggctcaggccagcccgccagaggaaaaggtgccagccgagctggacgaagtggggtcctgggaggaggtgagccccgctacagccgctgtccggactaaaaccctcgacaaagccggagtgcttcaccgcacaaaaactgccgacaaggggaaacgcttgcgcaagaagcattggtccgcttcgtggactgtgttggagggaggcgttttaacattctttaaggactccaaaacctcagcggctggaggcttgaggcaacccagcaagttctcaacacctgagtataccgttgagctgaggggagctacactgtcctgggccccaaaggataagtccagtcgcaaaaatgtgctggaacttagaagcagagatggttccgagtatctcatccagcatgactccgaagcgattatatctacttggcacaaagctattgcccaggggatccaggaactcagcgccgaactcccccctgaggaatccgagtcttcaagggtggacttcggctcctctgagaggctcggatcgtggcaggagaaagaggaagacgctcgccctaacgccgcagctcccgctttgggccctgtcggtctggaatcagacttgagtaaggttcggcacaagctgcggaaatttctacagcgcagacccactttacagtcactgcgagagaaaggctacatcaaagatcaggtatttggatgcgctctggcggcactgtgcgagagggaaagatcaagggtaccacgttttgtacaacagtgcatcagggctgtcgaagctagaggactagacatagacggcctgtaccggatctcgggcaatcttgccacaatccaaaaacttcggtataaggtggatcacgacgagaggcttgatctggacgacgggagatgggaagacgtgcatgtgattaccggagccctgaagctgttctttagagagttacctgagccattatttccattcagccatttcagacagtttattgcagctatcaaactgcaggaccaggctagacggagccgctgtgtgagagacctggtaaggagtttgcctgccccaaatcacgacaccctcagaatgctgttccagcacctttgtcgggttatcgaacacggcgagcaaaaccgaatgagtgtacaatctgtggccatagtattcgggccaactctgctacggccagaggtggaggaaacgtctatgccaatgaccatggtattccaaaatcaggtggtggagttgattttgcagcaatgtgctgatatattcccaccgcattag

SEQ ID NO: 238723 - DNA, 2013 bp, Artificial Sequence
  Description of Artificial Sequence: Synthetic coding sequence
atgttgtccaacgagagcctgcaccctcctgcctttagccgtagcaattctgaggcctccgttgacagtgccagcatggaagatttttggcgcgagatcgagagtatcaaggactcgtctatgggaggccaggaggagccgcctccagccgaagtcacaccggtggatgagggtgaactcgaggctgagtggttacaggatgtgggcctgtcgacgttgatcagtggagacgaggaggaagacggcaaggctctcctgtcgaccctaactcgaactcaggcagctgctgttcagaagcgctatcacacctatacccagaccatgcgcaaaaaggataaacagtcaatccgcgatgtccgtgacatctttggagtgtcagagtccccaccccgagacacttgtggcaatcacacgaatcagttagacgggaccaaagaggaaagagagttacccagagtcataaaaaccagtggatcaatgcccgatgacgcaagcctcaacagtacaactttatcagacgccagccaggataaggaaggctccttcgccgtcccacgcagcgattccgtcgccatcttggaaacaattccggtgctaccggtgcacagcaatggcagccctgagcctgggcagccagtacagaacgctatttcagatgatgatttcctggagaagaacattccaccagaggctgaggaactttcgttcgaagtctcttattcagagatggtgacggaggcactcaagcgcaataagctgaaaaagagcgaaatcaaaaaggaagactacgtgctgacaaaattcaacgtgcaaaaaaccagattcggtctaaccgaggctggcgatctctccgccgaagacatgaagaagattagacacctctcattaattgagttgacggctttcttcgatgctttcggaattcagctcaaacgaaacaaaactgaaaaggtcaaagggagggacaacggaatattcggagtgcccttgaccgtgctcttagacggtgatcggaaaaaagacccgggagtaaaggtaccgctagttcttcagaaatttttcgaaaaggtggaggagtcaggtctcgagtctgaggggatcttcaggctctccggctgtacagctaaggtgaaacagtatcgggaggaactggacgcaaagttcaacgctgacaaattcaagtgggacaagatgtgccaccgggaagcggcagtaatgctaaaggcctttttcagggaactgccaacgtccctatttcccgtggaatacatccccgcattcatcagtctgatggagcgcggaccgcatgtgaaagtgcaattccaggccctacacctaatggtgatggccctacccgatgcaaaccgggatgctgctcaggccttgatgacttttttcaataaggtcatcgctaatgagagtaaaaatcgaatgtcactctggaacatctcaacggtgatggcaccgaacctgttcttttcccgctccaaacattcagactatgaggaattgctgctggccaacaccgccgctcacattattagattaatgctgaaataccaaaagatattgtggaaagttcccagcttcctgatcactcaggtcaggagaatgaatgaggctacaatgctcctgaaaaaacaacttccctcggttcgcaaactactgagaagaaagaccctggaaagagagaccgccagtcctaaaactagcaaagtgctgcagaaaagtccctcagccaggcgcatgagcgatgtacccgagggcgttatacgcgtccacgcccctttgctatccaaagtctctatggcaattcagctcaacaaccaaactaaggcaaaagatatcctggcaaaattccagtatgagaatcgcatcctgcactggcagagagctgccctgagctttctgaacggcaaatgggtaaagaaagaacgggaagaaagcacagaaaccaaccgctctcccaagcacgtatttctctttaccatcggtctggacatttcgacttag

SEQ ID NO: 238724 - DNA, 1713 bp, Artificial Sequence
  Description of Artificial Sequence: Synthetic coding sequence
atgcggaaaaaggacaaacagtctatccgagacgtgcgagacattttcggcgtgtctgagagcccccctcgggacacatgcgggaaccatacaaatcaattagacggaacaaaggaggaacgggaattgcccagagtcattaaaaccagtggatctatgccagatgatgcaagcctcaattcaacaacgctatcggacgccagccaggataaggagggaagctttgccgtacctcgcagcgactctgtcgcgattctggagactatcccagtgctccctgttcattcaaacggctcacctgagcccggacaacctgttcagaacgccatcagtgatgatgatttccttgagaaaaacattcctcccgaggccgaggagcttagcttcgaggtctcatactcagagatggtcacagaagcactgaagagaaacaagctgaagaagtccgaaataaagaaagaggattatgtgctgaccaagttcaacgtgcagaaaacgcgcttcggcctgaccgaggccggtgacctctctgctgaggatatgaagaaaatccgccatctgtcactgatcgagctgaccgccttttttgatgcttttggcatccaactgaaacggaataagacggaaaaggtaaagggcagggataacggaatctttggcgtcccactaaccgttctcctggacggtgaccgcaaaaaagatcctggagttaaggtgccacttgttttgcagaagttcttcgaaaaggtggaggagtcaggcctggagtcggaaggaatcttcaggctgagcggatgtactgccaaagttaaacagtatcgtgaggagctggatgccaagttcaacgccgataagttcaagtgggacaagatgtgtcacagggaagccgctgtcatgctcaaggcctttttccgagagcttcccaccagtcttttccctgtagagtacatccctgcgttcattagcctgatggagcgtggacctcacgtaaaagtgcaattccaagcactacacctgatggttatggccctccctgatgccaatcgcgacgcagctcaggcattgatgacattcttcaataaagttattgccaacgaatctaaaaaccgcatgagcctatggaacatcagtactgttatggccccaaatttgtttttctcacggtccaagcactccgattacgaagagctgctcttggctaacaccgccgctcacatcatacggctgatgctgaaatatcagaagattctctggaaagtaccaagcttcctgattacccaagtccgcaggatgaatgaggctacaatgctgctgaagaaacagctgccaagcgtgagaaaacttctgcgcaggaagacacttgagcgcgaaaccgcttctccaaagacctccaaagtgctgcagaagtctccctcggctaggagaatgtctgatgtgcctgagggcgtaatccgggtccatgcacccctcctgtccaaggtgtccatggctatacaactcaacaatcaaactaaggcaaaggatatcctggcaaagtttcagtatgagaacagccacggctcgtccgaatgcattaaaattcaaaaccagcgcttatacgagattgggggaaacatcggtgagcactgcctggaccccgacgcatacatccttgatgtgtatagaatcaaccctcaagcagagtgggtgataaaacctcagcagtcaagctag

SEQ ID NO: 238725 - DNA, 1638 bp, Artificial Sequence
  Description of Artificial Sequence: Synthetic coding sequence
atgaacgagctgccgagggatacatgcggcaatcacacgaatcaactcgatggcactaaagaagaacgggaactacccagggtgatcaagactagcgggtctatgcccgatgacgcttctctgaactcaactacactttcagatgcaagtcaagataaggaaggcagttttgccgtgcccaggtccgattccgtcgctattctagaaaccattccggtgttacctgttcactcaaatggcagcccagagcccggtcaaccggtccagaacgccatctccgacgatgactttctagaaaaaaacattccacccgaagcagaagagctgagtttcgaggtatcatatagtgagatggtgacagaggcactcaagcgaaacaagctgaagaaatccgagatcaagaaagaggattacgtgcttacaaaatttaatgttcagaaaacgcggttcggactcacagaggctggggacctgagcgcagaggatatgaaaaaaatcagacatctctctttaattgagctgaccgcctttttcgacgcctttgggatacagttgaagagaaacaaaacagagaaggtgaaaggcagggacaatgggatttttggtgtgccgctgaccgtactgctagacggcgataggaaaaaggatccaggcgtaaaagtgccactcgtgttgcagaagttcttcgagaaagtggaggagtctggcctcgaatctgagggcatttttaggctttcaggttgtactgcaaaagttaagcagtaccgcgaggagctcgacgcgaagttcaacgccgacaagttcaaatgggacaagatgtgccacagggaggctgcagtaatgctgaaggcgtttttccgggagcttcccacctcactgtttcccgttgagtatatccccgcatttatctctcttatggagagaggccctcatgtgaaggtacagttccaggccctacacctcatggttatggccctgccagacgctaaccgggatgctgcacaagcattgatgacgttctttaataaagtgattgcaaacgaaagtaagaataggatgagcttgtggaacatcagcactgtgatggctcctaacctcttcttcagcaggagcaaacacagcgattacgaggagctgttgctggcaaacaccgccgcacatataattcggcttatgctgaagtatcagaaaatactctggaaagtgcccagcttcctgatcacccaggtgcgacgcatgaacgaggcgacaatgctgctgaagaagcagctgccctctgtgcgcaagctgctcaggcgcaaaaccctggaaagggaaacagcttcccctaaaacctctaaggtgcttcagaagtccccttccgctaggcgtatgagtgacgtgcctgagggcgtgattcgagtccacgccccattactgtccaaagttagtatggccatccagttaaacaaccagaccaaagcaaaagacatactcgcgaagtttcagtacgagaacaggatcctacattggcagcgcgctgccctttccttcctaaacggcaaatgggtaaagaaagaaagggaagaaagtacggagacaaaccggagccctaagcacgtctttctgtttacaatcggcctggatatttccacatag

SEQ ID NO: 238726 - DNA, 2169 bp, Artificial Sequence
  Description of Artificial Sequence: Synthetic coding sequence
atggaggtggaggattctggcggagttgtgttgaccgcatatcacagttacgcccgagcacaaccgcctaacgcagagtcccgctgcgcgcctagggcagcggcttctcacccattgtctagaaaaagcatcccacgatgtagaaggattaaccggatgctaagcaatgagagcctgcacccccctgcgttcagcagaagcaattcagaagcctccgtagacagcgcctcaatggaggatttctggcgggagatcgagagcattaaggattccagcatgggcggacaagaggaaccacccccagcagaggttactcccgtggacgagggcgaactagaagccgagtggttacaggacgtagggctgtccactttaattagtggcgacgaggaagaagatggcaaggccctgttgagcactctgacccgcactcaggcagcggcagtacagaagagataccatacctatacacaaacgatgcggaagaaggacaaacaatccatccgggatgtacgtgatatctttggggtgtcagagtcccccccacgggatacctgtggaaatcacaccaaccagttagacggcacgaaggaagagagagagctacctcgggttatcaagacatccggtagcatgcctgacgatgcatctctgaactcaaccacgctttctgatgcaagccaggacaaagaagggagttttgctgtgcccagatctgacagcgttgctatcctggaaaccattccggtgctgcccgtccactctaatggttcccccgagccaggacaaccggtgcaaaacgctatatccgacgatgacttcctggagaagaatataccacctgaagccgaagagttaagcttcgaggtgagctactcagaaatggtaacggaggccttgaagcgtaataagctcaagaaaagtgaaatcaagaaagaagactatgtgctgaccaaattcaacgtccagaagacacggtttgggttgaccgaggccggagatttgagcgccgaagacatgaaaaagattcgccacttgagtctgatcgaactcactgctttcttcgatgcattcggaatccagctgaagagaaacaaaaccgagaaagtgaaaggaagagataacggcatcttcggagtgccactgaccgtgcttcttgatggagaccgtaaaaaagatcccggagtaaaagttccactggtgctgcagaagttcttcgagaaggttgaagaaagcggcctcgagtctgaggggatctttagactaagcggatgtacggccaaggttaagcagtaccgagaagagctggacgctaaattcaatgctgataagttcaaatgggacaagatgtgccacagagaagcagccgtgatgctgaaagcctttttccgcgaactgccaacgagcctattccccgttgaatatattcctgccttcatctccctcatggagcgaggccctcacgtcaaggttcagttccaggcccttcacctcatggtgatggcactgccagatgctaatcgcgatgctgctcaagctctgatgacgttcttcaataaggtgatcgcaaacgagtccaaaaatcgtatgtccctgtggaacatctcaaccgtgatggcacccaacctctttttcagtcgcagtaagcactctgattatgaggagctgcttctcgcaaatacagcagcccatattatcagacttatgctgaaataccagaaaattctatggaaggttccgagcttcttgatcacacaggtccggagaatgaatgaagctactatgctgttgaaaaagcagttgccctcggtgaggaagctgctgcggcgaaagactctggaacgagagacagccagcccaaagacctccaaggtgcttcagaagtccccctccgctaggaggatgtcagatgttcctgaaggcgtcatcagagtgcacgcacccctgctcagcaaggtgtcaatggctattcagctgaataaccagaccaaagcaaaagatattctggcaaagttccagtacgagaataggatcctgcattggcagagagccgctctgagcttcctgaatggtaagtgggtgaaaaaggaacgtgaggagagcactgaaaccaaccgcagtcctaaacatgtattcctcttcacaataggcttagacatttctacctag

SEQ ID NO: 238727 - DNA, 1692 bp, Artificial Sequence
  Description of Artificial Sequence: Synthetic coding sequence
atgcggaagaaagataagcaatccatccgtgatgtacgcgatatttttggagttagtgaatctccacctcgagatacatgtgggaatcacacaaaccagctggacggcaccaaagaggagcgggagctccctcgcgtcatcaaaacttcagggtctatgccagatgatgcttccctgaacagtactaccctgtccgacgccagccaggataaagaaggatcattcgcagttcccagaagcgattcagtggccattctggagaccatcccggtactccctgtccactctaacggaagccccgaacctggccagcccgtgcagaacgccatctcagatgatgatttcctcgaaaagaacatccctcctgaggcagaagagctgtctttcgaggtttcctacagtgaaatggtaacagaggccctgaaacgaaataagcttaagaaatctgaaatcaaaaaggaggattatgtgctgacgaagttcaatgtgcagaagactagattcggcctaacagaggctggggatttgagtgctgaagacatgaaaaagattcgccatctgtcattaatagaactgacagcattttttgacgcatttggcattcagcttaagcggaataagacagagaaagttaaagggagagacaatgggatatttggggtgcctctgacagtactgttagatggagaccgcaagaaggatcccggagtcaaggtgccgctcgtcttacagaagtttttcgaaaaggtcgaggaaagtggcctagaatcggaagggatcttcagattgagtgggtgcactgcgaaggttaaacaatatagggaggagctggacgcaaaatttaatgcagataaatttaaatgggacaaaatgtgtcaccgtgaagcagcagttatgctgaaagcatttttccgcgaattgcccacgagcctgtttccagtggagtacatccctgcattcataagcctcatggaaaggggaccacatgttaaggtccagttccaggctctccatctgatggtgatggctctgcctgacgctaatcgagacgccgcacaggcactgatgacatttttcaacaaagttatagcgaacgaatctaaaaatcgaatgtccctctggaacatatccactgtaatggcacctaatctgttcttttcgagatctaagcactcagattacgaagaactattgctcgccaatacagctgcgcacatcatccggctgatgcttaagtaccaaaagatattgtggaaggtgcctagcttcctgatcactcaagtaaggcgcatgaatgaggctaccatgctcctgaaaaagcagttgccatccgtccggaaattactgcgacgaaaaacattagagcgcgagaccgcatcacccaagacgagtaaggtgctgcaaaaatcaccctctgccagaaggatgtcagacgtccccgagggagtcataagggtgcatgcgccactgctatcaaaagtcagtatggcaatacagctgaacaaccagactaaggctaaggacatactggccaagtttcaatatgagaaccgaattttacactggcagagagcagcactgagctttcttaacgggaagtgggtgaaaaaagaacgggaggaaagtacagagaccaaccggtctcccaagcacgttttcctcttcaccatagggctagatatatctacatag

SEQ ID NO: 238728 - DNA, 1713 bp, Artificial Sequence
  Description of Artificial Sequence: Synthetic coding sequence
atgcgcaaaaaggacaaacaatctattagggatgtcagggacattttcggggtgagcgagtcaccacccagggatacctgcgggaatcataccaatcagcttgatggtacaaaggaggaaagggagctccctagggtaatcaaaacctccgggtcgatgcctgatgatgcgagtcttaactctacgacactatccgatgcctcccaggataaggagggcagcttcgcagtgccacggtctgattcagttgcaatcttggaaaccataccggtgctgcctgtccactcaaacggtagtccagaaccaggccaaccagtccagaacgcaatttccgacgatgacttcctggaaaagaatatcccaccagaagccgaggagctatctttcgaggtgtcctactctgagatggttactgaggccttgaagcgcaataaactaaagaagtcggaaataaaaaaagaagactatgtgctaaccaaatttaatgtgcagaagactcgcttcgggttgactgaggccggagacctgagtgcggaagacatgaaaaaaatccggcatctcagtctgatcgagttaactgcctttttcgatgcttttggaatccagctgaagcgtaataagacggaaaaggtaaaagggagagataatggaatttttggggtccctctgacagtactcttagacggggacaggaaaaaggacccaggggttaaggtaccccttgtgctgcagaagttcttcgaaaaagtggaggagtccgggcttgagtcagaaggcatctttcggctttcgggctgcactgctaaagtcaaacagtatagggaggagctggacgctaaattcaatgcagacaaatttaagtgggacaagatgtgtcacagagaggcagccgtaatgctgaaggcattctttagagagttgccaacttcacttttccctgtggaatacattcctgcctttatcagtctaatggagcggggtccccacgtcaaagtgcagttccaggcactgcatcttatggtcatggcactgccggacgctaatagggacgcagcacaggcgttgatgacattctttaataaagtgattgccaatgagagcaagaaccgcatgtcattgtggaatattagcactgtaatggcccctaatctattcttctcccgttctaaacatagcgattatgaagagctgcttctcgcaaacacggcagcacacatcatcaggctgatgctcaagtaccagaaaattctgtggaaagtgccctcctttctgatcacccaggtgcggcgtatgaacgaggctactatgctcctgaagaaacaactcccatccgtcaggaagctgttgcggaggaagacactcgagcgcgaaacagccagtccgaagacctcgaaggtgctacagaagagcccaagtgctcgtcgcatgtccgacgtccccgagggcgtgatccgcgtccacgctcccctcctcagcaaagtctctatggccatccaactcaacaaccagactaaagcgaaggacatccttgctaagttccagtacgagaactcacatggctcttctgagtgcattaagatacagaatcagcgcttatatgagatcggcggaaatattggcgagcactgtttagacccggacgcctacatccttgatgtctatcgaatcaacccccaggcggagtgggtcatcaagcctcagcagagcagctag

SEQ ID NO: 238729 - DNA, 354 bp, Artificial Sequence
  Description of Artificial Sequence: Synthetic coding sequence
atgctctcgaacgaaagcctgcaccctcctgccttttcccggagcaacagtgaagccagcgtggactctgcatcaatggaagatttctggcgtgagatcgagagcatcaaggacagcagtatgggcggtcaggaagaaccaccgcctgccgaggtcacacccgttgatgagggcgaattggaggcggagtggctccaggatgtggggctgagcaccctaatcagcggtgatgaagaagaggatggtaaggccctactttcaactctcactaggacgcaagccgcagctgttcagaagagataccacacatacactcagaccatgcggaaaaaggataaacagtccattcggtag

SEQ ID NO: 238730 - DNA, 1665 bp, Artificial Sequence
  Description of Artificial Sequence: Synthetic coding sequence
atggcgttcatgaggatcaatgtaatcatgaatgagttaccaagggacacctgtggaaatcacaccaaccagctcgatggaactaaggaagaacgggagctcccccgagtcattaagacctctggcagcatgcccgacgatgcctccttgaatagcaccaccctgtctgacgcctcacaagacaaggaggggtcttttgcagtgcctcgctctgactctgtagccatccttgaaacaattccagtgcttccggtccactccaacggttcacctgagccaggacagcctgtgcagaatgctataagcgacgacgacttcctggaaaagaacattcctcccgaagccgaggagttgtcattcgaagtctcatattcggagatggtcaccgaggcactgaaaaggaacaaattgaagaaatctgagattaagaaagaagattacgttcttaccaagttcaacgttcagaaaactcgctttggcctgactgaagcaggcgacctctccgccgaagacatgaagaagattagacatttatcattgattgaacttaccgctttttttgacgcctttggaattcagctgaaaagaaacaagacagagaaagttaagggcagggataacggtatcttcggagtgccacttactgtgcttctcgacggagaccgcaagaaggatcccggtgtaaaagtgcccttagtgctgcagaaattttttgaaaaggttgaagagagcggactggagtctgaagggatcttccggctgtctggttgtaccgccaaggtgaagcagtacagggaggagttagacgcaaaattcaacgccgataagttcaagtgggacaaaatgtgccacagggaggctgcagtaatgctgaaagctttttttcgcgagcttcctacatcactttttcctgttgaatacatcccagctttcatcagtttgatggagcggggaccccatgtcaaagtgcagtttcaggcattgcatctgatggtcatggcccttccagacgctaatcgggatgctgctcaggctttgatgaccttctttaacaaggtgatagctaacgaaagcaaaaatcggatgtccctctggaacatttcgacggtgatggctcccaatctgttcttttcccgctccaagcacagcgactatgaagagctcttgctggccaacaccgcagcccacattatcagacttatgttgaagtaccagaagatcctgtggaaggtcccgtccttcctgattacccaggtgcgacgcatgaatgaagccaccatgctcctcaagaagcagctcccaagcgtcagaaagctgctcaggcgcaaaaccctggaacgggagaccgccagtcctaaaaccagtaaggtgttacagaagtcgcccagtgctcgaagaatgtccgatgtccctgaaggcgttatccgggtacacgcccctctgctgtctaaagtctctatggccattcagttgaataatcagaccaaggcaaaagatattctcgctaaatttcaatatgaaaatagaattctgcactggcagcgagctgctctctccttcctcaacggtaagtgggtcaagaaagagagggaggagagcacagaaacaaaccgttcaccaaaacacgtctttttattcacaatcggccttgacatctctacgtag

SEQ ID NO: 238731 - DNA, 3786 bp, Artificial Sequence
  Description of Artificial Sequence: Synthetic coding sequence
atgatcgcccacaagcagaagaaaacgaaaaaaaagagggcctgggcctctgggcaactcagtacagatataacgactagtgagatgggcttgaagagcctgtcctcaaatagcattttcgatccagactatatcaaagaactggtcaatgacattagaaaattttcacatatgctactctatctgaaggaggctattttttctgactgctttaaagaagtaatccacattcgactggaggagctcctccgcgttctcaaatctataatgaacaaacaccagaacctgaacagcgtggatcttcagaatgccgcagagatgctgactgccaaggtaaaagcggtaaacttcacagaagtgaacgaggaaaacaagaacgacctcttccaggaagtgttctccagtatcgaaactcttgctttcaccttcggaaatatattaacaaactttttgatgggggatgttggtaacgattccctactgaggctgcctgtgtcccgcgaaactaagtctttcgaaaatgtgagcgttgagtcagtagactccagtagcgagaagggcaatttcagtcccctggagttagataacgtgctcctgaaaaacactgactctatcgaattggccctgtcttacgccaagacttggtcgaagtacacaaaaaacattgtatcatgggtagagaagaaactgaacctagaactggaatctaccaggaatatggtgaagttggctgaggcaacacgtacaaacattggcatccaggaatttatgccactccagtctctatttaccaatgccctgctgaacgatattgaatccagccatctgctgcagcaaaccatcgctgccctccaggctaacaagttcgtgcagcctttactgggtagaaaaaatgagatggagaagcagagaaaggagataaaggagttatggaaacaggaacaaaacaaaatgcttgaggctgaaaatgcactcaaaaaggccaaactgttgtgtatgcagagacaagacgaatatgagaaggctaaatcctcaatgttccgcgcagaagaagaacacctcagcagttcaggcggactggccaagaacctgaataagcagcttgagaaaaagcgcagactcgaggaggaggctctccagaaggtggaagaggctaacgagctttacaaggtctgcgtgactaacgtcgaagaacgaaggaacgacctggaaaatacaaagcgggagatcctcgcacagctccgaaccctagtgtttcagtgtgatctcacactgaaagccgtaacggttaacctcttccacatgcagcacctgcaagcagcttccctcgcggactccctgcagtcgctgtgcgacagcgctaagctctacgatcctgggcaggagtactccgagtttgtgaaggccacgaattccacagaggaggagaaagtagatggtaacgttaataagcacctcaattccagccagccgagcggcttcggtcccgctaacagcctggaggacgtagtgcgcttacccgacagctcaaataagatcgaggaagacaggtgctctaattctgccgacattacaggtccgtcttttattcggagctggacctttggtatgttctctgactcagaaagtaccgggggatcttcagagtctcggagcttggactccgaatctatatcccccggagacttccatcggaagcttcctcgcactcctagctccggaacaatgtcctccgcggacgatcttgatgaacgcgaacctcctagtccatcagagaccggacccaactccttgggcactttcaagaaaacccttatgtccaaagccgcacttacgcacaagtttagaaagttgagatcaccgaccaagtgtagggactgcgagggaatcgtcgtcttccagggagtagaatgtgaggaatgcctgctggtctgccatagaaaatgcctcgaaaatctcgtaattatttgcggccatcagaagctgccagggaaaattcatctcttcggggctgaattcacacaggtagccaagaaagaacccgatggaatcccattcatactgaagatttgtgcatccgaaatcgagaatcgcgctttgtgcctacaaggaatttaccgggtctgtggaaacaaaatcaagaccgagaaattgtgccaggctctggagaacggaatgcatttggtggatatcagcgaattcagttctcacgacatctgtgacgtccttaaactctacttgaggcagctgccagagccattcattttattccgcttgtacaaagaattcattgacctagccaaggagatccagcacgttaacgaggagcaggagacaaaaaagaacagcctcgaggataaaaaatggccaaatatgtgtatcgaaatcaatcggattctactcaagagtaaagacctgcttaggcagctgccggcttctaacttcaatagcctccactttctgatagtgcacctgaagagagtggtcgatcatgcggaagaaaacaaaatgaacagcaaaaacttaggagtcatcttcggaccatctttgatccggcctaggccaactaccgctcccatcaccatttctagccttgctgagtatagtaatcaggcgcgactcgtggagttcctgatcacttattctcagaagatttttgacggatcactccagcctcaagatgtgatgtgcagtatcggtgtcgttgatcagggatgcttcccgaagcctctgctttcaccagaagagagggacatcgagaggtccatgaaaagcttatttttcagttcgaaagaagatatacatacttctgagagtgaatcaaagatctttgagcgggctacgagtttcgaagagtcagaacgcaagcagaacgccctcggcaaatgtgacgcctgcctgtcggataaagcccaattgctgctggaccaggaagctgagagtgcatcccagaaaatcgaagatggcaagacacccaagccgctgtcgcttaaatcagacaggtctacaaataatgtggaacgccacactccacggactaaaataagaccagtgagcttgccggtggaccgtctcctgcttgcctcacccccaaacgagaggaatggaaggaatatgggcaatgtgaatcttgacaaattctgtaagaaccctgcatttgagggcgtgaatcggaaggacgctgccacaaccgtttgtagcaagttcaacggcttcgatcaacagacattacagaagatccaggacaagcaatatgagcagaattcactgactgccaaaactactatgatcatgccctctgccctgcaggaaaagggcgtcactaccagcttgcagatcagcggcgatcacagcatcaacgctacgcagccatcaaagccctacgccgagccagtgagatcagtacgcgaagcttctgagagacgctccagtgattcataccccctggccccagtccgcgcaccacggactctccagccacagcattggaccacattttacaagccccacgccccaatcatctccattaggggcaacgaggagaagccagcctctcctagcgccgcagtgcctccgggaactgatcatgatccgcatgggctggttgtgaaatctatgccagacccggacaaggcctccgcttgcccagggcaagccactggccagccaaaagaagactccgaggagctgggcctaccagacgttaatcccatgtgtcaacggccacgactaaagaggatgcagcagttcgaagacctcgaaggcgagatcccacagttcgtctag

SEQ ID NO: 238732 - DNA, 1182 bp, Artificial Sequence
  Description of Artificial Sequence: Synthetic coding sequence
atgatcgcacacaagcagaagaagacaaaaaagaagcgggcttgggcttctggccaactgtccacggacatcaccacctccgagatgggactgaaatcccttagtagcaactccatctttgatcccgattatattaaagagctggtgaacgacattaggaagttctcgcatatgctgctgtatcttaaggaggcaattttctccgattgttttaaagaggtaatacacattcgcctcgaggaactgctaagagtattgaagtccatcatgaacaagcatcagaatctgaattccgttgatcttcagaacgcagccgaaatgctaaccgccaaagtgaaagccgtgaatttcactgaagttaacgaggagaacaagaatgacctgtttcaggaggtgttctcaagcatcgaaactttggcttttaccttcggcaacatcctcacgaactttcttatgggtgacgtagggaatgacagcttactgaggctgccagtgtcacgggagaccaagtcatttgagaatgtgtctgtggaatcagtggactccagctctgaaaagggtaatttctcgccccttgaactggataacgtgcttcttaaaaacacagattccatcgagttagcattatcctacgcaaaaacgtggtctaaatacacaaagaacattgtaagctgggtcgaaaagaaactgaatctggaactggaaagtactaggaatatggtgaaactggctgaggcaacgcgcactaacatcggtatccaggagtttatgccgctccagagcctgttcactaacgctcttttaaatgacatcgagtccagccatctcctgcagcaaactatagctgctcttcaggcaaacaagtttgtccagccactcttaggacgtaagaatgaaatggagaaacaacgtaaggaaattaaggagttgtggaaacaggagcagaataagatgcttgaggctgaaaacgcactgaaaaaagcaaagctgctgtgtatgcaaaggcaagatgagtatgaaaaagccaagagctcaatgttcagagctgaagaggaacatttaagttctagtggaggtctggctaaaaacctcaacaagcagttggagaagaagcgtcggcttgaggaggaggccctgcagaaggttacaatttttttcttctttatttgcaagctcaactag

SEQ ID NO: 238733 - DNA, 3306 bp, Artificial Sequence
  Description of Artificial Sequence: Synthetic coding sequence
atgaaatcacgacagaaggggaagaagaaaggttctgcgaaggaaagagtctttgggtgtgacctgcaggagcatcttcagcattccggacaggaagtccctcaagtcttgaagagttgcgcagagttcgtcgaagaatacggggtggtggacggtatttatcgattatccggtgtcagttctaacatacaaaagctgagacaagagttcgagtctgaaagaaagcctgatctgagacgtgacgtgtacctgcaggatattcactgtgtgagcagcctgtgtaaagcctacttccgggaactacccgatccgttactcacgtaccggctgtacgataagtttgctgaggctgtaggggttcagctcgagccggagaggctggtcaaaatcctggaggtgctgagagagctgcctgtcccgaattaccggaccctcgagtttcttatgaggcacttggtgcacatggccagcttcagcgctcagacaaatatgcatgcacgtaaccttgcaatcgtgtgggctcccaacctacttaggtccaaggacattgaggcaagtggcttcaatgggaccgccgctttcatggaagtgagagttcagtccatcgttgtcgaattcatcctgactcacgtggatcagttgtttgggggtgccgctctgtctggaggggaggtcgagtcagggtggaggtccctccccggaactagggcttcgggctcgcctgaggacctcatgcccagacctctgccataccatctcccctcgattctgcaggcaggcgacgggccaccgcagatgcgaccctatcataccatcatagaaatcgctgaacacaagaggaaaggctcgctgaaagtgagaaagtggagatcaattttcaatctgggaaggtcagggcatgagaccaagcgcaagctcccaaggggtgctgaagatagggaagataaatctaataagggaacactgcggccagccaaaagcatggactcactgtctgccgctgccggagccagcgacgaacccgaaggacttgtaggtccttcatcacctagaccttctccgctgctacctgaatctctggagaacgattctatcgaggctgccgaaggcgaacaggaacccgaggccgaggctcttggaggcacaaacagtgagcccggtacccctcgggctggcaggtctgcaatccgagccggtggctcttcccgtgccgagagatgtgccggtgttcatatctccgatccatacaatgtgaatctaccactgcacattacatccatcctgtcagtgcctcccaacatcataagcaatgtatcactggccaggctgaccaggggtcttgaatgccctgcactgcagcaccgtccctctcctgcaagcggccctggccctggtccaggactcgggcctgggccaccggacgagaaattggaggctagtcctgccagcagccctctcgctgatagcggaccagacgacctggcccctgcactggaagattccctctcccaagaggtgcaggattcgttctcatttctggaagacagtagctcgagtgagcctgaatgggtgggggcagaggacggcgaggtggcccaggccgaagctgctggagctgccttttctccaggggaggacgatccagggatgggctacctcgaggagctgcttggcgtaggcccacaagtcgaagagttttccgtggaaccgcctctggacgacctttccttagatgaagcccagttcgtattagctcccagctgttgctcactggattcagctgggcctagacctgaagtggaggaagaaaacggtgaggaggtgttcctgagcgcctacgacgacttatcacctctcttgggccctaaaccaccaatttggaaaggaagcggtagcctggagggagaggcagccggatgcggacgacaggctctgggacagggcggtgaagaacaagcctgttgggaggtgggggaagacaaacaggctgaaccgggtggtagactggacatccgcgaggaagccgaaggctcacccgagacgaaggtcgaagccggaaaggccagcgaggacaggggcgaagctggagggtctcaggagactaaggtcaggctcagagagggttccagggaggaaaccgaggctaaggaggaaaagtccaagggacaaaaaaaagcggacagcatggaagccaagggagtggaagagcccggaggggacgaatacactgacgaaaaggaaaaagaaattgagcgggaggaggacgagcaaagagaagaggcccaggttgaggctggcagggacttggagcagggggcacaggaggaccaggtcgcagaagagaaatgggaggtagtgcagaaacaagaggcagagggagtgagggaggacgaggacaaaggacagcgagagaaggggtaccatgaagccaggaaagatcagggggatggcgaggacagccgttcgccagaggccgctacagaaggtggggctggggaagtgtcaaaggagagggagtcaggggatggcgaggctgagggcgatcaaagagcaggcggttactacctggaggaggacaccctttctgaggggtcaggggtagcgagcctggaagtcgactgcgccaaggagggaaacccccactctagcgaaatggaggaggtcgctccgcagccccctcagcctgaggagatggaacccgaagggcagcccagtcctgatggatgcttatgcccctgtagccttggacttgggggagtcggcatgcgtctggcatccacactcgtgcaggttcaacaggtcagaagcgtaccggttgtcccgccaaaaccccaattcgcaaaaatgcctagtgctatgtgttctaaaatacacgtagcaccagcaaatccttgcccccgaccgggacgattagacgggacacccggtgagcgagcttggggtagccgggctagccgcagcagttggaggaacggtggaagcttgtcgttcgacgcagctgttgccttggctcgagacagacagcggactgaagcccagggagtgagacgcacccagacctgcaccgaaggcggagattattgcttgatccccagaacatcaccttgctccatgatcagcgcccactccccgagaccattatcctgcctggagctgccatctgagggggcagaagggagcggctcccgatcgcggctatcactgcccccacgggagcctcaagttccagatccactgctgtcgagtcagcgccgatcctacgcttttgagactcaggcaaaccccggtaagggcgaaggactgtag

SEQ ID NO: 238734 - DNA, 2673 bp, Artificial Sequence
  Description of Artificial Sequence: Synthetic coding sequence
atgaagtcaagacagaaaggaaagaagaaagggtctgcaaaagagcgggttttcggctgcgacctccaggagcacctccaacatagtgggcaggaggtcccacaagttctgaaatcatgcgccgaattcgttgaggaatacggtgtcgtagacggcatctatcgactgtcaggtgtatctagcaatattcagaagttgcggcaagagttcgagtctgagaggaaacccgatcttaggcgggatgtctacctgcaggatatccattgcgtcagctcattgtgcaaggcgtactttagagaactgcctgacccccttttgacgtatcgtctgtatgataagttcgctgaagcagtcggcgttcagctggagcctgaacgtttggtgaaaatccttgaggtgctccgggaacttccggtccccaactaccggaccctggagtttctgatgaggcatctcgttcatatggccagtttctctgcacagacaaacatgcatgcaagaaaccttgctattgtttgggccccaaatttgcttagatcgaaagatattgaggctagtgggtttaatggaaccgctgcttttatggaggtgcgagtacaaagcatcgttgtggaatttatcctaacacacgtagatcagttattcggtggcgctgcactatcgggaggggaggtggagtctggatggaggtccctccccggaactagagcctcgggttctcctgaggacctgatgcctcgccctctgccctaccacttgccaagtatacttcaggcaggagacggccctcctcagatgcggccataccacactatcatcgaaattgcagagcataagcggaaaggatccctaaaagtgcgaaagtggcggtccatctttaacctgggcagatctggccacgagaccaaacgaaagctcccccgaggcgcagaggacagggaggacaagagtaataaaggaacactgcgccctgccaaatctatggactcactttcagccgcagctggagcctcagatgagcccgagggcctggtcggaccgtccagtccgaggccctcccctctactgcccgagtctttggagaatgattccatagaagcagcagagggagagcaagaacctgaagccgaggctctcggaggtacgaattctgaaccaggtactccacgcgcaggcaggtctgctatccgcgctggagggagctctcgtgccgaaagatgtgctggagttcacattagtgacccctacaatgtgaatctcccactgcacatcacatctatccttagtgtcccccctaacattatctctaatgtcagtttggccaggctcaccagaggactggagtgcccggcacttcagcaccgtccctcccctgcaagcggcccaggcccagggcctggtcttggtcctggacctccagacgagaagcttgaagcctcccctgccagctcccctctggccgactctggtccagatgatctcgctcccgctttggaggatagtttgagtcaggaagtgcaggacagcttcagctttctggaagacagctcttcttctgaacccgaatgggtgggggctgaagatggagaagtggcacaagccgaggcggcaggcgctgccttttcacccggtgaggacgatccagggatgggttacctggaagagctcctcggcgtgggcccacaagttgaggaattcagtgtggaaccacctttggatgacttgagtctggatgaggcacaatttgtgctggctcctagctgctgctccctagacagcgctgggccaaggcctgaggtggaagaggagaatggcgaggaggtcttcctatccgcctacgacgatctcagccccctgctgggccctaagcccccaatctggaaggggagtgggtcactggagggcgaggcagccggatgtggccgtcaagccctagggcaggggggagaggagcaggcctgttgggaagtgggcgaggacaagcaggcggagcccggaggcagactggatatcagggaggaggctgaggggacccctcaacctccacagccggaggaaatggagcccgaaggccagccatcccccgacggatgtttgtgtccctgttctttagggcttggcggagtcggcatgcgcctcgcctccacattggtccaggtacagcaggtgagaagtgtgcccgtagttcctcccaaaccccaatttgccaagatgccatcagccatgtgtagcaaaattcacgtggcaccagctaatccatgccccaggcccggtagacttgacggaacacctggtgagcgcgcatggggatccagagcttccaggtcctcgtggaggaatgggggttcattgagctttgacgctgcagtcgcccttgctagagacaggcaacgaaccgaagcgcaaggggtccgacgaacccagacatgcactgaaggcggtgattactgtttgattccgagaacctctccatgtagcatgatctctgcccacagtccgaggcctttgtcctgtctggagctacctagtgaaggtgccgaaggttcggggtcaagaagtaggctgtcactgccacccagagagccccaggtccccgatcctctgctatcgtcgcagcgcagatcatatgccttcgagactcaggccaatcctggaaagggtgagggactgtag

SEQ ID NO: 238735 - DNA, 1500 bp, Artificial Sequence
  Description of Artificial Sequence: Synthetic coding sequence
atgaggcatctcgtgcacatggcctcattctcagctcagaccaacatgcacgcaagaaatctggctattgtctgggcgccaaacctactcaggtcaaaggacattgaggcctccggatttaacgggactgctgcgttcatggaggtaagggtccagagcatagttgttgaattcattctgactcatgtggaccagttgtttggtggagcagccctgtcgggaggcgaagtcgaatcaggatggcgatccctgcctggaacaagagcatcaggtagcccagaagacctaatgcccagaccgctcccctaccatttgccttctatcctgcaggccggtgacggacccccacagatgaggccttatcacacgataatcgaaattgccgagcacaaaagaaagggatccctgaaggtccggaaatggcgctccatcttcaaccttgggcgttccggccacgagaccaagagaaaattgccacggggagcagaggaccgggaagacaaatctaacaaaggtactctcagacccgcaaagtcaatggactctctgtccgctgccgcaggagcctccgatgaacccgaggggctggtggggcctagtagcccccgacctagtcccctactcccagaaagtctggagaacgactctatcgaagcagcggagggtgagcaagaaccggaagccgaggccttagggggtaccaactctgaacctgggacccctcgggcagggaggtctgcgatccgcgctgggggttcttctagagccgaacggtgtgcaggagtgcacatctcagacccctataacgtcaatttgccgctgcacatcactagcatcttgtctgtgcctcctaatatcatctccaatgtgtcgctggcacggctaactcgcggactggaatgtcccgcactgcaacaccggccatccccggctagtggtcccggtccgggtcctggtctcgggcctgggccacccgacgagaagttggaggcctctcctgctagctcccctctggcagacagcggcccagatgatttagctcccgctctcgaggattccctgagccaggaagtccaagacagcttctcttttttagaggattcgtcctcgtcggaaccagaatgggtgggagcagaggatggtgaggtggcacaggcagaagccgcaggagccgctttctcccctggggaggatgaccccggaatgggctatctcgaggaactgcttggagtcggccctcaggtagaggaattcagtgtcgaaccccctctggacgatttgtcactggatgaagctcaatttgtgcttgccccttcttgctgcagtctagatagtgctgggcctaggcccgaggtggaggaggaaaacggcgaggaggtcttcctgagtgcctatgacgatctcagccctgcacttgggctacttctgcagcccggatgggggcaccgctcccacagttcagaaggacaatgtctgcgaatcaaggctgtttttctgtag

SEQ ID NO: 238736 - DNA, 4335 bp, Artificial Sequence
  Description of Artificial Sequence: Synthetic coding sequence
atgaagaataaaggggcaaagcagaagcttaagcgtaaaggcgcagcttctgcgtttggctgcgacctgacagagtacctggagagctctggacaagacgtcccgtatgtgttgaagagttgcgcagagttcatcgagacacatggaattgtggacggcatctatcggctgagcggggtaaccagtaacatccagaggctgagacaggaattcggcagtgaccagtgtcccgacctgactagggaagtttatcttcaagacattcactgtgtgggctcattgtgtaaattatattttcgggagctgcccaatccgctgcttacttacgagctctacgagaagttcactgaggctgtgtcccactgtcccgaggagggacagctagccaggattcagaatgtcattcaggagctgccaccttcccattatagaacactggagtacctaatcagacacctggctcacatcgcctccttttcctcaaaaaccaacatgcatgctcggaacctagctcttgtgtgggcccctaaccttttaaggtcaaaagagatcgaagctactggctgtaacggcgacgcagcttttcttgcagtacgagtacagcaagtagtgattgaattcattctgaatcatgtcgatcaaatcttcaacaatggagctcccggatccctcgaaaacgatgagaacagaccaatcatgaaatccttgacactcccagcgctgtccctgccaatgaagctcgtctcactggaggaggcccaggctcgcagtctagcgactaatcatcctgcccgtaaagagcgcagggaaaactcccttcccgagattgtgcctccaatggggacacttttccacacagtacttgaactacccgacaataaaaggaagttgagctctaagtctaaaaagtggaagtcgattttcaatttggggaggtccggaagcgacagcaaaagcaaattatcaagaaacggcagtgtgttcgtgagaggccaacgattaagtgtagagaaggctacaatccgcccagctaagtcgatggattccctatgttcggttccagtggagggcaaagagacaaaaggtaacttcaacagaaccgtgactacgggcggattcttcattcctgcgaccaagatgcacagtactggcactggatcatcatgcgatctcacgaaacaagagggcgagtgggggcaggagggcatgccaccaggcgctgaggggggatttgacgtctcaagtgaccggtcacacctgcaaggagctcaggcccgaccgccaccagagcagcttaaggtgttcagacctgtagaggaccccgaatctgagcagaccgctcccaagatgttggggatgttctacacgagcaatgactctccatcaaagtccgtctttacttcatcactcttccaaatggaaccttccccaagaaaccagcgtaaggccctgaatatttccgaaccattcgctgtttcggtgccattgagggtgtccgctgtgattagtactaatagtaccccatgtcggacccccccaaaagagttacagtctcttagctcacttgaggaattctcattccacggatctgagtcaggtggctggccggaagaggagaagcctttgggtgcagagacaagcgcagctagcgtaccaaagaaggctggtctggaggacgccaaagctgtccccgaggctcccggaaccgtggaatgttccaagggattgtcacaggagccgggagctcacctagaggagaagaagacgcccgaatcttctctttcttcccagcacttgaacgagttagagaaacgcccaaatccagaaaaggtggttgaagaaggtcgggaggctggtgagatggagtcatctacgttgcaggaatctccacgggctagggctgaggccgtgctgctgcacgagatggatgaagacgacctggctaatgcactgatctggcccgaaatccagcaggagttgaaaatcatagagtcagaggaggaactctcgagtcttccacctcctgcgctaaagacctcccctatccagccaatcctggagtccagtctggggccttttattccaagtgagccacccggttctctgccttgcgggagcttccccgctccggtatcgactcctctagaggtctggacccgggacccagctaaccagtcaacccagggggctagcacagctgcatccagagaaaagcccgagccagaacagggtctccatcctgaccttgcttctctggccccattagagatcgttccctttgagaaagccagtcctcaagcaaccgtcgaagtgggaggacctggaaacttgagccctcctctgccgcctgctcccccaccgcctacacctctggaagaaagcacccccgtacttctatcaaaaggaggacccgaaagggaggattcatctcgcaaactgcgcacggatctgtatatcgaccagctcaagagtcaggacagccccgaaatttctagcctgtgccagggggaagaggcaacaccgaggcactccgacaaacaaaattcaaagaacgcggcttccgaaggaaaaggatgtggtttcccttctcccacgcgcgaggtggagatcgttagccaggaagaggaggacgtaacgcattcggtgcaagagccatcagactgcgatgaagacgacacagtgactgacatcgcccagcacggcctcgaaatggttgaaccttgggaggagccacaatgggttacttccccgctgcactccccgacactgaaagacgcgcacaaggcccaagttcaaggtctacagggacaccaactggagaaaagactctcccatcgcccaagcctccgacaaagccattccctggattctaaacctactgtgaagtcccagtggactcttgaggtgccttcatcctcctcttgtgccaacctggaaactgagcggaacagcgatccattacagcctcaggcccctcgcagggaaataactggctgggatgagaaggctttgcggtccttccgggagttctcagggctaaaaggtgctgaagctccacccaatcagaaagggccttccggagtgcagccaaatcctgctgaaactagtccgatttcgctggccgagggcaaggaactcggcacccatctgggccattcaagtccgcaaatccgccagggtggagtccccggacccgagagttctaaagaaagctctccatccgtgcaggatagtacatccccgggagagcatcccgcaaagcttcagctgaagagtactgagtgcggacctccgaaggggaagaatagacctagctctctgaatctggaccctgctatccccatcgcagaccttttctggtttgaaaacgtggcatccttttcctccccgggaatgcaggtgtccgaacctggagatccaaaggtgacttggatgacgtccagctattgtaaagcagacccgtggagggtgtacagccaggaccctcaggacctggatatcgttgcacacgccctgaccggtagaaggaatagcgcacctgtgagtgtgagcgccgtccgcacctccttcatggtgaaaatgtgtcaggcccgtgcggtgccagttatccctcccaaaatccagtacacccagatcccccagcccctgccatctcaatcctctggagagaacggggtgcagcctcttgaaaggtctcaggaagggccttcctctacaagcgggaccacccagaaaccagctaaagacgactccccttcctctctggagtcaagcaaggaggagaaaccaaagcaagacccaggagctataaaatcatcccccgtcgacgccacagcgccttgtatgtgtgaaggtcctacactgtcaccagagcctgggtcaagcaacctgctgagcacgcaggatgcagtggtgcaatgtcgtaaacggatgagtgaaaccgagccatccggcgacaatctgttgtcctctaaactagaaagacccagtgggggatctaaaccattccacagatctagacccggtcggccacagtccttgatcctgttctcccccccatttcccatcatggatcatttaccaccaagctccacagttactgattccaaggttttactatcccctatccgcagccctacccagaccgtgagcccgggtctcctgtgtggcgagctggccgagaatacatgggtcacacccgagggagttacgttacggaataagatgaccattccaaaaaacggacaacgtttggaaacctcaacgagctgcttctatcagccgcagcggcgtagtgtcattctcgatggcagatccggcagacagatcgagtag

SEQ ID NO: 238737 - DNA, 3300 bp, Artificial Sequence
  Description of Artificial Sequence: Synthetic coding sequence
atgaaaaataaaggggcaaagcagaagctgaaacgcaagggcgcagcaagtgcttttggctgtgatctgaccgaatacctggaaagcagtggtcaagatgtgccttatgtcctcaagagctgtgctgaatttatcgaaacccacggcatcgtggatggaatataccgtctgagcggcgttacgtccaatattcagaggctgcgacaggaattcggatcagatcaatgtccagacctcacacgcgaggtttacctgcaggatatccactgcgtcggctcactctgtaagctctactttcgagagttgcccaatcccctgttaacgtatgaactgtacgaaaagttcacggaagccgtctctcattgcccagaagagggccagctcgcgaggattcagaacgtcatccaggagttacctcccagccattaccggacgcttgaatatctcatcagacatcttgcccacatcgcaagcttctccagcaagaccaacatgcacgcacgtaatctggcccttgtgtgggcccctaaccttttgagatctaaagagattgaggctaccggctgcaatggtgacgctgctttcctcgcagtacgggttcagcaggttgtcatagagtttattctgaaccacgtggatcagatattcaataacggagctcccggtagcctcgaaaacgatgagaaccggccaatcatgaaatctctcacgctaccagcattgagcctccccatgaaactggtgtctctggaggaagcgcaagcacgttccctggctacaaatcatcccgctcgcaaggaaaggcgtgagaactctctgcccgaaattgtaccccctatgggaacactcttccacactgtcttggagctcccagataataagagaaagttatctagtaaaagcaaaaagtggaagtccatcttcaacctcggaagaagtggctctgattccaaaagtaaactgagccgaaatgggtctgtctttgttcgtggccagaggctcagtgttgagaaggccacgatccgtcctgccaaaagcatggactctctgtgctctgttccggtggaaggcaaggagacgaagggtaactttaacagaaccgtgacaaccggcggttttttcatccctgccactaagatgcacagtacaggcaccggaagtagctgtgatctgaccaaacaggaaggcgagtggggccaggaaggaatgcctcccggtgccgagggagggttcgacgtcagcagtgataggtcccacttgcagggcgctcaagcaagaccacccccagagcagcttaaggtgtttcggccagtggaggacccggaaagtgaacagacggccccaaagatgctagggatgttttatacctccaatgatagcccttcaaagagcgtctttacgtcatctcttttccagatggaaccatctcctagaaaccagaggaaggcattgaacatctctgagccctttgccgtgtcagtgcctctgagggtcagtgcggttatcagcacaaattctacgccctgtagaactccgcctaaggagcttcagtctcttagctccctggaagagttctcgttccatggatcagagtcaggaggatggccagaggaagagaagcctctgggggctgagacgagtgctgcaagtgtgccaaagaaggcgggactggaagacgcaaaagcagtgccagaggctccaggaactgtggaatgcagtaaggggttaagccaagaacctggggctcacctcgaagaaaaaaagacaccagagtcttccctgtcttcccagcacctgaatgagctggagaagcggcctaaccctgagaaagttgttgaagagggtagagaggcaggggagatggaatcttcgacattgcaggagagtcccagggctcgcgcagaagcagtcttgctgcatgaaatggatgaggacgatcttgctaatgcactgatttggcccgaaatacagcaggagctgaagataatcgaaagcgaggaggaactcagttctctgccaccaccagcactcaagacatctccaatccaacctatcctggagagcagccttgggccatttattccaagcgagcctccgggttctctaccctgcggatcttttcctgccccagtgtcaacaccactggaggtgtggacccgcgacccagcaaatcaatccactcagggagcttccacagcagcaagccgggagaagccagaacctgagcaggggctgcaccccgatctggcatccctcgccccattggagattgtgccattcgagaaggcctccccacaggcgacagtcgaggtgggtggtcccggtaatctctccccccctcttcctccagctccgccacctccaacccctctggaggagagcacccctgttctgctttcaaagggcggacccgagagagaagactccagtagaaaattgcgaacggacctgtatatagaccagctgaagtctcaggattcacccgaaatttcatcattgtgccagggtgaggaggctaccccgcgacatagtgataagcaaaactctaagaacgcagcctcagagggcaaagggtgcggctttcccagtccgacgcgcgaagtggaaatcgtcagccaggaggaggaagacgttactcactccgtccaggaaccctcggattgcgacgaggacgatactgtgacagatatcgctcagcacggactcgagatggtggaaccttgggaagagccacagtgggtgacgagccccctccattccccgaccctgaaggatgcccacaaggcccaggtgcagggcctccaagggcatcaactggagaagcgcctctctcatagaccttcccttcggcagagccactctctggatagcaagcccaccgtgaaatcgcagtggacactggaggtgcccagcagctcctcatgtgcgaatctcgagactgaaagaaacagcgacccactgcagccccaggctccaagaagagagatcaccggctgggacgaaaaggctttgcgctcattcagagaattttccgggctaaagggtgccgaggcccctcctaatcagaaaggacctagcggagtgcagccgaatcctgctcagcccgtggggccactgaggaaccttccgaagatgattctcccacccccttggaaagcccagaggaagaaaaaccaatctaaaattcctgaaccacttagtcctcatcagtggatgcctctgcaccccgcttgtgcacgagatctgccttttctgcaaaaccaggccaggttaacatgcagtcccccacgtatgcaatag

SEQ ID NO: 238738 - DNA, 4508 bp, Artificial Sequence
  Description of Artificial Sequence: Synthetic coding sequence
atgatggccaaaaataaggagccacggccacccagttatactatatccattgtggggttaagtggtaccgagaaagacaaagggaattgcggcgtcggaaaaagttgcttatgcaatagatttgtaagatccaaggccgacgaatattacccggaacacacttcagtgctgtctaccattgactttgggggtcgagtcgtcaataatgatcatttcctatactggggtgatatcatccagaacagcgaggatggcgtcgagtgcaaaatccacgtaatcgaacagaccgagtttattgacgaccagacatttctaccacatcgtagtacgaacctccagccttacattaaaagggcagccgctagcaaactgcagagcgccgagaaactcatgtacatatgcaccgatcagctgggactcgaacaagacttcgagcagaagcagatgccggagggtaagctcaacgtggatgggttcttactttgcatcgatgtgtcacaggggtgtaaccgaaagtttgacgaccagctcaaattcgtaaacaacctgttcgttcagttgtctaagagcaagaagcccgtgattatagctgctacaaagtgcgacgaatgcgttgatcattacctgagagaggtccaagcatttgcctccaataaaaagaacttgctagtggtggagaccagcgctcgttttaatgtgaacatcgaaacctgttttaccgcactggtccagatgctggacaagaccaggtcaaagcccaaaatcattccatacctggatgcatacaaaacccagagacaacttgtagtgaccgcaaccgacaagtttgaaaagctggtgcagactgtgcgggactaccacgctacgtggaagacggtgtctaacaaattgaaaaaccaccccgattacgaagagtacattaatttggagggcactagaaaggctagaaatacctttagcaagcatatcgagcaactgaaacaagaacacattaggaagcgaagggaagagtatattaatacactgccaagggcctttaataccctcctgcccaaccttgaggaaatcgaacacctgaattggagtgaggcacttaaattaatggagaagagggctgacttccaactgtgcttcgtggtgctggagaagactccctgggacgagactgatcatatagataagataaacgaccgaaggatcccttttgacctgttatctacgttagaagccgagaaagtgtaccagaatcacgtccagcacctcatctcagaaaaaagaagggtggaaatgaaggagaaattcaagaaaaccctggaaaagatccagttcatttcccctggccaaccctgggaggaggtgatgtgttttgtcatggaagacgaggcctataagtatataacagaggctgatagcaaggaggtgtatgggaggcaccagagagagattgtggagaaagctaaggaggaattccaagaaatgctgttcgaacattctgaactgttctatgatctggacctgaacgctacaccatcctccgacaagatgtccgaaattcatactgtgctgtccgaggagccacgctacaaagccctccagaaactggccccagaccgcgagtcattgcttttaaaacacattggcttcgtctatcacccgacgaaagagacatgtctgagcggacagaactgtacggatataaaagtggagcagctgctggcaagctccttgttgcagctggatcatggaaggctccgcctatatcacgattccacaaatatcgacaaagtgaacctgttcattctcggcaaagacggtctggcccaggagcttgctaacgaaatacgtacccagagcacagatgacgaatatgcattagatggtaaaatttatgaactcgatctcaggcctgtggacgccaaatctccctatttcttgtcccagctctggactgccgcatttaagcctcatggctgcttttgcgtgtttaacagcatagagagtctttcattcatcggcgagttcatcggcaaaatacggacagaggcgtcgcaaatacgcaaggacaagtatatggccaacctgccattcacactcattctagcaaatcagcgcgactcaatcagcaagaaccttcctatactcaggcaccagggacagcaactggcaaataagttacagtgcccatttgtagacgttcccgctggtacctacccacggaaatttaacgagactcagattaagcaggccctcagaggcgttctggaatccgtcaaacataatctggatgttgtgagccctatcccagcaaacaaggatctgagcgaggccgatctgcgtatcgttatgtgcgcaatgtgcggtgacccattcagtgtggatctcattctcagtcccttcctggactcccattcatgctccgcagcacaggcagggcaaaacaactcactgatgcttgacaagatcattggggagaagcggagacggatccagatcaccattctgagctaccactcatccattggtgtgagaaaggatgagttggtccacggatacatcctggtgtactcagccaagcgtaaagcatccatgggaatgctaagggcattcctgtcagaggtgcaggacactatacccgtgcagctggtcgccgtgacagattctcaagccgacttcttcgagaacgaggcgatcaaggaacttatgaccgaaggtgaacacatagccactgaaatcacagccaagtttactgccctgtatagcctgtcacagtatcacagacagactgaagtatttacactgtttttcagcgatgtgctggaaaagaagaacatgatcgaaaatagttatctttccgacaacacaagggagtcaacacaccagtctgaggacgtattcctgccctcgccgagggattgtttcccgtacaataactacccggatagtgacgacgacacagaggccccacccccttatagcccaatcggggatgatgtccagttgttgcctaccccgtcagaccggtcccgctaccgccttgatctagaggggaatgaataccccattcattctacacctaactgtcatgaccacgagcgaaaccacaaagtgccccctcctattaagcctaaacctgtggttcccaaaactaacgtgaagaagctggatccgaacctccttaaaaccatcgaagcaggaatcggaaaaaaccccaggaagcagacatccagagtccccctggcccaccccgaagacatggaccccagcgacaactatgcggaacccatcgacacaattttcaagcagaagggctattcagacgaaatctacgttgttcccgacgattcccaaaaccgcatcaagattcggaattcatttgttaacaacacgcagggtgatgaagagaacggatttagcgatcggacctctaagtctcacggtgagaggagaccatccaagtacaagtacaagtctaagacattgttcagcaaggcaaagagctactacaggcgtacacactcggacgcttccgatgacgaagcgttcacgaccagcaaaacaaaaaggaaagggaggcacagaggatcagaagaagaccccctcttatctcctgtcgagacctggaaggggggaattgacaatccagcaattacgagtgatcaggagctggacgacaaaaaaatgaagaagaaaacccacaaagtgaaggaggataaaaagcaaaaaaagaaaaccaaaaatttcaatccacctacccgacgcaactgggaatctaactacttcggcatgccactgcaggatctggtcaccgcagagaaaccaatccctctctttgtggagaagtgtgtggagttcatcgaagacacgggactctgcacagaggggctctatcgggtcagcggcaacaagactgaccaggataacattcagaagcagtttgaccaagatcacaatatcaatcttgtctcgatggaagtcaccgtaaacgccgtggccggagctttaaaggcctttttcgcggaccttccagacccactgatcccctatagcctccatcctgagttgcttgaagccgcaaagattcccgacaagaccgagcgccttcacgccttgaaggagatagtgaagaagtttcaccccgtgaactatgacgtgtttcgctatgttattacccacctgaaccgggtgtcccagcagcacaaaatcaacttgatgacagctgacaacttgagtatctgtttttggccaactctcatgaggcctgactttgagaatagggagtttttgtccactactaagattcaccagtcagtggtcgagacatttatccagcagtgccaatttttcttctacaacggggagattgtcgagactactaacatcgttgcccctcctcccccatccaaccccggtcaactagtggaaccaatggtgcccttacagctcccccctccattacagccccagctgattcagcctcaactccagactgaccccctgggtatcatcta

SEQ ID NO: 238739 - DNA, 714 bp, Artificial Sequence
  Description of Artificial Sequence: Synthetic coding sequence
atgtcactacccccaccgcctcccggtcccctgccattgaggcgaagacgcagacggcctaccctgttggggctgtgcactgagggcctgtatcgggtgtcaggaaacaagactgaccaggacaatatccaaaagcaattcgatcaggatcacaatattaacctggtttcgatggaagtaacagtgaacgctgtcgcaggagctctgaaagctttctttgcagatcttcctgacccactgattccctattccctgcatcctgagttactcgaggctgccaagatccccgacaagactgaacgtctccacgccttgaaggaaatcgtgaagaagttccaccctgttaactatgacgttttccgatacgtgattactcatttgaatcgcgtttcacagcagcacaagatcaaccttatgacagcagataatctgtctatctgcttctggcccactttgatgaggccagacttcgaaaacagggagttcttgagtacaaccaagatccaccagagtgtggtcgagacttttattcaacagtgccagttcttcttttataatggtgaaatagtggagacaactaacatcgtggcgccacccccaccatccaatcctggacagctggtggagcctatggtacccttgcagttgcctccgccactacagcctcagctgatacaaccccagctacagaccgatccactcgggataatctag

SEQ ID NO: 238740 - DNA, 4505 bp, Artificial Sequence
  Description of Artificial Sequence: Synthetic coding sequence
atgatggctaagaacaaggagcctaggcccccttcctatacaatttcaatcgtgggcttatcaggtactgagaaggataagggtaattgcggcgtgggcaaaagctgcctgtgcaacaggttcgtgaggtcaaaagcagatgagtactatccagagcatacgagcgtgcttagcacaatcgacttcgggggtagagtagttaataacgaccatttcctctactggggggacataattcaaaacagcgaggacggagttgaatgtaaaatacacgtcatagaacagaccgagttcattgacgaccagactttcttgcctcataggtcaaccaacctccagccctatattaaacgggctgctgcatccaagttgcagtccgctgaaaagctaatgtatatctgcaccgatcagctgggattagagcaggactttgaacaaaaacaaatgcctgagggtaaattaaatgtggacggatttctcctgtgtatcgacgtgagccagggctgtaatcgcaagttcgatgatcaactgaagttcgtgaacaacctgttcgttcagctgtccaagtccaaaaagccagtgatcatcgcagcgactaaatgcgacgaatgtgttgaccattatcttcgcgaggttcaagccttcgcctccaacaagaagaacttgctggtggttgagaccagcgccagatttaacgtgaacatagagacttgcttcaccgccttggtgcaaatgttggacaagacacgctcgaaacccaagatcatcccttatctggatgcttacaaaacacagagacagttagtggtgactgcaactgacaaatttgaaaagctggttcaaactgtacgcgactatcatgctacctggaagactgtgtcgaataagttgaagaatcatcctgactatgaggagtacatcaatttggagggcacacgcaaagccagaaacacattttccaagcatattgagcaactaaaacaggaacatattcggaagaggagggaagagtacattaatacactcccaagagccttcaacacactgctacccaacctagaggagattgaacacttgaattggtcagaagccttgaagcttatggagaaaagagcagatttccagctctgttttgtagtcttggagaagacaccatgggacgagactgaccacatagacaagatcaacgatcggagaatacctttcgatctgctctccaccttggaggcagagaaggtttaccaaaatcacgttcagcacctgataagcgagaaacgaagggttgagatgaaagaaaagttcaagaagaccctggaaaagatacagttcatcagccccggacagccctgggaggaagtgatgtgcttcgtgatggaagacgaagcctacaaatatataacagaagctgacagcaaggaagtctatggacgtcatcagcgcgagatagtagagaaggccaaggaagaattccaggaaatgctctttgaacatagtgagttgttttacgatcttgatctgaacgccactccttcctctgacaagatgtccgagatccataccgtgctcagcgaggaacctcgctacaaggccctacagaaactagcccctgatcgcgaaagtctcctcctgaagcacatcggcttcgtataccaccccaccaaagaaacgtgtttgtctggacagaattgtacagatataaaggtggagcaactgctggcaagcagccttcttcagttagatcacggacgcttgcgcctttatcacgattctacgaatattgacaaagtgaacctttttattttagggaaggatggcctagcccaggagctggcaaacgagatccggacccagtccaccgacgatgaatacgctctcgatggaaagatttacgaactcgatctccgcccagttgatgccaagtcgccgtattttctgtcacagctgtggaccgctgcatttaagcctcatggttgcttctgcgtgtttaattctatagaaagcctgagcttcatcggtgagttcattggcaagatacggactgaggcttcacagatacgcaaggacaagtatatggccaatctgcccttcaccttgattcttgccaaccagcgcgactcaatttcgaaaaacttaccaatactgcgacatcagggccagcagctggccaacaaactgcaatgtccattcgtcgacgtccctgcaggcacctaccccagaaagttcaacgaaacccaaattaaacaggctctgcgaggcgttcttgagtccgtgaagcacaatcttgacgtggttagcccaattcccgcaaataaagacttgagcgaagccgacctccggatcgtgatgtgtgctatgtgtggagatccgttcagtgtggacttaatattgtcaccattccttgactcacattcctgcagcgccgctcaggccggtcagaacaacagtttaatgctggataagatcatcggagagaagcgtcgcagaattcagatcacaattctgtcctaccactctagcattggggttaggaaagacgaattagttcacggatacattttggtgtattccgcaaaaaggaaagcctcgatgggcatgttgcgcgcatttctcagcgaagtgcaggacacaatccctgttcagcttgttgccgtgactgactcccaggcggattttttcgaaaacgaggctataaaagagctgatgacagaaggggaacacatagcgactgagattacggccaagttcacagcactttattccctgagccaataccaccggcagacggaggtgttcaccttgttctttagcgatgtcctggaaaaaaagaatatgatcgaaaattcttacctgtctgataataccagggagtctacccatcaaagcgaggacgttttcctgccatctcctagggactgttttccttacaacaactacccagactccgacgatgataccgaggcccctcctccatattctcctatcggcgatgatgtgcaactgctgccgacaccttccgatcgtagtcgttaccgtctggacctcgaagggaatgagtatcccattcattccactccaaattgccatgatcacgagagaaatcataaggtgcctcccccaataaagcccaaacctgtcgtccccaagacaaatgttaagaagcttgacccaaacctgttgaagacaattgaagctggcatcgggaagaatcctagaaaacaaacatctcgggtgcctctagcccaccctgaagacatggatcccagcgacaattatgcagagccgattgacactatttttaaacagaagggctattctgatgaaatctacgtggtgccagacgactcccaaaatagaatcaagatccggaacagcttcgttaataacacccagggagacgaagagaacggctttagcgaccggacctctaaatcacatggagaacggcgaccaagcaagtataaatacaaaagcaaaaccctcttttctaaggcaaaatcttactatagacggactcacagtgacgcctcggacgatgaggctttcacaaccagcaaaaccaagaggaaggggaggcaccggggaagcgaggaggaccccctattgtccccagtcgagacatggaaggggggtatcgataatcccgctatcacttctgatcaggaacttgacgacaaaaagatgaaaaagaaaactcacaaggttaaggaagataagaaaaaaaagaagaccaagaactttaaccctcctacaaggaggaattgggagagtaattattttggtatgcccctgcaggatctagtgacagccgaaaagcctatcccgctcttcgtcgaaaaatgcgtggagtttatcgaagacacaggcctgtgcaccgagggcctctatcgtgtttcgggaaacaagaccgaccaggataacatccagaagcaatttgatcaggaccacaacattaacctcgtgtctatggaagtgactgtaaacgctgtggccggtgctctgaaggccttcttcgcggatctgccagatccactgattccatattcccttcatccagaactgttggaagctgcgaagattcctgataaaacggagagactgcatgccctgaaggagattgtgaagaagtttcatccagtaaactatgacgtgtttaggtacgttataacacaccttaatagagtgagccagcagcataaaattaatctgatgacagcagacaacttatccatatgtttttggccaaccctgatgaggcccgacttcgaaaatagggaatttcttagcaccactaagatacaccagtccgtcgtcgagaccttcattcaacagtgccagttcttcttttacaacggagaaatcgtggaaactaccaacatcgtagcaccacctccaccctctaatccaggacagctcgtggagcccatggttcccctacaactccctccacccctgcaaccacagctgattcagccccaactccagacagatccgctcgggatcatcta

SEQ ID NO: 238741 - DNA, 726 bp, Artificial Sequence
  Description of Artificial Sequence: Synthetic coding sequence
atgcctttgcaggacctagtgacagccgaaaaacctatacccttatttgttgagaaatgtgttgaattcatcgaggatacaggtctatgcacggaagggctctaccgcgtgagcggaaacaagacagaccaagacaatatccaaaagcaatttgaccaagaccacaacataaatctggtgtcaatggaagttactgttaatgccgtggccggagccttaaaggccttctttgcagacctaccagatccactgataccctactcgcttcatcctgagcttctggaggcggctaagattcctgacaaaacagaacggctccacgcactaaaagagatcgtaaagaagttccaccctgttaattatgacgtatttcgctatgtgataacccacctgaacagggtgtcccaacagcataaaatcaatttaatgacggccgacaatctctcaatatgcttttggccaactctaatgaggcccgatttcgagaaccgagagtttctaagtacaaccaagatccatcagagtgtggtggagaccttcattcaacagtgccagtttttcttttacaacggagagatcgtggaaacaaccaatattgttgctccccctccacccagcaaccccggtcagctcgttgaacctatggtgcctctgcagctgccacctcctttgcaaccacagttgatccagccgcagctgcagacggaccctctggggatcatctag

SEQ ID NO: 238742 - DNA, 4509 bp, Artificial Sequence
  Description of Artificial Sequence: Synthetic coding sequence
atgatggccaagaataaggaacctagaccaccgtcctacacaatctcaatcgtcggtctgtcaggaacagaaaaagacaagggcaattgcggcgttggcaagtcatgcttgtgtaacagattcgtgaggagtaaagctgacgaatactaccctgaacacaccagtgtgttgagcactattgattttgggggtagagttgtaaacaacgatcactttctgtattggggagacattattcagaactctgaggatggagtggagtgcaagattcacgtcattgagcagacagagtttatcgatgaccagacctttttgcctcacagatctacaaatctgcagccatacatcaaaagggccgcagcgtccaaactgcagagtgctgagaaactgatgtacatatgcacagaccagctgggtctcgagcaagatttcgagcagaagcagatgccagaagggaaactcaacgtcgatggattcctgctgtgtatcgatgtgagtcaggggtgtaaccgaaaattcgacgatcagttaaaattcgtgaataacctgtttgtacagttgtctaaatccaaaaagcccgtgatcatcgcggctacaaagtgcgacgagtgtgttgaccattacctaagggaggttcaggctttcgcctcaaacaagaagaatcttctcgtcgttgagacaagtgccaggttcaatgtgaatatcgagacttgcttcaccgccttggtgcaaatgctcgataaaacacgatccaagccgaagattatcccatacctggacgcctacaagacccagcgacagcttgtcgtgaccgctaccgacaaatttgagaaactcgttcaaaccgtgcgggattatcatgcaacctggaaaacagtctccaataagctgaagaatcacccagactatgaagagtatattaacttggagggaaccaggaaggcacggaatacctttagcaaacatattgaacagttgaaacaggagcacatcagaaagcgtagagaagagtacattaacaccttaccaagagcatttaatacgcttctcccaaacttggaggagattgagcatttgaactggtccgaggcactgaaacttatggagaagcgtgctgactttcagctctgtttcgtcgtgctggagaagaccccctgggacgagactgaccacattgacaagattaacgaccgcagaattccttttgatcttctatctactctggaagcggagaaagtttaccaaaaccatgtgcagcatctgatatccgagaaaaggcgggttgaaatgaaagagaaattcaaaaaaaccctggaaaaaattcagttcatcagccctggtcagccctgggaggaggtgatgtgtttcgtgatggaggatgaagcttataagtacattacggaagccgacagtaaggaagtgtatggtcggcatcaaagagagatcgtggagaaagctaaagaggaattccaggaaatgctgtttgagcattctgaactcttttatgatctcgatttgaatgcaacaccctcatcggataagatgagcgaaattcacaccgtgttgagcgaagagccgcgatataaggcactccaaaaattagcacctgacagagagtcactgttattgaaacacatcgggtttgtatatcatccgaccaaagagacatgcttgagcgggcagaactgcaccgatatcaaggtcgagcagttgttagcatcaagccttctgcagctggatcacggcagactgcgtctgtatcatgacagcacaaatatcgataaggtcaatcttttcatcctgggcaaagatgggctcgctcaggagctcgccaatgagattcggactcagtccaccgatgacgaatacgctcttgatggcaagatctatgagctcgatctacggcctgtcgacgccaaatccccctacttcctctctcagctgtggacagccgcatttaagccccacggatgcttctgcgtcttcaacagcatcgagtctctatctttcatcggagagttcatcggcaaaattcggacagaagccagccaaatacgcaaagataaatacatggccaacctgccctttactctcatacttgccaatcaacgcgactcgatttctaaaaacctgcctatcctaagacaccagggccagcagctcgctaacaagttacaatgccccttcgtggatgtacctgccggaacctatccacgcaagttcaatgagacacagattaagcaggctttgagaggcgtcttagaaagtgttaagcataacctggacgttgtttcaccaatccccgctaacaaggacttgtccgaggctgacctacgcattgtgatgtgtgccatgtgcggtgatcccttctccgtagacctcatcctctcccctttcctcgacagccactcctgctccgcagcgcaggccggacaaaacaatagcctgatgttggataaaattatcggcgagaagaggagacgtattcagatcacgatcttatcttaccacagctctatcggcgtacgcaaggacgagctagtgcatggctatatcttggtttactcggccaagcggaaagctagcatgggaatgctgcgagcctttctgtctgaggtccaggataccatacccgtccagttggtcgcggtgactgactctcaggcagattttttcgagaacgaggctatcaaagagctcatgaccgaaggcgagcacatcgcgacagagataactgctaaatttacggccctctactcactttcccagtatcatagacagacggaggtttttacactcttcttcagtgacgtgttagagaaaaagaacatgatagaaaattcctacctgagcgacaatacccgggagagcactcatcaatctgaggatgtgttccttccatcaccccgtgactgctttccgtataataattaccccgacagtgatgatgatacagaagcccctcctccttattccccaattggcgatgatgttcagttgttgccaacaccctccgacaggagccgctacaggctggacctggagggcaatgaataccctattcacagcaccccaaattgtcacgatcatgagcggaaccacaaagttccaccacctatcaagccaaagcctgtggtgcccaagacaaatgtgaagaaattggatcccaacctcctaaagaccatagaggccggtatcggcaaaaaccctcgcaagcagacaagcagggtgcccctggcacatcccgaagatatggacccgtccgacaactacgccgaacctatagataccatcttcaaacagaagggctactctgatgaaatatacgtcgtccccgacgatagccaaaaccgtattaaaattcggaacagcttcgtgaataacacccaaggtgatgaagagaatggtttttccgaccggaccagcaaatcccacggcgaacgtagacccagcaagtacaaatataaatctaaaactctcttttccaaggccaaatcatattatcggaggacacactccgatgcatctgacgatgaggcatttactacctcgaagaccaagaggaaaggcaggcatcggggatcagaagaagatcctctgctgtcccccgtcgagacatggaaaggaggcattgacaatcccgctattactagcgaccaagagttggacgacaaaaagatgaaaaagaagacgcacaaggtgaaagaagacaaaaagcagaagaagaagaccaagaattttaatccaccaacaagaagaaactgggagtcaaattatttcggtatgcctttgcaggaccttgttaccgccgaaaaacccatccctctgttcgtcgagaagtgcgtggagttcatagaggacacagggctgtgcactgagggcttgtacagagtgtccggcaataaaaccgatcaggataacattcagaagcagttcgaccaggaccacaatatcaacctcgtcagtatggaagtgaccgtgaatgcggtggcaggagcacttaaggcattttttgcagatctgccggatcctctgatcccgtacagcttgcatcccgagctgttggaagccgctaaaatcccagataaaaccgaacgactacacgcgttaaaggaaattgttaaaaaatttcatcctgtgaactacgacgtgttcaggtacgtcatcactcaccttaaccgcgtgtcgcagcagcataagatcaatttgatgaccgccgacaacctttctatctgcttctggccaactctgatgcggcctgatttcgagaatcgggaatttctatcaacgaccaagatacaccagtcggtggtggagacgtttatccagcagtgtcaattctttttttacaatggagagattgtggaaaccaccaatatagtggcaccaccaccaccatctaaccccggtcaactcgttgaaccgatggtgcctctccaactgccacccccattgcagccacagctaattcagccacaactgcagaccgatccattgggcattatttag

SEQ ID NO: 238743 - DNA, 414 bp, Artificial Sequence
  Description of Artificial Sequence: Synthetic coding sequence
atgcccctccaggatttggtgactgccgaaaagcctattcccctctttgtggaaaagtgtgtggagtttattgaagacactggactgtgcacagaagggttatatagagtgtctggtaacaagactgaccaggacaatatccagaagcagttcgaccaggatcacaacataaacttggtgagcatggaggtgacggtgaacgcagtggccggagctctcaaggcctttttcgctgatctccccgaccctttgatcccgtacagcctgcaccctgagctgctggaagctgcgaaaattccagataagactgaacgcctgcatgcattgaaggagatcgttaagaagttccatcctgttaattatgacgtgttccgatacgtcatcacacacttgaatcgggtgagccagcagtag

SEQ ID NO: 238744 - DNA, 114 bp, Artificial Sequence
  Description of Artificial Sequence: Synthetic coding sequence
atgatggctaagaataaagaaccgaggcccccaagctatacaataagtattgtggggctgtccggcactgaaaaggataaaggcaactgtggtgtgggtaagtcatgtctgtag

SEQ ID NO: 238745 - DNA, 423 bp, Artificial Sequence
  Description of Artificial Sequence: Synthetic coding sequence
atgatggctaagaataaagagccccgacccccatcctacactatctccatcgtggggctaagtggaactgaaaaagataagggtaactgtggagtaggtaaaagttgcctgtgtaaccgatttgtccgcagtaaggcagatgaatactatcccgagcatacctcagtgttgagcaccatcgacttcggcggtcgtgtagtcaacaacgaccattttctctattggggggacataattcagaattccgaagatggggtggaatgtaaaatccatgtgatcgaacagaccgaatttatcgatgaccagacgtttttgccacatcgatctactaaccttcaaccatatattaagcgtgccgctgcctctaagctgcagagcgctgagaagttaatgtacatatgcaccgaccagctgggactctag

SEQ ID NO: 238746 - DNA, 4506 bp, Artificial Sequence
  Description of Artificial Sequence: Synthetic coding sequence
atgatggcgaaaaacaaggaaccacggcctcctagctacacaatcagtattgtcgggctgtctgggaccgaaaaagacaaagggaattgcggcgtgggaaagagctgcctctgcaatcgcttcgtccgatcaaaagcagatgagtattatccagaacatacctcggtgttgtcgactattgacttcggtgggagggtggtcaacaatgaccattttctgtactggggcgacattatccaaaacagcgaggacggagtggagtgcaagatccacgtgatcgagcagacggaattcatcgacgaccagacgttccttccacataggtcgacgaacctgcagccatacatcaaaagggctgccgcttccaagctgcagagcgcggaaaaactgatgtatatctgcacagaccagttgggactggaacaggattttgaacagaaacagatgcccgagggcaagctcaacgttgacggattcctcctgtgcattgatgtgagccaaggatgtaaccggaaatttgacgatcaattgaaatttgtgaacaatttatttgttcagctatccaaatcaaagaaacccgtgatcatagcagcgactaaatgcgacgaatgtgtggaccattacctacgcgaggtgcaggcctttgcctccaacaagaaaaatctgctcgtggtggagacctctgctcgctttaacgtgaacatagagacctgctttacagccctggtgcagatgctcgacaaaacccgctctaaacctaaaatcatcccatatctggacgcttataaaacccagcggcaactcgttgtgaccgctacagataaatttgagaagctggtccagacagtcagggattatcacgctacatggaaaacggtgtctaacaaactgaagaaccaccccgactacgaggagtacatcaatctggagggaactagaaaggcgcgaaataccttttccaaacacattgagcagctgaaacaagaacatatacgaaaaagacgcgaagagtatatcaacactcttcccagggcgttcaatacgctgctcccaaatctggaagagattgaacacctcaactggtccgaagcgctgaaactcatggagaaaagagccgacttccagctgtgttttgtagtcttggaaaagaccccatgggatgaaacagatcacattgacaaaattaatgatcggagaataccatttgacctgctctccaccctggaggccgagaaggtgtatcagaaccacgtgcagcacctcatatctgagaagcggcgagttgagatgaaggaaaaatttaaaaaaacacttgagaaaatccagttcatcagccccggtcagccatgggaagaggttatgtgttttgtcatggaagacgaggcttacaaatatataactgaggccgacagcaaggaggtgtatggaaggcatcagcgcgaaattgtggaaaaagcgaaagaggagttccaggaaatgctttttgagcattcagagctgttttacgacctggatctgaacgccaccccaagcagcgataaaatgagtgagattcacacagtcctaagtgaagaaccacggtacaaagccctgcaaaaactggcaccagaccgagaatcccttctgttaaagcatatcggttttgtatatcaccctaccaaggaaacctgcctttctggccaaaactgtacagacataaaagtcgaacagctgctggcttcgagcctgctgcagctcgaccacggcaggctgagattataccacgactctaccaatatagacaaagtcaatctcttcatcttaggcaaagatgggcttgctcaagagctggccaatgagattagaactcagagcactgatgatgagtatgcactggacggaaaaatctatgagctcgatctgcggccagtcgatgccaaatccccttatttcctcagccagctgtggacagccgctttcaaaccacacggctgtttctgtgtttttaattcaatcgaaagtttgtccttcataggcgagtttattgggaaaattaggacagaggcctcacagatacggaaggacaagtacatggcaaatctgcctttcaccctcatcttagcaaatcagagggacagtatttctaaaaatctgcctatacttcgacatcagggacaacagctggccaacaagctgcagtgcccattcgttgacgtccccgcaggcacctacccccgaaagtttaatgagacacaaataaagcaagccctgaggggggtactggagtcagtaaaacacaatctcgacgtggtctctcctatcccagctaataaggatttatccgaagcagatctgcgcatcgtcatgtgcgctatgtgtggagaccccttcagtgttgatttgatcctgtccccattcttggattctcactcttgcagcgctgcacaggcaggacagaacaattccctgatgctagacaagatcatcggtgagaagcgccgaagaatccagattaccatcttgagttaccacagctcaatcggcgtgcggaaagatgagctggttcacggttatatcctcgtctactccgccaagcggaaggccagcatggggatgctgagagcttttctgagcgaagtgcaggacacgattcctgttcaacttgttgccgtcactgactcccaggcggatttttttgaaaacgaagctattaaagagttgatgacggagggcgagcatatagctaccgagattaccgccaagtttaccgcactctatagcctgtcccaatatcatcggcagactgaagtgttcactctgttctttagcgatgttttagaaaagaaaaatatgatcgagaatagctacctctctgataatacccgggaaagtacgcaccagagcgaggatgtctttcttccatcacctagagactgttttccctacaataattatcccgattccgacgacgacaccgaggccccaccaccttacagccctatcggggatgacgtgcagctcctcccaactcctagcgaccgatcgcgatatcgccttgacttagaaggcaatgagtatcccatccatagcacacccaactgccacgaccacgagcgcaatcataaggtcccaccaccaattaaacctaagcctgtggtccccaagacaaacgtaaagaagttggatcccaatctcttaaagaccattgaggccggaatcggcaaaaaccctcggaaacagacttctagggtccccctggcgcatcccgaagatatggacccctcagataactatgcagagccaatcgacactatctttaaacagaagggctattctgacgaaatctacgttgttcccgatgactcccagaatcgcattaagattcgaaacagctttgtgaataacactcagggtgatgaggaaaacggtttctcggatcgcacttcgaagtctcacggggagcgcaggccatcaaaatataaatacaaaagcaaaacactcttctccaaggccaagtcctactatagacgtactcactctgacgctagcgatgacgaagcgtttaccacaagcaagactaagcgcaaagggagacaccgcggtagcgaagaagaccccctgctgagtcccgtggagacatggaagggcggaatcgacaaccccgctattacatcggatcaggagctggatgacaaaaaaatgaagaaaaagacacataaggtaaaggaagacaaaaagaagaaaaagacaaagaacttcaaccctcctacacgaaggaactgggagtcaaactattttggtatgccactgcaggatctggtgacggctgagaagcctatccctctatttgtggagaaatgcgttgagttcattgaagacaccggcttatgcaccgaaggactctacagagtcagcggcaataaaaccgaccaagacaatatccagaaacagttcgaccaagatcacaatataaacctggtgtccatggaggtgaccgtgaatgcagtggccggtgctctgaaggcgttttttgctgacctgcccgaccctctgattccatacagcctgcatccagaacttcttgaagcagccaaaatccctgacaaaacagaaagactacatgctcttaaggagattgtgaagaagtttcaccccgtcaattacgacgttttccgctatgtcatcacgcacctaaaccgagtttcccagcagcacaaaataaacctcatgacagccgacaacctgtctatttgtttttggcccactttgatgagacccgactttgagaatagggagttcctgagtaccacaaaaattcaccagagtgtagtggaaaccttcatacagcagtgtcaatttttcttctataacggcgagatcgtagaaactaccaatatagtggccccacccccacctagtaatcccggacagctggtggagccaatggttcctctacaactaccccctcctctgcagccacaattgatccaaccacaactacaaacagatccgttaggcatcatttag

SEQ ID NO: 238747 - DNA, 2316 bp, Artificial Sequence
  Description of Artificial Sequence: Synthetic coding sequence
atgtcagggaggagtgtgcggctcagatcagtgcccatacaatctctgagcgaacttgagagggctcgcctgcaagaggtggccttctatcagctacagcaggactgtgatctcagctgccagatcacaatcccaaaggatggacaaaagagaaagaagtcactgaggaagaaactggattctctcgggaaggagaaaaacaaagataaggagttcatccctcaggcattcggaatgccgctgtctcaggtgatcgccaatgatcgagcctataagcttaagcaagacctgcaacgcgatgaacagaaggacgcaagcgacttcgtggcatccctgctcccatttgggaacaagaggcaaaataaagagctgtcaagtagtaattcctcgcttagttctacgtctgaaacccccaatgagagtacatcacccaatactcctgagcctgctccacgagctcgccgaaggggggctatgtcagttgactccatcaccgaccttgacgataatcagagtaggctgctcgaggccctgcagctttccttgcctgccgaggcccagagtaagaaagagaaggccagggataaaaaactgtcactcaaccctatttataggcaggtgccgcgactcgttgattcatgttgccagcacctagaaaaacacggattacagacagtgggcatcttcagagttggcagctcgaagaagagggtgaggcagcttcgtgaagaattcgacagggggatagacgtctccttggaggaagaacactccgtccacgatgttgccgctctgttgaaagaattcctgagggacatgcctgatccactactgacaagagagttatatacagcctttattaacacgctacttctcgagccagaagaacagctcggtactctgcagctcctgatatacctactgcctccatgcaattgcgatacgttacatcggctgcttcaattcttaagcatagtagctagacacgccgatgataatatcagtaaagacgggcaagaagtaacaggcaacaaaatgacctctctcaacctagccaccatctttggtcccaatctgctgcacaagcaaaagtcgtctgacaaggagttctctgtgcagagcagtgctcgggcagaagaatctaccgccattattgccgtggtgcaaaagatgatcgaaaattacgaagctctcttcatggttccaccagacttacagaacgaggtactcatttcactgctggaaaccgatcccgacgtggtggattacctgttgaggaggaaggcttcgcagtctagctcccccgacatgctgcagagtgaggtctccttttcagtgggcggacggcactcctcaacggattcaaacaaggccagctccggcgatatcagcccctacgacaacaattctccagttctgtccgagcgaagtctgctggctatgcaggaagatgccgcaccagggggttccgagaagctataccgtgtccctggacagttcatgttagtcggtcacctgtcgtccagcaagagcagagagtctagccctggtcccagactgggcaaagacctgtccgaggagccctttgacatctggggcacttggcatagcacactgaaaagcggcagtaaggacccgggtatgacgggatcctctggagatatcttcgagagtagtagcctgcgcgcaggaccttgtagcctgtctcagggaaacttatctcccaactggccccgatggcagggaagccccgcagaactggactctgatacccagggggcaaggcggacgcaggcggctgctcccgctacggagggaagagcgcacccagccgtgtcacgcgcatgctctacacctcacgttcaggtggctgggaaagccgaacgtccgaccgcaagatctgaacagtacttaactctgagcggagctcatgatctctcagagagcgagctggacgtcgccggacttcagtcccgtgcaacgcctcaatgccagcgaccacatggctcagggcgtgatgataagcgaccaccaccaccctaccccggaccaggaaaacctgcagccgcagccgcttggatacaggggccaccagagggagtggagacaccaaccgaccaaggaggacaggcagcagagcgcgagcaacaggtcacgcaaaagaaactgagctcagctaattccttacccgctggcgagcaggattcccccagattaggggacgccggatggctggactggcagcgggaaaggtggcagatttgggagctgctctcaaccgataatccagacgccctgccagaaacactggtgtag

SEQ ID NO: 238748 - DNA, 2925 bp, Artificial Sequence
  Description of Artificial Sequence: Synthetic coding sequence
atgtctgcccagtcccttttgcacagtgttttctcttgcagttcccccgcttcgtcaagtgccgcttcagccaaaggattctcgaagcgcaagctgagacagaccaggtctttagatcctgctctgatcggagggtgtgggtctgatgaggcaggggcagagggctcagctcggggagcgaccgcgggacggttatatagcccttcactgcctgcggaaagcctgggacctcggctagcctcttccagccgtggacctccaccaagggctactcggctgccccctccaggaccattgtgttcgagtttcagcacacctagcacaccccaggagaaatccccttctggcagcttccattttgactatgaggtgccactgggcagaggtggtttgaaaaaatctatggcttgggatctcccttcagtcctcgcaggtccagcctcgagccgctctgcaagttccattctttgttcaagtggtggtggccctaacggaatttttgcatccccaagacgttggttgcagcagagaaaatttcagtcccccccagatagccggggtcacccgtacgtggtgtggaagtcagagggggactttacctggaactccatgtccgggaggagcgtaagacttcgctccgtccccatccagagcctatccgagttggagcgagcgcgtttacaggaagtggcattctatcaactgcaacaggactgtgacttaagctgtcagattactattcctaaggatgggcagaagcgcaagaagagtctgcggaagaaattggacagcctgggaaaggagaagaataaggataaggagtttattccccaggcattcggcatgccgttaagccaggtgatcgccaatgatcgcgcatacaagctgaagcaggacctgcaaagggatgaacaaaaagacgcttccgactttgtagcctcactgctgccattcggcaataagcggcagaacaaggaactgtcctcgagtaatagcagcctgagttcaacgtccgagacgccaaatgagtccacatctcccaataccccagagccagcacctagagcacgcaggcgtggagcgatgtcagtcgacagcattaccgatctcgatgacaaccagtctaggctcctggaggctttacagctgtctcttcctgctgaagctcagtccaagaaggagaaggcacgggataagaagctgtcgcttaatcctatctacagacaagtgccgaggctagttgactcttgctgccagcacctggaaaaacacggactacaaacagtgggaatcttccgggttgggtcatctaagaagcgagtgcggcaactgagagaagagttcgaccgtggaatcgacgtctctctggaggaggagcactcagttcacgacgtggccgcactccttaaggagtttctgcgcgatatgcctgatcctctcctgaccagggagttatataccgctttcataaacacattactgctggagccagaagagcagttggggactctgcagctactgatctatctgctgcccccatgcaattgtgatacactgcaccgcctgctgcaattcctcagcattgtggcccgtcatgctgatgataatataagcaaggacgggcaggaagtgaccggcaacaagatgacatcactaaatctggcgacaatcttcggacctaatctcctccacaaacagaagagcagcgacaaggagtttagcgtgcagagctccgcccgtgccgaggagagcaccgctatcattgcagtagtacagaaaatgatcgaaaactatgaggccctgtttatggtcccccctgatctgcagaacgaggtgcttatcagcctgttggaaacagaccctgacgtggttgattatcttttacgacgaaaggctagtcaaagctcttcaccagacatgctgcagagcgaagtgtctttctcagtggggggacgtcacagcagcactgactccaataaagcctcctcaggggatatatcaccatacgataacaacagtcccgttctgtcagagaggtccctcctagctatgcaagaagacgccgctcccggagggtctgagaaactctatcgggtaccaggccagtttatgttagtgggccacctatcctcatctaagtcgagagagtcttctcccggacctagattggggaaggacttatctgaagagcctttcgatatctggggcacgtggcattccaccctgaagtctgggtccaaggacccaggcatgacaggttctagcggggacatatttgaatccagtagcctgcgcgctggaccatgtagcctgtcgcaggggaacctgtcaccaaactggcccaggtggcaggggtcacccgcagaactggacagcgacacccagggcgcaaggcgaactcaggccgcagcaccggcaacagaaggaagggctcaccccgcagtgtcacgtgcctgtagtaccccgcacgtgcaagtggctggcaaagccgagagacctacagccagaagtgagcagtatctgaccctgagtggcgcacatgatctgagtgaaagcgaacttgacgtggctgggctgcagtcccgagcaacacctcagtgccaacgccctcacggatctggtcgggacgataagcggccacccccaccataccccggaccagggaagcccgcagccgctgcagcctggatccaaggaccccctgagggagtggaaacgcctactgaccagggaggacaggcagcagaaagggagcaacaggttactcagaagaagctgtcttccgcgaatagtttgcccgcaggtgaacaagactcccctaggttaggcgacgcaggctggctggactggcaaagagagaggtggcagatctgggaactcctttcaaccgacaatcctgatgccctgcccgagacactagtgtag

SEQ ID NO: 238749 - DNA, 1806 bp, Artificial Sequence
  Description of Artificial Sequence: Synthetic coding sequence
ctcgaattatatgacttgcagatactcgggactaaacccccaatgaactcagatacgcatagaaacttcgatcccacagctacactgcgaaatcagggcgatttcacctggaacagcatgtccggtagatctgtgcgactccgtagtgtgcctattcagtcgttgagtgaactcgaaagagcccgactgcaggaggttgccttctaccagttgcagcaggattgcgatctcagctgccaaataacaatccctaaggatgggcaaaagcggaagaaaagtctgcggaagaagcttgactccttggggaaggaaaaaaacaaggacaaagagttcatcccacaggccttcggaatgcccttgtctcaggtgatcgccaatgaccgcgcttataagcttaagcaagatcttcagagagatgaacaaaaagacgcctctgactttgtggcctctctgctcccatttggcaacaaacgccagaacaaggaactgtcatcttcgaattctagtctttcatccacatcagaaacgcccaacgagagtacctcgccgaacacaccagagccagcacctagggcgcgacgcaggggggcaatgtccgtggatagcatcactgacctggatgataaccagtcaaggcttctggaggcacttcagctctcactacccgcagaggcccagtctaagaaagagaaggcgagggacaaaaagttgtctcttaatcctatttaccggcaggtccctcgcctggtggattcttgttgtcagcatcttgaaaagcacggactgcagacggttgggatctttcgagtaggatcctctaagaaaagggttaggcagctgcgggaggagttcgacagagggatcgacgtcagtttggaagaggagcactctgtgcacgatgtcgctgcactcttaaaagaatttctgagagatatgcccgaccccctgctcacccgggagctgtacaccgcttttattaacaccttgttgctggaacctgaggagcagctgggaaccctccagctgctgatctatttgctccccccttgtaactgcgacactctgcacaggctgctgcaatttctttccatcgtagctagacatgctgacgacaacatctctaaggacgggcaggaagtgacaggtaacaaaatgacaagcctaaacttagccactatatttggacctaacctgctccacaagcagaaatcttctgacaaggaattcagtgtgcagagttccgccagagcagaggagtccacagccataattgccgtcgttcagaaaatgatcgagaactacgaggcgctttttatggtgccacccgatctgcaaaatgaggtgttgatatccctgctggaaacagatcctgatgtcgtcgactatcttctaagacgcaaggcttcccagagttcaagtccagacatgctccagtcagaggttagctttagtgtgggtgggaggcactcatcaacagactctaacaaggccagctccggagacatctcaccatacgacaacaattctcctgtgcttagcgaaaggtctctgttggctatgcaagaggatgctgccccaggcggttctgagaagctctaccgcgtgccaggccaattcatgctggtcggccatcttagctcctctaaatctagagaaagttcgccgggaccacgcctggggaagggaaattggtctcttgcatccagacggtggcccaaacaggctactctccttctgctccatgtggcatggtgcggagccctgcggaccttctcatcatctctgccatatttgatgttcctgtag

SEQ ID NO: 238750 - DNA, 2298 bp, Artificial Sequence
  Description of Artificial Sequence: Synthetic coding sequence
atgagtgcacaatcattgctgcactccgttttttcctgctcatcccccgcatcctcctccgcggctagcgccaagggtttcagtaagaggaaactgaggcaaaccaggagtctcgatccggcactgattgggggttgcggatccgacgaggctggcgctgaaggatcggccagaggcgctaccgcaggcagattgtactccccgagtcttccagcggagagtctgggcccacggctcgccagttccagccggggacctccacctcgcgctactaggctgccacccccaggacctctgtgctcgtcttttagcacgccttcaacccctcaggaaaagtccccatccgggagttttcatttcgattacgaggttcctctaggcagaggcggtttaaagaagtctatggcctgggacctgccctccgttctggctggcccagcaagttctagatccgcctcatccatcctgtgcagttcggggggtggtcctaatggcatctttgcttcgccacggaggtggttgcagcaacgtaagtttcagtcccctcccgattctagaggccatccatatgtcgtctggaaaagcgagggcgactttacttggaacagcatgagtggccgaagcgtgcggctccgatccgtgcctatacagagtctttccgagctggagcgcgcacgactgcaggaagttgcgttctatcagctgcagcaagattgtgacctctcgtgtcagatcaccattcctaaggatgggcagaaacgcaaaaagtcactgcgcaaaaagcttgacagtctgggcaaagaaaaaaataaggataaagaatttataccccaggcctttggcatgcccttatcccaggttattgcaaatgaccgcgcatataaactgaaacaggacctgcagcgtgatgaacagaaggacgctagtgactttgtcgccagcctgcttccattcggcaataaacgacagaataaagaattgtcttcgagtaactcttctctgtccagtacttctgagactcccaacgaatctaccagtcctaataccccggaaccagccccaagagccagaaggcggggtgctatgagtgtggactctatcaccgacttggacgataatcagtctcgcctgctagaggccctacagctgtctctcccggctgaggcacaaagcaaaaaagagaaagctcgcgacaagaagctgtccctgaaccctatctatcggcaggttccacgactcgtggatagctgctgtcagcatctggaaaaacacggcttacagacagtcgggatttttcgggtgggatcttcgaaaaagcgtgtgagacagctgcgcgaagaatttgaccggggtatcgacgtgtctctggaggaggaacactcagttcacgacgtggccgcattgctgaaagagttcttgcgcgatatgcctgatcccctgctgacgcgggagctctacaccgcctttattaatacactgttgttagagcccgaggagcagctgggcactttgcagctgctaatctacttgctaccaccgtgcaattgcgacaccctccacagactgctgcagttcctctccatcgtcgcaaggcacgcggatgacaatatttctaaggacggacaagaagtgaccggaaacaagatgacttctttaaatctggctaccatcttcgggccaaatctcctccataagcaaaagagcagtgataaggagttttctgtgcaatcctctgcacgggcagaggagagcacagcgattatagctgtcgtgcagaaaatgattgaaaattacgaagccctgtttatggtgccccctgatttgcagaacgaagtccttatttcgctgttggaaactgatcccgatgttgtggactatttgctccgtagaaaagcctcccaatcctcgagtcctgacatgcttcagtcggaggtctcctttagcgtaggcggtagacatagcagcaccgacagcaataaagcgtccagcggagacatctcaccatacgataataacagtcctgtgttgtccgagaggtctctgcttgcaatgcaggaagatgccgcacccggaggctctgagaaactttatcgcgtcccagggcagttcatgctcgttggtcacttatcctcctcaaagagccgcgagagtagcccaggacccaggttaggaaaaggaaactggagtctcgccagcaggaggtggccaaagcaggccaccctccttttactgcacgttgcctggtgtggcgcactaaggaccttcagtagctcccttccttatttgatgtttctgtag

SEQ ID NO: 238751 - DNA, 2073 bp, Artificial Sequence
  Description of Artificial Sequence: Synthetic coding sequence
atgtctgcccaaagtctgctacactctgtgttttcttgctccagcccagcatcgtcgtcagcggctagcgcgaaggggttctcaaagagaaagctgcgacagactcggtcactggaccctgcgcttattggcggttgtggttctgatgaagctggtgctgagggaagcgcccgaggcgctacagcaggccgactttacagcccctctctccccgcagagagtttgggcccaagacttgcgagttcaagccggggtccccctcctcgggctactaggctccctccccctggcccattgtgctcttccttttcgacaccctctacaccgcaggagaagagcccaagcggttccttccacttcgattatgaggttcctctcggcagaggcggactgaaaaagtccatggcatgggacctcccaagtgtgctcgcgggtcctgcctcttcccggtctgcatcctctatcctctgtagctctggaggaggacctaatggcatcttcgcatctccacggagatggctgcagcagaggaagtttcagtcacccccagattctagaggccatccctacgtggtttggaagtcggagctcgagttgtacgatttgcaaatactgggcacaaaaccacctatgaattcagatacccataggaactttgaccctactgctaccctgcgaaatcagggggatttcacttggaatagcatgagtggtagatcagttcggctcagatctgtgcccatccagtccctgagcgaactcgagagagctcgcttgcaggaggtggccttctatcagctccagcaagattgtgatctgagctgtcagatcaccattcccaaggacgggcagaagaggaaaaagtccttgcgcaaaaaactggactccctgggcaaggagaagaacaaagacaaagaattcatccctcaggctttcggcatgccactgagtcaggtcattgcaaatgacagggcctacaagctgaagcaggacctccagcgtgatgagcagaaagatgcctcagatttcgtagcttcactgctaccattcggtaacaagaggcagaataaggagctgtccagctcaaatagttctctgtcctctacctccgaaacccccaacgagtcaactagccctaacacacccgagcccgcacctcgggctaggagacgcggagccatgagtgtggatagcatcacagaccttgacgataaccaatctcgactgttggaagcactgcagctctccctgcccgcagaggcccagtccaagaaagagaaagctcgggacaagaagctttcgctcaacccgatctacagacaggtcccacgtttggtcgattcgtgctgtcagcatttggagaaacacgggcttcaaaccgtgggaattttccgggtgggctcatctaaaaagcgtgtgagacagctgagggaggaatttgataggggcattgacgtaagtctggaagaggaacactctgtacacgatgtggcagcgttactgaaggagttcttaagagatatgcctgatcctctgctgactcgcgaactgtacactgcgttcataaacacgttactactcgagccagaagaacagctgggtactctgcagctgttgatctatctgctgccgccttgtaattgcgacacccttcatcgcctgctccagttcctctctatcgtcgcgagacacgcagatgataatatctccaaagatggacaggaagtgaccgggaataagatgactagtttaaacctggcaacaatcttcggccctaatttgctgcataaacaaaaaagcagtgacaaggaatttagcgtgcagagctcggctagagccgaggagagcacagccatcatcgccgttgtccagaagatgattgagaactacgaggccctatttatggtccccccagacttgcaaaacgaggttctgatttctctcctcgaaacagatcccgacgttgtggactacctgctgaggcggaaagccagtcaatcttctacatcgtcagttcttcctgcggcagtccaggcctgcccacaatacccagcctcaatgtttaccccatag

SEQ ID NO: 238752 - DNA, 2316 bp, Artificial Sequence
  Description of Artificial Sequence: Synthetic coding sequence
atgagcggacgctctgtgaggctgcgttccgtccctatccagtcactctcagagctggaacgggcacggctccaagaggtggcattttaccagttacagcaggactgtgatctaagctgccagatcacaataccaaaggatggccaaaagaggaagaagtcgcttcgtaagaaactcgattcactgggtaaagaaaagaataaagacaaagagttcatcccccaggccttcggcatgccacttagccaagttatagcaaatgacagggcatataagttgaagcaggatctacagcgagacgagcagaaagatgcctccgattttgtggcctccctgcttcctttcggcaacaaacggcagaataaggaactatcttcctctaactcctccttatcctcaacaagtgagacccccaatgagtcaacgagtcccaacactccagagcctgcgccaagagccagacgcaggggtgcgatgtcagtggattcaatcacagatctcgacgacaatcagagcagactcctggaagcactccagctgtccctacccgctgaggctcagagcaaaaaggaaaaggccagggacaagaagttgtccctgaatcccatatatcgacaggtacccagattggtggattcatgttgtcagcacctggaaaagcatggtctacaaacggtgggaatctttagggtggggtccagcaagaagagggtacggcagcttcgcgaagaatttgatcggggtatcgatgtcagccttgaagaggaacattctgtccatgacgtcgccgcactgctcaaggagttcttgagagacatgcccgatcccctgctaacccgcgaactgtataccgcttttatcaacacgctgctcctggagccggaagaacaactcgggacgctgcagctgctgatatatctgttaccaccctgcaattgcgacacgctgcatcgcctcctccagtttctgagtatagttgctcgccacgcagacgacaacatctctaaagatggacaggaagtgaccggcaataaaatgacctccctgaatctggccactattttcggccctaatcttctccataagcagaaatctagcgacaaagagttctcagtgcagtcctccgcaagagcagaggagtctaccgctatcattgccgtggttcagaagatgatcgagaactacgaagcactgtttatggtgccaccggatctgcagaatgaggtactgatctcactactggagacagacccagatgtagtggactaccttttacgcagaaaagcgtcccagagcagttccccagacatgctgcagtctgaggtgtcgttcagcgtgggcggtcggcacagtagcaccgactcaaacaaagcatcctcgggcgacatttcaccgtatgataataattctccagttctcagcgagcgaagcctgcttgcgatgcaggaagacgcagcccctggagggtcagagaaattatacagggtacccggacaattcatgcttgtggggcatctttcaagttccaagtcacgagagtcttccccagggcctagattaggcaaggacctgtcagaggagcctttcgacatttggggcacttggcacagcactctgaaatcaggttccaaggatcctggcatgactggcagtagtggtgacatatttgagagctcaagccttagagccggtccatgctccttgagtcaggggaacttgtctccgaattggcctagatggcagggatcgcctgccgagctggacagtgacacccagggggcaagaaggacccaggccgctgccccagccaccgaaggtcgggctcaccctgcagtaagtcgcgcttgttccaccccgcacgtgcaggtagcgggaaaagccgagcgccctaccgcccgatcagaacagtacctcacactctccggagcacatgacctctctgagagcgagcttgacgtcgcagggctacagtcccgagcaacccctcagtgccagaggccccatggctcggggagagatgacaagagaccaccaccaccttatcccggacccggaaagccagctgctgctgctgcctggatacaggggcctccggagggagtggagacgcccacagaccaagggggacaagctgcagaaagggagcagcaagtgacccaaaagaagcttagttcagcaaactctttgcccgctggcgagcaggactccccccgtctcggggatgctgggtggctcgattggcagagggagagatggcagatttgggagttgctctctacagataaccccgacgcactgcccgagacccttgtctag

SEQ ID NO: 238753 - DNA, 1404 bp, Artificial Sequence
  Description of Artificial Sequence: Synthetic coding sequence
atgtacagaatcttcggcgatttcacctggaactcaatgagtggacgctccgttaggctccgatctgtgcctattcagtccctgagcgagcttgaacgcgcaaggctccaggaggtggcgttctatcagcttcagcaggactgcgatctgagctgccaaattactatccctaaagatgggcagaaacgcaagaagagccttagaaaaaagttagacagcctgggaaaggagaagaataaagacaaagagttcattccgcaggcctttggcatgccgttgtcccaagtcatcgctaatgacagagcatacaagctgaaacaggacctgcaacgggatgagcaaaaagacgcctccgactttgttgcatctctgctaccattcggaaacaaaaggcagaataaggaactttcatcctccaacagctccttgtcttctactagcgaaaccccgaacgagagcacatcccctaacacgcccgaacccgcacctagggcaaggcgcagaggtgctatgtcagttgactcaatcaccgatttggacgataaccagtcccggttactcgaagctctacagctttccctccccgcagaggcccaatctaagaaggaaaaggcaagagataagaaactatctctaaaccctatttatcgccaggtgcctcgcctcgtcgactcctgctgtcagcacctcgaaaaacatggattacagaccgtagggatttttagggtaggctccagcaagaagagggttaggcagttacgagaggaattcgatcgcggtatcgatgtgtcattagaggaggaacactcagtgcatgacgtggccgctttgctcaaagaattcctgcgggatatgcccgacccactgcttactcgcgaactctatactgccttcatcaatacgctgctactcgagcccgaggaacagctgggtactctgcagctcctaatttacctcctgcctccctgtaactgtgacacgttacatcggttgcttcagtttctgtctattgtcgcacgtcatgccgacgataacatctctaaagacggccaggaagtgaccgggaacaaaatgacatctcttaacctggctacaatcttcggacctaacttgctgcacaagcagaagagctctgacaaggagttcagtgtgcaaagctctgctcgagccgaggaatcaacagcaattatagccgtggtacagaaaatgatcgagaattacgaggccctcttcatggtcccaccagatttgcagaatgaggtcttaatctctcttttggaaacagatcctgacgtggttgattatctgctgcggaggaaggcttctcaatcctcgacctcatccgttctccctgctgccgttcaagcatgtccccagtatccggcttctatgtttacgccatag

SEQ ID NO: 238754 - DNA, 1815 bp, Artificial Sequence
  Description of Artificial Sequence: Synthetic coding sequence
atgaagaggctgcatatttttggtcccaagatccactcttctggtggcttatggcaacaaaaaggggacttcacttggaattccatgagtggacggagcgtgagactccgctctgtgcctattcagtccctgagcgagctggagagagccaggcttcaggaagtggccttctaccagctccaacaggactgcgatctaagctgtcagattactatccccaaagacgggcagaagcgcaagaagtctctgcgcaaaaaactggattcccttgggaaggaaaagaacaaggataaggaattcatcccgcaggccttcggtatgcccctcagccaggtgatcgctaacgatcgggcatacaagctgaagcaggacctacaacgtgacgaacaaaaggatgctagtgatttcgtggcgagtctgctgccattcggaaataagagacagaacaaagagctttcgtcctctaattccagcctgtcaagcacctccgagacgccaaacgagtccacatccccgaacacccccgaacccgctcctcgggcacgtaggcggggagccatgagcgttgattctatcaccgaccttgacgacaatcaatcacgacttctggaggccttacagctgtctcttcctgccgaagcccagagcaaaaaagaaaaggcccgagacaaaaagctgtctctgaatccaatctatagacaggtgccgcgactggtcgacagctgttgccaacatctcgaaaaacacgggttgcagaccgtgggtatattccgcgtcggaagtagcaaaaagcgagtgcgacagctaagagaggagttcgaccgcggtattgatgtctctctggaagaagaacattccgttcacgacgtcgcagcactgctaaaggagttcctccgagacatgccggaccccctcctgactcgcgagttatatacagcttttatcaacactttattgctggagcccgaagaacagctgggaacgctgcaactgttaatctacctccttcccccttgtaattgtgatactttacaccgtctcctgcagttcctcagtattgtggcaagacacgctgacgataatatatccaaggacggccaagaggttactgggaataaaatgacatctcttaatttggctacaatcttcggcccaaacctcctgcacaaacaaaaatcctccgataaagagttctccgtgcagagcagtgcacgcgctgaagagtcgacagccataatcgctgtggtgcaaaaaatgatcgagaattacgaggccctgttcatggtaccccctgacctacagaatgaggtactcattagcttgcttgaaactgatcccgatgttgttgattatctgctccggagaaaggcgtctcaaagctcttcgccagatatgctccagtcagaagtttctttcagtgtcgggggtcgccattctagcactgatagcaataaagcaagctccggagatatcagtccatatgataacaactcgccggtgctgtccgagcgaagcctcctggccatgcaggaggatgctgccccaggaggtagtgaaaagctctatcgagtacccggacagtttatgcttgtaggtcacctatcatcttccaagtctcgcgaaagctcccctggcccacgcctaggcaaggacctgtccgaggagccattcgacatatggggcacctggcacagcacgctcaagtccggctcaaaggacccaggaatgaccgggaccaccccattactaaatattagctcacaggaggatcacagacaaaaggacttgagattgattttcaagatttacccttag

SEQ ID NO: 238755 - DNA, 918 bp, Artificial Sequence
  Description of Artificial Sequence: Synthetic coding sequence
atggcgggtcaggaccctgcactttcaacttcccacccgttctatgacgtggcgcgacatgggatcttgcaagtggccggtgacgatcggttcggcagaagggttgtgacttttagctgttgccgcatgccgccttcgcacgagctggaccaccaaaggttattggagtacctgaaatacacgctggaccagtacgtagagaacgattatacgatcgtgtacttccactatgggctcaactccaggaacaagccctccttagggtggctgcagtcagcctataaggaattcgatcggaaatacaagaagaacttgaaagcgctatatgtggttcaccctacctcctttatcaaggttctgtggaatattctgaagcctctgatcagccataagtttggaaaaaaagtgatctacttcaattatctgtctgaacttcacgaacatcttaaatacgatcagctggtgatcccccctgaagttctccgatacgacgagaagctgcagtctctgcatgaaggcaggacacctcctccaacgaaaaccccccctcccagacctcctctgccaacacaacagttcggggtgagcttgcagtatctcaaggacaagaatcagggagagctcatccctcccgtgttaaggttcactgtgacctatctccgagagaaaggactgagaacagaagggctctttcggcgttccgcgagcgtgcaaacggtccgggagattcaacgcctgtacaatcagggcaaaccagtgaacttcgatgactacggagacatccatatcccggctgttatccttaagacatttctccgcgagttacctcagccattgctgactttccaagcctacgagcagatccttggcataacgtgtgtgcctggggagcacctccaacaaaacgagcagctctag

SEQ ID NO: 238756 - DNA, 1302 bp, Artificial Sequence
  Description of Artificial Sequence: Synthetic coding sequence
atggcaggtcaggacccagctctgtcaaccagccatccattctacgatgttgcacgccacggcatcctgcaggtggcaggagacgacaggtttgggcgtcgcgtcgtgaccttttcctgctgtcgcatgcctccaagtcatgagctagatcaccagagactgttggaatatctgaagtatactctggatcagtacgtggaaaatgactacacaatcgtctactttcactatggacttaacagcaggaataaaccaagcctcgggtggctacaatctgcgtacaaagaatttgacagaaaatataagaagaatctgaaagccctgtatgtcgtacacccaacttcctttattaaggttctgtggaacatattgaagcccctgatctcccacaagttcgggaagaaggtaatttactttaactatctgtctgagcttcacgagcacctcaaatatgaccaattggtcataccacccgaagtgttgaggtacgatgagaaactccaaagcctgcacgagggcaggaccccccctcccaccaaaacaccacccccacgaccacctcttccaactcaacagttcggtgtaagccttcagtatctcaaggacaaaaatcagggcgaactgattccacctgtcctcaggttcactgttacttacttgcgagagaaggggctgcgcactgagggactgtttagacggtctgcatctgttcagacagttagagagattcagcgcctatataaccaggggaaaccagttaacttcgatgattacggcgatatccacattccagccgtgatcttaaaaacctttcttcgagagcttccccaacctctcctgacctttcaagcctacgagcagatactcggcatcacttgtgttgaatctagtctgcgtgttaccgggtgtagacagatcctgagaagcctgccagagcacaactatgtggtgctcaggtacctgatgggattcttacatgccgtgtctcgggagtccattttcaacaaaatgaacagttctaaccttgcgtgcgtgttcgggcttaatcttatttggcctagccaaggcgtatcttcgttgtcagcactggtcccactcaacatgtttacagagctgctcatagagtactacgagaaaattttctcaactccggaagccccaggcgagcatggcctggccccttgggagcaggggtctagagccgcacccctccaagaagctgtgccccgtacacaggccaccgggctaaccaagcccactctccccccatccccattaatggctgctcgaaggcgcttatag

SEQ ID NO: 238757 - DNA, 1668 bp, Artificial Sequence
  Description of Artificial Sequence: Synthetic coding sequence
atgtcttcgcctagtctctctgacctcggaaaaagagagcctgccgcagccgctgacgagcgagggacacagcagcggagagcctgcgccaacgctacttggaatagcatccataatggcgtgatagctgtgttccagaggaaaggtctgcccgatcaggagctgttcagcctcaatgaaggcgtgcgccaactgctcaaaacagagctgggatcttttttcaccgagtacttacagaaccaactcctgaccaagggaatggtgattttgagagacaaaatcagattctacgaggagctccagagagacaaggctgctgcggcagccgtgctgggggcagtccgcaagcgtccctccgtcgttccgatggcagggcaagaccccgctttgtctacctctcatcctttttatgatgtggcccgtcacggcatcctccaggtggctggggacgaccggtttgggagacgggttgtgacattcagttgttgcagaatgcccccttctcatgaactagaccatcaacggctgctggagtacctgaaatacactttggaccaatatgtggaaaacgactacactatcgtttattttcattatggcctcaattctagaaataagcccagtctgggatggctgcagtctgcttacaaggaatttgatcggaagtataagaaaaaccttaaagcactgtatgtggtgcaccccacttcctttattaaagtcctgtggaatattctcaaaccattgattagtcataagtttggaaagaaggtgatctacttcaactacttaagtgaattgcacgagcacctcaaatatgaccaactcgtgattcctcctgaagtactacgttatgacgaaaaactgcagtcgcttcatgagggacgaacccctccccctactaaaacacccccaccccgacctcccttgcccacgcagcagtttggtgttagtctgcaataccttaaagataaaaatcaaggggaactgattccacccgtgctccgcttcaccgtcacttacttgcgtgagaagggccttagaactgaagggctgttcaggcgtagtgcatctgtgcaaaccgtgcgggaaatccagcgactatacaatcaaggcaaacctgttaatttcgatgactacggagatatccatattcccgcagtcatcctgaagacctttttgagggagttgccacagcctctgcttacgtttcaggcttacgagcagatcctgggtatcacttgcgttgagagttccctgcgcgttactggatgtcggcaaatactgcgaagcctgccggagcataattatgtcgttctgcgatacctcatgggttttctgcatgcagtttcaagggagagtatcttcaacaagatgaattcctctaatttagcctgtgtattcggacttaacctgatctggccgtcgcagggggtgtcatccctgagtgctctcgtaccactgaacatgtttacagaactgcttattgagtactacgagaaaattttctcgacccctgaagctccgggagagcacgggcttgctccatgggagcaagggtccagagcagcccctctgcaggaggcagtgccgagaacgcaagccacaggactcactaagcccaccctgcccccatcccccctgatggccgctcgaaggcggctctag

SEQ ID NO: 238758 - DNA, 1395 bp, Artificial Sequence
  Description of Artificial Sequence: Synthetic coding sequence
atggccggtcaggatcccgcactgtcaactagtcatccattctatgacgtggctagacacggaatactacaggtcgctggcgacgacaggtttggccgtcgagtggtaacttttagttgttgcagaatgcctccatctcatgagctggaccatcagcgattgcttgaatacctgaagtacacactggaccagtatgtagagaacgactataccatcgtgtacttccattatggccttaactcaaggaataagccttctctcggctggctgcagtcagcgtataaagagttcgacagaaaggatggagacctgacaatgtggccacggctagtgtctaactccaaattgaagcgttcctcacatctgtcgctccctaaatactgggactatagatataagaagaacctgaaggcactgtatgtcgtgcatcctacatcctttataaaagtgctctggaacattctgaagcccctcatcagccataagtttggtaagaaggtgatctacttcaactatctttccgagcttcatgaacaccttaaatacgaccagttggtgataccaccagaggtgctacgttatgatgagaagctccagtccttacatgaggggagaacaccaccccctacaaaaacacctcccccacgccctcctctacctacacagcagtttggcgtgagtttgcaatacctgaaggataagaaccaaggagagttaattcccccagtgctgcgcttcacagtgacatacctgcgggagaaaggacttcgaaccgaaggactcttccggaggtccgcctctgtgcagaccgtacgagagatccaaagactctataaccaaggtaagcctgtgaactttgatgattacggtgatatccacattccggctgtgattttgaaaaccttcctaagagagctgccacagccccttctcacttttcaagcgtatgaacagatccttggcattacctgcgtggagagcagcctccgcgtaacagggtgccgccagatcctgcggtctttacctgagcacaactacgtggtgctccgctatctcatgggtttcctgcatgcagttagtcgcgaatcaatctttaacaagatgaatagctcaaacctcgcctgcgttttcggcctgaatttgatctggcctagtcagggagtgagcagtctgtcagcccttgtgcctctcaatatgttcactgaactcctaatcgagtactatgagaagatattcagcacccccgaagctcctggagaacacgggctcgcgccatgggagcagggaagccgtgccgcaccactgcaggaagctgtgcctcggacgcaggccacagggctcaccaaaccaaccctgcctccgagcccattaatggctgccaggcgacggctgtag

SEQ ID NO: 238759 - DNA, 393 bp, Artificial Sequence
  Description of Artificial Sequence: Synthetic coding sequence
atggcaggccaggatcccgcactttccaccagccaccctttttacgacgtcgccaggcacggcattctccaagtcgccggtgacgatcggttcggcaggagagtggtgactttctcctgctgcaggatgccacccagccacgagctggatcaccagagactcctggagtatcttaagtacacccttgatcagtacgtggagaacgattacactatagtttatttccactatggcctgaattctcggaacaagccctctctggggtggctgcagtcagcatataaggaatttgatagaaaggatggcgatcttaccatgtggcctcgcctggtttccaactccaagctgaaacgaagctcacatctgtctctcccgaagtactgggattattag

SEQ ID NO: 238760 - DNA, 348 bp, Artificial Sequence
  Description of Artificial Sequence: Synthetic coding sequence
atggctggacaggatccggcactaagcacatcccaccccttctatgatgtagccagacacggcattctgcaggtggctggcgacgatcgcttcgggcgtagagttgttacattttcctgttgcaggatgcctccttcccacgagttggatcaccagcgcttgctcgaatatctgaagtacacgctcgaccagtacgttgaaaacgattatacaattgtgtatttccactacggccttaactcacgaaataagcctagtttggggtggctacaatctgcatataaagaattcgatcgaaaatacaagaaaaatcttaaggccctgtacgtggtgcacccaacttcttag

SEQ ID NO: 238761 - DNA, 1932 bp, Artificial Sequence
  Description of Artificial Sequence: Synthetic coding sequence
atgagaactctgcggcgactgaaattcatgtccagcccctccctatccgacctaggaaagcgggagcccgcagccgcagccgacgagcgcggaacccagcagagacgtgcttgtgcaaacgcaacgtggaactccatccataatggggtcatcgctgtgtttcagagaaagggcctgccggatcaggagctattttctctaaatgaaggggtgcgacagctactgaaaactgagctgggttccttcttcacagagtatctccagaatcagctcctgaccaagggaatggtgatcctccgggacaagattagattctacgagggccaaaagttactcgacagcctggccgagacttgggacttctttttcagcgacgtgcttccgatgcttcaggccattttttaccctgtgcaggggaaagagccttccgtccggcagcttgcgctgctgcactttcgcaatgctataacgctcagcgttaaattagaggatgccctggcccgtgcacatgcaagagtccctcctgccatagtgcaaatgctcctcgttctacaaggggtacacgagtccagaggcgttacagaagactatctaaggttggagacactcgttcagaaggtggtttccccctatttggggacttacgggctccattcctcggaggggccttttacccactcctgtattctggagctgcagcgcgataaggccgctgccgcagctgtcctgggagccgtgcgcaagaggcccagtgttgttcccatggcaggccaggaccctgccctaagcacgtctcacccgttctacgacgtcgcccgacacggaattctgcaagtcgctggggatgaccggtttggcagacgcgtggtgacattttcctgctgtagaatgcccccatcacacgagctcgatcaccaacgcctcctggagtacaaaaaaaacctcaaggccctctatgtcgtgcaccctacaagctttattaaggtgctgtggaatatattgaaaccccttatctcacataagttcgggaagaaagtgatctattttaactacctgagtgagctgcatgagcatctgaagtacgatcagttggttatcccccctgaagtgctgcggtacgacgagaaactgcagtccctacacgagggcaggacacctccccctaccaagacccctccacccagacctcctctgccgacacagcagttcggcgtttcgcttcagtacctgaaagataaaaatcagggggagctaatccctcccgtgttgcgatttacagttacgtatctgagagagaaaggactcaggacagaagggctgttccgaagatccgccagtgtgcaaacagttagggagattcaaaggctgtacaatcagggtaaacctgtcaactttgatgattatggcgacattcatatacccgctgtgattctgaagaccttcctcagggaattacctcaacccttgctaacttttcaggcatatgagcagatacttggcatcacgtgcgttgaatccagcctacgcgtcactggatgtcggcagatcctgcgcagcctccctgagcataactatgtggtactgcggtacctcatggggttcctgcacgccgttagcagagagtccattttcaacaaaatgaatagcagcaacctggcttgcgtcttcggcttaaacctgatatggccatcacaaggggtgtcgtcattgtcagccctagtaccactcaacatgttcactgagttactcatcgagtattatgagaagatcttctcaacccccgaggcccctggcgagcacggactcgccccatgggaacaaggctctcgagctgccccactgcaggaggctgtgcccagaacgcaggcgacaggcttaactaaacctacgctacccccatccccccttatggccgcacggaggagactatag

SEQ ID NO: 238762 - DNA, 2322 bp, Artificial Sequence
  Description of Artificial Sequence: Synthetic coding sequence
cagacccagaccgagtcacttacattgtgctcaggcgaggcagagagacgaggtaaggaggagtggcctgattcacaccactatccaggtccaactccggcaccagagagttctgacgggcctcacaaagtgactgtgctggccaccatgttgtcctcacgttggtggccgagttcttgggggatacttgggctgggccctcgttctcctcccagaggatcccagctttgcgccctctatgcattcacttatacaggggcagacgggcagcaagtgtcgctggccgaaggcgatagattcctgctcctcagaaaaacaaactctgattggtggctcgcacggaggctcgaagctccctccactagtagacccattttcgtacctgcagcatacatgatcgaagagtccatccccagccaatctcctacaaccgtgatcccgggacaactcttgtggacacccggtccaaaactgttccacggctcactggaagagctttcccaggcactgccatctcgcgctcaagcgtcaagtgaacaacccccaccactcccccgaaaaatgtgtcgctcggtgagtaccgacaatctgagtcctagtctacttaagcccttccaggaaggcccaagcggccgtagcctctcgcaggaggaccttccatcggaggcaagcgcttccaccgctggacctcagccactcatgagcgagccccctgtgtactgcaacctcgtggacctaagaaggtgccctagaagcccacccccaggtcctgcctgtcccttgctccagcggctcgatgcttgggagcaacatctggatcctaatagcggtcgttgtttctacatcaactcgctgaccgggtgcaagagctggaaaccaccacggaggagtaggtccgaaacaaaccccggttcaatggaagggactcagactctgaaacgcaacaatgatgttctgcagccacaggccaaaggctttcgcagtgataccggcacccccgagccgctggacccccagggctctctcagtctatcacagcgtacgtcacagctggaccctccggcactgcaggcccctagaccccttccacagctgctggatgacccccacgaggtcgagaaatccggacttctcaacatgactaagattgcccaggggggaagaaagctgaggaagaattggggaccttcttgggttgtcctgactgggaattccttggtattttatagggagcccccaccaacagccccatcatctgggtgggggccagctggaagtcgacctgaatcctccgtggatttaaggggtgcagctctggcccatggaaggcatttatcatctcgtaggaacgtgttgcacatcaggactatcccgggacatgagtttctgttgcagagcgaccacgagacagaactccgggcttggcacagagcgttaagaaccgttattgagagattagatcgtgagaatccgctcgaactgcgtctgagtggaagtggaccagccgagctatctgcaggagaggacgaggaggaagagagtgagctcgtgtctaagccactccttcggctttcatctagaagatcatcaatacggggacccgaaggcactgagcagaacagggtcagaaataagttgaagagactcattgctaagagaccaccactgcagtccctccaggaaaggggccttctgagggaccaggtttttggctgtcagctggaatcactgtgtcagcgcgaaggagatacggtgcctagcttcctgcgcctttgtattgccgcagttgacaagcgcggattggatgttgacggcatttatagagtttcagggaacctagcagttgttcagaagctccggttcctggtcgaccgcgagcgtgcagtcacctctgacggcagatacgtctttccagaacagccgggacaggagggccgtcttgacctagactctaccgaatgggatgacattcacgttgtgacaggagccctcaagctgttcctacgagagttgccacagccgttggtacccccactgctgctgccacatttccgggcagcgctggccctctctcagattcaggaactgattggcagtatgccaaagcctaaccacgataccctccgatatctgctggagcatctctgtagagtgatagcccatagtgataagaataggatgaccccacacaacttggggatcgtctttggaccaaccctgttcaggcctgaacaggaaaccagtgaccccgcagcccatgctctctaccccggtcagctggttcagctcatgctgacgaacttcacttctctgttcccctag

SEQ ID NO: 238763 - DNA, 2253 bp, Artificial Sequence
  Description of Artificial Sequence: Synthetic coding sequence
atgctcagcagccgctggtggccctcatcatggggcattttaggcctcggccctagaagtcccccacgtgggagtcagttgtgcgccctctatgctttcacctacaccggtgcagacgggcaacaggtgtctctggccgagggagacagatttctgttgctgcggaagaccaacagcgactggtggctggccagacgcctggaggctccaagcaccagccggcctatatttgtcccagccgcatatatgatagaggagtccatcccgagccaatcaccaacaaccgtaattccaggacagctactctggacaccaggacccaaactctttcacggatccctggaggaattgagtcaggcactgcccagtagagcccaggcctccagcgagcagccacctccgctaccaagaaagatgtgcaggtccgtgtctaccgataatctgtctccgtcccttctgaagccctttcaagagggccctagcgggagatctctctctcaggaggacctgcccagcgaggcgagcgccagcaccgcagggcctcagccgctgatgagtgagccaccggtctactgtaacttggtcgatctcagacgctgcccacgatcccccccacccggtcccgcatgcccactattacaacggctagatgcttgggagcagcatttggaccctaattctggcagatgcttctatattaactccctgaccggctgtaagagctggaaaccacctaggcgatccaggtccgagacgaatcccggatcaatggagggcacccagaccctgaaacgtaataacgacgtcttgcagccacaggctaagggcttccggtctgacaccggtaccccagaaccactggaccctcagggtagtcttagcctcagtcagagaacaagccagcttgatcccccagcactacaggctcccaggcctttgcctcaactgctggatgacccacacgaagtagagaagagtgggctcttgaatatgacgaaaatcgctcagggaggtcggaagttgcgcaagaactgggggccatcctgggtagtgcttaccggcaattccctagtgttttacagagaacctccgcctactgccccaagttccggatgggggccagctgggagtcggccagagtcgagtgtcgacctgaggggggctgcacttgctcacggcaggcatttaagctccagaagaaatgttctgcacattaggacaataccaggacacgagttcctgctgcaatctgatcacgaaactgagctcagggcctggcaccgcgctctgcgcaccgtgatagagcggctggttcggtgggtggaggccaggcgcgaggctcccacaggccgtgaccaggggagcggagatcgcgagaaccctctggagttgcgtcttagtggtagtggccctgctgaactgtctgccggagaagatgaggaggaagagagcgaactcgtcagtaagccattacttcgactgtcctctcgccgatctagtatccgcggtccagagggtacagagcaaaacagagtgcggaacaaactgaaaaggttgatcgccaagagaccccctctgcagagtctgcaggaaaggggattgcttcgcgatcaagtcttcggatgtcagctggagtctctgtgtcagagggagggagacaccgtgccaagctttctccgcctctgcatcgcagccgttgacaaacggggactggacgtggatgggatctatcgggtatccgggaacctagcagttgtccagaagctgagattcctggtggatcgcgagcgtgccgtgacatccgacggaaggtacgtattccccgagcagcctgggcaggaagggaggttggacctggatagcacggagtgggacgacattcacgtagttacaggggcactcaaactgttcctacgggagctgcctcagccattggtgccaccgttgcttctgccccactttcgtgccgcactggcgttgagtgaatctgaacaatgcctttcacaaattcaagagcttattggtagtatgccgaaacctaaccacgataccttgagatacctcctggagcatttgtgtcgggttattgcccactccgataagaaccggatgacccctcataaccttgggatcgtattcggacccacgctctttagacccgagcaggaaactagcgacccagctgcgcatgcattgtacccgggacagctcgttcagcttatgctgaccaacttcacctccctattcccatag

SEQ ID NO: 238764 - DNA, 2196 bp, Artificial Sequence
  Description of Artificial Sequence: Synthetic coding sequence
atgctatctagtaggtggtggccctcgtcctggggtattctgggcctgggcccacggtcaccgcctcgaggttctcaactgtgtgctctgtatgccttcacatatacgggcgcagacggacagcaagtgagtctggctgagggtgatcgctttctgctgctgagaaagactaactctgactggtggctcgcccgtcgcttagaggcccctagcacgtcccgcccaatttttgttccagccgcttatatgattgaggagagtatccccagtcagtcacctaccactgtaatccctggtcagttgttgtggacacccggtccaaagttgtttcacggaagcttagaggagttatcgcaggcccttccctcacgcgcacaagcaagtagcgaacagcccccaccactgccaaggaagatgtgtcgtagcgtgtccactgataatctgagcccatctctgttgaaaccttttcaggaaggaccctctggtcggagtttaagccaggaggacttgccgtccgaggcttctgcaagcaccgccggacctcagccgctgatgtcagagccacccgtctactgcaacctcgttgatttgagaaggtgtccacgaagtcccccacctggaccagcatgccccttactgcagcgcctggacgcctgggagcaacatttggatccaaatagtggaaggtgtttttacatcaacagtttgacaggatgtaagtcatggaagccgcctcgcaggagcagatctgaaacgaatcccggatccatggaagggacacaaacccttaagcgtaacaatgacgtgctccaacctcaagctaaaggatttaggtcagataccggaaccccggaaccgttggaccctcagggttcactgagcctaagtcaaaggacttctcagcttgacccaccggcactccaggccccacgaccactgcctcaactgctcgacgatcctcatgaggtggagaaatcgggtctcctcaacatgaccaagattgctcaggggggaagaaagctccgcaagaactgggggccttcttgggtggttttgactggcaactccctcgtcttttacagggagccacccccaacggccccatccagcgggtggggacctgcaggaagtcggcctgaaagtagtgtggacctccgcggtgccgcactcgctcacggtagacacttatcgagccggaggaatgtcctccatattcgcaccataccaggtcacgagttcctgttacagagcgaccacgagacagagctcagggcctggcatagggccttaagaacagtgatcgagcggctcgatagggaaaaccccttagaattgaggctgtctggcagtggccctgccgaactcagcgccggagaggacgaggaggaggagagcgagctcgtttctaaaccccttctgaggctatctagtagacgtagtagcatcaggggcccagaaggcaccgaacagaacagggttagaaacaaactaaaaaggcttatcgctaaacggccacccttgcagagcttgcaagaaagaggcctcctccgcgaccaggtgttcggctgtcaactcgaaagtctgtgtcaacgggaaggcgacactgtgccgtcattcctgcgattatgtatcgccgctgttgataaaaggggtcttgacgtggacgggatataccgggttagcggcaatctcgcggtggttcagaaactgcggttcctcgtcgatcgagagagggctgtaactagcgatggacgttatgtgtttcctgagcaacccggacaagaaggcagactggacctggattccacagaatgggatgacattcatgtggtgaccggggcactcaagctatttctgcgggagctgccacagcccctcgtgccgcctcttttgttgccccacttcagggcggctctggccctgtctgagtcagaacagtgcctttcccaaatccaggagctgattggctctatgcccaaacccaatcatgacacactaagatatctcctggaacatttatgccgggtcattgcccacagcgacaaaaaccgaatgaccccccataacttaggtattgtgttcggtccaacgctgttcaggcctgaacaggaaactagcgatcctgccgcacacgcactctacccagggcaactggtgcagctgatgcttactaacttcacgagcctctttccttag

SEQ ID NO: 238765 - DNA, 2466 bp, Artificial Sequence
  Description of Artificial Sequence: Synthetic coding sequence
atgcggaggggttcgagcgacagctgtgccagtggcagccaggtggcgggaactaccgtcgccggaccagcacaccccgaaagtctaaccctgtgcagcggagaagcagaacggaggggaaaagaagaatggcctgattcccaccactacccgggtcctacccccgcaccagagtcatctgatggaccccataaagtgaccgtgctagcgacaatgctttcatcccgctggtggccatcctcctggggaatcctgggtctgggcccaagatctccaccaagaggtagtcagctctgcgctctgtacgcttttacctacacaggggctgatgggcagcaagttagcctagcagaaggcgatcgctttttattattgcgtaaaacgaattctgactggtggctagctcgcaggttagaggctccttctacgtcccggccaatattcgtgcctgcagcctacatgatcgaggagtccatcccctctcagagccccactaccgtcatccctggacagttgctctggacccccggtccaaagttgtttcacggcagcttagaagagctctcacaagcgttgcctagtcgcgctcaggctagttccgaacagccgcctccactgcccaggaaaatgtgtagatcagtatctacggataacctaagtccaagtctgctgaaaccatttcaagaaggccctagcgggaggagtctgagccaggaggacttacctagcgaggcatctgcctctacagcaggtccccagcctttgatgtccgaaccccctgtctactgtaacctggtcgacctacgcagatgcccaagatctcccccaccaggcccagcatgtcctctgcttcagagactggatgcctgggaacagcacctggaccccaactcgggacggtgtttttacataaattctctcacgggctgcaagtcttggaagcctcccagacgatccaggtccgagaccaaccccggatctatggagggtacccagactctcaaacgaaacaatgacgtgctgcagccccaggctaagggcttccgaagcgatacaggcacgccagagccactggatcctcagggatctctctccctgtcccagcgaaccagtcagctggacccccctgcgctgcaagctccccgtccactacctcagttgctggacgatccacatgaagtcgagaaatctggcctcctaaacatgaccaaaatcgcgcagggtggcagaaaactgcgtaagaattggggccctagttgggtcgtgctaaccggcaattccctggttttctaccgagagccaccacccactgccccttcctctggttggggcccagctggaagcaggccagagtcatccgtcgatttaagaggcgcagccctcgcccatggtcgacacttgtctagcagaaggaacgtgctccacatccgtactattcccggacatgagtttcttctgcagtcagaccacgagaccgaattgcgagcctggcatcgtgcgcttcgtaccgtcatcgagaggctggtccgatgggtagaggcccgaagggaggccccaaccggacgcgaccaagggagcggagatagagagaaccccctggaactgcggctcagcggttctggacccgcagagctgtcggccggagaagatgaagaggaggaaagtgaactggtgtctaagcctttgttaagactctcgagtaggcgctctagcatccgtggtccagagggaacagaacagaatagggtgagaaacaagctcaagaggctgattgcgaagcggcctccgctgcagtcccttcaggagagaggcctgttgagagaccaagttttcggctgccaactggaaagcctgtgccaacgcgagggcgatacagtcccctcattcctgagattgtgcattgccgctgtggacaagagggggctggacgtcgacgggatctaccgtgttagcggtaatctcgccgtcgtccagaagttgaggttcctagtggatcgtgaacgagcagttacctctgacgggcgatacgtgtttccagagcagcctggacaggaaggtaggctggatttggactctacagagtgggatgacattcatgtggtgaccggagcacttaagctctttttgcgggagctacctcagcctctcgtgcctcctctgctgctgccccattttagggccgcactggctctctccgaaagtgagcagtgcctatcccaaatccaggaactgatcggttcgatgcccaagccaaaccatgacactctccggtacctattggaacacctatgcagagtcatcgcccactctgacaaaaaccgaatgaccccacacaatttggggatagtgttcggtccaactttgttccggccagagcaggagacctctgaccctgcagcccatgccctttatcccggacaattggtgcaactgatgctaaccaacttcacatcattatttccctag

SEQ ID NO: 238766 - DNA, 900 bp, Artificial Sequence
  Description of Artificial Sequence: Synthetic coding sequence
atgactaagatcgcacagggcggaagaaagctgcggaagaattggggcccatcctgggtcgtgcttaccggtaattcattagtgttttatagggaacctcctcctacagcgccatctagcggctggggacccgcagggtctagaccggaatcttctgtcgatctgcgtggcgctgccctcgcccatggccgacatctttcttcacgcaggaacgtcttgcacatccgtacgattcctggacacgaattcttgcttcagagcgaccacgagacagagttgagggcatggcaccgcgctctgcggacggtgatcgagagactagatcgggagaaccccttggagctgcgactttcaggttccggacctgccgaactttccgccggtgaagacgaggaggaggagtcagaattagtgtccaagcctttgctgagattatccagtcggcgatcttcgatcagagggcctgaaggaactgagcagaatagagttcgaaacaagctgaagcggctgattgcgaaacgcccaccacttcagagcctacaagaaagagggctcctcagggatcaggtctttggatgtcaactcgaatccctgtgccagagggaaggcgacacagttccctcattcctgcgcctatgcattgcagccgtagacaagcgaggactggacgtggatggaatctacagagtgtctggcaacttggcagtggtgcagaaacttcgcttcctagtggaccgtgaacgtgccgtaactagtgatggcaggtatgttttcccagagcagccaggacaggctctcagtgagagcgagcaatgcctaagtcagatccaggaactgattggcagcatgcccaagccaaatcacgacacactgcggtatctgctggaacacctctgctag

SEQ ID NO: 238767 - DNA, 1923 bp, Artificial Sequence
  Description of Artificial Sequence: Synthetic coding sequence
atgctttcttcacgctggtggccttcctcctggggaatcctgggcttgggaccaaggtcaccgcctagggggtctcaactgtgtgcactgtacgcctttacatacacgggtgccgacggacaacaggtgtccctagcagagggtgataggttcctgctgctgagaaaaacgaattcggattggtggctcgcaagaagactggaggccccttccacctcacggcctatttttgttcctgctgcttatatgatcgaggaaagtattccaagccagtcccctactactgtcatccccggtcagctgttatggactcctgggccaaaactgttccacggcagcctggaagagctgtcccaggctctgccaagtcgagcgcaggcctcctcagagcaacctccccctctgccccgaaagatgtgtcggtccgtgagcacagataatctttctcccagtctgcttaaacccttccaggagggccctagtggtcggtccctctctcaagaagatctgcccagcgaggctagtgcttcgaccgctggccctcagcccttgatgagcgagccacctgtgtactgcaacctcgtggatttgaggcgctgtcccagatcgccaccacctgggcctgcttgcccccttttacaacggttggatgcctgggaacaacacctggatcctaatagcgggaggtgcttttacattaattctctgactggctgtaaaagctggaagccgccacgacggtcacgatcagaaacaaaccctggtagcatggaaggtacacagactcttaaaaggaacaatgacgtcctgcagccccaagcaaaggggttcaggtccgatacaggtacaccagagccgctggatcctcagggcagcctcagtctctcgcaaaggacctcgcaattggatccacctgcactccaggcgcctaggcctctcccccaactccttgatgatccccatgaggtggagaagagcggactgctgaatatgacaaagattgcccaagggggaaggaagctgcgcaaaaactgggggccatcatgggtggttttaaccggcaacagcctggtcttctatagagaaccgccacccacagccccatcatctggttggggaccggcaggatccagacctgaatctagcgtggacttgaggggggcagctctggcccatggaaggcacctgtcttctcgtcggaatgtgctccacataaggaccatccccggacacgagttccttcttcagtcagaccacgagacagaattgagagcctggcacagagccttgcgcacggtcattgagcgcctggaccgagagaaccctttagagttgcggttgagtggcagtgggccagctgaattatctgctggcgaggatgaagaggaggaatccgagcttgtgagcaagcccctgcttcgcctcagctcacggcgaagcagcataaggggcccagagggaaccgagcagaatcgggtccggaacaagctcaaacggctgattgctaagcggccacctctgcagagtctccaagaacggggattgctccgggaccaggtgttcggctgccagttagaaagcctgtgtcagcgggagggcgacacagtacccagcttcctgcgcctgtgcattgcagccgtagataagagaggactcgacgtcgatggcatttaccgcgtgagcgggaatctggcagtggtgcagaaactgcgattccttgtcgacagggaacgtgccgtgacaagtgacggaagatacgtttttcctgagcaacccggacaggaggggaggctcgacctggacagcacggagtgggatgatatccacgtggtcacaggcgctttaaagctgttcttgagagagctcccccagcccttggtgccacctctgctgctgcctcacttccgagcggctctcggctag

SEQ ID NO: 238768 - DNA, 1644 bp, Artificial Sequence
  Description of Artificial Sequence: Synthetic coding sequence
atgagtgagccaccagtatattgcaatttggtggaccttcgcaggtgtccaaggagcccccctcccggacccgcatgtcctctgctgcagagactggacgcatgggaacagcacttggaccccaattcagggaggtgtttctacatcaactcgctgacaggctgtaaatcttggaaacccccacggaggagccgaagcgagactaatcccggttcaatggaaggtacgcagacattgaagcggaacaacgatgtattgcagccacaggcaaagggtttccggtctgacacagggacccccgagcctctagacccacaaggtagcctgagtctgtcacagcgaacaagccagctggatcccccagccctgcaggctccacgccctctgccccagctgctcgacgatccgcacgaagtggaaaagtccggtctgctgaacatgactaagatcgcccagggagggcgaaagctgaggaaaaactggggacctagttgggtagtcctaaccggaaattccttggtcttctaccgagagccacctcccactgcaccaagctcaggatggggtccagccggttcacgtccggagtccagtgtcgatctgcggggtgctgctctggcacacggaagacacctgagcagcagaagaaatgtgctgcacattcgaacgataccaggacacgagttcctgctccagagcgatcacgaaacagagttacgagcctggcacagggcccttaggactgtgatagagcgcctagatagagagaaccccttagagttgcggctgtccggaagtggacccgctgagctctcagccggtgaagacgaagaggaagagtccgagctggtcagcaagcctctcctacgactcagctcaagacgttcttcaatccgtggtcctgaaggtactgaacagaatagagtgcggaataagcttaaaaggctcattgcaaagcgcccaccactccaaagtcttcaagagagaggactgcttcgcgatcaggtttttgggtgccagctggaaagcctatgtcaacgcgagggagacactgtccctagcttcctgcgcctctgtattgccgcagtggataaacgagggttggacgtcgacggtatctatagagtgtctggcaatctggccgtcgtgcaaaaactcagatttcttgtggatcgagaacgggctgtgacatccgacggacgctacgtttttccggagcagcctgggcaggagggacggctggacttggactccaccgagtgggacgacatccacgttgtgacgggcgcactgaagctattcctacgggaattgccgcagcctctggttccacctctacttctgccccatttccgggctgccctggctctgagcgagtcagagcagtgcttaagtcagattcaggaattgatcgggagcatgccaaagccaaatcatgacacattaaggtatttgctagagcacctatgtcgggtgattgcgcattctgataaaaatcggatgacgcctcacaacttgggtatcgtcttcggccctactctgttccgccctgagcaggaaacgtccgatcctgccgcacacgcactgtacccaggacagttagtacagcttatgcttacaaattttacctcactcttcccctag

SEQ ID NO: 238769 - DNA, 894 bp, Artificial Sequence
  Description of Artificial Sequence: Synthetic coding sequence
atgtcagaaccaccggtatactgtaacctggtggaccttagaagatgcccacgttcccctcctcccggaccagcatgtcccctgctccagcggctagacgcatgggagcaacatctcgatcccaattccggaaggtgtttttacatcaactctctcactggttgtaagtcctggaaacctccccgaaggagcaggtccgaaactaacccaggaagcatggaaggaacacagacattgaagaggaacaacgatgtacttcaaccccaggctaaaggattccggtctgacaccggcactcccgagccacttgatccgcagggcagcctttcattgtcccagagaacttcacaattggatccacctgcgctccaggctccccgacccctgcctcagctcttggatgatccgcatgaagtggagaaatcagggctgctgaacatgaccaaaatcgcccaagggggtcgaaaactccggaagaattggggcccaagttgggtcgtactgactgggaactcactggtcttttacagggaaccaccccctaccgctcctagcagcggttggggacctgcgggatctaggcccgaatctagtgtggacttgcggggtgccgcattggctcatggccgtcatctcagttcccggcgaaacgtgctccacataagaacgatccctggccatgagttcctcctgcaatccgatcatgagacagaattacgggcttggcatagggctttgcgcaccgtaatcgaaaggctggatcgtgaaaaccccttggagctgcgcctctctggtagcgggccagccgagctgtcggccggtgaggacgaagaggaggaaagcgaactggtgagcaagccactgctgagattgagctctaggcgctcgtcatag

SEQ ID NO: 238770 - DNA, 186 bp, Artificial Sequence
  Description of Artificial Sequence: Synthetic coding sequence
atgagcgagcctccagtttactgcaatttagtcgatctgaggaggtgccccaggtctcctccgccaggtcctgcttgcccgctgttacagcgccttgacgcatgggagcagcatcttgacccgaattccggaaggtgcttttacataaattctctgactgggtgcaagtcctggaaacccccttag

SEQ ID NO: 238771 - DNA, 471 bp, Artificial Sequence
  Description of Artificial Sequence: Synthetic coding sequence
tgagagggggacaccgtccctagtttccttcgactgtgtattgctgccgtcgacaaaagagggctggatgttgatggcatttatagagttagtggcaatctggctgtggtgcagaagttacgcttcttggttgatagagaacgcgctgttacttccgacggacgctatgtgtttccagaacagccgggtcaggcgctcagtgagtccgagcaatgtctttcccaaatacaggagctgatcggttctatgccaaaacctaaccacgacacgctcaggtatctgctggaacacctttgccgcgtgatcgcccattctgacaagaaccgtatgacaccacacaatctgggaatagtttttgggccaaccctcttcaggcctgagcaagagaccagcgaccctgcagcacacgccctgtacccaggccaactggtgcaactcatgctgacaaactttactagcttatttccgtag

SEQ ID NO: 238772 - DNA, 396 bp, Artificial Sequence
  Description of Artificial Sequence: Synthetic coding sequence
atgagtgagccacctgtgtattgtaatctcgtggacttgagaagatgtcccaggtctccccctcccggacccgcttgtccattgctgcagaggctcgacgcatgggagcagcacctcgaccccaattcagggagatgcttttatataaattcactcaccggttgtaagtcttggaagccacctagacgtagcaggtcagagactaatcccggatctatggagggcactcagacactcaaacggaacaatgacgttttacagcctcaggccaagggcttccggtcagatactgggacccctgagcccctcgatccccaggggtccttatctttatcccaacggactagccagctcgatcctccagccctgcaggcccctaggccacttccacaatag

SEQ ID NO: 238773 - DNA, 2028 bp, Artificial Sequence
  Description of Artificial Sequence: Synthetic coding sequence
gaacctggatcaggcagtagggacccaggtccaggtattgcagagccggacttaggccgacctgccggacacctgcgcgcagatacttcccccgctgaacctcgggagatggaagattttgcccgtggcgcagcctcacccggaccctcaaggcctggattagtgcctgtgtccattattggggctgaggatgaggatttcgagaacgagctggagacaaacagtgaagagcagaactctcagtttcagagtttggagcaggtcaagcggcgtcctgcccatctaatggcattactgcaacatgttgcactgcaatttgagcccggacccctcttgtgttgtctccacgcagacatgctcggatcgttgggccctaaagaagcaaaaaaggcgttcctggatttctaccattcatttcttgaaaaaacggctgttctgagagtgcccgtgcccccaaacgtggcctttgaactcgaccggacccgcgctgatctgatctctgaagacgttcagcgcagattcgtgcaggaagtggtgcagtctcagcaggttgctgtgggcagacaattggaggacttcaggtccaagaggctgatggggatgacaccttgggagcaggagctcgcacaactggaggcatgggtaggacgggacagagctagctacgaagctagggagcgtcatgtggccgagcggctcctgatgcatctggaagagatgcagcataccatctcaaccgatgaagagaagtctgccgctgtggtgaacgccatcggcctgtatatgaggcacctgggcgtcaggacaaagtccggagacaaaaagtctggacgtaattttttcaggaagaaggtgatgggcaacaggaggagtgacgaaccagccaaaaccaaaaaaggcctaagctccatccttgatgccgctagatggaatcggggagagccacaggtcccagactttagacatctcaaggctgaagtggatgccgaaaaacctggggcaaccgacaggaagggcggagtgggcatgccaagtagggatcgcaatattggagccccaggacaggacacccccggtgtctccctccaccctttatccctggactctcccgaccgcgaaccaggggcagatgcgccactggagttgggcgatagttctccccaaggccctatgagccttgagagtctggcaccccctgaatccactgacgaaggagccgaaactgagcgttgtcccggatggggcgcaggcgcaggcggagtggcctactgggctcttgtcggaggttgccgtgtgacagctgccatatgcgcgtgcctcagccaggctttggccccacacgcccctctcctgcttagtggaagtggccactcttcccctttctttttcccttttctgatctcactgctgctgccacactgccccccttttttactctcctttctgttcccacttctgttgcccctgctgcccttctttaccaatccgtcccctccaccattcctgagcactacccccagcatctccttcatcagctctccactcctgtcccatctgccaccacccttattccctccccattctagcctcacttgggtattcttcccccacctaccaagcccctccgacttgcctgcaactttccactttttttcaccctcgcccttctctttcaaaccaccatgccctctgccacctacccccagacttgccccagccagttggtgcccatcactgaatccacccccactttgtagcgtcccctggggcccatgcccaccctacagctggggagcaggtagtgccagttgcccatctctgtgcaggtgcttcggggaccccctggtgggcgcaggtaggtgggtgcgttttcacctgggaccaccacttaccctgtgcccttctctgccccgtcgatggaagcgctgggtgccgggtccatgggtcggcgaaggattggcaccacccccttttttgccagcaccccctctgtcaccatggcccctgccgcctctgcacagtctctag

SEQ ID NO: 238774 - DNA, 2784 bp, Artificial Sequence
  Description of Artificial Sequence: Synthetic coding sequence
atggcttcactatctacgtggtcctctcctgctgaacctcgggagatggaagatttcgcgagaggtgcagcttctcccggaccttcaaggccaggcctggtgccagtgagtattatcggggcagaggatgaagacttcgaaaacgagctggagacaaatagtgaagaacaaaactcgcaattccagtccctcgagcaggtgaagagaaggccagctcacctcatggccttgctccagcatgtggccttgcaattcgaacccggtccacttctgtgctgtctgcacgccgacatgctcggcagcctgggtcccaaggaagccaagaaggccttcctggatttttatcatagtttccttgagaagaccgccgtcttacgagtgcctgtgcccccaaacgtcgcctttgaactggacagaactcgtgcagatcttatctcagaggatgttcagagacgattcgtacaggaggtcgtgcagtcacagcaggtggccgtgggaagacaactcgaagattttaggtctaaaaggttaatggggatgaccccatgggagcaggagcttgctcaacttgaggcttgggtgggtagggaccgggcatcctatgaagccagggagaggcatgtcgcagagcggttactgatgcacctggaggaaatgcagcacaccatcagcacggacgaggaaaagagcgccgctgtcgtgaacgcaattggtctgtatatgaggcacctcggagttaggactaagtccggcgataaaaagtcaggacgaaactttttccgaaagaaagtgatggggaatcgtaggagtgatgaacccgcaaagacaaaaaaaggcctgtccagcattctggacgctgccagatggaaccgaggggaacctcaggttcccgattttcggcacctcaaggcagaggtggacgctgaaaagcccggagcgaccgatcggaagggaggtgtgggaatgccttcacgggacagaaacatcggagcccctggacaggacacacccggtgtgtctctgcatcccctcagccttgactcccctgacagagagcccggtgctgatgccccacttgagcttggcgattctagtcctcagggacccatgagcctcgagagcctggccccacctgagtctaccgatgagggcgcagagactgagagcccagaacctggtgatgaaggtgagcctggccgttccggtttggagctggagcccgaggaaccgcctggctggagggaactggtgcccccagatactctgcactcactgccgaagtcccaagtgaaaagacaggaggtaatctccgaattgctcgtgacagaggctgctcacgtgcgcatgctgcgggtacttcacgacctattcttccagcctatggccgagtgtctcttttttccactcgaagagttacagaatatctttccttccctcgatgagttaatagaagtgcatagtctgtttctggatcggcttatgaaacgtcggcaggaatccggctacttaatcgaggaaattggagatgtccttctcgcccgtttcgatggcgctgagggcagctggttccaaaagatcagcagccgcttctgttctcgacaaagctttgctttagaacagctcaaggctaaacagcgcaaggatccaagattctgcgcattcgtacaggaggcagagtccagacctcgttgtcgcagactccagctgaaggatatgatcccaacagaaatgcaacgactgactaaataccctctcctcctccagagcattggtcaaaatactgaggaacccaccgagagggagaaggtggagctggctgccgagtgctgccgggagattctgcaccacgtgaaccaggctgttcgtgatatggaagacttactgcggcttaaagattaccagcgtagactggacctttcacacctgagacaaagcagcgatccaatgctcagcgagttcaaaaacctggatattaccaagaaaaagctcgtgcatgagggccctctcacttggagggttactaaggataaagcagtggaagtgcatgtgcttttattagatgatcttctgctgctcttacagcgccaagatgaacggttgcttctcaaaagccattcaagaacactgacgcctaccccagatggcaagaccatgctgcgacctgtccttagattaacctccgcaatgactcgcgaagttgccacggatcacaaagctttttatgtactgtttacctgggaccaggaggcccagatttatgagttggtggcccagaccgtgtcagaacgtaaaaactggtgcgcccttattaccgaaactgccggatcactgaaggtgcctgcacctgccagccggcctaaacctcggccatctccctcctccacccgagaaccacttctgtcatcaagcgagaatggcaatggcggacgcgagacttcaccagctgatgcacggactgagcgaattctttccgacctgctccccttctgtcgcccaggacctgaagggcagttggcagctacagctctccgaaaagttctaagtttaaaacaactgctcttccccgctgaggaagataacggcgctggccctccaagggatggagacggggtgccgggtggtggtcccctctcacccgctcgaacacaggaaatccaggaaaacctccttagcttagaagagaccatgaagcagctggaagagctcgaagaggaattttgccgtctgcgcccacttctgagtcagcttgggggaaactccgtgccccagccagggtgcacgtag

SEQ ID NO: 238775 - DNA, 2640 bp, Artificial Sequence
  Description of Artificial Sequence: Synthetic coding sequence
atggaagacttcgcaaggggcgcagcctccccagggccatcccggcctggtcttgtgccagtatcaataatcggagccgaagacgaggacttcgaaaacgaactggaaaccaactcagaagagcaaaactcacaatttcagtcgctggaacaggttaaacgccgtcctgctcatttgatggctctccttcagcatgtggcgctgcagtttgaaccaggccctctggtcctccgcgtgcctgttcctccgaacgtggcattcgagctggaccggacgcgggctgacctaattagcgaggatgtccagcgcaggttcgtccaggaggtcgtgcaatcccagcaggtggccgtcgggcgacaactcgaagatttcagatccaaacggcttatgggtatgactccatgggagcaggaactcgcccagctggaggcatgggtgggacgcgacagggcaagttacgaagctagggagcggcacgttgccgaacgtttgctgatgcacctcgaggaaatgcagcataccatctccactgatgaggaaaaaagtgctgccgtggtcaatgcaatcggtctgtatatgaggcacctgggagtccgcaccaaatccggcgataaaaagtcgggtcgcaacttttttagaaaaaaagtgatgggcaatcgccgatctgacgagcctgccaagaccaagaaggggctcagttcgattttggatgccgcaagatggaatcgcggagagccccaggttcctgacttccgacacctgaaagctgaggtagatgcagaaaagccaggagccactgatcgaaagggaggcgtcggcatgccgagcagagatcgcaacataggtgcccctggccaagatacgcccggagtgtccctccaccctttgagccttgactcccccgatcgggaacctggggctgatgctcctttagagctgggcgatagtagcccccaggggcctatgtctttagagagtctggctccacctgagtctacagacgaaggtgccgagactgagtcacccgaaccgggagatgaaggcgaacccggtagaagcggcctggaactcgaacctgaagagccgcctggctggcgagagctggtcccaccagatacattgcattccctgcctaagagtcaggtgaagagacaagaggtgatcagcgaacttctcgttactgaggccgcacacgtacggatgctccgcgtcttgcacgatctcttctttcaacccatggccgaatgtctattctttcctctggaagaactccagaatatctttccaagtctggacgaactgattgaggtgcactccctgtttctggacaggcttatgaagcggaggcaggaatcggggtacctgattgaagagataggtgacgttttgctcgccaggttcgatggggctgagggcagttggtttcagaagatatcctctagattttgttccaggcagagcttcgctttggaacagttgaaagcgaagcaacggaaggatccgaggttttgcgcatttgtgcaggaggcggagtcacggccaagatgtcgcaggctccagttaaaggatatgattcccactgaaatgcaacgattaacaaagtaccctctgttgctccagtccattggacagaacaccgaggaacctacagagcgagaaaaggttgaactggcagcggaatgctgcagagagatcctacatcatgtaaaccaggccgtgagggacatggaggatttgctccggttgaaagattaccaaaggcgactcgatttgtctcatttgcgccagagctctgatcccatgctgtctgagttcaaaaatctggacattacaaagaaaaagcttgtgcacgaaggacccctgacttggagagtgaccaaagacaaagctgtcgaagtccatgtcctcttgctggacgatttgctgctgctgctccagagacaagacgagcgtctgctactgaaatcacatagccgaaccctcacccccaccccagacggaaaaactatgctgagacctgtgctgagactgacatctgccatgacccgcgaggtagctactgatcacaaggctttctacgtcttattcacttgggaccaggaagcacaaatttacgagctggtagcccaaacagtgtcagaaaggaaaaactggtgcgcgctgatcaccgagaccgccggttctctgaaagtacccgcaccagccagtagacctaagcccaggccaagccctagctcaactcgggaaccgctactctcttcctctgaaaatggtaacgggggaagagaaaccagtcctgcggacgccaggaccgagcggatactctctgacctgttaccgttctgcagacctggacccgagggtcaactggcggcaacggcgctgcgtaaagtgctcagcttgaagcaattgttattcccggcagaggaagataacggcgctggaccaccccgagacggggatggcgttcctggcggtgggcctctgagtcccgctaggacccaggaaattcaggaaaatctcctgtccctggaagagactatgaaacaattggaagagctcgaggaggaattttgtcgccttagacccctgctgagccaactcggcggaaattcagtgccgcagcctggatgcacctag

SEQ ID NO: 238776 - DNA, 2739 bp, Artificial Sequence
  Description of Artificial Sequence: Synthetic coding sequence
atggaggattttgcacggggagccgcatcacccggaccatcccggccagggcttgtgccagtctccataatcggcgcagaagatgaggacttcgaaaacgaattagagaccaatagcgaagagcagaactcccaatttcagagtttagagcaggtgaaaagaaggccagcccacctaatggccctgttacagcatgtggcactgcagttcgagcccggtcccctactgtgctgtctccacgccgacatgctgggctcacttgggcctaaagaagccaagaaagcctttctggatttttaccactcctttctggaaaagactgcggttttgcgtgtgccggtcccaccaaatgtcgcattcgaactcgataggacgagagccgacctgatctctgaagacgtgcagcgacggtttgttcaggaggtggtccagagccagcaggtcgctgtaggaaggcaattggaagacttcaggagcaagagattaatgggcatgacaccatgggagcaggaacttgcccagctggaggcttgggttggcagggatagggctagctacgaagcacgagagagacatgtggccgagagactcttgatgcacttggaagaaatgcaacatacaatcagcaccgacgaggaaaaaagcgctgctgtcgtcaatgctatagggctgtacatgcgtcatctcggggtgcggacgaaatccggcgataagaaaagtggccgaaatttcttccgaaagaaagtgatgggcaaccgtaggagtgatgagcctgccaagaccaaaaagggcctctcgtcaattcttgacgcagcccgttggaacagaggcgagccccaggttcctgacttcagacacctaaaagctgaagtcgacgccgaaaagcccggagcaactgatagaaaggggggagtggggatgccctctcgtgatagaaatattggtgcaccagggcaggatactcctggtgtgagcctgcacccgttgtctctggattcccctgaccgggaaccaggagcagatgctcccttagaattgggcgactcctccccccaaggtcctatgtcgctcgagagcttggctcctccagaaagcactgatgagggagctgaaaccgagagtcccgaacccggtgatgaaggcgagccgggacgctcgggcttagaactggaacctgaagagcctccaggttggcgggaactggtgccgcctgacaccctgcactcactgccaaagtcccaggtaaagcgccaggaggtcatttccgaacttctcgttactgaggcagcgcacgtcagaatgctccgggtcctgcacgacctgttctttcagccgatggctgagtgcctgtttttccctctcgaggagctgcaaaacatcttcccttcacttgacgagctaattgaggttcattctctgtttcttgacagactcatgaagcgtcgacaggagtctggatatctgattgaggagattggcgacgttcttcttgcccgatttgatggcgctgagggttcatggtttcaaaaaattagcagtcggttttgctctagacagtccttcgcactcgagcaactcaaggcgaagcagcggaaagacccaagattttgcgctttcgttcaagaggcggagagccgacctagatgtagacgcttacagttgaaggatatgattcctacggaaatgcaaagattgaccaagtacccactcttactccaatccattgggcagaacaccgaagaacccacagagcgtgaaaaagtggagctggcagcagaatgttgtcgtgagattctgcaccacgtcaatcaggccgttcgcgatatggaagatctgttaaggctgaaggactatcagcgccgattagacctcagtcatctaaggcaatcttcagacccaatgctctccgagtttaaaaacttagatatcactaaaaagaagttagtgcacgaggggcctttgacatggcgggtgaccaaagacaaggccgtcgaggtccatgtgttactgttggatgacctgctgctattgcttcagagacaagatgagagacttcttcttaaatctcacagtcgcacactcaccccgacaccagatggcaaaactatgctgagacccgtactgcgactgacttccgccatgacacgggaggtggctaccgatcacaaggcattctatgtactgttcacatgggatcaagaggcccagatctacgagctcgtcgcacagactgtttccgagcggaaaaactggtgcgcactcataaccgaaaccgccggatctctcaaagtgcccgctcctgcctccaggcctaagccccgtccctccccctcttctacacgagagccgctgctatcttcctctgagaacggcaacggaggcagggaaacgagcccggcagacgctagaaccgaacgcattcttagcgacctcctgccattctgtagaccaggaccagagggccagctcgctgccactgcactgcgcaaggtcttatccttaaagcagttgctattcccagccgaggaggacaatggggcaggtcccccacgtgacggcgacggtgtgcccggagggggtcccctttctcctgcacgaacacaagagattcaggagaacctcttgtctctcgaggaaaccatgaaacagctggaggaactggaggaggagttctgtagactccgcccacttctgtcgcaattagggggtaactccgttcctcagcccggatgcacgtag

SEQ ID NO: 238777 - DNA, 2847 bp, Artificial Sequence
  Description of Artificial Sequence: Synthetic coding sequence
atggcatcactgagtacatggagctcacccgcagaaccaagggaaatggaggatttcgctagaggggctgcctcaccaggcccttcacggccaggtctcgtgccagtctccatcataggagcagaggacgaagatttcgaaaacgagcttgaaacgaacagcgaggaacagaatagtcagtttcagtcactggaacaagtgaagaggagaccggcacacttaatggctctcctgcagcacgtcgctcttcagttcgagccaggcccactcgtcctgcgggtgccagtgccaccaaacgttgcctttgaactggataggacacgagcagatctaatcagtgaggatgtgcagcgacgcttcgtgcaagaagtagtgcagtcccagcaggtggcagtgggtcgccagttggaggactttcgcagcaaacggctgatgggaatgactccgtgggagcaggagctggcacagctagaggcttgggttggtagggatcgcgctagctatgaagcccgagagcgccatgtggccgagagactcctcatgcacttggaggagatgcagcacaccatttccacggatgaagaaaagtctgctgcagtggtgaacgcaatcggactctacatgagacatcttggggtaaggaccaaatctggggacaagaagtccgggagaaattttttcaggaaaaaggtgatggggaaccggaggtcagatgagcctgccaagaccaaaaagggactctcctcaatcctcgatgccgctcggtggaataggggcgaaccccaggtgccagatttccggcatttgaaggccgaggtggacgcagaaaagcctggggcaactgatcggaaagggggtgtgggaatgccatccagagatagaaatatcggggcacccggtcaggacacccctggtgtcagcttgcatcccctttctctggactctccggatcgtgaacctggcgcagatgcccctctggagctcggggattcctccccccaaggtcccatgtccttggagtctttggctcctcccgaaagtactgacgaaggcgctgaaacagaatcaccagaacccggagacgaaggggaaccgggaagatccgggctggaactcgaaccagaagaacctccgggatggagggagttggttccacccgacactctgcattcactgcccaaatctcaagtcaaacgtcaggaagtgatttcagagctcctggtgaccgaggccgctcacgtccgaatgctgagggtgctccatgacctcttttttcagcccatggctgagtgcctcttcttcccacttgaggaactacagaatatcttcccatcactggacgagttgatagaggtacactctctttttctcgaccggttgatgaaaagacgacaggagtcaggctatctcattgaggaaattggagatgtgctcctggcacgattcgacggcgcagagggttcgtggtttcagaaaataagttcccgattctgttcccggcagagttttgcacttgaacagctcaaggcgaaacaacgcaaagacccgaggttttgtgcgtttgtgcaggaggccgagagcaggccacggtgtcggcgactgcagctaaaagacatgattcccacagagatgcaacgtctcaccaagtatcccctgctcctgcagagcatcggtcagaacaccgaagagccaacagagcgggagaaggtggaactcgccgctgagtgctgtcgcgagatcctccatcacgtcaaccaggcagtcagagacatggaggacctgttgcgccttaaggattatcagcgcaggctggacctgtcacacctcaggcagtcttccgatccaatgctcagtgaatttaaaaacttggacattacaaaaaaaaaactggtgcacgaaggccctctgacatggcgggtaaccaaagacaaggctgtcgaggtccacgtgttactcctagacgacttgctccttctcctgcagcggcaggacgaaaggctgctgctgaagagtcacagccggaccttgactccaacgcctgacggcaagacgatgctgcgtccagtcctccgactaacaagtgccatgacgcgcgaggtagcgacagatcataaagctttctatgttttatttacatgggaccaggaggcacagatctatgagctggtggcacaaaccgtgtccgagagaaagaattggtgcgcacttattaccgaaaccgccggaagtctaaaggttcctgcaccagccagcagacccaagccacgaccaagccccagcagcactagggagcctctcctcagctctagtgagaatggaaacgggggacgggagacttctcccgcagacgccagaaccgaacggattttaagcgatttgttgcccttctgtaggcctggccctgaagggcagctagccgctactgcactccggaagggtgttgggggaggaatcctgcctcctgagacgcctcccgtgagcgcttggggggaactttgccccccagcttggctgcaccttcgttttccgccaaggaaagctttttgtaaaaaagaacgaaacggtggggaggacgtgcgagatcacccccaccctcattcctgtagatccatttctcaccctgaggggctgcgcagggggtcatgcgggcctaggctggggggagcccagctgggcctgctcgcaccccacgagccaaggccgtctctcccccctgcgttatgtctcggtgatagcggcttacactctggcggacatcatggagacccagggcatctcagtatcgcgtgtgggggtcacccttcaacaccgacgcccaaatgcctccgatccgtatttattccctag

SEQ ID NO: 238778 - DNA, 4023 bp, Artificial Sequence
  Description of Artificial Sequence: Synthetic coding sequence
atgaggccacccggttttctgagtcgggcaccctcccttaacagggcagaaaggggcatatggagctgtagtatggaccagcgggaacctctgcctccagccccagcagagaatgaaatgaagtatgatactaacaataatgaagaggaggagggtgagcagtttgactttgattcaggtgatgagatcccagaagccgaccgccaggcccctagtgctcctgagaccggcggtgccggtgcttccgaagccccagctcccaccggcggtgaggacggggcaggagctgaaacaacccctgtggctgagccgactaagctggtgctgcctatgaaggttaatccatatagtgttatagatatcaccccctttcaggaggaccagcctcccacccctgtacctagtgccgaggaagagaacgtggggctgcacgtcccttgcggatatctcgtacccgtaccttgcggatacgcagtgccctccaatctgccactgttgctgcccgcttactcatccccagtaattatctgtgcgacatctctggatgaagaggctgagacccctgaagtgactgaagatagacagcccaactccctttcttctgaagagcctcccacgtcagaggaccaggtgggtagagaggactccgccctagcccgttgggctgctgaccctgcaaataccgcatggatggaaaatcccgaggaggcaatttatgacgatgtgccgagagaaaacagcgattctgagcctgacgaaatgatttacgacgacgtggaaaacggtgatgagggtggcaatagctccctagagtacgggtggtcttcgtctgagtttgagtcctatgaggagcagtctgattctgagtgcaagaacggtataccccgaagctttctgcgcagtaaccacaagaaacaactctcacatgacttaacccggcttaaggagcattatgagaagaaaatgcgagatctgatggcctccacggtcggcgtagtggagatacaacaacttcgccagaagcacgagctgaaaatgcagaaactggtgaaggctgccaaagacggcactaaggacggcctcgaaagaactcgtgcggcagttaagcggggaagatcctttatacggacaaaaagcctgattgctcaggaccacagatcttcgctagaagaggagcaaaacctgttcattgatgtggactgcaaacacccagaagctattcttactccaatgccagagggactctcacaacagcaagtcgtccggagatacatcctcggaagtgtggtcgattctgaaaagaattacgtggatgccctgaaacgcatcctcgaacaatacgagaaaccgctgagcgagatggaacccaaagttttgtcagagcgtaaactgaagaccgtgttttaccgcgtcaaggagatccttcagtgtcactcactgttccagatcgccttggcatctagagtcagtgaatgggatagcgtggagatgatcggtgacgtgttcgtggcaagcttctccaaaagcatggttctggatgcctattcagagtacgtcaacaacttctctacagccgtggctgtactgaagaaaacttgtgccactaagcctgcattccttgaatttttgaagcaggaacaggaggccagtccagataggaccaccttgtattccctgatgatgaaacctattcagcgcttcccccagttcatcttgttgctacaggatatgttaaagaacaccagtaagggacaccccgaccgattgcctctgcagatggccctcacagaactggagacattggctgaaaaactgaacgagcggaaaagagatgctgaccaacgctgcgaagttaaacagatcgctaaagccattaatgaacgatatttgaataagcttctgagtagcggaagtaggtatctgatccggagtgatgatatgattgaaactgtatataacgatcgcggtgaaatcgttaaaacaaaggagcgtcgtgtttttatgctcaacgacgtgctgatgtgtgccactgtttcttctcgcccaagtcatgattctcgagtcatgagctcccagcgttatctgctgaagtggtccgttccacttgggcatgtggatgctatagagtacgggagttccgcgggaactggggaacattcacggcacttagcagtacatccccctgaatccttggccgtcgtggcaaacgcgaaacctaataaggtctatatgggccctgggcagttataccaggacctccaaaacctgctccacgaccttaatgtaattgggcagataactcaactgatcgggaatttgaagggaaattatcagaatttgaatcaatctgtcgcgcacgattggacttccggcttgcaacgcctgatcctcaaaaaggaggatgagattcgggctgcagactgctgccggattcagctgcagttacccggaaagcaggataaaagcggacgcccaaccttcttcaccgccgtgttcaatacttttacgcccgctataaaagaatcctgggtgaattctctacaaatggctaaactggccctggaggaagagaaccacatgggttggttctgcgttgaagacgacggtaatcacattaagaaagagaaacacccactcctggttggacacatgccggtaatggtggcaaagcagcaggaatttaaaatcggcagttgtactcatcaaatgggccagattgccatcgtgtcgtttcagaacagtacccccaaagtcattgaatgctttaacgtagagagcaggatcctctgtatgttgtatgttcccgtagaggagaaaaggcgagaacctggcgctcctcctgatccggaaactcctgctgttagggcctccgatgtgccaactatctgtgtcgggacagaagagggaagcattagcatctacaagtcttctcaagggtcgaaaaaggtgagacttcaacatttctttaccccagagaagtcaacggtgatgagtttagcctgcacaagccagtctctgtatgccggactggtgaatggagctgttgccagttatgcgagagcacctgacggctcctgggacagcgagccacaaaaagtaataaaactgggggtgctaccggttcgatcactcttaatgatggaagataccctgtgggccgctagcggcggacaggtgtttataatcagtgtcgagactcacgccgttgaggggcagctggaagcacaccaagaggagggcatggtgataagtcatatggccgtgtcaggcgttggcatctggatagctttcacgtccggtagcacacttcggctgttccatacagagacgttgaaacatttgcaggatatcaatatcgccacccctgtccataacatgctgccaggccaccaacggctttctgtcactagtcttctggtctgccatggcctgcttatggtgggtacttcgcttggcgtgttagtggcattgcccgtgcccaggctgcaaggaattcctaaggtgaccggcaggggtatggtaagttatcacgcacacaatagtcccgtaaaatttatcgtgctcgccactgctcttcacgagaaggataaggacaagtcccgcgattctctcgcacctgggcctgagcctcaggatgaagaccagaaagatgcattgcccagcggcggagccggatcctctctgtcccagggcgatcccgatgccgcaatttggctgggagactctttaggcagcatgacccagaaaagcgacctgtcatcaagcagtggttctttgtctctctcccacgggtcttcgagcttagagcatagatcagaggactctacaatttatgacctgctgaaggacccagtgtcattgcggtctaaagcgcgacgggctaaaaaggcaaaggctagttccgcgctggtcgtgtgcggcggtcagggacacaggcgcgtgcacaggaaagctcgtcagcctcaccaggaggagctggcacccactgttatggtttggcagataccattgctgaatatttag

SEQ ID NO: 238779 - DNA, 4035 bp, Artificial Sequence
  Description of Artificial Sequence: Synthetic coding sequence
atggatcagcgcgagccacttcccccagctcccgcagaaaacgaaatgaagtatgacaccaataataatgaagaggaagagggcgagcaatttgattttgactccggcgatgagatccccgaagctgatagacaagcgccatccgcaccagagacaggcggtgccggagcaagcgaagcacctgcaccaactggcggtgaagacggtgctggcgcagaaaccacccccgtggccgagccaacaaagctggtccttccaatgaaagtgaatccgtacagtgtgatcgatatcactccgttccaggaggaccagcccccaacccccgtgccgtcagctgaagaggagaatgtgggcttgcatgtgccttgtggatatcttgtccccgttccttgcggctacgcggtgcctagcaacttgccgctgctgctgcccgcatacagtagcccagttatcatctgcgcaacaagtctggatgaagaagagacccccgaggttacagaggatagacagcccaattccctgtcttctgaggaaccccctacaagcgaggaccaggtcggacgggaggatagtgcactggcacgctgggccgcagacccagcaaacaccgcatggatggaaaacccagaggaggccatctatgatgacgtgcctagagagaatagtgactctgagcctgatgagatgatctacgatgacgtcgagaacggagacgaagggggaaattcctccttagagtatggttggtcttcctcagaatttgagtcttacgaagaacagagtgactccgaatgtaagaatgggatccctaggagctttctcagatctaatcacaaaaaacagcttagccacgatctcacaagactcaaggaacactacgagaaaaagatgagggatctgatggcctcaaccgtcggagtagttgaaatccagcagcttcggcagaagcacgagcttaagatgcagaaactggtgaaggcggcaaaggacggcacaaaagacgggctggagagaaccagagcagctgtgaagcgcggtaggagctttattagaaccaaaagtttaatcgcccaggaccatcggtcctcccttgaagaggaacagaatctgtttatcgatgtggattgcaaacatccagaggctatccttactcccatgcccgaagggttaagccaacagcaggtcgtacgtagatatatccttggatcagtcgtggactccgaaaagaattatgtggacgcgctgaaacggatacttgagcagtatgaaaaacccctgagtgaaatggaacctaaagtccttagcgaacggaagctcaaaactgtgttttatagagtcaaagaaatcctgcaatgccactcactgtttcagatagccttagcatctagagtgagcgagtgggactcagtggaaatgatcggggatgtcttcgtggcatcattttcaaaaagtatggttctggacgcatacagcgaatatgtgaacaacttttcaaccgcagtggctgtgttaaaaaaaacatgcgcgactaaacccgcttttctggagtttctcaaacaggagcaggaagccagcccagacagaacgactttgtattctcttatgatgaaaccaattcagcgcttcccgcagtttattttactgctccaggacatgctgaaaaacaccagtaagggccaccccgacagattgccactgcagatggccctgactgagctggagactctggctgaaaaactgaacgaacgcaaacgggacgccgaccagagatgcgaagtcaagcagatcgccaaggctatcaacgagcggtaccttaacaaacttctgagctccgggagtagatatctgatacgttctgacgatatgatcgagactgtctataacgaccggggagagattgtgaagactaaggagaggagagtgtttatgcttaatgacgtcctgatgtgcgccactgtgtcttctcgcccatcacacgactcaagggtgatgagctcgcagcgttacttgctaaagtggtccgttccactagggcacgtcgacgccatcgaatacggctcatctgccggaactggcgagcatagtagacacttggccgtccaccccccagagtcgctcgctgtggtggcaaatgccaagcctaacaaagtttatatgggcccaggacagttatatcaggacctgcagaatctcttacacgacctgaatgtgattggtcagatcactcaactgatcggaaacttgaagggtaactaccagaacctgaatcagagcgtcgctcacgattggaccagtggcttgcagcggctgattctgaaaaaggaggacgagatcagagccgctgactgctgtcgcatccagttacagctgccaggaaaacaggataagtcaggacggccaactttcttcacagctgtttttaatacctttacccctgctatcaaggaatcctgggttaattccttacagatggccaagcttgccctcgaggaagagaaccatatggggtggttctgtgtggaggatgacgggaatcacattaaaaaagagaagcatccactgctggttggccatatgcccgtgatggttgccaagcagcaggaatttaagatagaatgcgcagcatataatccggagccttacttgaacaatgaatctcagccagattcttttagtaccgctcatggctttttgtggatcgggagttgtactcaccagatgggacagattgctatcgtaagcttccagaacagcacgccaaaggtaattgagtgcttcaacgtcgagtccaggattctgtgcatgctatatgtccctgttgaggaaaagcggagagagcctggcgcacctcccgatccagagaccccggcagtgcgagcctcagatgtgccgactatctgcgtcgggaccgaagaaggctccatatcgatatacaagagctcacagggatctaagaaggtgcgcttgcaacacttctttaccccagaaaagagtaccgtgatgtctctcgcctgtacctctcaaagcctctatgcgggactcgtgaacggcgctgtggcttcctatgctcgagcccctgatgggtcttgggactcagaacctcagaaggtgattaaactaggggtattgccagtcaggagcctgcttatgatggaagatactctatgggccgcttcaggaggccaagtctttatcattagtgtggaaacacacgccgttgaaggacagctggaagctcatcaggaagagggcatggtaatcagccacatggctgtgtccggggtcggtatttggatcgcatttacatctgggtctactttacggctgttccacacagaaaccctgaaacatctgcaggacatcaacatagccacccccgtgcataatatgctgccgggtcatcagcgcttgagcgtgacatcactgctagtttgccatggccttctgatggtgggaacctcactgggggtgctggtggctctgcctgtgcctcgtctgcaaggaatacccaaggtgacgggaagaggaatggtctcttatcatgcccataatagccctgttaaattcatcgtccttgcaacggctctccacgagaaggataaagataagtcccgcgactcattggcaccgggtccagagccccaggatgaggaccagaaggacgcgctccctagcggtggggctggctcttctttgtcacaaggcgacccagatgcagcgatttggcttggggattcactcggatcaatgacacaaaagtctgacctgtcctcttcatccggctcactgtctctttcacacggatccagctccctggaacacaggagcgaggacagtaccatctatgacttgctgaaggatccagtcagcctgcggagcaaagcacggagagctaagaaggcgaaagcttcttccgctcttgtagtgtgtggtggacaggggcatcggagggtccaccggaaagctaggcagcctcatcaggaggagctggcacctactgtgatggtttggcagatccctttactcaatatttag

SEQ ID NO: 238780 - DNA, 1833 bp, Artificial Sequence
  Description of Artificial Sequence: Synthetic coding sequence
atgaggccccctgggtttttgtccagggctcctagtttaaaccgagcagagagaggaatctggtcatgcagtatggatcagagggagcctctgccaccagccccagcagagaatgagatgaaatatgatactaataataacgaggaggaggagggtgaacagtttgatttcgactctggcgatgaaatcccagaagctgaccggcaggcacccagcgcacctgagactggtggagctggggcttcagaggcaccagcacctacagggggagaagatggcgctggcgctgagaccaccccagtcgctgaaccaaccaagctggtcctgcctatgaaggttaatccctactctgtgatcgatatcacaccttttcaggaagatcagccgcctacccctgtgccttccgccgaagaggagaatgtggggctacatgtgccgtgtggctacctggtgcccgtgccatgtgggtacgcagttccctctaacttgccgctgttattgcctgcatacagctctcccgtgatcatctgcgctacctcgcttgacgaagaggcggagacacctgaggtgacggaggacagacagcccaattccttgtcaagcgaggaacctccaacgtctgaagaccaagtaggcagagaagactctgctctggctcgatgggccgctgatccggcaaacactgcttggatggaaaatcctgaagaggcaatctacgatgatgttccccgagaaaactcagatagcgagcccgacgagatgatttacgatgacgtggagaatggggacgagggcggaaatagtagcctggagtatggatggtcctcaagcgagtttgaatcatatgaggagcagtccgactccgagtgtaagaatggtatccctagatcctttttaagaagtaaccacaaaaaacagatgcagaagctggtgaaggccgctaaggacggcaccaaggacggcctcgagcgaactagagccgctgtgaagcgcggtcgcagttttatcaggacaaagtcactgatcgcccaggaccaccgatcaagtctcgaggaggaacagaatctgttcatcgacgtcgactgtaaacaccccgaggcaattcttacaccaatgcccgaaggcttaagccagcagcaggtggtgaggcgatatattctcggttctgtagtcgactctgagaaaaactatgtggacgctctaaagcggattctggagcaatatgaaaagcccctgagcgagatggagcccaaagtactgtcagagcgcaaactcaaaacggtcttctatcgagtgaaagaaatcctgcagtgtcactcgctcttccagatagccctcgcttctcgcgtgagcgaatgggatagtgtcgagatgattggagacgtctttgtggcctccttctctaaaagtatggtgctggacgcctactccgaatacgtgaacaacttcagcaccgccgtggccgtgttaaagaagacgtgtgcaacaaagccggcattcctcgaattcctaaagcaagaacaggaggcctccccggatcgtaccacgctgtacagcctgatgatgaagccgatccaaaggtttccccaattcattttgctgctgcaggatatgcttaaaaatactagcaaaggccatcccgaccgattaccattgcagatggccctgacagaactcgagaccctcgccgaaaaactgaatgagcgaaaacgtgacgctgaccagaggtgcgaggtgaagcagatcgctaaagctataaacgaacggtatctgaacaaggttgagcggggtttcctccagctctactccaaaattatattcgctctctgctag

SEQ ID NO: 238781 - DNA, 4110 bp, Artificial Sequence
  Description of Artificial Sequence: Synthetic coding sequence
atgcgccctcccggtttcctgagccgtgctccttccttaaaccgggctgagaggggaatttggagttgttccatggaccagagggaaccgctgcctcccgctcctgcggaaaacgaaatgaagtatgatactaataataacgaagaagaagaaggtgagcagttcgattttgatagcggggatgaaatcccggaagctgacagacaggctcccagtgcaccggaaaccggaggagcaggcgctagcgaggctccagcccctacagggggagaggacggcgctggcgctgagacaaccccagttgccgagccaacaaagctggtcctgccaatgaaggtgaatccctatagcgttattgatattacgccattccaagaagaccagccaccgacacctgtcccatccgcagaagaggaaaacgtgggcctccacgttccttgcggctatctggtgcccgtgccctgtgggtacgctgtgccatccaaccttcccctcctgctgccagcctacagtagtccagtgatcatctgtgccacctctcttgacgaggaggccgaaacccccgaggtgaccgaggacagacagcccaattcactgtcatctgaagagccgccaacttctgaggaccaggtgggcagagaggattcggcattagctaggtgggccgctgatcccgctaatacagcctggatggagaatcccgaagaggcaatctatgatgacgttccgagagagaactctgactcggagcccgatgagatgatctatgatgacgtggagaacggggacgagggaggtaattccagcctggaatacggttggtcgtcttctgagttcgaatcttatgaagagcagtctgactccgaatgtaagaatggaattcctaggagctttctccggtcaaatcacaagaaacagctgtcccacgacctgactcgcttgaaagagcattatgaaaagaaaatgagggacctgatggccagcactgttggcgtagtggaaatccagcagttaaggcagaaacatgagctgaagatgcagaagcttgtgaaagcagctaaagatggcacaaaagatggcctggaaaggacacgggcagccgtgaagagaggtcgctcgtttattcgaaccaagtctctgatcgcgcaagatcacagaagcagcctagaggaggagcagaacttgttcatcgacgtagactgtaaacaccctgaggcaattctgacccccatgcccgaggggctgtcccagcagcaggttgtccgacgatacatacttggctcagttgtggactcagaaaaaaattacgtggatgcactgaagagaatcttagagcagtacgagaagccattgagcgagatggaacctaaagtattgagcgagagaaaactcaaaacagtcttctacagggtcaaagaaattctccagtgccattccttatttcagatcgctctcgcgagccgagtctccgagtgggattctgtcgaaatgatcggagatgtgttcgtcgcctccttttccaagtccatggtgttggatgcatattcagaatatgtgaataatttttccaccgcagtggctgtactgaaaaagacctgcgccaccaagccggcatttctcgagttcctaaaacaggagcaggaggctagtcctgacaggactacactgtattccctcatgatgaaaccaatacagcgcttcccccagttcatcctactgctgcaggacatgctgaagaacacctcaaagggccatccagataggctgcctctgcaaatggcactgacagaattggagactctcgcagagaagttaaacgaacgcaagcgtgatgcagaccagagatgtgaggtcaaacagatcgcaaaggctatcaatgaacgctatctgaataagttgctctctagcggtagccgctatttaatacggagcgacgacatgatcgagacagtgtataatgacaggggcgagatcgttaaaactaaagaaaggcgagtgttcatgctcaatgacgtgctgatgtgtgcaacagtgtccagccggcctagccacgattcgcgggtcatgtcgagccagcgatacctactcaagtggagcgtacctctcggccatgtagacgctatcgaatacggcagcagcgcagggacaggggagcactctagacatttagccgttcatcctcccgaatctctggccgtagtggccaatgccaaacccaacaaagtgtatatgggtccgggacagttatatcaggacttacagaacctattgcacgatctgaatgtcatcggacagattactcaattgataggcaatttgaaaggaaactaccaaaatttgaatcagtctgttgcccatgattggacaagcggccttcagcgccttattctcaaaaaagaggacgagattagggccgcagattgttgcaggatccagctgcagttgcccggaaagcaggacaaatccggcaggcccacatttttcacggccgtcttcaatacgtttacacctgccatcaaggagtcctgggtgaactctctccagatggctaagcttgccctggaggaagaaaatcacatgggatggttttgtgtggaggatgatggcaatcacatcaaaaaagagaagcatcctcttctggtgggacacatgccggttatggtggccaagcagcaagaattcaaaattgaatgtgctgcttacaatccagagccatacctgaacaacgaatcacagccagatagcttctcaaccgcacatgggtttctgtggataggaagttgcacccaccagatgggccaaattgccattgtgagctttcagaattccacccccaaagttatcgaatgctttaacgtggagagccggatcctatgcatgctgtacgtaccagtggaagagaaacgcagggaaccaggcgctccccctgatcctgaaactccggcagtaagggcaagcgatgtgccgaccatttgcgtggggacagaggaggggtcaatatctatctataagagttcccagggatcaaaaaaggtgcgattgcagcatttcttcacccccgaaaagtctacagtcatgagcttggcatgcacgtctcagtcgctttacgctggactggtgaacggcgctgttgcttcctatgcgagggcaccagatggttcttgggattctgagcctcagaaagtgattaagctgggcgtgctgccagtgcgctctctcctaatgatggaggacaccctgtgggccgcatcagggggacaggtgtttatcatttcggtcgaaactcacgcagtcgaggggcagctcgaagctcaccaagaggagggtatggtcatctcccacatggcggtgtctggggtgggcatctggatcgctttcacatctggttccacacttcggctcttccacaccgagacccttaaacacttacaggacatcaatatcgcaacacccgtacacaatatgcttccaggacatcagaggctcagcgtgacttcccttttggtgtgccacggactgctaatggtcggtacaagcctcggcgtcttggtggcgctgccagtccctcgactacaagggattcctaaggttactggcaggggtatggtctcctatcacgctcacaactctcctgtgaagtttatagtgctggctacagcactacacgagaaggacaaggataagagtcgggattcacttgctccagggccagagccccaagacgaggatcaaaaagatgccctccctagtggaggggcaggcagtagccttagccagggtgacccagatgcagctatatggcttggcgactctcttggctcgatgacacagaaaagcgacctgtcgtcctcctccggcagcctgtcgttaagtcacggatctagcagtctggagcatcgtagcgaggacagcacaatttacgatttgctcaaagatcctgtctcgcttaggagtaaagctcgcagagccaagaaggcgaaagcctcatccgccctcgtggtgtgcggaggtcagggacatcgacgtgtgcacaggaaggctcgtcaacctcaccaagaggaacttgcgcctaccgtgatggtctggcagatcccactgctaaacatttag

SEQ ID NO: 238782 - DNA, 4107 bp, Artificial Sequence
  Description of Artificial Sequence: Synthetic coding sequence
atgagacctcccggttttctgtccagagcccctagcctgaatcgcgctgagaggggcatctggtcgtgtagcatggaccagcgagagcccttacctcctgctcccgctgaaaatgagatgaaatatgatacaaataataatgaggaagaggaaggtgaacaattcgacttcgatagcggcgacgagatcccagaggccgaccggcaagccccaagtgctccggagaccggtggagcgggagcttctgaagcaccagcacccactgggggagaagacggcgcaggtgcagagacgacaccagtggccgagccaaccaaactggtgctgcctatgaaagtgaatccgtattctgtaatagacattacgccattccaggaggatcagccacccacgcccgtgccgtcggcagaggaagaaaacgtggggttacatgtaccctgtggctatctcgttccagtgccgtgcggatatgccgtgcccagtaatctgcctctgttattgccagcatactccagccctgtgatcatctgcgcgacatcattagatgaagaggcagaaactcctgaggtgacagaggatcgccaacccaactcactttcatctgaggaacccccaactagcgaggatcaggttgggagggaggactccgcgctcgctcgatgggccgcagatccagctaacacagcatggatggaaaaccctgaggaagccatctatgatgacgttccacgagaaaactctgactctgagccagatgaaatgatctacgacgacgtcgagaatggggacgaaggagggaattcttctctcgagtacggctggtcttccagcgaatttgagagttacgaggagcaaagtgatagtgagtgtaagaacgggatcccccgtagcttccttaggagcaaccacaaaaagcagctttcacatgatctgactcgtctgaaggagcactacgaaaaaaagatgcgggacctcatggcgtccaccgtgggcgtagtagagattcagcagttgaggcaaaagcacgagctgaaaatgcagaaacttgtcaaagcagctaaggatggaactaaagacggtctggagagaacgagagcagccgtgaaacggggaaggagttttatcagaacaaagtcactcattgcccaggatcacaggtccagtctcgaagaggagcaaaacttgtttatcgatgttgactgcaagcatcctgaggcaattcttactccaatgcccgaggggctgtcacagcaacaggtcgtgcgtcgctacatcctggggtctgttgtggactcagaaaaaaactacgtagacgcattgaaaagaatcctagaacagtacgagaagcctctgtccgagatggaacccaaagtcctctctgagcgaaagctgaaaacagtgttttaccgagtcaaagaaatactgcaatgccactctttgtttcagatagcgctggcttccagagtctccgagtgggattcagttgaaatgattggagatgttttcgtcgcatctttctccaagtccatggttctggacgcctactctgaatatgtgaataatttttcgactgctgtggcggtcctcaaaaagacatgcgccactaagcctgccttcctggaatttctgaaggagcaggaggccagtccagaccggaccactctctacagcctgatgatgaaaccgatccagagattcccccaattcatccttctactgcaggacatgctcaaaaatacctccaaaggtcacccggaccgtctgcccctgcagatggctctgactgaacttgagactttagctgagaagctcaacgaacgaaagcgggatgctgaccagcgctgtgaggttaagcagatcgcaaaggcaataaatgagcgttatctgaataagctactgtcctcaggaagtcggtaccttatccgtagcgacgacatgattgagaccgtgtataacgaccgaggggagatagtcaagacaaaggagagaagggtttttatgctaaatgacgtgttgatgtgcgccaccgtttctagcagaccatcacatgactcccgggttatgagctcccagagatatcttctgaagtggtctgtcccgctgggccacgtggatgccatcgagtatggctcctccgccggaactggcgaacacagccgtcacctcgcggtgcaccctccagaatcgctggcggttgtggctaacgccaagccgaataaggtctacatgggacctggccagctgtatcaggatctgcagaatctgctgcatgacctaaatgttattggccagatcacccagttgatcggaaacctgaaaggaaattatcagaacctgaatcagtcagtcgcccatgattggacctccggccttcagcggttgatcttgaagaaagaggacgagatacgcgctgccgattgttgccgcatccaattacaactacctgggaagcaggacaagtctgggcgaccaacattttttacagccgtcttcaataccttcaccccagccattaaggaaagctgggtgaattcactccaaatggccaaactagctttagaggaggaaaatcatatgggttggttctgcgttgaggatgatgggaaccacatcaaaaaggaaaagcacccattgctcgtgggacacatgccagtcatggtcgctaagcagcaagagtttaagatcgagtgtgcggcttacaatccagagccttatctgaacaatgaatcacaacctgactccttttcgacagcgcacggatttctgtggatcggatcttgtacacatcagatggggcagatcgcgatcgtgtccttccagaactctactccaaaggtgatcgaatgcttcaacgttgagtctagaatcctgtgcatgctgtatgtcccagtcgaagagaaacgtagagagccaggggcacccccagacccagaaacccccgcagtcagggccagtgacgttccaacaatttgcgtgggcacagaagagggttcaatctccatctataaatctagccagggcagcaaaaaagttcgcctccagcacttttttacacccgagaagagtaccgttatgagcttagcttgcacctctcagagcctgtacgcgggactagtgaatggcgcagtcgccagttacgctagggccccagacggttcatgggacagtgagcctcaaaaggtcatcaagctgggcgtattacctgtccggtcactacttatgatggaagacacactctgggccgcttccggaggacaggtttttatcatcagtgttgaaactcacgccgtcgaggggcagctagaggcccaccaggaggagggcatggtaatatctcacatggcagtctcgggagtcgggatctggatcgcgtttacgagcggcagcacattgagactgttccatacggagacccttaagcatttgcaggacattaatatcgccacacctgttcacaacatgctacccggtcaccagagattgtctgtgacctcactgttggtttgccacggactgttgatggtgggtacgtctctgggggtgcttgtcgcacttccagtgccacgtcttcagggaatccctaaagttaccggccgtggcatggtcagctatcacgcccacaactctccagttaagttcatcgtcctggccactgccctgcacgagaaggataaagacaaatctcgcgactcactggcaccagggccagagccacaggacgaagaccagaaagatgcgctgccatcaggtggagctggcagcagtctgtcacagggcgacccagacgctgccatttggctaggggacagtctcggctcaatgacacagaagtctgacctgagcagttccagtggcagcctgagcctgagtcacggctcatcctcgctggaacatcgcagcgaagactcaacgatctatgaccttttaaaagatccagtcagcctgaggtccaaggcaaggagagccaagaaggcgaaggcttcgagtgccctagtagtatgtggcggtcaggggcaccgccgagtgcatcgcaaggcacgacaaccccaccaagaagaactggctcccacagttatggtctggcagattccattgctaaatatctag

SEQ ID NO: 238783 - DNA, 2949 bp, Artificial Sequence
  Description of Artificial Sequence: Synthetic coding sequence
atgctgccctcctcctcctggggcaagcgtaaactgcggggacggctcgggtgggtaagatcagacgccaggggggtgatgtgggcacgccaggagggactgcaccacccccatccacatgcagttatccgatgtccctcatcatcaagtagcagcgtgagctgctccggtgactctgaggaggaggacatgggattgctggaggttagcgtaagcgacattaagccacccgcacctgagctggggcctatgccagagggactctctccacaacaagtcgtgcgcagacacatcctgggttcaatagtgcaatcagaaggctcatacgttgagtcactgaagcggatcctgcaggattacaggaatccacttatggagatggaacctaaagcccttagcgctcgaaagtgccaggtcgtattctttcgcgtaaaagagatcttacactgtcactccatgttccagatcgcgctgagctcccgcgtagccgaatgggacagtaccgagaagattggtgatttattcgtggccagcgatatgttgaaaaacacgcctcgaggacatcctgatagactatcccttcaattggccctcaccgaactggagaccttagcagagaaacttaacgagcagaagcggctggccgatcaggtcgcagagattcagcaactgacgaaatccgtctctgaccgctctagcctgaataaattactgaccagcggtcaacggcagctgctgttgtgcgagaccctgactgagacagtgtacggggatcggggacagctgatcaaaagtaaagagcgtcgtgtgttccttctcaacgacatgctggtgtgtgccaatatcaactttaaaggtcagttagagatctcttctctcgtgccattaggaccgaaatacgtggtgaaatggaacacggcgcttccccaggttcaggtggtggaagttgggcaagatggaggaacctacgataaggacaacgttctcatccaacactctggtgcgaaaaaggccagcgcttctggacaggctcagaacaaggtatacctgggtccgcctaggctgtttcaggagttacaggatctgcagaaagatttggctgtggttgagcaaattacattattaatttctactctccacggcacatatcagaaccttaatatgactgttgcccaagactggtgtctggctctgcagagacttatgcgtgtaaaggaagaagagatccattcagctaataagtgccgcctgcggctattgctgcccggaaaacccgacaagtcgggaagacctatatcatttatggtcgtttttatcactccaaatcccctgagtaagatttcctgggtgaatcggctccacttggcaaagattgggttgcgggaagaaaatcagcccggatggctgtgccccgatgaggataagaagtcaaaggccccattttggtgccctatcctagcctgctgtattcccgctttctcatctagagccctgagtctgcagctgggagctctggtgcactctccagtgaactgccctctgcttggtttctctgccgtgagcactagcctgccacaaggctatctgtgggtgggaggcggtcaagagggcgcagggggacaggttgagatcttcagccttaatcggccatcccctcggaccgtcaagagcttccccctcgccgcacctgttctttgcatggaatacatccccgagctagaagaagaggctgaatctagggacgaaagtcctactgttgcagatccctcggcaaccgtccaccctacaatctgccttggtctgcaggatggaagtatcctgttgtattcctctgtagacactgggacacaatgtctggtcagttgcagatctccaggcctgcaacctgtgctctgtttacgacatagtcctttccaccttctggctggcttgcaggacggaaccttagccgcatacccaaggacatctggcggagtgctttgggacctggagagccccccagtttgtctcacagttgggccaggcccagtgcgtactcttctgtctctggaagacgctgtgtgggccagttgtggtccatgggtgaccgtcctagaagccacaactttgcagccccaacaatcttttgaagctcaccaggatgaagcagtctcggttacacacatggtaaaagccggttcaggagtttggatggccttcagctcaggcaccagtatccggctgtttcacaccgagacccttgagcacctccaggagatcaatatagcaaccagaacaactttcctcctgcccggtcagaaacatctctgtgtaacttcgctgctaatatgtcagggactcttgtgggtcggcaccgaccagggagttattgtcctgctgcctgttccgaggttggaggggatcccaaagatcacagggaagggtatggtgtccctcaacggtcactgtggccctgtggccttcctggctgtggctacctctattctcgccccagatatcctgcgctctgatcaagaagaggccgaggggcctagagccgaggaagacaaaccagatgggcaggctcatgagccaatgccggactctcacgtcggcagggagctgaccaggaaaaaggggatactgttgcagtacagactaagatccactgcacatctgccagggccactgctctcaatgcgggagcccgcacctgctgatggtgccgcattggagcacagcgaggaggacggaagcatttacgaaatggctgatgaccctgacatttgggtgaggtctaggccctgcgccagagacgctcaccgtaaagagatatgtagtgtggctatcatcagcgggggacaggggtaccgaaactttggctccgccctaggatcttcaggcaggcaggccccatgcggagaaactgattccacgctcttaatctggcaagtgccactgatgttgtag

SEQ ID NO: 238784 - DNA, 3840 bp, Artificial Sequence
  Description of Artificial Sequence: Synthetic coding sequence
atggcttctagcaatcctccccctcagcctgctatcggtgaccaattggttccaggggtacccggacccagctctgaagctgaggatgaccccggagaggcttttgaattcgacgacagcgacgatgaagaggatacctcagcagcgttgggagtgcctagcctcgcccctgagcgggataccgacccacctcttatccacctcgacagtatcccagttaccgacccagatcctgccgcagcgccacccggaaccggggtgcccgcatgggtgagcaacggagatgcggctgatgcagccttctccggggctcgccattcctcttggaaacgtaaatcatctagacggatagaccggtttacatttcccgcattggaggaggatgtgatttatgatgatgtgccatgcgaatctcctgacgcccaccagcctggcgcagagcggaatctgctctacgaggatgcccatagagcgggagccccacgccaggccgaagatctgggatggagcagctccgaattcgagtcctacagtgaggactctggagaagaagccaaaccagaggtagaagtcgagccggcaaagcatcgggtatcctttcagcctaagttgtctcctgatttgacccgcctgaaggagcgatatgctcggacaaagcgggatattctggctttacgagttggaggaagagacatgcaggaactgaaacacaagtacgactgtaagatgacccagcttatgaaggctgctaagtctggtactaaagatggactggagaagactcgcatggccgtaatgagaaaggtgagttttctacaccggaaggatgtgctaggggactcagaggaggaggatatgggtctcctggaggtgtctgtgagcgacatcaagccacctgcgccagagttggggcctatgcccgaggggcttagtccccagcaggtcgtgaggcggcacatccttgggagcatcgttcagtccgagggctcctacgtagaatcactgaagaggatcttgcaggactacaggaacccattgatggaaatggagccgaaagcactctcagcccgaaaatgccaggtagtgtttttcagagtgaaggaaatacttcattgccactccatgttccagattgcactgagtagccgcgtggctgaatgggactccactgagaagatcggagatctctttgtagcatctttctctaaaagcatggtcctggacgtttatagtgactatgtgaataatttcacaagcgccatgtccatcatcaagaaggcttgtctgacaaaacctgcatttctggaatttctgaagagaaggcaggtgtgctctccagatcgagtaactctttacggtctaatggtcaagccaattcagcggttcccccagttcatcctactcttgcaggacatgctaaagaatacacccaggggccacccagatcggttgagcctgcagctcgccctgaccgagctggaaaccctggcagaaaaactgaacgaacagaaacgattagccgaccaggtggctgaaattcaacaattgactaagtctgtaagcgatcggtccagcctgaataaactgctgacaagcgggcagcggcagcttctactgtgtgaaacgttaacggagacagtgtacggggataggggccagttaatcaaatctaaggagcgtcgagtgtttctcctgaacgacatgttggtctgcgccaatattaattttaagccagccaatcacaggggtcagctggaaatttcttccctagttcccctaggcccaaaatacgtggtgaagtggaacaccgccctccctcaggtgcaggtagtagaagtcggacaggatggagggacatatgacaaagacaatgttttaatacaacactctggtgctaagaaggcttcagccagtggccaggcccagaacaaagtctacctgggaccacctcgattattccaagaactccaggaccttcagaaggacctcgctgttgtggagcaaatcacactgctgatcagtacactacacgggacttatcagaacctcaacatgacggtagctcaggactggtgcctggccctgcagagattgatgagagtgaaggaagaagaaattcactcggcaaataaatgccgcctgaggctcttactaccaggaaaacccgacaagagtgggagacccataagtttcatggtggtgttcatcacccctaaccccctttctaagatctcttgggtaaatcggctccatctggccaaaattgggctgagagaggaaaatcagccagggtggttatgccctgacgaagacaaaaagagtaaggcccctttctggtgtcctattctggcttgctgcatcccagcctttagcagccgggcacttagtctccagctgggtgccctggtccactctccggtaaattgccccctgctgggtttttccgccgtctcaacctcactgcctcaggggtacctgtgggtaggcggaggacaggagggcgctggagggcaggtcgaaattttctctctaaatagaccatcaccgagaacggtgaaatccttccccctggcggctcctgtgctgtgcatggagtacatcccggaacttgaagaggaagcagagagtcgggacgaatcccctaccgtggccgatccatccgccaccgtacatccaacaatttgcctgggccttcaggatggatcaatcctcctgtacagctcagtggatacaggcacacaatgtctggtgtcttgtcgcagcccgggtctgcaaccagtactttgtcttaggcactcccctttccatttgctggccggtttgcaagacggcacactagccgcttatcccagaactagcggcggtgttctttgggacctggaaagccccccagtgtgtcttacagtaggtcccggacctgtgagaactttgttatccctagaggacgcagtgtgggctagttgtggcccatgggtgaccgtccttgaggccaccactctacagccccagcagtccttcgaggctcatcaagacgaagccgtgtcagtaacacacatggttaaggcgggaagcggggtatggatggctttctcaagtgggacatccatcaggttgtttcataccgaaacactcgagcatttacaggagatcaacattgctacacgtacaaccttcctgctgccagggcagaagcatctgtgtgtcacctctctccttatctgtcagggattgctgtgggtgggtactgatcagggagtaatcgtcctactgcctgtgcctaggttggaaggaatacctaaaatcactggaaaggggatggtttctttgaacggccactgcggaccagttgcttttctggctgtggccacctcaatcctggcgccagacattcttagaagtgaccaggaggaggcagagggacccagggctgaagaagacaaacccgatggacaagctcatgaacccatgcctgactctcatgtgggcagagagcttaccaggaaaaaaggcattcttttacagtaccggttacggagtacagcccatctgcctgggcctctgctgtcaatgcgcgaaccagctcccgctgacggggctgcgttggaacactcagaagaagatggttcaatttatgagatggcagatgacccagacatttgggtcaggagtcgcccatgcgcgagagatgctcatcggaaggagatttgctcagtcgccataatttctgggggacagggctataggaacttcggctccgctctgggaagctctgggaggcaggccccttgtggcgaaactgactccaccctcctgatttggcaggtgcccctgatgctttag

SEQ ID NO: 238785 - DNA, 3159 bp, Artificial Sequence
  Description of Artificial Sequence: Synthetic coding sequence
atgctgcccagctccagctgggggaaacgaaagctaagaggacggctaggctgggtccggagtgatgcgcgtggagttatgtgggccaggcaggaagggttgcatcatccccacccccacgctgtaatcagatgtccaagctcctcctcgtcctccgtatcctgtagcggggacagtgaagaggaagatatgggactgctcgaggtttcagtttccgatattaagccaccagcaccagagcttggccctatgccggagggcctgtccccccagcaggtggtgagaagacacatcctaggctccattgttcaatcagagggctcctacgtcgagtccctgaaacgtattctgcaagattatcgaaatcctctgatggagatggaacctaaagctctaagcgcacgcaagtgtcaggtggtgttttttagggtgaaagagattctgcattgccattctatgttccagattgccctcagttctagggtcgccgagtgggattcgacagaaaagataggagacctgtttgtggcctcattttctaaaagcatggtgctcgacgtttactctgactatgtgaataattttacaagcgcaatgtccattattaagaaagcttgtctcaccaaacccgctttcctggaatttctaaaaaggagacaagtatgttcgccagacagggttacactatacggactaatggtgaaaccgattcagaggtttccccaatttatcctgctcttacaggatatgctgaaaaacacgcccaggggacatccggaccgactgtctctccaactggccctgaccgagcttgagaccctggctgagaaacttaacgagcagaagagactcgcagaccaggtggctgaaatccagcagcttaccaagtccgtcagtgatagatcatcgttaaataagctgctgacttcgggtcagcggcagcttcttttatgtgaaaccctcaccgagactgtctacggagataggggccagctcatcaagtctaaggagcgcagagtattcctgctcaacgacatgctcgtctgcgctaacataaatttcaaagggcaattggagatcagcagcctggtgccactcgggccaaagtatgttgttaagtggaataccgccctgccgcaggtgcaggtcgtggaagtagggcaggacggcggaacgtacgataaggataatgttcttattcagcacagcggggcaaagaaggcttccgctagcggacaagcgcaaaacaaggtctatctgggtccccctagactgtttcaagaacttcaggacctccagaaggatttggccgtcgtcgaacaaatcactctgcttattagcactctgcatgggacttaccaaaatcttaatatgaccgttgctcaggattggtgcctggccctgcagagactcatgcgggtaaaagaagaggagattcattcggccaataaatgtaggctgagactgcttttaccagggaaacccgataagagtgggaggcccatctcattcatggtggtgtttataacaccgaacccactttccaaaatctcctgggtcaataggctacacctcgctaagatagggttaagagaagagaaccagcccggatggttatgcccagatgaggataagaagtctaaggctccgttctggtgccctatactggcctgctgcatacctgcatttagtagtagggccctgtctctgcagctgggtgcattagttcacagtccagtcaactgtcccttgctcggcttctctgcagtgagcacttcactgcctcaaggctacttatgggtcggagggggacaggaaggtgcaggcggacaggtggaaattttctctctcaatcgcccaagcccacgaaccgtgaagtccttccccctggctgcccctgtgctgtgcatggagtacattcccgagctagaggaggaggccgaaagccgggatgagtctccaaccgtggcagacccgtcggctacggtccatcctaccatttgtctggggctgcaggacggttccattcttctgtattctagtgttgataccggcactcagtgtctcgtatcttgtaggtctcccggacttcagcctgtgctgtgtctccgccattccccatttcacctgctcgcgggtctgcaagacggcactctggcagcttatccgaggacctcaggcggagtgctttgggatttggagagtccgccagtatgtcttacagtcggtcctgggccagtgagaacgttactttcactggaggatgccgtgtgggcgtcttgcgggccatgggttacggtcctcgaggcgactactcttcagccccagcagagctttgaagcccaccaggacgaggctgtgtctgtcacacacatggtgaaggctggcagcggagtgtggatggcattcagttccgggacctcaataaggctcttccacacagagaccctcgagcatctgcaggaaattaatatcgctactagaaccacgttcctgcttcccggacagaaacatctgtgcgtgacctcactcttgatctgccaagggctgctgtgggtaggaacagaccagggggtgatcgtcctgcttccggttccgcgactcgaagggatccctaagatcactggcaaggggatggtttcactcaatggacactgcggccctgtagcttttctcgcagtcgccactagcatattagccccagatattctgcggtctgatcaggaggaagccgaagggcctagagctgaggaagacaaaccagacggacaggcacacgaacccatgcctgactcccacgttgggcgagagctgactcgtaagaaaggaatcctgctgcaatatcggcttaggtcaaccgcccatctgcccggtccactgctgtctatgcgagaacctgcccctgccgatggcgctgctctggagcactctgaggaggatggcagcatctacgagatggcggacgaccctgacatatgggtccgcagccgcccttgcgcgcgagacgcacacagaaaggagatttgtagcgttgctattatctccggcggtcagggatacagaaactttggttctgctctgggaagtagcggacgccaagccccttgcggagagaccgacagtaccctgctgatctggcaagtccctcttatgctctag

SEQ ID NO: 238786 - DNA, 3723 bp, Artificial Sequence
  Description of Artificial Sequence: Synthetic coding sequence
atggcatcctcaaaccctccgcctcagcctgccataggcgaccagttggtgccgggtgtaccaggccctagtagcgaagccgaagacgatcctggcgaggcattcgaatttgacgactcggacgacgaggaagatacaagtgctgcgctgggcgtgcccagcctggccccagaacgagacacagacccgccactcatccatcttgattcaatcccagttactgaccctgatcccgctgcggctccaccgggaactggagttcctgcttgggtctctaacggggacgcagcggacgcagctttctctggcgctaggcacagttcgtggaagcgaaagagcagtcgcagaatagaccggtttacttttcccgcactggaagaggatgtgatctacgatgatgtcccatgcgaaagccctgacgcccatcagcccggagcggagaggaatctcttgtacgaggatgctcatagagccggagcacctcgacaggccgaggatcttgggtggagctcctcagaatttgagtcatattccgaggattcaggggaagaggcaaaaccagaagtggaggtggagcccgcaaaacatagagtgagctttcaacctaaaatgactcagttgatgaaggccgctaagtccgggactaaggatggcctggagaagacccgcatggcagttatgaggaaagtttcctttttacacaggaaggatgtgcttggggactctgaggaagaagacatgggacttttggaggtctcagtgagcgatatcaagcccccagcccctgaattgggcccaatgcctgagggtctgtcaccccagcaggtggtcagacgccacatactgggctccatcgtgcaaagtgaaggtagttacgtggaatctctaaaaaggatactgcaggactatagaaacccgctgatggagatggaacccaaggccctgagtgctcgaaagtgtcaggtcgtgttctttagggtaaaggagatcctgcattgccattctatgttccagattgccctgtccagcagggtggccgaatgggattctactgagaagatcggggatctttttgtggcctcgttttcgaagtcgatggtgcttgacgtgtacagcgactatgtgaacaacttcacttctgcaatgtcaattattaagaaagcatgcctaacaaaaccagcttttcttgagtttctgaagcgcagacaggtgtgctcgcctgatcgagtgaccctgtacggcttgatggtgaagcctatccagcggttcccgcagttcatccttctgctgcaggatatgctcaagaatacacctagaggacatccagatcgcctgagcctgcagttggcactcaccgaactggagacgctagcggaaaagctcaatgaacagaagcgactggcggaccaggtggccgaaatacaacagctgaccaagagcgtcagcgacaggtcatctttgaacaaattgctgacctcaggacaacgccagttgctactgtgcgaaacccttaccgaaactgtctacggtgataggggccagctgatcaaatcaaaagagagaagggtgttcctgcttaacgatatgcttgtgtgcgcgaatatcaatttcaagcctgccaaccaccgcggtcagctggaaattagttctctggtgccccttggccctaaatatgttgtgaagtggaataccgcactgccacaagtgcaggtggtagaggtggggcaggacggagggacctatgacaaggacaatgtcctcattcaacactccggcgctaagaaggcctctgccagtggccaagcccagaataaagtgtatctcgggccaccgcgactattccaggagttacaagacctgcagaaggacttggctgtggtggaacagatcacacttctcatctccactctccatggaacttaccagaatctgaacatgactgtggctcaggattggtgtttggcactgcaacgtctcatgagggttaaggaagaagagatccattcggccaacaagtgtcgactcagacttctgctaccgggaaagccggacaaaagcggccgtcctatctctttcatggtcgtcttcataactcctaatccgctgtcgaaaatttcctgggtcaacagattgcaccttgccaagatcggtttgcgggaagagaaccagcctggctggctttgccccgatgaagacaagaaatccaaggcacctttttggtgcccaattttagcctgttgcattcctgctttttcgtccagggcgttgtccttgcagttgggagctttagtgcactctcctgttaattgccctctcctcgggtttagtgcggtcagtacttccctcccgcagggttatctgtgggtgggcggaggccaggagggggcaggtggccaagttgaaatcttttcgctcaatcggcctagccccaggaccgtgaaatcttttccccttgcggctcccgtcctttgtatggagtatattcctgagctcgaggaggaggccgaatcaagggacgaaagtcctaccgttgctgacccatctgccaccgttcatcccaccatttgcctggggttacaggacggctccatactcctctacagttcggtggacacgggaacccaatgtctggtgtcgtgcaggtcgccaggattacagcctgttttatgcctaaggcacagtcctttccatctcctggcagggctacaggatggaactctcgcggcatatcccaggacctctggtggcgtgttgtgggatttagaatctccaccggtgtgcctcacagtaggcccagggccagtccggaccctgctgagcctagaagacgcagtctgggccagttgcggcccatgggttaccgtgctggaggcgacaactttgcaacctcagcagtccttcgaggcccatcaggatgaagccgtttccgttacccacatggtcaaggcaggcagcggggtgtggatggcattctcgtctggcacctccattaggctgttccacacggaaacccttgagcatttacaagagattaacatagccacaagaaccacatttcttctgcccggtcagaagcacttgtgcgttacatctttgcttatatgccaggggctgctgtgggttggcacagatcagggggtcattgtgttgctgccagtgccccgactcgagggtatcccaaaaattactgggaaagggatggtgtcactgaacggccattgcggccctgttgcctttctggcagtggcgacttcaatcctcgcacctgatatactgcggagtgaccaggaggaagccgagggccctcgagctgaggaagataaacccgatggtcaagcccatgagcccatgccagacagccacgtgggcagagagctcacaagaaagaaaggcattctgctgcagtacaggctgcgttcaacagcccaccttcccggaccactactttccatgagggagcccgctcccgctgacggtgccgcactggagcatagtgaggaggacggctctatctatgagatggccgatgacccagacatttgggttagaagtcgcccatgcgctagagacgcccaccggaaagagatctgctcggtggcaatcattagtggtgggcaaggctacaggaactttggcagtgcgctcggttccagcggcagacaagctccgtgtggtgaaaccgactccacacttctgatttggcaggtcccacttatgctttag

SEQ ID NO: 238787 - DNA, 1467 bp, Artificial Sequence
  Description of Artificial Sequence: Synthetic coding sequence
atgacacagctgatgaaggccgcaaagtctggaacaaaggacggcttggagaaaacgcgtatggccgttatgcggaaggtaagcttcctccacaggaaagatgttctgggggactctgaggaggaagacatgggcctgttggaagtgtcagtgagtgatatcaagccacccgcacccgaacttggtccaatgccggaaggactctcccctcaacaggtggtaagaaggcacatcctaggctcaatcgtgcagtcagaaggatcgtacgttgaaagcctgaagagaatcctccaggactataggaatccactcatggagatggagcccaaggccctgtccgcaagaaaatgccaggtggtgtttttccgtgtcaaggagatcttacactgtcactctatgttccagattgccctcagcagccgcgtcgccgagtgggattcaaccgagaagattggtgaccttttcgtcgcatccttttccaagtcaatggtgctcgacgtgtacagcgactacgtgaataatttcacgagcgcaatgtccatcatcaagaaggcctgcctgactaagccagctttcctggaatttctgaagaggcgccaggtgtgttctcccgatagagttaccttatacggtctgatggtaaaacccatccagcgcttcccccagtttatcctgctactacaggatatgctgaaaaacactccacgtgggcacccagatcgcctgagcttgcagctggcgctaacggaactagagacccttgcggagaagttgaacgagcagaagagattggccgatcaagtagccgagatccagcagctgactaagtcggtcagcgatcgatcttccctaaacaagctgttaacctcaggccaacgccagctgctgctctgcgagactctcacggagacagtgtatggcgataggggccaacttattaaatccaaggaaaggcgagtattcttactgaacgacatgctggtctgcgcaaacatcaactttaaacccgctaaccaccgaggccaattagagatatcgtctctcgtgcccctgggccctaagtacgtggtaaagtggaatacagctctacctcaggtgcaggtcgtggaagtcggacaagatggaggtacatatgataaggacaatgttcttattcagcactccggcgcaaaaaaggcatccgccagcgggcaggcccagaataaggtctatctaggcccacctcggttatttcaggaactccaagatctacagaaagacttggcagtcgtagaacagatcacacttttaatttctactctccatgggacataccagaacctgaatatgacagttgcccaagactggtgtctggccctgcagcgcctcatgcgtgtgaaggaggaagaaatccactccgccaataagtgtcggcttagactgcttctgcccggaaaaccagataaaggcacgtggtcagacatgtag

SEQ ID NO: 238788 - DNA, 3204 bp, Artificial Sequence
  Description of Artificial Sequence: Synthetic coding sequence
atggcgtcgagcaatccaccgccacagcccgctatcggggatcagctggtaccgggagtgcccggtccatcttcagaggccgaagacgacccaggagaggcctttgagtttgacgactccgatgatgaagaggacactagtgccgctctgggagtgccatccctggctcccgaacgcgacacagatcccccattaattcacttggactcaattcctgtgactgacccagacccggctgcggctccccctggaaccggggtgcccgcttgggtgagcaacggagacgcggcagacgccgctttctccggcgcaagacacagttcctggaaacgaaagtctagcagaaggatcgaccgattcactttcccagccctagaggaggatgtaatatacgacgacgtaccttgcgaatcccccgatgctcaccagcctggcgctgagagaaatcttctgtacgaggatgctcatcgtgccggagctccaaggcaagctgaggatcttggctggtcttcctccgagttcgaatcttattctgaagatagcggagaggaggcaaagccggaagttgaggtagagccagcaaagcaccgggtcagctttcagccaaagctatcacccgacctgactaggcttaaggagcgctatgccaggacaaaacgggacattttggctctgagggtaggaggtcgggatatgcaggaactgaagcacaagtatgactgcaagatgacccagctgatgaaagccgcaaagagtggcactaaagatgggcttgagaaaaccagaatggctgtgatgcgcaaggtgagctttttacatagaaaagacgtgctcggggactcagaagaagaagatatggggctactggaagtctcagtatcagacataaaaccccctgccccagagcttggcccaatgccggaaggcctctccccccagcaagttgtccggaggcatatcctcggatcaattgtacaaagcgaggggtcctacgtagaatccttgaaacgaattttacaggattaccggaaccctctcatggagatggaaccaaaagccctgagcgcccgtaagtgtcaggtcgtgttctttagggtaaaggaaattttgcactgtcacagtatgttccagattgctctgagttcaagagtggccgaatgggattcgacagagaagatcggcgacctgtttgtagcatctttcagcaagtcgatggttctggatgtgtattccgattatgttaacaatttcacttccgcaatgtctatcataaaaaaggcttgccttactaaacccgctttcctggaatttttaaagcgccgacaggtatgttctcccgatagagttaccctgtatgggcttatggtaaaacctatccagcggttccctcaatttattttgcttttacaggatatgctcaagaacacaccaagaggccatccggacagactgtccctgcagctcgcgctgactgaactggaaactctggcagagaagctgaatgaacagaaacgcctggcagaccaggtggcagaaatccagcagctgacaaaaagcgtgtcagatcggagcagcctgaacaagctgctgacctcaggtcaacggcagctcttactatgcgagacacttaccgagacagtttatggagacaggggccagctgatcaaaagtaaagagaggcgtgtgtttctgctaaacgacatgcttgtatgcgccaacatcaattttaagggccaactcgaaatcagctccctggtgccactggggcctaagtatgtggtcaaatggaatactgcgctgcctcaggtccaagtggttgaggtgggccaggacggcggaacttatgacaaggacaacgtcctcatccagcactctggagccaaaaaggcatctgcctcaggtcaagcgcaaaacaaggtgtaccttggccctccacgtctgttccaggagttacaggatctccagaaagacttggccgtggtagagcaaatcacactcctgatctctacactccacgggacataccaaaaccttaatatgacagtggcccaagactggtgcctcgccctgcagcgacttatgcgtgttaaagaggaggagatccacagcgcgaacaagtgtcggctaaggctcctccttcctggcaaacctgacaaaagtgggaggcctatctcgtttatggtagtcttcataacaccgaatccacttagcaaaataagctgggtgaatcgcctgcacctggcaaagattggcctcagagaagagaatcaacctgggtggttgtgtccggatgaagacaaaaaatccaaagcccctttctggtgtcctatattggcctgctgtatcccagctttcagcagccgtgctctctctttgcagttaggtgctcttgtgcactcccccgttaactgtcccttgctcggatttagcgccgtctctaccagcttgccacagggatacctctgggttggaggagggcaagagggagctggcggtcaggtggaaatattctcactgaatcgcccaagccccagaactgtgaagtccttccctttggccgcacccgtgttatgcatggaatacatcccagagttagaggaggaggccgagtctcgggatgagtctcccactgttgccgatccgtcagcaactgtacacccaacaatctgccttggactccaggacgggagcattctgttatatagctctgtagacacgggaacccagtgcctggtgtcatgccgatctcctggcctgcagcctgttttatgtctgcgtcacagcccttttcacctattagctggactccaggacggaaccctagccgcatatcccaggacaagcggtggcgtgctgtgggacctcgaaagtcccccagtgtgtctgactgtgggaccaggtccagtgcgcaccctattgagcctcgaggatgctgtttgggcatcttgtggaccctgggtgactgtgctggaagcaacgaccctacagcctcagcaatcctttgaagctcaccaagatgaagccgtgagcgtgacacacatggtcaaggcagggtccggcgtttggatggctttttccagtggaacaagtattaggctgtttcacacagaaacccttgaacacctgcaggaaataaacatcgcaacacgcaccaccttcttgctccctgacaggtcacttattaaatgttctcctcgggcttag

SEQ ID NO: 238789 - DNA, 3723 bp, Artificial Sequence
  Description of Artificial Sequence: Synthetic coding sequence
atggcttctagtaatccgccaccacagcctgcgatcggagatcagttggtcccgggtgttcctggcccatcctctgaggccgaggatgatccaggcgaggcattcgagttcgacgactctgacgatgaagaggatacctccgccgctcttggcgtccctagcctcgccccagaaagggatacagatccgcctttaattcatctcgactcgatcccagtaaccgatcccgatcccgctgccgctccacctggaacaggagtgccagcttgggtgtcaaacggcgacgccgcagacgccgcattctctggggctcgccatagttcatggaagcgcaagtcttcccggaggatcgaccgctttacattccccgctttggaggaggatgttatctatgatgacgtcccctgcgaaagtcccgacgcccaccaaccaggggcagagagaaatctgctgtacgaagacgctcacagagcaggggctccccgtcaggccgaggacctcggctggtcaagctccgaattcgaatcctactctgaagattccggagaggaagcgaagcccgaagtggaggtcgagccggcaaaacatcgggttagcttccagccaaaaatgacacagctgatgaaagctgccaagagcgggacgaaggacgggcttgaaaagacacgcatggctgtgatgcggaaggtctcattccttcataggaaagacgtcctcggggatagcgaggaggaagatatggggctcctcgaagtgtcagtgtccgacattaagccaccagccccagaacttggtcccatgcccgagggcctgtctccccagcaggtagtgagacggcatattctcgggtcaatcgtccagtccgagggttcttacgtcgaatcacttaagaggatcctacaagattacaggaacccattgatggagatggagcccaaagccctgtctgcacgcaaatgtcaagtggtgtttttcagagtcaaggaaatcctgcattgtcactctatgttccagatcgctttaagctctagggtagccgaatgggactctactgagaaaattggtgacctctttgtggctagctttagcaaatctatggtcctcgatgtgtactccgattatgtgaataattttacatccgctatgagcattatcaaaaaggcctgcttaacgaaacccgcattcctggagttcttgaagcgtagacaagtctgctcgcctgaccgtgtcacactctacggcctgatggtgaaacctattcaacgcttccctcagttcatcctgctgcttcaagatatgttgaaaaacacacctagaggccaccctgatcgcctaagtcttcagctggctctcacagaactagagacactcgcagagaaactgaatgagcaaaaacggttggcagaccaggtcgccgaaatacagcaactgactaagtctgtaagcgatagatcctcattgaacaagcttttgacttctggccagagacagttactcctatgcgagaccctgaccgaaaccgtctacggggacaggggccaactgattaagtccaaggaacggcgtgtgttcttgctgaacgacatgctggtctgcgctaacatcaattttaagccggcaaatcacagaggccagctggagatctcctctctggtcccgcttggcccaaaatacgtcgtcaagtggaatactgctttgccacaggtccaggtcgtggaagtaggccaggacggaggaacctacgataaggataacgtcttaatacagcattccggagccaaaaaagcctctgcctccgggcaggctcagaacaaggtctacctgggaccaccccgtctgttccaggagcttcaggacctgcagaaggacttagctgtcgttgaacagatcactttgctgatatcaaccctgcatggcacctaccagaaccttaatatgacagtggcccaagactggtgtttagccctgcaacgtctgatgagagtgaaagaggaagaaatacactccgcgaacaagtgccgcctgagactgttgctacccggtaagcctgataaatcaggcaggcctatttcttttatggtcgtatttattacacccaatcctctcagcaaaatctcttgggtgaatcggctgcacctggccaagatcggattacgggaggagaaccagcctggctggttgtgtcccgatgaggataagaaatctaaggcacctttctggtgtccaatcttggcctgttgtatcccagcgttcagctctagagctctttcactccaactcggggctctggtacactctccggttaactgcccactgcttggattcagtgctgtgagtacttcgcttccccaggggtacctttgggttggagggggtcaggagggggcagggggtcaggtcgagatctttagcctgaatcgcccaagccctaggacagtgaagtcattcccattggccgcaccagtcctgtgtatggagtacattccagagctggaggaagaagctgagtcgcgtgatgaatccccaacagtagcggatcccagcgccaccgtgcaccctaccatctgcttaggtctccaagacggatcgattctgctctactcttccgtggatacaggaacacagtgcctcgtgtcctgcaggtccccaggattacagcccgtgttatgcctgcggcacagcccattccacctcctcgctggccttcaggatggtacactggccgcatacccaaggactagtgggggagtgctgtgggatcttgagtctccaccggtgtgtctgaccgttgggccaggacctgtgcgcacgctactgtccctggaggacgctgtttgggccagctgcggcccatgggtcaccgtgcttgaagcaactaccctgcaaccgcagcagagctttgaagcccatcaggacgaggcggttagcgtgactcacatggtcaaggccggaagcggagtgtggatggcattctctagcggcacaagcatccgcctcttccacaccgaaaccctagagcacctgcaggagataaatatcgccacccgaaccacttttctgctcccaggccaaaagcacctgtgtgtcacaagcctgctcatttgtcaggggttattgtgggtggggaccgatcagggcgtgatagtcctgttgccagtcccacggctggagggcattcccaagattacaggcaaggggatggtttctctcaacggacactgtggacctgtcgcctttctcgcagtggccaccagcatactcgccccagacatcctcagatccgatcaggaggaggccgagggcccaagggccgaagaggacaaaccggacggacaggctcacgagcctatgccagatagtcacgttggaagggagttaactcgtaagaaaggcatactgctgcagtatagactgcgatccaccgcccatttgcccggtccactcttgagtatgcgagagcctgccccagctgacggcgctgctcttgagcatagtgaagaggatgggagcatctacgaaatggccgacgatcccgacatttgggtgaggtcaaggccatgcgcacgggacgcacatcgaaaggagatctgctccgtggccataatcagcggcggacaaggttatcggaactttggaagtgctttggggagcagcgggaggcaggcgccttgcggtgagacagattcaaccctactaatttggcaggtcccccttatgctgtag

SEQ ID NO: 238790 - DNA, 3129 bp, Artificial Sequence
  Description of Artificial Sequence: Synthetic coding sequence
atgctcccctcgtcaagctggggcaaacgcaaactgaggggaaggctggggtgggttagatcagatgcacgaggggtgatgtgggcaagacaggaaggtctgcaccatcctcacccccacgccgtaattcggtgtccgagtagtagtagctcgagcgtctcttgcagcggagattcagaggaagaagacatgggacttctcgaagtaagcgtgagtgacataaaaccacctgcacctgagctagggccaatgccagaagggctttcccctcaacaggtggttaggcgccacattctggggtccatcgtgcagtccgagggctcatatgtcgaatcccttaaaagaattctgcaggattatagaaaccccctgatggaaatggaaccaaaggcgttgagcgccagaaaatgccaggtcgtgttttttagggtgaaggaaatcttacattgtcactccatgttccagatcgctctcagttcccgtgtcgccgaatgggattcgacagaaaagatcggcgacctctttgtggcatccttcagtaagagcatggttctggacgtgtacagcgactatgtgaacaacttcacaagtgcgatgagcataattaagaaagcctgtctcaccaaaccagcatttcttgagttcctgaaaaggcgccaggtgtgttctcccgacagagtaaccctctatgggcttatggtgaaacccattcaacggtttccacagttcattctccttctgcaggacatgcttaagaacaccccacggggtcacccagacagattgtctctccagctggctctgacagaactggagactctcgctgaaaagctgaatgagcagaagaggctcgccgatcaggttgccgagattcaacaactcacgaaatccgtcagtgacaggtcaagtctcaacaagttgctcacttccggacagagacagctgctgctgtgcgagacactgacagagaccgtgtatggagatcgagggcaactcatcaaatccaaagagagacgggtgttcttgttaaatgatatgctggtctgtgctaacatcaacttcaaggggcagctggagatcagctccttggtgccgctgggcccaaagtacgtggttaaatggaatacagccctaccccaagttcaggttgtcgaagtgggccaggatggcggtacctacgacaaagacaatgtccttatacaacattcgggcgcaaagaaagccagtgcatcgggccaagcacagaacaaagtatacctgggcccaccacgcctttttcaggagcttcaggacttgcaaaaggatctggcagtagtggagcagattactctactaatttccaccctgcatggtacttatcagaatctgaacatgaccgtcgcccaggactggtgcctggctctccagcgcttaatgagagtgaaagaagaggagatccactctgcaaacaaatgcagactccgactgttgctccccggtaaaccagacaagtccggcaggcctatctctttcatggttgttttcatcactcctaaccctttgtctaaaatttcatgggttaatcggctgcatctggcaaagatcgggttaagggaggagaaccaacccggatggttatgtcctgacgaggataagaagtccaaggctccattctggtgcccaatcctggcctgctgcatacccgcattttcctcacgcgctttgtcactgcagctcggcgctcttgtccactctcccgttaactgtcctctgctcggattctccgccgttagtacatcactcccccagggttacctgtgggtcggaggcggacaagagggagccggaggacaagtggaaatcttctccctgaatcggccatcacccaggacagttaagtcatttcccctagccgctccagttttatgtatggaatacataccggaactggaagaggaagctgaaagtagggatgagtcaccgacggtggccgatccctctgcgacagtgcatcccacgatttgcctggggctgcaagacggctccattctgctgtactcgtcagttgacacaggcacccaatgtctcgtgtcctgcagatccccaggcctccaacccgtcctgtgcttgcgccactctccttttcatctgctggctggcttacaagatggtactctggcagcttatcctcgcacctcaggcggtgtgctttgggatctggagtccccccctgtgtgcctaactgtcggccctggcccagtcagaactctcctgagcttggaagatgcggtgtgggcgagctgcgggccttgggtaacagtactagaggctaccacgcttcagccccagcagagtttcgaagctcaccaggatgaggctgtgagtgtaacacacatggttaaggctggcagtggggtctggatggctttttccagcggcacttcgatcagactgtttcatacagaaacattggaacacctgcaagaaatcaacattgccactaggaccacgtttctgctgcccggacaaaagcacctctgcgtcaccagcctgctcatttgccaagggttactctgggtcggaaccgaccagggcgtgatcgttttgctccctgttccaaggttggaggggatccccaagatcactggtaagggcatggtctctctcaacgggcactgcggtcctgtggccttcctcgcagtagcaaccagcatactggccccagacatcctccgctctgaccaggaagaggcagaagggcctcgggctgaggaagataagcctgatgggcaagcccacgaaccaatgccagactctcatgtaggccgagaattgactaggaaaaaagggattttgctacagtaccgtctgcgctccactgcgcacctgccagggcctctcctctctatgagggaacctgccccagccgatggagccgcactcgagcacagcgaggaggatggttcaatctacgaaatggctttttttctcaaagccaaaaatactaaaccccataactgcctggcaagccccgtgagcctggtctgggcccttgctggtctacagggttcccatacccctctgctcgagggatgcgtgagagtgtccgtctgcgagtgcgtgggctggtgcgtaaatatctacaagtag

SEQ ID NO: 238791 - DNA, 4577 bp, Artificial Sequence
  Description of Artificial Sequence: Synthetic coding sequence
atgtcagggactcagtctaccattacggatcgatttcccctgaagaaacccatcagacacggctctattcttaaccgagagtcacccactgacaaaaagcaaaaggttgaaagaattgcaagccatgacttcgatcccacaggtctggtacagagatgtgtgatcatccagaaagacgacaacggcttcggactcacggtgtccggagacaaccctgtctttgtgcagtccgtgaaagaagacggggcagctatgagggcgggtgttcagacaggcgatcgcatcataaaggtgaacggtactctggtcacacactctaaccacttggaagtggtgaaactaataaagtcagggagctacgtggcactgaccgttcagggcagaccacctggcagcccacaaattcccctcgccgattctgaggtggagccaagtgtcataggccacatgtcgcctatcatgacaagcccacattcacctggagcatcagggaatatggagcggataacctctccagtgttgatgggagaggagaataacgttgtgcacaatcagaaggtggaaatcctccgcaagatgctgcagaaggaacaggaaagattacagctgctacaggaggactacaacagaacccccgcacagaggctcctcaaagaaatccaggaagcaaagaaacacattccgcagctgcaggagcagctctcaaaagccaccggcagcgctcaggatggtgccgtggtaacacctagtcgcccactaggcgatacccttacagtatccgaggccgaaaccgatcctggcgacgtactggggaggacagactgtagctctggggatgcctccagacctagctccgacaatgcggatagccccaagtccggtccgaaggagcgcatttacctggaggaaaaccctgaaaaaagtgagactatccaggacacagatacacaatcattggtcggctctccttccactaggattgctccccacataattggggctgaagacgatgatttcggaactgagcacgaacagatcaatggtcagtgtagctgctttcagagcattgagttgctcaagagcagacctgcgcacctggccgtctttctccatcatgtggtctcccaatttgaccctgcaacactcctttgctatctatatagtgacctatataagcatacaaactctaaggagactaggcgcatcttcttggaatttcaccagttttttttagataggagtgcacatcttaaggttagcgtaccggacgagatgagtgccgatttggagaaacggcgacccgaactcatccctgaagatctacaccggcactatatccaaacgatgcaggaacgtgtgcaccctgaagtgcagcgacacctagaagacttccggcaaaaacggagcatgggtctaacgctggctgaaagcgaactgacaaagctcgacgcggaaagagataaagacagactgaccttagagaaggagcggacatgcgccgaacagattgtggcgaagatcgaagaggtccttatgaccgcccaggcggtggaagaggataagagctctacaatgcagtatgtaatacttatgtacatgaaacatctcggagtcaaagttaaggagcctaggaatctggaacataagaggggaagaatcggctttttgcccaagattaagcaatccatgaagaaagataaggaaggtgaagagaagggtaaacggagaggttttccctccatcctcgggcctccgagacggccttctaggcatgataacagcgctattggcagagccatggagctacagaaagcaagacatcccaaacacctgtcaacacctagtagcgtgtctccagaacctcaggatagcgctaagttacgtcagtccgggcttgccaacgaggggactgacgccggatatctgccggctaattccatgtcgagcgtggcatcaggcgctagcttttcacaagagggaggcaaggagaacgacaccggcagcaaacaggtcggcgaaacctccgcgcctggtgatacactcgatggcactcccagaaccctgaacaccgtcttcgacttccctcccccaccgctcgatcaggtccaagaggaggagtgtgaagtggagcgggtaactgaacacggcactccaaagccattccggaaatttgatagtgttgctttcggagaaagccagtcagaggatgaacagtttgagaacgacttggaaacagatccacccaattggcagcagctggtgagccgggaagtgttactgggcttaaagccttgtgagattaaacggcaggaagtcataaacgaactcttctacaccgaacgagcgcacgtccgcaccctgaaggttctggaccaggtcttctaccagagagtgagtagagagggcatcttgtccccatccgagctgcggaagattttctcaaacttggaagatattttacaactccacatagggcttaacgagcaaatgaaggcggtgagaaagagaaatgaaaccagtgtgattgaccagattggcgaagacctcttgacctggttttctggccctggagaggaaaagttgaaacacgccgctgcgaccttctgcagtaatcaaccatttgccttggagatgatcaagtcccggcagaagaaggactcccggttccaaaccttcgtgcaagacgctgaatctaaccccttgtgccgacgcttgcagctcaaagatatcatccctacccaaatgcagcgcttaaccaagtatcctctccttctggacaatatcgccaagtatacagaatggccgacagagcgcgagaaagttaaaaaggcagctgaccactgccgccagattcttaattacgtaaatcaggccgtgaaggaagccgagaacaaacagcgcctcgaagattaccagagacgcttggatacaagctcactgaaactgtcagagtaccctaatgttgaggagttacgaaacctggatttgactaaacggaaaatgattcatgaaggtcccttggtctggaaggtgaatcgtgacaaaaccatcgacctctacactctgcttctggaggatatcttggtcctcctgcagaaacaagacgaccggctcgttctccggtgccattctaagatcttagcaagcacagccgattccaagcacacattctcccctgtaatcaaactctctacagtgctcgtcagacaggtggccacagacaacaaagcgctgttcgtcatcagcatgagcgacaacggagctcagatctacgaactcgtggcacagaccgtctccgagaaaactgtgtggcaggacctcatctgtcgcatggcggctagcgtcaaggaacagtccacaaaacctatacccctgccgcagagcaccccaggtgaaggggataacgacgaggaggatccttcgaaactgaaagaggagcagcatggaatatctgtcactggcctccagtcacctgatagagacctgggcctggaaagtactctcatctcttccaagccgcaatcacactccctgtcaactagcgggaaaagtgaggtaagggatctgttcgtggctgagcggcagttcgccaaagagcagcatactgatggtactttgaaggaggtgggggaagattaccagatcgctattccagacagtcacttgcctgtgagcgaagaaaggtgggcgctggatgccctgcggaatctcggactccttaagcagttactggttcaacagctggggctgactgagaagagcgtgcaagaggattggcaacacttccctagataccgcacagctagtcagggcccacagacagactccgtcattcagaactccgagaatatcaaggcctatcattccggggagggccacatgccctttagaaccgggaccggagatattgccacctgctattcgccaagaacctccacagaaagttttgcgccacgagattctgtggggttggctccgcaggatagtcaggcaagcaacatcctggtcatggatcacatgatcatgacaccagaaatgcccacaatggagcctgagggaggacttgatgattctggtgagcatttcttcgacgctcgggaggcacatagtgatgagaacccaagcgagggcgatggagcagttaataaggaggagaaggatgtcaacttgcggatttctgggaactatctgatcctggacggctacgatcccgttcaggagtctagcaccgacgaggaggtagcatcttcacttacactacagccaatgaccggtatccctgccgtggagtctacacatcagcagcagcatagcccgcaaaacacacattcagatggagccatcagcccctttactcccgagtttctggtgcagcagcgctggggtgccatggagtactcatgctttgaaattcagtcgccatcaagctgcgcagattctcagagccagattatggagtatatccataaaatcgaggccgacctcgaacacctcaagaaggtggaggaaagctatacaatcctgtgtcagagacttgctggcagcgcacttactgacaagcactccgacaagtccta

SEQ ID NO: 238792 - DNA, 4634 bp, Artificial Sequence
  Description of Artificial Sequence: Synthetic coding sequence
atgtctgggacgcaaagcaccattaccgaccggttccctctgaagaagccaattcgacatggctccattttaaatcgggagagccctactgacaagaagcaaaaagtggaacggatcgccagccacgattttgatccaacagattctagttctaagaagacaaaatcgagttccgaggaaagtagatcagaaatctacgggttggtgcaaagatgcgtcattattcagaaggacgataatggattcggtttgacagtcagtggtgacaaccctgtgttcgttcagagtgtgaaagaagatggagcagccatgcgggcaggcgtccagacgggagataggataataaaagtcaacggcacactggtgacccactcaaaccacctggaggtcgtaaagctcattaagagcggtagctatgtggccctcacagttcagggccgaccaccaggctccccccagatccccttggcagacagtgaggtggagcctagcgtgatcgggcatatgagcccaatcatgacttcacctcattcaccgggagcttcaggaaacatggaacgcatcaccagccccgtgctgatgggggaagagaataacgtggttcacaatcagaaagtggaaatccttcgtaaaatgctgcaaaaagaacaggagagactgcagctgctgcaagaggactacaacagaactcctgcgcagagactgctgaaggagatccaggaagcgaaaaaacacattccccagctccaagaacagctgagcaaagctaccggaagcgcacaagacggcgcagtggtaactccatccagacccctgggggatacgctgacagtttctgaggcagagacagaccccggagacgtgctcggccgaactgactgtagcagcggagacgcctcccggccatcgtcagacaatgccgatagcccgaagtccgggccaaaggaaagaatttacttagaagaaaaccctgaaaagagcgagaccattcaagacaccgatacccagagccttgtagggtcgccttcgacccggatcgctccccatataattggggctgaagatgatgatttcggcaccgagcacgagcagatcaacggccagtgtagctgtttccagagtattgagctcctgaagagtagacctgctcatcttgcggtttttctgcatcatgttgtctcacaatttgatcccgctacccttctgtgctacttatattcagatctctacaaacataccaacagcaaggagacaaggagaatttttctggagtttcatcagttttttctggatcggtccgcacatctgaaagtgtccgtgccagatgagatgagtgccgatctggaaaagcgccgaccagagcttatccctgaagacctgcatcggcattacattcaaaccatgcaggagcgtgtacatcccgaagtgcagaggcacttagaggattttcggcagaaacgctccatgggattaaccttagccgagtcagagttgaccaaactggacgcggaaagggataaagataggctcacattggaaaaggagcggacatgtgccgaacagatagttgccaagatcgaggaggtccttatgacagcccaggctgttgaagaggataaaagctctaccatgcagtatgttattctgatgtatatgaaacatttgggagtaaaagtgaaggagccccgtaacctcgagcataaaaggggccgaatcggcttcttaccaaagataaagcagtcaatgaaaaaagataaggagggggaagagaagggcaaaaggcgcggtttcccaagcatcttgggaccaccccgacggcctagccgtcacgacaatagcgccatcggccgagcaatggaactgcagaaagctcgccatcctaagcacctgagcaccccatcctctgtcagtccagaaccacaagattccgctaagctgcgccagtctgggctcgcgaatgagggcactgatgctggctacttgccggctaatagtatgtcgtccgtggccagcggtgcctcctttagtcaggaaggaggcaaggaaaacgacacgggttcaaaacaggtcggtgagacgagtgcacctggggacacactggacggtacccctcggacattaaatacagtgtttgatttcccgcctccccctctcgaccaggtgcaggaagaagagtgtgaggtcgaacgagtgaccgagcatggcacgcccaaaccttttaggaaatttgactctgtggcattcggagagagccagtccgaggacgaacagtttgaaaatgacctggagacggacccacctaactggcagcagctcgtaagtagggaggtgttgctcgggctgaagccttgtgagattaagcggcaggaagtgatcaatgagcttttttacaccgaaagggctcatgtgcgcacgctgaaggtcttagatcaggtgttttatcagcgcgtatccagagagggcattctgagcccttcagagctgaggaagatattctctaacttagaggacatcctgcaattgcacatcggcctcaacgagcaaatgaaggctgttaggaaaaggaatgaaactagtgtgatcgatcaaattggagaagaccttctgacatggttttccggacctggcgaggaaaaactcaagcacgctgctgcaactttttgtagcaatcagcccttcgctctcgaaatgattaagagccgccaaaagaaagattcaagattccagacattcgtccaagatgctgaaagtaaccccctatgtcggaggctgcagctcaaggatatcattcccacccagatgcagaggctgacaaaataccctctcctgctcgataatattgcaaagtacaccgaatggccgactgagcgcgagaaagttaaaaaagctgcggaccactgccgtcaaatcctgaactatgtcaatcaggctgtaaaagaagccgagaataaacaacggttagaggattatcaaagaagactggatacatcatccttaaaactcagtgagtacccaaatgttgaggagttaaggaacctggacctcactaagaggaagatgattcacgaagggcctctggtgtggaaagtaaatcgcgacaaaactattgacctgtacaccctgctgctggaagatattctcgttctgctccaaaagcaggacgacaggctcgtgctgcgatgccattcaaagattctggccagtactgccgactcgaaacacacatttagtccagtgatcaaactcagtaccgtcctggtgcgtcaggtggctacagataataaagccttattcgtcatttctatgagcgataatggggcacaaatctacgagctcgtagcccagacggtgagcgaaaagacagtgtggcaggacctcatctgccgaatggcagctagcgttaaagaacaatctactaagccaatcccactgcctcagtcgacccctggtgagggcgataatgacgaggaagacccgtcaaagctgaaagaggaacagcacggcatttcagtgacagggctccagtctccagatagagatctcggcctagagagtacgctgatttcctccaagccacaaagccactcattatccacatctggtaaaagcgaggttcgcgacctttttgtagccgaacgccaatttgcaaaggaacaacacaccgacggcactctgaaggaggtgggggaggactaccagattgcaattccagattctcacctgccagtgagcgaagaaaggtgggccttggacgctcttcgcaacctagggctgctaaagcaactgctcgtacagcaattgggattgacggaaaagagcgttcaggaagactggcaacattttcctaggtacaggaccgcatcccaggggccacagactgattctgtgattcagaactcggagaacataaaggcttaccatagcggggagggacacatgccgttccgtacgggcacaggagacatcgcaacctgttatagcccacgcacttcaacagaaagtttcgcaccgagggattccgttggattggcaccgcaagacagccaagcctcaaacatcctggtgatggaccacatgattatgacccctgagatgccaaccatggaacctgagggcggactggatgattcgggggaacacttcttcgatgctcgggaggcccattcggatgagaacccgagtgaaggggacggggcagtcaataaagaggagaaggacgtgaacctgcggatctccggaaattatcttatcctcgacggatatgatcctgttcaggagtcatctaccgacgaggaggtcgcctcctccttgaccctccaacctatgactggaataccagctgtcgagagcacccaccagcagcagcatagccctcagaatacccattcagacggagcgatctccccattcacaccggagttcctcgtccagcagaggtggggggcaatggagtactcctgctttgagattcagtcaccatcttcatgcgcagactcacagtcccagatcatggaatatattcacaagattgaggccgacctggagcatctgaaaaaagtggaggagagttacacaatactgtgccagcgactggcgggatccgctttaaccgacaaacacagtgataagagcta

SEQ ID NO: 238793 - DNA, 2409 bp, Artificial Sequence
  Description of Artificial Sequence: Synthetic coding sequence
atggactgtgggccacccgctaccctacagccacacctcacaggacccccaggcaccgcgcaccatcctgtggcagtgtgccaacaggagtcactctcgtttgcagagcttcctgcactgaagcccccttctcccgtgtgcctggatttgtttcccgtggctccagaggagttgagggcacctgggtccaggtggagccttggtaccccagctccccttcagggtctcctgtggcctttgtcacctggaggttccgatacggaaattacctccggaggcatgagaccaagccgagctgggagctggccgcattgtcctggagctcagccacctgctcttgaagggccatggagtccacggcacacccagccccagcggcgagcctcacacggcagtgaaaagaaatccgcatggagaaagatgagagtgtatcaacgagaagaggtgccaggatgtccagaggcacatgccgtctttctcgaacctgggcaggtggtccaagagcaggcgttaagtactgaggagcccagagtggagctgagcggatctactcgagtgtccctggaaggacccgagaggcggaggtttagcgcatcagagctgatgactcggcttcactcttccctcaggcttggacgcaacagcgcagcaagggctctgatctccgggtcaggcaccggagctgcgagagagggaaaagcctcaggcatggaggctcggagtgtcgagatgagcggtgacagggtgtcccgtcccgcacctggagattcgcgcgaaggagactggagtgagcccagactcgatactcaagaagagcccccattgggaagtagaagcacgaacgaaagacgccagtccagatttctgctgaattcagtcctttatcaagaatattctgacgtggcctctgctcgcgaactccggcgacagcagcgagaggaggaaggccctggagacgaggcagaaggcgcagaggaaggcccaggccctccgcgtgcgaacttgagtcccagctcctctttccgggcacagcgtagcgcccgtgggagcactttttcactgtggcaagatatccctgatgttagaggcagcggcgtgttagcaactttatcactcagggactgcaagttacaggaggctaagtttgaattaatcacaagtgaggccagttatatccactcactgagcgtcgctgtgggtcactttctcggatcagctgagctgtccgaatgcctgggtgcacaggacaaacaatggctgttctccaaacttccggaggttaagagcacatctgagagatttttgcaagacctggagcaacgcctggaggccgatgttctgagattctctgtgtgcgacgttgtgctggaccactgcccggctttccgacgcgtttacctcccatacgttactaaccaagcttatcaggaacggacataccaaagactgttgctcgagaaccccaggtttccgggtatcctggctcggttagaggagtctccggtctgtcagcggctgccattaacttcctttctcattctgccttttcaaagaatcactagacttaagatgctggtggagaatatcctgaagagaacagcccaaggctctgaagatgaggacatggccaccaaagcgttcaacgcgttgaaggaactggtgcaggaatgtaatgcctccgtgcagagcatgaagcggacagaggagctaatccatctttctaaaaaaattcactttgaagggaaaatatttcctctgatctcacaggccagatggctggtacgacacggggagcttgtcgaactcgcccctttgccagccgcaccacctgcgaaactgaagctgtctagcaaggcggtgtatttacacctattcaacgattgcttgctgctgtctcgcagaaaggagctcggtaagtttgccgtttttgtccatgccaagatggctgagttacaagttcgcgacctttcactgaagctccaggggatcccaggccatgtgttcctgctacagctgttgcatggacaacatatgaagcatcaattcttgctccgagctaggaccgaatctgaaaagcaaagatggatttccgcactttgtccctctagccctcaagaggataaagaggtgatctccgagggtgaggactgtccacaagtccagtgcgttaggacttacaaagcactccaccctgacgagctcaccctcgaaaaaactgacatcctgagcgtaagaacctggacaagcgatggatggctggagggcgttagacttgctgatggagaaaagggatgggtgccacaggcgtatgtggaagagataagtagcctctcagccaggctgaggaatcttcgagagaacaagcgggtgaccagcgcaacctctaaactgggagaggctcccgtctag

SEQ ID NO: 238794 - DNA, 1575 bp, Artificial Sequence
  Description of Artificial Sequence: Synthetic coding sequence
atggattgtggccctccggcaacactacagccccacttgaccggcccacctggtactgcccatcatccggttgcagtatgccagcaagagagcctgagtttcgccgagctgccggctcttaagcccccaagccctgtgtgtctagacctattccccgtggctcccgaagagttgagagcgccaggcagtagatggagtttgggaacgcccgcacccctgcaaggacttctgtggccgctgtctcccggaggatccgacacggaaattacctctgggggaatgaggcccagtcgcgcaggcagttggccacactgtcctggagcccagcctccagccttggagggaccctggtctccacgccacacccagcctcagagaagggccagtcatggcagtgagaaaaaatcagcctggaggaagatgcgcgtgtaccagagggaagaggtacctggatgtcctgaggcacacgccgtgttcctcgagccgggacaagtggtgcaagagcaggctctttctaccgaggaaccaagggtggaactgagcggctccacccgcgtatcactggaaggacccgagcgcagacggttttcggcctcagaattgatgacgcgcttgcatagttctctgagattgggacgcaactctgccgctagggctctgatctcaggaagcgggaccggagccgcaagagaaggcaaagctagcgggatggaggctaggtcggtcgagatgtccggagaccgagtgagtaggccggctcctggtgattctcgagagggagactggtccgagccgcgacttgacacacaggaggagccacctttgggctcacggtccacgaacgagcgacggcagtccagatttctgctgaacagtgtcctctaccaggagtattctgatgtggcctccgctcgggaactgcgtagacagcagcgcgaagaggagggacctggagacgaggcggaaggcgctgaggagggtccaggcccaccacgggcaaacctgtcaccaagctcctcttttcgggcacaacggtcagctcgcggttcaacctttagcctgtggcaagacatcccagatgtgcggggatcaggtgtgttggccacactgtcacttcgagattgcaagttgcaggaagctaaattcgaacttatcacctccgaagcctcctacattcactccttatcagtggcagtagggcatttcctcgggagcgcagagctgagcgaatgtctcggagcacaggataagcaatggctcttctcaaaactcccggaggtgaagtctacctcagagcgtttcctccaggatctggagcagcgactggaagctgacgttcttaggttttctgtgtgcgatgttgtgctggaccactgccccgcatttcgcagggtgtacctcccctacgttaccaatcaagcatatcaggaacgcacctaccagagattgctgctggaaaatcctaggttccctggaatcctagcaaggctcgaggagagccctgtttgccagcggttaccactaaccagcttcctgatcctgcagcccccaggaggccaggggggacaccaatag

SEQ ID NO: 238795 - DNA, 1509 bp, Artificial Sequence
  Description of Artificial Sequence: Synthetic coding sequence
atggattgtggccctcccgctacactgcagcctcacctgacaggtccaccaggcaccgctcatcatcctgttgccgtttgtcaacaggagagtttatcctttgcagaactacctgccctgaaaccgcctagccccgtatgtctggacctgttccccgttgcacccgaagaattgcgagcgcctggctctcggtggtcgttgggcacccccgctccattgcagggcctgctctggcctctgtcccctggaggcagcgacaccgaaatcacctccggtggcatgcgccctagtcgggcagggagctggcctcattgtccaggagcacagccccctgctctcgaaggcccatggagcccaagacacactcagccccaaaggagggcatctcacggcagcgaaaaaaagtcagcttggcgcaaaatgcgcgtatatcagagggaggaggtgcccggatgtcccgaggcgcatgccgtattcttggaaccgggacaagtggtgcaggagcaagccctgtctacagaggagcctagagtggaactctccggatctacaagagtctctctagagggcccagaaagacgaaggtttagtgctagcgagcttatgacccggctgcactctagcctgcgcctgggtcgcaattctgccgctcgggctttaatcagtggttcaggtaccggcgctgcaagggagggcaaggcctctggcatggaagccagatccgtagaaatgtccggcgaccgcgtgtctcgaccagcccctggcgatagtcgagagggtgactggtccgagcccagactagacacacaggaggaaccgcctctagggtctcgctccacaaatgagaggcgacaatcaaggttcctgcttaacagcgtcctgtatcaggagtacagtgacgtggcaagcgcgagagagctgcggaggcagcaaagagaggaggaaggccctggcgacgaggcagagggagccgaagaaggaccaggacccccaagagcaaatctctcaccctccagctccttccgggctcagaggtctgcccgaggttccacctttagcctctggcaagacattcccgacgtgcggggttcaggagtcctggctacactgagcctgcgtgactgtaagctgcaggaagccaagtttgagcttattacctccgaagcctcttacattcatagcctcagcgttgcagtgggacattttctcgggtcagccgagctgagcgaatgtctgggcgctcaggataaacagtggctattttctaagctacccgaagtgaagtctactagcgaaagatttctgcaggacctggagcagcgccttgaagccgacgtcctgaggttctccgtgtgtgatgttgtactagaccactgtcccgcattccgtagagtgtacctgccttatgtgacaaaccaggcctatcaagagaggacctatcagcggctccttcgggaaaataagcgcgtcactagcgcaacttcaaaactgggggaagccccagtctag

SEQ ID NO: 238796 - DNA, 504 bp, Artificial Sequence
  Description of Artificial Sequence: Synthetic coding sequence
gagcgactggcgcaattccctgccgcaggacgcggtagccccggtccaccgggtgctcgactgggagtgggactggaaaaaggtagaggcagggaagtatggaggccaggcgtttggggctgtgaggcaagggcctcagaggtgaactggtcatgtccctttgacccggtctgcgctctgccacaggcaaagttcgagctgatcacttcagaggccagctacatccattctctgtccgtggccgtgggccattttctgggctcggccgaactttccgagtgccttggtgcccaagataagcaatggctcttttcaaagctgcccgaggtgaagtcaaccagtgaacgctttcttcaggacttggagcagaggctggaagcagacgtgttaagatttagtgtgtgtgacgtggtgctcgatcactgtccagcatttcggagagtttatttaccgtacgttacaaatcaagcttatcaggaaagaacataccagagattgctctag

SEQ ID NO: 238797 - DNA, 924 bp, Artificial Sequence
  Description of Artificial Sequence: Synthetic coding sequence
tgacgagatagaggtcaggagcggctggctcagttccctgcagcaggaaggggcagtccgggtccccctggtgcccgactaggagtgggactcgagaaaggaagaggtagggaagtgtggaggccaggcgtatggggatgcgaggcaagggcctctgaagtcaattggtcatgtccctttgatcccgtctgtgctctcccgcaggccaagttcgagctgatcaccagcgaagcctcctacatccattccctgtcggtggccgtggggcattttctgggcagcgccgaactctctgagtgtctcggggctcaggacaagcagtggttattttccaaacttcccgaagttaagtctacatctgagcgctttctgcaggacctggaacaacggttggaagctgatgtactgcgattcagtgtgtgtgatgtggtgttggatcattgccccgcttttcgcagagtttacctgccatacgtgacgaatcaggcttaccaggagcgcacttaccagagacttttgctggaaaatccacgtttcccaggcatcctcgccaggctggaggaatcgcccgtctgccagaggctgcctcttacgtcatttcttatactgcccttccagagaatcacccgccttaagatgctagtggagaacattctgaaaagaacggcccagggatctgaagacgaggacatggctaccaaagcgttcaacgcgttaaaggagctggtacaagaatgcaatgcaagtgtacaatctatgaagcgcaccgaagagctgattcacctgtcgaaaaaaatccattttgagggtaaaatatttcccctaatctcccaggcacgctggctcgtccgccatggtgaactggtggaactagccccactgcccgctgcccctcccgctaaactgaagctgagttccaagtag

SEQ ID NO: 238798 - DNA, 1581 bp, Artificial Sequence
  Description of Artificial Sequence: Synthetic coding sequence
atggtcgctaaggattaccctttctatctgactgtcaagcgtgcaaactgtagcctggagctgccccctgcaagcggcccagctaaagacgcagaagaaccctccaacaagagagtcaagcccttatcacgcgtgacttctctggccaaccttattccaccagtcaaagcgacgccgctaaaacggttttcccagacattgcagagatctatctcctttaggtccgaaagtcgtccggatatcttagccccaagaccttggtcacgcaacgccgcaccatccagcactaagcgccgagactctaaactctggagtgagactttcgatgtgtgcgtgaatcaaatgctcactagtaaggagattaagagacaggaggcgatcttcgagctgagccagggcgaagaggatctcatcgaggacctgaaattagccaaaaaggcttaccacgatcccatgctgaaactctctattatgaccgaacaggaactgaaccagatcttcggaactctggactctctaattccactgcatgaggaactcctgtcacagcttcgcgacgtcaggaagccggacggcagcaccgagcacgtagggccaatactggtgggctggctgccctgcctgagttcatatgattcttattgtagcaatcaggtggccgctaaagccctactggaccacaaaaagcaagaccatagggttcaagactttcttcaaagatgcctcgaatctcctttcagtcgaaaactggatctttggaatttcttggatattccacgcagccgcctagttaaataccctctcctcctcagggaaattcttcgccatactcctaatgataacccagatcaacaacatttggaagaggccattaatattatacagggaattgttgcagaaattaatactaaaacgggcgagtcagagtgtaggtattacaaggagcggctgctatatctggaggaaggccagaaggatagtcttatcgactctagtagggtgctgtgctgccatggagagcttaaaaacaatagaggggtgaagctgcacgttttcctatttcaagaggtcctcgtcatcactagggccgtaacccataacgaacagctctgctaccaattgtaccggcagcccatccccgtgaaggatcttctccttgaagacctccaagatggagaggtgaggctgggaggctcattgagaggagcattttctaacaatgagaggattaagaattttttccgggtgtcttttaagaacggctcgcagagccagacacatagcctccaagccaacgatacgttcaataagcagcagtggctgaattgcattagacaggcaaaggagacagtgctctgcgctgcagggcaggcaggcgtgttggactcagagggctcattcctgaaccctaccaccggatcccgggagcttcagggagaaacgaagctggagcaaatggaccaatccgactcggaaagtgattgttcaatggacaccagcgaagtttcactggactgcgaacgcatggagcagaccgactctagctgtggcaatagcaggcacggggagtccaatgtctag

SEQ ID NO: 238799 - DNA, 1677 bp, Artificial Sequence
  Description of Artificial Sequence: Synthetic coding sequence
atggatagctctaccgcaatgaaccagtgctcctgtagggggatggaagagaataaagagaggcctaagaggcagcgtcagaacaactttcctatgttcccctctcccaaagcttggaacttcaggggacggaagcgtaagcaatccacccaagacgaggacgccgtgtcgctgtgctccttggatatctctgagccgtcaaacaaaagggtcaaacctttatcccgcgtcacctccctggcaaatcttatacctccagtcaaagcaactcccctgaaaaggttttcacagaccctgcagcggagtatttctttccggagcgaaagtcgcccagatatactggcgccacgcccttggagccgcaacgcggcaccaagctccacaaagcggcgtgattctaaactctggtcagagactttcgacgtatgcgtcaaccagatgctcacatctaaggagatcaagaggcaggaagctatctttgagctcagccagggggaggaggacctgatcgaggatttaaaactggctaaaaaggcctatcatgatcccatgctcaaactgtcaataatgacagagcaggagttgaatcaaatctttggtaccctggattctctcatacccctgcatgaagaactgctttcccaactgcgcgacgttaggaagcctgacggcagtacggagcacgtgggtcccattttggtgggctggctgccctgtttgagctcctatgactcctactgttctaatcaggtggctgccaaagcgctcttggaccacaagaagcaagatcatagggttcaggactttctgcagcgatgtctcgaatctcctttctctagaaagctggacctctggaactttctcgatattcccagaagcaggctcgtgaagtatcctttgttactgcgtgagatcctgagacataccccaaacgacaacccagaccagcagcacctggaagaagctatcaatatcattcagggaatcgtggcggaaataaataccaaaacgggcgagagcgaatgtaggtactacaaagagagactcctctacttggaggaagggcagaaggattcacttatcgattcttcaagagtgttgtgttgtcacggagagctgaaaaacaaccggggagtcaaactacacgtgtttctgttccaagaagttctggtcattacccgggcagtcacacacaacgagcagctttgctatcagttgtatcgccagcccattccagtcaaggatctcctgctcgaggatctgcaagatggagaggtgagactaggcggttccctgcgaggagctttctccaacaatgaacgaattaaaaattttttccgagtgagctttaagaatggctctcagagccaaacacactccttgcaggccaatgatactttcaacaagcagcagtggttaaactgtattcggcaggccaaggaaacagtgctttgtgccgctggacaggcaggggttctcgactccgaaggcagcttcttaaacccaaccaccggcagccgagagcttcagggagagaccaagctggagcagatggaccagtcagactcagagagcgactgcagtatggatacaagtgaagtgagcctggattgcgagagaatggagcagacggacagctcctgcgggaacagtcgccacggagaatccaacgtatag

SEQ ID NO: 238800 - DNA, 1599 bp, Artificial Sequence
  Description of Artificial Sequence: Synthetic coding sequence
atgattgaagtgtgccaccataattggctcctttggctctgtccatctaagttcggcatctttatgtgctgtctcgcaagcacgaccgggcaaatggagttaagacgaaccagggagccttcaaataagcgcgttaagcccttgagtcgggtaacatctctggctaacttgatccccccagtcaaagccactcctttgaaaaggttctctcagaccttgcagagatcaatttcttttaggtccgaatctcgaccagacatcctggccccaaggccttggtctcgcaatgccgctccctctagtacaaagcggagagactccaagctctggtctgagacttttgacgtctgcgtgaatcagatgcttacatcaaaagagatcaagcgacaagaggcaatcttcgaattgagtcagggagaggaggatctgattgaggatttgaaactggctaagaaagcctatcatgaccccatgctgaaactgtccatcatgactgagcaggagctgaatcagatttttgggactctggacagcctcatccctttacatgaggaactgctgagccagctccgcgacgtaagaaagccggacggcagcaccgagcacgtgggccctattcttgtgggatggctgccttgcctgagttcatatgattcgtattgcagcaatcaggtagccgctaaggcactgttggaccacaaaaaacaggatcatagagtgcaggatttcctccagcgttgtctcgaatcccccttcagcaggaaacttgacctgtggaatttcctggatatcccaagaagcaggctcgtgaaatatcccctcttgttgcgggaaattctgcgccacacgccaaacgacaaccccgaccaacagcatctcgaagaagccattaacattattcagggaatcgtcgccgaaatcaacaccaaaacaggtgaaagcgaatgccgttactataaagaacgtcttctttacctcgaggaaggacagaaagacagcttgatcgactcctctcgcgttctttgctgtcatggcgaactaaaaaataatagaggggttaagctgcacgtcttcctctttcaggaagttctggtcatcacccgtgcggtcactcataatgaacagctgtgttatcaactgtatcggcagccgattcctgttaaggacctgctgcttgaagacctccaggacggggaagtgagattaggtggcagcctccggggagcattttcgaataacgagagaatcaagaatttcttcagagtatccttcaagaatggcagtcagtcgcagactcattccctgcaggccaacgacacattcaataaacaacaatggctaaactgtattcggcaggcaaaagagacggttctttgtgccgcaggacaggctggggtcctcgattctgagggctcttttctcaatcccaccacaggatccagggagctccagggagaaactaagctcgagcagatggatcagtcagacagcgaaagtgattgtagcatggacacgtccgaagtaagcctggactgtgaacggatggagcagacagactcttcgtgtggcaattcaaggcatggcgagtctaatgtgtag

SEQ ID NO: 238801 - DNA, 2073 bp, Artificial Sequence
  Description of Artificial Sequence: Synthetic coding sequence
atgccttgggaagaacctgctggggagaagccatcatgcagccacagtcaaaaggctttccatatggagcccgctcagaagccctgctttaccactgatatggtaacgtgggcactgttatgtatctccgcggagactgtgcgcggagaggctccttctcagcctcggggtattccacaccgctcaccagtgtccgtagacgatttatggttggaaaagactcaacgcaagaaattgcaaaaacaggcccacgtggaaagaaggctccatattggcgcagtgcataaagatggcgtgaaatgctggcgaaagacaattatcacaagccctgagtcgctgaatctgcccaggaggtcacatcccctgtcacagtccgccccaaccggattgaaccacatgggttggcccgaacatacaccaggcacagccatgcctgatggcgctctggacaccgccgtttgcgctgacgaggtggggagtgaggaggacctatatgacgacttgcactccagttcccaccactattcccaccctggcggtggtggcgagcagttggctatcaacgagctcatctctgatggttctgtggtttgcgccgaagccctgtgggaccacgtgactatggacgaccaggaactagggtttaaagccggagacgtgatcgaagttatggatgccactaacagggaatggtggtggggtcgcgtcgccgatggtgagggctggttccctgcttctttcgtgaggctgagagtcaatcaggatgagcctgctgatgacgatgccccactggcaggcaactcaggggctgaggacggcggagccgaagcccagtcatctaaagatcagatgagaaccaacgtgatcaatgagattctgagcaccgagagggattacatcaaacacctgcgggatatatgcgaggggtacgtgcgtcaatgcagaaaacgagctgatatgttcagcgaggagcagcttcgaacaatattcggcaacatcgaggacatctatcgttgccagaaagcatttgttaaggcactggaacagagattcaatagggaacgcccacacctgagtgagttaggcgcatgcttcttagagcatcaggccgatttccagatctactcggagtattgcaataaccaccccaatgcatgcgtagaactgagcagactgaccaagctgtccaaatatgtctattttttcgaggcatgtagactgctacagaagatgatcgatatttctcttgatgggttcctgttgacgcctgtgcagaagatttgtaagtacccccttcaactggctgagttactcaaatacactcacccacagcatagagactttaaggacgtggaggctgctctccacgccatgaagaacgttgcgcaactgattaatgagcggaaacgcaggctcgagaacatcgacaaaatcgcacagtggcagagctcaatcgaggactgggaaggtgaggatctcttagtacgatcctcagagctaatctactcgggtgagctgactagagtgacccagcctcaggcgaagtctcagcagaggatgttctttttatttgaccaccagttaatttattgtaagaaagacttactgcggcgtgacgtgctctactacaaggggagactcgatatggatggcctggaagtggtagatctggaggatggcaaggaccgggatctgcatgtttcaatcaagaacgcctttcggctgcatcgtggtgctacaggtgactcccaccttctgtgcaccagaaagcctgagcagaagcaaagatggcttaaggctttcgctagggaaagagaacaggtgcagctcgaccaggagacgggtttctctataacagagttacagcgaaagcaagccatgctgaatgcttcaaagcagcaggtcacaggcaagcctaaggctgtggggagaccatgctacctcactaggcagaagcacccagcactgccttcaaaccgaccccaacaacaggtactcgtgcttgctgaaccgagacgcaaaccatcgactttttggcattccatcagtcgtcttgccccattcaggaagtag

SEQ ID NO: 238802 - DNA, 1860 bp, Artificial Sequence
  Description of Artificial Sequence: Synthetic coding sequence
atgcggccagatggccaacaggcactggacgctgtggtgcggagcttcgactgccactcagaggctgccctgcgccagcgcaacgacgtgatatactgttcactgcctaggactgcacaaggtattgttcagcgcgaggatcagctcgaggtcctggtgtcattaagggaggtctgggggagaagacgcggtagagatgggacctgtaccggtgctatgccggacggggctctcgacaccgcagtgtgtgccgatgaagtagggtctgaggaggacttgtatgatgatctgcatagttcgtcacatcattacagccatccgggtggagggggtgaacaattggcaatcaacgagttgatctccgacggtagtgtcgtatgcgctgaggcactatgggaccacgtcactatggacgaccaagaactggggtttaaggctggtgatgtgatcgaggtgatggacgctactaaccgtgaatggtggtgggggcgtgttgcagatggcgaagggtggttcccggcttcattcgtccggctaagagtgaaccaagacgagccagctgacgacgacgccccattagccggtaactcaggcgctgaagatggtggggcagaggcacagtcatccaaggatcagatgcggacaaatgtaatcaatgagatcctgtccaccgaaagggactatattaaacatttgcgcgacatctgcgaaggctatgtccggcaatgccgcaaaagggctgacatgttttccgaggaacaattgcgcactatctttggaaatatagaggatatttatcgctgccagaaagccttcgtgaaagcgctggaacagcgatttaaccgggaaaggccacacctttctgaactgggagcctgcttcctcgaacatcaggcggactttcaaatttactccgagtattgcaacaatcaccctaacgcctgcgtggaactcagccgcctgaccaaactgtccaagtatgtctatttctttgaggcttgtcggctcctccaaaagatgatcgacatcagcctggacgggttcctactcaccccggttcagaaaatctgtaaatatcctctgcagctggcagaactgcttaagtacactcaccctcaacaccgggacttcaaagacgtggaggcggcactgcatgcaatgaagaacgttgcccagctgatcaacgaacgaaaacgaaggctggaaaacattgataaaatcgcccagtggcagtcttctatcgaggattgggagggggaggacctgctggttcggtcttccgagctgatttactccggagagttgaccagggtgacccagccacaagctaagtctcagcagcgcatgttcttcttgttcgaccaccagctgatttactgtaaaaaggacctcctgaggcgtgatgtcctctattataaagggcgacttgacatggacgggctggaggttgtcgacctggaagatggaaaagatagggaccttcacgtcagcattaagaatgcgttccgccttcataggggcgctactggagattcacatctgctttgcacacggaaacccgaacagaagcagagatggcttaaagcctttgcaagagagagggagcaagtgcagctcgaccaagaaacagggttcagcataacggaactgcagaggaaacaggccatgttgaacgcatcaaaacaacaggtaactggaaagccgaaagcggtcgggagaccgtgctatctgactagacagaagcatcctgccctcccgtcaaacagaccacagcagcaggtcctggtgcttgcggagccacgccgaaaaccaagtactttttggcatagcattagcaggctggctcccttccgtaaatag

SEQ ID NO: 238803 - DNA, 2013 bp, Artificial Sequence
  Description of Artificial Sequence: Synthetic coding sequence
atgccttgggaggagcccgcaggcgaaaaaccgtcatgcagtcatagccagaaggcctttcacatggagcccgctcagaaaccctgctttacaaccgacatggttacctgggccctgttgtgcatcagcgctgagacggtgcggggtgaagcaccctcccagcccaggggtatacctcatagatctcccgtgtccgtggacgatctgtggctcgaaaagacacagaggaaaaaattgcagaaacaggcccacgttgaacgacgcctgcacatcggtgcggtgcacaaggacggcgtgaaatgctggcgcaagactatcatcacctcacccgaaagtctgaatctacccagaagatcccatcctctctctcagagcgccccaacaggactgaaccacatgggctggcccgagcatacacctggtactgcgatgcctgacggagctctggataccgccgtatgcgctgatgaagtaggtagcgaggaggatctgtatgacgatcttcactctagtagccatcactattcgcaccccggtggaggcggtgagcagctcgcaattaacgagctgattagcgacggcagcgtggtctgtgctgaggccctgtgggaccatgtcactatggacgaccaggagctcggttttaaggccggagacgttatcgaggtgatggatgcgaccaatcgggagtggtggtgggggagggtggctgacggggaaggttggtttcccgcatcattcgtgcggcttagagttaaccaggatgagcccgcagacgatgatgcacccctcgcaggtaacagcggggctgaggatggcggagctgaagcccagtcttccaaagaccaaatgagaacgaatgtgattaatgagatcctctctaccgaacgtgactatattaagcatctcagagacatatgcgaaggctatgttcgccaatgccgcaagcgagcagatatgttcagtgaggagcaactgcggacaatcttcgggaacattgaggatatttataggtgtcagaaggccttcgtcaaagcactggaacagcggtttaaccgggaacggcctcacttatccgagctcggagcctgtttcctggaacaccaggctgattttcagatttacagcgagtactgcaataatcatcccaacgcttgtgtggaactgtcccgtctgactaagctcagcaagtacgtttattttttcgaagcgtgccgcttgctacaaaagatgatagacattagtctcgatggtttcttgctgacacccgtacagaaaatctgtaagtatcccctacagctcgctgagctgctgaagtacacccaccctcagcaccgcgattttaaggatgtcgaggcagcgctacatgcaatgaagaatgtcgcacagctcattaatgaaaggaaacgaaggttggagaatatcgacaaaattgcgcaatggcagagctccatcgaggactgggagggcgaagatctgctggtgcggagtagcgagttaatatactccggcgagctgacacgagtcacccagccccaggcaaaatctcagcagcgtatgttttttttgttcgaccaccagctcatttattgtaagaaggatttattgcgcagggacgtgttgtactacaaaggcaggcttgatatggacggcctcgaggtggtcgacctggaggatggcaaagatcgtgacctgcatgtgtcaattaagaacgctttccggctccacagaggcgcaacaggcgacagtcatttactttgtacaaggaaacccgaacagaaacagcgatggctgaaagccttcgctcgcgagcgcgaacaggtgcagctcgaccaagaaacgggattctccataacggaactgcagaggaaacaagccatgcttaacgccagtaaacagcaggtgaccggcaaacctaagggtcgccgtacagccgctcccccaccacgccttccaggcccataccccgctgacataataccattctcagaaccccagtcccaggctagctag

SEQ ID NO: 238804 - DNA, 1893 bp, Artificial Sequence
  Description of Artificial Sequence: Synthetic coding sequence
atgccctgggaagaacctgccggagagaagccaagctgctcccacagtcagaaggcattccatatggagcctgcccagaagccctgctttactacagacatggtcacctgggccctgttatgtatctctgccgagacagttcgcggagaagcaccttcccagccccgaggcatcccacacagatcccctgtgtctgtggacgatctctggttggaaaagacgcaacgaaagaaactccagaagcaagcccacgtcgagcggaggctgcacatcggggcagtccataaagacggggtgaaatgctggcgaaagaccataatcactagtcctgagtcccttaacctcccacggcgtagtcacccactgtcgcagtcggcccctacgggcctgaaccacatggggtggccggagcacactcctggtactgccatgcccgatggcgcactagacacagccgtgtgcgccgacgaggtcggcagcgaagaagacttgtacgacgatctgcacagctcttcgcaccactatagccaccctggcggaggcggagagcagctggccattaacgaactcatcagcgatggaagcgtggtgtgtgcggaggccctatgggatcatgtgactatggacgaccaggagctggggtttaaggccggtgacgtcatcgaagtgatggacgcaactaatcgcgaatggtggtgggggagagtggccgatggcgaggggtggtttcctgcatcatttgtacggctccgcgttaatcaggacgagcccgcagacgacgatgcccctctggcaggcaacagcggagcagaggatgggggagcagaggctcagtcttctaaggatcagatgcgtacaaatgtgattaacgaaatactttccactgagagggattacatcaaacatttacgggacatctgtgagcaggcagatttccagatttatagcgaatactgcaacaaccatcccaacgcttgtgttgaactctccaggttaaccaagctgtctaagtatgtctatttttttgaagcttgccggctactgcagaagatgattgacatcagcttggacgggtttctcctgacacctgttcagaaaatttgtaagtacccgctacaacttgccgaactcttaaaatatactcacccccagcatcgggacttcaaggacgtcgaggctgccctgcacgctatgaagaacgtggctcagctgatcaatgaaaggaaacgaaggttggagaacatagataaaatcgcccagtggcagtcgagcattgaagattgggagggcgaagacctgctcgttcgctcttcagagctgatctacagcggcgaactcacccgggtcactcaaccccaggccaaatcccagcagcggatgttttttctgtttgaccatcagctcatatactgcaagaaggacctgctccggagggacgtgctgtactacaagggcagactagatatggatgggttagaagtagtggatttagaagatggaaaggatagggacttgcatgtgagtattaaaaacgcctttaggctccatcgcggtgccacgggagacagccacctgctgtgcactcgaaagccagagcagaaacagagatggctgaaagcctttgccagggagcgggagcaggtccaactggatcaagaaacgggcttcagtatcactgagctgcagaggaaacaggccatgctgaacgcttctaaacagcaagtcaccggcaagcccaaagccgtcggaagaccttgttacctgacaaggcaaaaacaccctgctcttccttcaaacagacctcagcaacaagtgctcgtgctggcggagcctagaaggaagccctccactttttggcacagcatctccagactcgccccatttaggaagtag

SEQ ID NO: 238805 - DNA, 579 bp, Artificial Sequence
  Description of Artificial Sequence: Synthetic coding sequence
atgccctgggaggagcccgcaggcgaaaagccgtcttgttcgcactctcagaaggcttttcatatggagccagcacagaaaccttgcttcacaacagacatggttacatgggcactgctgtgcatttccgccgaaacagtaaggggggaggcaccgtcacagcctcgaggaatccctcaccgctctccagtgtccgtggacgacctctggctggaaaagacccaacggaagaagttgcaaaaacaagctcacgttgaaaggcgcttgcacatcggtgctgtacataaggatggcgtcaagtgttggcgcaagactataattacgtcacccgagtccttgaatttgccccgacggagccaccccctttcccaatccgccccaaccggcctgaaccacatgggttggccggagcataccccgggtacagccgtcggacggccttgctatctgacccgtcagaaacatcccgcacttccttcgaatcggccacagcagcaggtactcgtactggctgaaccgcgacggaagccctcgacattctggcattccatctcccgcctcgccccatttaggaaatag

SEQ ID NO: 238806 - DNA, 2013 bp, Artificial Sequence
  Description of Artificial Sequence: Synthetic coding sequence
atgccctgggaggaacctgccggtgagaaacctagctgtagccattctcagaaggctttccacatggagcccgctcagaagccttgcttcactaccgacatggtgacctgggcgctgctgtgtataagtgctgagacagttcggggtgaggcaccctctcagccacggggaatcccgcatagatctccagtaagcgtcgacgacctatggcttgagaaaacccagcggaagaaacttcaaaaacaggcccacgtcgaacgcagattgcacataggggctgtgcacaaagacggcgtgaagtgttggaggaagacaatcattacatctccagagtccctcaatctgcctagaagatctcacccactgtcacagagtgccccaacaggtttaaaccatatggggtggccggagcatacccccggaacggctatgccagacggggctttagacaccgccgtgtgcgccgatgaggtgggcagcgaggaagacctatacgatgacctgcattcaagttcccatcactacagtcatcccggaggcggtggcgagcaactagcaataaatgagctgatctcagatgggagtgtggtctgtgccgaagcgttgtgggaccacgtgactatggatgaccaggagctaggtttcaaggcaggagatgttatcgaagtcatggatgctaccaacagagaatggtggtggggacgcgtggcagacggcgaaggttggttcccagcttcatttgtgcggttgagggtcaatcaagacgagccggcagacgatgatgctcctctggcaggcaacagcggcgctgaagacggcggagctgaggcacagagttccaaggaccaaatgagaaccaatgtcattaacgagattctttctaccgagcgagattatataaaacatctacgtgacatatgtgaaggctacgttcggcagtgtaggaagagagccgatatgttttctgaggaacagttgcgcaccatatttggcaatattgaagatatttaccgatgccagaaagcttttgtgaaggctctcgaacagagattcaaccgagagcgtcctcacctgtctgagctgggagcatgcttcctagagcaccaggccgattttcagatttattcggagtactgcaacaaccatcctaacgcttgtgtggagctctctcggcttaccaagctgagtaaatacgtgtatttttttgaagcctgtcgtttgctccagaagatgatcgacatctcactggacggcttcctcctgacccccgtgcagaaaatttgtaagtaccccctccaattggccgagctgcttaaatatacccatccacagcatcgggactttaaagacgtggaagccgctctgcacgcgatgaagaacgtggcacaacttattaacgagagaaaaagacgactggagaatatagacaaaattgcccagtggcagtcgagcatagaagactgggagggagaagacttgttagtgcgcagtagtgagctgatatacagtggagagctgacacgggtgacacagccccaggccaaatcacaacaaaggatgttttttcttttcgaccatcagttaatctactgtaagaaagatcttcttaggagagacgtactgtattacaaagggaggttggacatggatggccttgaagtggtggatctggaggacgggaaagatcgagacttgcacgtatccattaagaatgctttcagacttcacagaggtgccaccggcgattctcatctcctgtgcactagaaaacccgaacagaagcagcgatggttgaaagcgttcgctcgcgaacgcgagcaagtgcaactcgaccaggagacggggttcagtatcaccgaactgcagaggaagcaggctatgctcaacgctagcaaacagcaggtcaccgggaaaccaaaaggacgtaggactgccgctccacccccacgcctgccgggaccttaccccgctgacataatcccattctcggaacctcagagccaagccagttag

SEQ ID NO: 238807 - DNA, 4794 bp, Artificial Sequence
  Description of Artificial Sequence: Synthetic coding sequence
atggaggcagaagaggcccagaggggagcaagccctcctatcagtgccattgaggagttctcaattattcctgaggccccaatgcggtcttcacaggttagtgccttgggtctggaggcccaggaggatgaggacccaagctataagtggagggaagaacatcggctgagtgccacccagcaatcggaactccgagatgtgtgtgattacgctattgaaactatgccttcatttccaaaggagggcagtgcggacgttgaacccaaccaagaaagtttggtggctgaggcctgtgatacaccagagcactgggaagccgtgcctcagtcgcttgccggaagacaggccagaacgctggctcccccagagctctgggcctgtccaattcaatctgagcacctggacatggcccctttttctagcgaccttgggtctgaggaagaagaagtggaattttggcccggactgactagcttgaccctgggaagtgggcaagctgaagaagaggaggagacaagcagtgacaacagcggccagacacgctactatagcccttgcgaggaacatccagccgaaaccaaccagaacgagggatccgagtccggtacaatcagacagggcgaggagctccctccggaagaacttcaggaatctcagggactactccacccacaggaagtgcaagttcttgaggagcaggggcagcaggaagcaggttttcgcggtgaagggactctgcgcgaagacgtatgtgccgatgggctcttaggggaagaacaaatgatcgaacaggtcaatgacgagaaaggcgaacagaagcagaagcaagaacaagtgcaggacgtaatgctggggcgacagggggagaggatgggcttaaccggcgagcccgaaggactgaacgatggcgaatgggaacaagaggatatggagcgcaaggctcaaggtcagggaggacccgagcagggtgaagaaaggaagagggagctgcaggttcctgaggaaaaccgcgctgacagccaggacgaaaaatcccaaacgttcctgggaaagtcagaggaagtgactggaaaacaggaagaccatgggataaaggagaagggagtccccgtctcaggccaggaggctaaggaacccgagagttgggatggaggacggttgggagcggtgggcagagcccgaagcagagaagaagagaacgagcaccatggacctagtatgccagctctgattgctccagaggactcaccacactgcgatctttttccaggggcatcatacctgatgacacagattccaggcacgcagactgaatctcgagccgaggagctctcccctgctgctctctctccatctttagaacctatcaggtgttctcaccagccaattagcctgttgggtagctttttaaccgaggaatcaccagacaaggagatcgatcagaactctcagcaggaagaatcccgactgagaaagggcacagtcagcagtcagggcaccgaggtggtgtttgcgtccgcgagcgtcacccctcccagaacgcctgatagtgctcccccatcaccggcagaggcctatcctattactcccgcatctgtgtccgccagaccgcctgtcgcttttcctcgcagagaaacgtcctgtgccgctcgggcacctgagactgcctctgcaccattaagtatggacgaccccagtccgtgtgggacctccgaaatgtgtccagccgcactgtacggattcccgtctactggaacgtcaccacccagaccacccgctaactccacaggaacagtgcagcacctacgctctgattccttccccggaagtcacaggaccgagcagactccagacctcgtgggcatgcttctatcctattcgcattcggaactaccgcagcgccctcccaagcctgccatatacagttctgtgacccctagacgagacagacgttcagggagagattacagtacagttagtgcatctccgaccgctttaagcaccctgaagcaagactcacaggaaagcattagcaatcttgagcgaccctcctccccgcctagcatccagccttgggtgtccccacacaacccggcttttgctaccgagtcaccagcttacggtagtagcccctcctttgtctctatggaagatgtccgaatccacgagccccttccacctccacctccccaaagaagggacacgcacccttctgtcgtcgagacagacgggcatgcacgagtcgtggtccctactctgaagcaacacagccatccccctcctctcgccctcggtagcggactgcacgctcctcacaaaggcccactgccccaggcgagtgaccccgcagtggccagacagcaccgccctttgccatctactccagacagcagccatcacgctcaagcaaccccacgctggcgttacaataaacctctcccgccaacccctgacttgccacagccacacctgcctcctatctccgctcctggcagctcacggatctaccggcctctgccaccgctcccaatcatcgatccccctactgagcctccacccctcccccctaagagccgcggacgctcccggagcacaagagggggtcacatgaactctggtgggcacgctaaaacccgcccagcctgccaggactggacagtcccgctaccagcttcagccggaaggacatcctggcctcccgcaactgcccgttctactgagagctttacctccacgagccgatccaagtcagaagtgtcccctggcatggcatttagtaacatgaccaacttcctgtgtccttcttcgccaactacgccatggacaccagaacttcaaggtccgaccagcaaagacgaggcaggggtgtccgagcaccccgaagctcctgcaagagaaccacttcgccgaaccactccccagcagggcgctagcggacccggacggtccccagtggggcaggctcgccagcccgaaaagccaagccacctacacctcgaaaaagcttcatcatggcctcacagaagggatagcggccgaccccctggcgatagttctgggcaggcagtcgctccatctgaaggtgccaataagcacaagggatggtccaggcaggggctgcggaggccgtcaattctacccgaaggatcttctgattctagaggccctgcggtggagaagcaccctggaccttcagacaccgtggtgttccgcgagaagaaaccaaaagaagtgatggggggattttcccgcaggtgctcaaagctaattaatagcagccagctgctctatcaggaatacagtgacgtcgtgctcaacaaagagatccagtcccagcagagactggagagcctttccgagaccccagggcctagctctccgagacagccacggaaggccctggtgagcagcgaatcatatctccaacgcctgtcaatggcgtcctcaggcagcctatggcaggaaatacccgttgtcaggaactctacagtcctcctgagcatgacccatgaggatcagaaactgcaggaggtgaagtttgagctgatcgtgtccgaagcttcgtacctgcgcagtctgaatatcgccgtagaccattttcaactgtcaacatccctccgggctaccctgagtaaccaggagcaccagtggctcttttcacggctgcaagacgtgagagatgtcagtgctacgtttctctccgacctcgaagagaacttcgaaaacaacattttctcttttcaggtatgtgacgtggtgttgaaccatgcccctgactttagaagagtgtacctcccctatgtgactaaccagacctatcaagagagaacgttccagagcttgatgaactccaactctaatttcagggaggtacttgagaaactggaaagtgatccagtctgtcagaggctatccctgaagagcttcctgatcctgccgtttcagaggatcacacgacttaaactcctgttgcagaatattctgaaacgaacgcaacctgggtcttctgaagaggcggaggcgaccaaggcacaccacgcgcttgaacagctcattcgggattgtaataacaatgtgcagtctatgcggaggaccgaagagctcatttacctgagccagaaaatcgaatttgaatgcaaaatctttcctttaatctcccaaagccgctggctcgttaagagtggggagctaaccgccctcgagttttccgcctcgcccggattgcggagaaagttgaatacccgtccagtgcacctgcacctgtttaatgattgtctgttattatcccggcctcgcgagggcagcagatttctggtgttcgatcacgccccattctcttccatccgtggtgagaagtgtgagatgaagttgcatggaccacacaagaatctgttccggctttttctccgccagaatacacagggtgcccaagcggagttcttattccggacagaaactcagtctgaaaagctgagatggatatcagcgctggctatgcctagagaggagctggatctactggagtgctataactcccctcaggtgcagtgtttgagggcctacaaaccccgtgagaacgatgaactcgccctagagaaggcagacgtggtgatggtgacgcaacagtctagtgatggatggctggagggtgttagactgtctgacggcgagcgcggttggttcccagttcagcaggtggagttcatctcaaacccagaagttcgtgctcaaaatctcaaggaagctcaccgcgtcaagacagccaaactgcaacttgtggaacagcaggcttag

SEQ ID NO: 238808 - DNA, 1197 bp, Artificial Sequence
  Description of Artificial Sequence: Synthetic coding sequence
atggcctcctccggcagcctttggcaggaaattccagtcgtccggaacagcaccgtgttattgagcatgacacacgaagaccagaaattacaggaagtgaagtttgaactcatcgtgagcgaagcgtcctacttaaggagtcttaatatcgccgtcgatcattttcaactgagcacgtctctacgagccactctgtccaatcaggaacaccaatggttgtttagtagactgcaagatgttcgagatgtttctgccacttttctgtctgatctggaggagaatttcgagaacaacatcttcagcttccaggtgtgtgacgtggtgctgaatcatgccccagattttcgaagagtgtacctcccctacgtcactaaccaaacttatcaagaacggactttccaaagcctgatgaattctaactccaacttcagagaggtgctagagaaactcgagtccgatcctgtctgtcaaagacttagcctgaagtcgttcctgattctgcccttccagcgaattactagactgaagctgttgctgcagaatatcctgaagagaacacaacctgggagcagtgaagaagcagaagctactaaagctcatcacgctctcgagcagctgatcagagactgtaataacaacgttcagtctatgagacggaccgaggagttgatatacctcagtcaaaagattgaattcgaatgtaaaattttcccgctgatatcacagtcccggtggttagtcaaaagtggtgagctgactgcgctggagttttcagccagccccggactgcggaggaaactgaacacacggcctgtccacctccatctgttcaacgattgccttctgctgtctcgcccacgggagtcggagaagctccggtggatttccgcgctagctatgccaagggaagaactggacctgcttgagtgttacaactctccccaggttcagtgcctgagggcctataagccacgcgagaatgatgagctcgctctggaaaaggcagacgttgtgatggtcacccaacagtcctccgacggctggctggaaggagttaggcttagcgacggtgagcgtgggtggttcccagttcagcaagttgagtttatctccaatcctgaagtcagggcccaaaatcttaaggaggcacaccgtgtgaaaactgctaagttacagctcgtagagcagcaggcctag

SEQ ID NO: 238809 - DNA, 1560 bp, Artificial Sequence
  Description of Artificial Sequence: Synthetic coding sequence
atgggtggcttttctagacgctgcagtaagttgatcaattcgtcacagcttctgtatcaggaatactctgacgtggttcttaacaaagagatccagagccagcaacgactggaatcattgtctgagacccccggacccagctcccccaggcagcctcggaaagcccttgtgtcatcggagtcctatctgcaaaggctgtctatggcttcgagcggaagtctgtggcaggaaattccagttgtccgtaactcgactgtgctgctctcaatgacacacgaggatcaaaagctccaagaggtcaagtttgagcttatcgtctcagaggccagttacctaaggagccttaatattgctgtcgaccatttccagttgtctacctctctccgggctacactgtcaaatcaggagcaccagtggttgttttcacgtctgcaagacgttagggatgtgtcggccaccttcttgtccgatttggaagaaaacttcgaaaataatatcttctccttccaggtatgcgacgtggtgctgaaccacgcccctgacttcaggcgagtctacttgccttacgtgactaaccagacttaccaggaaagaaccttccagagcctaatgaatagtaatagtaatttcagagaggttctcgaaaagctggaaagtgacccggtgtgtcagcggctctcactgaagagcttccttatccttccttttcaacggatcacgcgcctgaagttgctactgcagaacattttaaaacggactcagcccggaagcagcgaagaggctgaggccaccaaagcccatcacgcattagagcaattaatcagggactgcaacaacaatgtgcagagcatgcggaggacagaagaactgatttacttgagccagaaaattgaatttgagtgcaaaatcttccccctgatatcccagtcacggtggctggttaagagtggggagctgacggccctggaattcagcgcttcccccggacttcgccgaaaattgaacacccgtccagtgcatctgcacttatttaacgattgtctgcttctttcacgacctagagaggggagcaggtttcttgtgttcgaccacgcccctttctccagcatcaggggcgaaaaatgtgaaatgaagctccatggccctcataagaacctcttccgcctttttctgagacagaacacccagggcgctcaagccgaatttttgttcaggactgagacgcagtccgagaagcttcgctggatctccgcgctcgctatgccaagagaggaactggaccttctcgagtgttacaatagcccccaagttcaatgtcttcgcgcttacaaacctcgtgagaacgacgagttagctctcgagaaagctgacgtcgttatggttacgcagcaatccagcgatgggtggctggagggggttagattgtccgatggcgagcgcggatggttccccgtgcaacaggtagaattcatcagcaaccctgaggttcgggcacagaacctaaaggaggcgcacagggtgaagacggctaagctgcagctagtggaacaacaggcttag

SEQ ID NO: 238810 - DNA, 2394 bp, Artificial Sequence
  Description of Artificial Sequence: Synthetic coding sequence
taggtagtggtgcccactttgaaacagcattcccaccctcccccactggccctgggatctggactccatgccccacacaaggggccactgcctcaggccagcgatccagccgtcgcaagacagcacagacctctgcctagtacccccgattcttcgcatcatgcgcaggcaacccctaggtggaggtacaataagcccctgccaccaacacctgacctgcctcagccccatctgccccctatcagtgctccaggaagctcacgaatctatcggcctttgcccccattgcctattatcgatcctccaactgagccgccacctctccccccaaagagtagggggagatctaggtccactagaggtgggcatatgaattctggcggtcatgcgaaaactcgacctgcttgtcaggactggactgtccccctgccagccagcgctggtagaacaagctggcctccagccactgcacgtagtactgaaagctttaccagcaccagtcggtccaagtcagaggttagtcccggaatggctttttctaatatgactaacttcctgtgccccagcagcccaaccaccccctggacacccgagttacaaggccctacatcaaaagatgaggcgggtgttagcgaacacccggaggctccagccagagagcctttacgacgaacgacccctcaacagggggcttcaggccctggtcggtcgcctgtgggtcaggcacgccaaccagaaaaaccctcccacctgcatcttgagaaagcatcttcctggcctcacaggcgggacagtggtcgcccacccggagattcaagcggacaggccgtggctcccagtgagggtgctaacaaacataagggctggtccaggcaggggctgagacgcccaagtattttgcctgaaggaagctccgatagtaggggccctgccgtagaaaaacaccccggtccctcagacaccgtggtcttccgagaaaagaagcccaaggaagttatggggggtttcagcaggagatgctctaagctcatcaactctagccagttgttgtaccaggagtactcagacgtggtcctgaataaagagattcaatcccagcaaaggctggagagcctcagcgagaccccaggtccctctagcccccgacagcctaggaaggccctggtgagcagcgagtcttacctccagagactcagcatggcctctagtgggagcctctggcaggagattccagtggtgcgaaactcaacagtattgctgagtatgacccatgaggatcaaaagctccaggaggtcaagtttgagcttattgtctctgaggcctcatatcttcgttccctcaatatcgccgtcgaccacttccagctcagtacatccttaagggccacactctccaaccaagagcatcagtggctgtttagcagactccaggacgtgcgtgatgtttctgcaacattcctgagcgatcttgaagaaaatttcgagaacaatattttctctttccaggtttgtgatgtggtgttaaatcatgctcctgattttagaagggtatatctcccctacgttacaaatcagacttaccaagagcgcactttccagtccctaatgaactccaattccaatttcagggaggttctcgaaaagttggaaagcgaccctgtttgccagcgattgtcactcaaatctttccttatactccctttccagcgaatcacaagattgaagttgctcctgcagaatattctgaagcgaacccagcccggatcaagtgaggaagcagaggccaccaaagcacaccatgctctggagcagcttataagagattgcaacaacaacgtgcagtctatgcgtcggactgaggaattgatttacctctcccagaaaatcgagttcgagtgtaagatctttccgctgatttcccagagtcgttggctagtgaagagtggcgagctcaccgcactggagttttccgcgagcccgggacttcggaggaagctcaacacccggcctgtgcatctgcatttattcaacgactgcttgctgctgagccgacctcgagaatcagaaaagcttaggtggataagcgccctggcaatgcccagggaggagttagatctcttagaatgttataactccccacaggttcagtgcttgagggcttataagcccagggagaacgatgagttggctttggagaaggccgatgtggtgatggtcacgcaacagtccagcgacggctggctggaaggagtgcggctaagtgacggagaaagaggctggtttcctgttcagcaggtggagtttatctccaatcccgaggtgagggcccagaacctgaaggaggcacacagagtcaaaaccgcaaagctgcagcttgtagaacagcaagcatag

SEQ ID NO: 238811 - DNA, 2958 bp, Artificial Sequence
  Description of Artificial Sequence: Synthetic coding sequence
atgtctaggatcgagtcgctcacccgggcaaggatcgataggtctcgtgaattggcttctaaaacccgcgagaaagagaagatgaaagaagcgaaggacgctcggtacacgaacgggcacctgttcactaccatttccgtcagtggaatgaccatgtgctacgcttgtaataagtccatcaccgccaaggaggcactgatttgccctacatgtaacgtgaccattcataaccgctgcaaggatacacttgctaactgcactaaagtgaagcagaaacagcagaaagccgctctcttaaagaataatacagccttacagtcagtaagcctcagatcaaagacgaccattcgggaaaggcctagtagtgccatttacccttccgattcctttaggcaatctttactgggctcaaggagaggacggagcagcctctcactggccaagtccgtctctacgaccaatattgccggacactttaatgacgagagtccactcggccttagacgtatcctctctcaatcgactgattctctgaatatgcgcaatcgcactctcagtgtcgagtcacttatcgatgaggaggtgatttactcagaattaatgagcgattttgagatggatgagaaggatttcgctgccgactcctggagtctggctgtcgacagttcttttttgcagcagcacaagaaggaagtcatgaagcaacaggatgtgatttatgagctgatccagacggagttgcaccacgtgcggactcttaagatcatgacacgactgtttagaactggaatgttggaagagctgcatctcgaaccgggagttgtacagggactctttccttgcgttgacgaactgtccgacatacacacccggttcctgtcgcagctgctggagcgaagacggcaggccctctgtccgggtagcacaaggaattttgtgatccaccggcttggtgacctattgatctcccagttctctggccctagcgctgagcagatgtgcaagacttattcagaattctgtagtcggcacagcaaagcgctgaagctgtacaaagagctgtacgcaagagacaagcgatttcaacagtttattcgcaaggtgacaaggcccgctgtcctcaagaggcacggtgtgcaggagtgtatactattggtcactcagagaattacgaagtatccgcttttgatcagtcggattctccaacattcacacgggatcgaggaggaacgccaggaccttaccaccgcacttgggctggtcaaggagctgcttagtaacgtggacgagggaatctaccaactggaaaaaggagccaggctgcaggaaatatataatcggatggacccaagagcccagaccccagtgccaggcaaaggacctttcggtcgtgaggagctgcttcgtcgaaaattgattcacgatggatgtctactgtggaagacggcgaccggtaggttcaaagacgtgctcgtgctgttgatgacggatgtgctcgtgtttctccaggaaaaagaccagaaatacatttttcctacactcgacaagccctccgtcgtgtccctgcaaaacttaattgtgagagacatcgccaatcaagaaaagggaatgtttctcatctctgccgcacctccagagatgtacgaggtccataccgcttctagggacgatagatccacgtggatcagggtgatccagcaaagtgtgagaacatgcccaagcagggaggattttccccttatcgagactgaagacgaagcttatctaagacgcattaagatggagctgcaacagaaggatagagcgctggttgagctcttgagggagaaggtcgggctgtttgccgagatgacccatttccaagccgaggaagacgggggatctgggatggccctgcctacactgcctagagggttgttcaggtcagagagcctcgaaagtcccagaggggaacgactgctgcaggatgccattcgggaggtggaaggattaaaggacttgctggtgggcccaggggtcgaactgctgctgacacctcgagagccggcactgcctctggagcccgactccgggggtaatacgagcccaggagttacggcgaatggcgaagccagaactttcaatgggagcatagagctttgccgggctgattctgactcatcccagagagatcggaatggtaaccagctgcggtctccccaggaggaagcactccagaggttggtgaatttgtacggactgctgcacgggctgcaggctgccgtcgcacagcaggatacactcatggaggcgagattccctgaggggcctgaaaggcgagagaaactctgcagggccaactcccgcgacggcgaagcaggaagagctggggctgcgccagttgcgccagaaaaacaggccaccgagctcgccctactccagcgccagcacgctcttttgcaggaagagctcagacgttgtaggaggctgggcgaagagcgtgctaccgaggcaggttctctcgaggctcgcctgagggagagcgagcaagcacgcgcactgctggaacgagaggctgaggaggcccgacggcaactagctgccctgggacagactgaacccctccccgcagaggctccctgggcgcgtcggcctgtagatccgcgaagacgtagcctgccagcaggcgatgctttgtacctaagctttaaccctccgcaaccaagcaggggcacagaccgcctggatcttcctgttaccacacgaagtgtccataggaactttgaggaccgtgagcgccaggagttggggagtcccgaggaaagactgcaggatagttctgatcctgatacaggtagtgaggaggaggggtcctcacggctttctccgcctcactcacctcgagattttacccgaatgcaagacatcccggaagagactgaaagcagggatggcgaggcagtcgccagcgagtcgtag

SEQ ID NO: 238812 - DNA, 2877 bp, Artificial Sequence
  Description of Artificial Sequence: Synthetic coding sequence
atgaaggaggctaaagatgctaggtataccaatggtcacctgttcaccaccataagcgtgagtggcatgacaatgtgttacgcctgcaacaaatccataaccgccaaagaagctctcatctgtccaacatgtaacgtgacaattcacaatcgctgcaaagacaccctggctaactgcacgaaggtgaaacagaagcagcagaaggctgcactcctcaaaaacaatactgcacttcagagtgtttccctgcggtcgaaaaccaccatccgggaaagaccttccagcgccatctacccttctgattctttccggcagtcattgctaggtagcaggcggggtcgcagctctcttagtcttgccaaatccgtgtccacaaccaatatcgctggacatttcaatgacgaaagcccactcggcttgaggagaattctcagccagtcgaccgacagtctgaacatgcggaatagaactttgagtgttgaaagcctaatcgatgaagaggttatctattccgagctcatgtctgactttgaaatggatgagaaggattttgccgcagattcatggtcgttggcggtagacagtagctttctccagcagcacaagaaggaggtgatgaaacagcaggacgtgatctacgagctcatccagacggagcttcatcacgtccgcactctgaagatcatgactaggctgtttcgcactggtatgctcgaggaacttcaccttgaacctggggtcgttcagggactatttccatgcgtagacgaactatcggatatccatactcgcttcttgtctcagctgctggagcgtcgacgtcaggctctttgccccggttcaacacgcaattttgtaatccacagattgggcgacctcctgatttcccagttctccgggcctagtgccgaacagatgtgcaagacctattccgaattttgctcacggcatagtaaggctctcaaactgtacaaagagctatatgcgagagacaagcggtttcagcagttcatacggaaagtgacccgccctgcagtgcttaagcggcatggcgtgcaggaatgtattttgctggtgactcagaggattacaaagtacccgctgctgatcagccgcatactccagcattctcacggaatagaggaggagcgacaagatctcaccaccgcgctgggccttgtcaaagagctgctttcaaacgtggacgaaggcatctaccagctagagaagggagccaggcttcaagaaatttataatcggatggacccacgcgctcaaactccagtgccaggcaaagggccatttggcagagaggaactcttgcgcagaaagctgatacatgacggctgtttgctttggaagactgcaactggtcgatttaaggatgtcctagtcctgctgatgacagatgtcctggtcttccttcaagagaaggaccaaaaatacatctttccaacactcgacaaaccctccgttgtcagccttcagaatctgatcgtgcgagatattgcaaaccaggaaaagggaatgttcctcatcagcgctgcccctcccgagatgtacgaggttcacacagcttcaagagacgaccggtcaacatggatccgcgtgattcaacaaagcgtcaggacttgtcctagcagagaggatttccccttaatcgagaccgaggacgaggcctacctacgcagaatcaagatggagttgcagcagaaggaccgcgctttagtggagctgctgagggagaaggttggcctattcgctgagatgacccattttcaagcagaggaggacggcggatctgggatggctcttcccaccctgcccagagggctcttccgtagcgaaagtcttgagagccccaggggcgaaagactgctccaggacgctatccgcgaggtggaaggcctgaaggacctgctcgtgggccctggagtggagctactactgaccccacgcgagcccgcactgccccttgaacccgacagcggcggtaatacctctccaggggtgacagctaacggcgaggctcgaacgtttaacgggtcaatcgagctctgccgggcagactccgactcttcacagagggacaggaatggcaatcagctgcgcagccctcaggaggaggctctgcagaggttagttaatctttacggtctgttacatggcttgcaggcagccgtcgcacagcaagatactctcatggaagccagattcccagaaggcccagaaagaagggagaaactctgtcgggctaacagccgcgacggcgaagcaggacgggcaggggcagccccagtggcccctgagaagcaggcaacggaactggctctcctgcagcggcagcatgccctactgcaggaggagctcaggcgttgtcggaggctgggtgaagaacgcgctactgaagcgggtagcctcgaagccagactccgcgaatcagagcaggccagggcactacttgagagagaagccgaggaggcacggcgacagctggcagctctcgggcagactgagccgctgcctgcagaggcaccctgggcacggaggccggtggatcctaggcggcgaagcctccccgcaggcgatgcactatatctgtcctttaacccgccacaaccgagtcgtggcactgaccgcctcgatcttcccgttactacacgcagcgtgcaccggaactttgaggacagagagcgacaggaactggggtccccggaagagcgtctgcaggacagctcagaccccgatactggatctgaggaggagggttctagccgcctctctcctccgcacagtcctagggacttcacaagaatgcaggatattccagaagagacagaatcacgagatggcgaggctgtcgcctccgaatcttag

SEQ ID NO: 238813 - DNA, 2961 bp, Artificial Sequence
  Description of Artificial Sequence: Synthetic coding sequence
atgtcgagaatagaatctcttacccgggcaaggatcgaccggtcgagagagctagcctctaagacccgtgagaaagaaaagatgaaggaggcgaaggacgcacggtatactaacggtcacctcttcactacaatatctgtttctggaatgaccatgtgttacgcttgtaacaagtctattactgccaaggaggccctgatatgtccaacctgtaacgtcactatacacaaccgatgtaaggacactttagccaactgcaccaaggttaaacagaagcagcagaaggcagctttactgaaaaacaataccgcactgcagtccgtttctcttcggtctaagacaacgatccgggagagaccaagttcagctatttacccctcagatagcttcaggcagtcgctgctcggctccaggcgcggacgctcttctctgtcgctcgccaagtccgtatctacaaccaatatcgctggacattttaatgacgaaagtccactcgggctccgcagaattctctctcagtcgactgacagcctgaacatgaggaatcggaccctctctgtcgaatccctaatcgatgaagcagaggtaatttattcagagttgatgtcagacttcgagatggatgaaaaagatttcgccgctgactcatggtccttggcagtcgattcttccttcctgcagcagcacaaaaaagaggtgatgaagcagcaggatgtcatctacgagctcatccagactgagctccatcacgtccggactctcaagatcatgacccgccttttcaggacaggaatgctagaagagctacatctcgagcctggcgtagtgcaaggcctgtttccttgcgtggacgagttgtctgatattcacacacgcttccttagtcagttattagagagacgacgtcaggccctatgtccaggtagcacccgcaatttcgtgatccataggttgggcgatctgcttatctctcagttctcagggccttccgccgagcagatgtgcaagacctacagcgaattctgcagccgccacagcaaggccctgaagctgtacaaagagctatacgccagagacaagaggtttcaacaattcattcgaaaggtgacaaggccagccgtgctcaagcgacacggcgttcaggagtgtatccttttagtaactcaacgcattaccaagtacccgcttctcatctcaaggatcctccaacactctcacggcatcgaggaggaacgccaagacctgaccaccgccctcggtctggtaaaggaactgctgtcaaacgtggatgagggaatttaccaacttgaaaagggagcccgactgcaggagatttacaatagaatggacccgagggcccagaccccggtaccaggaaagggcccatttggccgtgaggagctgctgcgcaggaagctgattcatgatgggtgtcttctatggaaaaccgcaaccgggagatttaaggatgtactggtactgctgatgactgacgtattggtattcctccaggagaaagaccagaaatatatcttccccacgctggacaaaccaagtgtagtgtcgctccaaaatctgatagtgcgagacatcgccaatcaggaaaaagggatgtttctgatcagcgctgcccctcccgagatgtatgaggtccataccgcctcgagagacgacaggagtacatggatccgggttatccagcagagcgttcggacttgtcctagccgcgaggattttcctttgattgaaactgaagatgaggcttacctgcgacggattaaaatggagttgcagcagaaggacagggctctcgtcgaactcctgcgtgagaaagttggcctgtttgcagagatgacccatttccaggcagaggaggatgggggttccggcatggcccttcccactttacctaggggtctgtttcggtctgaaagcttggagtcccccaggggcgagcgtctgctgcaggatgcgatccgtgaagtcgaggggttgaaagacctgctcgttggtccgggagtggagctgctgttaacgcccagggaacctgccctcccactggagcccgactcagggggaaataccagtcccggtgttaccgctaacggcgaggcaagaacattcaatggctctatagagttatgtagagctgatagcgacagctcccaacgagaccgtaatggtaaccagctcaggagcccacaggaagaagctctgcaaaggttagtgaatctctacggactcctgcatggtttgcaggccgctgtggctcagcaggatacgttaatggaggccaggtttcctgaggggcctgagagacgcgaaaagctgtgcagggccaatagccgggatggcgaggcgggacgtgccggagccgctcccgttgcccctgagaagcaggctacggagttggctctcctccagcgtcagcatgccctcctccaggaagagttgcggaggtgtagacggctcggcgaagagagagccaccgaagccggatcactggaagcacgcctgcgggagagtgagcaggcaagggctctgctcgaaagagaagcggaggaagctcgacgacagctagccgctctgggtcagactgaaccacttcccgcagaagcaccttgggcccgaagacccgtggatccaagacggcgttcattgcccgcaggtgatgcgctgtatctgtcttttaatcctccccagcctagcaggggtaccgacagactggacttgcccgttacgaccaggtctgtgcacaggaacttcgaagaccgggagaggcaggagctcggatcgccagaagagcgtcttcaggattcaagcgacccagacaccggttcagaagaggaaggttcaagcaggctgtccccaccccatagtccgagggattttacaaggatgcaggatatccctgaggagaccgaaagtagggacggcgaggccgttgctagtgagagctag

SEQ ID NO: 238814 - DNA, 2964 bp, Artificial Sequence
  Description of Artificial Sequence: Synthetic coding sequence
atgtgttgctgctgcggctgttgtccattgctagcccacctagagcaaggtagcctgcgtgaacggacaagggagaaagagaagatgaaggaggcaaaagatgcacgttataccaacggccacttgtttaccacaatctccgtgtcggggatgacaatgtgctatgcttgcaacaaaagtatcacagccaaagaagctttgatatgtcccacctgcaatgtgactatccataatcgctgtaaggatactcttgccaactgtaccaaggtgaaacagaaacagcagaaggccgctctactgaaaaataatacagccctacaatctgtgtctttgcgcagcaaaactacaattagggagagaccttctagcgccatctacccgtctgactcttttcgacaaagcttgctcggctctagaagaggtcgctcatcactctcgcttgcaaagagtgtgtctaccaccaacatcgccggacacttcaatgacgaatctcctctgggccttagacggatcttgagccagtcaaccgacagccttaacatgagaaacagaacattgtcggtggagtcactgatcgatgaagctgaagtaatttattctgaacttatgtctgactttgagatggacgaaaaggacttcgccgctgacagctggtccctggccgtggacagttcgttcctacagcaacacaaaaaggaggtgatgaaacaacaagacgttatctacgagctgatccagaccgagctacatcacgtgagaacactgaagatcatgacgcgcttgttcagaacaggaatgctggaggagctgcacttggaaccgggagtcgtacagggactgtttccatgcgtggacgaactgtccgatattcatacccgcttcctctcccagttgctagagaggcgcagacaagcgctatgccccggatccacacgcaacttcgtgattcaccggctgggagatctgctcatttcccaattcagtggcccttcagccgagcagatgtgtaagacgtacagcgaattttgctctcgccactccaaggcccttaaactgtataaagagctctacgccagagacaagcgattccagcagtttatccgtaaagtcactagaccagccgtcctgaagcgtcacggggtgcaggaatgcattctgcttgtgactcagaggatcactaaatatcctcttcttatcagcaggattttgcagcacagtcacggtatcgaagaagagcgccaagacctcactaccgccctgggcctggtgaaggaacttctcagcaacgttgatgaagggatttaccagctcgagaagggagccagactgcaggaaatttataaccggatggatcctagagctcaaacacctgtgccaggtaaaggcccattcggacgagaggaactcctcagacgaaagctgattcatgacggctgtcttctttggaaaaccgctactggacggtttaaggatgtacttgtgctgttgatgacagacgtcctggtgttccttcaggagaaagatcagaaatacatctttcccaccctcgataagcccagtgtggtctctctgcagaacctgatcgtccgggatattgctaaccaggaaaagggaatgttcctcatatccgcagcaccaccagaaatgtacgaggtgcacactgcctcccgggacgaccgatcaacctggattagagtgatccagcagagcgtccgcacctgtccttccagagaggatttccctctgattgaaactgaagatgaggcctacctgagacggatcaaaatggaactgcagcagaaggatagggctttggtggagttgctgcgcgaaaaagtgggactctttgctgaaatgacccattttcaggccgaagaggacggtggctctggcatggctctgccaacattacccagaggactcttcagaagtgagtccctcgaatcacctaggggagaaagattgttgcaggatgctattagggaggtggaaggcctgaaagacttgctcgtgggccctggtgtggaactgttactgacccccagagaacccgctttacctctcgaacccgattccggcggtaatacgagccccggtgtgaccgccaacggagaagctcgaactttcaacggcagtattgagctttgtcgcgctgacagcgacagttcccagcgggaccgaaacgggaaccagctaaggagcccccaagaggaagccctgcagagacttgtcaacctgtacggtcttcttcatggactgcaggccgctgtggcccagcaggacactttgatggaggccaggttcccggaaggaccggagaggagggaaaagctgtgcagggcaaacagtcgcgatggtgaggcaggcagggcgggagctgcaccagtggctcctgaaaagcaggccacagaactggccctcctgcagagacagcatgctctgctccaggaagagctcagaaggtgtagacgtttgggcgaagagcgggcaaccgaagcaggtagtttggaggctaggctgcgagaaagcgaacaggccagggctctgttggaaagagaagccgaggaagccagaagacaactggctgctttgggacagaccgagccactacctgcggaggcaccgtgggctcgaaggccggtggatcccagaaggcgttccctgccggcaggagatgccttatatttgtccttcaacccaccacaaccgtctcggggaactgatagattggatttacccgtgacaacccggtccgttcatagaaattttgaagacagagagaggcaggagctgggcagtccagaggagaggctgcaggattcgtcggatcccgacactggctccgaagaggaaggctcttcacggctatccccccctcacagcccacgggactttactcgtatgcaggatattccagaagagacagaatctagagatggtgaagcagtagccagcgagtcttag

SEQ ID NO: 238815 - DNA, 2877 bp, Artificial Sequence
  Description of Artificial Sequence: Synthetic coding sequence
atgaaagaagctaaagacgctagatataccaacggtcatctatttactaccattagcgtgagtggaatgacaatgtgctacgcctgcaataagagcatcacagccaaagaggccttaatttgcccaacttgcaacgtaacaatccataatcgatgcaaggacacattggccaactgtaccaaggttaagcaaaaacagcagaaagcagcgctgttgaaaaataacacagctctgcagtccgtgtctctccgctcaaagacgacaatccgcgaaaggccgagctccgccatttacccttccgattcttttaggcagagtttgctcggcagccgtagaggaagatcaagtctgagcctcgcgaagagcgtgtcaacgactaatattgcgggtcactttaacgatgaatcacctctcgggttgaggaggatactttctcagagcaccgatagcttgaacatgagaaaccggactctgtcagttgaatccctcatcgatgaagaggtaatttactccgagttgatgtccgactttgaaatggatgagaaggactttgccgcagactcatggagcttggccgttgacagctccttccttcagcagcataagaaggaggtcatgaagcaacaggatgttatttacgagctgatccagacagagttgcaccatgttagaacgttaaaaatcatgacacgcttattcaggaccggtatgcttgaggaactgcacctggaacctggcgtggtgcaggggctgtttccgtgcgttgatgaactgtccgatatccatacaagattcctttctcagttactggaaagacgcaggcaggccttatgtcctggttccaccaggaacttcgtgatccaccgactgggcgacttactcatttctcagttctccggccctagcgcagagcaaatgtgcaagacttacagcgagttttgttcaagacattctaaagccttgaagctgtacaaagaactctatgcacgggacaaacggttccagcagttcattcgaaaagtcacaaggccggcagtgctgaaaaggcacggggtacaggaatgtatcctcctggtgacgcaacgaattacgaagtaccccttactgataagcaggatactgcagcacagtcatggaatagaagaggagcggcaagacctgacaactgctcttggtcttgtgaaagaactgctgagcaacgtggacgaggggatttatcagctagaaaagggcgctcggttgcaagagatctataaccgtatggatcccagagcccagactcccgtgccaggcaagggcccatttggaagagaggaactcttgcgcaggaagctgatccacgacggatgtctactatggaagacagctactgggagatttaaggacgtgcttgtactcctcatgactgatgtacttgtgttcctgcaggaaaaggatcagaaatatatttttcctacgttggataaaccctccgtggtttccctgcagaatttaatcgtgcgagacatcgcgaaccaggaaaagggcatgttcctgattagtgctgccccacccgagatgtacgaggtgcataccgcgtcaagagacgatcggtccacctggataagagtgattcagcagtctgtgaggacatgcccttcccgggaggattttcctctgatcgagaccgaggacgaggcttatctgcggaggatcaagatggaactgcagcagaaggaccgtgcactggtcgagcttctgcgcgaaaaggtgggtctgttcgcagagatgacccacttccaggccgaggaggatggaggctcgggtatggccctcccgacgctccctaggggtctcttcaggtccgagtcactcgaatcacccaggggggagcgcctgcttcaggatgcaatcagggaagtcgaaggactgaaagatttgttagttggcccaggtgtcgaacttttgttaacgcccagagagcccgcactgcctttagagcccgattctgggggaaatacttcaccaggggtgactgcaaacggtgaggccaggaccttcaacggttccattgagttgtgccgtgcggactctgacagctctcaacgcgatagaaacggcaaccagttacgatccccacaggaggaggctctgcagaggctggttaacctgtacggtctactgcatggcctgcaggcggcagtggctcaacaggataccttgatggaagctcggttccccgaaggaccagaacgacgagagaagctttgccgggcaaattccagggacggggaagctggtagggcaggcgctgcccctgtcgcccctgaaaagcaagcgacagagttggccctcctccagagacagcacgcactgcttcaagaagaactccgtaggtgccggagactaggggaggagagagccaccgaagccggatcactggaggccagattgagggagtctgagcaagctcgagcactgttagagcgtgaggcagaagaagccagacggcaactggcagccttgggccaaacagaaccgcttcccgcagaggccccatgggcaaggcgacccgtggacccaaggcgcagaagcctgcccgcaggagatgctctttacctgtctttcaacccaccgcaacccagtagaggtacagatcgcttagaccttcctgtgaccacacgaagcgtgcatagaaacttcgaagaccgggaacggcaggagttagggagtccagaagagcgcctccaagacagctccgacccagatactggatccgaagaagaaggcagcagccgcttgtctccacctcacagccctagagactttacccggatgcaggacattcctgaggagacagagagcagggatggagaggctgtggcatccgagtcatag

SEQ ID NO: 238816 - DNA, 1548 bp, Artificial Sequence
  Description of Artificial Sequence: Synthetic coding sequence
atgctcagtaaatccgtacccgtaagtgggatcaactgtctgttggaccgcagtgacaccgatggcaatgtctctcagtcttcagcgattgatctgcgcaaacggtgcagccagttggagggacattctggcactagagtgggcagctctctcaggcagactttctcctttttaagcggaatgacagggaaagccaaaacccgggagaaagaaaagatgaaagaggcaaaggacgcaaggtacacgaacggacatctgttcacaactatttcagtgagcggcatgactatgtgctatgcttgcaacaaatcgattactgctaaggaagccctaatatgccccacttgtaatgtcactatccacaatagatgcaaggacacactcgccaactgtacaaaggtaaaacagaaacagcagaaagccgctctgctgaaaaacaatacggctctgcagagtgtgtccctgaggtccaagaccactattagggagcgcccttcaagtgcaatctacccctcagatagttttcggcagtccctgttggggtctcgcagagggaggtcctccctctcactggcaaaaagtgtgagcacaactaatattgctgggcactttaatgacgaaagcccgctgggactgagacgaatcttgtcccaatccaccgactccttgaatatgaggaatcgcacactcagtgtcgagtctttaatagacgaggctgaggtcatatacagtgagctgatgagtgattttgagatggacgaaaaagactttgccgctgactcatggagtctggcagtggatagtagtttcttgcaacagcacaaaaaagaggttatgaaacaacaagacgtgatatacgagctcatacagactgagctgcaccacgtcaggactcttaagatcatgacacggctgttcaggacggggatgctagaggagcttcatttagagccgggagtggtccagggactatttccctgtgtcgacgagcttagtgacattcacacccggtttctttctcaacttctggagaggcggcgtcaagctttgtgtccaggtagcacccgtaattttgtgatccatcggctgggagacttactgatctcacaattttctggccctagtgcagagcagatgtgtaaaacctacagcgagttttgtagccgccattcaaaagccctgaaactctacaaagagctatacgcgagggataagaggtttcagcaattcatccgaaaggtgactcggcctgcggtgctcaaaaggcatggggtgcaagaatgcattctgctagtgacccaacgtattactaaatatccactgctcatctcaaggattttgcagcacagccatggtattgaggaggagcggcaggatctgacgaccgccctgggcctcgtgaaggagctcctctccaacgtcgacgagggcatttaccagctggagaagggcgctagactccaggagatctacaatttgctcctcctcttctccctgtcaccctcgttcatggaggccctgggcgataatctggctagctggtcctag

SEQ ID NO: 238817 - DNA, 1332 bp, Artificial Sequence
  Description of Artificial Sequence: Synthetic coding sequence
atgaaagaagccaaggatgccaggtatacaaacggacacctgtttacaactatatctgtgtctggcatgacaatgtgttatgcctgcaacaagtccatcacggccaaggaagccctgatttgcccaacatgtaacgttactatccataaccgttgcaaggatacgctcgctaattgcacaaaggtgaagcaaaagcaacagaaggccgctctgttaaagaataacacggcattacagtcagtgtcgcttcgctcgaaaacaactatccgggagaggcccagttctgcaatctatccatctgatagcttcagacagtctcttcttggcagccgtcgaggaagatcgtcgttaagtctggccaaatcagtcagcactactaatatcgcaggacacttcaacgacgaaagtcctctgggcctcaggaggatcctgagtcagtctacggattctctcaatatgaggaaccggaccctatccgtcgagagcctgatcgatgaagctgaggttatctactctgaacttatgtccgacttcgagatggacgagaaagatttcgcggcagatagttggagtttggcagtggactccagtttcctccagcaacacaagaaggaagtcatgaaacagcaggatgtgatttacgaactcatccagactgaactgcatcatgtgcggacattaaagataatgacacggctgtttcggactggaatgctggaggaactgcacttggagccgggtgtggtgcagggcttgtttccttgcgtggatgagctgtcagacattcacacacggttcctctctcagctcctcgaaagacgcaggcaggccctgtgccctggaagcactagaaattttgttatccaccgtcttggtgatctcttgatatctcagttctctgggccaagcgcagagcagatgtgcaagacatatagcgaattttgttccagacacagtaaagccctcaagctatacaaagaactttacgctagggataagcggtttcagcagttcatacggaaagtaaccagacctgccgttctcaaaaggcatggtgtgcaggaatgcatattacttgtgacgcaacgaattacaaagtatcccctcctgatttctcgcattctccagcactcacatggcatcgaggaagagaggcaggacctcacaactgccctcgggttagtaaaggaactgctcagcaatgtcgacgaggggatataccagctggagaaaggagccaggctacaggaaatttacaatctgttgctgcttttctctttgtccccctcattcatggaggccctgggcgataacctggcttcatggtcctag

SEQ ID NO: 238818 - DNA, 4167 bp, Artificial Sequence
  Description of Artificial Sequence: Synthetic coding sequence
atgtccagacccccacctaccggcaaaatgcccggagccccagagaccgcgccaggagatggggcaggggcatccagacagcggaaactagaggcactgatccgagatcccagatcccccattaatgtcgagtctcttctggacggcctgaacagcctggtcctggacctggactttcctgccctgaggaagaacaaaaacattgacaacttcttaaaccgctatgaaaagatcgtgaagaaaataagaggactgcagatgaaggctgaagactatgacgtcgtgaaggttattggacggggagccttcggggaggtccagttagtgagacataaggcttctcagaaggtgtatgccatgaagctcctttccaaatttgagatgataaagagatctgacagtgcttttttctgggaggaaagggacattatggccttcgccaattccccttgggtggtgcagctattctacgcctttcaggacgacagatacctgtacatggtgatggaatatatgcctggtggggacttggtgaatttgatgagcaattatgatgtgcctgagaaatgggccaagttttacacagccgaagtggttttggccctggatgccatacacagcatgggtctgatccaccgggatgtaaagccagataatatgctgcttgacaagcacggacacctgaaactcgctgacttcgggacttgtatgaagatggatgaaaccggtatggtccattgtgacactgccgtgggcacacctgactacatttctcctgaagtacttaagtcacagggaggcgatgggttttacggtagagaatgtgactggtggtcggtgggcgtgttcctgtacgagatgcttgtgggagacacaccattctacgccgactctttggtggggacctactctaagattatggatcacaaaaacagtctctgcttccccgaggacgcagagatatctaaacacgcaaaaaacttgatttgcgctttcctgacagatcgagaagttcgcctcggaaggaatggggtggaagagattaggcagcacccattcttcaagaatgaccagtggcactgggataatatccgtgaaacagccgctccagtggtgcctgaattaagtagtgatattgatagtagcaattttgatgacatcgaggatgataagggagacgtcgagactttccctatcccaaaagccttcgtcggaaatcagttgccatttataggcttcacatattaccgggaaaatcttctgctcagcgattccccctcctgccgcgaaacagatagtatccagagccggaagaacgaagagtcccaagaaatacagaagaagctgtatacccttgaagaacatctgtccaatgagatgcaggctaaggaggaattagaacaaaaatgcaagagtgtgaacaccagattggaaaagaccgcaaaagaactcgaagaggagattacgttgaggaagtcagtggagagtgccttacgacagttagaacgcgagaaggccctgctacagcacaaaaacgctgagtatcagaggaaggccgaccatgaggcagataaaaagcgcaacctcgagaacgatgttaactccctgaaagaccagctcgaagatcttaaaaagcggaatcaaaattctcagatttccactgagaaggttaaccagctccagcgtcagctcgatgaaacgaacgccctcctgaggacagaaagcgatacagcagcacggctccgtaagactcaggcagagtctagcaagcagatccagcaactggagtccaacaacagagacctccaagacaaaaattgtctgctggagacggccaagctcaaactcgaaaaggaattcatcaatctccagtcagcgctggagtcagaacgccgagaccggacccatggatccgagataatcaatgacctgcagggccgtatctgtggattagaggaggaccttaaaaatggaaagatccttctcgccaaagtcgagttggagaagcgtcagctgcaggaacgtttcacggatctcgagaaagagaaatcaaacatggaaatagatatgacctatcaactcaaggtcatccagcagtccctggaacaggaagaggcagaacacaaggcaaccaaagctcgtcttgcggacaagaacaaaatttacgagtcaatcgaggaggccaaatcagaggccatgaaagaaatggagaaaaaactgctcgaagaacgaactctgaaacagaaggtggaaaacctgctccttgaggccgaaaagcgatgttcactgctcgattgcgatctaaaacagtctcagcaaaaaattaacgagctgctgaaacaaaaggacgtgttaaatgaagatgtgcggaacctgacgctgaagattgagcaggagactcaaaagaggtgcctcacccaaaacgacctgaaaatgcagacccagcaggtcaacaccttgaaaatgtctgaaaagcagctgaaacaggaaaacaaccacctaatggaaatgaagatgaacttggaaaagcagaacgccgaactcagaaaggagcgccaggacgctgacggccaaatgaaggagctgcaggatcagctcgaagcagaacagtatttttctacattgtacaagacccaagttcgcgaactgaaggaggaatgcgaggaaaagactaagctcggcaaggaactgcagcaaaagaagcaggaactgcaggacgaaagggatagtttggccgctcaactcgagatcacactgacgaaggcagacagcgaacaactggcacggtccatcgccgaggagcagtactccgatctggagaaagaaaaaattatgaaggaattggagatcaaggagatgatggctaggcacaaacaggagctcacagaaaaggatgccacaattgcctctctggaagagacaaatcgaactcttacaagcgatgtggctaacctagcaaatgaaaaagaagagctaaataataagctgaaagacgtgcaggaacagctgtcacgcctgaaggatgaggagatcagcgctgctgcaattaaggcccaatttgagaagcagctgctcaccgaacggacgctgaagacgcaagcagtgaacaagctcgccgaaattatgaatagaaaggagcctgtgaaaaggggaaacgacactgacgttagaagaaaagaaaaggagaaccgaaaactgcacatggagctcaagtcagaaagagaaaagctcacccagcagatgatcaagtatcagaaggaactcaatgagatgcaggctcagatagctgaggaaagccagatccgcatcgagcttcagatgacacttgatagtaaagacagtgacattgagcagttgcggtctcaactgcaagccctacacatcggattagatagttcgtctataggcagtggtccgggagacgctgaagccgatgatgggtttcccgaatccagactcgagggatggctgtcattgcctgtacgaaacaatacgaagaagtttggctgggtgaagaagtacgtcattgtctcttcaaaaaaaattctgttctatgattccgagcaggataaagagcagtccaacccttatatggtactggacatagataaactgttccacgtgagacccgtcactcaaacggacgtctatcgggctgatgctaaagagattcccaggatctttcagatcctgtacgccaatgagggagaatccaaaaaagaacaagagttcccagtcgagcctgtgggcgagaaatccaattatatctgccacaaagggcatgagtttattccaactctctaccacttcccaacaaactgtgaagcgtgcatgaaacctctctggcacatgttcaagcccccacccgctttggagtgcaggcggtgccacatcaagtgccataaggatcacatggacaaaaaagaggaaatcatcgcaccatgcaaggtatactacgatatctcaaccgcaaagaatttattacttttggccaactccaccgaggagcagcagaagtgggtgagccgtctggttaaaaagattccaaaaaagcctcccgcaccggacccgttcgcgcgaagcagccccaggacatccatgaaaatccaacagaaccagtccatacgccgtccgtccagacaattggctcccaacaagccgagttag

SEQ ID NO: 238819 - DNA, 2241 bp, Artificial Sequence
  Description of Artificial Sequence: Synthetic coding sequence
atgatttacaaggtggagtgtgggcttgaggaggatctgaagaacggcaaaatcctcctggccaaggttgagctcgagaagcggcagcttcaagagcgtttcacagatctggagaaggaaaagagtaacatggagattgatatgacgtaccagctgaaggtgatccagcagagtctcgaacaggaggaagctgaacataaagctacaaaagctaggcttgccgataagaacaagatctacgagtccatagaagaagcaaagagtgaagccatgaaggaaatggagaaaaaactgctggaagagaggactctgaagcagaaagttgagaatctcctgctagaggccgagaagaggtgctccctactagattgcgatcttaaacagagccagcagaagatcaacgagcttctcaaacagaaggatgtgctcaacgaggacgtccgtaatcttacgctaaaaattgaacaagaaacccagaaacgctgcctgactcagaacgacctgaaaatgcagactcagcaggttaataccttgaaaatgtccgagaagcagctcaaacaggagaataatcatttaatggagatgaaaatgaacttggaaaagcaaaatgcagaactgcgtaaggagcgacaagacgcagatgggcaaatgaaagaactgcaggatcagttggaggcagaacagtatttcagcacactgtataagactcaggtgcgtgagttgaaagaagaatgcgaagaaaagacaaaattaggcaaagagttacagcagaaaaaacaggagctgcaggatgagcgagactcattggcagctcagctggagattactctaacgaaagccgattctgagcagttagccaggagtatagccgaagaacagtactccgatctggaaaaagaaaaaatcatgaaagaattggagattaaagagatgatggccaggcacaagcaggaacttactgagaaggatgcgaccatcgcatctctggaggagaccaatcggactctcactagtgatgtggccaatcttgctaacgaaaaggaggaactgaataacaaattgaaggacgtccaggagcagctgtctaggctgaaagatgaggagatctcagctgctgcaatcaaagcacagtttgagaagcagctcttgaccgagcggacccttaaaacgcaggctgtgaataagctggccgagatcatgaatcgcaaggagcctgttaaacgcggtaacgatactgatgtgcggagaaaagaaaaagaaaatcgtaaacttcacatggaactgaagtccgaacgcgaaaagctgacacagcagatgataaagtaccagaaggaactaaatgaaatgcaagcccagatagcggaggagtcacagatccgtatcgagctgcagatgaccctggactcaaaagatagcgacatagaacaactgcgcagtcagctccaggcacttcacatcggtctcgacagctcaagcataggaagcggacccggagacgctgaagccgacgacgggttcccggaatccagactcgaaggctggctgagcctccccgttcgaaacaatactaagaaatttggttgggtgaagaagtacgtgatcgtctcttcgaaaaagatcctcttttacgattccgaacaggataaagaacaatctaatccctacatggtgctcgatatcgacaagctgtttcacgtgcgaccagtgacacagacggatgtgtatcgcgctgatgcaaaagagattcctcgaatctttcaaatcctttatgctaacgagggagagagcaagaaggagcaggagttccccgtggagcccgtgggagagaagtcgaattacatttgccacaaggggcatgagtttatcccgactctgtatcattttcctacgaactgcgaagcatgcatgaaacccttgtggcatatgtttaaaccccctcctgccttagagtgcagaaggtgccatattaagtgtcacaaggaccacatggacaagaaagaagagataattgcgccttgcaaggtgtactacgacatttcaaccgccaagaatctcctgttgctagccaacagcactgaggagcagcaaaagtgggtttctcgccttgtcaaaaaaatacctaaaaaacctccagctccagatccgttcgccagatcctcacctcggacaagcatgaagatccagcaaaaccagtccattagaaggccctctcggcagttggctccaaacaaaccttcctag

SEQ ID NO: 238820 - DNA, 3438 bp, Artificial Sequence
  Description of Artificial Sequence: Synthetic coding sequence
atggttcattgtgatacggccgttgggaccccagactacatatcgccagaggtgctgaagagccagggaggtgatggcttttatggacgagaatgtgactggtggagtgtgggcgtgtttctgtatgagatgctggtcggagatacgcccttttacgctgacagcctagtcggtacgtactcaaagatcatggaccataaaaactctctttgctttccagaagacgcggagatctccaagcatgcaaaaaatctgatctgcgcttttctcaccgacagagaggtaagattgggtaggaacggggtcgaggaaatacgccagcatccattctttaagaacgatcagtggcactgggacaatatccgtgaaaccgccgctcccgtggtccctgagcttagcagcgatatcgacagctctaattttgatgacatcgaagacgataagggcgacgtcgagaccttcccgataccaaaggccttcgttggtaaccaactcccttttatcggctttacttactatagggagaatctcctgctctccgattctcccagctgtagagagactgatagcatccagtctaggaagaacgaagaatcacaggaaattcagaaaaaactgtatactcttgaggagcatcttagtaatgagatgcaagcaaaggaagaattggaacaaaaatgtaaaagtgtgaatactagactggagaagaccgccaaggagttggaggaggagatcacactacggaagtccgtggagagtgctctgaggcagcttgaaagagagaaggctttactccagcacaagaatgccgaatatcagagaaaggccgaccatgaggccgataagaaacgcaatctggagaacgacgtcaacagcctgaaggaccagctagaggacctgaaaaaaaggaaccaaaactcacagataagcaccgagaaggttaaccagcttcagaggcaactggacgagactaatgcactgctgaggaccgaatctgatacagccgctcgccttaggaaaacccaggcagagagcagtaagcagatccaacagctggaaagcaataaccgcgacctgcaggacaaaaattgtcttctggagacagccaaactgaagttagagaaggaattcattaacctgcagagtgctctcgaatccgaaaggcgtgataggacacacgggtcagaaataattaacgacctgcagggcagaatttgtggactggaggaagacctcaaaaatggcaagatcctcctggctaaggtggaattagagaaacgtcaactgcaggagaggtttaccgacctcgagaaagagaagtcaaacatggagattgacatgacgtaccaactgaaggtgattcagcagagtcttgagcaggaggaagccgagcataaggccactaaggccagactcgcggacaagaacaaaatatacgagtcaatcgaagaagccaagtctgaggccatgaaggaaatggaaaagaagctgctcgaagagaggacacttaagcagaaggtagaaaacttgctgctcgaggccgagaagcgttgctctttattggactgtgatttgaaacagtctcagcaaaagattaacgaactgctgaagcagaaagacgtactgaacgaagacgtgcgcaacttaaccctgaaaattgagcaggaaactcaaaagaggtgcctaacacagaatgatctgaagatgcagacgcagcaggtgaataccttgaaaatgagcgagaagcaattaaagcaagaaaataaccatttaatggaaatgaagatgaacctagagaagcaaaacgcagaactgagaaaagagcgacaagacgcagacggccagatgaaggaactccaggatcagcttgaggccgagcagtacttctccactctgtacaagactcaggtgcgcgagctgaaggaggaatgcgaggaaaagacaaaactcggaaaagagctgcagcagaaaaagcaggagctgcaggatgaaagagatagcctcgctgcccaacttgaaattactcttactaaggctgactcagaacagctggcgagaagtattgccgaagagcagtacagtgacttggaaaaagagaaaatcatgaaagaactggagatcaaagagatgatggctcggcacaagcaggaactgactgaaaaagacgccacaattgcaagcctcgaggaaacaaatagaacactgaccagcgacgtagcaaacttagctaacgagaaagaagaactgaataacaagctgaaggatgtccaggaacaattgtctagacttaaggatgaagaaatcagcgcggcagcaatcaaggcacagttcgagaagcagctgcttactgagcgtacccttaaaacgcaggcagtgaataagttggccgagatcatgaaccggaaagaacctgttaaaagaggcaacgacacggacgtcagacggaaggaaaaggaaaatagaaagttgcacatggagctgaagtcagagagggagaaacttacacagcaaatgattaaataccaaaaggagctcaacgaaatgcaggcacagatagcagaagagagtcagatcagaatcgaacttcagatgacccttgacagcaaggacagtgatattgagcagcttagatcccagctgcaggcgctgcatattggcctcgattcgtcatccattgggtccgggccaggggacgccgaagctgatgacggtttcccagagtctagacttgaaggttggttgtccctaccggtcaggaataacaccaaaaaattcggatgggtgaagaagtacgtgatagtgagcagcaagaagattctgttctacgatagcgagcaggataaggagcagtctaacccatatatggttctggacatagacaagctcttccacgtgcgccctgtcactcagacagatgtgtatagagccgacgccaaggaaatcccaagaatcttccagatcctgtacgccaatgagggcgaaagcaagaaggaacaggagtttcctgtggaaccagtgggcgagaaaagtaactatatctgtcataaaggccatgagttcatccctactctgtaccactttcccactaattgcgaggcttgtatgaagcctttgtggcacatgtttaagccgcctcccgctcttgagtgcaggcggtgtcacataaagtgccacaaagatcacatggataaaaaagaggagatcattgccccatgcaaagtgtattatgatatttcgacagccaagaatctcttgctcctggcaaatagtactgaagaacagcagaagtgggtcagccgcttagtaaaaaagataccgaaaaaacctcccgctcctgatcctttcgctcgttccagccctaggacatctatgaagattcagcagaaccagtccatccgacggcctagtagacagttggcacctaacaagcccagctag

SEQ ID NO: 238821 - DNA, 2568 bp, Artificial Sequence
  Description of Artificial Sequence: Synthetic coding sequence
atgagtgaggccagaagggattctacctcatcgttacaacggaaaaagccaccatggctgaaactggacatcccctctgcagtccctctcaccgccgaggagccgtcttttttgcagcccttgcggaggcaagccttcctccgatctgtgtcgatgccagcggaaactgcccacatcagcagcccccatcatgaacttaggcggcctgttctgcagcgtcagacttctatcacccaaaccatacgccgtggcacggccgactggttcggggtgagcaaagacagcgacagtactcagaaatggcagaggaaatctattcgacattgtagtcaaaggtacgggaaactaaaaccccaggtgctccgagagctcgatctgcccagtcaggacaatgtgagcctgacctctactgaaacccctcctcccctgtacgtcgggccttgccagctggggatgcagaaaattatagaccctctagcgagaggccgagcctttagagtggctgatgacaccgcggaggggctaagcgccccacacactcccgtcacaccaggagccgcttctctgtgttccttttcttcaagtcgttccggtttccacaggcttcctcgccgacggaaaagagagtccgtcgcaaagatgtccttccgcgctgccgctgcgcttatgaaaggtagaagcgtaagggacggtaccttccgacgtgcacaacggcgttcatttaccccagcgagctttctggaagaagataccacagacttcccggacgagttggatacctctttttttgcccgagagggcatactgcacgaggagttgtccacctaccctgatgaggtgttcgaaagccccagtgaagccgctctgaaagactgggaaaaagctccagagcaggctgatctgacaggtggagctcttgacaggagcgagcttgagagaagccatctgatgctccccttggaaagagggtggcgcaaacaaaaggagggggctgcagcgccacaaccaaaggtgcggctgaggcaggaagtggtttccactgctggcccaaggcgcggacagaggatcgctgtgcctgtgaggaaacttttcgcacgggaaaaaagaccctacgggcttggaatggttggccgtctgaccaaccgcacctaccgcaaacggattgacagcttcgtgaagcggcagattgaagatatggatgatcacaggccctttttcacctactggttgacatttgtacatagtctggtgactattctggccgtatgtatctacggaatcgctccggttggtttttcacaacacgagactgtcgatagtgtgttgcgcaaccggggagtgtatgaaaacgtcaagtacgtacaacaggaaaacttctggatcggtcctagtagtgaggcactgatacacctgggcgctaaattcagcccatgcatgcgtcaggacccccaggtgcacagctttatacgctcagccagggaaagagagaaacacagtgcttgttgcgtgagaaatgataggagcgggtgcgtgcagacatctgaggaagagtgctccagtactctcgcggtctgggttaagtggcctattcaccctagcgcgcctgagctggcgggtcataagaggcagttcggtagtgtttgccaccaggaccccagagtgtgtgatgaaccgtcttccgaagatcctcatgagtggccagaggacatcactaagtggccgatctgcaccaagaattcagctggaaaccacaccaatcacccacacatggattgcgtcatcactgggaggccttgttgcattggcacgaaaggacgatgtgaaataacatcaagagaatattgcgatttcatgaggggttacttccacgaagaggccacattgtgttctcaggtacactgcatggatgacgtgtgcggcctcctgccttttctcaaccctgaagtgcccgaccaattttatcgattgtggctctctctctttctgcacgctgggattctgcactgtctcgtttcaatatgctttcaaatgacagtcctccgcgacctcgagaaactcgctgggtggcaccggattgcgataatttacctcctgagtggagtgacggggaacctggcttccgcgatttttctcccataccgggcagaggtaggacccgctggcagccagtttggtatccttgcctgcttgtttgttgagctgtttcagtcgtggcagatactcgccaggccttggagggctttcttcaagcttttagctgtggtactgttcctgttcacatttggcttgctgccttggattgataactttgcccatatttctgggtttattagtgggttgtttctgtccttcgccttcttgccctacatatcattcgggaagttcgacctctacagaaaaagatgccagataatcatcttccaggtcgtattcttgggactcttggctggcctcgtggtcctgttttatgtctaccccgtgagatgcgagtggtgcgaatttcttacctgcatcccgtttacagacaaattttgtgagaagtatgaactggacgcccaattacactag

SEQ ID NO: 238822 - DNA, 573 bp, Artificial Sequence
  Description of Artificial Sequence: Synthetic coding sequence
atgtcagaggcacgcagggattcaacatcctccctccagagaaaaaagcctccatggctaaaactggacattccaagtgcggtgcctctgactgctgaagagccaagttttctgcaacctctccgcagacaagcatttctgaggagcgtgtcgatgcctgctgagaccgcgcatatatcaagtccccatcacgaattgagacggccagtgctacaacggcaaacatccatcactcagacaatacggtccagtagacaagttcgatttgggagggtccatacactgccgctcttgggtcctcgcgctgcccgacgcgcatttcctcaacgccagtccctgagttggagcttactgcgaggtaccgccgactggtttggggtgtccaaggactcagattcaactcaaaaatggcaaagaaagagtattcgtcactgctcgcagaggtacggcaaactcaaaccccaggtattgcgggagctggatttgccttctcaggataacgtgagcctgactagcacagaaacacctccaccactgtacgtcgggccttgccaactaggaatgcagaaatag

SEQ ID NO: 238823 - DNA, 699 bp, Artificial Sequence
  Description of Artificial Sequence: Synthetic coding sequence
tgacgcccatgttgcatcgggacgaagggtagatgcgaaattactagtagagaatactgtgatttcatgagaggctactttcacgaggaggccactctctgcagtcaggtgcactgtatggacgacgtatgcggcctgctgcctttcctaaatccagaaatgacggtcctcagggatttggagaagcttgccggttggcataggattgcaatcatatacttgctgtctggtgtcaccggcaacctcgcctccgcaatctttcttccctaccgcgcagaggtgggacctgctggatcccagttcggtatcctcgcctgcttgtttgtggagctttttcagagctggcagatccttgcaaggccatggcgtgctttctttaaactgctggccgtggtgctgttcctgttcacttttggattattaccatggatcgacaacttcgctcacatcagcgggttcatatcaggcttgttccttagtttcgcctttttaccctacatctcgtttggtaaatttgacctgtaccggaagcggtgccaaatcatcatatttcaggttgtctttctcggcttactggccggactggtggtcctcttctatgtgtacccagtgcgatgtgagtggtgtgaatttctgacttgtattccctttactgataaattttgcgaaaaatacgaactggatgcccaactccattag

SEQ ID NO: 238824 - DNA, 492 bp, Artificial Sequence
  Description of Artificial Sequence: Synthetic coding sequence
atgtctgaagcccgtcgcgactccacttcgtcccttcagaggaaaaaacctccctggctaaagctcgatatccctagcgctgtgcctctgaccgccgaggagccttccttcctgcagccactccgcagacaggcgtttctcagaagtgtgtctatgccagcggagaccgcgcacatttctagcccacaccatgagctccgtagaccagtgctccaacgtcagacaagcattacccagacaattaggcggggtaccgccgactggttcggggtatcaaaggatagcgactccacacagaaatggcagcggaagagtattcgccactgttctcagaggtatggaaagctgaagccacaggtcctgagagagcttgatctgccaagccaggacaatgttagccttacaagtacggagacaccaccgccactgtacgtgggtccttgtcagctcggaatgcagaaaatcatcgacccattggcaagaggacgatag

SEQ ID NO: 238825 - DNA, 1740 bp, Artificial Sequence
  Description of Artificial Sequence: Synthetic coding sequence
atgtctgaggcacggagagatagcaccagctcactccaaagaaagaaacccccttggctgaagctcgacatccctagcgcagtgccgctaactgcggaagaacccagctttttgcagccactgcgcagacaggcctttctccggtccgtttctatgcctgccgagacagcccatatctctagcccgcatcacgaactcagacgacctgtcctgcagaggcagacatcgataacccagaccatccggagagggaccgccgattggtttggagtgtccaaagatagtgattctacccagaagtggcaacgcaaatccatacggcattgcagtcaaagatatggcaagctcaagccccaggtactgagggagctcgacttacctagtcaggataacgtgagcctgacaagcacagaaactcctccccctctgtacgtcggaccctgccagctgggtatgcagaaaatcatcgatcccttagcgagaggaagagctttcagagtggccgacgacacagcagagggcttgtcagcccctcataccccagtgacccctggtgcagcaagcctatgcagctttagctcatcacgaagcggattccatagactccccaggcggaggaaaagagaatccgtcgcgaagatgagtttccgcgctgctgcagccttgatgaaaggtaggtcagtcagggacggaacatttagaagggctcagaggaggtccttcactccggcatcattcctggaggaagacaccaccgatttcccagacgagctcgacacctctttttttgcgagggagggcattctccacgaggaactgagcacttatccagacgaggtcttcgagagccctagtgaggccgctttgaaggattgggaaaaggcaccagagcaagccgaccttactggcggtgccctggatcgatctgagctggagcggtcacatctgatgctcccgttagaaagagggtggcggaaacagaaggagggagcagcggctccacagccaaaagttaggctgaggcaggaagtagtgagtaccgcaggccctagacggggtcaacgcatagctgtcccagttcgcaagcttttcgcaagagaaaagagaccttacgggctgggcatggtggggaggcttacaaatcgcacgtaccgaaagcgcatagactcgttcgtgaaaaggcagatcgaggatatggatgatcataggccgtttttcacttattggctcacctttgtacactccctcgtgacaatcttggccgtgtgcatctacgggatcgcgccagtgggtttctctcaacatgagacagtggacagtgtactcagaaatcgaggggtctacgagaatgtgaaatacgtgcagcaggagaatttctggatcgggccatcatctgtcagaacaggcttgggagccggaccagccggtgccggacctgggggagctcgcagaggacaggaggctccggactgcggtcgttcttctcccagtcccgcaggtgggccacacccacctggaagacaggtgtttgcattgcacgcgccaggaccagccggtgctcaactccactccctgggggcacgagctcgtgaggccttaaggctactgagagcccagaggcaggtcgggcttagagcggacctgggcggtggcgtgctcggggctttccccaggcctggactcccaccctcaagcgccagatgtagcctcttccggcctcagattgattccgcagagtag

SEQ ID NO: 238826 - DNA, 2571 bp, Artificial Sequence
  Description of Artificial Sequence: Synthetic coding sequence
atggcctccgccgataagaacggcggttctgtgtcgtctgtgtcctcaagccgccttcagtctaggaagccaccaaacctgagcataactatcccccctccggaaaaagagactcaggcgcctggtgagcaggacagcatgctgccagagggtttccagaaccgcagactcaagaaaagccagccacgtacttgggccgctcacaccaccgcatgcccccctagctttctgcccaagcgcaagaatcccgcttacctaaagtccgtgagcttacaagaacctcggtctaggtggcaggaaagtagtgagaagcgccctggcttccggagacaggcctcactgagccagtcgattcggaaaggcgctgcacaatggtttggggtgagtggcgattgggagggacaacggcagcaatggcagagacgaagtctacatcactgttctatgcgttacggtcgactcaaagctagttgtcagcgagatctggagcttccctcgcaggaggccccatcctttcagggtactgagtcccccaagccttgtaagatgcctaagatcgtcgatccacttgctagaggtcgcgctttcaggcatcccgaagaaatggataggccgcacgccccacacccccctctcacccctggggtgttgtccttaacaagttttaccagtgtgagaagtggatattcccatctgcctagacgaaagagaatgagtgtggcccatatgtcactccaggcagccgcagctctgctaaagggccgtagcgtgctcgatgcaaccggacagcggtgcagagtggtgaaacgcagctttgcttttccaagctttctcgaggaggacgtcgtggacggagcggatacattcgattctagcttcttcagtaaggaggagatgtcaagtatgcccgatgacgtcttcgagagccccccactgagcgcgtcatacttccgcggaatcccacatagtgctagccctgtttcacctgacggtgttcagattccgctcaaggaatatggacgggcaccagtccccggacctcgacggggtaaacgcatagcgtcaaaggtcaagcatttcgctttcgatcggaaaaagcgacattatggcctgggcgtcgtggggaattggctcaacagaagctatcgtcgttcgatttcaagcacggtgcagagacagctggaatcctttgatagccacagaccttattttacttattggttaaccttcgtccatgttattatcactctcttggtcatttgtacctacggtatcgcacccgtgggatttgcacagcatgtgacaacccagctggtgctccggaataagggcgtgtatgagagtgtcaaatacatccaacaagaaaatttctgggtcggccctagtagcattgatcttatccatctgggggctaaattctctccatgcatcaggaaggatggacagatcgagcagctcgttctgcgggaacgcgatttggaacgcgactcgggttgttgcgtgcagaatgatcattcaggatgcatccagacccaacggaaagactgttcagagaccctggctaccttcgtgaaatggcaagacgataccgggccacctatggacaaatcagaccttggccagaaaagaacttcgggggcagtctgccaccaagacccacggacatgtgaggagcccgcttcctcaggcgcacacatttggcctgacgatattacaaagtggcctatttgtactgaacaagcccgaagtaaccacacaggctttctccatatggattgtgaaatcaagggcagaccctgttgtattggtactaagggctcgtgcgaaatcactacgcgggagtactgtgaattcatgcacggttattttcatgaagaggctacactctgctcgcaagtgcattgcctcgataaggtctgcggactgctgccatttctgaatcctgaggttccagatcagttttatcgcctgtggctttcccttttcctccacgcaggagtggtacattgtctggtatcggtcgttttccagatgacgattctcagagacctcgagaagctagccggttggcaccgcattgccatcatcttcattctctctggtattacaggcaacttagcaagtgctattttccttccataccgggcagaggttgggccagctgggagtcagtttgggcttctggcatgccttttcgttgaactgtttcagagttggcctttactcgagaggccctggaaggcatttctgaacctgtcggcaatcgtcctgtttctttttatttgtggcctgctgccctggattgacaacatcgcccacattttcgggtttctctctggactgttgcttgcttttgcgttcctgccctacatcaccttcggcacatcagacaagtaccgcaaaagggctttgatcttggtgtccctcttagcatttgcaggcctttttgcagctttagtgctgtggttgtacatttatccgattaactggccttggattgagcacctgacatgtttcccattcacctcccgcttctgcgaaaaatacgaactagatcaggtcttgcattag

SEQ ID NO: 238827 - DNA, 2484 bp, Artificial Sequence
  Description of Artificial Sequence: Synthetic coding sequence
atggcgtcggccgataagaatggtggatctgtctcctccgtttcctcaagtcgcctgcagtcccggaaaccccctaatctctctataacaattccgccacccgagaaagaaacacaggctcctggcgagcaggacagtatgctgcctgaaaggaaaaatccagcctatctcaaaagtgtgagcttacaagaacccaggtctagatggcaggagtcgagtgaaaagagacctggctttcggcgacaggccagtctgtcacagtcaattagaaaaggggctgcccaatggtttggggtgagcggggattgggagggacagcgccagcagtggcaacgccgttctctccatcactgcagtatgcggtatggacgcctgaaggctagctgccagcgcgatttggagttgccttctcaagaagccccaagttttcagggcacagaatcgcccaagccttgtaagatgccaaaaatcgtggatccactggcaaggggaagggcatttcggcatccggaagagatggaccgaccccacgcaccgcaccctcctctgactccgggagtcttaagtcttacaagctttaccagtgttcgtagtggctatagccacctgcctcggcgaaaacgcatgtcggtggctcacatgtcccttcaagctgccgctgccttattgaaggggcgatcagtgttagatgccaccggccagcgctgtcgcgttgtgaaaagatccttcgcgtttccctcttttctggaagaggacgtggtggatggcgctgatacttttgactcgtcgtttttcagcaaagaggagatgtcgagcatgcccgacgatgtatttgaaagccctcctctatctgctagctactttcgaggaatcccacatagcgcttccccagtgtctcccgacggtgttcagatccctctaaaagaatacggccgtgctccagtgcctgggcctcgaagggggaaacgcatcgcctccaaagtcaagcattttgctttcgatcggaaaaaacggcattatgggctgggggtggtgggcaactggctaaatagatcctatagaaggtccatttcctctacggtccaacggcagctggagtctttcgacagccacaggccctacttcacctactggctgacctttgtgcatgtcattataactctcttggtcatatgcacctatggtattgctcccgtgggctttgcacaacatgtgacaacgcagctggttctgaggaacaagggtgtttatgaatccgtcaaatacattcaacaggagaacttttgggtgggccctagcagcatcgatttaattcatttgggcgctaaattcagcccctgtatccgcaaagacggtcaaattgaacagctcgtgttgcgcgagcgcgacctggaaagggactcaggatgttgtgtgcagaacgaccatagcggatgtattcagacccagcggaaagattgtagcgaaaccctggctacgttcgtaaaatggcaggatgatacagggccacccatggataaaagcgacttgggccagaagagaacctcaggagcggtttgtcaccaggaccctcggacatgcgaagaaccggcttcctctggagcacatatctggcccgacgatatcacgaagtggccaatttgcacagaacaggctcgcagtaatcacacaggttttttacatatggactgcgaaataaagggcaggccatgctgcatcgggacaaagggatcctgtgagattacgactcgcgagtattgcgagtttatgcatggatatttccacgaagaagcaacactgtgcagtcaggtgcattgtcttgataaagtttgcggcctgttaccctttctgaatccggaggtgcctgatcagttttacaggctttggctgtctctttttctgcatgcaggagtggtccactgcctggtcagtgtggtatttcaaatgacaattctgagggatcttgaaaagttggccggatggcaccggattgccattatttttatcctctccggaataactggtaatctggcgtcggctatttttctgccttacagggccgaggtcggccctgccggttcgcagttcggtcttctggcctgtcttttcgtggaactgttccaaagctggccccttctggagcgcccatggaaagcttttctaaacctgtccgctatagtgctgttcctttttatctgcgggctgctcccttggattgacaatattgcccacatctttgggtttctgtctgggctgcttctcgccttcgctttcctaccctatatcacctttggcacttctgacaagtacaggaagagggccctaattttagtcagcttgctggccttcgcgggactatttgcagccctggtgctgtggctctacatatacccaatcaactggccgtggatcgagcatttgacatgtttccctttcaccagccgattttgcgaaaagtacgagctggaccaggtgcttcactag

SEQ ID NO: 238828 - DNA, 2151 bp, Artificial Sequence
  Description of Artificial Sequence: Synthetic coding sequence
cctggaagctcacggtccaggcacccacttttactgctgatctggtcccttggtagttctcagggtcctcatagacaaattcgccctccaccaccctgcagacacgccggaacacacgtgccgagtcctttgccccatacccaagtgcaccggaggcggcaagcgtacgcccacctgtcactggtgtgcttccggagaggggcagctcagtggtttggagtcagcggggactgggaaggacagaggcaacagtggcagcgacgctccctgcatcactgtagtatgcgatacggccgactgaaagcctcatgccagagggatttggaactgccatctcaagaggccccttcttttcaaggaaccgaaagtcctaaaccctgcaagatgcctaaaattgtagaccccttggcgaggggcagggcctttcggcatcctgaagaaatggaccgccctcacgcaccccacccccctcttacacccggagttcttagtttaacttccttcacatcagtccgcagcggctactcccacctgccgaggagaaagcgcatgagtgtggcgcacatgtcactgcaagccgctgccgcactgctgaagggacgctcagtgttggacgccaccggacagaggtgtcgggtagtgaagaggtcatttgctttccctagttttcttgaagaggacgtcgtggacggtgctgacacctttgactccagtttctttagcaaagaggagatgagctctatgccggacgacgtgttcgagagtcccccactgtccgcatcatatttccgcggtatcccgcattcagccagtcccgtcagccctgatggggtgcagattccccttaaagagtacggaagggcacctgtccccggtccaaggcgagggaagcgcatcgcctcaaaggtgaagcatttcgctttcgaccggaagaagagacattatggcctgggagtcgtcggaaactggcttaacaggtcttatcgccgttccattagctcaacagtacagcgtcagctggaatcatttgacagtcaccgaccttattttacctactggttgacattcgtgcacgttatcataacattattggtcatctgtacgtacggtatagcgcctgttggctttgcccagcacgtcacaactcaactcgttttaaggaacaaaggggtatacgaatcagttaagtatatccagcaggaaaacttctgggtagggccatcttcaatcgatctgattcacctaggcgcaaagttctcaccgtgcatccgcaaggacggtcaaatcgaacagctcgttctcagggaaagagatctagaaagggattctggttgttgcgtccagaacgatcacagcggttgtattcagacccagcggaaagactgtagtgaaacactagcaacattcgtgaagtggcaagatgacacaggccctccaatggataaatctgacctcggtcagaaaagaacgagcggggctgtgtgccaccaggatccgaggacttgcgaagaacccgcatcttctggcgcacacatctggcccgacgatattaccaagtggccaatatgcacagaacaagcgagaagcaaccataccggctttctccatatggactgtgagatcaagggtagaccctgttgcatcggtactaagggcagctgcgagataactacacgcgaatattgcgaattcatgcacggctacttccacgaggaggctactctgtgcagtcaggtgcactgtctggacaaagtctgtggactgcttcccttccttaaccccgaggtacccgaccagttctaccggctatggctgtccttgttcctacacgcaggtgtagtccattgtctggtctcagttgtctttcaaatgaccattctcagagaccttgagaaactggctggctggcatcggattgcgatcatttttatccttagcggtataaccggaaacctggcatcagcaatttttctgccctacagggcggaagtccgcatgtggagaatgggacctctccctcacattggaggacagccttgttgttcttactcaacccatctcggatcagctcgcggtacacgatgtccttcctgtaccggtctgcacagtggaggaactgccaacctgggtgcatattggctggtgtcatag

SEQ ID NO: 238829 - DNA, 639 bp, Artificial Sequence
  Description of Artificial Sequence: Synthetic coding sequence
atggcccagacagacaagccaacctgcatcccacctgagctgccaaagatgctgaaggaattcgctaaggcagccattcgggtacagccccaggatctgattcaatgggctgccgactatttcgaggctttgtcacggggtgaaacaccacccgtcagagaaagatcagagagggtagccctctgtaacagggctgagcttacccccgagttgctcaagatcctgcactcccaagtggccggtcggctgattattagggctgaggaactggcgcagatgtggaaagtcgtcaatctacctacagacttgttcaattctgttatgaatgtggggaggtttacagaggaaatcgaatggctcaaatttctcgcactggcttgcagcgctctaggagtcacaataaccaagacactgaaaatcgtgtgcgaggtcctcagttgcgatcacaacggcggatctccaagaattccctttagtacttttcagttcttatacacctacatcgccaaggtggatggtgagatttccgcatcacacgtcagccggatgttgaattatatggaacaggaagttatcggccctgatggaatcataactgtgaacgatttcacccaaaatccgcgtgtgcagctggaatag

SEQ ID NO: 238830 - DNA, 639 bp, Artificial Sequence
  Description of Artificial Sequence: Synthetic coding sequence
atggcccaaaccgacaagccaacgtgcattcccccagaactgccaaagatgctcaaggagtttgcaaaggcagctatccgcgtccaaccgcaggacctgattcagtgggctgccgattactttgaggctttgagtaggggggagacaccaccagtcagagagagaagcgaaagagtggcattgtgtaacagagccgagctgacccctgagcttctcaagatcttgcacagtcaggtcgccggtagactgatcattagggccgaagaactagctcaaatgtggaaggtagttaaccttccaacggacctgttcaactccgtaatgaacgtggggcgtttcaccgaggagatcgaatggctcaaattcctggccttggcctgcagcgcgctaggagtaaccatcacaaagaccctgaaaattgtgtgcgaagtccttagttgcgatcacaatggcggaagcccgcgtataccgttctccacatttcagttcctttatacttacatcgctaaagtggatggcgagatcagcgcgagtcacgttagtcgaatgctgaattatatggagcaggaggtaatcgggccagatggcatcataaccgtgaatgattttacccagaatcctagggtccagctcgagtag

SEQ ID NO: 238831 - DNA, 351 bp, Artificial Sequence
  Description of Artificial Sequence: Synthetic coding sequence
atggcccagactgacaagcccacgtgcattccccctgagctcccgaagatgctgaaggagttcgcaaaggccgctatcagggtgcagccacaggacctaatacagtgggccgcagactatttcgaggctctctcccgcggagaaaccccaccagtgcgcgagagatccgagagagtcgctctgtgcaaccgggcagaattgacaccagaactgctaaaaatcctgcatagccaagttgccggaaggttaatcattcgggcagaggagctggcccagatgtggaaagtagttaatctgccaacagatctgttcaattctgtcatgaacgtcgggaggtttaccgaagagtag

SEQ ID NO: 238832 - DNA, 393 bp, Artificial Sequence
  Description of Artificial Sequence: Synthetic coding sequence
atggcgcaaacggataaacccacatgtatcccaccggaactgccgaaaatgctcaaggagtttgcaaaggcggctatccgagtgcaaccgcaagacctgatccagtgggctgctgactatttcgaggcactcagccggggagagacaccaccagtgcgcgagcgatccgaacgagtggctctctgcaatagagccgaactgacaccagagctcctgaaaatcctgcactctcaggtggcgggacggcttatcattcgggctgaagagctggcccagatgtggaaggtagttaacttaccaacagacctcttcaattctgtgatgaacgtaggtaggtttactgaagaaatcgaatggttgaaattcctggcactcgcctgcagcgccctctag

SEQ ID NO: 238833 - DNA, 312 bp, Artificial Sequence
  Description of Artificial Sequence: Synthetic coding sequence
atggcccagactgataaaccaacatgtattccacctgagttaccaaagatgctcaaggagttcgctaaagcggcaattcgggttcagccacaggacctgattcagtgggcagccgattattttgaggctctgagccgtggagagactccgccagttcgagagcggtcggagagagtagccctgtgcaacagagcagagctcactccagagttgctcaagattctgcattcgcaggtggcagggaggctaataatccgtgccgaggagctggcacaaatgtggaaagttgttaatctcccaacagatttgtag

SEQ ID NO: 238834 - DNA, 234 bp, Artificial Sequence
  Description of Artificial Sequence: Synthetic coding sequence
atggcccaaaccgacaagcctacgtgcataccacctgagctgcccaaaatgctcaaggagttcgctaaagccgctatccgcgtccaacctcaggacttgatccaatgggcggctgactattttgaggccctcagccgaggcgaaacacctcctgtcagagagagatcagagagagtggcattatgcaatcgggcagagctgactccggagctgttgaagatcctccattcctag

SEQ ID NO: 238835 - DNA, 693 bp, Artificial Sequence
  Description of Artificial Sequence: Synthetic coding sequence
atgccactgcccgataccatgttctgcgcccagcagattcacataccccctgagctgcctgacatcctgaaacagttcactaaggctgcaatcaggacccagccggctgatgtgctccgctggtccgccggatattttagcgccctctcccgcggtgaccccctcccagtaaaagatcgaatggagatgccaacagctacccagaagactgatacagggcttacacagggtttgctgaaagttctgcataaacagtgtcatcataagcgctatgttgagctgacagatctggaacagaaatggaaaaatttgtgtctccccaaggagaaatttaaagctcttctgcagctggacccctgcgaaaacaagatcaagtggatcaatttcctggcacttggctgctcaatgctaggagggagcctcaacacagccctgaaacacttgtgcgagatccttacagatgatccagaaggaggacctgctcgcatccctttcaaaactttttcctatgtttatcgctatctagctagacttgattcggacgtgagcccattggagaccgaaagctacctagcgtccctgaaggagaatatcgatgccaggaaaaatggcatgataggtcttagcgacttttttttccctaagaggaagctgttggaatcaatcgaaaacagcgaagatgtgggtcattag

SEQ ID NO: 238836 - DNA, 693 bp, Artificial Sequence
  Description of Artificial Sequence: Synthetic coding sequence
atgccgttgcctgacacaatgttttgtgcccagcagattcatatcccacccgagctgcccgatatcctcaaacagttcactaaggcggctatccgaacgcagccagcggatgtgcttagatggagcgccggatacttttccgcactatctcggggagatccactcccagttaaggaccgcatggagatgcctacagccacccagaaaacagacacaggactgacacagggccttttgaaagtgcttcacaagcagtgccaccacaaaaggtatgtagaattgacggacctggagcagaagtggaaaaatctctgcctgcctaaagaaaaatttaaggctcttttgcaactggatccatgcgagaacaaaattaagtggattaactttttggcgcttggatgtagcatgctcgggggaagcctaaacactgccctgaagcacctgtgtgagatattgaccgacgacccggaaggcggacctgcaaggattccttttaaaacattttcctatgtatataggtacctggctcgactggacagcgatgtgtcacctcttgagacagagagttatctcgcaagtctcaaggaaaatattgacgccaggaaaaatggtatgattggcttaagcgatttctttttcccaaagaggaagctattggaaagcatcgagaacagtgaggacgtcggacactag

SEQ ID NO: 238837 - DNA, 2091 bp, Artificial Sequence
  Description of Artificial Sequence: Synthetic coding sequence
atggatgctgatatggactatgagaggcctaatgtggagaccataaaatgcgtagtggtcggagataatgccgtgggtaaaactcggctgatctgcgctagagcatgcaatacaaccctgactcagtatcaactgctggccactcacgtacccaccgtttgggctatagaccagtatcgcgtatgtcaggaggtgctggaaagaagtcgagacgtggtggacgaggtatccgtgagtctccgtctgtgggatacctttggcgaccaccacaaggaccgaagattcgcttacggcagaagcgacgtggtggtgctgtgcttctctatcgccaaccccaactcattgaatcacgtgaagagtatgtggtatccggaaattaaacacttctgcccaagaacacccgtcattctcgttgggtgccagctggacctacgctacgcagatctggaagcagtgaaccgggctcgacgcccactggcccgtcctataaagaggggtgacattctacctcctgaaaaagggcgagaagtggctaaagagctcggattaccatactatgagacctctgtattcgaccagtttggtatcaaggacgttttcgacaatgccataagagccgcactgatctctaggcgccatctgcagttctggaaatcgcacctgaaaaaagtgcaaaaacccttattacaggccccttttctgccccctaaggcacccccaccggtgatcaaaattccagagtgccctagcatgggcactaatgaggcagcgtgcctccttgacaatcccctctgtgctgatgtcctgtttatcctgcaagaccaggagcacatcttcgcccacagaatctacctagccactagttcaagcaagttttacgacctgtttctgatggaatgtgaagaatcgcctaatgggtcagagggggcttgcgaaaaggaaaagcaaagcagggacttccagggcaggatcctgtcggtggaccccgaagaggagagggaggagggccctccgcgaatcccacaggccgatcagtggaaaagctctaacaaatccttagttgaggcactggggctggaggctgagggggcagtcccagagactcagaccctgactggctggagtaagggttttatcgggatgcaccgggagatgcaggtgaacccaatctccaagaggatgggcccaatgaccgtcgttcggatggatgcatcagttcagccgggtccattcaggacactgctacaattcctgtacaccgggcagcttgatgagaaggagaaagacctggtggggctggcccagatcgccgaggtgctggaaatgtttgatcttcgcatgatggtagaaaatataatgaacaaggaggcctttatgaatcaggagatcactaaggccttccacgtccgtaaggcgaaccgcatcaaagagtgcctctcaaaaggcaccttctccgacgttacctttaaactcgatgacggcgctatcagtgcccataaacctctcctgatctgctcttgtgaatggatggctgccatgttcggtggctctttcgtggagagcgccaattctgaagtgtacttaccgaatatcaataagatttcgatgcaggctgtgttagattacctctacacgaagcagctctcccccaacctggacctggaccccttagaattaatagctcttgcaaatcggttctgtctgccccatctggtggccctagccgaacagcatgccgtgcaggagctcacgaaagccgcaacctctggtgttggaattgatggcgaggttctgtcttaccttgagcttgcacagtttcacaatgcccaccagctggcagcctggtgcttgcaccacatctgcacgaactacaatagcgtctgctcgaagttccgcaaagagatcaagtccaaaagcgccgacaaccaggagtattttgaaaggcacaggtggccgccagtctggtacctcaaggaagaagatcattatcaacgggttaaacgagaacgcgagaaagaagatatcgccctgaacaaacataggagcagaaggaaatggtgcttctggaactccagccctgcggtcgcatag

SEQ ID NO: 238838 - DNA, 2091 bp, Artificial Sequence
  Description of Artificial Sequence: Synthetic coding sequence
atggatgctgacatggactatgagcgcccaaacgtggaaacaattaagtgcgtggtggtgggggacaacgctgtcgggaagacacgcctcatctgcgcccgtgcctgtaatacaaccttgacccagtaccaactactggcgacccacgtgcccacagtgtgggctatcgatcaataccgcgtatgtcaagaggttctggaaaggagtcgggatgtcgtcgacgaagtgtcggtttcactgaggctgtgggataccttcggagaccatcacaaagaccgcaggttcgcctacggcagatccgacgtggtggtcctgtgcttctctatcgccaaccctaatagtctgaatcatgtaaagagcatgtggtacccagagatcaaacatttctgtccaagaacccccgtgatcctggtgggatgtcagctcgatctgcgttacgccgacctggaagccgtaaatcgcgcacgcagacccctggctcggcctattaaaaggggcgacatattgcctccagaaaaggggagggaagtggccaaggaactgggactgccttactatgaaacctccgtgtttgaccagtttggtataaaagacgtgtttgataatgccattcgcgcagccctcattagcaggcgtcacttgcagttttggaaaagccacctgaagaaagtgcaaaagcccctcctgcaagcgccatttttgcctccaaaggcccctcctccagtcatcaaaatcccagaatgtccgagcatggggaccaatgaggcagcgtgtctactcgacaaccctctctgtgcagacgttctcttcatcctgcaggatcaggagcacatcttcgcgcacagaatctacctggcaacgagcagctcgaaattctatgacctctttctcatggagtgcgaggagtccccgaacggttctgagggagcctgcgagaaggaaaaacaatcacgcgatttccaaggacggattttgtcagtggatcccgaggaggagcgggaagagggccctcctcgcattccacaggccgaccaatggaaatcatcaaacaagtcactagtcgaggccctcggcctggaagcagaaggcgcagtccctgaaacacagactctgactgggtggtcaaaagggttcatcgggatgcaccgagagatgcaagtgaaccccatcagcaaacgaatgggccctatgactgtcgtccgcatggacgctagtgttcagccgggaccatttagaacgctgttgcagtttctgtacacaggccagctcgacgaaaaggagaaagatctggttgggttagcccagattgcagaagttttagagatgtttgacctccgaatgatggtggaaaacatcatgaacaaggaggcattcatgaaccaggagattacaaaggcatttcatgtgaggaaagccaacaggattaaagagtgtttgtcgaaaggaacgttcagtgatgtgaccttcaaactggatgacggagcgatctctgcacacaagccactattgatttgtagttgtgaatggatggccgcaatgttcgggggttcattcgtcgaatccgcaaattctgaggtgtaccttcccaatatcaacaagatctctatgcaggcagtccttgattatctgtacactaagcagctttccccaaatctggatctggatcctctcgagctgatcgcacttgcgaatagattttgcctgcctcacctagttgctctcgccgaacagcatgccgtgcaagagctcacgaaagccgcaacgagcggcgtcggcatcgatggcgaagtgctgtcctacctcgagttggcccaatttcataacgcccaccagctcgccgcttggtgcttacaccacatctgcaccaactacaactcagtgtgtagtaagtttcgtaaagaaattaaatcgaagtccgcagataaccaggaatactttgaacggcaccgctggccacctgtgtggtacctaaaagaggaggatcactatcaacgggtcaaaagggagagggagaaagaagatattgccctgaataaacacaggtcccgtagaaaatggtgtttttggaacagtagcccagctgtggcatag

SEQ ID NO: 238839 - DNA, 300 bp, Artificial Sequence
  Description of Artificial Sequence: Synthetic coding sequence
atggacgccgatatggattacgagcggccaaacgtcgaaacaatcaagtgcgttgtcgtgggcgacaatgccgttggaaaaacgcgcctgatctgtgcccgtgcatgtaatactactttgactcagtaccaattgctggcgacccatgtgcccaccgtgtgggcaattgatcagtatagggtgtgccaggaggttctggagaggtcacgagatgtggtagatgaggtgtctgtgtccctgagactctgggacacctttggcgatcaccacaaagaccgccgattcgcctacgggaggtag

SEQ ID NO: 238840 - DNA, 2184 bp, Artificial Sequence
  Description of Artificial Sequence: Synthetic coding sequence
atggactctgatatggattatgagcggccaaatgtggaaaccatcaagtgcgtagtcgtgggtgacaatgcagtaggcaaaactcgcctcatttgcgctagagcttgtaatgctacacttacccaataccagctgctcgctacgcacgttccgacagtctgggccattgaccagtatcgggtgtgccaagaagtgctggaaagaagtcgtgatgttgttgacgacgtgtccgtatcacttcgactgtgggacacttttggtgatcaccacaaggacagaaggttcgcttacggcagaagcgacgtggtagtgctgtgtttcagtattgctaaccccaactcattgcatcacgtgaagactatgtggtaccccgaaattaagcacttctgccctagagcccctgtcatactcgtcgggtgccagcttgatctcaggtatgctgatctggaggccgtcaatcgggcaaggagacccctggctcgtcctattaagcctaatgagatcctcccaccagaaaaggggagagaggtggcgaaggagctggggatcccatattacgaaacctccgtcgtggctcagttcggaatcaaggacgtcttcgacaatgcaatccgagctgcccttatatcccgcagacacctgcagttctggaagtcccatttgaggaacgtgcaaaggcctcttctgcaggctcccttcttacccccaaaacctcctcctccgatcatcgttgtccccgacccaccatcctcttcggaggaatgcccagctcacctgctggaagatcccctctgcgccgacgttatactggtgctgcaagagcgcgtcagaatcttcgcccataaaatttacctgagcacttcgtccagtaaattctacgacctctttctgatggatctcagcgagggagagctaggcggaccttccgagcctggcggtacgcatccggaagatcaccagggccacagtgatcaacaccaccatcatcaccaccaccatcacggcagagacttcctgttgagagccgcttcattcgacgtatgtgaatctgtcgacgaggccggagggagcggacccgcaggcctccgagcaagcacctctgacggtattctgcgagggaatgggaccgggtaccttcctggacggggtcgagtattatcttcatggagccgcgctttcgtgagcatccaggaggaaatggctgaagatccgcttacctataagagccgcctcatggtcgtggtgaagatggactcatccatacaacctggacccttccgcgcagtcctgaagtacttgtacactggagaactggatgaaaatgaacgggacttgatgcacattgctcacatagccgagcttcttgaagtgttcgacctgcgcatgatggttgcgaatattctcaacaacgaggcatttatgaaccaggagatcacgaaggcatttcatgtgcgtagaacgaaccgggtcaaagaatgtctcgccaagggtacattcagcgacgtcacctttatacttgatgatgggaccatatccgcccataagccactgttgatctcatcttgcgactggatggccgctatgttcgggggaccgttcgtcgagtcatccacccgcgaggtggtgttcccatacacctctaaatcctgcatgcgggctgttctcgagtacctgtacaccggcatgtttacgtccagtcctgacttggacgatatgaaacttattatattagccaaccgcctgtgtctcccccacttagtggctcttactgagcagtacacggtgaccggcctaatggaagccactcagatgatggtcgatatagatggcgatgtgttggtttttttggagctggcgcaatttcactgtgcataccagctcgccgactggtgtctgcaccacatctgtaccaactacaataatgtatgtcggaaattccctcgtgacatgaaagccatgtcgccagagaatcaggagtatttcgaaaagcacagatggccacccgtctggtacctgaaagaggaagaccactatcagcgcgctagaaaggagcgcgaaaaagaggattacctgcacttgaagaggcagcctaagcggagatggttgttttggaacagccccagtagccctagcagctcggcagcgtctagcagcagccccagttcatccagtgcggttgtgtag

SEQ ID NO: 238841 - DNA, 2250 bp, Artificial Sequence
  Description of Artificial Sequence: Synthetic coding sequence
atgcaggcttggcggaaagggcctgacggaccacagaagacttcatcagactctatgagtcgcctgatggattcggatatggattatgaacgacctaatgttgagaccattaaatgtgtggtggtcggggacaacgccgtgggaaagacccgactgatctgtgcgagagcttgcaatgccacactgacccaataccaactgctcgccacccacgttcctacggtgtgggccatagatcaataccgggtctgtcaagaagtcttggaaaggagcagggacgtcgtggacgacgtcagcgtgtcactgagactgtgggataccttcggggaccatcataaagacagacgttttgcctatggcagatcggacgtggtggtgttgtgtttcagcatagctaacccaaattctctgcatcatgtaaagaccatgtggtatccagaaattaaacacttttgccccagggcaccagtcattctcgtcggctgccaactagatctgagatacgcagatctggaggccgtgaatcgggcacgcaggcccctcgcaaggcctataaagcctaatgagatactgcctccagagaagggtcgcgaagtcgctaaagagttgggtatcccttattacgagactagtgtagtggctcagtttggaataaaagatgtcttcgacaacgctataagggccgctctgatttcccggaggcacctgcagttctggaaatcacacctgcggaatgtccaacgtccattgctccaggcaccatttctacctcccaaacctccccctccaatcattgttgtgcccgatcctccaagctcatccgaggaatgcccagcgcatcttttagaagatccgttgtgcgccgatgtgattctggtgctgcaggaacgtgtgagaatcttcgcccacaaaatctacctgtccacatcaagtagcaagttctacgaccttttccttatggatttgtctgagggcgaactggggggtccgtccgaacccggtgggacacatcccgaagatcatcagggacacagtgaccagcatcaccaccatcatcaccatcatcatgggagagatttcctcctacgtgcggctagtttcgatgtctgcgaaagcgttgatgaggcaggcggaagcggcccagccggattgcgtgcatctacttctgacggcatcctgaggggcaacggaaccggatacctgccgggtcgcggaagagtgttatcctcttggtctcgcgcttttgtctccatccaggaagagatggccgaagacccactgacatacaaatccagactgatggtcgtcgtcaagatggatagtagtatccagcctgggccttttcgggcagttcttaaatacctgtacacgggagagctcgacgaaaatgagagggaccttatgcatatagcccacatcgcagaactcttggaggtctttgacctcaggatgatggtggcaaacatacttaataatgaagcttttatgaatcaggagattactaaagcctttcatgtgcggaggaccaatagggtgaaggagtgcctggctaaggggaccttctccgacgtaacctttattctggacgacgggacaataagcgcccacaaacctctgcttatcagcagctgcgattggatggcagccatgttcggaggacccttcgtggagagtagtacacgcgaggtggttttcccctatacgagcaaaagttgtatgcgggcagtcctggagtatctgtacaccggaatgtttaccagtagcccagatctggatgatatgaaattgattatcctcgccaataggttatgtttgcctcacctcgtggcactgacagaacaatatacagtgacagggctcatggaagcaacccagatgatggtagacattgatggtgatgtcctggtgtttctagaactggcccagtttcactgcgcctaccagctcgccgactggtgtctgcatcatatttgcacaaactataacaacgtgtgtcggaaatttccgcgagacatgaaggcaatgagtccagaaaatcaggagtattttgaaaaacacagatggccccctgtgtggtacctgaaagaggaagaccactaccagcgcgctaggaaggaaagagagaaggaagattatttgcaccttaagcgacagcccaagcggcgttggctgttttggaattcaccctcttccccgtccagcagcgctgcaagctcctcttctccgagttccagcagcgcagtcgtttag

SEQ ID NO: 238842 - DNA, 2205 bp, Artificial Sequence
  Description of Artificial Sequence: Synthetic coding sequence
atgaaggccaggagcaggctaatggattcagacatggactacgagaggccaaacgtggagacaatcaaatgcgtggtagtcggtgacaatgccgttggcaaaacaagactgatctgtgcccgagcatgtaatgctacacttacccaatatcagctccttgccacccatgtgcctacagtgtgggccatagatcagtaccgagtgtgccaggaagttcttgagcggagcagggatgtcgtcgatgacgtgtctgtcagtcttagactgtgggataccttcggagatcatcacaaagacaggagattcgcatacggtcggagtgacgttgtggtcctctgctttagcatagccaatcccaactccctgcaccacgttaaaactatgtggtaccctgagatcaagcatttttgcccaagagcacctgtgatcctcgtgggctgccaactcgacctgagatatgcagatctggaggccgttaaccgcgctcggaggccgctggcaaggcccataaaaccaaacgaaattctgcctcctgagaaggggagagaggtggccaaagaactcggcatcccctactacgagacaagcgtggtcgcccagttcggcatcaaggacgtgtttgacaacgcaatccgcgcagcattgattagtcgccgacatctgcaattctggaagtctcacctcagaaatgtgcagcggcctttactccaagcgccttttcttcccccaaagcccccaccgccaattatagtggtgcccgacccaccgagttcctcggaggagtgccctgcacacttactcgaagaccctctttgtgcagatgtgatcctggtacttcaagaaagagtaaggattttcgctcataaaatatacctctctacctcgagcagcaagttttacgacctgttcctcatggacctctctgagggcgaactcggcggacccagtgagccaggcggtactcaccccgaggaccaccagggccatagtgaccagcatcatcaccaccaccatcaccatcacggcagggactttctgctccgagccgcatcatttgacgtctgcgagagcgtggatgaggccggaggatctggccctgctggactgagagcatcgacaagtgatggaatcctgcgcggaaacggcaccggatatctccccggtagagggagagtactctccagctggtcacgcgctttcgtaagcattcaggaggagatggctgaggatcctctgacctataagtcacggctcatggtagtagtgaagatggactcatccatccaaccaggcccattccgcgcagtgctcaaatatttgtataccggtgaactggatgagaacgagagggaccttatgcacattgctcacatcgccgagctgctcgaggttttcgatttgcgaatgatggtggctaacattctgaataacgaggcctttatgaatcaggaaataaccaaggcatttcatgttagacggacgaatagggtgaaagagtgcctggctaagggaaccttctccgatgttacatttatactcgatgacggcacaatttcagcgcataagccgcttctgatctctagctgtgattggatggctgcaatgtttggaggcccatttgttgaatcctccacacgcgaggtcgtgttcccctacacctctaaaagctgcatgcgagccgtgctggagtatctgtatacaggcatgttcaccagctcaccagatctcgacgacatgaagctcatcatactggcgaatcggctatgccttccgcacttggtggccctgacggagcagtacactgtgacgggtctgatggaggcaacccagatgatggtggatattgatggggacgtcctcgtttttctggaacttgcgcagttccattgtgcctatcagctcgctgactggtgcctccatcatatctgtacaaactacaataacgtgtgccgcaagttcccccgagacatgaaagccatgtcacctgagaatcaagaatatttcgagaagcacaggtggcccccagtatggtacctaaaagaggaggatcattaccagcgcgcacggaaagagagggagaaggaggattacttacaccttaagcgccagcccaaacggcgatggctgttctggaactctccctcttcacctagctcctctgccgctagcagcagttctccaagtagtagctctgcagtagtgtag

SEQ ID NO: 238843 - DNA, 1836 bp, Artificial Sequence
  Description of Artificial Sequence: Synthetic coding sequence
atgtccatccatatagtcgccctgggtaatgagggcgacaccttccaccaggacaacaggcctagtggccttattcgtacttacttggggcgttcaccactggtgtctggggatgagagctctctcctactgaatgccgctagcacagtggccaggcccgtttttactgagtaccaagcaagcgcctttggaaacgtcaaactggttgtacacgattgccctgtgtgggatatttttgattcagactggtacactagcaggaacctcataggcggagccgatataatcgtgatcaaatataacgttaacgacaaattcagtttccacgaagtgaaagataactacattcctgtgatcaagagggcactcaacagcgttcccgtcatcattgccgcagtagggacaagacagaacgaggaactgccctgtacttgtccgctgtgtacctctgacagagggagctgcgtgtccaccacagaggggattcagttggcgaaggagttgggggctacctatctggagttgcactcgctggacgacttttatataggtaaatacttcgggggtgtgctggaatattttatgattcaggctctgaatcagaagacatcagaaaagatgaagaagcgtaagatgagcaacagttttcacggcattcggccacctcagctggaacaacctgagaagatgcccgtcctgaaagcagaggccagccattacaactccgatctgaacaacctcttgttctgctgccagtgcgttgacgtcgtcttctacaatcccaacctcaaaaaagtagtggaggcacataagattgtgctgtgcgccgtcagtcatgtcttcatgctcctgttcaatgtgaaatccccaactgacatccaggacagcagcattattcgcaccacacaggacttgtttgccattaaccgtgatactgctttccctggagcatcacacgagtcgtccggcaatccaccattgagggtcattgtaaaggatgctctgttctgttcatgtctctccgacatactgagattcatttacagcggtgcctttcagtgggaggaactggaagaagatatccgtaagaagctaaaggatagcggtgacgtctccaatgtgatagaaaaagtaaaatgcattctcaagactccgggtaagattaattgtctgaggaattgcaaaacctaccaagccaggaagccattgtggttctataacacttccctcaaatttttcctaaacaaacctatgctggccgatgtggtgtttgagattcaaggaacaaccgttcccgcacatcgggctatcctcgtggcgagatgcgaggtgatggctgccatgtttaacggcaactacatggaggctaagtctgtattgatcccggtctacggggtgagtaaagaaactttccttagctttttagaatatttgtataccgacagctgctgtcctgccggtatcttccaggctatgtgcctgttgatctgtgccgagatgtatcaagtctcccgactgcagcacatctgcgagttgtttattattacacagctacagtcgatgccgtctagggagctagcctcaatgaacctcgatattgtggatctactcaaaaaggccaagttccatcattcagactgtctttctacttggttactacattttattgccaccaattatctgattttttcccagaagcctgagttccaggacctgtctgtagaagaacgcagcttcgtggaaaaacacaggtggccaagtaacatgtacctcaagcaactagccgagtaccggaagtacattcactcccgcaagtgtcgatgcctggtgatgtag

SEQ ID NO: 238844 - DNA, 354 bp, Artificial Sequence
  Description of Artificial Sequence: Synthetic coding sequence
taggagatgtatcaggtgagccgtcttcagcacatttgtgagctattcatcatcacacaactccagtcaatgccttctcgggagctcgctagcatgaacctcgatatcgtagaccttcttaagaaggctaagtttcaccattcagactgcctctccacctggcttctccattttatcgccactaactacctgatcttttcacagaagcctgaatttcaagatctcagtgtcgaggaaagatcttttgtggagaaacaccgttggccatctaacatgtatctgaaacagctagccgaatatcgcaaatatatacacagccgcaaatgtcgttgtcttgtgatcaaaagacactag

SEQ ID NO: 238845 - DNA, 1692 bp, Artificial Sequence
  Description of Artificial Sequence: Synthetic coding sequence
atgttcagtaggaaccatagatccagagtgaccgtggctcgaggaagcgctctggagatggaatttaagcgcggaaggttcagactgtctttattctcagatctgcccgaagacactgagcttcaaaggaagctggaccatgagatcaggatgcgggagggcgcttgcaaacttctggctgcatgcagccagagagagcaggcccttgaagccacaaaaagtctgctcgtgtgcaactctaggatcctgtcctacatgggagaattgcaacgcagaaaggaagcacaagtcctggggaagaccagccgccgaccaagcgattccggcccacccgcagaacgcagcccatgcagggggagagtgtgcatcagcgaccttcgcatccccctcatgtggaaggacaccgaatatttcaagaacaagggggaccttcataggtgggccgtattcttgctgctccagcttggcgagcacatccaggatacagagatgatcctggtcgatcgtaccctgacagatatctccttccagtctaacgtgctgttcgctgaagcgggtcccgactttgagctgaggcttgaattatatggcgcatgcgtagaggaggagggggctctgaccggcggacctaaacgactggcgactaaactctcaagtagtctcggcagatcctcagggagacgggtgcgcgcttcccttgatagcgctgggggatctggcagtagtcctattctattgcccactccagttgtgggaggacctcggtatcaccttctcgcccatacaaccctaactctggccgcagttcaggatgggtttcggacccacgatttgacactcgcttctcacgaagaaaaccccgcttggctccctctgtacgggagcgtgtgttgtcgcctggccgctcagcctctgtgcatgacacagcctacagcctcaggaacccttagggtacagcaggccggtgaaatgcaaaattgggctcaagtgcatggggttcttaaagggaccaaccttttctgctatagacagcccgaagacgccgacactggagaggaacccctactgacaatcgcggtgaacaaggaaacacgcgtgcgtgccggtgaactggatcaggccttggggagaccctttaccctgtcgatctcaaaccagtatggcgatgatgaagtaactcataccctccagactgaatcgcgcgaagctctccagtcatggatggaggccctctggcagttgttctttgacatgtcccagtggaagcagtgctgtgatgagatcatgaaaatcgagacacctgcccctcgaaaaccgccacaggcccttgcgaaacagggatccttatatcatgagatggccatcgagcccctcgatgacatcgcggcagtgactgacatcttaactcagcgggaaggggctagactcgaaacaccacctccctggttggccatgttcactgatcagcctgccctcccgaacccttgctctcccgcaagtgtcgctccggctcctgactggacccacccactgccctggggccgacctcgcacattcagtctcgacgctgttccacctgaccattccccaagagcgaggagcgtggcccctctcccccctcagagatcccccagaactaggggtctctgttctaagggacagccgaggacctggttacagtctccagtatag

SEQ ID NO: 238846 - DNA, 1653 bp, Artificial Sequence
  Description of Artificial Sequence: Synthetic coding sequence
atgcaggacaggttgcacattcttgaggacttgaacatgttgtatattcggcagatggctctgtccttagaagatacagagcttcagcgtaaactggaccacgagatcaggatgagagagggcgcatgcaagctcctggctgcctgttcacaacgggagcaagcactcgaggcaacgaaatctctacttgtgtgcaactctcgcattctgtcttacatgggggaactgcagcgtcgtaaggaggcccaggtccttggcaaaacatctcgtagaccatcagactccggtccgccagctgagcggagtccatgcagaggtcgtgtctgcatctccgacttacgcatccccctgatgtggaaagacaccgaatacttcaaaaataagggagaccttcacaggtgggccgtgttcctgctcctgcagcttggggagcacatccaagacacagagatgatcctggttgaccgaacacttaccgacatcagctttcagtccaacgtgctgttcgctgaagccggtcctgatttcgaactcagactggagctttatggcgcttgcgtcgaggaggagggcgctctaactggaggcccaaagaggctcgctacgaagctgagctcttcgctggggagaagcagtggcaggcgcgtcagagcaagcctggatagcgctggaggcagcggctcctctccgatcttgttgcccacgcctgttgtcggcggacctaggtaccatctgctcgcacatactactctcacccttgccgcagtccaagacggattccgtacacatgacctgaccctcgcaagccacgaagaaaaccccgcttggctcccgctgtatgggagcgtctgttgtaggttggcagctcaaccactgtgtatgactcaacctacagcatccgggaccctgcgagtacaacaggccggtgaaatgcagaattgggcacaggtgcacggcgtcctgaaggggacgaacctgttctgctaccggcaaccggaggatgctgacaccggggaggagcctctcctcacaatagccgtaaacaaagagacacgcgttagagcaggagagttggatcaggctctgggccgtccctttaccctatcgatctcgaaccagtatggagatgacgaagtgacacacaccctgcaaacagaaagtcgggaggcattgcagagctggatggaggctctgtggcagctcttttttgacatgtcccaatggaagcagtgttgcgatgagatcatgaaaattgagacacccgctccgcgaaaacccccacaggcgctggccaaacagggctctttgtatcatgagatggccatcgaacctctggatgatattgccgctgtgacagatattctgacccagagagaaggagctcgtcttgagacccctcctccttggcttgcaatgttcacagatcagccggctcttcctaacccttgctcacctgcatcggtggctcctgcacccgattggacccaccccttgccatggggcagaccgaggaccttcagccttgacgctgtcccacctgaccacagccctagagccaggtcagtggctccgcttccaccccaacggagcccccgaacgcggggactttgcagcaaggggcaaccacgtacctggctacagtctccagtgtag

SEQ ID NO: 238847 - DNA, 4635 bp, Artificial Sequence
  Description of Artificial Sequence: Synthetic coding sequence
atggatagcggacctgtgtatcatggagactccagacagttatctgcctccggggtgcccgtcaatggtgcacgtgagcctgccggaccctcactgttgggaacaggagggccttggagagtggatcagaaaccagattgggaagcagcgcctggcccagctcacacggctcgtttggaggatgcccatgatttagtggccttttcagctgtggctgaggctgtgtctagctacggagcattgtcaacgcgcctgtatgagactttcaatagagagatgtctagagaagcagggaacaacagcaggggccctcggccagggccagagggatgtagcgcgggaagtgaggatctcgataccctccagacagccctcgccttggcaaggcacggcatgaaacccccaaattgtaattgtgatggacccgagtgccccgattacctggagtggctggaaggcaagatcaaaagtgtagtgatggaggggggtgaagagaggccaaggctgcccggacctctgcctccaggagaagctggcctgcctgctcctagcaccagaccccttctatcaagtgaggtaccccagattagcccacaggagggcttacccctgagccagtccgctctctctatagcaaaagagaaaaatatctctctgcagaccgctatcgctattgaggctctgacccagctgagcagcgctctaccccagccaagtcattccactccacaggctagctgccctctccccgaggctctgagccctccagctccattccgctctccccaaagttacttgagagccccatcttggccagtggtgccgccagaggagcacagtagttttgcgccagactcttctgcctttcctcccgctacgccccgaacagagtttccagaggcatggggtaccgatactcctcccgctaccccacgcagtagctggccgatgcctcgcccttctcccgaccccatggccgagttggagcaactccttgggtctgcctctgattacatccaaagcgtatttaaacgccctgaagccctgccaacgaagccaaaagtaaaggtggaagctccaagctcatccccagccccagccccatcccccgtactgcaaagggaagcccctaccccaagctccgagccagatacccaccagaaagcgcaaaccgccctgcagcagcatttacaccacaagcggagcttgttcttagaacaggttcatgatacgtccttccccgcaccctccgaacccagcgcacctggctggtggccccctcctagctctcccgtgcctcgacttccagaccggccacctaaggaaaagaagaagaaactcccaactccggctggcggacctgtcggaacagagaaggcagccccaggaatcaaacccagcgtgcgcaaacccatccagatcaagaagtctaggccccgagaggctcagcccctttttcccccagtgaggcaaatcgtgctcgaaggcctgcggagtcctgcgtctcaggaagttcaagcccaccccccagcccctctgcccgcatctcagggatcagccgtgcccctccccccagagccctctcttgctctgtttgcccctagcccatcccgggactcacttctcccacctactcaagaaatgaggagccctagccctatgacggcattacagcccggatcaaccggaccgttacccccagccgatgacaagctcgaagagctgattagacagtttgaggcagaattcggggattccttcggcctcccaggacctccaagtgttccgatacaggatcccgaaaatcagcagacctgtctgcctgcacccgaaagcccattcgctacgaggtccccaaaacaaatcaagattgaatcatctggcgctgttactgtgctgtcaactacatgctttcactccgaagaaggcggacaggaggctactccgaccaaggccgaaaatcctctgacgcctaccttatctgggtttctcgaatccccattgaagtacctggatactcctaccaagagcctgctggatacaccagcaaaaagggcacaagctgaattccccacatgtgactgtgttgagcagatagtcgaaaaggacgagggcccttactacacccacctcggatccggtcccaccgtggcatctatacgggaactgatggaggagcgatacggtgaaaagggcaaggctattcggattgaaaaggttatatacacagggaaggaagggaaatcttcccgcggttgtcccattgctaagtgggtgatccgcagacacaccctggaggaaaaactcctgtgcctggtgcgccacagagctgggcaccattgtcagaatgcagtgatcgtcatcctgattttggcctgggaaggaatacctcggtccttgggcgacacactgtatcaggaattaacagacactctgcgaaagtatgggaatccgacatcacggagatgcggcctcaatgatgaccggacatgcgcctgtcaagggaaagatcctaatacctgcggagccagtttttcctttgggtgtagttggtcgatgtactttaatggctgcaaatacgcgcgtagcaagacaccccgaaaattccgacttgcaggtgacaacccaaaagaagaggaggtgctccggaagtcttttcaagacctggctaccgaagtagctccgctgtacaaacgcttggccccacaggcatatcagaaccaggttactaacgaagagatagccatagactgtcggcttggcttaaaagagggccgtcccttcgccggagttacagcgtgtatggacttttgcgcccacgcccacaaggaccagcacaacctatataacggttgcacagtcgtatgtactcttaccaaggaggacaacagatgcgtgggaaaaattccagaggatgagcaactacacgttctgcccctgtacaagatggcaaacaccgacgaattcggcagcgaggaaaaccaaaatgcaaaggttggctccggggcaattcaagtcctgactgcgtttcccagggaagtacgaagactcccggagcccgctaaatcatgtaggcagcgccagttggaggccaggaaggccgctgctgagaaaaaaaaaatccagaaggaaaaattgtctacaccagagaaaatcaaacaggaggctctcgagttggctgggattacctcggatcctgggctgtccctcaaggggggtttgagtcaacagggtctcaagccatccctgaaggttgagcctcagaatcattttagctcgttcaaatattcgggaaacgccgttgtggagagttacagtgttttaggaaactgtagaccttccgacccttacagcatgaattcagtgtattcctaccattcttattatgctcagcctagcctgacttcagtaaatggttttcactctaagtacgccctgcctagctttagctactacgggttccctagcagcaatcccgttttcccctctcaatttctcgggcctggggcatgggggcacagcggctccagcggcagctttgaaaagaagcccgatctccacgccctgcataatagtttgtctcctgcttacgggggtgccgaattcgctgagctaccttcccaggcagtgcccacggatgctcatcaccccacaccccaccaccaacagcccgcttaccccggaccaaaggaatatcttctgccgaaggcacccctgttgcactctgttagccgggaccctagcccattcgcgcaaagctctaactgctataaccggtcaatcaagcaggagcctgttgatccactgacgcaggccgagcccgtgccacgtgacgccggaaaaatggggaagacaccactatctgaagtttcacagaacgggggaccctcacacctctggggccagtactccggaggaccaagcatgagcccaaagcggaccaacggggtaggagggtcctggggagtgttttcatcaggagaatcacctgctatcgtgcccgacaaactcagtagctttggtgctagctgcctggcccctagccatttcaccgacggacaatggggactctttcccggagaaggacagcaggctgcctcacattcaggcggaagactccggggaaagccctggagcccttgcaaatttggtaattctacatctgctctggctggccctagcctgacagagaaaccctgggccctcggcgcaggagatttcaacagcgctcttaagggcagccccggtttccaggacaaattgtggaatcccatgaagggggaagagggccgtattccggcagccggagcatcacagctggtattttatcagcataaaaacctgaaccaacctaatcacggacttgccttgtgggaggctaagatgaagcagctggccgagagggctagagcacggcaggaagaggccgcacgcttgggccttggccagcaggaggctaagctgtatggaaaaaagcgtaaatggggtggtaccgtggtggccgaaccacagcaaaaggaaaagaagggggtggtgccaaccagacaagccctggccgtgccaacagattcagccgtaacggtgtcctcttatgcttatacaaaggtcactggcccatattcacggtggatatag

SEQ ID NO: 238848 - DNA, 468 bp, Artificial Sequence
  Description of Artificial Sequence: Synthetic coding sequence
atgcgacacctgccctatttctgcaggggtcaggtggtcagagggtttggtagggggagcaagcagctgggaatccctacagctaattttccggaacaggtcgtcgacaacttacccgctgacatttccaccggcatatactacggctgggcgtccgtgggctccggcgatgtgcacaaaatggttgtttctattggatggaacccatattacaaaaataccaagaagagcatggaaacacatattatgcacacattcaaggaggatttttacggggagatcctcaacgtagctatagtggggtacttgcggcctgaaaagaattttgactccctcgaatctctgatatctgccatacagggtgacatcgaggaagccaagaaacgcctcgagctgccagagcatttgaaaataaaagaggataatttcttccaggtgagcaaaagtaagatcatgaatggccactag

SEQ ID NO: 238849 - DNA, 969 bp, Artificial Sequence
  Description of Artificial Sequence: Synthetic coding sequence
atggctgctagcggggaaccacagcgacagtggcaagaagaggtggccgcagtggttgtggtgggaagctgcatgacagatctcgttagcctaacatcccgcttgcccaagacaggtgaaacaatccacggtcacaagttttttattggtttcggagggaagggggcaaaccagtgtgttcaggccgcacgcctcggggctatgactagtatggtgtgtaaagtcggcaaagactccttcggaaatgactacatcgagaaccttaagcagaatgacatcagcactgaattcacgtaccagaccaaggacgctgccaccggcaccgcgtctatcattgtgaataatgagggccagaacatcatcgtcatcgtggccggtgccaacctccttctgaataccgaggacctgcgtgccgcagctaacgtgatcagcagggcaaaggtgatggtctgtcagctggagatcacacctgcaacatctctggaggccttaactatggctcggaggagtggcgtaaagaccttattcaaccctgcccctgcaatagccgatctcgacccacaattttatactttatccgatgtgttttgctgtaacgagtcagaggcagagattttgacagggctgaccgttggaagcgctgcagacgccggtgaggcggctcttgtactgttgaagagagggtgccaagtggtgatcattactctgggagctgaaggttgcgtcgtgttaagccagacggaaccagaaccgaagcatatccctacggaaaaagttaaagctgtcgatacaacgggggctggagactcttttgtgggggctctggctttttacctagcatactatccaaatctgtcactggaggatatgctgaacagatccaattttatcgcggctgtgtccgtccaggccgcaggtacacaatcctcctatccatataagaaggacctgccactcacactcttttag

SEQ ID NO: 238850 - DNA, 861 bp, Artificial Sequence
  Description of Artificial Sequence: Synthetic coding sequence
atggccgcttcgggcgaacctcaacgacagtggcaggaggaggtggccgcagtggttgtggtgggttcctgcatgacggatctggtttccctgactagccggctgccaaaaaccggcgaaactatccatgggcacaagttctttatagggtttggaggcaaaggggctaatcagtgcgtgcaggccgctcgattgggagccatgactagtatggtgtgtaaggtgggtaaggattcctttggaaacgactacatcgagaatcttaaacagaacgatatcagcacagaattcacttatcagaccaaggacgcagccacgggaaccgcctcgatcattgttaataacgagggacagaacataatagtcattgttgctggggctaatctgctcctcaacaccgaggacttgagggccgcagccaacgtcatctccagagctaaggtcatggtctgccagctggaaatcacgcccgctacgtctctggaggcactgacaatggcaaggagatccggagtcaagactctattcaatccagctccggctatcgctgacctggatccccaattctacactttaagtgatgtgttctgttgcaatgaatctgaggcagagatccttacagggcttaccgtcgggtctgctgccgatgccggtgaggcggctctggttcttctgaagagagggtgtcaggttgtcatcatcaccctcggcgcagagggctgtgtggtgctatctcaaaccgagcccgagcctaagcatatcccgactgaaaaagtgaaggctgtggatactacctgccgcccaggaagtaggccaaaaagcgaggcagctagtgtcaaaaagcagaagcactataagtag

SEQ ID NO: 238851 - DNA, 861 bp, Artificial Sequence
  Description of Artificial Sequence: Synthetic coding sequence
atgagctggctcttatttcttgctcatagggtggccctggcggctttgccttgccgacgcggtagccgcggatttgggatgttttacgctgtccggcgaggacggaagacaggggtttttcttacctggaacgaatgtagggcacaggtagaccgctttcccgcagcacgctttaagaagttcgcaaccgaagacgaagcctgggccttcgtacgcaagtctgcctccccagaggtgagcgagggacatgagaaccagcacggccaggagtccgaggccaaagcatctaaacgcctccgtgagccactggacggagatgggcacgagtctgcagagccatacgctaagcacatgaagccgtcggtggaacctgcgccacctgtgtcgcgggacacatttagttacatgggcgacttcgttgtggtctatactgatggatgttgctcctcgaacggaaggcgtaggcctagggccggaattggtgtgtactggggacccggacaccctttgaatgtggggatccgactgcctggaagacagaccaatcagagagccgagatccacgccgcttgcaaggcaattgaacaggcgaagacacaaaatattaacaaactggtactgtacacagactcgatgttcactatcaacggaatcacgaattgggtccaaggctggaaaaaaaatggttggaaaaccagcgccggtaaggaggtcattaacaaggaagactttgtggcactggagagactgacccaggggatggacatccagtggatgcatgtgccaggccattccgggttcattggcaatgaggaggctgaccgactcgcgagagaaggcgctaaacagtctgaagattag

SEQ ID NO: 238852 - DNA, 1683 bp, Artificial Sequence
  Description of Artificial Sequence: Synthetic coding sequence
atggagtttcggcaggaagagttccgcaagcttgctggtcgagccctgggtaagttacaccgcctactcgaaaaacgtcaagagggggctgaaactctggagttgtctgcggacggtagaccagtaaccacacagacaagagacccacccgtggtggactgtacatgcttcggccttccaaggcgctacattatcgcaatcatgagtgggctcggattctgcataagcttcggcatcaggtgcaatctgggagtggccattgtatctatggtcaacaattccactacccatagggggggacacgtcgtagtgcagaaagctcaatttagttgggatcctgagactgtgggactcattcacggctcctttttctgggggtacatagtgactcagatccctggaggatttatttgccagaaattcgcagccaaccgcgtatttggatttgcaatcgtggccacctctaccttgaacatgctcataccttcagcagccagggtgcattatgggtgtgtaatcttcgtacgcatattgcaaggcctagttgagggagtcacctatcctgcttgccacgggatttggagcaaatgggctcctcccctggagcgcagtcggttggccaccacggcattttgtggaagttacgccggtgccgtggtcgctatgccccttgccggtgtccttgtgcagtattccggctggtcctcggtgttttacgtatatggctcgtttgggatcttttggtatttgttctggctgctggttagctacgaatcacctgcgcttcatccatccatctccgaggaggaaagaaagtatatcgaggatgccattggtgaatcggccaaactgatgaatccgctgacaaaattctctacaccttggaggaggtttttcacatctatgcctgtttatgcaataattgtggccaatttctgccgctcgtggacgttctacctcttattgatttcccagcctgcctactttgaggaggtgtttggcttcgagatctccaaggtcgggctggtaagcgccctgcctcacttagttatgactatcatcgtgccgattgggggtcagattgcggattttcttaggtctcggagaattatgtctacaactaacgtcagaaaactgatgaattgcggcggttttgggatggaagctactcttctgctggtggtagggtattctcattctaaaggtgtggcgatttcctttctagtgctggccgtcggtttttctgggttcgccatctctggcttcaacgtaaatcatcttgacatcgcaccccgttatgcaagtatactgatgggtatctctaatggtgtgggaactcttagcggaatggtctgccccatcattgttggggctatgactaagcacaaaacacgggaagagtggcagtatgtcttcctcatcgcctctttagtacactatggcggagtaattttttacggtgtattcgcgagcggtgagaaacagccctgggcggaacctgaggaaatgtccgaggagaagtgtgggtttgtcggacacgaccaactcgctggaagcgatgatagtgagatggaggacgaagccgagccacctggcgcacctccagcaccaccaccatcctacggtgccactcattcaaccttccagccccctaggccaccaccgccagtacgagactattag

SEQ ID NO: 238853 - DNA, 939 bp, Artificial Sequence
  Description of Artificial Sequence: Synthetic coding sequence
atggcggctggcgttgattgcggcgacggtgttggcgctcgccaacacgtgtttctggtttcagagtacctgaaagacgcttccaaaaaaatgaagaacgggctaatgtttgtaaaactggtgaatccttgttctggcgagggggcaatctacctctttaacatgtgtctgcagcagttgtttgaggtcaaagttttcaaagaaaagcaccacagttggttcatcaatcagagcgtccagtcaggcggactcctgcattttgctactccagtcgatccactgtttcttcttctgcattacctcatcaaagccgacaaggaaggaaaattccagccacttgatcaagtggttgttgacaatgtgtttcctaattgtatcctgcttctcaagctgccgggtttggagaaactgctacaccatgtgaccgaagagaaggggaatccggaaatcgacaataagaaatattacaagtacagcaaagagaagacgttgaagtggttagaaaaaaaagtcaatcaaacagtggcggctcttaagactaacaatgtcaatgtgagtagccgtgtgcagtccaccgccttttttagtggcgaccaggccagcaccgacaaagaagaagactatatccgctacgcccacgggctgatctccgactacatccccaaagagctatccgacgatctatccaagtatctgaaattacctgagcccagcgcctctttacctaaccccccttccaagaaaatcaagctgagtgatgagccggttgaggccaaagaggattacaccaagttcaatactaaggacttgaagactgagaaaaaaaactctaaaatgactgccgcacagaaagccttggcaaaagtggataagagtggaatgaagtctatcgatacattcttcggggtgaagaataagaaaaaaattggtaaggtgtag

SEQ ID NO: 238854 - DNA, 774 bp, Artificial Sequence
  Description of Artificial Sequence: Synthetic coding sequence
atggcggctggcgtagactgcggcgatggcgtgggagcgagacagcatgtctttctcgtgtcggagtatctgaaggatgcctctaagaaaatgaaaaacgggctcatgtttgtcaagctcgtcaatccttgtagcggggagggtgcgatctaccttttcaacatgtgcctccaacagttatttgaagtcaaggtctttaaggagaagcatcactcctggttcattaaccagtcagttcagtccggcggtttgctccactttgctacaccagttgacccactgtttctcctcctacactaccttatcaaggcagataaggaaggcaagtttcagccactggatcaggtggtcgtggataacgtcttccccaactgcattctgctgctcaagctcccgggactcgaaaaacttctccaccacgtcacagaggagaaggggaaccccgagattgacaataagaagtactataaatattcaaaggaaaagacactcaagtggcttgagaagaaggtgaaccagactgtcgctgcattaaaaacaaacaatgtgaatgtcagctccagggttcagtctaccgctttcttcagcggggatcaggcaagtaccgataaggaggaggactatatccggtatgcccacggactcatttctgactatatccccaaggagttgtctgacgacttgtcaaagtacctcaaactcccagaaccctcagcctcacttcctaaccctcctagcaagatggcagcccagagacagaaaagggggaaatag

SEQ ID NO: 238855 - DNA, 996 bp, Artificial Sequence
  Description of Artificial Sequence: Synthetic coding sequence
atggcagcaggcgtggattgcggggatggggtgggcgctcggcagcatgtatttttggtcagcgagtacctgaaagacgcatctaaaaagatgaagaacggtttgatgtttgtcaagctggtgaacccctgctccggcgagggcgctatctatcttttcaatatgtgcctgcaacagctgttcgaagttaaggtgttcaaggaaaaacatcatagctggtttatcaatcaaagtgtacaatctggcggtctgctgcactttgccaccccagtagatcccctctttcttctgttacattacctaataaaggcagacaaagagggcaaatttcagcctcttgaccaggtggtggtggacaacgtgttccctaactgtatcctattgctgaaactgcctggcttagagaagctactgcaccatgtgacagaagaaaaggggaatcccgagatcgacaacaagaaatattacaaatattcaaaggagaaaacattgaagtggctggaaaaaaaagtgaatcagactgtggccgctttgaaaacaaataatgtaaatgtctcatctcgggtgcagagcaccgcatttttctcaggggatcaggcctctactgataaggaggaagattacatccggtatgcacatgggttaatcagtgactacattccgaaggagttatccgacgacttgtctaagtacctaaagttgcctgaacccagcgcatctctgcctaaccctccgagcaaaaaaattaagctgtccgacgagcccgtcgaagcaaaagaagactatacgaaatttaacacaaaggacctaaagacagagaagaagaactccaagatgactgctgctcagaaggctctcgctaaagtggataagagcggcatgaaaagcatcgacacatttttcggcgtcaaaaagaagctggagagatttgagactctgaaaatcaagtctagtaaaaacatatgctttctgcacgttagtgtgtgcccttcctag

SEQ ID NO: 238856 - DNA, 495 bp, Artificial Sequence
  Description of Artificial Sequence: Synthetic coding sequence
atggagtctggtgatgaggccgcaattgagaggcaccgcgttcatctgaggtctgctactcttagggacgccgtgcctgccacacttcacttgctgccatgtgaagtggccgttgacggtcccgcaccggtgggtcgcttctttacccccgctatcaggcaaggacccgagggcttagaagtatcatttcgcggtagatgtctgcgcggtgaagaggttgccgtcccaccagggctggtcggttacgtgatggtaacagaggagaagaaggtcagcatgggaaagcccgatcctcttcgagacagtgggactgacgaccaggaagaagagccgctggaacgcgatttcgatagatttattggggctacagccaattttagtcgctttaccctgtggggcctcgagacgattcctggcccagacgctaaggtccgcggagcactgacctggcctagcctcgccgcagctatacacgctcaagtaccagaagactag

SEQ ID NO: 238857 - DNA, 2226 bp, Artificial Sequence
  Description of Artificial Sequence: Synthetic coding sequence
atggaatcgcgagaccataacaacccccaggaaggcccaacctccagttcgggacggcgagccgctgtggaggataaccatctccttataaaagccgtacaaaacgaagatgtggacctcgtccagcaactcttagaggggggagccaacgtgaacttccaggaagaggaaggagggtggactccattgcacaacgcagtgcaaatgagccgcgaggacattgtagagctgcttttgcgccacggtgctgatcctgtgctccggaaaaaaaacggcgctacaccctttatccttgctgccattgcaggctctgttaaactcctgaaactcttcctgtccaaaggagctgacgtcaacgagtgtgatttctacggattcacagccttcatggaagctgccgtttatgggaaagttaaggccctcaaattcctctacaagcgaggagcaaatgttaacttgaggcgtaagaccaaagaggaccaagagaggctgaggaaggggggtgcaaccgctctcatggatgccgctgaaaaaggacacgttgaggtgttgaaaatccttctagacgagatgggggcagacgtcaatgcatgtgataatatgggcagaaatgcgctgatacatgcactcctgtctagcgatgacagcgatgttgaagcaatcacccatctgctcctggaccatggtgcagatgtaaacgtgagaggggaacgtggcaagacccccctcatcctggcagtggagaagaagcatctgggactcgtccagagactattggagcaagagcacatcgaaatcaatgacaccgacagtgacggaaagactgcactgttactagccgtggagctaaaactcaaaaaaattgcggaactgctatgtaagcggggtgcatcaaccgactgcggggacctggtaatgaccgctagacgaaattacgatcatagtctcgtaaaggtactgctgagtcacggagccaaggaagattttcatcctccggcagaagactggaaaccacagagctctcactggggggctgccctgaaagacctgcatcgtatctatcgccctatgataggtaagttaaagttttttatcgatgaaaaatacaaaattgccgacactagcgaaggcggtatctatttggggttctatgaaaagcaggaagtcgcagttaagactttttgtgagggcagcccacgggcacagcgagaagttagctgtctgcagtcatctcgcgaaaattcccatttggtcactttttacggcagcgagagccatagggggcacctgtttgtttgcgtcaccctttgcgagcaaactctggaagcttgcctcgacgtgcacaggggcgaggacgttgagaacgaggaggacgagtttgccagaaacgtgctgagcagtatattcaaggcagtccaggaattgcatctatcatgcggatacacccaccaagacttacagccccaaaacattctgattgattccaagaaggcagcacacttggccgatttcgacaagtccataaagtgggcaggcgatcctcaagaggtgaaaagggaccttgaagaccttgggcgactggtcctctacgtggtaaagaaaggatctatttcgttcgaagacctcaaagcccagagtaatgaggaagttgtgcagctgagccctgatgaggagaccaaagatctgatacaccgcctcttccatcccggagagcacgtgcgagattgcctgtcagacctgctggggcaccccttcttttggacttgggaatccagatacagaacccttcggaatgtaggcaacgaatctgatatcaagacccgcaagtcagaaagcgaaatactgagactgctccaacccggacccagcgagcacagcaagtcattcgacaagtggactacaaagatcaatgagtgcgtgatgaagaagatgaacaagttctatgaaaaaagaggcaatttctaccagaatacggttggggacctgctcaagttcatccgtaacctcggagagcacatcgacgaagaaaaacacaaaaagatgaaattgaaaatcggtgacccctccctgtacttccagaagacctttcccgacctggtgatctacgtgtacacaaagttgcagaatacggaatatcggaaacacttcccccagactcactctccgaataaaccacagtgtgacggggctggcggagcttctggcctcgccagccctggatgctag

SEQ ID NO: 238858 - DNA, 2226 bp, Artificial Sequence
  Description of Artificial Sequence: Synthetic coding sequence
atggagtcacgggatcacaacaaccctcaggagggcccaacgagctcttccggcagacgcgcagccgtcgaggataaccacctcctgattaaagcagttcagaatgaggacgtagatttggtgcaacaactcctagagggaggggcaaatgttaactttcaggaggaagaaggaggatggactcccctccacaacgctgtccagatgagtagagaggatatagttgagctgctgctgcgccacggtgcagatccagtgctacggaaaaagaatggtgccacccctttcatcctggcggctattgccggttcagttaaactcctgaagctcttcctcagcaaaggggcagacgtaaacgaatgcgatttctacggctttaccgccttcatggaagcagccgtatacggtaaagttaaagccctaaagttcttgtataagcggggagcgaatgtgaacctgcgacggaagactaaagaggaccaggagagacttcgcaagggaggcgctacggccctgatggatgccgctgagaaagggcatgtggaggtgcttaagattctgctggatgagatgggtgctgacgtcaacgcctgtgataacatgggtcggaacgcattaatccacgcgcttctttccagcgacgacagtgacgtggaagccattacacacctgctgctggaccacggagccgacgtcaatgtgcgtggagaacgaggaaagacccccctgattttggctgttgagaagaagcatttgggcttggtacaacgcctgctggaacaggagcacattgaaatcaatgacacagatagcgacggaaagactgccctccttctggccgtggaattgaagctcaaaaagatcgctgagttgctgtgtaagcgcggagcttctacagattgcggagacctcgtgatgacggctaggcgcaactatgaccattccctggtcaaagtgctgctttctcatggcgctaaggaagattttcatcccccagcagaagactggaaaccacaaagtagccattggggcgctgccctgaaggacctgcatcggatttacaggcccatgatcggcaagctcaagttttttatcgacgagaagtataagatagccgacactagcgagggtggtatctacctggggttctatgaaaaacaggaggtcgcagtgaagacattctgtgagggttcaccaagggcccagagggaggtgagctgtttgcagtcctcccgcgaaaattctcacctggtcaccttttatgggtccgagagccatagggggcatcttttcgtttgcgtaaccttatgtgaacagaccctggaggcctgcctggacgtccacagaggggaggacgtagagaacgaggaggacgagttcgctcgcaacgtcctcagcagcatttttaaggccgtgcaagaactgcacctgtcatgcggatacactcaccaggacctgcagccgcagaatatcttgatcgatagtaaaaaggcggctcacctggccgatttcgacaagagcatcaaatgggcgggagatccccaagaggtgaagagagacctggaagacctgggcaggctggttctgtatgtggtaaaaaaaggatccatttcgttcgaggaccttaaggcccaaagcaatgaggaagtcgtacaactgtcacccgacgaggaaactaaggacctgatccaccggctttttcacccaggagaacacgtacgggactgcttatcagatttgttggggcatccattcttttggacatgggaatctaggtatcggacactacggaacgtcggaaatgagagtgatatcaaaaccagaaaatcagaatcagagatcttgcggctccttcagcccggaccctccgagcatagtaaaagcttcgataaatggacaactaagataaacgagtgcgtcatgaagaagatgaataagttctatgagaagcgaggaaacttctatcagaatactgttggagacctgcttaaattcattagaaatctcggcgagcatatagacgaggaaaagcacaaaaagatgaagctgaagattggtgaccccagcctttattttcaaaagacattccccgaccttgtgatctacgtttataccaagttacagaacactgagtaccgaaagcatttcccccagactcatagcccaaacaagccacagtgtgatggggcaggaggagcatccgggctggcttcgccgggatgctag

SEQ ID NO: 238859 - DNA, 1959 bp, Artificial Sequence
  Description of Artificial Sequence: Synthetic coding sequence
atggaatctagggatcataacaatcctcaggaggggcctacgagttctagcggacgcagggcagctgtcgaagataatcatctcctgatcaaggcggtccagaatgaggatgtggatttggtgcaacaactgctggagggcggagctaacgttaacttccaggaagaagagggaggctggacgcctttacataatgctgtgcagatgtccagggaggacattgtggagctattgctgaggcacggcgcagaccctgtgctgcgcaagaaaaatggggctacccccttcattcttgctgcaattgcaggctctgtgaagctgcttaagttattcctgtccaagggagccgatgtcaacgaatgcgacttctacggatttaccgcatttatggaagcggctgtttatggtaaggtgaaagcattgaaatttctttacaaaagaggggctaacgtcaatcttagacggaaaaccaaagaggatcaggagagactgcgaaaaggaggagctacggctttaatggatgccgcagagaaggggcacgtggaagtgcttaaaattctgcttgacgaaatgggcgcagacgtgaatgcttgcgataatatgggcagaaacgcattaatccacgccctgttgtcctcagatgactctgacgtggaggcgattacacatctgctcctcgaccatggtgctgatgtgaacgtgcgaggcgaaagaggaaagacccctctaatacttgctgttgagaagaaacatttaggtcttgttcaaagactccttgaacaagagcatattgagatcaacgatacggatagtgacggaaaaaccgcgctgctgctcgctgtggagttgaaactgaagaaaatcgccgagcttctttgtaagcgtggggcatctaccgactgcggcgatcttgtcatgaccgcccgtagaaattacgatcatagtttggtcaaagtgctgttatcccatggagctaaagaagactttcatccccctgccgaggattggaaaccgcagagctcacactggggggcagctctaaaggacctacaccggatttatcggccaatgatcggtaagctgaaattttttatagatgagaaatacaaaattgcagacacaagcgaaggcggaatctatctggggttctatgagaaacaagaggttgcagtgaaaactttctgtgagggaagtccccgtgcccagagggaggtgtcctgcctccaatcctctagagagaatagtcatttggtgacgttctacggctccgaatctcaccgcggtcatctattcgtctgcgtcactctatgcgagcagaccctcgaagcctgtcttgacgtacatagaggtgaagatgtggagaatgaggaggacgaatttgcacggaatgtgctctcttcaatatttaaggcagtgcaagagttacacttgagctgcggctacacccatcaggacctgcagcctcagaacattcttatagacagcaaaaaggccgctcacttggccgacttcgacaagtccatcaagtgggccggtgacccgcaagaagtgaagcgggacttggaagaccttgggcgtcttgtattgtatgtggtgaagaagggttcaatctcctttgaggatctgaaagctcagagtaacgaagaagtcgtgcagctgtctcccgatgaggaaactaaggatctgattcacagactgttccatcccggtgaacatgtccgagattgcctctccgaccttttgggacatcccttcttttggacatgggagtctagatatcgaacactgcgaaacgtcggaaatgagtctgacatcaagacacgcaagtcagagagcgaaatcctccgcctcttgcagccaggcccttccgaacacagtaagtcctttgacaaatggacaacaaaaatgtccaaactcaggcacagacagatcatatttcccacgacccagaaccagtag

SEQ ID NO: 238860 - DNA, 465 bp, Artificial Sequence
  Description of Artificial Sequence: Synthetic coding sequence
atgattggaaaacttaagtttttcatcgacgagaagtacaaaatcgccgacacatcagagggaggtatctatctgggcttttatgagaaacaggaggtggcggtgaaaacattttgtgaaggaagccctcgagcccagcgcgaggtgtcctgtcttcagtcttctcgtgagaacagtcatcttgtaaccttttacgggtccgagagtcaccgcggacatttgttcgtgtgtgtgactctgtgcgagcagacgctggaagcgtgcttagacgttcaccgaggagaggacgtggagaatgaagaagatgagttcgcccgtaatgtgctttccagtatcttcaaggctgtgcaggagttacacctttcttgtggctacacacatcaggatcttcaaccgcagaacattctcatcggcccttggaccgccggtcctctctgcggaaaggaaggcaagcatctgatttag

SEQ ID NO: 238861 - DNA, 465 bp, Artificial Sequence
  Description of Artificial Sequence: Synthetic coding sequence
atggctggtcctgttaaggaccgggaggcttttcagcggttaaacttcttgtaccaggccgcacactgtgtgctagctcaggatccggagaaccaggctctggctcgattttattgctacacagaaagaaccatcgccaaaaggctcgttctccgaagggacccgagcgtgaagcgtactctatgtaggggctgctcttcactcttagtgccgggattaacatgtacccagcgtcagaggcgctgtcgtgggcaacggtggactgtgcagacctgccttacgtgccagaggagtcagcgattcctgaatgatcccggacaccttctgtggggagatcgcccagaggcgcaactgggatcacaggctgatagtaagcctcttcagcccttgcccaataccgctcattccatttcagatcgcttacccgaggagaaaatgcaaacacagggctcgtccaaccagtag

SEQ ID NO: 238862 - DNA, 489 bp, Artificial Sequence
  Description of Artificial Sequence: Synthetic coding sequence
atggctggacccgtgaaggatcgggaggcattccagaggctgaacttcctatatcaggctgctcactgcgtgctggcacaggatccagagaatcaggccctggctcgtttctactgctacaccgagagaacaatcgccaaaagactcgttcttcgtcggcctctctcgtccagtgccccacgggacccatcagtcaaacggaccttgtgccgaggatgttccagccttctggttccaggattaacgtgcacccagcgccagcgcagatgccgaggacagaggtggacagtccagacctgccttacttgtcaacggtcacaaaggtttttgaatgacccaggccacctgctatggggggatcgtccagaagcccagctgggaagtcaagcagattctaagccactgcaacctctgcctaataccgctcattccatctcggataggttacccgaggagaaaatgcaaacgaaaggaagctcgaatcaatag

SEQ ID NO: 238863 - DNA, 534 bp, Artificial Sequence
  Description of Artificial Sequence: Synthetic coding sequence
atggctgggcctgtgaaagacagagaagcgttccagcgcttgaatttcctttaccaggtgtcgttgaggcaaggcccacatggcgacggggctaggcgacctagagtcaccgcccctctgcctcaggccgctcactgtgtgctggctcaagatcccgaaaaccaggcattggccagattctattgctatactgagaggacaatcgcaaagcgcctggtgttgcgtcgagatccatcggtgaagcgcacgctgtgccgaggctgctcttccttactggttccaggcttaacgtgcacccagcgtcagcgtaggtgcagaggccagcgctggaccgtgcagacttgcctgacgtgtcaacggagtcagcggttcctgaacgatccaggccaccttctgtggggtgaccgacccgaggctcagttgggatctcaggccgattccaaaccgctgcagcccctacctaacacagctcattctatttcggatagattgcctgaagagaagatgcaaactcaggggtcctctaaccaatag

SEQ ID NO: 238864 - DNA, 489 bp, Artificial Sequence
  Description of Artificial Sequence: Synthetic coding sequence
atggcgggaccagtgaaggaccgagaagcgttccagcgccttaacttcctctatcaggctgctcactgcgttcttgcacaggaccctgaaaatcaggcactggcccgattctactgttatactgaacgtacaatcgccaaacgattggtgctgaggagaccactcagtagctcagcccctagagatccctcagtgaagagaactctgtgcagaggctgcagctcactgcttgtgccaggattgacttgtactcatcgacagcgcaggtgtcgcggtcagcggtggacagtacagacttgcctaacttgccagcggtcacaacgtttcctgaacgatcccggacatttgctgtggggtgacaggcccgaggcgcagctgggatcacaggctgactcaaaacccctgcagcctttgcctaacaccgcgcactccatcagtgataggttacctgaagagaagatgcagacccagggcagctctaaccagtag

SEQ ID NO: 238865 - DNA, 534 bp, Artificial Sequence
  Description of Artificial Sequence: Synthetic coding sequence
atggctggccctgtgaaggaccgtgaggcatttcaacgactgaacttcttgtatcaagtgtctcttaggcaggggccacacggtgatggcgctcggcgacctcgggtgacggcccctctcccccaggccgcacattgtgtgctggcacaggacccagagaaccaggcgttagctcggttctactgttatactgaaaggaccatagctaagcgcctggtcttaaggcgggaccccagcgtgaagcgcaccctttgtaggggctgttcaagcttgctcgtgccaggcctaacttgcacccagcggcaaaggagatgccgagggcagaggtggacggtgcagacctgtctgacctgccagaggtcgcaacgtttcctgaatgatccgggacatctcctgtggggcgacaggcctgaggctcagctcggatcccaggctgactcaaaaccactgcaacctttgcctaacacagcccattcaatcagcgatcgccttccagaggagaagatgcagactaaagggtcctctaaccaatag

SEQ ID NO: 238866 - DNA, 465 bp, Artificial Sequence
  Description of Artificial Sequence: Synthetic coding sequence
atggctggacccgtgaaagaccgggaggcttttcagcgtctcaattttttataccaagcagcccactgtgtcctggctcaggatccggagaaccaggccctggccagattctattgttatacagagagaacaatcgcaaagagactggtgcttagacgtgacccatctgtcaaaaggacgctgtgtcggggttgctcatcccttctggttcccggattgacttgtacccacagacagcgcaggtgtcggggtcagaggtggaccgttcagacctgcctaacttgccagcggagccagcggttccttaacgatcctggccacctcctctggggggacaggcccgaagctcaacttggcagccaagcggattccaaaccgttgcagcccctgcccaatacagctcactcgattagcgaccggctgccggaggaaaagatgcagacacagggcagcagtaaccagtag

SEQ ID NO: 238867 - DNA, 435 bp, Artificial Sequence
  Description of Artificial Sequence: Synthetic coding sequence
atggctggccctgtgaaagaccgggaagcgtttcagcggctgaattttctatatcaggcagctcattgcgttctggctcaagatccagagaaccaggccctggcaaggttttactgttataccgaaaggaccattgcaaagagactggtgttgaggcgcgatccctctgttaagaggaccctctgccgaggctgtagctccctcttggtgcccggactgacctgtactcagcgccagcggagatgcagaggtcagcgctggaccgtgcaaacctgtctaacctgtcaaagatcacagagatttctgaacgacccaggccatctactgtggggcgaccggccagaagcccagcttgggagccaggctggcgagcggtttcagactaccaccacactggctaagcactcccctttacacttcagaccgccttcctag

SEQ ID NO: 238868 - DNA, 465 bp, Artificial Sequence
  Description of Artificial Sequence: Synthetic coding sequence
atggcaggtcctgtcaaagacagagaggcatttcagaggctgaactttctgtatcaggcggcacactgcgtcctggctcaggacccggaaaaccaggcactagcacgcttctattgctatacagaacgtaccatagccaagcgcctcgtgctacgcagagacccatctgtaaaaaggaccctgtgcagaggctgttccagcctgctggtccccggattgacctgtactcaccgacagcgaaggtgtagagggcagcgatggacggtccagacttgcttgacctgtcagagatcacagcgattccttaacgatccaggccatctgctgtggggcgataggcctgaggctcagcttggaagccaggctgatagcaaacccttacagcccttacctaacacggcccactccatctccgacagactgccagaggaaaaaatgcagacacaggggtcttcaaatcagtag

SEQ ID NO: 238869 - DNA, 465 bp, Artificial Sequence
  Description of Artificial Sequence: Synthetic coding sequence
atggcaggtccagtgaaagaccgggaggcctttcagcgcttgaattttctgtatcaagccgcacactgcgttcttgcccaggatcctgagaatcaggctctcgccaggttttactgttatactgagcggaccatcgccaaaagattagttctccgcagagatccatcagtgaagcgcactctgtgcaggggctgttcctctctccttgttccaggcctgacttgcactcagcgccagagaaggtgtaggggacagcgctggaccgtgcagacatgtttgacttgtcaacggagccaaagatttctcaacgacccaggtcacctcctgtggggcgatcgtcctgaggctcaactgggcagccaagcagattctaaaccgctgcagcctctgccaaataccgcccattccattagcgacaggctgccagaggagaagatgcagacaaaaggctcatctaatcagtag

SEQ ID NO: 238870 - DNA, 534 bp, Artificial Sequence
  Description of Artificial Sequence: Synthetic coding sequence
atggctggtccggtcaaggatcgcgaagcctttcagcgcctcaattttctgtaccaagtgagtttaagacagggaccacacggagacggagctcgaagaccgagggtaaccgcccctctcccacaggccgctcattgcgtcctcgctcaggaccctgaaaatcaagccctggcacgcttttactgttacaccgagcgtacaattgcaaagagattagtgcttaggagagatccttctgtcaagcgtaccctctgtcgaggctgctcatccctgctggttcccggactcacgtgtactcaccgtcagcgcagatgtagaggccagaggtggaccgtgcagacttgcttgacatgtcagcgttctcaacgattcctcaacgatcccggacatctgctctggggggatcgcccagaagcacagttggggagccaggcggactccaaacccctgcaacctttgccaaatacagcacacagtatatccgatcggctgccagaggaaaaaatgcagactcagggtagctcaaatcagtag

SEQ ID NO: 238871 - DNA, 435 bp, Artificial Sequence
  Description of Artificial Sequence: Synthetic coding sequence
atggcaggcccagtcaaagatagggaggcctttcagcgattgaatttcctttaccaggccgcacattgtgtattggcccaagatcccgaaaatcaggcgctggccagattttactgttatacagaacgaaccatcgccaagagattggtgctaaggagagacccgtctgttaaaaggactctgtgcagaggctgctccagcttgctggtccccggattgacttgcacccaccggcagagacggtgccggggacagcgttggaccgtgcagacgtgcctgacgtgtcagaggagtcaaaggtttcttaacgacccagggcatcttctctggggtgatcgacctgaggcgcagctgggcagtcaagccggagagagatttcagacgacaaccacacttgccaagcactcacctcttcatttccgacccccaagctag

SEQ ID NO: 238872 - DNA, 465 bp, Artificial Sequence
  Description of Artificial Sequence: Synthetic coding sequence
atggcaggccctgtcaaagaccgcgaggccttccagcgcctgaatttcctataccaggccgctcattgtgtgctggctcaggaccccgaaaaccaggcactggccagattctattgctatactgagcgtacgattgctaaacgtcttgtgctacggagagacccaagcgtaaagcgcacactttgtcggggatgtagttctctactggtgcctggcctgacatgcacacaacgccagcgtcgctgtaggggccaaaggtggaccgtgcaaacttgtctgacttgccagcggagtcagcggttcctcaacgatcccggtcatctgctgtggggcgaccgccctgaagctcagctcggaagtcaagcagattcaaagccacttcagccattaccgaacaccgctcactcaatcagcgaccgccttcccgaggagaagatgcaaactcagggtagttccaaccagtag

SEQ ID NO: 238873 - DNA, 489 bp, Artificial Sequence
  Description of Artificial Sequence: Synthetic coding sequence
atggctggacccgtaaaggatagagaagccttccagagattgaacttcctgtatcaagctgcacactgtgtcttggcccaggaccccgagaatcaagccttggccagattttactgctacaccgagcggaccattgcgaagcggcttgtgctcaggaggccactgtcaagttccgcccctcgcgatccgagcgtgaagcgcaccctctgccggggatgcagcagcctgctcgtgcccggactgacttgcacacagcgacagaggcgatgccgaggacagaggtggactgtacagacctgcctgacatgtcaaaggtcacagcgcttcctgaatgatcccggtcacctcctgtggggcgatagaccagaagcacagttggggagtcaagccgactccaagccactgcagccacttcctaacaccgcacattctatcagtgaccggttgccagaggagaagatgcagacccagggcagctctaaccagtag

SEQ ID NO: 238874 - DNA, 435 bp, Artificial Sequence
  Description of Artificial Sequence: Synthetic coding sequence
atggccggacccgtaaaggatagagaagcattccagcgcttgaactttctctatcaggctgcccattgtgtcctggcccaagatcccgagaatcaggccctggcccgattctattgttacacagaaaggaccatcgcaaagcgcctcgtgctgcggagggatccctccgtcaagcgcacgttatgccggggttgcagtagcctcttagtgcctggcctgacctgcactcacaggcaaagacgctgtcgcggacagagatggacggtccagacttgtctgacatgccagcgttcccagcggtttctgaacgatccagggcacttgctttggggggatcggcctgaagctcagttgggctcacaagctggagaaaggtttcagaccaccaccacgcttgccaaacactctcccttgcatttcagacccccatcctag

SEQ ID NO: 238875 - DNA, 534 bp, Artificial Sequence
  Description of Artificial Sequence: Synthetic coding sequence
atggccggtccggtcaaggacagagaggcattccagaggctcaacttcctttatcaagtatctttaagacaggggccacacggagatggcgcacggaggcctagggtcaccgcgccactccctcaggccgcacactgtgtcctggctcaggatccagagaatcaggccttggcccgtttttactgctacacggaacgcacaattgccaaaaggcttgtcctgcggcgagatccttccgtcaaacgcactctgtgtcgagggtgctcatctttgcttgtgccaggactgacatgtactcagcgccagcggcgatgccgtggtcagcggtggaccgttcagacctgcctcacatgtcagagaagtcaacggttcttgaatgatcctggacatctgctgtggggtgacagaccagaggctcaactaggatcacaggcagactcaaaaccactccagccgctacctaatacggctcactccatctccgatagactccccgaagagaagatgcagacccagggctcgagcaatcagtag

SEQ ID NO: 238876 - DNA, 489 bp, Artificial Sequence
  Description of Artificial Sequence: Synthetic coding sequence
atggccggtccagtcaaagacagggaggcattccaaaggcttaacttcctttatcaggccgcacactgtgtgctcgcccaggacccagaaaaccaggccctggcccgattttactgctacactgagaggactatcgccaaaagactcgtgctccggcgtcccctatcaagtagtgccccacgagaccctagcgtgaagcggacactctgtaggggctgctcgagtctgctggtgccaggccttacttgcactcatcggcagcgcagatgtcgcggtcagagatggacagtccagacttgcctcacttgccaaagaagtcagagatttctgaatgacccaggccatctattgtggggcgatcgacccgaagcgcaactggggagccaagcagacagtaagcccctgcagcctctgccaaatactgcccactccatcagtgaccggctccccgaggagaagatgcaaacacagggttcctctaaccagtag

SEQ ID NO: 238877 - DNA, 534 bp, Artificial Sequence
  Description of Artificial Sequence: Synthetic coding sequence
atggcagggccagtgaaagatcgggaagcctttcaacgcctaaattttctgtaccaagtcagtctacgccaaggccctcatggtgatggcgcaagacggccacgcgtcaccgccccactcccccaggccgcacattgcgttctggcgcaggaccctgagaatcaagcactggcaagattttactgctacaccgaaagaacgattgcaaaaagactggtgctccggagagatccatctgttaagcgcactctctgtagagggtgctccagtctgctggtccccggtctcacctgcacccaaagacagcggcgatgtcgcggacagcgctggaccgtgcaaacatgtttgacctgccagagatcccagaggtttttgaatgacccgggtcacctgctctggggagacaggccagaagcacagctggggagccaggcggattctaaaccactgcagccactcccaaacaccgcacactccatctctgaccggctccctgaagagaagatgcagacacaggggtcgtccaaccagtag

SEQ ID NO: 238878 - DNA, 489 bp, Artificial Sequence
  Description of Artificial Sequence: Synthetic coding sequence
atggcgggtccagtgaaagatcgggaggctttccagcggctgaacttcctctaccaggccgcacactgtgtcctcgctcaggaccctgagaatcaagccctggccaggttctactgttacacagaacgcactatcgctaaacgtttagtgctaagaaggccactttcttcatctgccccacgggatcccagcgttaaacgtaccctatgtcggggatgctcttcactcctcgtccctggactgacatgcacccaaagacaaagacgatgccgcggacagcgctggacggtgcaaacctgcctgacgtgccagcgaagtcagcgctttctcaatgatcccggtcacctcctctggggcgaccgacctgaggcccagctgggatcccaggccgactctaagcccctacagcctttacccaacactgcgcattctatctccgaccgtctcccagaagagaagatgcagacccagggaagttctaatcagtag

SEQ ID NO: 238879 - DNA, 465 bp, Artificial Sequence
  Description of Artificial Sequence: Synthetic coding sequence
atggcaggacccgtgaaagatcgggaggccttccagaggctcaacttcctctaccaggcagctcattgcgtcctggcacaggacccggagaatcaagctttggctcgattctactgctacaccgaaagaactatagcgaaacggttggtcttaagaagagatccatccgtgaaacggacactgtgtagggggtgcagctctttgctggtgcccggtcttacctgcacgcatcgccagagacgctgccgcggacagcggtggacagtccagacctgcctgacatgtcagcgctcccagcggttcctcaacgacccaggtcacttgctttggggagatcgtccagaagctcagctgggcagccaggcagacagcaagccattacagccactgcctaacacggcccattctatttcagatagactccctgaggagaagatgcagactcagggaagcagtaaccagtag

SEQ ID NO: 238880 - DNA, 435 bp, Artificial Sequence
  Description of Artificial Sequence: Synthetic coding sequence
atggccggaccggtgaaggatagagaggcttttcagcgactaaatttcctttaccaggccgctcactgcgtcctcgctcaggatcccgagaaccaggcactggcacgcttttattgttataccgagcgcaccatagcgaagaggctggtcttgaggcgagatccctctgtgaagcggaccctgtgtcgtggctgctcatctctgctggtgcccggactgacctgcacgcagagacagagacggtgccgcggacagagatggaccgttcaaacgtgcctgacttgccagaggagccaaaggttcttgaatgaccctggccatctgctgtggggtgatcgcccagaggcccaactcggatcccaagctggcgagcgctttcagacaaccacaaccctcgccaaacactctcctctgcacttcaggccaccatcatag

SEQ ID NO: 238881 - DNA, 435 bp, Artificial Sequence
  Description of Artificial Sequence: Synthetic coding sequence
atggcaggaccagttaaagaccgggaggcgttccagcggctcaacttcctgtaccaagccgcacactgtgtgttagcccaggaccctgagaaccaggccctggccaggttctactgctatacagaaaggacgatcgcgaagcgcctggtattaaggcgggacccctcagtcaaacggacactctgccggggatgttcttcacttcttgtcccaggactaacttgtacgcaacgtcagcgcagatgccgcggacagagatggacggttcaaacatgcctgacttgtcaacgatctcaacggtttctcaacgacccaggacacttactgtggggagatcgaccagaggcccaattgggaagccaggctggggagcggttccagactacaacgaccctggctaaacattcccccttgcatttcagaccaccctcctag

SEQ ID NO: 238882 - DNA, 435 bp, Artificial Sequence
  Description of Artificial Sequence: Synthetic coding sequence
atggccggtcccgtaaaagacagagaagcctttcaacgactgaattttctctaccaggctgcacattgtgtgctggcccaggaccccgagaaccaagcgctggccaggttctactgttatacagaaaggactatcgccaagagactcgtactccggcgtgatccctccgtgaagagaactctgtgccggggatgctcatccctcctggtccctggccttacgtgcacccagaggcagcggagatgccggggacagcgctggacggtgcaaacttgtctaacctgtcagaggagtcaaaggtttttaaacgatcctggtcacttactctggggggatagaccggaggctcaactgggctcacaggccggtgaacggtttcagaccactaccacactcgcaaagcatagcccacttcattttaggcctccctcttag

SEQ ID NO: 238883 - DNA, 534 bp, Artificial Sequence
  Description of Artificial Sequence: Synthetic coding sequence
atggcagggccagttaaagacagggaggcattccaacggctgaatttcctgtaccaagtaagcctgcgtcagggcccacacggcgatggagcaaggcgtccacgagtgaccgccccactgcctcaggctgcccactgtgtgctggcccaggaccctgagaaccaagcactggctcggttttattgctacacagaaaggacgattgccaaacggctcgtcctgcggcgtgatccctcggtcaagagaactctgtgcagggggtgttcttccctgttggtcccaggactgacctgcactcaccgccagcgccgatgtcgtggccagaggtggaccgtgcaaacctgcttgacctgccaaagatcgcagaggtttcttaacgacccaggccatctgctgtggggcgaccggcctgaggcccagcttgggagccaggccgattcgaagcctctccaaccactaccaaatacagctcacagcatcagcgataggttgcccgaggagaagatgcagacacaaggctcatcaaaccagtag

SEQ ID NO: 238884 - DNA, 435 bp, Artificial Sequence
  Description of Artificial Sequence: Synthetic coding sequence
atggcaggaccagttaaggaccgcgaagcatttcagcgcttgaattttctgtaccaagctgcccactgtgtcctcgcgcaagatcctgaaaaccaagcacttgccaggttctattgctataccgagcgcaccatcgccaagcgtctggtgcttcggagggacccgagcgtcaaacgtacattgtgcagaggatgttcctcactgctggtccctggactgacttgtacacataggcaacgaagatgccgcggacagaggtggaccgtccaaacttgtctgacttgccagaggtcacagagattcctcaatgaccctgggcacctcctgtggggtgaccgcccagaggcacagctaggatcccaggcgggtgagcgatttcagactaccactacattagctaagcatagcccactccacttccgcccaccctcttag

SEQ ID NO: 238885 - DNA, 465 bp, Artificial Sequence
  Description of Artificial Sequence: Synthetic coding sequence
atggccggacccgttaaggatagggaggcttttcaacggttaaatttcctgtatcaagcggctcactgtgtcctggctcaagatcctgaaaatcaggctctggcccgtttctactgctatacagaacgaaccattgccaagagactcgttctgcgtcgcgatccttcagtgaagaggaccctatgtcggggttgcagcagtcttctggtaccaggtctgacatgtactcagagacagcgccgttgcaggggacagcggtggactgtgcaaacttgtctgacatgccagcggagccaaaggttcctgaatgatcctgggcacctgctttggggcgataggcctgaagcgcagctcgggagccaggctgacagtaagcccttgcagccgctaccgaataccgcacattctatttccgataggttgcccgaagagaaaatgcagacccaggggtcttccaaccagtag

SEQ ID NO: 238886 - DNA, 534 bp, Artificial Sequence
  Description of Artificial Sequence: Synthetic coding sequence
atggcgggacccgttaaagatcgggaggctttccagagactgaatttcttataccaggtttctctaagacaggggcctcatggagatggggctcggaggccgagagtcactgcccctctcccgcaggccgctcactgtgtgctcgcacaggatccagagaatcaggcattagccagattctactgctacaccgaacggacgatcgcaaaaaggctggttctgcgacgggaccctagtgttaaacgcaccctatgtcgaggctgcagttccttgttggtcccaggcctgacatgtacccacagacagcggagatgtcgaggccagcgctggacggtgcagacatgtttaacttgtcagcgctctcagcgcttccttaatgatccgggacacttgctgtggggcgaccgcccagaggcccagctggggagccaggctgattccaaaccactgcagcccctccccaatactgcccattccattagtgaccggctgcccgaggaaaagatgcagacccaggggagtagcaaccaatag

SEQ ID NO: 238887 - DNA, 489 bp, Artificial Sequence
  Description of Artificial Sequence: Synthetic coding sequence
atggccggaccagtgaaggacagggaggctttccagagattgaacttcctttatcaagccgctcactgcgtgctggctcaagatccagagaatcaggctctcgcgaggttttactgttacaccgaacggaccatagctaaacggttagtcctgcggagaccactgagttcttccgcccctagagacccttccgtaaaacgcactctgtgccggggatgctctagtctcctcgtaccagggctcacatgcacccagaggcagcggcgatgcagaggtcagcgctggactgtgcagacctgcctaacttgtcaaaggagccagcgcttccttaatgatccgggacacctactgtggggagataggcctgaggcccaattggggtctcaggccgatagtaaaccgctgcaacctttgcccaatacggcgcatagtatttccgatagactgcctgaggaaaagatgcagacccaggggtcctccaatcaatag

SEQ ID NO: 238888 - DNA, 489 bp, Artificial Sequence
  Description of Artificial Sequence: Synthetic coding sequence
atggccggacctgtgaaagatcgggaggcctttcagaggcttaattttctgtatcaagctgcccactgtgtgctcgctcaagatcccgagaatcaggctttggctaggttctactgctacacggagcggaccatagcaaaacgtcttgttctacgcaggcccctgagtagctctgcccctagagatccgtcagtgaagcggaccctgtgtagaggatgttcttctctactggtgcctggcctcacttgcacgcaccgccaacgtaggtgtcggggacagaggtggacagtccagacctgcctaacttgtcagcgatcccagaggttcctcaatgatcctggtcacctcctgtggggcgatcggcctgaagcacaactggggtcccaagcagactctaagccattacagccattgcctaacacagcccactcaatttcagatcgtcttcctgaggagaaaatgcagacacaggggtcctctaatcagtag

SEQ ID NO: 238889 - DNA, 765 bp, Artificial Sequence
  Description of Artificial Sequence: Synthetic coding sequence
atggctgtgtttgccgacctagacttacgggctggcagcgatcttaaagcattgaggggcctggttgagaccgctgcccaccgagagctccccagactaagagcctggcccaccagttgtcacccagatcatcgagccaccttacggatcggctactcggttgtggccatcaatcacatcgtggatttcaaggaaaaaaagcaggagatcgaaaagccagtcgctgtgtcggaactcttcacaacactgccgatcgtccagggaaagtcacgacccataaagatactaacccgcctcaccatcattgtgagcgatccgtctcactgcaacgtcctgagagccaccagtagtcgggctcggttgtatgacgtcgttgctgtatttcccaagactgaaaagctgtttcacattgcttgtactcatctggacgtcgatttggtgtgcatcacagttacagagaagctaccattttacttcaagaggccccctattaatgtcgccatcgaccggggactcgccttcgagttagtttactccccagcgattaaggacagtaccatgcggagatacactatctcatctgcactgaaccttatgcaaatttgcaagggaaagaacgtgatcatctcttcggccgcagagcggcctttagaaattcgaggtccctatgacgtcgcaaatctgggactcctgtttggcctcagtgaaagtgatgccaaagccgcagtgagcaccaactgccgcgctgcactcctacatggatag

SEQ ID NO: 238890 - DNA, 807 bp, Artificial Sequence
  Description of Artificial Sequence: Synthetic coding sequence
atggcagtgttcgcagacctcgatctgcgagctggctctgatttgaaagcactgcgaggtctggtagaaaccgcagctcacctggggtattctgttgttgctatcaaccatatcgtggattttaaagaaaagaaacaggagatcgagaagcctgttgccgtgtctgagctgtttactactctgccgatagtccaggggaagagccgccctataaagatcctcacaagactcacaatcattgtgtctgacccatcccactgcaacgtgctgcgagccaccagctctagagctagactgtatgacgtggtggccgtatttccaaagactgagaagttgtttcacatcgcatgtacccatctcgacgtcgacctagtctgtataacagtgacggagaaattgccattctacttcaaaaggccacccataaacgtggccattgatagggggctggctttcgagctggtgtatagcccagcaatcaaggactccaccatgaggcgttataccattagctctgccctgaatttgatgcagatctgtaagggcaaaaacgtcataatcagcagcgccgcagagaggccgctcgagataagaggcccatacgacgtggctaacctgggcttgctgtttggtctgagcgagagcgacgctaaggccgcagtctccacgaattgccgggcagcgctcctccatggcgagactcggaaaaccgccttcggcattatttccaccgtgaaaaaaccacggccaagtgaaggtgacgaggactgccttccggctagtaagaaggccaaatgcgaaggctag

SEQ ID NO: 238891 - DNA, 768 bp, Artificial Sequence
  Description of Artificial Sequence: Synthetic coding sequence
atggccgtgtttgccgacctcgatcttagggcgggtagcgatctaaaagcactcagaggtcttgttgagacagccgcacacttaggatatagcgtagtggccatcaatcatatcgtcgacttcaaggaaaagaaacaggaaatcgagaagccggtggctgtgtccgaattattcaccacactgcctattgttcaaggcaaaagcagaccaattaagattctcaccaggttgaccatcatagtcagcgacccaagtcattgcaacgtactgcgcgctacttcctcccgcgcacgcctgtacgacgtcgtggctgtgtttcctaaaaccgagaagctatttcacatagcttgcactcatctcgacgtcgacttggtctgtatcacagtgaccgagaagctgccgttttactttaagcgaccacccatcaatgtggctattgataggggcctggcatttgagctcgtgtactcacccgctattaaggacagcactatgcgaagatataccatatcctcagctttaaatttaatgcagatttgcaaggggaagccgctcgagattcgtgggccttatgatgtggcaaatctcggattgttgtttgggttatctgagtctgacgctaaagcggctgtctccaccaattgtagagccgcactcttgcacggggagacccgcaaaaccgctttcggcatcatttctaccgtgaagaagcctagaccaagcgaaggagacgaagattgtttgccagcctctaagaaagccaaatag

SEQ ID NO: 238892 - DNA, 969 bp, Artificial Sequence
  Description of Artificial Sequence: Synthetic coding sequence
atggctgtgtttgcagatttggacttaagagccggttccgacttaaaagctctaagggggctcgtcgagactgctgcacatttgggctactctgtggtcgccatcaaccatatcgtggacttcaaggaaaagaagcaggaaatcgaaaagccagtcgccgtttcagagctctttaccactttgcctatcgtccaaggcaaaagccgcccaattaagatcctgactcggttgaccatcatcgtttctgaccctagccactgcaacgtcttaagggctacatcctccagggctaggctgtacgacgtcgtagcagtcttccctaagacagaaaaactgtttcatatcgcttgtacacacctggatgtcgacctggtctgtattacagtgactgagaaactacccttttattttaagcggcctccaataaatgtcgctattgacagaggcctggctttcgagctcgtgtactcaccggctatcaaagactctacaatgcgtcggtatacaatcagctctgccttaaacctcatgcagatatgcaaaggcaagaacgtgattataagctctgctgctgaaagacctctggagatccgaggcccttacgatgtcgcaaacctagggttattgttcggcctgtcagagagtgatgccaaagccgctgtctctaccaattgccgcgctgccttgttgcacggcgaaaccaggaaaaccgccttcgggataattagcacggttaagaagcctcggcctagcgagggagatgaagattgcttacccgctagcaaaaaagctaaatggtcccatagcgtgacacaggccggagtgcagtggcacaatttgggatctcttcagccacttcccttgggactgaagccctctagtcacctgagcctccccagaacaaggattcaacagcgccagcttctgatctcacatcagagagatcatacacctaagaataggctatag

SEQ ID NO: 238893 - DNA, 639 bp, Artificial Sequence
  Description of Artificial Sequence: Synthetic coding sequence
gagatcgagaaacccgtcgcagtgtcggagttgttcactaccctccctattgtgcagggcaaatctcgcccaatcaagatcctaactcgcttgacaataattgttagcgacccttcacactgcaatgtcctgcgtgctactagttctcgggcaagactgtacgatgtagttgccgtgttccccaagaccgagaaattattccatattgcctgtacacacctcgacgttgacctcgtttgtatcactgtcactgagaaactccccttctactttaaacggccacccattaatgtggcaatcgataggggtctcgcattcgaattggtgtattccccagccattaaagactctaccatgagacggtatacgatttcaagcgctctcaaccttatgcaaatctgcaaaggaaaacccctggagattaggggcccatacgacgtggccaaccttggtttgttatttggactgagcgagtcagacgccaaggccgctgttagcacaaactgcagagcggcactcctgcatggggagactcggaagacagctttcggtatcatatccaccgtcaaaaagcccagacccagcgaaggagacgaagactgtttgcctgcatccaagaaagcaaaatgcgagggttag

SEQ ID NO: 238894 - DNA, 852 bp, Artificial Sequence
  Description of Artificial Sequence: Synthetic coding sequence
atggccgctgctccccaggcccctggcagaggatccttgcgcaaaactcggcctcttgttgttaaaacttcgcttaacaatccatatatcatacggtggtcggcactggaaagtgaggacatgcacttcattttgcagaccctcgaagaccgcctaaaggccatagggttacagaaaatagaggacaaaaagaaaaagaataagactccttttctgaagaaggagtctagggaaaagtgttcaattgccgtggacatctcggagaacttgaaggagaagaagactgacgcaaagcagcaggtgagtggctggacccccgctcatgtgaggaaacagttggctataggcgtgaatgaagttacacgggcattggaaagaagagagctcctattggtgctggtgtgtaaatctgtgaagccggcaatgattacttctcacttgatccaactatccctctcccgctccgtgccagcctgccaggttcctaggctgagtgagcgaatcgctcccgttatcggcctgaagtgcgtgctggctctggccttcaaaaagaacacgaccgactttgtggatgaagtgcgggctattattcctcgggttccgtccctttccgtgccgtggttgcaggaccggatcgaggattcaggggagaacctggagacagagcctcttgagtcccaagaccgcgagcttctggatacttcatttgaggatttatccaagcctaaacggaagctggctgatggccgtcaggcatccgtgacgcttcaacctctgaaaatcaaaaaactgattcccaacccaaataaaatcagaaaacccccaaagagcaaaaaagccactccaaagtag

SEQ ID NO: 238895 - DNA, 504 bp, Artificial Sequence
  Description of Artificial Sequence: Synthetic coding sequence
atggcagccgctccccaggcccctggcaggggcagcctcagaaagacaagacctctcgtggtaaaaactagtttaaacaacccctatatcattaggtggagcgctctggaatccgaggatatgcatttcatcctccagaccctcgaggatcgcctgaaggctattggcctacagaagatcgaggacaagaaaaagaagaacaaaacaccttttttgaaaaaagagtcaagggagaagtgctctattgcggttgacatatccgagaacctcaaggaaaagaagaccgatgccaaacagcaggtgtcaggttggacccccgcacatgttagaaaacagttagccattggtgtcaacgaggtgacccgtgcactggaacggcgagaacttttgctcgtgctggttcttaccctgctgccaagactcgagtgttcaggggtcatccccgcacactgcaaccctgcctcatgggtgcaagccatcctattgccacagccgccagagtag

SEQ ID NO: 238896 - DNA, 852 bp, Artificial Sequence
  Description of Artificial Sequence: Synthetic coding sequence
atggccgcagccccacaggcccctgggcgtggaagcctgcgcaagacgcgccctctagtggtcaagacctcactgaataatccatacataatcaggtggagcgcactcgaatctgaagacatgcactttattctccaaacactggaggatcgactgaaggcaattggcctccagaaaatcgaagacaagaagaagaaaaacaaaaccccctttttaaaaaaagagtcccgagagaaatgttctatagcggtggacatatccgagaacctaaaagagaaaaagaccgatgctaaacaacaggtgtcaggctggactcccgcacatgttcgcaaacagctcgccatcggggtaaatgaggttacccgggctctggaacgccgagagttactcctcgtgctggtttgcaagtcagtgaagccggcaatgatcacctcccatctgatccagctatctttatccagatctgtacctgcctgccaggtgcccaggctgtcagaaagaatcgctcctgtgatcggactcaaatgtgtcttagcacttgcgtttaagaagaacactacggactttgttgacgaggttagggccattataccccgtgttcctagtctgagcgttccatggctgcaggacagaatagaagactcaggggagaatctcgagacagagcccctagaatctcaggatcgcgaactcctcgatacctcctttgaagatctttctaagccgaaacgcaaacttgcagacgggaggcaagcttctgtgacattacagccactgaaaattaagaagctgattcctaatcctaataaaattcgcaagcctcctaaatccaagaaggccaccccgaagtag

SEQ ID NO: 238897 - DNA, 852 bp, Artificial Sequence
  Description of Artificial Sequence: Synthetic coding sequence
atggccgctgctccccaggcgcctggccgaggctccctgcgcaagaccagacccctcgtggtgaagaccagcttgaacaatccttacattattagatggtccgcattggagagcgaggacatgcactttatcctacagacccttgaagacagacttaaggctattggcctgcaaaaaattgaggataaaaagaaaaagaataaaactccattcttaaaaaaggagagtcgggagaagtgtagcatcgcagtggatatcagcgaaaacttaaaggaaaagaagaccgatgccaaacagcaggtgtctggatggactcctgcccacgtaaggaagcagttagctataggagtaaatgaggtgacccgggctctggagcggcgtgagctactgctggtcctcgtgtgtaaatccgtcaagccagctatgattaccagccacctgattcagcttagcttgagtcgttctgtcccggcatgtcaggttccacgcttgagcgaaagaatagccccagttatcggactgaagtgtgtgcttgctctggctttcaagaagaacactactgattttgtggatgaggttagggccataatcccccgtgtgccctctttatccgtaccatggctccaggatcggatcgaggactcaggcgaaaacctcgagaccgaacccttggagagccaggaccgcgaattactcgataccagcttcgaagacctgagcaagccgaagcgcaagctcgccgacggacgccaggcaagcgtcacgctccagccgcttaaaattaagaaactgattccgaatcctaacaaaattaggaagcctcctaagagcaagaaggcaactccgaaatag

SEQ ID NO: 238898 - DNA, 510 bp, Artificial Sequence
  Description of Artificial Sequence: Synthetic coding sequence
atggcggcagcccctcaggccccaggacggggttctctgaggaagacccgacccctcgtggttaaaacgagcctcaataacccctatataatacggtggtccgccctcgagagtgaagatatgcacttcatcttgcagacccttgaggatcggctcaaagccattgggctgcaaaagatcgaggacaaaaagaagaagaacaaaaccccatttctaaagaaggaatcacgtgagaagtgcagcattgctgtggacatcagcgagaatctgaaggagaagaagacggatgcaaagcagcaagtctccggatggacccccgcacatgtgcgtaaacaacttgccattggagtgaacgaagtaacaagggccttggagcggcgagagttgctcttagtgttagtctgtaaatctgttaagcccgcaatgattacatcccacctgatccagctgtccttaagcaggtcagttcctgcctgtcaggtgccccgactcagcgagcggattgcatag

SEQ ID NO: 238899 - DNA, 1092 bp, Artificial Sequence
  Description of Artificial Sequence: Synthetic coding sequence
atggcgacactcagacgccttcgcgaagccccaaggcatcttcttgtttgtgagaagtctaatttcggcaaccacaaatcgagacaccggcacctggtgcagacccattattacaactacagagtgagtttcctgattcctgaatgtggcatactttccgaggaactgaaaaacctcgttatgaacaccggaccatattactttgtgaagaacctcccactgcacgaattgatcacccctgagttcatcagtaccttcattaaaaagggatcatgttatgcgcttacgtataacacccacatagacgaggataatacggtggccttgcttcccaatggtaaactcatccttagcctggataaagatacttacgaagagaccggcttgcaggggcacccctcccagttttccggcaggaagatcatgaagttcattgtgagcatcgatctcatggaactgtctctcaacctcgattccaagaaatacgaacgaatcagttggtcatttaaagagaaaaagcctctgaagttcgacttcctcctggcttggcacaaaacagggagcgaagaaagcactatgatgtcttacttctccaagtatcagatccaggagcaccaacctaaagttgccctctccacgctccgagacctccagtgccctgtgctccagagctctgagctcgaaggcaccccggaggtttcttgtagggcgttggagctgttcgactggctcggcgcagtgttttccaacgttgacttgaataatgaaccaaataatttcattagtacatattgctgcccggagccctcaacagtagtggccaaggcttacctgtgtacaatcaccggtttcatcttgcccgaaaagatctgtctacttctagaacacttatgccactatttcgacgagcctaagctggcaccatgggtcacactttcagtgcaggggttcgctgatagtcccgtatcctgggaaaagaacgagcacggatttagaaaggggggagaacacctgtataattttgtaatcttcaacaaccaggactattggctgcagatggcggtcggcgctaatgatcactgccccccttag

SEQ ID NO: 238900 - DNA, 912 bp, Artificial Sequence
  Description of Artificial Sequence: Synthetic coding sequence
atgaatacaggcccttattacttcgtcaaaaacctgccactgcacgaactgattacccccgagttcattagcaccttcatcaaaaaagggtcgtgctatgccctcacgtacaatacccatatcgacgaagacaacacagtcgccctgttgccaaatgggaaattaatcctgagtctggacaaggacacatacgaagaaacaggcctgcagggacacccctcacagttctcagggagaaagattatgaaatttatagtgagcattgatctcatggagctttcattgaacctggattctaagaagtacgagcgtatctcgtggtccttcaaggagaagaagccccttaaattcgactttttgctcgcctggcataagacaggcagcgaagagtctaccatgatgtcatatttttcaaaataccagatccaagagcaccagccaaaagtggcccttagcaccctgagggacctgcagtgccccgtgttgcaaagcagtgagcttgagggaacgcccgaggtttcgtgcagggcactggagctgtttgactggctcggcgcagtgttttctaacgtggacctaaacaatgaacctaacaatttcatttcgacatactgttgtcccgagccctctaccgtggtggcaaaagcatacctttgtactatcacaggctttatactaccggagaagatctgcttgctgctcgagcacctgtgccactacttcgatgaaccaaaactcgcaccttgggttacattaagtgtccagggattcgccgacagcccagtctcatgggagaagaatgagcacggcttccgcaagggcggagagcatttatacaacttcgtgatcttcaacaatcaagactactggttacagatggcagtcggagctaatgatcattgtcctccctag

SEQ ID NO: 238901 - DNA, 717 bp, Artificial Sequence
  Description of Artificial Sequence: Synthetic coding sequence
atgcgcccagccgcactcaggggcgcattgctcggctgtctgtgcctggcactgctgtgtttaggtggtgccgacaagagactccgcgataaccacgaatggaagaaactgattatggttcaacactggccagagaccgtctgcgaaaagattcagaacgattgtcgggacccccctgattattggaccattcatgggctatggcctgataaaagcgagggatgtaaccgcagctggccctttaatctggaagaaatcaagaagaattggatggaaataaccgactcatccttgcccagtccgtctatgggtccggcacctcccagatggatgcgttccacacccaggcgcagcacactggccgaagcctggaacagcactgggagctggacttccacaggtggatgtgccctgccacctgcagcattgcctagcggggacctgtgctgtagaccatccctaacagccggatccaggggggtgggcgtagatttgactgcgcttcagcaactgctgcatgtccattactcagctacggggattattccagaagaatgttcagagccaaccaaacccttccagatcattctgcatcacgaccacacagaatgggtgcagagtatcggtatgcccatttggacaatcagctctagtgagtctgcgatcggcaaaacacggacacaaccagcctgtgctgtgctgtcccatgattcctag

SEQ ID NO: 238902 - DNA, 624 bp, Artificial Sequence
  Description of Artificial Sequence: Synthetic coding sequence
atgagacccgcagcactaaggggagctctgctcggctgtttatgcctcgctctgctctgcctgggcggagctgataagcgcctaagagataatcacgagtggaagaaacttatcatggtgcaacattggcccgagacagtttgcgagaagatccagaatgattgtagagacccccctgattactggactatccacgggttgtggccagataaatccgaaggctgtaacagatcctggccatttaatctggaggagataaagaagaattggatggagataacagactcttccctgccaagcccgagcacagatctgctgccggaaatgcgggcttactggcccgacgtgattcattctttccccaaccgctctcgtttctgtggcacttgtgccgcacaggttgatgccctcaatagccagaaaaaatactttgggaggagtctggaactctaccgggaattggatttaaacaggtgggtccgcccttcacctggttgcacatctcagtgggggtccctgctgtccccaaagcccgactcttggatacagggatccggttgccgaccgcactgtccgcctgccgcatctgcgtgcgctctattcgggtactgggaccactcctag

SEQ ID NO: 238903 - DNA, 921 bp, Artificial Sequence
  Description of Artificial Sequence: Synthetic coding sequence
atgcggcctgccgcactgagaggcgcattgctgggatgcttgtgccttgcactgctatgcctggggggagccgacaaacgtctgagagataaccatgaatggaagaagctcattatggtgcagcactggcccgaaactgtctgcgagaaaatccagaatgactgcagggacccaccagattactggacaattcacggcctttggcaggtgtcgcacacttccaggaggggtctgctctttctcttcaagaacattttctcgctgtctagcagaaatttttccttttattcccttcaaacgagcatgaagaagccaccgcagccatccctgatttttctaatctttagcttcaaaccggacaagtccgagggctgtaatcggtcctggccattcaaccttgaagagatcaaagatctccttccagaaatgcgggcttactggccagacgtaatccactccttccctaacagaagccgcttctggaaacatgagtgggaaaagcatggtacgtgtgcggcacaggtcgacgccctgaactcacaaaagaaatattttggccgttcactggaactgtaccgcgaacttgacttgaactccgttctcctgaaacttggaataaagccttccattaactattatcaggtcgcagacttcaaagatgcgctggctagagtgtatggggtgattcctaaaatccaatgcctcccaccttctcaggatgaagaagtgcaaacaatcggccagatcgagctgtgtctgacgaagcaggatcagcaactgcagaattgtacagagccaggagagcagccctcacctaagcaggaagtgtggctcgccaatggcgctgctgagtctcgcggactccgtgtatgtgaagatggccctgtcttttaccctccaccaaaaaagacgaagcattag

SEQ ID NO: 238904 - DNA, 771 bp, Artificial Sequence
  Description of Artificial Sequence: Synthetic coding sequence
atgaggcctgccgctctaagaggcgctttgttaggctgtctctgcctagcactgttatgtctaggcggtgcagacaagagattgagagataatcacgagtggaaaaaacttataatggtgcagcactggccagagacagtgtgcgagaaaatacagaacgactgtcgggatccccctgattattggaccattcatggcttatggccggacaagagcgaaggttgcaacaggagttggccattcaaccttgaggagatcaaagacctactgccagaaatgcgggcttattggcccgatgtgatccatagctttcctaatcgctctaggttctggaaacacgagtgggaaaagcatggaacatgcgccgctcaggttgatgcgcttaactcacagaaaaaatattttggcagatccctcgaactgtaccgcgagctggatctcaactcggtgttgctgaaactggggatcaaaccgagcattaattattatcaggtggccgactttaaagacgcactcgcccgagtttacggagttattcccaagatacaatgcctgcctccttcacaggacgaggaagtgcagaccatcggacaaatcgaactctgccttaccaaacaggatcaacagctgcaaaactgcacagaacctggcgaacagccttcccccaaacaggaagtctggttggcaaatggggctgccgagagtcgtggactgcgcgtgtgtgaagatggacccgtgttttacccccctcccaaaaaaactaaacactag

SEQ ID NO: 238905 - DNA, 765 bp, Artificial Sequence
  Description of Artificial Sequence: Synthetic coding sequence
atgcgccctgccgcactgcgcggagccctcctggggtgcctgtgcctggctttattgtgtctgggaggcgcagacaaacggttacgcgacaatcacgagtggaagaagctgatcatggtgcagcactggccagaaactgtgtgcgaaaagattcagaatgactgcagagaccccccagattactggacaatccacggcctttggccagacaagtctgaggggtgtaatcgtagctggcctttcaacctggaggaaataaaagacctcctgcctgagatgagagcgtactggcccgacgtaatccattcgttcccgaaccggagccgattctggaagcacgaatgggaaaagcatggcacgtgcgcagcccaggtggatgcgttaaatagtcagaagaagtacttcggtcggtccctcgagttatatagggagctggacctcaacagcgtgctgctaaagctcggcattaagcccagtatcaactattatcaggtggcagattttaaggacgcacttgccagggtttatggcgtaattccaaaaattcagtgtctgcccccatcacaagatgaggaggtccagaccattggtcagattgaactctgcctaacgaaacaagatcagcagttacagaactgtacagagcccggagagcaaccctcacccaagcaggaggtctggttggccaacggagctgccgagtcacggggtcttagggtgtgcgaggacggacccgtattttatccgcctcctaaaaagacatag

SEQ ID NO: 238906 - DNA, 771 bp, Artificial Sequence
  Description of Artificial Sequence: Synthetic coding sequence
atgagaccagccgctctacgaggggctctcttaggctgtctttgcctggcgttactgtgtctagggggagccgacaaacgtcttcgagacaatcatgaatggaaaaaactcataatggttcagcattggccagagacagtttgtgagaagattcaaaatgattgtcgagatcccccagattactggacaattcacggcctttggcctgacaagtccgaaggctgtaaccggtcatggccattcaatctcgaggagattaaagaccttctgcccgagatgcgggcatattggccagacgtgattcattctttccctaatcggtcaagattctggaagcacgagtgggagaagcacggcacgtgcgccgcacaggtcgatgctctgaactcccagaagaagtatttcggcaggtctcttgagctctacagggagctagacttgaactcagtgttgttgaagctgggcatcaagccctccatcaattactaccaggttgctgatttcaaagatgctctggcccgagtgtacggggtaattcccaaaatccagtgcctgccaccatcacaggatgaagaggtccagacaatcggccagattgaactgtgcctgactaagcaagaccagcagctccagaattgtactgaacctggagagcagcctagccctaaacaagaggtatggttggccaacggggcagctgagtcccgtggtcttcgcgtgtgcgaagacgggcctgtattttatccacctcctaaaaagactaagcattag

SEQ ID NO: 238907 - DNA, 471 bp, Artificial Sequence
  Description of Artificial Sequence: Synthetic coding sequence
atggccttggagaaatccctggttcgcttgctcttgctggtgctcatcctacttgtgcttgggtgggtccagcccagcctgggaaaggagtcccgcgctaaaaagttccagagacagcacatggattccgactcaagtccatcctccagctctacctactgtaaccagatgatgcggcgtcgcaacatgactcagggtaggtgtaagccagttaatactttcgtccacgagcctttggttgacgttcagaacgtctgctttcaagaaaaagtgacctgcaagaacggccaaggtaactgctacaaatctaacagttccatgcacatcactgattgtcggctgaccaacggaagcaggtatccgaactgcgcgtatcgcacgtcaccaaaagaacggcacatcatcgtcgcatgtgagggaagcccgtacgtgcctgtgcattttgacgcgagtgtcgaagatagtacctag

SEQ ID NO: 238908 - DNA, 471 bp, Artificial Sequence
  Description of Artificial Sequence: Synthetic coding sequence
atggccttagaaaaatcactcgtcagactattgctcctggttcttatactcctggttctgggttgggttcagccctccctcggcaaggaaagccgggcaaagaaattccagagacagcacatggatagcgactccagcccctcttctagctcaacatattgcaatcaaatgatgcggaggagaaatatgacccaggggaggtgcaaacccgtaaacacattcgtccacgagcctcttgtggacgtccagaatgtatgtttccaggaaaaagtgacttgcaagaacggtcaaggaaattgttacaagtctaattcttctatgcatatcacggattgtaggctcactaatggcagcaggtatcccaattgcgcctatcgaacttctccgaaagaacggcatattatcgtcgcctgtgaagggagcccatatgtgcccgtgcatttcgacgcgtccgtggaagactctacttag

SEQ ID NO: 238909 - DNA, 471 bp, Artificial Sequence
  Description of Artificial Sequence: Synthetic coding sequence
atggctctcgaaaagtccctagttagattgcttcttctggttcttatcttgctcgtgctagggtgggtgcagcccagcctcggaaaggaatctcgcgctaagaaattccaaagacagcatatggattcagattcgtctcctagcagctccagcacttactgcaatcaaatgatgagaagaagaaatatgactcaagggagatgcaagccagttaatacttttgtacacgagccactcgtcgacgtgcagaatgtgtgttttcaggagaaagtcacatgtaagaacggtcagggtaattgttataagagcaactcttccatgcacattacggactgccgcttgactaatgggtctcgatatccaaattgcgcctacaggacttctcccaaggagcggcatattattgtagcatgtgagggctccccctacgtgcccgtgcacttcgacgcaagcgtcgaggacagcacttag

SEQ ID NO: 238910 - DNA, 471 bp, Artificial Sequence
  Description of Artificial Sequence: Synthetic coding sequence
atggccctcgagaagagcttagtaaggttgctgctgttggtcttgatcttattggtacttggctgggttcagccaagcctcggcaaagaatcacgcgcaaaaaagtttcagcggcagcacatggactcagatagcagcccgagctctagtagcacttactgcaaccagatgatgcgtcggaggaacatgacacagggaagatgcaagccagtcaatacgttcgttcatgaacccctggtggacgtgcaaaacgtatgcttccaggaaaaggtgacttgcaagaatggtcagggcaactgctacaagagcaactcttctatgcacatcaccgattgccgattgaccaacgggtcacgataccccaattgcgcctacagaacaagtcctaaggagcgccacattatcgtggcatgtgagggctctccatacgtgcccgtgcactttgacgccagcgtggaggattctacgtag

SEQ ID NO: 238911 - DNA, 486 bp, Artificial Sequence
  Description of Artificial Sequence: Synthetic coding sequence
atggtgcctaagctatttacgtcccagatttgtttattgttactgctggggctactcgcagttgaagggtcactgcacgtgaaacctccccagtttacttgggcccagtggtttgaaacacagcacattaatatgacttcccagcagtgtacgaacgcgatgcaggtgattaacaactaccagcggagatgtaaaaaccaaaacacctttctgctgactacgtttgcaaatgttgtcaacgtgtgcgggaatcccaacatgacctgcccttcgaacaagacacggaaaaactgccatcattcggggtcccaggtgcctctcattcactgtaatttgaccacccccagtccacagaatatctctaactgtaggtacgcacagacccccgctaatatgttttacattgtagcttgcgacaacagggatcagaggagggatcctccccaatatcctgtggtgccagtccatctcgatcgcattatctag

SEQ ID NO: 238912 - DNA, 483 bp, Artificial Sequence
  Description of Artificial Sequence: Synthetic coding sequence
atggttccaaagttattcacaagtcagatctgtttgctgctcctcctcggcctgatgggagtcgaggggtctctgcacgcacgacccccacagttcacccgagcgcagtggtttgccatccagcacattagcttgaaccccccaagatgcaccatcgcaatgagagccatcaacaattataggtggaggtgtaagaatcagaacacattcttacggactacattcgctaatgtcgttaacgtatgtggtaaccaatcaatcaggtgcccacacaatcgcactctgaataactgccatcggagtcggttccgggtacccctacttcactgcgacctgatcaatccgggagcccagaatatttcaaactgtacctacgcggacagacccggacggagattttacgtagtcgcctgtgacaaccgagaccctcgagatagtcctcgttatcccgtcgtcccggtccatctagacacaaccatttag

SEQ ID NO: 238913 - DNA, 444 bp, Artificial Sequence
  Description of Artificial Sequence: Synthetic coding sequence
atggccctgcagcggacacatagtctactgcttcttctgctcctcaccctgcttggcctggggctggtccagccttcctacggacaagacggcatgtaccagaggtttctgcgccagcatgtacatcccgaagagaccggtgggtcggataggtactgcaatctaatgatgcagcgtagaaagatgactctctatcactgcaagcggttcaatacctttatccacgaagatatctggaatattagatcaatatgttctacaactaatatccaatgcaaaaacggtaagatgaactgtcatgaaggagtggtgaaggtcaccgattgccgagataccggttcatctcgtgctccaaactgccgctaccgggcaatcgcctcgacgagaagggtggtgattgcttgtgagggcaatccacaagtcccagtgcatttcgacgggtag

SEQ ID NO: 238914 - DNA, 444 bp, Artificial Sequence
  Description of Artificial Sequence: Synthetic coding sequence
atggccttgcagaggacccacagcttgttgctattacttctgttgactctactgggtctcgggcttgtgcagccttcatatggccaagacgggatgtaccagaggtttcttcgtcagcacgtgcaccccgaggaaactggaggaagcgacagatactgtaacctgatgatgcagcgtcggaaaatgactctctaccactgtaaaaggtttaacacattcatccacgaggatatttggaatattcggagcatctgtagtacaaccaatattcaatgcaaaaatgggaagatgaactgtcacgagggtgtcgtgaaggtaactgattgtcgtgatacaggatcctcccgtgccccaaattgcaggtacagggccatcgcatctacacggagagtagtcatcgcatgtgaaggtaacccacaggttcccgtccacttcgacggttag

SEQ ID NO: 238915 - DNA, 444 bp, Artificial Sequence
  Description of Artificial Sequence: Synthetic coding sequence
atggctctacaaaggactcatagtctgttgctccttttgctcctcacattgctgggcctgggactggtgcaaccgtcatacggacaggacggaatgtatcaaagattccttaggcagcacgttcatcccgaggaaacaggcggtagtgaccggtattgtaacctgatgatgcagcgacgtaagatgaccttgtaccactgcaagcggtttaacacttttatccatgaggatatttggaatattcggtccatttgttctactactaatatccagtgcaaaaacgggaaaatgaactgtcacgagggagtcgtgaaggttaccgattgcagggacaccgggtcctcccgcgcaccaaattgccgctaccgagccatcgcctccactaggagggtggtcattgcatgcgaggggaacccacaagtgcctgtgcattttgatggatag

SEQ ID NO: 238916 - DNA, 465 bp, Artificial Sequence
  Description of Artificial Sequence: Synthetic coding sequence
atggctcctgccagagccggttgctgcccgctgttgcttctcctgttgggattgtgggttgcagaggtgctcgttcgcgcaaagccaaaggacatgaccagtagccagtggttcaagacccagcatgttcaacctagccctcaggcctgtaactctgccatgagtatcattaacaagtataccgagagatgtaaggatctgaacacattcctgcatgagcctttttcttcggtggccatcacctgtcagactcccaacatcgcatgtaaaaacagttgcaaaaactgtcatcagagccatggccctatgagcttaactatgggtgaactcacatccgggaaatacccaaactgtaggtacaaggaaaagcacctgaatacaccttacatcgttgcatgtgacccgccacaacagggtgaccctgggtatcctctggtgcctgtacacctggataaggttgtgtag

SEQ ID NO: 238917 - DNA, 453 bp, Artificial Sequence
  Description of Artificial Sequence: Synthetic coding sequence
atggttctctgcttccccctcctgttgcttctgctcgtgctctggggaccagtgtgtcctctgcacgcctggcctaaacgcctaacaaaggcccattggtttgaaattcagcacatccagccttcccccctccaatgtaaccgcgcaatgtccggaatcaataactatacccagcactgcaagcaccagaataccttcctccacgacagtttccagaacgttgccgcagtatgcgacctcctctctatcgtgtgtaagaatcggcgacacaattgtcaccaaagttccaaacctgtaaatatgactgactgtagattaacaagtggtaaataccctcagtgtcggtattccgccgcagctcagtacaagtttttcattgttgcttgcgatccgccacagaaaagtgaccccccatataagctggttccagtacacctagactctattctatag

SEQ ID NO: 238918 - DNA, 2271 bp, Artificial Sequence
  Description of Artificial Sequence: Synthetic coding sequence
atgcctttgcgacccggaagcttggtaccagagggggcaggatttcctaaaatggccgcagacgtgagcgtcacacacaggcccccattgtcaccaaagagtggggcagaagtggaggcaggcgatgccgctgagagacgggctcccgaggaggagctgcctcccttggaccctgaagagatccgtaagaggctcgagcacaccgagagacagttccggaacaggcgcaaaattctaatccggggtctacccggagatgttaccaatcaggaagtgcacgatctgctgtcggattacgagcttaaatattgtttcgtggacaagtataagggaactgcgttcgtgactttgttgaacggagagcaggccgaagcagcaatcaatgccttccatcagtcacgccttagagagcgcgagctgtctgtgcagctgcagccaactgacgctctgctgtgcgtagccaatctccccccaagcctgacacagcagcagtttgaggaattagtgcgaccctttggctcgctcgaaaggtgctttctggtttattcagaaaggaccggtcagagtaagggctacggattcgcagagtatatgaaaaaagattctgcggctagagccaagtctgatctgctggggaagcctctcggcccacgcactctgtacgtgcactggactgatgctggccagcttacacctgctctcctgcactctcggtgtctttgcgtggatcgactgccgccagggtttaacgacgtggacgccttgtgccgggctcttagcgctgtgcattcgcctacgttttgccagctggcttgcggacaggacggacagctgaaagggtttgcagtgctagaatatgaaacggcagagatggccgaagaagctcagcagcaagctgatggcctgtctctcggtgggtctcatctccgggtatctttttgcgctcctggcccaccgggacgtagtatgctagcggcactcatcgcagctcaggcaacggctctgaatagaggtaaaggattgctgcctgaacccaacatcctgcaattgctcaataacctgggaccttctgcctcactccagctgttgctgaaccctctcttgcacggctccgccggtggcaagcaagggctgctgggcgctcctccggctatgcctttgctgaatggcccagcactctctactgctttattgcagctcgccctgcaaacccaaggccagaaaaaaccgggaatcttgggcgatagcccacttggtgctctccaaccaggagctcaacctgccaaccctttacttggggagctacccgcaggcggagggctacccccagaattgcctcccaggcgaggtaagccccctcctctattgcccagcgtcctcgggcctgcagggggagatcgagaagccttaggccttggacctcccgcagctcagttaacgccacctccagcccctgtggggttgagagggtccgggcttagaggcctgcagaaggatagcggaccgctgcccaccccgcctggggtttcactgctgggcgagcccccaaaagattatagaattcccctgaatccctacctgaatcttcacagcctgttgccagcttccaatttggcagggaaggaggcccgtggatggggcggagcaggtagatcccgaagacccgctgaaggtcctccgaccaatccaccggcacctggcggtggtagttcatcctcaaaggcctttcagctgaagtctaggctgctaagtcccctgtcttcagcaagactgccaccggagcccggactctcggacagttactcgttcgactatcccagtgacatgggcccacgcaggcttttctcccaccccagggaacctgctctcggaccacacggtccctctcggcataagatgtcaccacctccctcaggctttggagagagatccagtgggggatctggaggcggtcccctcagtcacttttatagtggatctcctacatcttactttactagtggtctgcaagcagggctcaaacagtcgcacctgtccaaagcgatagggtcctccccactgggaagcggcgagggtttgctcggcctgagtcctggacctaatggccatagccatttgctgaaaacacccttgggaggccagaaaaggtcatttgctcacctgctgccttctccagagccttctccagagggcagttatgtagggcagcacagccagggtctgggaggacattatgctgacagctatctgaaacgaaagcggatattttag

SEQ ID NO: 238919 - DNA, 1821 bp, Artificial Sequence
  Description of Artificial Sequence: Synthetic coding sequence
atggcagccgacgtgtctgtgacgcataggccccctttgtccccaaagagcggggcagaagtagaggcaggagacgctgccgagcgacgagcccctgaggaggaattgccaccactcgaccccgaagaaatacggaagcgactggagcatacagaacgccagttccgcaaccggaggaagatacttattcgtggactgcccggtgacgtgacaaatcaagaggtccatgacttgttgtcagattacgaactgaaatactgcttcgtggacaagtataagggcacagctttcgtgaccttgctgaatggcgagcaggcggaggcagccataaatgcattccaccagagcagactgcgcgaaagagagctcagcgttcagctgcagccaaccgacgcattgctatgtgtggccaacctgccaccatcactgacccagcagcaatttgaggagctcgtccggccattcgggtcccttgagaggtgttttctggtgtatagcgagagaaccgggcagagcaaaggatacgggttcgctgagtatatgaagaaagactctgccgcacgcgcaaaatctgacctgctaggcaagcctttgggaccacggaccctatacgttcattggaccgacgctgggcagttgactcccgcactgctccattctcgctgcctgtgcgtagaccgcctgcccccaggctttaatgacgtcgatgcactctgcagagccctgtccgccgtgcactcacccacattctgccaactcgcttgtgggcaagatggccagcttaagggttttgccgtgctagagtacgaaactgctgaaatggctgaagaggcccagcagcaagccgacgggctgtcacttggcggaagccatctgcgcgtcagcttttgtgctcccggtccgcctggcaggtctatgctggccgcactaatagcggctcaagcaaccgccctgaacagaggtaagggtctcctaccggaaccgaatatcctgcaactgctgaataatctgggaccttcggcgagtctacaactgttgctgaaccccctgctccatggcagcgcgggtgggaaacagggcctcctcggggcacctcctgccatgccattactgaatggccctgccctttcaaccgctctgctgcagctcgcattacagactcaaggccaaaaaaagccagggattctcggagattccccacttggggctctccagccaggagcccaaccagcaaatccactccttggagaacttcctgccggagggggactgcctccagagctgccccctcgtcgagggaagccacctcccctcttacccagtgtgctcggccctgctgggggagatcgcgaagctctcggcctggggcctccggctgcccaattgacacccccacccgctccagtaggcttacgcggtagcggtctgcgaggtcccctcagccatttttattccggttctccaacctcatactttacctccgggctgcaggccggactgaaacaaagccatctctccaaggcgatcgggtcttcgccactgggatccggggagggactactaggactctccccaggccctaatgggcatagccacctgttgaaggttagggccggaggcggagatatgcagggctgggaggctcctgccccacagcggcctctgacaagacccgcactcccatcagtgagcaggcctcactgggcggcacgcaatgccgctttgcccacttgctgccccaggccaagccccgcacagaaagccgctatgtgggcatcaacaccgagggcttcagctgccaccactcggactcctacctag

SEQ ID NO: 238920 - DNA, 2076 bp, Artificial Sequence
  Description of Artificial Sequence: Synthetic coding sequence
atggccgctgctgctggcgatggtgggggagagggtggtgctgggttgggcagtgccgctggcctgggccctgggccagggcttagaggtcaaggccctagcgctgaggcccatgagggagctccagatcccatgcctgcagcccttcacccagaggaagtggccgcacgcctgcaacggatgcagagggagctgagtaataggcgtaagatccttgttaaaaacctcccacaggacagcaattgtcaggaagtgcatgatctgctcaaagattatgaccttaaatactgctatgtcgacaggaacaaaaggaccgcttttgtgacactccttaacggcgagcaggcccagaacgctattcaaatgttccaccagtatagttttcggggtaaagacctcatcgttcagttgcagcccacggatgctctgttatgtatcactaacgtgcccatttcctttaccagtgaggaattcgaggagctggtgcgggcatacggtaatatcgagcgctgttttttagtgtacagcgaagtcaccggtcacagtaaagggtacgggttcgtggaatatatgaaaaaggatttcgcggcaaaagccaggctagagttactcggacggcagctaggtgcaagcgcattgttcgcacagtggatggacgtaaaccttttggcttctgagctgattcatagcaaatgtctgtgcattgataaactcccaagcgactatcgggacagcgaggagttgctccagatcttcagttctgttcataagccagttttctgtcagctggcacaggacgaaggaagctatgtggggggattcgctgtggtcgagtactcaacggctgagcaagccgaggaggtccagcaggcagccgacggaatgacaattaaaggatccaaggttcaggtgtctttctgcgcgcctggtgcccctggcaggtccacccttgccgcactgatcgccgctcagagggtaatgcactctaatcaaaaagggctcctgccagaacccaatcccgtgcagataatgaagtcattgaataatcctgctatgttgcaggtgctgctgcaaccccagctgtgcggtcgagccgtgaaacccgcagtgctcggcacaccacactccctcccccatctgatgaaccccagcatttcacccgcattcctgcacctaaacaaggcacatcaaagttcagtcatggggaacaccagcaacttgttcctgcaaaacttgagccatattccccttgcacagcaacagttgatgaaattcgagaatatccatacaaacaacaagcctgggttgctgggagaaccgcctgctgtggttctccagacagcgctggggattggctccgtgctgcccctgaagaaggagctcggacaccaccacggcgaggcccacaaaacatcctctttgatacccacgcagactacaatcactgcagggatgggaatgttaccatttttcccaaaccagcacatcgccggtcaggcagggcctggacactccaacacccaggagaaacagccagctaccgtaggcatggccgaaggaaattttagcggaagccagccctatctccagtctttcccaaacctggcagccggaagtctgttggtcggtcaccacaagcagcaacagtcccagcctaaaggtacggaaatttctagtggcgcagcaagtaagaatcagacatctctgctcggtgagcctccaaaggaaatcaggctgagcaagaacccatacctcaacctcgcttccgttctgcccagcgtttgcctctcttctcctgcgtctaaaacaaccctgcacaagaccgggatagcctctagcatcctggatgcgatttctcagggcagtgagagccagcacgctctcgagaaatgcatagcgtacagtccccctttcggggactatgctcaggtgtcctcccttaggaatgaaaagaggggatcgtcatacctgatcagtgcgcctgaggggggaagcgtagaatgtgtcgaccagcacagccagggaacaggagcctactacatggaaacctatctgaagaagaaacgcgtttattag

SEQ ID NO: 238921 - DNA, 2037 bp, Artificial Sequence
  Description of Artificial Sequence: Synthetic coding sequence
atggccgcagcagccggtgatggcggaggagagggcggagccggactgggatcggcagccggactcggcccaggcccaggcctgagggggcagggcccatctgctgaagcccatgaaggagcgccagaccccatgccggcagccctgcacccggaggaagtggctgctaggctccaacgcatgcagagagagctgagcaaccggcgaaagatccttgtcaagaacctgccacaggactccaactgccaggaggttcacgatctacttaaagattatgacttgaaatattgctatgtcgataggaataagcgcaccgcctttgttactctgttaaatggagaacaggcccaaaacgcaatccagatgttccatcagtatagctttcgcggaaaagacctgatcgtgcagcttcagcctactgatgccctcctgtgcattaccaacgttccaattagttttacatctgaggaatttgaggagctcgttcgggcatatggaaacatcgagaggtgcttcctggtgtattccgaggtaacaggccactccaaaggatatggatttgtcgagtatatgaaaaaggactttgcggcaaaggctcgattggagctgctgggtcgccagcttggggcatctgcgctgttcgcgcagtggatggatgtcaacctgcttgcttctgagctgatccatagcaaatgcctttgcatcgataaattgccatccgattatcgggacagcgaggagctcctccagatcttcagctccgtgcacaagccagtcttttgccagctagcccaggatgaaggatcatacgtgggagggtttgctgtcgtggagtattccaccgcagaacaagctgaggaggttcaacaggcggctgacgggatgactatcaagggctcaaaagtccaggtgtccttctgtgcgccaggcgctcccggaagatctacccttgcagcactgattgcggctcaacgcgtcatgcattcaaaccaaaagggcctcctgcccgagccaaatccagtccaaataatgaaatctctaaacaacccagccatgttgcaggtgctgcttcagccacagctatgtggacgagccgtcaaaccagctgtgctggggaccccccatagccttccacacttgatgaaccccagcatctctccagcttttttacaccttaataaagcgcatcagaatctttctcacatccccctcgcacagcagcagcttatgaaattcgaaaatattcatactaataataagcctggtctgctcggcgagccacctgccgtcgtcttgcagaccgccctggggatcgggtcggtgcttcccctgaagaaagaactgggtcatcaccatggagaggctcataagacatcttctctgattcctactcagaccacaatcaccgctggcatgggcatgctgcctttttttccgaatcagcatattgccggacaggccggaccagggcacagcaacacccaggaaaagcagcccgcaactgtcgggatggctgaaggaaacttcagcgggagtcagccgtatctgcagtctttcccaaatctggctgccggaagtcttctggttggacatcataagcagcagcaaagccagcccaaaggaacagagatttcttctggggctgcctcaaagaaccagaccagcctcctaggcgaaccgccaaaagaaatcagactcagcaagaacccatatctgaatcttgcaagtgtcctgccgagtgtgtgtctgtcctccccagctagtaagactaccctgcacaagactggcatagccagctccatcttggacgccatttcacagggatccgagtcccagcacgcactggagaagtgtatcgcgtactcgcccccatttggcgactacgctcaggtgtcttcccttagaaacgagaaaagaggatcgtcttacctcattagcgcgcctgaggggggaagtgttgagtgtgttgatcagcactcgcagggtacgggggcttattacatggagacatacttgaagaagaaacgggtttattag

SEQ ID NO: 238922 - DNA, 693 bp, Artificial Sequence
  Description of Artificial Sequence: Synthetic coding sequence
atgacaatcaaggggtccaaagttcaggtatccttctgcgctcccggtgcgccaggcagatcaacactcgccgctctgatcgccgcacagagggtgatgcatagcaaccagaaggggctgttacccgagccaaatcccgtgcaaattatgaagagtctcaataatccagccatgttgcaggttctgctgcagcctcaattgtgcggaagagcagtgaagccagccgtcttaggtacaccccactcactgccccatttgatgaatccttccattagcccagcttttttgcatctcaataaggcccaccagaaccagacaagcctcttgggggagcctcctaaagaaatccgcctgagcaagaatccatacttgaatctcgcctctgtcctccctagcgtgtgtttgtctagccccgcttcaaagactaccctgcataaaaccgggattgcatcgagcatacttgacgccatcagccaagggagcgagagccagcatgcccttgagaaatgtattgcgtacagtcctccgttcggggactacgcacaggttagctctctgcgcaatgagaagcgaggcagcagttatctgatcagtgcaccggagggcggaagcgtggaatgcgttgatcagcattcgcagggaacaggcgcatactacatggagacgtacttaaaaaagaagcgggtgtactag

SEQ ID NO: 238923 - DNA, 2379 bp, Artificial Sequence
  Description of Artificial Sequence: Synthetic coding sequence
atgcatgtgattaagagggacggaagacaggagcgagttatgtttgacaaaatcacaagtaggattcaaaagttatgctatggtctcaatatggacttcgtcgacccagcccagatcacaatgaaagtgatccagggcctgtattctggagtgacaacagtggaactggacacactggcagctgaaacagccgcaactcttaccactaagcaccctgactatgccatcctggctgcgagaatcgctgtttccaatttacataaggagaccaaaaaagttttttccgacgtaatggaggatctgtataattacataaacccccacaacggcaaacacagcccgatggtagcaaaaagcaccctcgatatcgtcctcgccaacaaagataggttaaactctgccatcatctacgacagggacttttcctataactattttggatttaagactctcgaaagaagttatctactcaagatcaacgggaaagtcgcggagcgtccgcagcatatgctcatgagggtctccgttggaatccacaaggaagatatcgatgcagcaatcgaaacctacaatcttctctcagaacgatggtttactcacgcttcaccgactttatttaacgctggaaccaatcggccacaactgtcctcttgctttttgctatcaatgaaagatgacagcattgaggggatctatgacactctcaaacagtgcgctctgatctcaaagtccgccggtggaattggcgttgccgtgtcgtgtataagagctactggatcttatattgctggtacaaacggaaactccaacggacttgtccccatgctgagagtgtataataacacagctcgttacgtggaccagggagggaataagcgtcccggtgcatttgccatctatcttgagccttggcacctggatatctttgagttcctcgacctcaagaagaacaccgggaaggaagaacagcgcgcaagagatctgttcttcgctttgtggatccctgaccttttcatgaagcgggtggagacaaaccaggattggtcccttatgtgccccaatgagtgccctgggcttgatgaggtctggggcgaagagttcgaaaaactttacgcgtcctatgaaaaacagggccgagtccggaaggtggtgaaagcgcagcagctgtggtatgccatcatagaatctcagaccgaaacaggaacaccgtacatgctatataaggatagttgcaaccggaagtccaaccagcagaatcttggtaccataaaatgtagcaacttatgtacagagatcgtagagtacacaagtaaggatgaggtcgcggtctgcaatctagcctctctcgcgcttaacatgtacgtaacaagcgagcacacatatgatttcaagaagttagctgaagtgactaaggtagtggttaggaaccttaataagatcatcgatatcaactactatcctgttcccgaggcctgtttgtctaataagcggcatcggccaatcggcatcggcgtgcaggggctggcagacgcttttattctgatgcgctacccttttgagtccgcagaggctcaactccttaataagcaaatcttcgaaaccatatactatggcgcactggaggcatcctgcgacctggctaaggaacaggggccttacgagacatacgaggggtcacccgtatcgaaaggaattctgcagtatgatatgtggaatgtaactcccacagatctctgggattggaaagtgctgaaggaaaaaatcgcgaaatacggtatccgtaactccttgctgattgctccaatgccaacggcatctaccgcccagattctgggcaataacgagtccatcgagccttacacgagtaacatctatacgcgaagggtattgagcggcgagtttcaaatcgttaatccccacctgttgaaagacctgacagaaaggggcctgtggcatgaggaaatgaagaaccagatcatagcttgcaacggatcgattcagagtattcccgagatccctgacgatctaaaacagctatacaagaccgtctgggagatctctcagaaaacggtcctgaagatggcagccgaacgcggagcttttattgaccagtcccagtccctgaacatccacatcgccgagcccaactatgggaaactcacttccatgcacttctatgggtggaagcaaggcctgaagactggaatgtattacctccgaacccgtcccgctgcaaacccaattcagtttactctcaacaaagaaaagctgaaggataaagagaaggtatcaaaagaagaagaggagaaggaaaggaacacagccgcaatggtgtgcagccttgaaaatcgtgacgaatgccttatgtgtgggagttag

SEQ ID NO: 238924 - DNA, 2088 bp, Artificial Sequence
  Description of Artificial Sequence: Synthetic coding sequence
atggaggatctatataactatatcaacccgcacaatggaaaacacagccctatggtcgctaagagtactctcgacattgtgctagcaaacaaggatcgcctgaattccgccattatctacgatcgtgacttctcttacaactactttggtttcaagacacttgaacgctcctacttgctcaagataaacgggaaggtcgccgaacggccacaacatatgctgatgcgtgtgtctgtgggcatccacaaggaggatattgatgccgctatcgagacatataacctgctgtctgaacgatggtttacgcatgcttcgccgacactctttaacgccggaactaaccgcccacagttgagtagctgtttccttctgtctatgaaagacgattcaattgaggggatttacgatacgctgaagcaatgcgccttaatttccaaatccgcaggagggatcggtgtggccgtgtcctgcatccgagccactggatcctacattgcgggaacaaacggcaactccaatgggctggtccctatgctgcgggtgtacaacaacacggcccgatacgtggatcagggcggtaataaacgccctggcgctttcgcaatatacctggaaccttggcatctcgatattttcgaattcctcgatcttaaaaaaaataccggcaaggaagagcagcgggctcgggatctgttctttgccctgtggatccctgacctgttcatgaaaagagtggagactaatcaagattggtcacttatgtgtcctaacgaatgtcccggactggatgaggtctggggggaggagtttgaaaaactctatgcctcctacgagaaacagggtagggttaggaaggtcgtaaaagcccaacagctatggtatgcaataatcgagtctcagacagagacaggcacgccctatatgctatacaaagactcgtgtaaccgtaagtcaaatcagcagaacctgggtaccatcaaatgctctaatctgtgcacggagatcgtcgaatacacatctaaggatgaagttgccgtctgcaacctcgcatcccttgccttaaacatgtacgttacatcggagcacacttacgactttaaaaagcttgctgaggttaccaaagtggttgtcagaaacctaaacaagatcatcgacatcaactattacccagttccagaagcgtgtctcagtaacaagaggcatcggccaatagggatcggcgtccaaggactggctgacgcttttatcctgatgcggtacccattcgagagcgctgaggctcagctgcttaataagcaaattttcgagactatatattacggagctctagaggcatcctgcgatttagccaaagagcaggggccttatgaaacatatgaaggatcacccgtcagcaagggaatcttgcagtacgatatgtggaacgtcacccctacggacctctgggattggaaggttctcaaggaaaagatcgctaaatatgggatccgtaacagcctattaattgccccaatgccaactgcctccactgcgcagattctgggcaacaacgaaagtatcgagccctacaccagcaatatttatacaaggagggtccttagtggggagttccagattgtgaacccccacttgttaaaggacctcacggagagggggctctggcacgaggaaatgaagaatcagataatcgcctgtaacggctccatccaaagcataccggagataccagacgacctgaaacagctgtataagacagtctgggagatctcacagaaaacagtcctcaagatggccgctgaaaggggcgctttcatcgaccaatcccagtctcttaatatccacattgcggaacctaattatggtaagctcacatccatgcacttttacggctggaaacagggcctgaagaccggcatgtactacctgcgcacacggcctgcagctaatcccatccagttcacactgaataaagaaaaactcaaggacaaggaaaaagttagcaaagaagaagaagagaaggaacgaaataccgcagcgatggtttgcagtttggagaaccgggatgagtgtcttatgtgcggctcctag

SEQ ID NO: 238925 - DNA, 2118 bp, Artificial Sequence
  Description of Artificial Sequence: Synthetic coding sequence
gatgggcgacaggagagagtcatgttcgataaaataacaagccgaatccagaagctgtgctacggcctgaatatggatttcgtcgatcccgcacagatcaccatgaaagtgattcagggcttgtattccggagtcaccacagtggaactagataccctggccgcagagacagcagctaccctgaagacgctcgagcgctcatatctgctgaagattaatggaaaggtggccgaaaggcctcaacacatgctgatgagggtcagcgttggaatacacaaagaggacatcgatgccgctattgagacttacaaccttctgtccgaaaggtggttcacccatgctagtcctaccctgttcaacgccggaaccaatcggcctcagctgagtagctgcttcctgctgagtatgaaggacgattccattgaaggcatttatgacaccttaaagcaatgcgcacttattagtaagagcgccggtggcatcggtgtggccgtcagctgcattcgggcaaccggctcatatattgcaggcactaacggaaactccaacgggctggtacccatgctgcgggtgtacaacaacaccgcaaggtacgtcgatcagggaggcaataaacgacccggagcgttcgctatctatctggaaccctggcatttggatatctttgagtttttggacctgaagaagaatactgggaaagaggaacaaagagccagggatctgttttttgcactgtggatccccgacctgtttatgaaaagagtcgaaaccaaccaggactggtccttaatgtgtcccaacgaatgccccggactggacgaggtgtggggtgaggaatttgagaagctgtatgcttcttatgagaagcaggggagagtgcgaaaggtagtgaaagcccagcagctgtggtacgccattattgaatcccagacagagaccggcactccatatatgctgtacaaagattcttgtaatcgcaagtctaaccagcagaacctgggcaccatcaaatgtagtaacctgtgtacggagatcgtggaatatacaagtaaagacgaggtcgcagtttgtaacctggcaagcctcgctcttaatatgtatgtgacctccgaacacacctacgacttcaaaaagctggctgaggtcaccaaggtcgtggtgcgcaatctaaacaaaatcatagacattaactactaccccgttccagaggcctgtctctctaataagcggcaccgtcctatcggtatcggcgtgcagggcctggcagatgcctttatcttgatgaggtaccctttcgagtcagccgaggcacagctcctgaataagcaaattttcgagaccatctattacggcgctctagaggcctcctgcgacctggccaaggagcagggaccttacgaaacttacgaaggctctccagtgtctaagggaatcttgcagtatgatatgtggaacgttacgcccaccgatctttgggattggaaggttttgaaagagaagatcgccaaatatggcattaggaacagcctgctgattgcacccatgcccactgcgagtacagctcaaattcttggcaataacgagtccatcgaaccatatacatctaacatttacacccggagggtcctgagcggggagtttcaaatcgttaacccacatctgctgaaggatctgactgaacggggtctttggcacgaggagatgaagaaccagatcatcgcatgcaacgggtccatccagtcaatcccagaaatccccgacgacttaaagcagctctacaaaacggtctgggaaatctcccagaagaccgtgttgaaaatggcggctgagcgcggagctttcatagaccagagccagtcattgaatatacatattgcagaacctaactacggcaagttgacttcaatgcatttctacgggtggaagcagggccttaaaaccgggatgtattatctgaggacccgacctgctgccaacccaatccagtttacgctcaataaggagaaactgaaggacaaggaaaaggtcagtaaggaggaggaggagaaagagaggaatactgctgctatggtgtgctcgctggagaaccgtgacgagtgcttgatgtgtggcagctag

SEQ ID NO: 238926 - DNA, 1365 bp, Artificial Sequence
  Description of Artificial Sequence: Synthetic coding sequence
atgaagcgtgtcgagaccaaccaggactggtcccttatgtgccccaatgaatgccctggtttggacgaggtctggggagaggagttcgagaaactgtacgcctcttatgaaaaacaggggcgagtccgcaaggtcgtaaaggcacaacagctatggtatgccatcattgagtcacagactgagaccggcacaccgtatatgctatacaaagactcatgtaacagaaaaagcaatcagcagaatctcggaacaatcaaatgcagcaacctgtgcaccgagatcgtggagtataccagtaaagatgaggtggccgtgtgcaacctggcttccttagctctgaacatgtacgtaaccagtgagcatacttatgactttaagaagcttgctgaagtgacaaaggttgtggtcaggaaccttaacaagatcatcgacatcaattactaccccgtcccagaagcgtgtctgtctaataaacggcaccgccctatcggaattggagttcagggccttgcagacgcttttatccttatgcgatacccgtttgagtcagcagaagctcaacttttgaataaacagatctttgaaactatttactatggcgctctggaggcatcttgcgacctggctaaggagcagggaccttacgaaacctatgagggcagccccgtttccaaaggcattctgcagtatgacatgtggaatgtgacacccactgacctctgggactggaaggtgcttaaggagaagatagccaaatacggcatacgaaacagcctgcttatagcgcctatgcctactgcatctactgcacagattctcgggaataacgaaagcattgaaccttacacatccaatatctatactcgcagggtgctgagtggcgagtttcagattgtgaaccctcatctgctgaaagacctgaccgaacggggactgtggcatgaagaaatgaagaaccaaattattgcttgcaatgggagcatccagagcatccccgaaatcccagacgatttaaagcagctttacaagactgtgtgggagatcagtcaaaaaaccgtgctgaagatggccgctgagcggggagcttttatcgatcagtctcagtccttaaatatccacatcgctgaaccaaattatgggaaacttacctccatgcacttttacggttggaagcaagggctgaagacaggaatgtattacctgcggacccgaccagccgcaaacccaatccagttcacactcaacaaggaaaagctgaaagacaaggaaaaggtgtccaaggaggaggaagagaaagagagaaacacggctgccatggtgtgcagcctcgagaatcgcgatgaatgtctgatgtgtggcagctag

SEQ ID NO: 238927 - DNA, 1170 bp, Artificial Sequence
  Description of Artificial Sequence: Synthetic coding sequence
atgttgtcactgagggtccccttggccccaatcaccgatcctcagcagttacaactctccccactgaagggcctgtcactggtggataaagagaacaccccaccagctctgtctggtacacgggtcctcgcctctaaaaccgctcggaggatctttcaagagcctacggagcccaagacgaaagctgccgcacctggggtcgaagacgaaccactgctgcgggagaacccgagacgctttgtcattttcccaatcgaataccacgacatctggcagatgtataagaaggcggaagcatccttctggacagcagaggaagtggacctgtcaaaggacattcagcattgggagagtttgaagcccgaagagagatattttatctcccatgtgttggcatttttcgccgcatcagatggtatcgtgaacgagaaccttgtcgaaagattctctcaggaagtgcaaatcaccgaagctagatgcttttatggattccagatcgcgatggagaatatccattctgagatgtatagcctcctgattgatacctacattaaggatcccaaagaacgagaattcctgttcaatgcgatcgaaactatgccttgtgtcaaaaaaaaggccgattgggccctccggtggattggtgacaaggaggccacatacggtgaaagggtggtggcgttcgccgcagtggaaggaatattttttagcgggagctttgcatccatcttctggttaaaaaaaagaggtttaatgcccggacttactttctccaatgaactcataagtagagatgaaggtctgcattgcgactttgcttgcctgatgtttaagcacctcgtccataagcctagtgaagagcgtgtgagggaaataatcattaatgccgtgcggatcgaacaagaatttctgaccgaggccctccccgtgaagctgattggaatgaactgtacgttaatgaagcaatatattgaatttgtggctgataggctgatgcttgagctgggattttcaaaagtgttccgcgttgaaaacccttttgacttcatggaaaatatctctctggagggaaaaactaacttcttcgaaaaacgggtgggggaatatcaacggatgggagttatgagcagtccgacggagaacagttttacactagacgccgatttttag

SEQ ID NO: 238928 - DNA, 1350 bp, Artificial Sequence
  Description of Artificial Sequence: Synthetic coding sequence
atgggcagagtgggcggtatggcccagcccatgggacgcgctggagcgccaaaaccaatgggtcgcgctgggtcagccagacgtggccgtttcaaaggctgctggtcagagggcagccccgttcaccctgtacccgctgttttgagctggcttctggccctgctacggtgcgccagtaccatgctcagtctgcgggtgcctctggcccctatcaccgacccccaacaactgcaactctcacctctgaagggtctctccctcgttgataaggagaatacaccgcctgccctgagcggaacaagagtgttggcctctaagaccgcccgaaggatctttcaggagccaaccgaacctaagacaaaggccgcagcacccggagttgaagatgaacccctgttgcgcgaaaaccctagacgcttcgttatctttcctatcgagtaccatgatatatggcagatgtataaaaaggctgaagcatcattttggacagcagaagaagtggatctgagcaaagacatccagcattgggaatcactaaaaccagaagagaggtacttcatcagtcacgtactcgcattcttcgccgcttcggacggtattgtgaatgagaatctggttgaacgctttagccaggaggttcaaataactgaagctagatgtttctatggtttccagatcgccatggagaacattcacagcgagatgtatagcctcctcatcgacacttatatcaaggatccaaaggaacgcgagttcctattcaatgcgatagagactatgccttgcgttaaaaaaaaagctgactgggcattgcggtggatcggagataaggaggccacttatggagaaagggtggtcgcattcgcagccgtcgagggcatcttcttctctggcagcttcgccagtatattttggctgaaaaagagaggtctcatgcccggtctgacatttagcaatgaactcattagtagggacgagggattgcactgcgattttgcctgtctgatgtttaagcatctcgttcacaaaccctcagaagagcgggttagagaaatcattatcaatgcagtgagaatagagcaggaattcctcaccgaggccctcccagttaaattgatcggaatgaactgcaccctcatgaagcagtatattgagttcgtggcagaccgcctgatgctggaactaggcttttccaaggtttttcgagtcgagaacccgttcgatttcatggaaaacatcagcctcgagggaaagaccaacttctttgaaaaacgcgtcggggagtatcagcgcatgggagtcatgtctagcccgactgagaactcatttacgctggacgctgacttttag

SEQ ID NO: 238929 - DNA, 1056 bp, Artificial Sequence
  Description of Artificial Sequence: Synthetic coding sequence
atgggtgatcctgagcggccagaggctgccggactggatcaggatgaacggtcatcctccgatactaacgaaagtgaaattaagtcgaacgaggaacctctcttgcgaaaatcctccagaaggtttgtgatcttccccatacaatatcctgatatatggaaaatgtacaaacaagcccaggctagtttctggaccgccgaggaggtggacctgtcgaaagatctcccccactggaataaactaaaagcagatgaaaagtattttatctcccacattctcgccttcttcgctgcatcagacgggatcgtgaatgagaatcttgtcgaacggttctcacaggaggttcaggtccctgaggcacgatgcttttatggtttccagattctgatcgagaacgtgcattctgaaatgtactcattgctaattgatacatacattcgggatccaaagaagcgggaatttctgtttaatgctatagagacaatgccatacgtcaagaagaaagcagactgggcgctgaggtggatagccgacagaaagagcacatttggtgagcgcgttgttgcattcgccgcagtggaaggcgtcttcttctcaggatcttttgccgctatattctggctgaaaaagcgcggactaatgcctggccttacattctccaatgagttaatatctcgggatgaaggactgcattgtgactttgcatgcctgatgtttcagtatcttgttaacaagccttccgaggaacgggtccgcgagattatcgtggacgcagtaaagatcgagcaggagttcctcaccgaggccctgccggtgggactcatcggtatgaattgtatcttaatgaagcagtacatcgaatttgtcgcagaccgacttctcgtagagctgggtttctctaaggtcttccaggcagaaaatcctttcgacttcatggagaatatctcactggagggtaaaacaaacttcttcgagaagcgggtgtctgaataccagaggtttgccgtgatggccgagaccacagacaatgtattcactctcgatgccgacttttag

SEQ ID NO: 238930 - DNA, 900 bp, Artificial Sequence
  Description of Artificial Sequence: Synthetic coding sequence
atgggggatccggaacgcccagaagccgctggactggatcaagacgaggtggatttgtctaaggatctcccccattggaacaaacttaaagcggatgaaaaatatttcatttctcacattctggctttcttcgctgcttctgatggcattgtcaacgagaatttggtggaaagatttagccaggaagtgcaagtccctgaggcccgatgcttctatggcttccagatcctgatcgagaatgttcacagcgagatgtattccttactgatcgacacctacatcagagaccctaaaaagcgggagttcctcttcaacgccatcgagaccatgccatatgttaagaaaaaggccgactgggcactgagatggatcgcggatcgtaaatctaccttcggagaaagagtggtcgcattcgccgctgttgagggagtgtttttcagtggttcattcgctgccattttttggctcaaaaagcggggactcatgccaggactgacatttagcaatgagctgatctcccgggacgaaggattgcattgcgacttcgcttgtttgatgtttcagtatctcgtgaacaaaccttccgaggaaagggtccgggaaattattgtcgacgctgttaaaattgagcaggaattcctgactgaagccctgcccgtgggactgatcggaatgaattgcatcttgatgaaacagtacatcgagtttgttgctgatcggctgctggtggagctcggtttctctaaggtcttccaagctgagaacccgttcgacttcatggaaaatatctcattagagggcaagactaatttcttcgagaagcgagtctccgaataccagagattcgcagtgatggctgagaccaccgataatgtgttcacgctcgatgcagacttctag

SEQ ID NO: 238931 - DNA, 420 bp, Artificial Sequence
  Description of Artificial Sequence: Synthetic coding sequence
atgggtgacccagaacggcctgaggcagctggattggaccaggacgaaggtctgcattgcgatttcgcatgcctgatgttccagtacctcgtcaacaagccatctgaggagcgcgtcagagaaataattgtcgacgctgttaaaatagagcaggaatttcttacagaagcgctgccggtgggtctcatcggcatgaactgtatcctgatgaagcagtatatcgaatttgtcgcggaccggctgttagtggagctgggctttagcaaagtgttccaggccgagaatccgttcgatttcatggaaaacatctctctcgaaggtaaaaccaatttcttcgagaaaagggtatccgagtaccaacggtttgcggtgatggctgaaacaaccgacaatgtctttacccttgatgctgatttctag

SEQ ID NO: 238932 - DNA, 201 bp, Artificial Sequence
  Description of Artificial Sequence: Synthetic coding sequence
atgggagacccagaaagacctgaggcagcagggttggaccaggatgaagtgtttcaggcagagaaccctttcgacttcatggaaaacatctcactcgaaggcaagacgaactttttcgagaagcgtgttagtgagtatcagagattcgcagtgatggctgagaccacagacaatgtgttcacattggacgccgatttctag

SEQ ID NO: 238933 - DNA, 132 bp, Artificial Sequence
  Description of Artificial Sequence: Synthetic coding sequence
atgggcgatccagagcgacctgaagcagcaggactggatcaagatgaacgcagtagcagcgacacaaacgagtccgagatcaagtccaatgaagaaccattgctccggaagagctctcgcagatcattttag

SEQ ID NO: 238934 - DNA, 894 bp, Artificial Sequence
  Description of Artificial Sequence: Synthetic coding sequence
atgtacaagcaggcgcaagccagcttttggacagccgaggaagtggacctgtccaaggatctgcctcattggaacaagttgaaagccgacgaaaaatacttcatcagccacattctcgcgttctttgctgccagtgatggaatcgtgaacgagaatctcgtggagagattttctcaagaggtccaagtgcccgaggcacgttgcttttacggttttcagatccttatcgagaatgtccattcagagatgtacagtttgctcatcgacacgtatattcgtgaccccaagaagagggagtttctgtttaatgctatcgaaactatgccctatgtcaagaagaaagcagactgggcgctcaggtggatcgccgatcgcaagagcacatttggcgaacgagtcgtggcttttgccgctgtggaaggagtgttttttagcggatcctttgccgcaattttttggctcaaaaaaaggggtttgatgcccggtctgaccttcagcaacgaattgatctccagggacgaaggtctccactgtgactttgcttgcttgatgtttcagtacctggtcaataaaccctctgaggagcgtgtcagagagattatagttgatgcagtaaaaatagagcaggaatttctgactgaggctctgcctgttggcctcatcggaatgaactgtattttgatgaagcagtacatcgagttcgtggccgataggctactggttgagctcggtttttctaaagtcttccaggcagaaaatccattcgactttatggaaaatatcagcctggaaggcaagactaacttcttcgaaaaaagggtgagcgagtatcagaggttcgcagtgatggctgagacgacagacaacgtgtttacactggacgccgatttttag

SEQ ID NO: 238935 - DNA, 1824 bp, Artificial Sequence
  Description of Artificial Sequence: Synthetic coding sequence
atggaggcacctgcggcaggactgtttcttttgttactcctgggtacttgggccccagcacctggcagtgccagttctgaggcccctcctctcattaatgaggatgtgaagcgtacagtcgatttatccagccatctcgctaaggtgaccgcggaagtcgtgctggctcacctaggcggaggctctacaagccgtgccacatcttttctcctcgctcttgaacccgagctcgaagcgcgactggctcacctgggcgtgcaagtgaagggtgaagatgaggaagagaataatctggaagtcagggagactaagattaaaggaaaatctggaagattcttcactgttaagctgcctgtcgctttggaccctggcgcaaagatctcggtaattgtcgaaacggtgtatacgcacgtgctccatccttatccgactcagatcacccagagcgaaaagcaattcgtggtgtttgaaggaaaccactatttttattcgccttatcctaccaaaactcagaccatgcgggtcaaactggcttcccggaatgtagagtcatatactaagctcggcaatccaacgcggtccgaagacctcttggactatggtcctttcagggatgtgcccgcttatagccaggacacgttcaaggtccattacgagaacaactcccccttcctcaccatcacaagtatgacaagagtgattgaggtttcccattggggcaatatcgccgtggaggaaaacgtggatttgaaacacaccggggcagtgcttaagggcccatttagtcggtacgactatcagagacaaccagactccgggatctcttccattcgtagcttcaaaacgattttaccggcagctgctcaggacgtatattaccgggacgaaatcgggaatgtgtctacatcacacctcctgattctggacgactctgttgaaatggaaatccgcccacggtttcccttgtttgggggatggaaaacgcactatattgtgggatataacctgccctcctacgaatacctctacaacttaggcgaccagtatgccctcaagatgcgattcgttgaccatgtgttcgatgagcaagtcatagatagtctgaccgtgaaaatcatcctacctgagggagccaaaaacattgaaatcgatagcccctacgagatctcccgggcacccgacgagttgcattacacgtatctggacacattcggtcgcccagtgatcgtcgcttataaaaagaaccttgttgaacagcacattcaggacatagttgtccactacacatttaataaggtcctgatgctgcaggaacccctcctcgtggtagctgccttttacatcctgtttttcacagttatcatttacgtgaggctggatttttctattaccaaggacccggctgcagaagcgaggatgaaagtggcttgtattacggaacaggttttaactcttgtgaacaaaaggattggcctttacagacacttcgacgagaccgtcaataggtacaagcaatctagagatataagcacattgaactccggaaaaaaaagcttggaaacagaacataaagccctgacctcagagattgcactgctccagtctagacttaagacagaaggttccgatctgtgcgacagggtgtcagaaatgcaaaagctggatgctcaggttaaggagctggtgctcaaatccgccgtagaagctgaaagactggtagcaggcaagctcaagaaggacacctatatcgaaaacgaaaagctgatttcaggcaagaggcaggagctggtgaccaagatagaccacatcttggatgccttatag

SEQ ID NO: 238936 - DNA, 1308 bp, Artificial Sequence
  Description of Artificial Sequence: Synthetic coding sequence
atgcgggtcaaacttgctagcagaaacgtggaaagctacacgaagctgggcaaccctacccggagtgaggacctgctggattacggtccgttccgcgatgtgccagcttatagtcaggatacttttaaggtgcactatgagaacaactccccctttttgaccatcaccagtatgactagagtgatcgaagtctctcactggggaaacatcgcagttgaggagaacgtggatcttaagcacacgggcgcagtgctcaaagggccttttagtcgatatgactaccagcgtcagcctgactctgggatctctagtattcggagctttaaaacaatcctgccggcagcagctcaggatgtgtactacagggatgaaataggcaatgtgtccactagtcacctactcatcctggatgacagcgtcgaaatggagattcggccaagatttccactctttggcggttggaaaacccactatattgtagggtacaatctaccctcgtacgaatacctgtataacctgggcgatcagtacgcattgaagatgcgcttcgttgatcatgtttttgatgagcaggtgattgatagtcttacagtcaaaataatattgccagagggagcaaaaaatattgagatagactccccttatgaaatctcccgggcacccgatgaacttcactatacgtacctggatacttttggtcggccagtaatcgtggcctacaagaaaaacttggtagaacagcatatccaggatattgtcgtgcattatacttttaataaggtgttaatgttgcaggaacctttactcgtagtagcagcattctacatcctgttcttcacggtgatcatctatgtgagattggatttttctatcacaaaagatcctgccgctgaagcgagaatgaaagtggcatgcatcacagagcaggtgctgactctggttaacaagcgtatagggctgtatcggcactttgatgaaactgtgaatcgatataaacagtctagagacatctcgactctcaacagtggtaagaaatccctggagactgagcacaaggccctcaccagtgagatcgctctccttcaatctcgcttgaagacagagggtagcgacctgtgcgaccgcgtgagcgaaatgcaaaagctggatgctcaagtaaaggaacttgtattgaagtctgccgtcgaggctgaacgactcgtggcgggaaagttaaagaaggatacatatatcgaaaacgagaagctgatcagcggtaagcggcaggagctggtgactaagattgatcacatcctggacgctctctag

SEQ ID NO: 238937 - DNA, 1137 bp, Artificial Sequence
  Description of Artificial Sequence: Synthetic coding sequence
atgaccagggtgattgaggtttcccattggggaaatattgcagtggaagaaaacgtggatctcaagcatactggcgctgtcttgaaggggccattcagtagatacgactatcagaggcagcctgattctggtatcagtagtatcaggtcatttaaaacaatcctgcccgctgctgcgcaggacgtatactacagggatgagataggtaacgtctccaccagtcatctgctgattcttgacgactctgtagaaatggagatcaggcctcgctttcctcttttcgggggttggaaaacgcactacatcgtggggtacaacttgccgtcttacgaatatctgtataacctcggtgatcagtatgcgctgaagatgcgattcgtcgaccatgtttttgatgaacaggttatagacagcctgactgttaagatcattcttcccgagggtgccaaaaacatagaaatcgattccccatatgaaatttcaagagcccctgacgagctgcactatacgtatttagacactttcgggaggccagtcatcgtggcctacaagaaaaatctcgtcgaacagcacattcaggatatcgtggtccattataccttcaacaaggtgctcatgctgcaggagccattgttggttgttgctgccttctacatcttgttctttacagttatcatttatgttaggttagacttcagcattaccaaggaccccgcagcggaggctcgaatgaaggtggcatgtattacagaacaggtcctgactctggttaacaaacggatcggcctgtatcgacatttcgatgagaccgtgaatcgctacaagcagagcagggacatctcaaccctcaactctggcaaaaagagtctggaaactgaacacaaagccttgacctcagagatcgcactgctgcagagccggctcaagacagagggatccgacctctgcgatagggtgtccgaaatgcagaagctcgatgcccaggtgaaagaactagttctgaaaagcgccgttgaggccgaaagactcgtcgccggaaagcttaaaaaggacacttacatcgaaaatgaaaaactgattagtggaaagcgacaggaactggtcaccaagatcgatcatatactggacgctctctag

SEQ ID NO: 238938 - DNA, 1746 bp, Artificial Sequence
  Description of Artificial Sequence: Synthetic coding sequence
atggaggcccctgctgcaggtctgtttctccttcttctactagggacctgggcccctgcaccgggaagcgcctctagcgaggctcccccacttatcaacgaagacgtaaagcggacagtagacctgtcttcgcatcttgctaaagtcacggccgaggtggtgttagcccacctgggcgtgcaagtgaaaggagaggacgaggaggaaaataatctggaggtgagagaaactaagatcaaaggtaagagtggccgatttttcacagtgaaactcccagtagctcttgaccctggcgctaagatctctgttattgtggaaacggtctacactcacgtcctgcatccataccctacgcaaattacccagagtgagaaacagtttgtggtgtttgaggggaatcactacttctattccccttaccctacaaaaacgcaaactatgcgggtgaaactggccagtcgaaacgtagagtcctataccaaactgggaaatcccacaaggtcagaggaccttctggactatggcccatttcgagacgttcccgcatattctcaggatacgtttaaagtacactatgaaaataacagtcctttcctcacaatcacttcaatgaccagagtaatcgaggtgagccactggggcaacatcgcggtggaggagaacgttgatctaaagcacactggtgcggtgctgaagggtcccttctcccggtatgattatcagcgccagcccgatagcggtatatcatccatcaggtcttttaaaacaatacttccagcggcagctcaggacgtctactaccgtgatgagatcgggaacgtaagtacatcccacttgctgatattagacgacagtgtggagatggagattaggcccaggttcccacttttcggtggctggaagactcattacattgtcggatacaacttacccagctacgagtacctgtataatctgggggatcaatacgctctgaaaatgcggtttgtggatcatgttttcgatgaacaggtcattgactccctgacggtaaaaatcatactgcctgagggggcaaaaaatattgagatcgatagtccctacgagattagtagagcccctgatgagttgcattacacatacctcgatacttttggtcgccctgttatcgttgcctacaagaaaaatctggtggaacagcatatccaggatatcgtcgtgcactatacttttaataaagtgttgatgttgcaagagccgctgctggtcgtcgccgcattctatattttgttctttacagtcattatatacgtaagactggatttctccattacaaaagatccagccgcagaagccaggatgaaggtggcatgtataacagagcaggtgctgacccttgtcaacaaacggattggcctgtatcggcactttgacgagactgttaaccgttacaagcagtctcgggatatctcaacgctcaacagcgggaaaaaaagcctggaaaccgaacataaggctttgaccagtgagatcgcgcttcttcagtctcgattgaagactgaaggatcagatttgtgcgacagggtaagtgagatgcagaagttggacgctcaggtcaaggagctcgtgctgaagtccgctgtggaggcagagaggctagtagcaggcaaattgaagaaggacacgtatatagagaatgaaaagctcatcagcggaaaacgtcaggaacttgtcaccaaaatagatcatatcctggacgcattgtag

SEQ ID NO: 238939 - DNA, 1896 bp, Artificial Sequence
  Description of Artificial Sequence: Synthetic coding sequence
atggcacctccaggctcttctacagtgtttctgcttgctttgactattattgcatccacatgggcgttgacccctacacattatctcactaagcatgacgtggagaggctgaaagcttctctagataggccattcactaacctcgagagtgccttctatagtatagttggcctgtcttctctcggcgctcaggtgccagatgccaagaaggcctgcacgtatatccgttccaacctggacccttcaaacgttgactccttattctacgcagcccaggcttcccaggcgctctccggctgcgaaatcagcatcagcaatgagacgaaagaccttctcctggccgcagtgtccgaggactccagcgtgacgcagatttaccatgcggtggctgccctcagcgggtttggccttccgctcgctagtcaggaggccctgtccgcgttgacagcccgacttagcaaagaggaaacagtgctcgcaacagtgcaggcgctccaaaccgccagtcatctgagccagcaggccgatctgcgctcaatcgtcgaggaaatcgaggacctggtagccaggctcgacgaactggggggtgtttatttgcagtttgaagagggactggaaaccacggccttgttcgtcgccgctacttacaaactcatggatcacgtgggaacagagccaagtattaaagaagatcaagtgatccaactgatgaatgcaatttttagcaagaaaaattttgagtctttgtcagaggcatttagcgtcgcgtctgccgctgctgtactctcccacaataggtatcacgtgcctgtcgtcgtcgtgccagagggatcagcatcagatacccacgaacaagccatactgcgcctgcaggtaacaaatgtgttgtcccagcctctcacacaagcaacagttaagctcgagcacgcaaagagtgttgcttcacgtgccactgtgctgcagaagaccagcttcaccccagtgggggatgtgttcgagctcaatttcatgaatgtgaagttcagtagcgggtattacgactttcttgtggaggtagaaggcgataatagatatatcgccaatacagttgaacttagggtcaagatctctactgaagtgggcatcactaacgtcgacctcagcactgttgataaggatcagtctatcgcccctaaaacgaccagagtcacttaccctgctaaagcaaagggaacatttatcgccgattcccaccaaaatttcgccttgttttttcagctagtggacgttaataccggggctgagctgacaccccatcagacgttcgtaagattgcataatcagaagacggggcaggaagtggtattcgtggctgagcccgataacaagaacgtgtacaagtttgagttggacacgtccgaaagaaaaatcgagttcgactctgcctcgggcacatataccctgtacttaatcataggcgacgccaccttgaaaaaccctatcctgtggaacgttgctgatgttgtcataaagtttcctgaagaggaagctcccagcacggtcttgtcccagaacttatttacacctaagcaggaaattcagcacctattccgcgaacctgaaaaaaggccgccaactgtggtgagcaacacgtttaccgcactcatcttaagtccccttctgttgctctttgctctttggattcgcatcggagctaacgtgtccaatttcactttcgcaccaagtaccatcatcttccatttagggcatgctgcaatgttgggactgatgtatgtgtactggacccagttaaacatgttccaaacactgaagtacctggcgatcctgggctctgtcacttttctagctggcaataggatgctggcccagcaagccgtgaagagaacggcccactag

SEQ ID NO: 238940 - DNA, 1038 bp, Artificial Sequence
  Description of Artificial Sequence: Synthetic coding sequence
gtttccccccagggcagtagtactgtgtttctcctggcgctgaccattatcgcctcgacatgggccttgactcctacccattacctaactaagcatgatgtggagaggctcaaggctagcctagacaggccttttaccaatctcgagagtgccttttattcgattgttggcctgtcctccctgggggctcaggttccagatgcaaagaaggcctgtacgtatatcagaagtaacttagatcccagtaacgtcgacagcctgttttacgccgctcaggcctcgcaggcccttagtggctgcgaaatatcaattagtaacgaaaccaaggacctcctcttagcggctgtatccgaagactcaagcgtaactcagatttaccacgcggtagccgcactctctgggttcgggctgcccttggcctctcaggaagccctctcagccctcacagcccgtctctcaaaggaggaaactgtgctggccagagtttggagtactgttcttgaaagtaggtccttgttttctaaaaggactgtacaagctcttcagaccgcttctcacctgtcccaacaggccgacttacgcagcatcgttgaggagatcgaggacctcgtggcgagactcgatgagctggggggagtctatttgcagtttgaggaaggcctggagaccactgcgttgtttgtggccgcaacgtataagcttatggatcatgtcgggactgagcctagtatcaaggaggatcaggtgatacagctcatgaacgcgatcttctctaaaaaaaacttcgagtcactcagtgaggcgttctcggtggcctctgctgctgccgtgctaagccacaataggtaccacgtgcccgttgttgtggtgccagagggatcggccagcgatacccacgagcaggcgatcctgaggttgcaggtgaccaacgtcttatcacagccgctgacacaggccacggtgaagctggaacatgcaaaaagcgttgcaagcagagctaccgtgcttcaaaagacaagtttcactcctgttgggtag

SEQ ID NO: 238941 - DNA, 1848 bp, Artificial Sequence
  Description of Artificial Sequence: Synthetic coding sequence
atggccccacccggttcctccaccgtttttctcttggcactgaccatcatcgcctctacctgggctctgactccaactcattatctcactaagcatgatgtggagcgcttgaaagcttccctggataggcctttcacaaatctggagtccgccttttactcgattgtgggcctgtcctcccttggcgctcaggtgccagacgcaaaaatctcaataagcaatgaaaccaaggacctcttgctcgctgctgtgtcagaagattcatcggtgactcagatctatcacgccgtggcggcactctcgggattcggattgcccttagcaagccaggaggccctgtccgcccttacagccaggctcagcaaagaagagaccgttctggctacagtgcaggctctccagactgcaagtcacctctcccagcaagctgatttgaggagcatagtggaagagatcgaagaccttgtcgcacgattggatgaacttggcggtgtttacctgcagtttgaggaaggtctcgagactacagctctgttcgtggccgctacctataagctgatggaccatgtgggcacagagccttcaattaaagaggaccaagtcattcagcttatgaacgccattttttcaaagaagaacttcgagtcattatcagaggcctttagcgtggccagcgccgcagctgtgctctcacataaccgctatcatgtacccgtcgtagtcgttccagagggatctgccagcgacacccacgagcaggcaatcttgagactccaggtgacgaatgtcctgtctcaaccattgacacaggcaacggtgaagcttgaacacgcaaaaagtgtagcgtcacgcgctaccgtgctccaaaaaacaagttttacgcccgtgggagacgtgtttgagctcaatttcatgaacgtgaaattttcttctgggtattatgattttttggtggaggtcgaaggtgataatcgatacatagctaataccgtcgaactgcgagtaaaaatctccacggaagtcggcatcaccaatgtggacctctctaccgttgataaagaccagagcattgccccaaagacgacacgagtgacctaccccgcaaaagccaagggcacctttattgcggattctcaccagaactttgcgctcttcttccagctggtggacgttaacaccggcgcagaactgaccccccaccagacattcgtcagactgcacaatcagaaaacgggtcaggaggtggtgttcgtagctgaacctgacaataaaaacgtatataaattcgaattagatacttctgagcgaaaaattgagtttgatagtgcttctggcacgtacacactatatctgatcatcggagatgccaccctgaagaatcccattctttggaatgtcgccgatgttgtgataaagttcccggaagaggaggcccctagcacagttttgtcccagaacctctttactcccaaacaggagattcagcatctgtttagagaacccgagaagcgaccacctaccgtagtgagtaacacatttacagccttgatcttgagtcctttgctactcttatttgcactttggattagaataggcgctaatgtgtccaatttcacattcgccccaagcacaatcatcttccaccttggtcacgcggctatgctagggcttatgtatgtttactggacccagttgaatatgttccagacacttaaatacctcgccatcctgggttcagtgacctttctggccggaaaccgcatgctggctcagcaggcggtaaagcggattgcagccgagcagtcttctaggttggccaagtacaggacactgcggacagcccactag

SEQ ID NO: 238942 - DNA, 441 bp, Artificial Sequence
  Description of Artificial Sequence: Synthetic coding sequence
ggcacttatacactgtatctgattatcggagacgccaccctgaagaacccaatactctggaatgtggcagatgtggtaattaagttcccggaagaggaagccccaagcaccgtactatcacagaacttattcactccaaagcaggagattcagcacctcttcagagaacctgaaaaacgaccgcctactgtcgtgtctaacactttcactgcactaattttgtctcctcttctactcctgttcgcgctgtggataaggatcggcgcaaacgttagcaatttcacctttgcccctagtactattatattccacctggggcatgccgaacaacacatcagcagtcgacgaaagatggagattctcaaaaccgaatgccaggaaaaggaaagccgtacaatccacagcatgagacggaagatggagaaaaagaactttatctag

SEQ ID NO: 238943 - DNA, 1038 bp, Artificial Sequence
  Description of Artificial Sequence: Synthetic coding sequence
atggcaccaccgggtagctcgaccgtgttcctgctggcacttaccattattgcatccacctgggcacttaccccaacccattacctaaccaaacacgacgtagagcgactgaaagcttccctggaccggccattcacgaatcttgagtccgcattctactccatcgtaggactgtcttcactgggtgcgcaggttccagatgcgaaaaaggcatgcacctatattcgaagtaacctggatcctagtaatgtggactcactgttctacgccgctcaagcttcccaggctctctctggatgtgagatatccatcagcaacgaaacaaaggacttgctcctggccgcagtcagcgaggatagcagcgtgacgcagatttaccatgcggtggccgctctgtcaggctttggattgcctctggcaagtcaggaagctttgtccgccctcactgccaggttgagcaaggaggagactgtgctggctcgcgtctggtcaaccgtgttagagagccgatcgttattctctaaacggaccgtccaggccctacaaaccgcgagtcacttgagtcagcaagcagacctgagatcgatcgtcgaggagattgaagatctcgtcgctcgcttggatgaacttggcggtgtctatctgcaatttgaagaaggcctcgaaacgaccgctctatttgtggctgccacatacaaacttatggatcacgtggggaccgagcctagtatcaaggaagaccaggtcatacagctcatgaatgccatttttagcaagaaaaacttcgagagtctatccgaggcttttagtgttgccagtgctgcagccgtcctgtctcataacaggtatcacgttcccgttgtcgttgtccctgaggggagcgcatccgacacccacgagcaggctattttgaggctccaggtgaccaatgtgctttctcagcccttgacgcaagctaccgttaagctggagcacgctaagtcagtcgcaagcagggctactgtcctgcagaaaaccagcttcacccccgttggttag

SEQ ID NO: 238944 - DNA, 417 bp, Artificial Sequence
  Description of Artificial Sequence: Synthetic coding sequence
gagctggatactagcgagcggaagattgagtttgattctgccagcggtacctacactctctacttgatcatcggtgatgccaccctgaagaacccaatcctctggaacgtggccgacgtggtgataaaattcccagaagaagaggctccgagcacagttctcagccaaaatctgttcacaccaaaacaggagatacagtggattaggattggagccaacgtgtctaatttcacttttgccccatccaccatcatcttccatctgggacacgcagcaatgctcggcctgatgtacgtttattggacacagctcaatatgtttcagaccttgaagtacctggcgattctggggtccgtgacatttcttgctggaaatcgaatgttggcccagcaagcggtaaagaggactgctgagtag

SEQ ID NO: 238945 - DNA, 417 bp, Artificial Sequence
  Description of Artificial Sequence: Synthetic coding sequence
gaactagatacttctgaaagaaaaattgaatttgactccgcctcagggacatacaccttgtatctgatcattggcgacgctacgctgaaaaaccccattttgtggaacgtcgccgatgttgtgataaaatttcccgaggaggaggcgccatctacagttctgtcccaaaacctctttacccccaagcaggaaattcagtggattaggatcggtgcgaacgtttccaacttcacattcgcaccttccaccattatattccacctgggacatgctgccatgctggggctgatgtatgtctactggacccagctgaatatgtttcagacactgaagtatctagccatccttgggagcgtgacgttcctcgctggcaacagaatgcttgcgcagcaggccgtaaagcgcaccgctcactag

SEQ ID NO: 238946 - DNA, 504 bp, Artificial Sequence
  Description of Artificial Sequence: Synthetic coding sequence
atgcagcgcaccgtccaggctcttcagacagcttctcatctttcccaacaggccgacctgcgctctatcgtcgaggagattgaagatttggtcgccaggctggacgaattaggaggcgtctacctgcagttcgaagagggactcgaaacaaccgcgttgttcgtcgccgcaacatacaagcttatggaccacgttgggacagaacctagcatcaaggaggatcaggtcatacagttaatgaacgccatattttccaaaaagaactttgagagtttaagtgaggcattctcagtggctagcgcagctgctgtcctgtcgcataacagataccatgtgccagtcgtggttgtgcccgaaggctcagccagtgacacccacgagcaggccattctgcggttgcaggtaacaaatgttctatcccagccactgacccaggccacagtgaaactagaacatgcgaaatcagtggcttctcgcgctacggttttgcagaaaacctcttag

SEQ ID NO: 238947 - DNA, 444 bp, Artificial Sequence
  Description of Artificial Sequence: Synthetic coding sequence
taggggacatacaccttgtatctaattattggggacgcaactcttaaaaaccctatcctgtggaatgttgccgatgtcgtcattaagttcccagaagaagaagccccttctaccgtcctgtcgcagaatctcttcacacctaagcaggaaatacagcatctctttcgagagccggagaaacggcctcccaccgtggtgagtaataccttcaccgcactgatactgtctcctctacttctgttgtttgccctgtggatccggataggagctaacgtgtctaacttcacatttgctccatctacgatcatctttcacctgggtcacgccgagcaacatatttcaagccggcgtaaaatggagatcctcaagacggagtgtcaggaaaaagaatcccgcactatccacagcatgcgcaggaaaatggagaagaaaaattttatttag

SEQ ID NO: 238948 - DNA, 936 bp, Artificial Sequence
  Description of Artificial Sequence: Synthetic coding sequence
atgcaacggccaggtcctttctccactctttacggcagagtcctggctccccttccaggcagagccggtggggcagcttccgggggaggcggtaactcctgggatctgcctggaagccatgtgagactgcccggacgcgctcaaagcgggactagggggggtgctgggaatacaagcacatcatgcggcgacagcaacagcatttgtcccgctcctagcactatgtctaaggcggaagaggcgaagaagctggctggcagggccgcagtagaaaaccatgttcgaaataatcaggtgttgggaattggttctggttcgaccatcgtccacgccgttcagcgaattgccgaaagggtgaagcaggaaaacctgaacctcgtgtgcataccaacatctttccaagccagacaactaatcctacagtacgggcttaccctgtccgatctggataggcatccagagatcgatcttgccatagatggggcagatgaggtcgacgccgatctgaatttgattaagggcggagggggttgcctgacacaggagaagatagtagcaggatacgcgagccgatttattgtaatcgcagattttaggaaagatagtaagaacctcggcgatcagtggcataagggcatcccaatcgaggtcatccccatggcctatgttcccgtctcacgcgctgtaagtcaaaagttcggaggagtggtggagctcagaatggccgtgaacaaggccggacccgtggttacggataatggcaattttatcttagactggaaattcgaccgcgtgcataagtggtccgaggtcaacacggccattaagatgatcccgggagttgtggacaccgggctgttcataaatatggccgagagggtgtattttggcatgcaggacggcagcgtgaacatgcgggaaaagccattctgctag

SEQ ID NO: 238949 - DNA, 534 bp, Artificial Sequence
  Description of Artificial Sequence: Synthetic coding sequence
gcacgacagttgattctccagtacgggctcactctatctgacttggaccggcaccccgaaatcgacctggccattgacggcgcagatgaggtggatgccgatctaaatctgatcaagggcggtggcggatgtcttacacaggagaaaattgtggctggctatgcatcaaggttcattgtcatcgccgacttccgcaaagactcaaaaaatttgggcgatcaatggcataaaggcatacccatcgaggtaatcccaatggcctacgtacctgtgagtcgggcagtttcccaaaaatttggcggagtggtggagctgaggatggcagttaacaaggctggacccgtggtgacagacaatggcaattttattttggattggaagtttgatagggtgcacaaatggagtgaggtcaataccgccatcaaaatgatccctggagtggtagatactggacttttcatcaatatggcggagagggtatatttcgggatgcaggacgggtctgtgaatatgcgggaaaagcccttttgttag

SEQ ID NO: 238950 - DNA, 492 bp, Artificial Sequence
  Description of Artificial Sequence: Synthetic coding sequence
atgcggatcgagaagtgctacttctgtagcggccctatatacccaggacacggtatgatgttcgtaaggaacgattgtaaggtatttcgcttctgcaaaagtaagtgccacaagaacttcaaaaagaaacggaaccctcgaaaagtgcgctggactaaagctttccgcaaagcagccggtaaagagctaacagtagataactcgtttgagtttgaaaagcggagaaacgaaccaatcaagtaccagagagagttgtggaacaagactatcgacgcaatgaagagagtggaagagatcaagcaaaaacgacaagccaaatttatcatgaaccggttgaagaagaataaggagctgcagaaggttcaggatatcaaagaagtgaaacagaacatacacctcattagggctcctctggctggaaaggggaagcagctagaggaaaaaatggtccaacaactgcaggaggacgtggatatggaggacgccccatag

SEQ ID NO: 238951 - DNA, 1161 bp, Artificial Sequence
  Description of Artificial Sequence: Synthetic coding sequence
atgtgtagtagcgtggctgcaaagctgtggtttctcaccgatcgtcggatcagagaggactaccctcaaaaggaaattctgagagctctaaaagctaagtgttgcgaggaggaattagattttcgtgccgttgtgatggacgaagtggttctcaccatcgaacagggtaacttgggcctaaggattaacggggaacttatcactgcataccctcaggtggttgtcgtgcgggtgccaactccgtgggtacagtctgactctgacataactgtcctacgccacctggagaagatgggttgccgcctcatgaatcgaccccaggcaatcctgaattgcgtgaataaattttggacatttcaggagcttgcagggcacggagtacctctgccagatacattttcttacggaggtcatgagaacttcgcaaagatgatcgacgaggcagaggtcctagagttccctatggttgtgaagaacacccggggtcatcggggtaaggccgtgtttcttgcccgagataaacatcacctggcggatctttcccacctaatacggcacgaggccccatacttgtttcagaagtacgttaaagagtcccatgggcgtgatgttagggtgatcgtcgttgggggtcgagtggtcggtacaatgctgagatgttccaccgatggaagaatgcagagcaattgcagcttgggtggcgtcgggatgatgtgttcattatctgagcagggcaagcagctagctattcaggtgtcaaacattttgggcatggacgtctgcggtattgatctgctgatgaaggacgatggatcattttgcgtctgcgaagccaacgcaaatgtcggcttcattgccttcgataaggcttgtaacctggacgttgcgggaatcattgccgactacgcggcttccttactacccagtggacgtctcacacggaggatgagtttgctgtccgtcgtaagcaccgcctcagagaccagcgagcccgagttaggccctcccgcaagcacggctgtggataacatgagtgctagcagctcctcagtcgactcagaccctgaatccaccgaaagggagctcttgactaagctgccgggaggattatttaatatgaaccaactgctggcgaacgaaataaaactgctggtggactag

SEQ ID NO: 238952 - DNA, 1161 bp, Artificial Sequence
  Description of Artificial Sequence: Synthetic coding sequence
atgtgttcatccgtcgctgccaaactgtggttcctgaccgataggagaattcgggaggactatccacagaaggaaatcctcagagccctgaaggccaaatgttgcgaagaagagttagattttcgagccgttgtaatggatgaggtggttctgaccatcgagcaaggaaacttagggctgcgaattaacggcgagctcatcactgcctatccccaggttgtcgtcgtccgagtgccaacaccttgggtgcagtcagattctgatatcacagtcttgcgacatctagagaagatgggatgcaggctgatgaaccgccctcaagcaatactcaactgcgttaataaattctggacctttcaggagcttgccggacatggcgtgccactccccgatacctttagttacgggggacacgaaaacttcgccaagatgattgacgaggctgaggtgctggaattcccaatggtggtgaagaacacacggggacacagaggcaaggccgtgtttctcgccagggataaacatcatcttgccgacttgtcccatttgattcgccatgaggcgccatatctcttccaaaagtatgtgaaagaaagccatggtagggacgtccgagtgatcgtagtggggggtcgggtggtgggcactatgctccggtgttcaaccgatggacggatgcaatctaactgctctctggggggtgtggggatgatgtgctccctttccgaacaggggaagcagttggctatccaggtgagcaatattttagggatggatgtctgcggaattgaccttctgatgaaagacgatggctcgttctgcgtttgtgaagccaatgctaatgtcggcttcattgccttcgataaggcctgtaatttagacgtcgctgggatcatcgcggattatgcagccagtctgttgccctctggtcgactgacacgcagaatgtccttgttatctgtggtgtccaccgcgtccgaaacctcagagcctgagcttggacccccagccagcacagctgtggataacatgtcagcctccagcagctctgtggatagcgaccctgaatcaacagagcgggaattgctcaccaaattgcctggcggactgtttaatatgaaccaattgttggctaatgagatcaaacttctggttgactag

SEQ ID NO: 238953 - DNA, 1161 bp, Artificial Sequence
  Description of Artificial Sequence: Synthetic coding sequence
atgtgcagcagtgtggctgctaagctgtggtttctaaccgatagaaggatcagagaggattatcctcagaaagaaatcctccgggctctgaaggctaaatgttgcgaagaggagctggacttccgcgcagtcgtgatggatgaagtagtgctcacaatcgaacaggggaatctggggctcagaattaacggagagctcatcacagcctatcctcaggtggtggtcgtcagagtcccaacaccctgggttcagtccgactctgatatcaccgttctgagacatctggagaagatgggttgccggctcatgaataggcctcaagccatactgaattgtgtgaataaattttggaccttccaggaattagccggacatggagttccactcccagacaccttcagttacggcggacatgaaaacttcgctaaaatgatcgacgaggctgaggttctcgaatttcctatggttgtgaagaacactcgcggacacaggggaaaagccgtgtttctggccagagacaaacaccacctcgccgatttgagccacttgatccgtcacgaggcaccttacctgttccagaagtatgtcaaagagtcccatggccgagatgtacgcgtgattgtcgtgggcggacgggtggtgggcaccatgctgcggtgtagcaccgacgggcgtatgcagtccaactgtagcctcggtggcgtaggaatgatgtgcagtctgtccgagcaagggaagcagctggcaatccaagtgagcaatatcctcggcatggatgtgtgcggcatagacctgctcatgaaagacgacggctcattctgtgtatgcgaggcgaacgctaatgtagggtttatcgcgttcgataaggcttgtaacctggatgtggccggtattattgccgactatgcagcaagccttctgccctccggacgcttgactcgtagaatgtcactcctgagtgtggtttccacagccagcgaaacatcagagccagagcttggcccacctgcttccacagctgtggacaacatgagcgcgtctagttcttctgtggactcagatcctgagagcactgagcgggaactacttaccaaactgcctgggggactgttcaacatgaatcaactgctcgctaatgagattaaacttctggtcgattag

SEQ ID NO: 238954 - DNA, 288 bp, Artificial Sequence
  Description of Artificial Sequence: Synthetic coding sequence
atgtgtagttctgtggctgccaagctctggtttctcaccgatcggaggattcgtgaggattacccgcagaaggagatcctgcgggctttaaaggctaaatgctgtgaagaggagctggactttcgcgctgtcgtcatggacgaggtggtgctcaccattgagcaaggaaatcttggcctgaggatcaatggggagcttataaccgcctacccacaggttgtcgtagtgagagtgccgactccctgggtgcagtctgattccgacatcacggtccttagacacctgtag

SEQ ID NO: 238955 - DNA, 345 bp, Artificial Sequence
  Description of Artificial Sequence: Synthetic coding sequence
atgtgctcatctgtcgccgctaagctgtggttcctgaccgataggagaataagggaggactatccgcagaaggagatcctgcgggctctgaaggccaagtgttgtgaagaagagctcgactttcgagccgttgtcatggatgaagttgtccttactatcgagcaggggaacctgggcctgagaattaacggtgaactgatcactgcttacccacaagtggtcgtggtccgggttcccactccatgggtgcaatctgattcagacattacagtgcttcgtcatctggaaaaaatggggtgtcgtttaatgaacaggcctcaggctatactgaattgtgtgaactag

SEQ ID NO: 238956 - DNA, 645 bp, Artificial Sequence
  Description of Artificial Sequence: Synthetic coding sequence
atgggcaggcggcctgcacggtgctaccggtattgtaagaataagccttaccccaagtcaagattctgccgcggagtgcccgacgcaaagatacgtatatttgatctgggccgaaagaaagctaaagtcgatgagtttcccctgtgcgggcatatggtcagcgatgagtacgagcagctatcaagcgaggctcttgaagctgcacggatctgtgcaaacaaatatatggtgaagtcatgtgggaaagacggctttcatatacgggtacgcctgcaccccttccacgtgatccggattaacaagatgctatcctgtgccggagctgatcggctgcagactggcatgcgcggtgcctttggtaagcctcagggcaccgttgctagggtgcatatcggacaggtcattatgtcaatccggacaaaactgcagaataaggagcatgtgatcgaggctctgaggcgtgcaaagttcaagtttcctggacgacagaagattcatatctccaagaaatggggtttcaccaagtttaatgccgatgaatttgaggacatggtggctgagaagaggctgattccagacggatgtggtgtgaaatacattcccaaccgaggacctctcgataagtggcgcgctttacactcctag

SEQ ID NO: 238957 - DNA, 645 bp, Artificial Sequence
  Description of Artificial Sequence: Synthetic coding sequence
atggggagaaggcccgctcggtgctaccgttattgcaaaaataagccctaccctaaaagtcgtttctgccggggtgtaccagatgcgaagatccgtatttttgacctggggagaaagaaggccaaggtcgacgagtttccgctctgtggtcacatggtctccgatgaatacgagcagctgagctctgaggctctggaggccgctcgcatctgcgccaataaatacatggttaagtcttgcggcaaagatggcttccacatccgggtgagattacatccctttcacgtcatacgaatcaataagatgctctcttgcgctggcgctgatagattgcagactggtatgcgcggagctttcgggaagccacagggaactgttgccagggtacacattgggcaggtcattatgtccatacggaccaagctccagaataaggaacacgtgatagaggccttgagaagagcaaagttcaagtttccgggtagacaaaagatacacatatcaaagaaatgggggtttacaaaattcaatgccgacgaattcgaagatatggtggctgagaagcggctgatccccgatgggtgtggcgtgaaatacattccaaatcgtggccctttggacaagtggcgtgcgctgcattcatag

SEQ ID NO: 238958 - DNA, 645 bp, Artificial Sequence
  Description of Artificial Sequence: Synthetic coding sequence
atgggacgcagacccgcaagatgctacaggtattgcaagaataaaccctaccctaagagcaggttctgtaggggggtacctgacgctaaaattcggattttcgatctgggtaggaagaaagccaaggtcgacgagtttcctctgtgcggccacatggtctctgacgaatacgagcagcttagttccgaggcgcttgaggctgcacggatttgcgctaataaatatatggtaaagagctgcgggaaagacggatttcatataagagtgcgccttcacccatttcatgtaattcgaatcaataaaatgctcagctgtgcaggggctgaccggctgcaaacgggcatgcggggagccttcggcaagccgcagggtacagtcgccagggtgcacattggccaggttatcatgtctatacggactaagctccagaataaggagcatgtcatcgaggcactaaggcgagcaaaattcaagttcccaggccgtcagaagatccatatcagtaaaaagtgggggttcacgaagttcaatgctgatgaattcgaggacatggtagctgagaaacgcctgattcccgatggatgcggggtaaaatacatccccaacaggggacccttggataagtggcgcgctctacattcttag

SEQ ID NO: 238959 - DNA, 606 bp, Artificial Sequence
  Description of Artificial Sequence: Synthetic coding sequence
atgggacgacggcctgcgcgttgctatcgttactgtaagaataaaccataccctaaatccagattctgcaggggtgttccagatgccaagatccggattttcgatcttggacgaaaaaaagctaaagttgacgagtttcctctgtgcgggcacatggtgtctgacgagtacgaacaattgagctctgaggcgctggaggctgcccgtatttgcgctaacaagtacatggttaagtcctgcggtaaggacggctttcacatcagagtgagattacacccctttcacgtgatccgtatcaataagatgcttagctgcgccggtgccgataggcttcaaacagggatgagaggggctttcggtaagccacaggggacagtcgcacgcgtccacatcggtcaggtaattatgtcaattaggaccaagctgcagaataaggaacacgtgatcgaagctctccggagggctaagtttaagttccccggaagacagaaaattcacatatccaagaagtggggattcactaaatttaacgccgacgaattcgaggacatggtggcggagaagagattaatccccgatgggtgcggtgttaaatacatcccctag

SEQ ID NO: 238960 - DNA, 327 bp, Artificial Sequence
  Description of Artificial Sequence: Synthetic coding sequence
cctaagtctcggttctgcagaggagtccccgatgcaaagatccgaattttcgacttaggacggaagaaagctaaagtggatgaatttccgctgtgtggccacatggtcagcgatgaatatgagcaactgagcagcgaagcccttgaggccgctcgcatttgtgcaaataaatatatggttaaatcgtgcggaaaagatggcttccacatccgagtgaggctgcatccatttcatgtcatccgaataaacaagatgttatcttgcgcaggggcagaccgccctacacttttatgccaatgttgggaaacctccaggaacacttcatag

SEQ ID NO: 238961 - DNA, 546 bp, Artificial Sequence
  Description of Artificial Sequence: Synthetic coding sequence
atgggtcgcaggccagcgcgttgttaccgctactgtaagaacaagccataccctaagagcagattttgtcgtggcgtgcccgacgctaagatcagaattttcgatctgggcaggaaaaaggccaaggtagacgaattccctctgtgtggccatatggtgtctgacgagtatgaacagcttagtagcgaagcgctggaggcagccagaatctgtgctaataagtacatggtgaagtcctgtggaaaggatggctttcacataagagtgcgcctccatccatttcatgtcatcagaattaataagatgctcagctgcgcaggggctgatcggtccacatcgcagaggtcaggcgctagtccatcatcgatgctcatgaatctcaagacctggtggctgaagtccggctcaagccagatggcagtcggctcgagcaccagtcctatcgtggcactatggacgtcgggaggaccatgcacccatgaggggtttcagtgcgccgcaccgctactaattctgacaaacaagttttactttctgagcacatag

SEQ ID NO: 238962 - DNA, 537 bp, Artificial Sequence
  Description of Artificial Sequence: Synthetic coding sequence
atggcacaggatcagggagaaaaggagaacccaatgcgagaactgagaattagaaagctgtgcctgaatatctgcgttggtgagagtggagacaggctcacgagagccgcaaaggtgctcgaacagcttactggacagacccccgtattctccaaagccagatatacggtgaggtcatttggcattcggaggaacgagaaaatagcggttcactgcactgtgcgcggagcaaaagcagaagagattttggagaaggggttgaaagtcagggaatacgaactgcgtaagaataacttctctgataccggaaattttggcttcgggatacaagaacacattgatcttggaataaagtatgaccctagcatcgggatttacgggttagacttctatgttgttctgggccgaccgggatttagtattgctgataaaaaaagacggacaggatgcatcggcgcaaagcataggatttcaaaggaggaggccatgagatggttccagcagaagtacgatgggattatactgcctggtaaatag

SEQ ID NO: 238963 - DNA, 396 bp, Artificial Sequence
  Description of Artificial Sequence: Synthetic coding sequence
caggatcaaggcgaaaaagagaaccccatgcgggaactgaggattcgtaaattgtgcctgaatatctgcgtgggcgaatccggagatcgcttgaccagagccgctaaggtgctggaacaattaacaggtcagacaccagtcttctctaaggccaggtacaccgtgcgcagttttggcatcagaagaaatgagaagatagccgtccattgtacggtgagaggagcgaaggctgaggaaatacttgaaaaaggcctgaaggtcagggaatacgaactgcggaaaaacaatttcagcgacacaggcaactttggcttcgggattcaggagcatattgacttgggaatcaagtatgacccttcaattggcatctatggcttagatttctatgttgtttag

SEQ ID NO: 238964 - DNA, 525 bp, Artificial Sequence
  Description of Artificial Sequence: Synthetic coding sequence
caagatcaaggagagaaggagaatccaatgagagagcttcgcattcgaaagctttgcttgaacatctgcgttggcgaaagtggagaccgactgactcgcgctgcaaaagtgctggaacagttgactggccaaactcctgtctttagcaaagctaggtacacagttagatcctttgggattcgcagaaacgaaaaaattgcggtgcactgcactgtcagaggcgctaaggcggaagaaatcctggaaaaggggctaaaagtcagggaatacgaactgaggaaaaacaattttagtgacaccggtaattttgggttcggcatccaggaacacattgaccttggcattaagtacgacccgtcaatcggcatttatgggctggatttctacgtggtgctgggcagacctggcttttcgattgccgacaagaagcgcaggacggggtgtatcggagccaaacatcggatttccaaggaggaagctatgagatggtttcagcaaaaagtcaagctgatctacctgaaatag

SEQ ID NO: 238965 - DNA, 498 bp, Artificial Sequence
  Description of Artificial Sequence: Synthetic coding sequence
atgccacctaagttcgatcccaatgagattaaggtcgtgtatctgagatgtacggggggagaagttggagccactagtgcattagcgccaaaaattgggccactcgggctgtctcctaaaaaagtgggtgacgatattgctaaagcaactggggactggaaaggactgcgaatcactgtgaaactgactattcagaatcggcaggcccagattgaagtcgtaccatcggcaagtgccttaattatcaaggcactgaaagaaccacccagggataggaaaaagcagaaaaatattaagcacagcggaaatatcaccttcgacgagatcgttaatatagcaagacagatgaggcaccgcagcctggccagggaacttagcggcactataaaagaaattttgggtaccgcacagtccgtggggtgtaacgtggacggtcgacatccccatgacatcatagatgatattaattcaggcgcagtagaatgccccgcaagttag

SEQ ID NO: 238966 - DNA, 399 bp, Artificial Sequence
  Description of Artificial Sequence: Synthetic coding sequence
atgccacctaagttcgaccctaatgaaatcaaagtggtctatttacgctgtaccggaggcgaagtcggggcaaccagcgcactcgctccaaagattggaccactaggcctcatcgaggtcgtgccgtcggcctctgctcttattattaaagcattaaaagagcctcccagagacaggaaaaaacagaaaaatatcaaacactccgggaatattacctttgatgaaatagtgaacatcgctcgtcaaatgcgccaccgaagcctggcgagggaattaagcggcactataaaggagatccttggaacagctcagagtgtaggatgtaacgttgacggcagacacccccacgacattattgatgacattaactccggcgcagtagaatgtccagcaagttag

SEQ ID NO: 238967 - DNA, 636 bp, Artificial Sequence
  Description of Artificial Sequence: Synthetic coding sequence
atggcaccctctcggaacgggatggttctaaaaccccacttccacaaggactggcaacggagagtggccacctggttcaaccagccggctcggaagattagaagaagaaaggcaaggcaggcgaaagccaggagaatcgccccacggccagcatctgggcctataaggccaattgtgcgatgccctaccgtgcgctaccacactaaggtgcgcgctggacggggattttccctggaggagctgagagtggctggtattcacaagaaggttgcacgtaccatagggatctcagtggatccaagaagacgcaacaagagcactgagagcttgcaagccaacgtgcagaggttaaaggagtatagatccaaattaatcttgttcccacgtaaacccagtgccccaaagaagggggacagctcagccgaagaactcaaactggctactcagttaactggtccggttatgcctgtcaggaacgtgtacaagaaggagaaagcacgggtaatcaccgaggaggaaaaaaacttcaaggcctttgcttccctgcgtatggcacgggcaaacgcgcgtctgttcggcatcagggcaaagagggctaaagaagcggctgaacaggatgtggaaaagaaaaaatag

SEQ ID NO: 238968 - DNA, 636 bp, Artificial Sequence
  Description of Artificial Sequence: Synthetic coding sequence
atggccccttctagaaatggtatggtgctgaagcctcatttccataaagactggcagcgcagggtagccacatggttcaatcagcctgcacgtaagataaggagacgtaaagccagacaggcaaaagcacgcaggatagcccctcggcctgccagtggacctatccgaccgattgtgcgctgtccaaccgttaggtaccacactaaggtccgggcaggcagagggttctcgcttgaagagttgcgcgtcgctggtattcacaagaaagtggcacgcacaattggcatctccgtggatccacggagacggaataagtctaccgagtctctacaggccaacgtgcaaaggctaaaagaatacagaagtaagctgatcttgttccctcgcaaaccatcggccccaaagaagggggattccagtgccgaggagctcaaactcgctacccaactgactggacctgtgatgcccgtgcgcaacgtgtataaaaaggagaaagcgagagtaatcaccgaagaagaaaaaaacttcaaagcttttgcctcccttagaatggccagggccaacgcccgtctctttggcataagggcaaagcgcgctaaggaggcagcagagcaggatgtggagaagaaaaaatag

SEQ ID NO: 238969 - DNA, 495 bp, Artificial Sequence
  Description of Artificial Sequence: Synthetic coding sequence
atggccccatctagaaatggcatggtgctgaaaccgcacttccataaagattggcagcgcagggtcgcaacctggttcaatcaacccgctaggaagatccgccgacggaaggctcgacaagcgaaggcccgtagaattgcccctagacctgctagtgggccaatacgccctattgttagatgtcccactgttaggtaccatactaaagtgcgggcaggacggggattctcgctggaagagcttcgtgttgctgggatccacaaaaagggcgattcctctgccgaggaattgaagctggcaacacagctgacggggccagtgatgcccgtacgaaacgtctataagaaagagaaagcccgagtaataaccgaagaagagaagaatttcaaggcttttgcttcactgcggatggcacgggctaatgccaggctttttggcatacgagccaagcgggcaaaggaagccgcagaacaggatgtggaaaagaaaaaatag

SEQ ID NO: 238970 - DNA, 615 bp, Artificial Sequence
  Description of Artificial Sequence: Synthetic coding sequence
atgggtgcctataaatacatacaagaactgtggaggaagaagcagtccgacgttatgaggttcctcctgcgggttagatgctggcagtacagacagctgtcagctctacaccgggctccccgacccactcgccctgataaagccaggcggctcgggtacaaagcaaagcaaggatatgtcatctatcgaatccgagttcgtcgaggtggccgaaagcgtcctgttcccaagggagccacctatgggaaacccgttcaccatggggtaaatcaattaaaattcgcaagatcccttcagagcgtggccgaagagagggcagggaggcattgcggagcacttagagtcctgaacagctactgggtgggagaggattcaacttacaaatttttcgaagttattctgatcgatccattccataaggccattagacgcaatcccgatacacagtggatcaccaaacccgtgcacaaacaccgcgagatgagggggctgacaagtgctgggagaaagagcaggggcctcgggaagggccacaagttccaccatacaattgggggttcgaggagagctgcctggaggaggcggaacaccctccagctccatcggtataggtag

SEQ ID NO: 238971 - DNA, 615 bp, Artificial Sequence
  Description of Artificial Sequence: Synthetic coding sequence
atgggtgcctacaaatacattcaagagctgtggaggaagaaacagtctgacgtgatgaggtttctactcagagtcagatgttggcagtacaggcagctctctgccctgcatcgcgcacctaggcctaccagaccagataaggccagacgattggggtacaaggccaagcaggggtacgtcatttaccgcatcagggtcagaaggggtggtcggaagagaccagtgcctaagggcgctacatacggcaagccagtacatcacggcgtgaatcaactcaagttcgctcggagccttcaatcagtagctgaggagcgtgctggtcggcattgtggcgctctgcgagtgttgaactcatattgggtcggcgaagattcaacttacaaatttttcgaggtgatcctgatcgatccttttcataaggccattcgacgcaacccagacactcaatggatcacgaagcctgttcataaacatagagagatgagaggattgacaagtgccggaagaaagtcacgcggtctgggtaaaggccacaagttccatcatacaattggtgggtctagacgagcagcgtggcgcaggcgcaacacattacaactccaccgataccgatag

SEQ ID NO: 238972 - DNA, 528 bp, Artificial Sequence
  Description of Artificial Sequence: Synthetic coding sequence
atgggtgcatataagtatattcaggagctgtggcggaagaagcagtccgatgtgatgagatttctcctgcgagttagatgttggcagtacagacagctaagtgctctgcatcgggcaccaaggccaactcggcctgataaggcaagaagactgggttataaggccaaacagggatacgtgatctaccgcatcagagttaggaggggcggacggaaacgccctgtacccaagggtgctacatacgggaagcccgtccaccatggcgtgaatcagctgaaattcgcccgttcccttcagagtgtggcagaggtcaatgccggacgccactgcggtgccctacgagttctgaattcttactgggttggtgaagattccacctacaagttcttcgaagtcattctgatcgacccgttccacaaagctatcagacggaatcccgacactcagtggattacaaagcccgtgcacaaacaccgcgagatgcggggtctgacctcagccggacgcaagagccgtggtctcgggtag

SEQ ID NO: 238973 - DNA, 615 bp, Artificial Sequence
  Description of Artificial Sequence: Synthetic coding sequence
atgggggcatataaatatatacaggaactctggaggaagaaacagagcgatgtcatgcggttcttactacgcgttaggtgttggcagtacagacagctgtctgctctgcacagagctcccagacctaccagacccgataaggcccgtagattgggctataaggccaagcaggggtacgtaatctaccgcattagggtgcgcaggggcggacgtaagcgcccagtcccgaagggagcaacttacgggaagcctgtgcatcacggcgtgaatcagctgaagtttgcccgatcactgcagtccgtagcagaagaaagggctggtcggcactgtggagccttgagagttctgaattcctactgggtcggagaggattctacctacaagttttttgaagtgatcctcattgaccccttccacaaagccataagacgcaaccctgatactcagtggatcacaaagcccgtacataagcacagagagatgcgagggttgacttccgccggacgtaagagtagaggcctcgggaagggacacaagttccatcacaccatcggagggagcaggagagcagcctggagacggaggaataccctgcaactgcacagatacaggtag

SEQ ID NO: 238974 - DNA, 615 bp, Artificial Sequence
  Description of Artificial Sequence: Synthetic coding sequence
atgggggcttataagtatatccaggaattgtggagaaagaagcagtccgacgtgatgcgtttcctgcttcgggtacgttgctggcagtatcggcagctgtcagcgctgcacagggcaccgagacccacccggcctgacaaagccagaagactgggatacaaggcaaagcaaggatacgtcatatatcggatcagagtccggagaggaggcaggaagaggcctgtgcctaaaggcgcaacctacggcaagcccgtacaccacggggtgaaccagcttaaattcgctcggagtcttcaatccgtcgccgaagagcgtgccggacgccattgcggcgcactgagggtgctgaacagctactgggtgggcgaagactctacctataagttcttcgaggtcatcctaatcgacccctttcacaaagctatacgccgtaacccggacacacagtggattacaaagcccgtgcacaaacacagagagatgcggggattaacaagcgctggacggaagtcacgtggtctcggtaagggccataaattccaccacacaatcggagggagcagacgcgcagcctggagaaggcggaacactctacagttgcatcgatatagatag

SEQ ID NO: 238975 - DNA, 402 bp, Artificial Sequence
  Description of Artificial Sequence: Synthetic coding sequence
atgggggcttacaaatacatccaagagttatggcgcaaaaaacagtccgatgttatgcgatttttactaagggttcgatgctggcagtatcggcaactgagcgcccttcaccgcgcaccaaggcccacaagacctgataaggcaagaaggttggggtataaagccaagcaaggatatgtgatctatcggatccgcgtccggagaggtgggagaaaacggcctgtccccaaaggggctacatatggaaaacccgtgcatcacggtgtgaatcaacttaagttcgccaggagcctgcagagcgtggccgaggagcgggcaggaagacactgcggggctttgcgtgtgctcaattcctattgggtcggcgaagacagcacatataaattcttcgaggtcatctag

SEQ ID NO: 238976 - DNA, 525 bp, Artificial Sequence
  Description of Artificial Sequence: Synthetic coding sequence
atgggtgcttacaagtatatccaggaactttggagaaaaaaacaaagcgacgtgatgcgatttttgctgagggtgaggtgttggcagtatcggcagctaagtgccttgcaccgggctccgcgtcccactagacccgataaagcccgtcggttagggtacaaggcgaagcagggctatgtaatctatcgcatccgggtgcggaggggcggaaggaagaggcccgtgcccaagggggctacctacggaaaacctgtgcatcacggagttaaccaacttaagttcgcacgttccttacagtcggtcgcagaggaacgagctggaagacattgcggggcactgcgggtgctgaattcttactgggtgggcgaggattccacctataaattcttcgaggtcattctgattgacccatttcataaggccatccggaggaatcctgacacccagtggattaccaaaccagtgcataagcacagagaaatgagaggcctgacatctgccggacgaaagtccagaggattatag

SEQ ID NO: 238977 - DNA, 615 bp, Artificial Sequence
  Description of Artificial Sequence: Synthetic coding sequence
atgggtgcctacaagtacattcaagagctatggcgcaaaaaacagtccgatgtaatgagattcctgctcagggtgcgctgctggcagtatcggcagttgtcggctttgcatagggcacccaggcctacgaggccagacaaggcccgtcgcctgggatacaaggctaagcaggggtatgtgatttatcgcattagggtgagacgcggaggcaggaaacggccagtccccaaaggcgcaacttatgggaagcccgtgcaccatggtgtcaaccaactgaaatttgcccgatctcttcagtcagtcgcagaggaacgcgcagggagacactgtggagcattgcgggtgctaaattcttactgggtgggcgaggatagcacatataagttctttgaagtaatacttatcgatccatttcataaggcaataaggagaaaccccgatactcagtggatcacgaagcccgtgcataagcatcgggagatgcgtggtttgacctctgctggtcggaagtcccggggtttgggaaagggccacaaatttcatcacactatcggaggatcccgtagggccgcatggcggagacggaacacgctccagctgcaccgatacaggtag

SEQ ID NO: 238978 - DNA, 180 bp, Artificial Sequence
  Description of Artificial Sequence: Synthetic coding sequence
atgggcgcatacaagtatattcaggagctgtggcgaaagaagcaaagtgacgtaatgagattcctactgagggtacgatgttggcagtataggcagctgagcgcactccaccgcgctcctagaccaacaagacctgataaagccaggaggcttggatacaaagcaaaacaaggaacctag

SEQ ID NO: 238979 - DNA, 438 bp, Artificial Sequence
  Description of Artificial Sequence: Synthetic coding sequence
atgggcgcttataaatacatccaggagttgtggcgcaagaagcagtccgacgtaatgcgtttcctgctgcgagtccgatgctggcagtatcgccaacttagcgccctccatagggccccaaggccaactcgccctgacaaggcaaggcgtctggggtataaggctaaacaggggtacgtgatttatcgaattcgagttaggcgaggtggcagaaagagacccgtgcccaaaggagccacttatggcaaacctgttcaccacggcgtgaaccaactgaagtttgcgagatcgcttcagtctgtagctgaggagagggccggaaggcattgtggcgctctaagagttctgaactcttactggatggagtcgcattctcactccggaggatccgcagtgggccagtcccgccttacagccacctcagtcagccgggtgtag

SEQ ID NO: 238980 - DNA, 495 bp, Artificial Sequence
  Description of Artificial Sequence: Synthetic coding sequence
atgggcgcttataagtatatccaagaactctggaggaagaagcaaagtgacgtgatgcggtttctgctgcgagttagatgctggcagtaccgtcagctgagtgccctacatcgagcaccaaggcccacaagacccgataaggccaggaggctgggatataaggccaaacagggttacgtgatctacaggatcagagtgaggcgaggtgggagaaaacgcccagtacctaagggcgctacttacggtaaacctgtgcaccacggcgtcaatcagttgaaattcgcaagatccctgcagtccgttgccgaggagcgtgccggaaggcattgtggtgctcttagagtgcacaaacacagggaaatgagggggctcacatcagccggaaggaaatctagaggcttaggaaaaggccacaagttccatcacacaatcgggggttcacggagagctgcgtggcgccgacgtaacactcttcagctgcacaggtaccggtag

SEQ ID NO: 238981 - DNA, 441 bp, Artificial Sequence
  Description of Artificial Sequence: Synthetic coding sequence
atgcacattcgcaaggcaactaagtacctgaaggatgtgacattgcagaaacagtgtgtgccatttcgcaggtacaatgggggtgtgggtcggtgtgcccaggccaagcagtggggatggacacaggggaggtggccgaagaagtccgccgaatttttacttcatatgctcaaaaacgccgaatcaaacgcagaactgaaaggattggacgtggatagtctggttatcgagcacatccaggtcaacaaggcaccgaagatgcgcagacgaacctatcgcgcacatggcagaattaacccctacatgagtagtccttgtcacatcgaaatgattctgactgagaaagagcaaatcgtgcctaaaccagaagaggaagtggcccagaaaaagaaaatttcccaaaaaaaactgaaaaaacaaaagcttatggccagggaatag

SEQ ID NO: 238982 - DNA, 555 bp, Artificial Sequence
  Description of Artificial Sequence: Synthetic coding sequence
atggtccggtatagtctagatcctgaaaaccctaccaagtcatgcaagagtagagggagtaatctgagggtacactttaaaaacacccgtgagaccgcccaggctatcaaggggatgcatataaggaaagccaccaagtatctcaaagacgtgacgttacagaaacagtgcgtaccctttcggcgttataatggcggagtgggcaggtgtgcccaagcaaagcagtggggctggactcaagggaggtggccaaagaagagcgcagaatttttgctccatatgctcaagaatgcggaatcaaatgctgagttgaaaggactcgacgtagactctctggtgatcgagcatatacaggtcaataaagctcccaagatgcgcagacggacgtatcgggctcatggaagaattaacccctacatgtctagcccttgccacatcgaaatgatattgacagaaaaggagcagatagtaccgaaaccagaagaagaagtagctcagaaaaagaaaatttctcagaagaagctgaagaagcaaaagctgatggctagggaatag

SEQ ID NO: 238983 - DNA, 555 bp, Artificial Sequence
  Description of Artificial Sequence: Synthetic coding sequence
atggttagatactctctcgaccctgagaatccaacgaagtcgtgtaaaagccgaggctcaaaccttagagtgcactttaaaaatactagggaaaccgcgcaggccatcaaaggcatgcatatacggaaggcaacaaagtacctcaaagacgtgaccttacagaaacagtgcgtacccttcagaaggtataatggtggtgtcggaagatgtgcccaagctaaacagtggggctggacacagggacgctggccaaagaagtcagccgaattcttgctgcatatgctgaaaaacgccgaatccaatgccgagctgaaaggtctggatgttgactccttagtaatagaacacatacaggtcaacaaagctccaaagatgcggcgacgaacttatagggcccatggcagaatcaacccctacatgtctagtccttgtcacattgaaatgattttgaccgaaaaggagcagatcgttcctaagccggaagaggaggtcgcccaaaagaaaaaaatctctcagaaaaagttgaaaaaacagaagctgatggccagggagtag

SEQ ID NO: 238984 - DNA, 573 bp, Artificial Sequence
  Description of Artificial Sequence: Synthetic coding sequence
tgaccccagggagtcgatattaggcacaataaagatcgcaaagtcagaaggaaggaaccaaaatcccaggatatctacctgcgactactggtgaagctgtaccgcttcttagcacgaagaaccaacagcacctttaaccaggtggtcttgaagcgattgtttatgtctcggaccaaccgtcccccactcagtttgagccgcatgatccgaaaaatgaagctacctgggagggagaacaaaaccgctgtcgtggtgggtactataaccgatgatgttcgagtccaggaggtcccgaaattgaaagtgtgcgctctgcgagtgaccagtcgagctaggtcccggattctccgcgcagggggaaagattcttacctttgaccagctcgctctagactctccaaaaggatgcggaactgtgttactgtcaggaccccgaaagggacgcgaagtttacaggcattttggcaaagcgcctggtaccccgcacagccacacaaaaccttacgtgaggagcaagggcaggaagttcgaaagggctcgcggtcgtcgggcttctaggggatacaagaactag

SEQ ID NO: 238985 - DNA, 408 bp, Artificial Sequence
  Description of Artificial Sequence: Synthetic coding sequence
atgggtgtcgatatcagacacaataaggaccgcaaggtgcgccgaaaggagcctaaatcccaagacatctaccttcgtttactggtgaagctgtatcgctttttagctagacgcacaaattcaacgtttaaccaagttgtgctgaagagactctttatgtctaggactaacaggcccccactgtcactctcaagaatgatacgtaaaatgaaactccctggtcgggagaataagactgccgtggtggtaggcacaattaccgatgacgttagggtgcaagaggtcccgaagttgaaggtgagctggcgaggtcttggcaggcccatcaggcccctcctgtattgtgccgtgctgtgttgtgctgtgttgtgttgtttggtgcacccgcagagttgccataggtggtag

SEQ ID NO: 238986 - DNA, 567 bp, Artificial Sequence
  Description of Artificial Sequence: Synthetic coding sequence
atgggcgtggatataagacacaacaaagaccggaaggtgaggcggaaggagcctaaatcccaggatatctacttgcggttgctggtgaaactctacaggttcttggcaaggagaactaattctactttcaaccaggtggtgctgaaacggttatttatgagcaggaccaacaggcccccactctctttgtccaggatgatcagaaagatgaaactccctgggagagagaacaagacagccgtcgtggttggaactatcactgatgacgtgcgtgtgcaggaggtgcccaaactgaaggtgtgtgcgctgagagttactagtcgcgcacgcagccgcatacttcgcgcaggagggaagatcctcaccttcgatcaactcgcccttgactctccaaagggttgtggaacagtgctgctgtctggccctagaaaaggacgtgaggtgtaccggcactttgggaaagcccctgggacgccccacagtcacacgaaaccctatgtcaggtcaaaaggaaggaagttcgaacgcgcacggggtagaagagcaagccgagggtacaaaaactag

SEQ ID NO: 238987 - DNA, 480 bp, Artificial Sequence
  Description of Artificial Sequence: Synthetic coding sequence
atgctctatagatttctggccaggcgtaccaactccacctttaatcaagtcgtgttgaaacggttatttatgagtagaactaatcgaccacctctgtccctatcacggatgattcgtaaaatgaagctgccgggtagggagaacaagactgcagtggtggtcgggaccatcacggatgacgtcagggtgcaggaggttccgaaactgaaggtgtgtgcgcttagagttaccagccgggcacgttcaagaatcttacgggcagggggaaaaatcctcacattcgatcagctggctttagacagccccaagggatgcgggactgtactcctgtctggccctcgaaaagggagggaggtgtatcggcacttcggcaaggctcctggcaccccacactcccacacgaagccctatgtgcggtctaaggggaggaaatttgagcgagcaagaggtcggagggcgtcacgtggctacaaaaactag

SEQ ID NO: 238988 - DNA, 795 bp, Artificial Sequence
  Description of Artificial Sequence: Synthetic coding sequence
atgaatatcttgccaaagaagtcgtggcacgttaggaacaaggataacgtggctcgcgtgcgacgtgatgaggcccaggcccgtgaagaagaaaaggagagggaaaggcgtgttctgctggcgcagcaggaagccagaactgagtttcttcgaaagaaagccaggcatcagaactctctgcctgagctggaggctgcggaggccggtgccccagggtccggaccggtggatctgttccgggaactgctcgaggaaggcaagggcgttataagggggaataaggagtatgaagaggagaaaagacaagaaaaagagaggcaggaaaaggcccttggaatcctgacctacttgggccagtccgcagcagaagcgcaaactcagcctccctggtaccagcttccccctggtcgcggaggacccccacccggaccagcacccgatgagaagatcaaaagccggcttgaccccctccgagagatgcagaaacacctgggcaaaaaacgccagcacggaggggacgagggatccagatctcggaaggaaaaggaagggagcgaaaagcaaagacccaaggaacctccctccctcgatcaactgcgggcagagagattgagacgggaggccgctgagagatcaagagccgaagcactgctggccagggtccaggggagggccctccaggagggccaacccgaggaggatgagacggacgaccgtaggcgcagatataattctcagttcaatccccagctggctcgcagacctcggcagcaggacccccacctgacccattag

SEQ ID NO: 238989 - DNA, 465 bp, Artificial Sequence
  Description of Artificial Sequence: Synthetic coding sequence
atgaaggcatccgggacacttcgtgaatacaaggtggtcggtcgatgcttgcccacacctaagtgtcacactccaccactttaccgcatgagaatttttgctcctaatcacgtcgtcgcaaagtcaaggttttggtacttcgtgtcccaactcaaaaagatgaaaaagtcttccggagaaattgtctactgcggccaggtcttcgagaaaagtccgctgagggtaaaaaattttggaatatggcttagatatgactccaggtctgggacccacaacatgtatcgggagtaccgcgacctgacaacggcaggggcagtgacacagtgttaccgcgatatgggggctcgccaccgcgctagggcacattctattcagattatgaaagtggaggaaattgccgcttccaagtgtcgacggcagcacaaacccaggttcacaaccaagcggcctaacaccttcttttag

SEQ ID NO: 238990 - DNA, 1278 bp, Artificial Sequence
  Description of Artificial Sequence: Synthetic coding sequence
atgggaggtggggatctcaacctgaagaagtcttggcaccctcagacgctgcgaaatgtggaaaaagtgtggaaagctgaacagaagcacgaggcagaacgaaagaaaattgaggaattacagagagaactaagggaggagcgtgctagagaagagatgcagcgctacgctgaggatgtgggtgctgttaagaagaaggaagagaagctcgactggatgtaccagggccctggcggaatggtaaatagagacgagtatctgctgggcagacctattgacaaatatgtatttgagaagatggaggagaaagaggccggatgcagttctgaaacagggctcttgcctggtagcattttcgcaccctctggggctaacagcctgctcgatatggcctccaaaattcgggaagatcccctgtttatcattcgcaagaaggaagaagaaaagaagagggaggtgctgaacaaccccgtcaagatgaaaaagatcaaagagctgcttcagatgagcctcgagaagaaggaaaagaaaaaaaagaaagagaaaaagaaaaagcacaagaaacacaaacaccggagttcgagctccgatagaagttcctcagaagatgagcactcagctggcagaagccagaaaaagatggccaactcctctcccgtcctgagcaaagtcccgggatacggactccaggtacggaatagtgatagaaatcagggcctgcaggggccactgaccgctgagcagaagcgaggccatggcatgaaaaatcacagtagaagtcgatctagttcccattctcctccacgacacgcaagcaaaaaaagtacccgcgaggccggatcccgcgatcgtcgatctcgctcactcggtcggcgttcaaggtcccccaggccctctaaacttcataattctaaggtgaaccgaagggaaaccggtcaaacgaggagtccgagcccgaagaaagaagtgtatcagcgccgacacgcacctggttacactcgtaagctgtctgcggaggagctggagaggaaaagacaggagatgatggagaacgcaaagtggcgggaggaggaacgtctcaacatccttaagcgacacgccaaggatgaagaacgcgaacagaggctggaaaaacttgattcaagggacggcaagtttattcaccgtatgaaactagaaagcgctagcacaagctctctggaggatagggtgaagagaaacatctactccttacagagaaccagtgtcgctcttgagaaaaactttatgaaaaggtag

SEQ ID NO: 238991 - DNA, 483 bp, Artificial Sequence
  Description of Artificial Sequence: Synthetic coding sequence
atgaccaacacaaagggaaagcgtcgtggcactagatatatgttcagtcgaccattccgcaagcatggcgtagtgcccctcgctacctacatgcggatttataagaaaggggatatcgtggatatcaaaggtatgggcacggttcagaaggggatgccccacaagtgctatcacgggaaaacagggagagtgtacaacgtaactcaacacgcggtcggaattgtggtcaacaagcaggtgaaagggaaaattctcgccaaacgcattaacgtgcggattgaacacatcaagcacagcaagagccgggattcttttctgaagagagtgaaggaaaacgaccaaaaaaagaaagaggccaaggagaagggtacttgggtgcagctcaaacggcaacccgcacctccgagagaggcacattttgtccgcacaaatgggaaggagcccgagctcctggaacctatcccctatgagttcatggcctag

SEQ ID NO: 238992 - DNA, 483 bp, Artificial Sequence
  Description of Artificial Sequence: Synthetic coding sequence
atgacgaataccaagggtaagagacgaggcactcggtacatgttttcaagaccttttcgaaagcacggggtggttccacttgccacatacatgaggatatacaagaagggagatatagtcgatatcaagggaatgggcacagtccaaaaaggcatgccgcacaaatgctaccatggaaagactggaagggtgtataatgtcacgcagcatgccgtcggaatcgtcgtgaataagcaagtcaaaggcaagattctcgctaagcgtatcaatgttagaatcgagcatatcaaacactctaagtcacgggactccttcttaaagagggttaaggaaaatgaccaaaaaaagaaagaggctaaagaaaaaggcacctgggttcaattgaaaaggcagccagcgcctccacgcgaagctcacttcgtgaggacgaacggcaaggagcccgagcttctcgagcctatcccttatgaatttatggcctag

SEQ ID NO: 238993 - DNA, 483 bp, Artificial Sequence
  Description of Artificial Sequence: Synthetic coding sequence
atgactaacaccaaggggaagcgccgagggacacgctacatgttcagccggccatttagaaaacacggggtcgtccccctagctacatacatgaggatctacaaaaagggcgacatagttgacattaaggggatgggcactgttcagaagggcatgccccataagtgttaccatggaaaaactggtcgggtgtacaatgtgactcagcacgccgtcggcattgttgttaataagcaagtgaaaggcaagatcctagccaaaaggattaatgtgcgtatcgagcacattaaacacagcaaatcccgtgactcctttctgaagagggtcaaggaaaatgaccaaaaaaagaaggaggccaaggaaaaggggacttgggtccagttgaagcgtcagcccgcacctcccagagaggctcacttcgtaaggaccaacggtaaagagccagagctgctggaacctattccatatgagtttatggcatag

SEQ ID NO: 238994 - DNA, 483 bp, Artificial Sequence
  Description of Artificial Sequence: Synthetic coding sequence
atgacaaatacgaaaggtaagcggaggggcacgcgttacatgttttcaaggccttttagaaagcacggagtcgtgcccctggccacctacatgagaatctacaaaaagggagacatcgtcgatattaagggcatgggcactgtccagaaaggcatgccgcataagtgctaccacggtaaaactgggcgagtgtacaatgtcactcagcacgccgtaggaatcgttgtcaataaacaagtcaagggaaagatactcgccaaacgtattaacgtgcgcatagagcacattaaacactccaaatcacgtgactccttcctcaaaagagtgaaggagaacgatcagaagaaaaaagaggctaaagaaaagggcacctgggtccagctgaagagacagccagcacctccgcgagaggcccactttgtgagaactaatggcaaggaaccggagcttttggagcctattccttacgaattcatggcctag

SEQ ID NO: 238995 - DNA, 972 bp, Artificial Sequence
  Description of Artificial Sequence: Synthetic coding sequence
atggctgcgcctaaaggatcgctatgggtccgcacccagttagggctgcctcccctactcctgctgaccatggccctagccggtggatcaggaacagctagcgccgaggcctttgacagcgtactgggcgacactgccagctgtcaccgagcttgccagctcacataccctctgcacacttatccaaaggaggaagagctctatgcctgtcaacggggatgtcggctcttcagcatttgtcagtttgtcgatgatggaattgatctgaatcgaacaaaactagaatgcgagtccgcgtgcacagaggcatactcccaatccgatgagcagtatgcctgccacttgggttgtcagaaccagttgccctttgcagagctcaggcaagagcagctgatgtccctcatgcctaagatgcacctgctatttcccttaacactagtccgaagcttctggtcggatatgatggactcagctcagtcctttattacatcctcatggaccttttatctgcaggctgacgatggtaaaatcgtgatctttcagagtaagccagaaatacaatatgccccacatctggagcaggagcctacaaatttacgcgaatcgagtctgagtaaaatgtcctacctacagatgagaaatagccaggcacaccgaaatttcctagaggacggggagtctgacggattcctcaggtgtttaagcttgaattcaggatggattctaaccaccacactggtcctgagcgttatggtcttgttgtggatttgttgcgctacagtagccacagctgtggaacagtacgtgccatcagagaaattgtccatctacggcgaccttgagttcatgaatgaacagaagctgaaccgatacccggcatcttcgttagtggtggtgaggtctaaaactgaagaccatgaagaagcaggccctttgccaactaaagttaatttggcccacagcgaaatctag

SEQ ID NO: 238996 - DNA, 276 bp, Artificial Sequence
  Description of Artificial Sequence: Synthetic coding sequence
atggccggttctaggcgcgaatgccgaaggggcggaagctccggtgccaaatttagaatttcactggggttgccggtcggcgcagtgatcaactgtgccgacaatactggggcaaaaaatctgtatatcatatcagtgaagggtatcaagggtagactgaatcggctcccagccgcaggtgttggcgatatggtaatggccaccgtaaaaaagggaaaacccgaattacgtaagaaggtgcaccccgctgtcgtcattcgtcagcgaaaaagttag

SEQ ID NO: 238997 - DNA, 423 bp, Artificial Sequence
  Description of Artificial Sequence: Synthetic coding sequence
atgtctaaaagggggaggggcggatcctccggagctaagtttcgcatatctctaggccttcctgtgggagccgtgattaattgtgctgacaacacgggagccaaaaatttgtacatcataagtgtgaaggggataaagggtagactcaaccgcctacctgccgctggagtgggtgacatggtgatggccacagtgaaaaaaggcaagccagagctcaggaagaaggtccacccagccgttgtgatccggcagcggaagtcctatcggcgtaaggatggcgtcttcttatactttgaggataatgcgggagtaattgtcaataacaagggagaaatgaagggaagcgctatcacaggcccagtagcaaaggagtgtgccgacctctggccccgtattgccagtaacgcagggtccattgcctag

SEQ ID NO: 238998 - DNA, 345 bp, Artificial Sequence
  Description of Artificial Sequence: Synthetic coding sequence
atgtccaagcgcggacgtggtggaagttccggagccaaattccggattagcctggggttacccgtgggtgcagtcataaactgtgctgacaacaccggagctaaaaacctctacattatctcagtgaagggtattaaagggagactcaatagactgcccgctgcgggagtcggggacatggttatggccacagtcaaaaaagggaagccagaactgcgaaaaaaagtgctactctgccacactggctggtcagctgttacccccctgaaacttactgtcaccctcaactgctggacctggaacccaccagccgtcgcctttaaaggcctccagctgcaggtgtag

SEQ ID NO: 238999 - DNA, 423 bp, Artificial Sequence
  Description of Artificial Sequence: Synthetic coding sequence
atgtcaaagcggggtcgagggggatcttcaggggctaagttcaggatctcacttggattaccagtgggtgcagtgatcaactgtgcggacaacacaggtgcaaagaacctgtacatcatctccgtgaagggcatcaaaggtaggctcaatcgtctccctgccgcaggagttggtgacatggttatggccacggtgaagaaaggtaagccggagttgaggaagaaggtccaccccgcagtggtcattcgacagaggaaatcgtaccgccgaaaggacggggtgttcttgtacttcgaggataatgccggtgtaattgtcaacaacaagggagagatgaaaggcagcgccatcacgggcccagttgctaaagagtgtgccgacctgtggcctaggatcgcatcaaatgcaggttcgatcgcctag

SEQ ID NO: 239000 - DNA, 477 bp, Artificial Sequence
  Description of Artificial Sequence: Synthetic coding sequence
tagctagtcggagctccttgtcctagagcatctcctgccccacccaaggcggaagctaaggctaaggccctgaaggctaagaaggctgtgcttaagggggtgcacagccataagaagaagaagataaggacctcaccaactttcagacggccaaagactctgagattacgaagacagcccaaatatcccaggaagagcgcacctcgacgtaacaagctcgatcactatgccatcatcaaatttccgctgaccaccgagagcgctatgaaaaagatcgaggacaacaatacattggtgttcatcgtcgacgtgaaggcgaacaaacaccagatcaagcaagcggtgaagaagctgtatgatattgatgtggccaaggtgaatacccttatcaggcctgatggggaaaaaaaggcttatgtgcgccttgcaccagactatgacgctttagacgtagcaaataagatcgggatcatctag

SEQ ID NO: 239001 - DNA, 477 bp, Artificial Sequence
  Description of Artificial Sequence: Synthetic coding sequence
atgagccctgggttggtggtgcttagatgggcgccagccccaccgaaggccgaggccaaagcaaaagcgcttaaggcaaagaaggccgtattgaagggggtccatagccataagaagaaaaagatacgtactagtccaacattcaggcgccctaagacattacggctgcgcaggcagcccaagtaccctcggaaaagcgcccctcgcagaaacaaactcgaccactacgcaatcatcaagttcccgctgaccactgaaagcgcaatgaagaaaattgaggacaacaataccttggtcttcatcgtggatgtgaaggccaacaaacaccaaatcaagcaggccgtaaagaagttgtatgacatcgacgttgctaaggtgaacacactgattcgaccagacggggaaaaaaaggcctacgtgcggcttgcgcctgactacgacgctctggacgtggcgaataagatcggcatcatttag

SEQ ID NO: 239002 - DNA, 585 bp, Artificial Sequence
  Description of Artificial Sequence: Synthetic coding sequence
atgcaccccctggttggcgctccatgtccacgcgcatgcaaagaattagtgccgagtgccctgacaatctttctactcgtgcatgtgcagcccggatatataactcgaccttcccttagaagtgtggtgctaagatgggctccagcacctcccaaggcagaggcaaaggccaaggccctgaaagcaaagaaggccgttctcaagggtgtccacagtcacaagaaaaaaaaaattagaacaagtcctacctttagaaggcccaaaaccttaaggctcagacgtcagccaaagtatccgagaaagagcgcgccacgcagaaataagctggaccattatgccatcattaagttccctctgactaccgagagcgctatgaagaagattgaggataataatacattagtcttcatcgtggatgtgaaggctaataagcaccagattaaacaggccgttaaaaaattgtatgacattgatgtcgcaaaggtaaatactttaattcgacccgatggagagaaaaaagcttatgtgcgcctggcccctgactatgacgccctcgatgtagccaacaagatcgggatcatatag

SEQ ID NO: 239003 - DNA, 471 bp, Artificial Sequence
  Description of Artificial Sequence: Synthetic coding sequence
atggcaccaaaagccaagaaggaggccccagctcctccaaaggccgaggcaaaagccaaggccctgaaagctaaaaaagctgttctgaagggcgtgcacagccacaagaagaagaaaatccgtacctccccaacattccggaggcccaaaactttacgcttacgacgccagcccaagtacccaagaaagagtgccccaagacggaataaattggatcactacgccataatcaagtttccccttaccacggaatcagccatgaagaaaatcgaggataataatacactagtctttatcgtggacgtgaaggcaaacaagcatcagatcaagcaggctgtcaaaaaattgtatgacatcgatgtcgccaaagtcaatactctgattcggccagatggagaaaagaaagcttacgttcgtctggctcccgactacgatgctttagacgtggctaacaaaattggcatcatttag

SEQ ID NO: 239004 - DNA, 474 bp, Artificial Sequence
  Description of Artificial Sequence: Synthetic coding sequence
atgaaggtcgaactatgctcattttctggctacaaaatttaccccggacatgggagacgatatgctagaaccgatggcaaagtgtttcaatttcttaatgctaaatgtgagtccgcattcttgtccaagagaaatcccagacaaatcaactggacggtactctatcggcgtaagcacaagaaaggacagtctgaagagattcagaagaagcggacgagaagagccgttaagttccagcgtgctattacaggagcgagcctagcggatataatggccaagcggaaccagaaacccgaggtgcggaaggcacagagagagcaagcaatcagggccgctaaggaagccaagaaggccaaacaagccagcaagaagacggctatggcggctgccaaagctccaaccaaagcagcgccaaagcagaagatcgtcaaacccgtgaaggtaagtgcccctcgagttggaggcaagcggtag

SEQ ID NO: 239005 - DNA, 453 bp, Artificial Sequence
  Description of Artificial Sequence: Synthetic coding sequence
atgaaggtggaactgtgttcgttttccggatataagatttatcccggacatgggagacgctatgcccgaaccgacgggaaagtgtttcagttcttgaacgctaagtgcgagtccgcattcctaagtaaacggaacccaagacaaattaattggaccgtactgtacaggaggaagcacaaaaagggccaatcagaggaaatacagaaaaaacgtaccaggcgggcagtgaaatttcagagagccatcaccggggctagcctcgcggacattatggctaaacgcaaccaaaaacccgaggtgagaaaagcccagcgcgaacaagccatcagagctgcaaaggaggcaaaaaaagcaaaacaggcttcaaaaaagactgcaatggctgcggctaaagtaatcatgggctttctgtatttcctggaacagtacaacaggaaaatctttttcttctag

SEQ ID NO: 239006 - DNA, 438 bp, Artificial Sequence
  Description of Artificial Sequence: Synthetic coding sequence
atgaagttcaaccccttcgtaaccagtgatcgctcaaaaaatcgaaaaagacattttaatgcaccctctcatattaggcggaagattatgagcagccccttatccaaggaattgcgacagaagtataacgtgaggtcaatgccgatcaggaaggacgatgaagtgcaggtagtccggggtcattataagggtcagcagatcggcaaggtggtccaggtctaccgcaagaaatatgtaatttacatcgagcgcgtgcagagggagaaggcaaacggcaccacagttcacgtcggaattcaccctagtaaggttgtgatcacaagacttaaactggataaagaccgaaaaaagatcttggaaagaaaagcgaaatcccgccaggtcggaaaggaaaagggcaaatataaggaagaaactatcgaaaaaatgcaggagtag

SEQ ID NO: 239007 - DNA, 411 bp, Artificial Sequence
  Description of Artificial Sequence: Synthetic coding sequence
atggggaagtttatgaagcccggaaaagtagtgcttgtgcttgcagggaggtattcgggcagaaaggccgtgatcgttaaaaatatcgacgatgggacctcagacagaccatattcccatgctctggtggctggaatcgatagataccctcggaaggtcacagcggcaatgggaaaaaagaagatcgctaaacgctcgaaaatcaagagttttgtgaaagtgtataactataaccacctgatgcccacccgatactcggtggacattcctctggacaagacagtggttaacaaagatgtgtttcgagaccctgctcttaagaggaaggcacgacgagaagccaaggtaaagttcgaggagcgctataagacaggtaagaataaatggttcttccagaaactgcgcttttag

SEQ ID NO: 239008 - DNA, 447 bp, Artificial Sequence
  Description of Artificial Sequence: Synthetic coding sequence
atgcctagccggctcaggaagacacggaagctgagagggcacgtatctcacggccacggcaggattgggaaacaccgaaagcacccaggcggtcggggaaacgctggaggtcttcaccatcatagaatcaattttgacaagtatcaccctggttacttcggaaaggtgggcatgaagcattatcacctcaagcgtaaccagtccttctgccccactgtgaacctcgacaagctgtggacattagtgtcagaacagactagagtcaatgctgctaaaaataaaaccggcgctgctcccatcatagatgtcgtgaggtctggctactacaaggtactgggcaaagggaaactacctaagcagcccgttattgtgaaggccaagttctttagccggcgagcggaagagaaaattaagtccgtgggcggagcatgtgtcctcgtggcctag

SEQ ID NO: 239009 - DNA, 327 bp, Artificial Sequence
  Description of Artificial Sequence: Synthetic coding sequence
atgccttctagactgaggaagacccgaaagctacgaggtcacgtgtcgcacggccatgggcgaatcggaaagcatcgcaagcaccctggtggcagaggcaacgctggcggtcttcatcaccatcgcattaactttgataagtaccaccctggctatttcggaaaggtggggatgaaacattaccacttaaaacgtaaccagtcattttgtccgaccgtaaacctggataaactatggacactggtttcagagcagacccgcgtaaacgcagcaaagaacaagaccggcgctgcccctatcattgacgtcgtgagatccgttagctag

SEQ ID NO: 239010 - DNA, 414 bp, Artificial Sequence
  Description of Artificial Sequence: Synthetic coding sequence
atgagcgcccatctccaatggatggtggtacgaaactgttcctcattcttgataaaaaggaacaagcagacgtactcgaccgagcccaacaatctgaaggccagaaatagttttagatacaacgggctgattcaccgaaagacagtaggggttgagcccgctgctgatggaaagggcgtagtggtggtgatcaagagaaggagcggtcaacgcaagcctgctaccagttacgttagaacaaccattaacaagaacgctcgcgcaaccctgtcctccattcgacacatgataaggaagaacaagtatcgacctgacctgcgaatggcagctattcgtagagcaagtgccattctaaggtcccagaaacccgttatggtgaagcgtaagcggacccggcctaccaagtcctcttag

SEQ ID NO: 239011 - DNA, 210 bp, Artificial Sequence
  Description of Artificial Sequence: Synthetic coding sequence
atgagcgcccatttgcagtggatggtggtacgcaactgttcgagcttcctgatcaaacggaacaagcagacttattctaccgagcccaataacctaaaggctaggaacagttttcgttacaatggcttgatccatcgcaagaccgtgggggtagaaccggctgctgatgggaaaggggttgtcgtcgtgattaaacgtagatcggagtag

SEQ ID NO: 239012 - DNA, 264 bp, Artificial Sequence
  Description of Artificial Sequence: Synthetic coding sequence
atgagcgcacatctacagtggatggtggtgcggaattgttcttcattcctgataaagagaaacaaacaaacctattccacagagcccaacaatctcaaagcgaggaactcttttcgctacaatggcctgatccatcgtaaaaccgtaggcgtggagcctgccgctgatgggaaaggtgtcgtggtcgtgatcaaaagacgttctggagagttttgtctcgtgtgggcccgtgaacgcccactgtcccgggtgtgggagctgtag

SEQ ID NO: 239013 - DNA, 510 bp, Artificial Sequence
  Description of Artificial Sequence: Synthetic coding sequence
atgtctgcacatcttcagtggatggtggtgcgaaattgctcttcttttctcattaaaaggaacaagcagacctatagcacagaacctaataatcttaaagcaaggaactcttttagatacaatggtctgatacaccggaagactgtcggcgtggagcctgccgctgacggcaagggcgtcgtcgtcgtgatcaaaaggcggtccgggcaaagaaagccggcaacctcctacgtccggaccactatcaataagaatgctagggctactttaagtagcatacgccatatgattcgtaagaacaaatataggcctgatctccggatggacatgttggccagcacaggtagcggtttgtgctgcagtgtggccgttcagccttgggctagttccagtacctcactctgcctacgcactctgatctgtaatatgagagtggatcgtccttattactctgggttgatgagaagactgaatgtccagaaccttctggattgcgcccacaaaagttag

SEQ ID NO: 239014 - DNA, 510 bp, Artificial Sequence
  Description of Artificial Sequence: Synthetic coding sequence
atgtccgcacatctgcaatggatggtggttcgaaattgctcatcctttcttatcaagagaaacaagcagacctatagtaccgagcctaataacctgaaggctagaaatagcttccggtacaacggcctgatccaccggaagacagtaggggtagagccagccgctgacggcaagggagtcgtcgtagttatcaaacgcagatcaggccaacggaagcccgcaaccagctatgtccgaacaacaattaacaagaatgcaagggccacgttatcatctatcaggcacatgatcagaaagaacaaatataggcccgatctgagaatggatatgctggctagtacaggctccggcctgtgctgctcagtggccgtgcagccgtgggcctccagcagcacttcattgtgcttgcgcacactcatctgcaacatgcgggtggatcgcccatactactcaggtctgatgcgccgtctcaacgtccaaaatctgctagactgcgctcacaagagctag

SEQ ID NO: 239015 - DNA, 414 bp, Artificial Sequence
  Description of Artificial Sequence: Synthetic coding sequence
atgagtgctcatctgcagtggatggtggtgagaaactgtagctcttttcttataaagagaaataagcaaacttacagcacggaacctaacaacttaaaagcacggaattcctttcgatacaacggccttattcacaggaagacagtgggcgtggagcctgccgcagatggaaagggtgtcgtcgttgtgattaagcgaagatctggccagagaaagccggcaacttcctatgtgagaaccacaattaataagaatgccagggccactctctcttccattagacacatgatcagaaagaacaaatatcgcccagatctgcggatggctgccattcggcgagcttccgccattttacgatcacaaaagccagtgatggttaaacgtaagcggaccagaccaactaagtcttcttag

SEQ ID NO: 239016 - DNA, 492 bp, Artificial Sequence
  Description of Artificial Sequence: Synthetic coding sequence
atgtcagcacacttacaatggatggtggtacggaactgttcctcttttttgattaagcgcaataagcagacttatagcaccgaacctaataatcttaaggccaggaattccttccgctacaacggcctcattcatcgcaagacagtgggagtggagcctgcagcagacggaaagggagtcgtagtggtgatcaaacgcaggtcagggcagcgcaaacctgcaaccagttacgtccggacaaccataaataagaatgcccgagccaccctaagcagtatcagacacatgataagaaagaataagtacagacccgacctgcgcatggtgagttggggattgggtattagattgggcgaaaccggccaatgctgcggagaaggaccccctactacgggatgcaatatggggtggcgtggcatggactcctgttttcaaccaactccccacacccaacattggcctcgagggagacttgtggagtgtatgggctag

SEQ ID NO: 239017 - DNA, 480 bp, Artificial Sequence
  Description of Artificial Sequence: Synthetic coding sequence
atggcaaagtccaaaaaccatacaacacataatcagagccggaagtggcacagaaatggaattaaaaagccccgttcccagcgctatgagtccctcaagggagtggatccaaagttcctgcgcaacatgcgctttgcaaaaaaacacaacaagaaaggcttaaagaaaatgcaggcgaacaatgcaaaagctatgtccgccagagcggaagccatcaaagcactcgttaaacccaaagaagtcaagcctaaaatccctaaaggggtttctcgaaagctagaccgcctggcatatatagctcacccaaagctgggcaagagagctcgcgctcggattgcaaaggggctgaggttgtgcagaccgaaggcaaaggccaaggccaaggctaaggatcagacaaaggcacaagccgctgctccggcttctgtgccagcacaggcccctaagcgtacccaggccccaactaaagcatccgagtag

SEQ ID NO: 239018 - DNA, 480 bp, Artificial Sequence
  Description of Artificial Sequence: Synthetic coding sequence
atggctaaatctaagaatcataccactcacaatcagtctcgtaagtggcatcgaaatggcatcaaaaagcctagatctcagcgatatgagtctttgaaaggagtggaccccaagttcctcaggaatatgaggttcgccaaaaaacacaacaagaaaggcctgaagaaaatgcaggccaataatgcaaaggcgatgtctgccagggcggaggctatcaaggcgctggtgaagcctaaagaagtaaagcctaaaatccctaagggagtctctcgaaagctggacagactggcctacatagcccacccaaagctgggcaaacgagccagggccagaatcgcaaaggggctgcgtctgtgcagacctaaggccaaggcgaaggcaaaggctaaggaccagacaaaggcccaggcagcagcacctgccagtgtccctgctcaggccccaaagaggacccaggccccaacaaaggcttctgagtag

SEQ ID NO: 239019 - DNA, 480 bp, Artificial Sequence
  Description of Artificial Sequence: Synthetic coding sequence
atggctaagtcgaaaaatcatactacccacaaccagtcccgcaagtggcacaggaacggtatcaagaaacccagatcccaacggtacgagtctctcaaaggcgtagatcccaaatttcttcgtaatatgagatttgctaaaaagcataacaagaagggcttgaaaaagatgcaggctaataatgccaaagctatgtccgctagggcagaggccatcaaggctctggtgaaaccaaaggaggtgaagcccaagatccctaaaggggtttcccggaagctggatcgcttagcttatattgctcacccaaagctggggaagagggcgagagcccgaatcgccaaagggctgagactctgtagaccaaaggccaaggctaaggctaaagcaaaggaccagacaaaagcccaggctgctgcaccagcgtccgtgcctgcccaggctcccaagcggacccaggcacctaccaaagcctcggaatag

SEQ ID NO: 239020 - DNA, 480 bp, Artificial Sequence
  Description of Artificial Sequence: Synthetic coding sequence
atggctaaatccaagaaccacaccacgcacaaccaaagtaggaaatggcaccgcaatggtataaagaagccaagatcccagcgatatgaatctctgaaaggtgtggacccgaaatttttacgaaacatgcgtttcgctaaaaaacacaacaaaaaagggctgaagaaaatgcaagcaaacaacgcgaaagcaatgtcggcaagggccgaagccattaaggccctggtcaagcctaaagaggtaaaaccgaagataccgaagggggtctccagaaaacttgataggttggcttacatcgcacatcctaaactgggcaaaagagctcgtgctcgaattgcaaaggggctgcgcctttgtcgccctaaggctaaggccaaagccaaggccaaagatcagaccaaagctcaggcagcggctccagccagcgttccagcccaggctccaaagaggacacaggctccgaccaaggctagcgagtag

SEQ ID NO: 239021 - DNA, 480 bp, Artificial Sequence
  Description of Artificial Sequence: Synthetic coding sequence
atggccaaaagcaagaaccatacgacccacaaccagagtcggaagtggcataggaatggtataaagaaacccaggagccaacggtatgagtcactgaagggcgtcgacccaaaatttctgagaaacatgaggtttgccaagaaacataataaaaaggggctgaaaaagatgcaagcaaataatgctaaggctatgagtgccagggccgaagcaatcaaagccttggttaagcccaaggaagtgaagcctaagatcccaaaaggggtgtctaggaaactggacaggctggcctacatagctcaccctaagctgggcaaacgcgcacgcgctcgcatcgcaaaaggccttaggttgtgccgacccaaagccaaagctaaagctaaagccaaagaccagaccaaggcgcaggcagccgcaccagcctctgtacctgcccaggcaccgaagcgcacacaggcacccacgaaggcgtccgaatag

SEQ ID NO: 239022 - DNA, 480 bp, Artificial Sequence
  Description of Artificial Sequence: Synthetic coding sequence
atggctaagagcaagaatcacacaacacacaatcaatcacgtaagtggcacagaaatggcattaaaaagcctcgaagccagcggtacgagtcacttaagggggttgatccgaaatttctgcgaaacatgcgtttcgctaagaaacacaataagaaggggctcaagaagatgcaagcgaacaacgccaaggcaatgtcagccagggctgaggccataaaagcactcgttaagcctaaggaggtgaagcccaagattcccaaaggggtgtcaagaaagctcgataggctggcatacatcgctcaccccaagctaggtaaacgggcaagagcacgcattgcaaaagggctgcgactgtgtagaccgaaagctaaagcaaaggcaaaagccaaagaccagaccaaagcccaggccgcagccccagctagcgtccccgcacaagctcccaaacggacccaggctcccactaaagcctctgaatag

SEQ ID NO: 239023 - DNA, 648 bp, Artificial Sequence
  Description of Artificial Sequence: Synthetic coding sequence
atgcccttccaccccgttacagccgcactcatgtacaggggaatctatacagttcctaatctcctgagtgaacagagaccggtggatataccagaggatgaattggaagagataagggaagctttcaaggttttcgacagggacggcaatggattcatatcaaaacaggagcttggcacggctatgaggtccctgggctacatgcctaatgaagtcgaactggaagttataatacagcgcttggatatggatggggatggacaggttgattttgaggagttcgtgactctgctcggccctaaactgtcaacatcaggcattcccgagaaattccatggtactgatttcgatacagttttttggaagtgtgacatgcagaagctgaccgttgatgaactgaagcgccttttgtacgacaccttttgtgagcacctcagtatgaaggatattgagaacatcataatgactgaggaggagagccatctcggcacagctgaggaatgccccgttgacgtcgagacctgttccaaccagcagatcaggcagacatgtgtcagaaaaagcctcatttgcgcgttcgccattgcatttattattagtgtgatgctgattgcagcaaatcaggtcctgagatcagggatgaagtag

SEQ ID NO: 239024 - DNA, 1056 bp, Artificial Sequence
  Description of Artificial Sequence: Synthetic coding sequence
atgacccacatagttcgcgaggtagatagaccaggaagcaaggtcaacaaaaaggaggtggtggaggcagtaacaatcgtggaaaccccgcctatggtggtagtcggaattgtaggttacgtggagacaccgcgaggcttgagaactttcaaaacggtgttcgcagagcatatcagtgacgagtgtaagaggcgcttttacaaaaactggcacaagagcaaaaaaaaagcatttacaaaatattgtaagaaatggcaagatgaagatggcaagaagcaactcgagaaagacttcagctctatgaaaaaatattgccaggtcattcgcgttatcgctcacacacagatgcggctcttacccctccggcagaagaaagcccacctaatggagatccaggtgaatgggggaacagtggccgagaagctggattgggccagagaaagactggaacaacaggtgcccgtgaaccaggtgtttggacaagatgaaatgattgatgttatcggggtaaccaaaggaaagggctacaagggggtgacttcccgctggcacactaagaagctgccccgaaaaacacaccggggtttgaggaaagtcgcctgcataggcgcatggcaccccgctcgcgtggcttttagtgtcgccagggccggtcaaaagggctatcatcatagaactgagattaacaagaagatttacaagattggacagggatatctgattaaggatggcaagctgataaagaataatgcctccacggactatgatctgagcgacaagagtatcaaccctttaggtgggtttgtgcattacggagaggtgactaacgacttcgtaatgctcaaagggtgcgtggtgggaactaagaagcgtgtgctgaccctgagaaaaagtttgctggtacagaccaaaaggcgggctctcgaaaaaattgatttaaagtttattgacacaacctcgaaattcgggcatggacggtttcagactatggaggaaaagaaggcttttatgggtccgcttaagaaagatcggatcgccaaggaggagggagcctag

SEQ ID NO: 239025 - DNA, 348 bp, Artificial Sequence
  Description of Artificial Sequence: Synthetic coding sequence
atggtcgccgcaaagaagacaaagaagtccctcgagagcatcaatagtagactacaactggtcatgaaatccggcaaatacgtgctggggtacaagcagacgctcaagatgattcggcagggcaaagccaaacttgtcatacttgccaacaactgtccagcccttaggaaatctgagatcgagtactacgctatgctcgcgaagacaggcgtgcatcactactccggcaacaatatagaactgggcacggcttgcggcaaatactatcgtgtttgtacactggcaataattgacccaggcgactcagatattatcaggtcaatgcccgaacaaaccggcgagaagtag

SEQ ID NO: 239026 - DNA, 348 bp, Artificial Sequence
  Description of Artificial Sequence: Synthetic coding sequence
atggtcgcggctaaaaaaactaaaaaatccttagagtccattaacagccggctgcagttggttatgaaaagtggaaagtacgtcctcggttataagcagacgcttaagatgattaggcagggcaaagcgaagctcgtgatactggcgaataattgccctgcactacgcaagtcagaaatcgagtattatgctatgctggccaaaacgggggttcaccactactctgggaacaacatcgagttgggaactgcttgcggcaagtactacagagtatgcacattggctatcattgatccaggagactcggacattataagaagtatgccggagcaaacgggtgagaagtag

SEQ ID NO: 239027 - DNA, 345 bp, Artificial Sequence
  Description of Artificial Sequence: Synthetic coding sequence
atggtggccgctaagaaaacaaaaaagagtctcgaatccattaactcccgactccagctggtgatgaagagtgggaaatacgtgctggggtataaacagactctaaaaatgatacgccaggggaaggctaagcttgtcatactcgctaacaactgtccagccctcaggaaaagtgaaattgaatactacgcaatgcttgcgaagaccggagtacatcattattccgggaataacatcgaactggggaccgcttgcggcaaatattaccgagtatgtaccttggccatcattgacccaggagactctgacattattcgtagcatgccggagcagaccggcgagtag

SEQ ID NO: 239028 - DNA, 285 bp, Artificial Sequence
  Description of Artificial Sequence: Synthetic coding sequence
atgtccgggaggttgtggtccaaggccatttttgctggctataagcgcggactccggaaccagcgtgaacacacggcccttctgaagatcgagggtgtgtacgcgagagacgagactgagttttatctaggaaagcgctgtgcttacgtgtacaaggccaaaaataatacggttactcccggaggcaagcccaacaagacaagagtgatttggggtaaagtgacccgcgctcatggaaatagcggcatggttcgggctaagttccggtctaacctccctgcttag

SEQ ID NO: 239029 - DNA, 333 bp, Artificial Sequence
  Description of Artificial Sequence: Synthetic coding sequence
atgtctggacggctgtggtcaaaagcgatctttgccggatacaagagagggctgcggaatcagagagagcacacagccctgttaaaaatcgagggcgtgtacgccagagacgaaactgaattttacttgggaaagcgttgtgcctatgtgtacaaggcaaaaaataataccgtgacaccaggcggaaaaccaaataaaactcgggtcatctggggtaaggtcaccagagcccatggcaattcaggtatggtgcgcgctaagttccgctccaacctgcccgcaaaagccataggacaccggattcgggtgatgctgtatccttcccgcatctag

SEQ ID NO: 239030 - DNA, 333 bp, Artificial Sequence
  Description of Artificial Sequence: Synthetic coding sequence
atgtccggcagactgtggtctaaagcaattttcgccggatacaagcggggtttacgcaatcaaagggagcataccgctctcctaaagatcgaaggtgtttacgccagggatgagactgaattttacctgggcaaacggtgcgcatatgtctataaggccaagaataatacagttacacccggaggaaagcctaataagactagagtgatttggggcaaggtaactcgcgcacacggcaactctggaatggtgagagctaagttcaggtctaatctgccagccaaagccataggccaccggatccgagtgatgctctacccttctcgaatctag

SEQ ID NO: 239031 - DNA, 396 bp, Artificial Sequence
  Description of Artificial Sequence: Synthetic coding sequence
tgactgccttttgcatcaagatttctctctttcagagcagactcagcacacgcttccatggtgaatgtgcctaagactagaaggaccttctgcaaaaagtgcggcaagcaccaaccacataaagtgacccagtacaaaaaaggtaaagactcgttatacgcacaaggtaagaggagatacgaccgcaagcaaagtggctacggcggtcaaactaaacccatctttagaaagaaggccaagaccaccaaaaagatcgtgctgcgactcgagtgtgtagaacctaattgccgctcaaaaaggatgttggccataaagcgttgcaaacacttcgaacttgggggagacaaaaagcggaaagtgtacaattacggatggaaggtgcagagcttctcatag

SEQ ID NO: 239032 - DNA, 429 bp, Artificial Sequence
  Description of Artificial Sequence: Synthetic coding sequence
atgatcgcaccaaccgactcccacgaggaggtcaggagtgggacttcatacatcctcccctttgcaagtagattcctgagctttagagccgactcggcccatgcaagcatggtgaacgttccaaagaccaggcggacattttgtaagaaatgcggtaaacatcaaccgcataaagtgacacagtacaaaaagggaaaggactctctatacgcacaagggaagcgcaggtacgatagaaagcagtccgggtacggagggcaaaccaagcctatatttcgcaaaaaggccaagacaacgaagaagatagtattgcgtctagaatgcgtggaacctaactgccgttcaaagcgtatgctggccattaagaggtgcaaacactttgagctcggcggagacaaaaagcgcaaaggacaagtcatacaattctag

SEQ ID NO: 239033 - DNA, 321 bp, Artificial Sequence
  Description of Artificial Sequence: Synthetic coding sequence
atggtaaacgtgcctaagaccaggcgcacattttgcaagaaatgtggcaaacaccagccacataaagtgactcaatataagaaagggaaagactctctgtatgcccagggcaagcgcaggtacgaccggaagcagagcggctacggcggacaaaccaaacctattttccgcaaaaaggctaagacgactaaaaagattgttcttcgcttagagtgtgtcgaacccaactgtcggtctaagcggatgctggctattaagagatgcaagcactttgagctgggcggagacaagaagaggaaaggccaggtaatccagttttag

SEQ ID NO: 239034 - DNA, 321 bp, Artificial Sequence
  Description of Artificial Sequence: Synthetic coding sequence
atggttaacgtgcccaagacgcgccgtaccttctgcaaaaagtgcggaaagcaccagccccacaaagtgacccagtataaaaaaggaaaagattctctttacgctcaggggagacgcagatatgatcgtaagcagtcgggctacggaggccagaccaagccaattttccggaaaaaagccaaaacgaccaagaagatcgttctgcgtttggagtgcgtcgaacccaattgtagatccaagcgcatgcttgccatcaaaagatgtaagcacttcgaactgggcggagacaagaaaagaaagggacaggtgatccagttctag

SEQ ID NO: 239035 - DNA, 294 bp, Artificial Sequence
  Description of Artificial Sequence: Synthetic coding sequence
atgacgaaagggactagcagtttcggtaagcgcagaaacaagacccatacactgtgcagaaggtgtggcagtaaagcctatcatctccaaaagagcacgtgcgggaagtgtggttatccagccaaaagaaaacgaaagtataattggagcgcaaaagctaagagacggaatacaactgggaccgggcgaatgagacacttgaaaatcgtgtatcggaggttcagacacggctttcgggaagggacaactccgaaacctaaaagagctgctgtcgctgccagttccagcagttag

SEQ ID NO: 239036 - DNA, 207 bp, Artificial Sequence
  Description of Artificial Sequence: Synthetic coding sequence
atggtgaagaagatcgagattagccagcacgccaagtatacatgctccttttgtggtaagacaaagatgaagaggagagctgtgggcatctggcattgcggctcatgtatgaagacggtggcgggtggcgcatggacttataatacaacgagcgcagtcaccgttaaatccgccatccgccgactcaaagagcttaaggatcagtag

SEQ ID NO: 239037 - DNA, 279 bp, Artificial Sequence
  Description of Artificial Sequence: Synthetic coding sequence
atggctaagaggaccaagaaagtgggcatagtgggaaagtacggtacaaggtacggtgcttctctccggaaaatggtgaagaaaatcgaaatcagccagcatgctaagtacacctgcagcttttgtggtaagaccaagatgaagcgtagagcagtcgggatctggcattgtggcagctgcatgaagaccgtggctggtggcgcttggacatacaatacaaccagcgccgtgaccgtgaaaagcgccattcggaggctaaaggagctaaaggatcagtag

SEQ ID NO: 239038 - DNA, 213 bp, Artificial Sequence
  Description of Artificial Sequence: Synthetic coding sequence
atgcccaggaagatagaagaaattaaggatttcctgctcaccgcccgacgaaaggacgcaaagagtgtaaagataaagaaaaataaggataatgtgaagttcaaagttcgctgtagccgctatctgtatacactggttatcaccgataaagaaaaagccgagaagttgaagcagagcctcccacctggtttggcggttaaggaactaaagtag

SEQ ID NO: 239039 - DNA, 213 bp, Artificial Sequence
  Description of Artificial Sequence: Synthetic coding sequence
atgcctagaaagattgaagaaattaaggacttcttgctcaccgccaggcgaaaggatgccaaaagtgtgaagattaaaaaaaacaaggacaatgtgaagtttaaggttcgatgttcccgttacttgtatacactcgtcatcacggataaggagaaggctgaaaagcttaagcagtcgctgccccctggcttggccgtgaaggagcttaaatag

SEQ ID NO: 239040 - DNA, 213 bp, Artificial Sequence
  Description of Artificial Sequence: Synthetic coding sequence
atgccccgaaaaatcgaagaaatcaaagatttcctgctaaccgccagacggaaagacgccaagtctgtgaagatcaagaagaacaaggacaatgttaagtttaaagtgagatgtagccgctacctatatacactggtcatcacagacaaggaaaaggccgaaaagctgaagcaatctttgccccctggcttagctgtgaaggaactcaaatag

SEQ ID NO: 239041 - DNA, 156 bp, Artificial Sequence
  Description of Artificial Sequence: Synthetic coding sequence
atgtcctcccacaagacattcacaatcaaacgctttctcgccaagaagcagaaacagaatcggccaattccacagtggatccaaatgaagcccggatctaaaattagatataatagcaaacggcgtcactggaggcgtaccaaattgggcctttag

SEQ ID NO: 239042 - DNA, 156 bp, Artificial Sequence
  Description of Artificial Sequence: Synthetic coding sequence
atgagttctcataagacgttcaccattaaaaggttcttggccaagaagcaaaaacaaaacaggccaatcccccaatggatccagatgaaaccaggcagcaaaatccgctataactccaagagaagacattggcgcaggacaaagctgggcctgtag

SEQ ID NO: 239043 - DNA, 156 bp, Artificial Sequence
  Description of Artificial Sequence: Synthetic coding sequence
atgagcagccacaaaacttttactatcaagaggttcttagccaagaagcagaaacaaaacagacctatccctcagtggattcagatgaaacccggatctaaaattcgttacaacagcaagcgacggcactggaggaggacgaagctgggcttgtag

SEQ ID NO: 239044 - DNA, 1284 bp, Artificial Sequence
  Description of Artificial Sequence: Synthetic coding sequence
atggcttgtgcacgccctcttatttccgtctacagtgaaaagggagagagtagcggtaagaacgtcacactgcccgctgtcttcaaggcccctattaggcccgatatcgttaacttcgtacacactaaccttcggaaaaacaacaggcagccatatgctgttagtgagctggctggccatcagaccagcgccgagtcctggggtacaggtagagctgttgcacgtatccctagagttagaggagggggaacccatagatctggccagggcgcattcggcaacatgtgccgcggtggacgcatgttcgcacctacaaagacttggagacggtggcatcgcagagtgaacaccacccaaaagcgttacgccatctgtagtgcattagctgcttccgctctacctgccctcgtgatgagcaaaggtcacaggattgaggaagtccccgagcttccgctcgtagttgaggacaaggtggaaggttacaagaaaacaaaagaggccgttctgctgctgaaaaagttaaaggcttggaacgacatcaaaaaagtctatgccagccagcgcatgcgagctggcaagggcaaaatgcgcaaccgcaggaggattcaaagaaggggaccctgtattatttacaacgaggacaatgggatcatcaaggcattcaggaacatcccgggtataaccctccttaatgttagtaagctaaatatcctgaagctggccccaggaggccacgtgggacgattctgcatttggactgagtccgcattccgcaaactggacgaattgtatggaacatggcgtaaggccgctagtctgaagtcaaattataacctgcccatgcacaaaatgatcaataccgatttaagccgtatcctgaagtcacccgagatccagcgcgctctgagagcccctcgcaagaaaatccaccggagggtcctgaaaaagaacccactaaagaacctgcggattatgttgaagcttaacccctacgcgaaaacgatgcgcaggaataccattctgaggcaagcccgtaaccataaactgagagtggataaggccgctgcagctgccgcagccctgcaggccaagagcgacgagaaagcagcagtcgccggaaagaagcctgtagttggaaagaaggggaagaaagccgctgtgggtgtcaagaaacaaaaaaagccactcgtcggtaagaaggctgccgcaactaaaaagcccgcacccgagaagaagcctgctgagaaaaagcccaccactgaagagaagaagccagcagcatag

SEQ ID NO: 239045 - DNA, 1221 bp, Artificial Sequence
  Description of Artificial Sequence: Synthetic coding sequence
atggcctgcgccagaccattgatcagcgtgtacagcgaaaagggggaaagttctggcaagaacgtcactttgccagccgtgtttaaggccccaataaggcctgacatagtgaacttcgtccataccaatttacgtaagaacaaccgtcagccctatgcagtgagcgaactagccggacaccaaacatctgcagaatcctggggaacagggcgtgccgttgcccgtatcccccgtgtgaggggaggaggcacccatcggtctggccagggagccttcgggaacatgtgccgcggaggccgaatgttcgcacccactaaaacatggcggagatggcacagacgtgtgaacacaactcagaagcgttacgctatctgttccgctctggctgcctccgctctgccagcactggttatgtcgaagggacaccggatcgaggaggttcctgagctgccactggtcgtggaggacaaagtggaaggctacaaaaagaccaaggaggccgtgctgctgctaaagaagctaaaagcttggaacgatattaaaaaagtatacgcgagccaacggatgcgcgcaggcaaggggaaaatgcggaaccggagacggatccagagacggggtccctgcataatttataatgaggacaacggcatcatcaaggcattccgcaatattcccggaattaccttgttgaatgtgagtaaactgaacattctgaagctggccccaggcggacacgtggggcgtttttgtatctggaccgagagtgcatttaggaaactggatgagttgtacggtacgtggaggaaggctgcctcactgaagagtaactacaacttacccatgcacaagatgataaacacagacctgtcgcgcatactgaaatccccggaaatccagcgcgcattgcgcgctccacgcaaaaaaatccacagaagagtgttaaagaagaaccctctgaagaacctccggattatgctgaaactcaatccgtatgcgaagaccatgaggcggaatacaatccttaggcaggccaggaaccataagctccgggtcgacaaagccgctgcggctgcagccgctctgcaagctaaaagtgacgaaaaagccgctgtggccggaaagaagccggttgtaggtaagaagggcaagaaagccgctgtcggagagaagaagcccgctgagaagaaacctacaactgaagagaaaaagccagcggcatag

SEQ ID NO: 239046 - DNA, 456 bp, Artificial Sequence
  Description of Artificial Sequence: Synthetic coding sequence
atggcctgtgccagacccttaattagcgtgtactcggaaaagggcgagagctccggaaagaacgtcacccttcccgctgtcttcaaagccccaatacgtcccgacatcgtcaacttcgtgcatactaacctcaggaagaataatcgccagccctacgctgtgagtgaactggcgggacaccagaccagcgcagagtcctggggaactggcagggcagtggctagaattccccgagttcgcggaggcggaacccatcgcagcggccaaggcgcatttgggaatatgtgcagaggcggtaggatgttcgcccctactaaaacctggaggagatggcaccgtcgtgttaatactactcaaaagctggagaatcatgtggaggccaaacccatttgcaaagatcacgcacccgagcaccactcaagcccgggacaggaaagccaagcccctggcggttag

SEQ ID NO: 239047 - DNA, 78 bp, Artificial Sequence
  Description of Artificial Sequence: Synthetic coding sequence
atgcgcgctaagtggaggaagaagcgcatgcgtaggctgaaacggaaacgaagaaaaatgcggcaacggtctaagtag

SEQ ID NO: 239048 - DNA, 78 bp, Artificial Sequence
  Description of Artificial Sequence: Synthetic coding sequence
atgcgggcaaagtggcggaagaagagaatgaggagactgaaaaggaagaggcggaagatgcgccagaggagtaagtag

SEQ ID NO: 239049 - DNA, 381 bp, Artificial Sequence
  Description of Artificial Sequence: Synthetic coding sequence
atgattgtccgggtcacgaacagagacatcatttgccagattgcctatgctaggattgaaggagacatgattgtatgcgcagcttacgcccatgagttacctaagtacggggtcaaggtggggctaaccaattacgccgctgcgtactgcacaggacttctccttgccagaaggttgctcaaccggtttggcatggataaaatctacgagggccaagtcgaggttactggcgatgagtataacgtggagtccatcgacggtcagcctggagctttcacctgctacctggatgcaggcctggccaggactacaactgggaataaggtgtttggagctttgaagggggctgtggatggtggcctttcaatacctcacaggtag

SEQ ID NO: 239050 - DNA, 894 bp, Artificial Sequence
  Description of Artificial Sequence: Synthetic coding sequence
atgggctttgtcaaggtggtcaagaacaaagcctacttcaagcggtatcaggtcaaattcaggagacggagagagggaaaaacagattattacgccagaaaacggctggttattcaggacaaaaataagtataacacccccaagtacaggatgatcgtccgcgtgactaaccgggatattatttgtcaaattgcgtacgccaggatcgaaggggatatgatagtgtgtgcagcttacgcccacgaactgccaaagtacggagtgaaggttggcctcactaattacgcagctgcctattgtaccggcctgctgctcgcaagacggctgttgaatcgcttcggtatggacaagatttatgaggggcaagtcgaggtgacgggtgatgagtacaatgtagagagcatcgacggccaacctggtgcattcacgtgttatctggatgctggtctcgccagaacgactaccggaaacaaggtattcggtgccttgaagggcgcagttgatggcggtctgagcattccccacagtacaaagcggttccctggctacgatagtgagagcaaagagttcaatgctgaagtccaccgtaagcatatcatgggacagaacgtagcagactatatgaggtacctgatggaggaggatgaggacgcatataagaagcaattctcccagtacatcaagaattctgtgacccccgatatgatggaggagatgtacaaaaaggcgcatgccgctattagggagaaccccgtgtatgaaaagaagcctaagaaagaggtgaagaagaagaggtggaaccggcctaagatgtctctggcccagaaaaaggacagagtggctcagaaaaaggcttcatttctgagagcccaagagagagccgctgagagctag

SEQ ID NO: 239051 - DNA, 744 bp, Artificial Sequence
  Description of Artificial Sequence: Synthetic coding sequence
atgatcgtccgagtaactaatagggatatcatttgccaaatcgcttatgcaagaatcgagggagacatgatcgtctgtgctgcatatgcccatgagcttcccaaatatggcgtgaaagttggtttgactaattatgccgcagcgtattgtaccggtttgcttctggccaggcggttgctgaatagattcggaatggataaaatttatgagggccaggtcgaggttacgggcgacgagtataacgtcgagtctatcgatggccaaccgggtgcttttacctgttatctagatgccggtctcgccaggacgacaactggtaataaggtgtttggagccctgaaaggggcagtggatgggggactgagtatacctcattccactaaacggtttcctggctatgatagcgagtcaaaagaatttaacgccgaagtgcataggaagcacatcatgggacagaatgttgccgactacatgcgatacctgatggaagaggatgaagatgcctacaagaagcagttttctcagtacatcaaaaacagcgtgactcctgatatgatggaggagatgtataaaaaggcccatgctgccatccgtgaaaatcccgtttatgaaaaaaagccgaaaaaagaggtgaagaagaagagatggaacaggcctaagatgagtcttgcccaaaaaaaggatcgggtcgctcagaaaaaggccagctttttacgggcacaggaacgggctgcggagtcgtag

SEQ ID NO: 239052 - DNA, 867 bp, Artificial Sequence
  Description of Artificial Sequence: Synthetic coding sequence
atggccggagaaaaagtcgagaaacctgataccaaagagaagaaaccagaggctaagaaggtggatgcaggaggaaaagtaaaaaagggaaatctgaaggccaaaaaaccaaagaaggggaaacctcattgctctcggaatccagttctggtgagagggattggaagatactcccgttccgccatgtattcccgcaaagctatgtacaaacgaaaatatagcgccgcaaagtctaaggtcgagaaaaagaaaaaggagaaggttctggctacagtaactaaacctgttggcggagataaaaacggcggaaccagagtagtcaaacttcgaaaaatgccacggtactatccaaccgaggacgtccctcgcaagctcctcagccacggaaaaaaaccattctctcagcacgtgaggaagttacgagcaagcattactcctgggaccattcttatcattctcacaggacgacataggggaaagcgtgtagtgtttctcaagcagctcgcttcgggcctgctgttagtaacgggaccccttgtgcttaaccgggtgccactgagaagaacccaccagaaatttgtgatcgccaccagcacgaagatagatatctcaaatgtgaagatccctaaacatctaactgacgcgtatttcaagaagaaaaagttgcggaaacctcgccatcaagagggcgaaattttcgacacagagaaagaaaaatatgagatcacagaacaaagaaaaatagaccagaaggcggttgactcccagatcctccctaagatcaaggcaattccccagcttcaggggtacctgaggtctgtctttgccctaacaaacggaatataccctcacaaactggtcttctag

SEQ ID NO: 239053 - DNA, 867 bp, Artificial Sequence
  Description of Artificial Sequence: Synthetic coding sequence
atggctggggagaaggttgagaagcccgatacgaaagaaaagaagcctgaggctaaaaaggtagatgctggaggtaaagtgaaaaaaggaaatctcaaggctaaaaaacccaagaagggtaagcctcactgttctagaaatcccgtactcgtgcgcggaatcgggaggtattctcggtccgccatgtactccagaaaggctatgtataagaggaagtactcagctgctaagtcaaaggtggagaaaaaaaagaaagagaaagtcttggcaaccgtgaccaaacccgtgggcggtgataagaatggcggaacaagagttgtcaagttgcgaaagatgccacggtactacccaacagaggacgtgcccagaaaactgcttagccacggtaagaagcccttctcccaacatgtgcgtaagctgcgggcttctattacccccggaaccatcttaatcattctcacgggaaggcaccggggaaaacgtgtggtgttcctgaaacagttagcaagcgggttgcttttagtcaccggccctttggttctcaatcgggtaccattacgaaggactcatcaaaagtttgtgatcgcgacatcaaccaagattgacattagcaatgtcaaaatccccaagcacctcacagatgcttacttcaagaagaagaaactgagaaagcccaggcatcaggaaggcgagatatttgacactgaaaaagagaaatatgagataacggaacagcggaagatcgaccagaaggctgttgattcacagatactaccaaagattaaagcaatcccacagctgcaaggttatctccgatctgtttttgctctcaccaacgggatatacccacataaactcgtgttttag

SEQ ID NO: 239054 - DNA, 318 bp, Artificial Sequence
  Description of Artificial Sequence: Synthetic coding sequence
atggcgggtgaaaaagtggagaagcccgacacgaaagagaaaaagcctgaagctaaaaaggtcgatgctggcggaaaggttaaaaaaggcaatcttaaggctaaaaagccgaagaagggcaagccccactgtagtcgcaaccccgtgctcgtcaggggaattggcagatattcacggtcagcaatgtactctagaaaggccatgtacaaaagaaagtacagcgctgccaagtcaaaggtggagaaaaagaagaaggaaaaagtcctggccaccgtaaccaagccagtgggcggagacaagaacggaggcacccggtag

SEQ ID NO: 239055 - DNA, 219 bp, Artificial Sequence
  Description of Artificial Sequence: Synthetic coding sequence
atggctggggagaaggttgagaaacccgatacaaaagaaaagaagccagaggccaaaaaggtagatgctgggggaaaagtgaaaaaaggaaatcttaaggcaaagaaacctaagaaaggcaagccccactgctcccggaatcctgtcctggtgagaggcatcgggagatatagccggagcgcgatgtactccagaaaagccatgtataagcgtaagtag

SEQ ID NO: 239056 - DNA, 480 bp, Artificial Sequence
  Description of Artificial Sequence: Synthetic coding sequence
atggctggagagaaggtcgagaagccagacacaaaggaaaaaaaaccagaggcaaaaaaagtcgacgctggtggtaaagtgaagaaggggaacctaaaggccaaaaagcccaaaaaaggcaagcctcactgcagtcggaatcctgtactcgtgcggggaataggacgctattcaaggagcgcaatgtatagccggaaggccatgtataaacggaagtatagcgctgccaagtccaaagtagagaagaagaaaaaagaaaaagtgttagccacagtgaccaaaccagtgggcggtgacaagaatggaggcacccgcgtcgttaagttaaggaagatgcctagatactaccccactgaggacgtgccacggaagctcctgagccacggcaagaaacccttcagccagcacgtcaggaagcttcgcgcaagtatcactcccggaaccatccttattatcctcacggggcgacataggggctag

SEQ ID NO: 239057 - DNA, 345 bp, Artificial Sequence
  Description of Artificial Sequence: Synthetic coding sequence
atggccggtgagaaggtcgaaaagcccgacacgaaagaaaagaagcctgaggctaagaaagtggacgccggagggaaagtgaagaaaggcaacttaaaagccaagaaaccaaagaagggcaagccacattgctctcgcaaccccgtgctggttcgaggcatcggacgttactcccgctccgctatgtactcccgtaaagcgatgtataagcgtaaatactcggccgcaaaatcgaaagtggaaaagaagaaaaaggagaaggtactggccacagtgactaagccagtgggcggagataaaaacgggggaactagggtggttaagctcaggaagatggtgagatag

SEQ ID NO: 239058 - DNA, 345 bp, Artificial Sequence
  Description of Artificial Sequence: Synthetic coding sequence
atggcgggtgagaaggtagaaaaacccgacacaaaagagaaaaagccagaggcaaaaaaggttgatgccggaggcaaggttaaaaaaggcaatctcaaagctaagaagcccaaaaaaggtaaaccgcattgtagcaggaatccagtcctcgtgcgtggtatagggaggtactcaaggagcgcaatgtacagccggaaggcgatgtataagcgaaaatatagcgccgctaagtcaaaggtcgaaaagaagaaaaaggaaaaggtgctcgcaaccgtaactaagcccgttggaggagataaaaacgggggtacacgcgtggtcaagctgcgcaaaatggttcgctag

SEQ ID NO: 239059 - DNA, 747 bp, Artificial Sequence
  Description of Artificial Sequence: Synthetic coding sequence
atggagggggtggaggagaaaaagaaagaggtccccgcagtgccagagacgcttaaaaaaaagcggagaaattttgcagagctgaaaattaaacgcctgagaaagaagttcgctcagaagatgttgaggaaagcaagacgaaaactaatttatgagaaagctaaacactatcacaaggaataccggcagatgtacaggaccgagatcaggatggcccgtatggcaaggaaggctggaaacttctacgtgccagccgagcccaagcttgcttttgtgatcagaattcgaggcatcaacggggtgagcccaaaggttcggaaagtgctccagttacttcgactccggcagattttcaatggtacattcgtcaagctgaataaggcctcaataaatatgctgcggatcgtggagccgtacatcgcctggggctaccccaatttgaaaagcgttaacgagctaatctacaagcggggttatgggaagatcaacaagaaacgtatcgctctcacggacaatgctctcatcgcgagaagcctgggaaagtacgggatcatttgtatggaggatctgattcacgaaatctacaccgtaggcaagcgtttcaaggaagcaaataacttcctgtggcccttcaaactgtctagcccgagagggggaatgaaaaagaagaccacccatttcgtggaggggggagatgccggaaatcgggaggaccagatcaataggctgattcgcaggatgaactag

SEQ ID NO: 239060 - DNA, 456 bp, Artificial Sequence
  Description of Artificial Sequence: Synthetic coding sequence
atggcacctctgtaccaggccgcaggaaaaggtgatgttcccacaaagaggccacctgtgcttcgtgcaggcgtcaatactgtgactactctggtggaaaacaaaaaagctcagctcgtggtgatcgctcacgacgttgaccccattgagcttgtggtctttttgccagcgctgtgcagaaaaatgggtgtaccctattgcataatcaaggggaaggccagattagggaggctcgttcatcgaaagacatgcacgaccgtcgcgtttacacaggtgaattcggaggacaagggcgcactagcaaaactagtagaggctattagaacgaattataatgaccgctacgatgaaatccggcgtcactggggcggtaatgtgctggggccaaaatcggtcgctcgcattgccaagttagagaaagcaaaagccaaggagttagcgacgaaattggggtag

SEQ ID NO: 239061 - DNA, 801 bp, Artificial Sequence
  Description of Artificial Sequence: Synthetic coding sequence
atgcccaagggaaaaaaggctaaagggaaaaaggtggcgccagctcccgctgttgttaagaaacaggaagcgaagaaggtggtcaaccccctgtttgaaaagcgcccaaaaaatttcggcataggtcaggacatacaacccaagcgggatttgacaagattcgtgaaatggccaaggtatattagactacagagacagcgggcaattctgtataaacgcctgaaggtcccacctgccatcaaccagtttacccaggctctagacagacagacggccactcagctgctcaaactggctcacaaataccggcctgaaactaagcaagagaagaagcaaagattgttggcccgagccgaaaaaaaggccgcaggaaaaggggatgtgcccactaagagacccccagttctccgcgctggagtcaacacagtcaccaccctggtcgagaacaaaaaagcacagctagtcgtgatcgctcatgacgtggaccctattgaactagtggtgttcctgccagctttgtgcaggaagatgggagttccttattgtatcattaaaggtaaagcccgattggggaggctggttcatcgcaagacttgcacaaccgtggcgttcacgcaggtcaactccgaagacaaaggggctctggctaagctggtggaggcaattcggactaactacaacgaccgttatgatgaaattagacggcactggggtggcaacgttctcggacctaagtctgtggctcggatcgctaagctggagaaagccaaagccaaagagctcgcgacaaagctgggttag

SEQ ID NO: 239062 - DNA, 576 bp, Artificial Sequence
  Description of Artificial Sequence: Synthetic coding sequence
atgctcgtgcgcctgaacgtgcgatgttcatgccgtggcgtggtgctgggcggatgtcggaaactactagccagccttgttcagcccaaaggcaagaaagccaagggcaagaaggtggcgcctgcccctgctgtcgtcaagaaacaggaggcaaagaaggtcgttaatccgctgttcgaaaagagaccaaagaacttcggtattggtcaagatatccagcccaaaagggatctcaccagattcgtcaagtggccgagatatattagattgcagcggcagcgggcaatcttgtacaaacgacttaaggtaccgcctgcaattaaccaattcacacaagccctagatcgtcaaacagccacccaactgttgaagctcgcgcacaaatacaggcctgagaccaaacaggaaaagaagcaacgactcttggcgcgtgccgaaaaaaaggcggctggtaaaggcgacgtgcctactaaacgccctcctgtcctgcgcgcaggggttaacaccgtgacgactctggtagagaataaaaaggcccagctagtagtgatcgcgcatgatgtggaccctatctag

SEQ ID NO: 239063 - DNA, 774 bp, Artificial Sequence
  Description of Artificial Sequence: Synthetic coding sequence
atgggcagggtgatccgaggccagaggaaaggcgcaggttcagtattcagagcacacgtcaagcatagaaagggagcggctagactgcgagccgtcgattttgcagaacggcacggctatataaaaggcatcgtgaaagacattatacatgaccctggcaggggtgcacctcttgctaaagtggtcttcagggacccctacaggtttaagaagcggacagagctgttcatcgccgctgagggcattcatacaggccaatttgtctactgcggaaaaaaagctcaactgaacatcggaaacgttttgccagttggcacgatgcccgaaggcacgattgtttgttgtctggaggagaaacccggagatagagggaagctggccagagcctcagggaactacgctacagtcattagtcacaaccctgaaacgaaaaaaacacgagtgaagctcccttctggctcgaagaaggtaatcagctcagctaatagagctgtggtcggtgtcgtcgccggaggtgggagaattgacaaaccgatcctgaaagctggcagggcctaccacaaatacaaagcgaaacgaaactgctggccacgggtccgcggtgtggctatgaatcccgtggagcatcctttcggcggtggaaatcaccagcacataggaaagccaagcactatccgcagggacgcaccagccggacggaaagtcggtttaatcgctgctcggaggacaggccgactgcgcggaaccaaaacagtgcaggagaaggagaactag

SEQ ID NO: 239064 - DNA, 774 bp, Artificial Sequence
  Description of Artificial Sequence: Synthetic coding sequence
atgggaagggtgattaggggtcagaggaaaggagccggatctgtcttccgtgcgcatgtcaaacacaggaagggtgcagcaaggcttcgggctgtcgactttgccgaaagacacggctacataaaggggatcgtgaaagatattatccacgatcctggacggggagcacccctggctaaggtggtctttcgcgatccctacaggttcaagaagcggacggagctgtttatcgctgcggagggaatacataccggccagtttgtttactgtggtaagaaggctcagttaaatatcggaaacgtgctgcccgtaggaactatgcctgagggcactattgtgtgttgcctggaagagaagcccggtgaccgcggaaagctagccagggcatccggaaattacgcaacagtcatcagtcacaatcccgagacgaagaaaacccgggttaaactgccaagcggatctaagaaggtcatctcttccgccaaccgagctgtggttggcgtagtggctgggggaggccgtatcgataagcctatcctcaaagctggacgagcatatcataaatacaaagctaaacgtaactgctggccccgtgtccgcggagttgcgatgaacccggttgaacatccgtttggaggtggcaatcaccaacacattggcaagcctagtactattagaagagacgcgccagccggacgaaaagtgggccttatcgcggcacgtagaacaggcagactgcgcggaacaaagactgtgcaggagaaggaaaactag

SEQ ID NO: 239065 - DNA, 579 bp, Artificial Sequence
  Description of Artificial Sequence: Synthetic coding sequence
atgaaaacaattttatccaaccagactgtcgatatccccgaaaacgtcgacatcacgttaaaggggaggacagtgattgtgaaggggccacgaggaactttgagaagagactttaaccacatcaatgtggaactgtccttgctgggaaaaaagaagaaacgtctgagagtagacaaatggtgggggaatcggaaggagctcgccactgtgcgcacaatctgttcccatgtccagaacatgattaagggtgtgaccctggggttcagatataagatgaggtctgtctatgctcactttcccatcaacgtggtgatacaggaaaatgggtccttggtggaaattcgtaactttttaggtgaaaagtacatcagaagagtccgaatgaggcccggtgtcgcctgctccgtgagtcaggcgcaaaaggatgagttgatcctcgagggcaatgacatcgaacttgtgagtaactccgcagctttaattcaacaggccaccacagtgaaaaataaagatatcaggaagttcttggatggcatctatgtgagcgagaagggaacggttcagcaggcagatgagtag

SEQ ID NO: 239066 - DNA, 444 bp, Artificial Sequence
  Description of Artificial Sequence: Synthetic coding sequence
atgaagaccatcctgtctaaccagacggtcgacatcccggaaaacgtggatattacactgaaaggcagaaccgtgattgtaaaagggcctagaggaaccctcagaagggatttcaatcacatcaatgtcgaactgtcccttcttggaaagaagaagaagcgtctgcgagtggataagtggtgggggaatagaaaagaactggccacggtccgaacaatatgcagccacgtgcagaacatgattaaaggggttacactcggtttcagatacaagatgaggtcagtatacgcccacttcccgatcaacgtagtgattcaggagaacggcagcctggttgaaattcgcaacttccttggcgagaagtatatcaggcgggtgcgcatgcggccaggagtggcctgcttcaagttctctggattcgatagcgcctcccataatagttag

SEQ ID NO: 239067 - DNA, 579 bp, Artificial Sequence
  Description of Artificial Sequence: Synthetic coding sequence
atgaaaactattttgtcaaaccagaccgtcgatatcccagaaaacgtagatatcacacttaagggcagaactgtaatcgtcaagggaccccgtggcacgctaaggagggattttaaccatataaatgtggagttgtccctcttgggcaagaaaaagaaaagattgagggttgacaagtggtggggaaatagaaaggagcttgccacagtccgtactatatgcagccatgtgcagaacatgatcaagggagtgaccctgggattcaggtataaaatgagatcggtgtacgcccattttcctatcaacgtggtgatccaagagaacggctctctagtggaaattagaaattttctcggcgagaaatatatccgcagggtacgaatgcgtcctggcgtcgcatgctcagtctcacaggctcagaaagatgaattgattctggaaggcaacgatatcgaattggtgagcaacagtgcagccttgatccagcaagcgactactgtgaaaaacaaggatatcaggaagttcctggacggaatctatgtttctgagaagggcaccgttcaacaagctgatgaatag

SEQ ID NO: 239068 - DNA, 501 bp, Artificial Sequence
  Description of Artificial Sequence: Synthetic coding sequence
atgaagacaatcctgtctaaccaaaccgttgacatccccgagaacgtcgatattaccctgaagggacgaacagttattgtgaaaggccctcgaggaacattgcgccgagactttaaccacattaacgttgaactcagtctgctcgggaaaaagaagaagagactgagggtggataagtggtgggggaaccggaaggagcttgctacagtccgcactatatgttctcacgttcagaacatgatcaagggagttacgctgggctttagatacaaaatgcgatctgtttacgcccatttccccatcaacgtggtgatccaggaaaatggctctctggtggagattagaaacttcctgggtgagaaatacatccgccgagtgcgcatgcggccaggtgtcgcttgtagcgtctctcaggcgcagaaagatgagctgatactggagggaaacgatatcgaactggtgtctaattcagcagccctaatccagcaggccacaacctag

SEQ ID NO: 239069 - DNA, 498 bp, Artificial Sequence
  Description of Artificial Sequence: Synthetic coding sequence
atgctcatgcccaaaaaaaaccggatagccatttatgagcttctgttcaaggagggagtgatggtggctaaaaaggatgtacacatgcctaaacaccctgaattggccgataagaacgtgccgaatctgcatgtgatgaaggccatgcagtctctcaagagcagaggttatgtcaaagaacagttcgcgtggcgacacttctattggtacctgacaaatgaggggattcaatacctgcgcgactacttacatctgccacctgaaattgtgccagcaactctgaggaggagccggcctgagaccgggaggccacggccaaagggactcgaaggcgagcgcccagcccgtctgacacgtggcgaagccgacagggacacatatcgcagatcggctgtgcccccaggtgcagataaaaaggccgaagctggcgcaggcagcgccaccgagtttcaatttagagggggattcgggcgagggaggggccagccaccacagtag

SEQ ID NO: 239070 - DNA, 477 bp, Artificial Sequence
  Description of Artificial Sequence: Synthetic coding sequence
atggcagatatccagactgagagggcctaccagaagcagcctaccatcttccagaacaaaaagcgggtccttctgggtgagacgggaaaggagaaactgccaagatactataagaacattggactgggattcaagaccccaaaggaagccatagaaggtacctacattgataagaagtgcccattcacaggaaatgtttcaatccgcggacgcatcctgtctggggttgtgaccaagatgaagatgcagaggaccattgtgatccggagagactatctacactatattcgtaagtataaccgtttcgaaaagcggcataaaaacatgagtgtgcatctgtctccatgttttagagatgtgcagatcggggacattgttacagttggagagtgtcgaccactctcaaagactgtgaggtttaatgttctgaaagtgactaaggcggctggcaccaagaaacaatttcagaaattttag

SEQ ID NO: 239071 - DNA, 423 bp, Artificial Sequence
  Description of Artificial Sequence: Synthetic coding sequence
atgacgtctatgacacagtcgttgcgggaagtcataaaagctatgactaaggccagaaatttcgagcgagtgctagggaaaattactctcgtcagcgcagcgccaggcaaggtgatttgtgagatgaaggtcgaggaggagcacactaatgcaattggcactctgcacggagggctgacagctacgctggtggataatattagtacaatggcactgctgtgtactgaaagaggggcaccaggcgtgagcgtggatatgaacattacatacatgtcccctgccaaactgggcgaggacatagtaattacagcccatgtcctgaagcagggaaaaacactggccttcaccagtgtggatctaaccaataaggctacagggaagctcatagcccagggcagacatacaaaacacctcggtaactag

SEQ ID NO: 239072 - DNA, 456 bp, Artificial Sequence
  Description of Artificial Sequence: Synthetic coding sequence
atggggagaatgcatgcccctggtaagggactcagccaatctgcccttccttacagaagatccgtcccaacatggctaaaactgacttcagatgatgtgaaagaacagatctataaattggcaaagaaggggttaacaccctcccaaatcggtgttatcctccgggacagtcacggagtggctcaagtcaggttcgtgaccggtaacaagattctgagaatactgaagagcaaggggttggcccctgaccttccagaagacctgtaccatcttattaagaaggcagtggcagttaggaagcatctcgagaggaacagaaaggacaaagatgcgaagttccgcttaattctgatcgagagtcggatacaccgccttgcaaggtactataaaactaagcgggtgctgcccccaaattggaagtacgaatcgagtacagcgagcgccctggtagcctag

SEQ ID NO: 239073 - DNA, 456 bp, Artificial Sequence
  Description of Artificial Sequence: Synthetic coding sequence
atggcccctcgcaaaggcaaggaaaagaaggaagagcaggtgatctccctgggccctcaagtcgctgagggtgagaacgtgtttggggtgtgccatatcttcgcgtcgtttaacgacactttcgtacacgtgaccgatctgagcggaaaagagaccatatgtagggtgaccggcggaatgaaggttaaagcagatagggatgaatccagtccatatgctgccatgctagccgcacaggacgttgctcagcggtgtaaagaactgggaatcacagccctacatatcaaactccgggcaacaggaggtaaccgcaccaagactcccggacctggagcacagtctgcactgagggctctggctcggagcggcatgaaaataggtagaatagaggatgtcaccccgattccatctgattccactagacgtaagggcggaagaagaggaagaaggttgtag

SEQ ID NO: 239074 - DNA, 456 bp, Artificial Sequence
  Description of Artificial Sequence: Synthetic coding sequence
atggcccctcgcaagggcaaggaaaaaaaagaggagcaggtcatatccttgggaccacaggtcgctgaaggagagaacgtgttcggagtgtgccacatattcgccagcttcaacgacacattcgtgcacgtcacagacctgtccggcaaggaaactatctgcagagtcactggaggaatgaaagtgaaggctgaccgtgacgagagctcgccgtacgctgctatgttggcagcacaggacgtggcgcagagatgtaaggaacttggaatcacggctctgcatattaagctaagagcgaccggaggaaaccgaacaaagaccccgggacctggagctcagagcgcgctgagggctctcgcgcgatctggcatgaaaattggaaggattgaagacgttactccgattccaagcgatagcacacgacggaaaggtggccgtcggggacggcgattgtag

SEQ ID NO: 239075 - DNA, 456 bp, Artificial Sequence
  Description of Artificial Sequence: Synthetic coding sequence
atggctccgaggaagggcaaggagaagaaggaagagcaagttattagcctcgggccacaggtggccgagggagaaaacgtgtttggggtgtgccacatcttcgcgagcttcaacgatacgtttgtccacgtcacagatctgtcagggaaagagactatttgccgggtgactggaggcatgaaagtgaaagcagacagggacgagtcctctccctacgctgcaatgctagccgctcaggatgtcgcccagcgctgcaaggaattggggatcacggctctgcacataaagctgcgggcaaccggcggaaataggaccaaaacccctgggcctggcgcacagagcgcactgcgggctttagccaggagcggcatgaagattgggaggattgaggatgtgacgccaatcccctctgattccactagaagaaaaggagggcgtagaggtagacggttatag

SEQ ID NO: 239076 - DNA, 456 bp, Artificial Sequence
  Description of Artificial Sequence: Synthetic coding sequence
atggcgccacgcaaagggaaggagaaaaaagaagagcaggttatctctctgggtcctcaggtggcggagggagaaaacgttttcggtgtctgtcatatttttgccagcttcaatgacacatttgtccatgttacggatctttccggtaaggaaacaatctgtagagtaactggaggtatgaaggtgaaagccgaccgggatgagtcatctccatacgcagctatgcttgctgctcaggacgtagctcagcggtgtaaggagctgggcatcacagcccttcacatcaagctgcgggcaactggtggcaaccgcaccaaaaccccaggaccaggggctcagagtgccctgagagctctggcacgttccggcatgaaaattggacggatagaagacgtcacccccatacccagcgactccacacgcagaaagggcggacgcagagggaggcgcttgtag

SEQ ID NO: 239077 - DNA, 6912 bp, Artificial Sequence
  Description of Artificial Sequence: Synthetic coding sequence
atggcatcaagtgtcgccccttatgaacagctggtgcgacaagtcgaagccctgaaggcagaaaactcgcacttaaggcaggaattgcgggataacagttcccatttgtccaagctcgagacagagaccagcggcatgaaggaggtactgaaacacctgcagggcaaactggaacaggaggccagagtactcgtgtcaagcggacagacagaggtcttagaacagctgaaggcactccaaatggatatcacatccctgtataacctaaagttccagcctccaactctgggccctgagcctgccgctcgtactccagagggaagccccgtgcatggatccggcccatcaaaggatagttttggagaactgagtcgcgctactatacggctcctggaggagctggatagagaacgctgctttcttctgaatgagattgaaaaggaggaaaaagaaaagctttggtactactctcagcttcagggcctgagtaaaaggcttgatgagctgccccacgttgagacacagttctcaatgcagatggatctgatccggcagcagttggagtttgaggcgcagcatatcagaagtctcatggaggaacggtttggaacatctgatgagatggtgcagcgggctcagattcgggctagcaggctggaacagattgataaggaactcctagaagcccaggaccgtgtgcagcagaccgaaccccaggccctcctcgccgtgaagtccgttccagttgacgaggatccggagacggaagtgcctacccaccccgaagacggcacacctcagcctggcaatagtaaagttgaggtggtcttctggctgctttcaatgcttgcaaccagggaccaggaggatacagcacgcacactgcttgcgatgagttcctcacccgaatcctgcgtggctatgcgcagaagtggatgtctgccgcttctgctccagatattgcatgggaccgaagctgcagccggtggcagggccggagccccaggggctcccggagccaaagacgccaggatgagggcgaacgcagcccttcacaacatcgttttcagccaacctgatcagggcctggcgagaaaagaaatgagggtattgcatgtccttgagcaaattagagcttactgcgagacttgttgggactggctgcaggcaagggatgggggtcccgaggggggaggagctggaagcgcaccaatccctatagagccccaaatttgccaagccacttgcgctgtcatgaagttgagttttgatgaggaatatcgcagagcaatgaatgaactggggggacttcaggccgtggctgagttgttgcaggtcgactatgaaatgcataaaatgacccgagatcccttgaatctggcactaagacgctatgcagggatgacgctgacaaaccttacatttggcgacgtggcgaataaagctacactctgcgccaggagaggctgcatggaagctattgtggcgcagctggcatctgactcagaagagttgcaccaggtggtaagtagtattttgcgaaacttaagttggcgcgcagatatcaactctaagaaagtgctgcgggaggccggatccgtcaccgctctcgtccagtgcgtgcttcgtgccaccaaggaaagcaccctgaaatccgtgctcagcgctctgtggaatttgtctgcccactcaaccgaaaacaaagcagctatatgtcaggtggacggtgccttaggatttctggtgagcacactgacatacaaatgccagagtaattctctggcgatcatcgaatctggcggaggtatcctgcggaacgtctcttcgctcgtcgccactagggaagactaccggcaggtgctcagggatcacaactgtttgcagactcttcttcagcatctgacatctcatagcctgactatcgtgtctaatgcctgtggaaccctgtggaacctgagtgccaggtcggcacgagaccaagagctgctgtgggatctgggggctgtaggaatgttgagaaatctcgtgcactctaagcacaaaatgatcgcaatggggtccgctgcagcactgcggaatttgttggcacaccgacccgctaagcaccaggctgccgctactgctgtgtcaccagggtcttgtgtgccctccctgtacgtgcgtaaacagcgggcactggaggcggagttagacgcaaggcacttggcgcaggccttggagcacctggagaaacagggaccccctgcagcagaggccgcaaccaagaaacccctcccgcctttacggcatttagatgggctggcccaggactacgcttcagattctggatgcttcgatgatgatgatgcaccaagctctctcgcggcagccgcagcaacgggcgagcccgcttccccggcagctctgagtctgttcctgggatcacccttcctccagggtcaggccttggcacgtacccctcccacgagaagaggcggaaaagaggcagagaaagatacctctggcgaggccgcagtagcagcgaaagcgaaggcaaagctggctctggctgtcgccagaattgaccagttggtggaggatataagtgctctccatactagttctgatgattctttcagcctgtcctccggggatcccggtcaggaagcgccaagggagggacgtgcccagtcttgttccccatgcagaggccctgagggcggaaggcgagaagctggatcaagagcccacccgctcttacgcctgaaagccgcacacgcaagcctttctaatgacagtttgaacagtggatcggcttctgacggctactgtccacgggaacacatgctgccctgtcccctggcagcactcgcatcgcggagggaagacccccgatgtggccagccacgaccatccagactggacctagacttgccagggtgtcaggctgagccccctgcaagggaggccacaagcgccgatgctagagtgaggactatcaaacttagcccaacgtatcaacacgtgccgctcctagagggggcaagtagggctggcgcagaacccctggcaggccctgggattagtcctggggctaggaagcaggcatggcttcctgctgaccatctcagtaaggtcccagagaagcttgccgcagctccattgagtgtcgcgtcaaaggccctgcaaaagttggcagcccaggaaggtcctctctccctgtctagatgcagttctctttcatccctgagtagtgctggcaggcccggacccagtgaagggggagatctcgacgactctgattcttcccttgaaggcctggaagaggctggcccttcagaagctgagctcgactcaacttggcgcgctcccggagccaccagcctccctgttgccatccctgctcctcgaagaaaccggggaagaggactcggagtggaagacgcgactccttccagttcttcggagaattacgttcaggaaacacccctcgtgctttctagatgctctagcgtcagcagtttggggtcttttgaatctcctagtattgcaagctcgatccctagcgagccttgttctggacaaggctcgggaacaatcagtccttctgagctgcccgactcacctggccaaacaatgccaccaagcaggtccaaaactcccccactggcgcctgccccacaaggtcccccagaagcaacacagttcagcctccaatgggaatcatatgttaagcggttcttggacatcgctgactgcagggagaggtgtcgcctgcccagcgagcttgacgctgggtcagttagatttaccgtggaaaaaccagatgaaaacttctcgtgtgcctcaagcttgagtgcccttgccctgcatgagcactacgtccagcaggacgttgagctgaggctgctgccctccgcttgccccgagagaggcggaggtgccggaggggctggccttcacttcgccggtcaccgcaggagggaagagggcccagccccaaccggatcccgcccacgcggtgctgccgaccaggagctggagctactccgggagtgtctgggagccgctgtgccagcacggctgcgcaaagtggcctcagccttggtgccaggcagaagagcgctgcccgtacctgtttatatgcttgtgccagcccctgctcccgcacaggaggacgattcttgtacagattcagcagaggggaccccagtgaatttttcaagtgcagcttccctgtctgatgagactctgcagggaccacctagggatcagccagggggtccagcgggtaggcagcgacccacaggaaggcctacctctgcacggcaggccatgggccaccggcataaggccggaggagccggtagatccgccgaacaatccaggggcgcaggaaagaaccgagcaggactggagctgcccttagggagacctccatcagccccagccgacaaggacggcagcaagccaggtaggaccagaggcgacggagccctgcagtccctatgcttgacgacacccaccgaagaggccgtgtactgcttttacggaaacgacagcgatgaagaaccccctgccgcagctccaacacctacgcatagaaggacctccgccattccacgcgcatttacaagagagcgtccacagggtaggaaggaagcccctgcaccatccaaagctgcaccagccgcacctccacctgcccgtactcagccgtcacttatagctgatgaaactcccccatgttacagtctttccagcagcgcttccagcctgtccgaaccagagccctcggagcctcctgccgtccatccaaggggtcgggagcccgcagttaccaaagatcccggacctggcggagggagggacagctctccgagtcctcgtgcagctgaggaactgctgcagaggtgtattagtagcgctctgcctcggcgtagaccacccgtctccggcctcaggcggagaaagcctagagcaacaagactcgatgaaagacccgctgaggggtcacgagagagaggcgaggaggctgctggcagtgaccgagcctcagatctggacagcgtggaatggagggcaatacaggaaggcgctaacagcatcgtcacatggctgcatcaggcagccgctgccacacgcgaggcatcttccgaaagcgattccatcttgagctttgtcagtgggctgagtgttggctccacgctgcagcctccgaaacacagaaaaggcagacaggcagaaggtgagatgggctccgcgcgtcggcctgaaaagcggggagccgcttcagtgaaaacctctgggagccccaggagtcctgccggtcctgaaaagcccaggggcacccagaaaaccacacctggcgtgcctgctgtgctccgcggtcgcacagtgatctatgttccttcgcctgcacccagggcacagccgaaaggaactcctgggcctcgtgccaccccacgtaaggttgcccctccgtgtctggctcagcccgcagccccagctaaagtccctagcccaggccaacagcggtcccgatccctccatcggcctgcaaagacatcagagctggctaccttgtctcagccccctcgatccgcaaccccccctgccagactggctaaaacaccttcctcatccagctcccaaacatctcctgcctcacaacctctgccgcgaaaacgccctcccgtcacgcaggcggctggggctcttcctggaccaggggcttctcccgttcctaagacccctgccagaaccttgctagcaaaacagcacaagacccagcgcagtcccgtcaggataccatttatgcagcgtcccgcaaggagaggtccaccaccccttgcaagagccgtgcccgagccaggaccgagaggaagagccggtacagaggcaggaccaggagccaggggcggtcgcctagggcttgtgcgcgtggcaagtgctctgtcatccggtagcgagagttccgatcgtagtgggttccgcagacaactgacctttatcaaggagtcaccagggcttcggagacgacgcagcgaactgagttctgccgagagcgcagcctctgcgcctcagggagcctcccctcgaaggggtcgccctgccctacccgcagtcttcctgtgcagctccagatgcgaggagctgcgtgccgcaccccgtcaggggcctgccccagctcgccagaggcccccagcagcacgaccatcccctggggaaaggcctgcacgccgtaccacttccgaaagtcctagtagactcccagtcagagcacccgcagcaagaccagaaactgtaaagaggtatgcttcactgccccacatttccgttgcaagaaggcctgatggtgctgtgcccgctgctccggcttcggccgacgctgcacggaggagctcggatggcgaacctcgtcctctccctcgcgtagcggcaccagggaccacatggaggcggatccgcgacgaggatgtcccccatatcctccgtagtacacttcccgctacagcgctccccctgcgaggttccacaccagaggacgcacccgctggccctcccccaagaaagactagtgacgccgtcgtgcagaccgaggaagtggccgcacctaaaaccaatagctccacaagtccctcacttgaaacgcgggaacctccaggcgcacccgcagggggtcagcttagccttctcggtagcgacgtggacggccctagtctcgccaaggcccctatcagtgctccctttgtgcacgaaggcttaggtgtcgcagtgggtgggttccccgcttctcggcacggttcacctagtaggtccgctcgggtgccccctttcaattatgtgccatcacctatggtagtagcagctacgacagactccgccgcagaaaaggctccagcaacggcttccgccaccttgttggagtac

SEQ ID NO: 239078 - DNA, 438 bp, Artificial Sequence
  Description of Artificial Sequence: Synthetic coding sequence
atggcagaggtagagcagaagaagaaacgcaccttccgcaaattcacctacaggggtgtggatctcgaccaattgctggatatgtcctatgagcagctgatgcaactctacagcgctcgccagagacggcgactcaatcggggacttaggaggaaacagcactcgttactgaaacgactgagaaaggccaaaaaagaggcccctcccatggagaagcctgaggttgttaaaacacacttgcgtgacatgatcatccttccggagatggtggggtctatggttggcgtgtataacggcaagacttttaatcaggtggagattaaacctgaaatgataggacattatctgggggaatttagcattacctacaaacccgttaagcatggccgacccggtataggagctactcattcaagcaggttcatccccctgaaatag

SEQ ID NO: 239079 - DNA, 393 bp, Artificial Sequence
  Description of Artificial Sequence: Synthetic coding sequence
atggttcggatgaacgtgttggcagatgcactcaaaagtatcaacaatgctgagaaaagaggaaagcgccaggtattaatccgtccttgttccaaagtcatcgtcaggtttctgaccgtgatgatgaagcacgggtacatcggagagtttgagattattgacgaccatcgggcagggaagatcgtggtgaacctgactggccgtctgaacaagtgcggcgtgatcagtccccgttttgatgtgcagctgaaggacttagagaagtggcaaaataacctactgccatctcgccagttcgggtttattgtgctgactaccagcgcaggcatcatggaccacgaggaggccagacggaagcatacaggcggtaagatcctagggtttttcttctag

SEQ ID NO: 239080 - DNA, 393 bp, Artificial Sequence
  Description of Artificial Sequence: Synthetic coding sequence
atggtccgtatgaatgtgttagccgacgccctgaaatccatcaataacgccgaaaaaagaggaaagaggcaggtactgattcgaccatgcagcaaggtcatcgtgcggttcctcactgtgatgatgaagcacggatacataggagaatttgagatcattgacgaccatagggcgggtaagattgtggtcaatctcacaggacggttgaacaagtgtggggtgatcagccccaggtttgacgtgcagctaaaggatctggagaagtggcagaataatctgctcccatctcggcaattcggattcatcgtgcttaccacgtccgccggaataatggaccacgaggaagctaggcgcaaacacacaggcggaaagatcctgggttttttcttctag

SEQ ID NO: 239081 - DNA, 441 bp, Artificial Sequence
  Description of Artificial Sequence: Synthetic coding sequence
atgccatctaaaggcccactgcagagtgtgcaggtgtttggtcgaaaaaaaacggccacagctgtggctcactgcaaacgagggaacggtctgatcaaagtgaacggcaggccgctggaaatgatcgagcctaggacactgcagtacaagctactcgaaccagtcctgctgctaggaaaggagagatttgccggtgttgatattcgcgtgagagtgaagggcggtggacacgtggcacagatctacgccatcagacagtccatttctaaagccttagtcgcatattatcagaaatacgtggacgaggcatctaaaaaggagattaaggatattttaatccagtacgatagaaccctgctggtcgccgatccacggaggtgcgaaagcaagaaatttggcggaccaggggcaagggcacggtatcagaaaagctaccggtag

SEQ ID NO: 239082 - DNA, 459 bp, Artificial Sequence
  Description of Artificial Sequence: Synthetic coding sequence
atgccatccaagggacccctgcagagcgtgcaggtttttggcaggaaaaaaaccgccacggccgttgctcattgtaagcgcggaaatggattgattaaggtaaatgggagaccattagagatgatcgaacccaggacactccaatacaagctcctggagcctgtgctgctactgggcaaggagcgctttgccggagtggacatacgggtaagggtgaagggtgggggacacgtcgcccagatctacggtgagtcccaagagctaggtgcctggaggcgatggttatgggaggggggactgcattccgctccagttccattcaactgtgtgtctttttctcaattatccgtgagcccaagccctaaaccatggtggccaattacccggaacatgtggatgcgcctgccacgccgacgcagtaagacctcttctagctccatgacaggcccttgttggtag

SEQ ID NO: 239083 - DNA, 408 bp, Artificial Sequence
  Description of Artificial Sequence: Synthetic coding sequence
atgggcagagttagaacgaagaccgtcaaaaaagcagcacgagtgattattgaaaaatactatacgcgactcggtaacgacttccacacgaataaacgagtttgtgaggagatcgccatcattcccagcaagaaacttaggaataagatcgcgggatatgtcactcaccttatgaagcgcatacagagaggcccagtacgcggtatcagtattaaactgcaagaggaggagagagagagaagagacaactatgtgccggaggtgtcggcactcgatcaggagattatcgaggtggacccagataccaaggagatgttgaagctgttggacttcggctccctgtccaatctgcaagttacgcagcccacagtcgggatgaactttaaaacccccagagggcctgtgtag

SEQ ID NO: 239084 - DNA, 300 bp, Artificial Sequence
  Description of Artificial Sequence: Synthetic coding sequence
atggacctgatagggttcggatacgcagctctggtgaccttcggatcgatcttcgggtacaaacggagaggcggagtgccctcccttatcgcgggactttttgtcggttgtctggccggatatggagcatatcgcgtcagtaacgataagagagacgtaaaagtttcgctgtttacagccttcttcctggctacaattatgggcgtacgcttcaaacggtctaaaaaaataatgcccgctggcttggttgctggtctgagcctgatgatgattctccgcctcgtgcttctccttttatag

SEQ ID NO: 239085 - DNA, 459 bp, Artificial Sequence
  Description of Artificial Sequence: Synthetic coding sequence
atgagtctcgtaatccccgaaaaatttcaacatatattgagagttctcaatactaatatcgatggacggcgtaagattgctttcgctattacagcaatcaagggggtggggagaagatatgcacacgttgtgctaaggaaggcagatatagatttgacaaaaagagctggcgagctcacagaggatgaggtggaacgagtgatcaccatcatgcagaacccccgacaatataagattccggattggtttctcaacaggcaaaaggacgtgaaggatggaaagtacagtcaggtgttggcaaatggcctagataacaaacttagggaggacctggagaggttgaagaagattagagcacacaggggtctcagacatttctgggggctgcgggtgcgagggcaacatactaaaacaaccggcagaaggggccgaaccgttggggtaagcaaaaagaaatag

SEQ ID NO: 239086 - DNA, 459 bp, Artificial Sequence
  Description of Artificial Sequence: Synthetic coding sequence
atgtctttggtaattcccgaaaaatttcagcatatactgcgagtgcttaacacgaacattgacggcagacgcaaaatcgcattcgccatcactgctatcaaaggtgtgggtcgaagatacgcccatgtggtgctccgaaaagccgacatagatctcactaaacgcgcaggagaactaaccgaagatgaagtggagcgagttatcaccattatgcagaatccgagacaatataaaattcctgactggttcctcaatagacaaaaagacgttaaggatggaaagtattcccaagtgcttgccaatggtttggataacaagctgcgcgaggacctggagaggcttaaaaagataagagcccaccgcggtctcaggcacttctggggtctgagggtccgcggacaacatacaaaaactaccggcaggcgaggacgtacagttggcgtgagtaagaagaaatag

SEQ ID NO: 239087 - DNA, 105 bp, Artificial Sequence
  Description of Artificial Sequence: Synthetic coding sequence
atgtcgctggtgatccccgaaaagttccagcacatcttgagagtgcttaacaccaatattgatggcagaaggaagattgcctttgctataaccgctatcaaatag

SEQ ID NO: 239088 - DNA, 459 bp, Artificial Sequence
  Description of Artificial Sequence: Synthetic coding sequence
atgtctctagtgattcctgagaaatttcagcacattctaagagtccttaacaccaacattgacggtagacggaaaatcgccttcgccattactgccattaaaggtgtgggcagacgttatgcacacgtagtgctcaggaaggcagatatcgatttaaccaagcgcgctggtgaattaacagaggatgaagttgagcgagtcattacaatcatgcagaatccgcgacagtataaaatcccggactggtttctgaaccggcagaaagacgtcaaggatggcaaatactcacaggtgctggccaacggactggacaataaactgagagaagatttggaacggctcaaaaagataagagcccaccgcggactccgccacttctggggactcagggtgagaggacagcatacgaagactacaggcaggagagggaggactgtgggagtgtcaaaaaaaaaatag

SEQ ID NO: 239089 - DNA, 459 bp, Artificial Sequence
  Description of Artificial Sequence: Synthetic coding sequence
atgtcgctagtcatcccagagaaatttcagcacattctgcgggtgctgaataccaatattgacggtagacggaagattgcatttgccattaccgctataaaaggtgtcggaaggcgctacgcgcacgtggtattgagaaaggctgacattgacctcacaaagcgcgcaggagaactgacggaggatgaggtagagagggtgattacaattatgcagaatccacggcagtacaagatcccagactggttcttgaaccggcagaaggatgtcaaggacggaaaatatagccaggtgctggctaatggactcgataacaaactgagagaagatctggaacgcctgaagaaaatcagagcccataggggcctgcggcacttctggggtctaagagtcaggggccaacacaccaaaacaacaggacggagaggtcgaaccgtgggagtctccaagaaaaagtag

SEQ ID NO: 239090 - DNA, 249 bp, Artificial Sequence
  Description of Artificial Sequence: Synthetic coding sequence
atgcagaatcccaggcaatacaagatcccagactggttcctcaatcgacagaaggacgtgaaggacggcaagtactcccaggtgcttgccaacggcttagataataagctgcgcgaggacctcgagcgtctgaaaaagattagggcacatcgtggtcttcgtcacttttggggcttgcgtgtcagaggacagcacactaaaacaactggcagacggggtcggacggtaggcgtgtcaaagaaaaaatag

SEQ ID NO: 239091 - DNA, 249 bp, Artificial Sequence
  Description of Artificial Sequence: Synthetic coding sequence
atgcagaatccccgacagtataagatccctgattggttcttgaatcgtcagaaagacgttaaggacggaaaatattcccaggtactggccaacggcctggataataaattgcgagaggacctagagcgcctcaagaaaatccgtgcacaccggggtttacgtcacttctggggtttgcgggtgagaggacagcacacaaagacgacaggacggagaggccgaaccgtgggtgtttcaaagaaaaagtag

SEQ ID NO: 239092 - DNA, 249 bp, Artificial Sequence
  Description of Artificial Sequence: Synthetic coding sequence
atgcagaatcccagacagtacaagatccccgattggttcctgaacagacagaaagacgtcaaggacggaaagtattctcaggttctggctaacggcttggacaacaaactgagagaggacttagagcgattgaagaagattagggcacatcgcggtctaaggcatttctgggggctgcgcgtccgtggacagcatacaaagaccaccggcaggagaggccgaaccgtaggggtgagcaagaaaaagtag

SEQ ID NO: 239093 - DNA, 249 bp, Artificial Sequence
  Description of Artificial Sequence: Synthetic coding sequence
atgcagaatcctagacaatacaagatccccgactggttcctcaatagacagaaggacgtgaaggatggcaagtattcacaagtccttgctaacgggcttgataataaacttcgtgaggacctggagcggctgaaaaaaatacgggcacatcgtgggctgcggcacttttggggcctgagggttcgcggtcagcacaccaaaacaactggaagacggggaagaaccgtcggcgtgtccaagaaaaagtag

SEQ ID NO: 239094 - DNA, 249 bp, Artificial Sequence
  Description of Artificial Sequence: Synthetic coding sequence
atgcagaacccccgacaatacaagattcccgattggttcctgaacagacagaaggacgtcaaagacggcaagtatagccaggtccttgctaacgggcttgataataagctgcgggaggacctcgagcggttaaagaagatccgggctcaccggggactgcgacacttttggggcttacgggtgagaggtcagcacaccaagaccacaggcagacgcggaagaactgtgggtgtgtccaagaaaaagtag

SEQ ID NO: 239095 - DNA, 648 bp, Artificial Sequence
  Description of Artificial Sequence: Synthetic coding sequence
atgtactccttcatggggggtggtctgttttgtgcatgggtgggaacaatccttttagttgttgccatggctaccgatcactggatgcagtataggttgtcaggcagcttcgctcaccaggggctctggagatactgtcttggcaacaagtgctacctgcaaaccgacagtattggtgagcccccaggccaaggccctggacgagcgtggggcaagagcagagcagacttaggagcacaaggtcatctgtactccaggtggagaactctcagacttaaggaaggaaagggtgccacacaagcatactggaatgccacacgggcattcatgatcctctccgccctgtgtgccatttcaggcatcataatgggaattatggctttcgctcatcagccgacctttagccggatcagcaggccattttccgctggaatcatgttcttctcatctacgctgttcgttgtgctggcgctggcgatttataccggtgtgactgtgtcattcttgggccgacggtttggagattggcggtttagttggtcctacatactggggtgggtagcagtattgatgacattttttgcaggcattttctacatgtgtgcgtacagagtccatgagtgtaggagattgagcacaccaagatag

SEQ ID NO: 239096 - DNA, 438 bp, Artificial Sequence
  Description of Artificial Sequence: Synthetic coding sequence
atgcctggtgtgaccgtcaaagatgtgaatcagcaggagtttgtacgcgcattggctgccttcctcaagaagagcggaaaactgaaagttcccgaatgggtggatacagtcaaactcgcaaagcataaagaactcgccccttatgatgagaactggttctacacacgggctgcatcaaccgcccgtcacctgtaccttaggggtggagccggagtcggctctatgactaaaatctatgggggacgccagcggaacggcgtaatgccttcccacttttctcggggatccaagagtgtggccaggagggttttgcaggctctggaagggctgaaaatggtcgaaaaggaccaggacgggggacggaagctgactcctcagggccaaagagatctggaccgtatcgccggtcaggttgcagccgctaacaaaaagcactag

SEQ ID NO: 239097 - DNA, 411 bp, Artificial Sequence
  Description of Artificial Sequence: Synthetic coding sequence
atgagtgcagctctattacggcgtggcctggaattactggctgcatcagaggctcctcgcgacccacccggacaggcaaaacccagaggagcccctgtgaagcggccacgcaagactaaagcaattcaggcgcagaaactgcggaactccgcgaagggcaaagtccccaagtcggcccttgacgagtacaggaaacgcgagtgtagagatcacttgcgggtgaatctgaaatttctcacccgcactaggtctacagtggccgaaagcgtctctcagcagatcctccggcagaaccgcggtagaaaggcctgcgatcggccagttgccaagactaaaaaaaagaaagctgagggtaccgtgtttaccgaagaggacttccagaagtttcaacaagaatatttcggatcatag

SEQ ID NO: 239098 - DNA, 882 bp, Artificial Sequence
  Description of Artificial Sequence: Synthetic coding sequence
atggcggatgacgctggagctgctggcggtcctggaggccctggcggacccggaatgggcaatagaggcggatttcgaggtggcttcgggtctggcattcggggacggggtcgcggaagggggcgaggccgagggcgtggacgcggagcgagggggggtaaggctgaggataaggaatggatgcctgtgaccaagctaggccgtctggtgaaagatatgaagatcaaaagcttggaggaaatttacctgttttctttgcctatcaaagaatccgagattatcgatttctttttaggagctagtctgaaagacgaggtgttgaaaatcatgccagtgcaaaagcaaactcgagccggacaacgcactcgcttcaaggcgttcgtggcaataggtgactacaacggacacgtggggctcggtgtgaagtgctctaaagaagttgcgactgccatacgaggggcaattattctcgcaaagctctccatcgtgcctgtccgcagagggtactgggggaacaagattggaaagccacatacagtgccctgcaaggtgacaggaagatgcgggagcgtgttagtccggctgattcctgcaccgagaggtaccgggatagtcagtgctcccgtgcccaagaaattgctgatgatggccggtatagacgattgttacacctccgccaggggatgcacagccacactcggcaacttcgccaaggccacatttgacgcgatttccaaaacgtatagttatttaacacctgacctgtggaaggaaacggtgttcactaaatctccataccaagagtttacagaccacctcgtgaagacgcacactagagtctccgtgcagcgtacacaggcacccgctgtggccacaacgtag

SEQ ID NO: 239099 - DNA, 708 bp, Artificial Sequence
  Description of Artificial Sequence: Synthetic coding sequence
atggcagacgacgccggtgctgccggagggcctggtggacctggcggaccaggcatggggaatagggggggatttcgcggaggctttgggtcgggcattcggggtcggggacggggtagagggagaggcagaggacggggaagaggagctagggggggaaaagcagaagataaagaatggatgccagttacgaagctaggaaggctggttaaagatatgaaaatcaaatctttagaagagatttacctgttttcactgccaattaaggagtcagaaatcattgacttttttctcggagccagtctgaaggacgaagttctcaaaatcatgcctgtgcagaagcagacacgcgcaggccagagaaccaggttcaaggttactggccgatgcggatctgtgctggtacgattaattccggctccaagggggaccggaatcgtcagtgctcctgtcccaaaaaagctgctgatgatggctggcattgatgattgttatacctccgcccgtggctgcacagcaacgctgggcaattttgccaaagctacatttgacgccattagtaagacctatagctatctgaccccagatctttggaaagagacagtctttaccaagtcaccataccaagagttcaccgatcacctcgttaaaacacatactcgagtcagtgtgcagcggacgcaggctcccgctgtagccaccacctag

SEQ ID NO: 239100 - DNA, 537 bp, Artificial Sequence
  Description of Artificial Sequence: Synthetic coding sequence
atggcagatgacgctggtgccgcaggtggcccagggggtccagggggtccgggaatgggaaatagggggggatttcggggaggctttggttcaggcatcagaggcaggggaaggggtcggggacgcggaaggggaaggggtagaggcgctagggggggaaaagccgaggacaaagaatggatgccggtaaccaaacttgggagattggtcaaggacatgaaaattaagtctctagaagagatttatctgttcagtctgcctattaaagaatcggaaattatcgatttctttctgggcgcttcattgaaagacgaggtgcttaagatcatgccagtgcagaagcagacccgggcaggccagcgaacccgttttaaggtgcccggatgccccggaggaggctgcgcaggcctagctggcacactgtctgcccttcattcttgtacttggctgcacccttgcgactttcgtaatggcgagagagaaaagcggagtcctcaggatctgggatgggctctcttgtggcctttattcccttag

SEQ ID NO: 239101 - DNA, 588 bp, Artificial Sequence
  Description of Artificial Sequence: Synthetic coding sequence
gtgacaaagctgggcagattggtgaaggacatgaaaatcaagtccctcgaagaaatctatctttttagcctgcccataaaggctttcgtcgccatcggggactataacggtcatgtgggtcttggagtgaagtgctctaaggaggtggcaaccgccatccggggagctatcattctggccaaactgtcaatcgtcccagtcaggagggggtactgggggaataagattggaaaaccacacactgtgccatgcaaggttaccggtagatgtggtagtgttcttgtgaggctcatcccagcaccaaggggcactgggatcgtgtctgcccctgtgccaaaaaagctgctaatgatggccggtatcgatgactgctacacctctgctcgcggatgtacagccactttgggcaatttcgctaaagcgacttttgacgcaatctctaagacatatagctatctcacacctgatctgtggaaagagacagtattcactaagagcccataccaagagtttactgaccacctggttaagacacacacacgtgtatcagtgcaaaggactcaggcccctgcggtggccaccacttag

SEQ ID NO: 239102 - DNA, 360 bp, Artificial Sequence
  Description of Artificial Sequence: Synthetic coding sequence
atggcattcaaagataccggcaaaactcctgtggagccagaagtggcaatccaccgcattcgtatcacgctcacctccaggaatgttaaaagcctggagaaagtctgtgccgatctaatccgtggtgccaaggagaaaaatctgaaagttaagggcccagttagaatgccaacaaagacccttcgtatcacaacgcgaaaaactccttgcggggaaggctcaaaaacctgggaccggttccagatgaggattcataagagactgattgaccttcattcacctagtgagatcgttaaacaaattaccagtatcagcattgagccgggtgttgaagtcgaggtgactatagccgatgcttag

SEQ ID NO: 239103 - DNA, 429 bp, Artificial Sequence
  Description of Artificial Sequence: Synthetic coding sequence
atggccttcaaggacaccgggaagacgcctgttgagcccgaggtagccatccacagaatccgtataactctcacttcccgcaacgtgaaatcactcgagaaagtctgtgcagatctgattagaggggcaaaggagaaaaacctcaaggtgaagggaccagtgaggatgcctaccaagaccctgcgcatcaccacccggaaaacaccatgtggagagggctcaaagacgtgggatcggttccagatgcggatccataaaagattaatcgacttgcacagtccctccgaaattgtgaaacagataacttccatctccatagagccgggagtagagttgatagagagcactgatgccgaacccatggatacagagggacagcaatacactctgcggtctgtattcgaatcacccggaacgtgccccttttag

SEQ ID NO: 239104 - DNA, 360 bp, Artificial Sequence
  Description of Artificial Sequence: Synthetic coding sequence
atggccttcaaggacaccggcaagacacctgtggagcccgaagtcgccatccatagaatcagaatcaccctcacctcccgaaacgtgaagagtctcgagaaggtgtgtgctgaccttatccgaggcgcaaaggagaagaacctcaaggtcaagggaccagtccgcatgccaaccaaaacccttagaattacaacgaggaaaaccccgtgcggcgaaggatccaaaacctgggatcgcttccagatgcgcattcataaacgtctgattgacctgcacagcccttctgagattgttaagcaaattacaagcattagcattgagccaggcgtggaagtggaggtgaccattgctgatgcttag

SEQ ID NO: 239105 - DNA, 252 bp, Artificial Sequence
  Description of Artificial Sequence: Synthetic coding sequence
atgcagaacgacgccggagagttcgttgatttgtatgtcccaagaaagtgttctgcatccaacagaatcataggggcaaaggatcacgctagtatccaaatgaacgttgccgaagtggacaaagtgactggcaggttcaacggccaattcaagacgtatgctatctgcggagcgattaggcgcatgggggaatcagatgacagcatactgagattggcaaaggccgatggaattgtgagtaaaaatttttag

SEQ ID NO: 239106 - DNA, 294 bp, Artificial Sequence
  Description of Artificial Sequence: Synthetic coding sequence
atgcaaaatgatgccggagagtttgtggatctgtacgtgcctaggaaatgcagcgccagcaaccgtatcattggcgctaaggaccacgctagcatacagatgaatgttgccaggctgacaaggtcccaggcgggacttatggcatcactgaagctgatgctctccgctggtccatttgtggggtgggtgagccagatgatccccttctccgattggccacggagatggcaccggctcaaagaactcctgaccggggaaaaccataggtgtgggatatttgtaatcaacaagtag

SEQ ID NO: 239107 - DNA, 252 bp, Artificial Sequence
  Description of Artificial Sequence: Synthetic coding sequence
atgcagaacgacgccggtgaattcgtggacctatacgtgcccagaaagtgctccgcttctaaccggatcatcggtgccaaagatcacgcaagcattcagatgaacgtggctgaagtggataaggtcacaggacgcttcaatggacagtttaaaacctatgctatttgcggcgctatccgcagaatgggagagagcgacgacagcatcctacggctggcgaaagcagatggcattgtgtcgaagaatttctag

SEQ ID NO: 239108 - DNA, 201 bp, Artificial Sequence
  Description of Artificial Sequence: Synthetic coding sequence
atgcagaacgacgcgggagagtttgttgacctctacgtaccacggaagtgctcagcttccaacaggatcatcggtgctaaagaccatgcaagcatccagatgaatgtagctgaggtttcatgggaacctggtaggagggaaggttgtgatatttgtgctgggaaggccggttgcccaatcgtcgaagagccgctgggttag

SEQ ID NO: 239109 - DNA, 273 bp, Artificial Sequence
  Description of Artificial Sequence: Synthetic coding sequence
atgcagaacgatgctggcgagttcgtcgacttgtacgtaccgaggaagtgtagtgcctccaaccgcattattggcgcaaaggaccacgcaagtatccaaatgaatgtggctgaagtggacaaggtgactggcaggttcaacggacaattcaagacctacgccatttgtggagcaatcagaagaatggtgtcggttagtctgggctttgcacaccacttcggaacgtcctggaccctcccctgtgcactggagtgcgtaatggtgccagagtag

SEQ ID NO: 239110 - DNA, 246 bp, Artificial Sequence
  Description of Artificial Sequence: Synthetic coding sequence
atgcagaatgatgccggagaatttgtagacctgtacgtgccgaggaaatgttctgcttcaaaccgcattattggagcgaaagaccatgccagcattcagatgaatgtagccgaggtggacaaggtgaccgggaggtttaacggccaattcaagacctacgcaatctgtggcgcaatcaggcggatgggggaatccgatgattccattctcagactggccaaggccgatggaatagtgtctaagtag

SEQ ID NO: 239111 - DNA, 432 bp, Artificial Sequence
  Description of Artificial Sequence: Synthetic coding sequence
atggggaaatgtaggggcttaaggaccgccagaaaattaaggtctcacaggcgggatcagaagtggcatgataagcagtataaaaaagcccatctgggaacagctctcaaggcaaatccatttgggggtgcaagtcatgcaaaaggcatcgttttggagaaagtcggagtggaggcaaagcaacccaactcagccatacgcaagtgcgtgcgtgttcaacttataaaaaatggaaagaaaattaccgcttttgtgcccaatgacggttgtttgaacttcattgaggagaatgatgaggtcttagtcgccggttttggaagaaaggggcatgccgtcggagatatccctggagtgcgcttcaaagtggttaaagtcgcaaacgtgtctctgcttgctctgtacaagggcaaaaaagaacgcccaaggtcatag

SEQ ID NO: 239112 - DNA, 393 bp, Artificial Sequence
  Description of Artificial Sequence: Synthetic coding sequence
atgaatgacactgtaacaattcgcacacggaagtttatgactaacagacttctgcagcggaagcaaatggtgatcgatgttcttcacccgggaaaagccaccgtcccaaagacagaaatcagggaaaaactggccaaaatgtataagacaacgccagatgtgatcttcgtgtttggctttcggacacacttcgggggaggcaagacaaccggattcggcatgatatacgactctctggactacgctaagaaaaacgagccgaaacatcgattggcacggcacggcttatacgagaaaaaaaagacctcccggaaacaacgcaaagaaagaaagaacagaatgaagaaggtgcggggaaccgcaaaggcaaatgtgggtgccggaaaaaagtag

SEQ ID NO: 239113 - DNA, 402 bp, Artificial Sequence
  Description of Artificial Sequence: Synthetic coding sequence
atgaacgacactgtgaccattcgaacgcggaagtttatgactaaccgcctgttgcagcgcaagcagatggtcatcgatgttctgcaccccggaaaggccacagtaccgaagaccgaaatccgggagaagttggcaaaaatgtacaaaactacacctgacgtgatcttcgtattcggttttcgaactcacttcggaggaggcaaaacgaccggatttggcatgatttacgattctcttgactacgccaagaaaaacgaacctaaacacagactcgctcgccacggtttgtacgaaaaaaaaaaaaccagtaggaaacagcgaaaagagagaaagaatcgaatgaagaaagtcaggggcacggccaaggctaacgtgggggctggcaaaaaacccaaggaatag

SEQ ID NO: 239114 - DNA, 399 bp, Artificial Sequence
  Description of Artificial Sequence: Synthetic coding sequence
atgaacgatactgtgactatcaggaccaggaagtttatgactaaccggctcttgcagagaaaacagatggtgatagacgtgttacatccaggtaaagcaacggtacctaaaaccgagattagagagaaactggccaagatgtacaaaactaccccagacgttatcttcgtgttcggattccgaacccactttggtggcggaaagactacagggtttggaatgatctacgattccctggactatgccaaaaagaatgaacccaagcacaggctagcgaggcatggactttacgaaaaaaaaaaaacctcccggaagcagcgcaaagagagaaagaatcgcatgaagaaggtgcgcggaacagcgaaggctaacgtgggggcaggaaagaagcagaagtag

SEQ ID NO: 239115 - DNA, 396 bp, Artificial Sequence
  Description of Artificial Sequence: Synthetic coding sequence
atgaatgacaccgtgacaatccgtactaggaagtttatgacaaacaggctcctgcagcggaagcagatggtgatagacgtcctgcacccaggcaaagcgaccgtgcccaaaacagaaatacgggagaaactggccaagatgtataagacaactcctgacgtgatcttcgtcttcggatttagaacacactttggcggaggaaagaccaccgggttcggaatgatctatgactctcttgactacgcaaagaagaacgaaccaaaacacagacttgcacgccacgggctatatgaaaagaaaaagacctctcgcaagcagcgcaaggagagaaaaaatcgcatgaagaaggttaggggcactgccaaagcaaacgtgggcgcagggaagaagcagtag

SEQ ID NO: 239116 - DNA, 870 bp, Artificial Sequence
  Description of Artificial Sequence: Synthetic coding sequence
atgaacgataccgtaacaattcggacgcggaaatttatgacaaatcggttgctgcagcggaagcagatggtgattgacgttctccatccaggcaaggcaacagtgcccaagacagagataagagagaagttggccaagatgtataaaacaacgcctgacgttatctttgtgtttgggtttcggactcacttcggtggaggaaagaccaccggtttcggaatgatttacgactctctggattatgctaagaaaaacgaaccaaagcacaggctcgctaggcatggcctgtacgaaaagaaaaaaaccagccggaagcagcggaaggaaaggaaaaaccgaatgaagaaggtgcgtgggaccgctaaggctaatgtcggtgcaggtaagaaaatgagagaactcggtctcggtgtgcaggcgctgggaaggattagtcaggaagagaggtgcacggacgtcaaaaacagcaaagccagggaaagcaggggggttgtgtggcaggtagaagtacctggtccttggagcgtgtggacctgcggcagattacggaggggttgcggcaagtatctccaagtggctgttacttggaggaagacggagaaccgagagcagtgttgtcaggcctgtttgcttgagcgcgcactagttcgcaacggcgcatttatgagcccagccagccctgcccctgccggaagcccccacccagttgatggcgacctcgttctgcacctccctgaagccctatcagcgacattgacgttgtctcctcacattcaggccattaataaaagctttggtccattcttcgagatccaccaggagtcaagctgcttttcacctccttcgtgcctgtccggattaggccactag

SEQ ID NO: 239117 - DNA, 378 bp, Artificial Sequence
  Description of Artificial Sequence: Synthetic coding sequence
atgccccctaaggatgacaaaaaaaagaaggacgctggcaagtctgctaaaaaggataaggatcctgtgaacaaatccgggggaaaagccaagaaaaagaagtggagcaaaggaaaagtgcgagataaattgaacaatttagtgttatttgataaggccacatacgataaactctgcaaggaggttcccaactataagttgatcactcctgcagttgtgtccgaacgcctgaaaatcagggggagtctggccagggcagccttgcaggagctcctgtcgaaggggctgattaagctcgttagtaaacaccgcgcacaggtgatctacacaagaaacactaaaggcggagacgcacctgccgctggggaggatgcatag

SEQ ID NO: 239118 - DNA, 348 bp, Artificial Sequence
  Description of Artificial Sequence: Synthetic coding sequence
atgacaaaaaagagaaggaataacggaagagcaaagaaggggcgtggccacgtgcaacctatcagatgtactaattgcgcacgctgtgttcctaaagacaaggcgatcaaaaaattcgtgatccgaaatattgtggaagccgcagccgttagggatatctcagaggcgagcgtgttcgacgcttacgtgctcccaaagctgtacgttaaactgcactactgcgtgagctgtgctatccacagcaaagtcgttcgtaacaggagcagagaagccagaaaagatcgcactcctccaccgcgattcaggcctgcaggcgcagccccacgaccccctcccaaacctatgtag

SEQ ID NO: 239119 - DNA, 348 bp, Artificial Sequence
  Description of Artificial Sequence: Synthetic coding sequence
atgactaaaaagaggagaaataatggcagagcaaagaaaggtaggggtcacgtccagcccatccgttgcaccaattgtgcacggtgcgtgcccaaggataaggccataaaaaaatttgtcattcggaacattgtggaagccgcagcggtccgggatatctcagaggcatcagtctttgacgcatacgtgctcccaaaattgtatgttaaactgcactattgtgtttcttgcgccattcattcaaaggtcgtgcgaaacaggtctagagaggcaagaaaagataggactccacccccaagattccgacctgccggtgcggcacctaggcctcccccaaagcctatgtag

SEQ ID NO: 239120 - DNA, 255 bp, Artificial Sequence
  Description of Artificial Sequence: Synthetic coding sequence
atgccacttgctaaggatctattgcatcccagcccagaagaggaaaagaggaagcacaaaaagaagcggttggttcagagccctaattcttatttcatggatgtgaaatgtccaggttgctacaaaatcactacagttttctctcatgcacagaccgtcgtgttatgtgtgggctgctcgactgtcctgtgccagccaacagggggaaaagcaaggttgacggagggatgctcttttcggagaaaacaacactag

SEQ ID NO: 239121 - DNA, 201 bp, Artificial Sequence
  Description of Artificial Sequence: Synthetic coding sequence
atgccactggccaaagaccttttgcatccctctcccgaagaggaaaaacggaaacacaagaaaaagcggctcgtacaaagccctaattcttatttcatggacgtcaaatgccccggagaggaaactgcttgctgtagtggcgagtccaccgggccacagcagctggaaaatgtggtcgttttggctgtgagctacccctag

SEQ ID NO: 239122 - DNA, 255 bp, Artificial Sequence
  Description of Artificial Sequence: Synthetic coding sequence
atgcctcttgcccgagacttattgcacccttcactggaggaagaaaaaaagaaacacaaaaaaaaacgactcgtgcagtctcctaactcttatttcatggacgtgaaatgccccggatgctacaagattacgactgttttctcacatgcccagaccgttgtgctctgtgtggggtgcagtacagtcctgtgtcagcccacaggaggaaaagcccgactcaccgaggggtgctcctttcggcgtaagcagcattag

SEQ ID NO: 239123 - DNA, 159 bp, Artificial Sequence
  Description of Artificial Sequence: Synthetic coding sequence
atggatgtgaaatgccctggctgctacaagatcacaacagtttttagtcacgcccagacagtggtgctctgcgtgggctgctcaaccgtgctgtgccagcctactggcggaaaggctagactgactgagggatgctcatttcggaggaagcagcactag

SEQ ID NO: 239124 - DNA, 159 bp, Artificial Sequence
  Description of Artificial Sequence: Synthetic coding sequence
atggacgtgaagtgccctggatgctataaaataactaccgtcttttcccacgcccagacggtcgtcctatgtgtcgggtgttccaccgtactgtgccagccaactggaggtaaggccaggctgactgaagggtgttcctttcggaggaagcagcactag

SEQ ID NO: 239125 - DNA, 303 bp, Artificial Sequence
  Description of Artificial Sequence: Synthetic coding sequence
atgtgccagcgttgtggcctgaaactgatcgttatcatctgctttttcgtgcagctggccagagacctcctccacccctcactcgaggaagagaaaaaaaagcacaaaaagaagcgtctggtgcaaagcccaaattcttacttcatggatgtaaaatgcccaggctgctacaagattacaacagtattctcacatgcccagaccgttgtgctctgcgtcggttgttctactgtattatgtcaaccaacgggcggaaaagccagactcaccgaggggtgctccttccggaggaagcagcactag

SEQ ID NO: 239126 - DNA, 210 bp, Artificial Sequence
  Description of Artificial Sequence: Synthetic coding sequence
atggacaccagccgagtgcaaccaattaagttggcccgagttactaaggtcctgggaagaacaggaagccaaggtcagtgtacacaagtgcgggttgaatttatggacgacaccagccgatctatcatccgcaacgtcaagggacccgtgcgggagggagacgtgttgacactgctggagtccgagagggaagctcggcgtctgaggtag

SEQ ID NO: 239127 - DNA, 366 bp, Artificial Sequence
  Description of Artificial Sequence: Synthetic coding sequence
atggtgcctttcaatgacctctattccggcccagacacattcagtgagtttatctccgcatcgcactctgctgtaccctttaggggtcctcccctgctgctcccacctctcaggtgggggccagtgggggctagaggtatccacggacgccacgagcctatacatcacccacagtgtaaaagacccagggcccgtgggagacgcgcacatccatttggggttcgggcacgatctccggaggtcgctctttccctggctgctagatgggtgctcgatgtaggttttgatcacctggctgatggaaacggactctctcagtccgccccattcttctgccctcctcatgtgaccgagatgctcttgtag

SEQ ID NO: 239128 - DNA, 210 bp, Artificial Sequence
  Description of Artificial Sequence: Synthetic coding sequence
atggatacctctcgcgtacagcctatcaaactcgccagggtgactaaagttctgggacggactggttctcaggggcagtgcactcaggtccgcgttgagttcatggatgacacctctagatcaattatccggaatgttaaaggccctgtccgggaaggtgatgttcttacactgttggaaagtgaaagagaggctcgcagactgaggtag

SEQ ID NO: 239129 - DNA, 171 bp, Artificial Sequence
  Description of Artificial Sequence: Synthetic coding sequence
atgggccaccagcagctatactggagccaccctcggaaattcgggcagggatcccgctcttgtcgcgtgtgtagcaaccgacacgggctcatcaggaaatacggactgaatatgtgtaggcagtgtttcagacaatacgctaaggatatcggattcattaagctcgattag

SEQ ID NO: 239130 - DNA, 204 bp, Artificial Sequence
  Description of Artificial Sequence: Synthetic coding sequence
atgggccatcaacagctgtactggtcccaccccagaaagttcggccaggggtcaagatcatgccgggtttgctcaaataggcacggtctgatacggaagtacggcttgaatatgtgccggcagtgttttcggcagtacgcaaaggacattggatttatcaaaaaggacctgtcttgcctgccttggcattgtctatggagatag

SEQ ID NO: 239131 - DNA, 780 bp, Artificial Sequence
  Description of Artificial Sequence: Synthetic coding sequence
atggccgtacagatctcgaagaaacgcaagtttgtcgccgacggcatattcaaggccgaactgaatgagtttctgaccagagagttggccgaggacggctattctggcgtggaggtgcgtgtgacaccaaccaggacagagatcataatcctggccacacgaactcagaacgtccttggtgagaagggcaggagaatccgggaactgacagccgtggtgcagaagagatttggcttccccgaaggatcggttgagttaaagatcatggtgatggtgacaggataccctttactccctctgaaattatacgctgagaaagttgcgacccgcggtctgtgtgcgatagctcaggcggaaagcttgaggtataaattactgggaggcttagcagtgaggagagcatgctatggcgtgttgcggtttatcatggagtccggagcaaaagggtgcgaagtagtggtgtctggcaagctccgcggacaaagggctaagtctatgaaatttgtggatggcctaatgatccactccggcgaccccgtgaattactacgtcgacacggctgtgaggcatgtgcttctgaggcagggcgtgctgggcataaaagtgaaaattatgctcccttgggatcccacaggaaaaattggaccgaagaagccccttcccgaccacgtgagtatcgttgagccaaaagacgaaattctgcccacgactccaatttctgaacagaaagggggaaagccagagcctccggctatgccccagcctgtgcctacggcttag

SEQ ID NO: 239132 - DNA, 732 bp, Artificial Sequence
  Description of Artificial Sequence: Synthetic coding sequence
atggctgtccaaatttctaagaaacgcaaattcgtagcagacgggatcttcaaagcagagttgaacgaattcctgacccgcgaactggcagaggacgggtattccggcgttgaggttagagtcaccccgaccagaaccgagattattattctggccactaggactcagaacgttctcggagagaagggcagacggatcagggaactgacagctgttgtccagaagaggttcggcttccctgaagggagcgtcgagttgtacgctgagaaggtcgcaaccaggggactgtgtgccatcgcacaagcggagtccctccgatacaaactgttgggtggcctggccgttagacgcgcttgttacggcgtgctccggttcataatggaatcgggagccaaggggtgtgaggtcgtggttagcggaaaattgagagggcaacgggctaagtcaatgaaatttgtagatggcctgatgatccatagcggtgatcccgtaaactactacgttgatactgccgttagacacgttttgttaaggcaaggggtacttgggatcaaagtcaaaattatgttgccttgggaccctactggcaagatcgggccaaaaaaaccgctacctgatcacgtgagcatcgtcgagccaaaggatgagatcttgccaactacacccatttccgagcaaaagggcggtaaacctgaaccccctgccatgccccagcccgtgcccaccgcttag

SEQ ID NO: 239133 - DNA, 732 bp, Artificial Sequence
  Description of Artificial Sequence: Synthetic coding sequence
atggctgtgcagatctcgaagaaacgcaaatttgttgcagatgggatctttaaggctgaacttaacgagttcttgacccgggagcttgcggaggacgggtacagcggggttgaggtaagagtcaccccgacaaggacggagatcattattctcgctacacgcacacagaacgttctcggggagaagggccgaagaataagagagttgacagccgtcgtgcagaagagatttgggttcccagagggatctgtagagttgtatgcagagaaagttgccactaggggtctgtgcgcaatagcgcaagctgaatctctgagatacaaattgctgggcggattagcagtgcgcagggcttgctacggggtactcagattcattatggagagcggtgccaagggttgtgaagtggtggttagcggcaagttgcgcggacagcgtgcaaagtccatgaagtttgtggacggtctgatgatccactcaggagacccagtcaactactatgtagacactgccgtgcggcacgttcttcttagacagggagtactgggcataaaggttaagattatgttgccatgggacccgacaggaaagattggccctaaaaaaccgctccccgatcacgtgagtattgtggaacctaaagatgagatcctgcctacaacaccgatttcagagcagaagggtgggaagccagaaccccctgctatgccgcagccagtgccaacggcatag

SEQ ID NO: 239134 - DNA, 732 bp, Artificial Sequence
  Description of Artificial Sequence: Synthetic coding sequence
atggccgttcagatctccaagaagcggaagttcgttgcagatggcatcttcaaggcggagttgaacgagttccttacccgtgaactggcagaggatgggtattctggtgtggaggtacgggtgaccccaactaggacagaaataatcattctggcaacgagaacacagaatgttctcggcgaaaaaggtcgccgtatcagggagctgacagctgtcgtgcagaagcggttcgggttccccgaaggttctgtggagctgtacgcagaaaaagtcgccactcggggactgtgcgctatagcccaagctgagtccttgcggtacaaattactgggaggtctggccgtccgcagagcgtgttatggcgttctacggtttatcatggagtctggagcaaaaggctgcgaagtggtggtttccggcaaactcaggggccaaagagccaagagtatgaagttcgttgatggactcatgatccattcaggagatccagttaactattatgtagacactgctgtgcgccacgtcctgctgcggcagggagtcctgggaatcaaggtgaagattatgctcccctgggatcccactggaaagataggacctaagaagcctctccctgaccacgtaagtatcgtggaacccaaagacgaaattctccctaccacaccaatttcagagcaaaaaggtggaaagcctgaacctcctgctatgccacaacccgtgccaactgcatag

SEQ ID NO: 239135 - DNA, 795 bp, Artificial Sequence
  Description of Artificial Sequence: Synthetic coding sequence
atggcggtgggcaaaaacaagcgcctgaccaaaggcggtaaaaagggggctaagaaaaaggtggtcgacccattctctaaaaaggattggtatgatgtcaaagcccctgcgatgttcaacatccggaacattggaaaaacactagttacccggacgcagggaaccaagatcgccagcgacgggctaaaagggagggtattcgaagtcagcctcgctgacctccagaatgatgaagtcgcgttccggaaattcaaactcatcaccgaggacgttcagggaaagaactgtttgactaatttccatggtatggacctgacccgcgataaaatgtgcagcatggtgaaaaaatggcagacgatgatcgaggcccatgtagacgtaaagacaacggacggctacctcctgcgccttttctgcgtcgggttcacaaagaaacggaacaatcagatacggaaaacgagctacgcccaacatcagcaagtccggcagatccggaaaaaaatgatggagatcatgactcgggaggttcagacgaacgacctgaaggaagtagtcaacaaactgatcccagattcaatcggtaaggatatagagaaggcctgccaaagcatttacccactgcatgatgtgttcgtacgcaaggtcaaaatgctcaagaagcctaaattcgaactcggaaagctcatggagcttcacggggaaggctccagttctggaaaggccactggcgatgagactggcgctaaggtcgaaagagccgatggctatgagcctccagtacaggaatcagtttag

SEQ ID NO: 239136 - DNA, 528 bp, Artificial Sequence
  Description of Artificial Sequence: Synthetic coding sequence
atggcggttgccaagaagaaagtcgtggacccttttagcaagaaggactggtacgatgtgaaggcccctgccatgtttaacatacggaatatcgggaaaactcttgttaccaggactcaggggacgaagatcgcaagtgatggcttaaaagggagggtgtttgaggtgtcactggccgatttgcaaaatgatgaagtggctttccgcaaatttaagctgatcacagaagacgtgcaaggcaaaaactgtctgactaactttcacggaatggacctaacacgggacaaaatgtgcagcatggttaaaaagtggcaaaccatgattgaggcgcatgtagatgtgaagaccactgacggataccttttaaggctgttttgcgtgggcttcaccaaaaaacggaacaatcagattcggaaaacatcctacgcccagcaccagcaggtccggcagatcaggaagaagatgatggagatcatgacgcgagaagtgcagacaaatgacctcaaagaagtggtgaacaagctgtag

SEQ ID NO: 239137 - DNA, 684 bp, Artificial Sequence
  Description of Artificial Sequence: Synthetic coding sequence
atgtttaacattaggaacattggtaagaccctagtgaccaggactcagggcactaagattgcgtcagacgggcttaaaggccgtgttttcgaggtgtctcttgctgatcttcagaacgacgaggtggccttccgaaaatttaagctgattacagaagatgtgcaggggaaaaactgcctaactaacttccacggcatggacctcaccagggacaaaatgtgtagtatggtgaaaaagtggcagaccatgatagaagcccatgtggacgtgaaaaccaccgacggatacctcctgaggctcttttgtgtgggatttaccaagaagcgaaacaaccagatccgcaagacatcctatgcacaacatcaacaagtgcgtcagattcggaagaagatgatggagataatgactagagaagtgcagaccaacgacctgaaggaggtggttaacaaacttatacctgactcaattggtaaggacattgagaaggcctgtcagagcatttaccccctgcatgacgtgttcgtgcgtaaggtgaagatgctcaaaaagccaaagtttgaactcgggaaactcatggaactgcacggcgagggaagttcaagcggaaaggcaacaggggacgagacaggtgccaaagtcgagcgagctgatggatacgagcctccggtgcaggaatctgtgtag

SEQ ID NO: 239138 - DNA, 438 bp, Artificial Sequence
  Description of Artificial Sequence: Synthetic coding sequence
atgatcgaagcacatgtggatgtgaagaccacggacggttatttactcaggctgttctgtgtgggttttaccaagaaacgcaacaatcagattcgcaaaacgtcctatgctcaacatcagcaggtgcggcagatcaggaagaaaatgatggaaatcatgacgcgggaggttcagacaaacgatctgaaagaagtagtgaataaattgatcccagattctatagggaaggatattgagaaggcttgccagtccatctatcccctgcatgatgtcttcgttagaaaggtcaagatgctcaaaaagcctaagttcgagttgggaaaactcatggagctccatggggaaggttcaagctcaggaaaagccactggggatgagaccggcgcaaaggtggagagagcggatgggtacgagcccccagtgcaggagtctgtgtag

SEQ ID NO: 239139 - DNA, 684 bp, Artificial Sequence
  Description of Artificial Sequence: Synthetic coding sequence
atgttcaatatacgaaatatcggcaagacacttgtaacgagaacccaaggaaccaagattgcttctgacggactgaaaggtcgggtcttcgaagtcagtctagccgaccttcagaatgacgaggtcgccttcaggaaattcaagctgatcacagaagacgtgcagggcaaaaattgtctgaccaattttcacggaatggatctgacccgggataagatgtgcagtatggtcaagaaatggcagacaatgatcgaggctcacgtcgacgtgaaaacgaccgacggctatctgctgcgtctgttctgcgtcggctttaccaaaaagcggaacaaccagatcagaaagactagctatgcccaacaccaacaggtcaggcagatacgcaaaaagatgatggaaattatgactcgcgaagtgcagaccaacgacctgaaagaagtcgtcaacaagctgatccctgactcgattggcaaggatatcgagaaggcttgccagtctatttaccctttacacgatgtgttcgttaggaaagttaaaatgttgaaaaagcctaagttcgagttgggaaaactcatggaacttcacggggagggctccagcagtggcaaggcaaccggagacgaaaccggggctaaggtggagcgtgcggatggctacgaacctccagtgcaggaaagtgtgtag

SEQ ID NO: 239140 - DNA, 627 bp, Artificial Sequence
  Description of Artificial Sequence: Synthetic coding sequence
aaaaggttgaccaaggggggaaagaaaggggctaaaaagaaagttgtggaccctttctcaaagaaggactggtacgatgtgaaggctcctgcaatgttcaatattcggaacattgggaagactctggtgactcgaacacagggtaccaagattgcttccgacgggctcaaaggccgagtattcgaaactatgatcgaggcccacgtagatgtgaagaccactgatggatacctccttcgcctgttctgcgtcggatttactaagaaaaggaataatcagattagaaagacctcatacgctcagcaccagcaggtgcgccagattaggaagaaaatgatggagatcatgactcgggaggtccagaccaacgatctgaaggaagtagtgaacaagctgattcccgacagtatcggtaaggacattgagaaagcctgtcagtccatttatccacttcatgatgtattcgtgagaaaagttaaaatgcttaagaagcctaaattcgaactgggtaagcttatggagctgcatggagagggctctagctcagggaaagctacaggagatgagaccggcgcaaaggtcgagcgcgcagacgggtacgagccacctgtgcaagagagcgtctag

SEQ ID NO: 239141 - DNA, 792 bp, Artificial Sequence
  Description of Artificial Sequence: Synthetic coding sequence
atggctcggggacctaagaagcacctgaagagggtggccgcaccaaagcactggatgttagataaactgactggcgtttttgctcctcgaccaagcactggaccccacaaattgcgggaatgcttgccactgatcatctttctgcggaaccgactgaaatacgcactgacaggagatgaggtgaaaaaaatctgcatgcagcggtttatcaagattgacggcaaagtgaggaccgacattacttaccctgctggcttcatggacgtgatctcaattgataagaccggcgagaactttcgcttaatatatgacacgaagggcaggttcgctgtgcacaggattacgccagaagaagccaagtacaagctttgcaaagttaggaagatctttgtcggaactaagggaatacctcacctggtgactcacgacgctcggacaattaggtaccctgatccgctcatcaaagtgaacgataccatccaaattgatctggaaaccggaaagattacagacttcattaaattcgacacagggaacttatgcatggtcacgggcggagccaacctgggtcgcattggagtgatcaccaaccgtgaacgccaccctgggtcttttgatgtggtgcacgtgaaggacgcaaatggcaacagctttgcaacccgcctgtccaatatcttcgtgatcggcaagggtaacaaaccttggatcagtctgccccgtgggaaaggcattcgcctaacaattgcagaggaacgagacaaacgattggcagccaagcagtccagcggatag

SEQ ID NO: 239142 - DNA, 369 bp, Artificial Sequence
  Description of Artificial Sequence: Synthetic coding sequence
atggcacgtggccctaagaaacacctgaagcgcgttgcagctcctaaacactggatgctggacaaactcactggggtgttcgctcctcggccaagtacaggcccacataagctcagggagtgcctgcccctcattattttcctgcgcaatcggttgaagtacgcactgactggcgacgaggtgaagaagatttgcatgcagaggtttatcaagatagatggtaaggttcgcacagatatcacctatcctgccggatttatggacgtcattagcatcgacaagactggggagaactttaggctaatttacgataccaagggaagatttgccgtccaccggatcacgccagaggaggctaagccctgctag

SEQ ID NO: 239143 - DNA, 792 bp, Artificial Sequence
  Description of Artificial Sequence: Synthetic coding sequence
atggcgaggggaccaaagaagcatctgaagcgcgtggccgcaccgaagcactggatgctggacaaactgacaggggtatttgcccctcgcccaagcacagggcctcataagctgcgagagtgtctccccctcattgtgttcctgcggaataggcttaagtacgcgcttaccggagacgaagtgaagaagatatgcatgcagcgattcatcaaaatagacggtaaggtgagggtcgatgtcacctaccctgctggctttatggacgttattagtatcgaaaagactggagagcacttccgtcttgtttatgacacaaagggcagatttgcagtgcacaggataacggtggaggaagccaaatataagctttgcaaggtgcgtaagattactgtcggtgttaaggggatcccccacctggtgactcatgatgcacgaacaatcaggtatcctgacccggtgatcaaagtcaatgatactgtgcagattgacttgggcactggcaagatcatcaacttcatcaagttcgatactggcaatctgtgtatggtgattggaggtgccaacctgggtcgtgtcggggtaatcaccaaccgggagaggcaccctgggagctttgacgtggtgcacgtaaaagatgccaacggaaattctttcgccaccagactctccaacatctttgtgatcggaaatggaaacaaaccttggatcagtcttccaagagggaaaggaatccgacttacggtggcggaggagcgggacaaacgtttggcgacgaaacagtcctcggggtag

SEQ ID NO: 239144 - DNA, 789 bp, Artificial Sequence
  Description of Artificial Sequence: Synthetic coding sequence
atgcttggccgtcctgccaagtttagcaaggctaggggacccaaaaaacacctcaagcgcgtcgccgcacctaagcattggatgttagataaactgacaggcgtgtttgcccctcgtccctctaccgggcctcataaactgagggagtgcctgcctttaattgtgttcctgagaaaccgcctcaagtatgccctcacaggggatgaagttaagaaaatctgcatgcagcgcttcattaaaatagacggcaaggttagagttgatgtgacttatcctgctgggtttatggatgtcattagtatcgagaaaacaggagagcacttccggttagtgtatgataccaagggaagatttgcggtgcatcgcatcaccgtagaagaggctaaatacaagttgtgtaaagtgaggaagatcaccgtgggcgttaaaggcatcccccacttagtcactcacgatgctcgcactataaggtaccccgatccagtgattaaggtgaatgacaccgtgcagatcgatctcggtacaggtaagatcattaacttcatcaaattcgataccggtaatctttgtatggtgattggcggagctaacctgggacgggtgggagtaattactaaccgggagcgtcaccctggcagtttcgatgtggtacacgtgaaggacgcaaacgggaactcttttgcaaccagattaagtaacatatttgtcattgggaacgggaataagccctggatatcactgccacgtggtaagggcattagattgaccgtcgccgaggagagagactag

SEQ ID NO: 239145 - DNA, 792 bp, Artificial Sequence
  Description of Artificial Sequence: Synthetic coding sequence
atggcgcgtggtccaaaaaaacacctgaagcgcgttgctgcacccaaacactggatgctggataagctcactggggtgttcgctcccagaccgtcaactggccctcacaaactgagagaatgtttacccctgattgtatttctccgcaacagattgaagtacgctttaaccggcgatgaggttaagaaaatttgcatgcagcatttcctgaagatcgatggtaaagtccgtgtggacatcacttatcccgctggcttcatcgatgttataagcatcgagaagactggagagcattttcgtttggtgtataatactaaggggtgttttgctgtccatcgaataaccgtagaagaagcgaagtataagctttgtaaggttcgaaaaatcacagtcgggacgaagggaatcccccacctggtaacgcacgatgcaaggaccattcgataccctgatccactgatcaaagtaaacgatacagtgcagatcgatttgggcactggcaagataacatcgttcattaagttcgatactgggaacgtgtgtatggtgattgctggcgctaacttgggcagggtcggcgtgatcaccaacagagagaggcaccctggctcttgcgatgtggtccacgtcaaggacgcaaacgggaactcattcgcaacccggatcagcaatatctttgtcattgggaacggtaacaagccttggatctcactccccagggggaagggcattaggctcactatcgccgaagaacgggataaacggcttgccgcaaagcagagcagcggctag

SEQ ID NO: 239146 - DNA, 615 bp, Artificial Sequence
  Description of Artificial Sequence: Synthetic coding sequence
atgaccgagtgggagaccgctgctcccgcagtcgcggagacccccgatatcaagctgtttggcaagtggtcaactgatgatgtgcagattaacgatatctcgctacaggactatattgccgtgaaagagaagtacgctaagtacctgccacacagcgcagggagatacgcagctaagcggttcagaaaagcacagtgcccgatcgtagagcggttgaccaattccatgatgatgcatggcagaaataacgggaaaaaactcatgaccgtgagaattgtgaagcatgcttttgaaatcattcatctgctcacaggcgaaaatcctctgcaagtactggttaacgctattatcaattctggcccacgtgaagatagcaccaggattggccgtgcagggaccgtgcggaggcaggccgtggacgtgagcccactgaggcgcgtgaaccaggcaatttggttgctctgtaccggcgctcgggaggccgcatttcgaaacatcaaaacaattgccgaatgtctggctgatgagctcatcaatgccgctaagggttcatccaatagttatgcaattaagaaaaaagatgagctggagcgggtggctaagtccaaccgatag

SEQ ID NO: 239147 - DNA, 615 bp, Artificial Sequence
  Description of Artificial Sequence: Synthetic coding sequence
atgacggagtgggagacagctgcccctgccgttgctgaaacacctgatatcaagctcttcgggaagtggtctactgacgatgtgcaaatcaatgacatctccctgcaggattatatcgctgtaaaggagaagtatgctaagtacctcccccattcagcaggcaggtacgccgctaaacgcttcaggaaggctcagtgcccaattgtagagcgacttactaactcaatgatgatgcatggaaggaacaatggcaaaaaactgatgacagtgaggattgtaaagcacgccttcgaaataatccacctcctgactggtgaaaatcccttgcaggttctcgtcaatgccattataaattcgggacctcgggaggactcaactcggatcggccgagctggcaccgtacgacgtcaagccgttgacgtcagcccattgcgcagggtgaaccaggcgatttggctcttatgcacaggggctcgggaagccgctttcagaaacattaaaaccatcgcggagtgcctggctgacgagctgattaatgcagccaaagggtcctcaaatagctacgcaataaagaaaaaggacgaattggagcgcgttgcaaaatccaacaggtag

SEQ ID NO: 239148 - DNA, 657 bp, Artificial Sequence
  Description of Artificial Sequence: Synthetic coding sequence
atggccactgaagtggccgcagacgccctgggggaagaatggaaaggttacgtggtgcgcatcagcggaggaaacgacaagcaaggcttcccaatgaagcagggcgttctgacacacgggcgagtgcggttacttttgtccaaaggccattcctgctacagacccaggagaacaggcgagagaaagcgcaagtccgtccggggttgtattgtggatgccaatctcagcgtactcaatctggttattgtgaaaaagggtgagaaagacatccccggactcactgataccaccgtgccccgtcgcctggggccaaaacgggcatctcgcatcagaaagctgttcaacctcagtaaggaggatgatgtaagacagtatgttgtgaggaaacccttaaacaaggagggcaagaagccacgaactaaggctcccaagatacagcgcttggtcacgcctcgagtcctccagcataagcgacgcagaatagccctgaaaaagcaaaggacaaagaagaataaggaggaagcagctgaatatgccaagctgctcgccaaaaggatgaaagaagcaaaagaaaagagacaggaacaaatcgctaagcggcgtcggctgtctagccttcgagccagcacttcgaaatccgaatcctcccagaaatag

SEQ ID NO: 239149 - DNA, 276 bp, Artificial Sequence
  Description of Artificial Sequence: Synthetic coding sequence
atgaagctcaacattagcttccccgcaactggctgccagaagttaatcgaagtggatgatgagcggaaactcagaaccttttatgagaagcgtatggcaactgaggttgccgcagatgcacttggtgaggagtggaaggtgaaggttgacaaactcctgcaagtttttaaatcagagacagtcaacgctattggcaactggtacctcgagtggggcagcgattccggcttctggctccttacgttcggcaaacttttacccaacgctaccctttag

SEQ ID NO: 239150 - DNA, 657 bp, Artificial Sequence
  Description of Artificial Sequence: Synthetic coding sequence
atggcgaccgaggtcgctgcggatgccctgggtgaggaatggaagggatatgttgtacggatttctgggggtaacgacaaacagggtttcccaatgaagcagggggtgctgacccacggccgtgtgcggctgctcctctccaagggccattcttgttaccgcccacgccgaacgggcgagcgtaagagaaaaagcgtccggggttgtatcgtcgacgctaacctaagtgtgctcaacctagtgattgtaaaaaaaggggagaaagatatacctggtttaactgataccaccgtgccaaggagactggggccaaaaagggccagtagaattcggaagctattcaatttgtccaaagaggacgatgttaggcaatacgtggttcgcaagccactgaataaggaagggaaaaaacctcgcacaaaggcccctaagattcaacgactggtcacaccccgagtgctccagcataaaaggaggaggatagccctcaagaagcagcgcacaaaaaagaacaaagaggaggccgctgagtacgcaaaactgctggcgaagagaatgaaagaagcaaaggagaaaagacaagaacagatcgccaagcgcagacgactgtcatctctccgggctagtactagcaagtccgaatctagccaaaagtag

SEQ ID NO: 239151 - DNA, 750 bp, Artificial Sequence
  Description of Artificial Sequence: Synthetic coding sequence
atgaaactgaacatctccttccccgcaacagggtgccaaaaactcatcgaagtcgacgacgaacgcaaactgcggaccttctatgaaaagagaatggcgacagaagtggccgctgacgccctgggcgaggagtggaaaggttatgtggtgagaatctccggtggtaacgacaaacaggggttccctatgaagcagggcgtgctgacccacggtagggtgagactgcttctgtctaaaggacactcttgctatcggcctcggcgtacaggtgaacgcaagaggaagtctgttagagggtgcattgttgacgcaaatctgtctgtgcttaatttggtgattgtgaaaaaaggcgaaaaagacattccaggacttactgatacgacagttcccagaaggctggggcctaagcgggcttcgaggatacgcaagctgtttaatctgtcgaaggaggacgatgtgcgacagtacgttgtacgtaagccattgaacaaagaaggtaaaaaaccaagaacaaaggcccctaaaatccagagactagtaacgcctcgcgtgttacagcataagaggcgcagaattgcacttaagaagcaacgaaccaaaaagaacaaggaggaagctgccgagtatgccaagttgttggctaagagaatgaaggaggcaaaggaaaagcgtcaggagcagatagccaagaggaggagactgagctcattaagggctagtacttctaaatccgagagcagccagaagtag

SEQ ID NO: 239152 - DNA, 585 bp, Artificial Sequence
  Description of Artificial Sequence: Synthetic coding sequence
atgttctccagctcagcaaagattgtgaagccgaatggagagaagcccgacgagttcgagagtggtatttcccaggcgctcctggagttggagatgaatagcgatttgaaggctcagcttcgcgaactcaacatcacagccgctaaggagatcgaagtggggggtggtcgtaaagcgattatcatcttcgtccccgttccccagcttaagtcatttcagaagattcaggtgaggttggtgcgggagctggagaaaaaattctccggtaagcatgttgtgttcattgcccagagacggatcctgccgaaacctacacgtaaaagtcgaacgaaaaacaaacagaagaggccgagatcaagaaccctgacagccgtgcatgacgctattctggaagacctggtgtttccaagcgaaattgtgggaaagcggattagggtgaaactcgacggttctagactgatcaaagtgcatctggacaaggctcagcaaaacaacgtcgagcacaaggtggagacgttttcgggcgtttacaagaaactcaccggaaaggacgtcaacttcgaattccccgaattccaactgtag

SEQ ID NO: 239153 - DNA, 585 bp, Artificial Sequence
  Description of Artificial Sequence: Synthetic coding sequence
atgtttagtagctctgcgaaaattgtgaaaccaaacggagaaaagcccgatgaattcgaatcgggcatctctcaagcattattggagctcgagatgaactccgatttgaaggctcagctccgcgaattaaatatcactgctgctaaggagatagaggtcggtggcggtcgaaaagcaattattatatttgtgcctgtgccccaactgaagagttttcaaaagattcaggttcggctggtccgcgagcttgaaaagaagtttagcgggaaacatgtagtgttcatcgctcagaggcgcatcctccctaagcccactcggaaaagcaggacgaaaaacaagcagaagcggcctcggtccagaactctgaccgcggtgcacgatgcaattctcgaggaccttgtctttccttcagagattgtgggcaagcggattagggtgaaattggacgggtccaggctgatcaaagtgcacttagataaagcgcaacagaacaacgttgagcataaggttgaaactttttccggtgtctacaagaaactcaccgggaaggacgtgaatttcgagtttcctgaatttcagttgtag

SEQ ID NO: 239154 - DNA, 585 bp, Artificial Sequence
  Description of Artificial Sequence: Synthetic coding sequence
atgttctctagcagtgccaagattgtgaagccaaacggagaaaagcctgatgaatttgagtctggtatcagccaggctcttctggagctcgaaatgaacagcgatctgaaagctcaactacgcgagctgaacatcacagcagctaaggaaatcgaagtgggcggaggtaggaaggcaattatcatttttgttcctgtgccacagttgaaaagcttccagaagattcaggtgcgtctcgtgcgggagctcgagaagaaatttagcggcaagcatgtcgtgtttatcgcccagcgcaggattcttccaaaacccacacgtaaaagccgcaccaaaaataaacagaagaggccacggagccgcaccctaacagccgttcacgacgccatcttagaagaccttgtgtttccatcagagatcgtcggcaagcggatcagggtgaagctggacggcagtcgtcttatcaaggtccacctcgacaaggcacagcagaataacgtagaacataaagtcgaaacatttagcggcgtctacaagaagctgaccggcaaagacgtcaattttgagttcccagaatttcagctatag

SEQ ID NO: 239155 - DNA, 567 bp, Artificial Sequence
  Description of Artificial Sequence: Synthetic coding sequence
atggggatctctagagacaactggcataagcgaagaaagaccgggggtaaaagaaaaccctatcacaagaaacgaaagtacgagcttggacggcctgctgccaatactaaaatcggaccgagaagaattcacacagtgagagttcgcggagggtgtacacgaaagacccgcattatcgatgtcgtgtacaacgcttccaataacgagcttgtgagaacgaagacactcgtcaagaattgtatagtccttattgattctactccgtatcgccagtggtatgagtctcactacgcactgccgctcgggaggaaaaagggcgctaagttaactccggaagaagaagaaattttgaacaaaaaacgaagcaaaaagatccaaaagaaatatgacgagcggaaaaaaaatgcaaaaatttcatctctgctagaagagcaattccaacaaggtaaattgctcgcctgtatcgcttcccgcccaggacagtgtggcagagcagatgggtacgtactagaaggaaaggaactggagttctatctgaggaaaatcaaggcacgcaagggaaaatag

SEQ ID NO: 239156 - DNA, 627 bp, Artificial Sequence
  Description of Artificial Sequence: Synthetic coding sequence
atggggatctctcgtgacaattggcacaaaaggcgtaaaaccggaggcaagcggaaaccttatcacaaaaagcgtaagtatgaactcggcagaccagccgctaatacgaagatcggccctcggcgtattcatacagtcagagtgagaggaggcaacaagaagtacagagccctacgcttggacgtaggcaattttagctgggggtcagaatgttgcacccggaagacaaggattatcgacgttgtgtacaacgcctccaataatgagctggtgcgtacgaagactctagtgaaaaactgtatcgtgcttatcgacagcaccccctaccgccaatggtatgaatcccactacgcgctcccccttggaaggaagaaaggggctaaactgacccccgaggaggaagaaatattaaataaaaagcgttctaaaaagatccagaaaaagtatgatgagaggaagaaaaatgctaaaatctcgtctctgttggaggagcagttccagcagggcaaactactggcatgtattgcatcccgtccaggccagtgcgggcgagcagatgggtacgtcttggagggaaaggaactcgaattttatctgcgcaaaatcaaagctcgcaaaggaaaatag

SEQ ID NO: 239157 - DNA, 585 bp, Artificial Sequence
  Description of Artificial Sequence: Synthetic coding sequence
atgccagtggccagatcctgggtgtgcagaaagacttacgtgaccccccgaaggccttttgagaaaagccggctggaccaggagctgaagttaatcggtgaatacggactccgaaataaacgagaagtgtggcgtgtcaagtttaccctggcgaagatccggaaggctgctagggagctgctgaccttggatgagaaggatcctaggagactgttcgagggaaatgctcttctgcggaggctcgtgcggattggtgtgttggacgagggtaaaatgaagttggactatatcctcggtctgaaaatcgaagatttcctagagagacgcttgcagacacaagtttttaagttgggccttgccaagtccatccatcatgccagagtgttgattcggcagcgtcacatccgagtcagaaagcaggtggtgaatatacccagctttatcgtgagactcgattctcagaagcacattgatttttcactgagaagcccgtacggaggtggtagacctggtcgggtgaagagaaagaatgctaagaagggacaaggaggggcaggtgcaggtgatgatgaagaggaagattag

SEQ ID NO: 239158 - DNA, 585 bp, Artificial Sequence
  Description of Artificial Sequence: Synthetic coding sequence
atgcctgtggccaggagctgggtttgcagaaagacgtacgttactccacggcgaccttttgagaagtcccgattggaccaagaactcaaactcatcggggaatacgggctccggaacaagcgcgaggtctggagggtgaagtttactctggctaagatccggaaggctgccagagagctcctgacattagacgagaaagatcccaggcgtctgttcgagggaaatgcactgctgagacggctggtccgcatcggtgtactggatgagggtaaaatgaagctggactacattctcggcttgaaaattgaggactttcttgagcgaagactgcagacccaagttttcaaattgggtctggctaagagcattcaccacgccagagtgcttatccgacagcgacatatccgtgtccggaaacaggtagtgaatatcccgagtttcattgtgagactcgacagccagaagcacatagatttttcccttagaagtccatacggcggaggccgaccagggagggtgaagaggaagaatgccaaaaagggtcagggaggagccggagccggagacgatgaagaggaagattag

SEQ ID NO: 239159 - DNA, 585 bp, Artificial Sequence
  Description of Artificial Sequence: Synthetic coding sequence
atgcctgtggcgcgtagctgggtgtgcaggaagacctatgtgacaccccgaagacccttcgaaaagagtcgcctggaccaggagcttaaactcattggggaatatgggctcagaaacaagcgcgaggtttggagggtgaagttcacactggctaaaatccgtaaagcggctcgcgagctgctgactctcgacgagaaggacccacgacgactgttcgaaggaaatgcattgctacggcgactggtccggatcggggtgcttgacgagggcaaaatgaaactcgattacatcctgggacttaagatcgaggacttcctggaacgcaggctccagacacaagtattcaaacttgggctcgcgaaatccattcaccacgctagagtactgatcaggcagcgtcatatccgcgtgcgaaaacaggtggttaacataccctcgtttattgtgaggctggatagccagaagcatatcgacttctctctaagatccccctatgggggaggtagacccggacgcgtcaagaggaaaaacgcgaagaagggccagggcggagcaggggcaggtgatgacgaagaggaagactag

SEQ ID NO: 239160 - DNA, 420 bp, Artificial Sequence
  Description of Artificial Sequence: Synthetic coding sequence
atgccagttgccagatcctgggtgtgccgaaagacctatgtgacacccagaaggccttttgaaaaatcgcggctcgatcaggaattaaaattaatcggcgagtatggactgcggaataagagggaggtctggagagtgaaattcacgctcgccaaaatacggaaggcagcacgggaattgctcaccctggacgaaaaggatcccaggcgactgtttgagggtaatgccctactgagacggttggtgcgaattggggttcttgatgaaggcaagatgaagctagactatattctgggcctgaaaatcgaagatttcctggagcgtcgtctccagacccaggtgtttaagctcggcttggccaaatctatacaccacgccagggtgctgatccgccagagacacatttcgcccaggcgctag

SEQ ID NO: 239161 - DNA, 420 bp, Artificial Sequence
  Description of Artificial Sequence: Synthetic coding sequence
atgcccgtcgctcggagctgggtctgtcgtaagacatatgtgacacctcggaggccattcgaaaagagtcgactagatcaggagttgaagctgattggggaatatggactacgaaataagcgcgaagtctggagggtcaagtttactctcgccaagattcgcaaagcggctagggagctgctgacccttgacgagaaggatcccagacggctgttcgaagggaacgctctgctccgcaggttggtgcgcattggcgttctggacgagggcaaaatgaagctggactacattctgggtttaaagattgaagatttcctggagcggcgattgcagacccaggtgtttaagctcgggctggccaagtccatccatcatgctcgggttttgatccgccagagacatataagtccaagacggtag

SEQ ID NO: 239162 - DNA, 471 bp, Artificial Sequence
  Description of Artificial Sequence: Synthetic coding sequence
atgccagtggcaagaagctgggtgtgtagaaagacctacgtgactccacgcaggccctttgagaagtcaaggctagatcaggaactgaagcttatcggtgaatacggtctgaggaataagcgcgaggtttggcgagtcaaattcaccctagcaaaaattagaaaagcagctagggagctgctgacccttgacgagaaagacccccgaaggctgtttgaaggaaatgcgttgctaagacgcctggtccgcataggggtcctagatgagggtaagatgaagctcgactatatcttgggcctgaagatcgaggactttttggagcggcgtctgcagacacaggtcttcaagttaggcctcgctaagtcaatccaccacgccagagtgttaattcgacagagacacataagatatcacctgggttgggctccagaaagtagcagcacttgcccaagtgacgggtgcccccactag

SEQ ID NO: 239163 - DNA, 420 bp, Artificial Sequence
  Description of Artificial Sequence: Synthetic coding sequence
atgcctgttgcccgatcctgggtgtgtaggaagacttacgtgacaccccgacggccattcgagaagagccggttggaccaagaattgaagctgattggggagtatgggctacgcaacaagagggaggtttggcgggtgaaattcacactggctaagatccgtaaagccgctagagaactgcttaccctggacgaaaaggaccccagacggctgttcgaggggaatgccctccttaggcgtcttgtgcggattggtgtgctcgacgagggaaagatgaagttagattacatcctcggactcaagattgaagatttcttggagcgaagacttcagactcaggtcttcaagctgggccttgccaaatcaatacaccatgctcgcgtactcattcgccaacgccacatctccccgagaaggtag

SEQ ID NO: 239164 - DNA, 2844 bp, Artificial Sequence
  Description of Artificial Sequence: Synthetic coding sequence
atggccacaagggtgaggactgccagtatctgggtacctcccctgcaggagcggaactcatcatgggatcgcatacgtaagttacaagggcaagaatccatcctgggtcaggggaccccaggattgcaacctctacctggcactccacgccagaaacaaaaaagcaggcgcattgagaaggtcctggagtggctcttcattagccaggaacaacccaaaataaccaagtcttggggtcctcttagctttatggatgtgttcgtcgactttacatgggaagagtggcagctcctcgacccagcccaaaagtgtctgtacagatctgtgatgctcgaaaattattctaacctcgtcagtctgggttatcagcacaccaagccagacataatcttcaagctggaacaaggagaagagctttgcatggtacaggcgcaggtgcctaaccagacctgccccaacaccgtctggaaaattgacgacctgatggattggcatcaagagaataaagataagctcggtagcacggccaagtcctttgagtgtactacttttggaaaactctgcctcctcagcacgaagtatttgtcacggcaaaaacctcacaagtgtggaactcacggcaagagtctaaaatacatagatttcaccagcgactatgctcgaaataaccccaacggttttcaggtgcacggtaaatccttctttcacagtaaacatgagcagacggtgataggtattaaatattgtgagtcgatcgagtccggaaagacagtcaacaaaaagagtcagctaatgtgtcagcagatgtatatgggggagaagccctttggttgctcctgttgcgaaaaagccttttcaagcaaatcttatctcctggtccatcaacagacccatgccgaagagaaaccctacggctgtaacgagtgtggaaaagatttcagcagtaagtcatacctgatagtacatcagcgcattcacacaggggaaaagctgcacgaatgcagtgaatgtcggaagactttcagcttccacagtcagttggttattcaccagcggattcacaccggagaaaacccttatgagtgctgcgaatgtggcaaggtgttcagtcgtaaggatcagttggtctctcatcaaaaaacccacagcggccaaaagccctatgtatgcaatgaatgcggcaaagcgtttggcttgaagagccaattgatcattcacgagcggatccacactggcgagaagccgtacgaatgtaatgagtgtcagaaagcattcaacactaaatccaatctgatggtgcatcaaagaacacatacaggggagaaaccttacgtgtgctccgactgcggtaaagctttcacctttaaatctcaattaattgttcatcaaggcatccacaccggggtgaagccatatggatgtatacagtgcggtaagggtttctctctgaaatctcaactcatcgtccaccaacgctcccatactggcatgaaaccctacgtctgtaacgagtgcggcaaggcctttagatctaaatcctatttaattattcacacaaggacacacactggcgagaagctgcacgaatgtaataattgcgggaaggccttctcgttcaaatcccaattgataatccatcagaggatccatactggtgagaacccctacgaatgtcacgaatgtggcaaagccttttcgagaaaataccaattaatttctcaccaaaggactcatgcaggcgagaagccatatgagtgcaccgactgtgggaaagcgtttggtctgaaaagtcagctcattatacaccagagaacacacacaggcgaaaagccatttgagtgctccgaatgtcagaaagcttttaacaccaaatccaatttaatcgtgcatcagagaacgcacaccggagaaaagccttacagctgtaacgaatgtggcaaagccttcactttcaagtcccaactgatcgtgcataaaggtgtgcataccggagtgaagccttatggttgttcacaatgcgccaaaacttttagtctgaaatctcagctgattgtgcaccaacgatcacacactggagtaaagccctatggatgcagcgaatgtggcaaggcattcagatccaagagctatctgattatccatatgcgcactcacactggcgagaagcctcacgagtgcagagagtgcggcaaatcattcagttttaacagtcagttgatcgttcaccagaggattcataccggtgagaacccgtacgagtgcagcgaatgcggaaaagcattcaatcgaaaggatcaattgatctcacatcagcgaacccatgctggagagaagccatatggatgcagtgagtgtgggaaggcatttagttcaaaatcctatttgataatccacatgagaacacactcaggagagaagccgtatgaatgtaacgaatgtggtaaggcgtttatctggaagagcttgttgatcgtccacgagaggactcacgcaggcgtcaatccttacaaatgtagtcaatgcgagaagtccttctccggcaagttgaggctgcttgttcaccaacgcatgcatactcgcgagaaaccatacgagtgttcggaatgcggaaaagctttcatcagaaattcccagctgatcgtgcatcagaggacccattctggtgagaagccatacgggtgtaacgaatgtggcaagactttcagccagaaaagcatcctgtccgcccaccagcggacacatactggagagaagccctgcaagtgcaccgagtgcggcaaggccttctgctggaagagtcagctgatcatgcaccaaaggactcacgtggatgataagcattag

SEQ ID NO: 239165 - DNA, 768 bp, Artificial Sequence
  Description of Artificial Sequence: Synthetic coding sequence
atgcctagagaagatagggccacctggaagtccaattactttcttaaaatcatacagctgttggacgactaccctaagtgcttcatcgtgggtgctgacaacgttgggtcaaagcagatgcagcagatcagaatgagtctccgaggcaaagccgtggtactcatgggcaagaacacaatgatgagaaaggccatacgcggacacctcgagaacaatccggctttggaaaagctgctgccgcacattcggggaaacgtgggcttcgtgtttacgaaggaagatcttacagaaattcgtgacatgctgcttgcgaataaggtccctgccgctgcgagggccggtgccatagcaccgtgtgaagtgacagtgccagcccaaaacaccggactggggccagagaagaccagctttttccaggcactcgggatcacgaccaaaatttctagaggcaccattgaaatcctgggagtccgtaacgttgccagcgtgtgcctccagatcggataccctaccgttgcatctgttccacactcaattatcaatggatataagcgggttctagctttgtcagtcgagactgactatacctttccgctggcagagaaagtaaaggcgtttctcgccgatccctcggcttttgtggccgcagccccagtggcagctgctaccactgccgctcctgcagcggcagccgcacctgcgaaagttgaagctaaagaagaatccgaggaatccgatgaggacatgggattcggcctttttgactag

SEQ ID NO: 239166 - DNA, 954 bp, Artificial Sequence
  Description of Artificial Sequence: Synthetic coding sequence
atgcccagggaagacagagctacctggaaaagcaactactttctcaagatcatacagctcctggatgactaccccaagtgctttattgtgggggctgataatgtagggtcaaagcaaatgcaacaaatccgcatgagcctgcggggtaaagccgtggtgcttatgggaaagaatactatgatgaggaaagctatccggggtcatttagaaaataatcctgctttggaaaagctgcttccacatattaggggaaacgtcggttttgtttttaccaaggaggacctgacggagatccgcgacatgttactggcaaacaaggtccctgctgctgctcgagccggagccatagctccctgcgaagtgacagtaccagcccagaatactggactcggacctgaaaagactagctttttccaagctttaggaataaccaccaaaattagccgcggtaccattgaaatcctatcagacgtccagctgattaagacgggcgacaaagtgggcgcttccgaagcaacactgctgaatatgttaaacatttcaccttttagtttcggactcgtaatccagcaggtctttgataatggttctatctacaaccctgaggttttggatataacggaggagactttacacagccgctttctggagggggtccgaaatgtagcatccgtatgtctacagatcgggtacccaacggtggcgagcgtcccccattcaatcatcaacgggtacaagcgcgtcctcgctctgtccgtcgaaaccgactacacttttcctctggcggagaaagtcaaggccttcttagccgaccctagtgccttcgtggctgcagctccagtcgcggcagctaccacagcggctcccgctgcagccgctgcaccagccaaggtagaggcaaaagaggaaagtgaggaaagcgatgaagacatggggttcggcctatttgactag

SEQ ID NO: 239167 - DNA, 954 bp, Artificial Sequence
  Description of Artificial Sequence: Synthetic coding sequence
atgccaagagaggaccgtgcaacctggaagtcaaactacttccttaagataatacagctgctggatgattatccaaagtgctttatcgtcggggctgacaatgtggggtctaagcagatgcagcaaattaggatgtcactgagaggaaaagctgtggtactgatggggaagaatacgatgatgcggaaggcaattagaggacacctggaaaataacccggctctggaaaaactgctgccacatattaggggcaacgtgggcttcgtattcactaaggaagatttgaccgagattagagatatgctgctggcgaacaaggtccctgccgcagcaagggctggtgctattgctccatgtgaagttactgtgccagcacagaataccggactgggccctgaaaagacgtcattttttcaggcgctgggcataacgacgaagatcagcaggggaacaatagagatcctatccgatgtgcagcttattaaaacaggggacaaggttggcgcatccgaagctacccttctgaacatgttaaatatctctcccttcagttttgggttggtaattcagcaggtctttgataacggcagtatatacaaccccgaggtattagacatcacagaggaaactctgcattcaaggtttcttgaaggtgtgcggaacgtggcctctgtatgtcttcagatcggctatccgacagttgcttccgtgccccattcaattatcaacggatataaacgtgtgttggccctctctgtagaaacagactatacttttccactggctgagaaggtcaaggcgttcctcgcagacccttctgctttcgtggccgcagctcctgttgcagctgcaactacagcggctccggcagctgctgccgctccagcgaaggtggaggctaaagaagagagtgaggagagcgacgaagatatgggttttgggctctttgattag

SEQ ID NO: 239168 - DNA, 345 bp, Artificial Sequence
  Description of Artificial Sequence: Synthetic coding sequence
atggcgtcggtgtctgagttagcatgtatatattccgctttgattcttcacgatgacgaagttacggtgaccgaggacaagatcaacgccttaatcaaggccgcaggcgtcaacgtggagccattctggcctgggctgttcgccaaagccttggctaacgtcaacatcggatccctgatatgtaacgtgggagcaggtggacccgcacccgctgcaggagctgctcctgccggagggccagctccaagcacggccgctgcccctgctgaggagaagaaggtggaggcaaaaaaagaagagagcgaagaatctgatgatgacatgggtttcggtcttttcgactag

SEQ ID NO: 239169 - DNA, 270 bp, Artificial Sequence
  Description of Artificial Sequence: Synthetic coding sequence
atggccagcgtatctgaactggcttgcatttactctgctttaatcctccacgatgacgaagtgacggtgacagccttagcgaacgtgaacattgggtcactgatctgcaatgtgggagcaggcggaccggcacccgcagccggtgccgcacccgctgggggaccggcacctagcacagctgctgccccagccgaagaaaagaaggtggaagcaaagaaagaagagtcagaagaaagcgacgacgatatgggctttggactgttcgactag

SEQ ID NO: 239170 - DNA, 2277 bp, Artificial Sequence
  Description of Artificial Sequence: Synthetic coding sequence
atggccccagccatgcagccggctgaaatccagttcgctcagcgtctggcatcctccgagaagggtatcagggacagggcagtcaaaaaacttaggcagtatataagtgtgaagacacagcgcgagaccgggggattctcacaggaagagctgcttaagatctggaaaggcttgttttattgtatgtgggtccaagacgagcctctcctgcaggaggaactggccaatactatagcacaactggtgcatgcagtcaataattctgcagcccagcacctcttcatccaaacgttctggcaaacgatgaatcgcgagtggaaaggtatcgataggctgcgactggacaaatattatatgctcattcgcctggttcttcgccagagcttcgaggtcctgaagcgaaacggatgggaagaatcgagaataaaagtcttcctcgatgttctgatgaaagaggttctgtgtcccgagtcccagtccccaaacggagtacgattccattttatagatatctatctggacgagttgtcaaaggttggcggtaaggaactgctagcagatcagaatctgaagtttatagatccattctgcaagatcgctgctaagacaaaggatcacaccctagtccaaaccatcgcgaggggagttttcgaggcaattgtggaccagtcaccttttgtacccgaggaaactatggaagagcaaaaaactaaagtgggagatggtgacttaagcgctgaggagattccggaaaacgaggtgagccttaggagggccgttagcaagaaaaagaccgcccttggcaagaatcatagccgcaaagatggattgtccgacgagcgcggacgggacgactgcggcactttcgaagatacaggacctcttctgcaatttgactacaaggcagtggctgatcgtctattggagatgacttcccggaaaaataccccccactttaacagaaaaagactatcaaaactgattaaaaaatttcaggatctgtcagagggatcttcaatatcacagctttcgtttgctgaagacatctcagccgacgaggacgaccagatcctttcacaggggaagcataagaagaaaggtaacaaactattggagaagaccaacctcgaaaaggaaaagggcagtagagttttttgcgttgaagaagaagatagcgagagctctttgcaaaaacggaggcgcaaaaaaaaaaaaaaacaccatcttcaacccgaaaaccccggacccggtggagcagctccaagtctcgaacagaacagagggagagagccagaggcctctggcctcaaggccctgaaagcccgagtcgcagagcctggggctgaagccacaagttccacaggcgaagagtccgggtctgaacaccccccagccgttccaatgcataacaagagaaaaagaccgagaaaaaagagtcctagagcacatagagagatgttggagtccgctgtcctgccacccgaggatatgtcccagtccggcccttccggaagccacccgcaaggcccacggggttccccaaccggcggagcacagctgctgaaaaggaagaggaagttgggcgtggtcccggttaacgggtcaggactttccaccccagcttggcccccactacagcaggagggcccacccactggaccggctgagggagctaacagccacactactctgcctcagcgtcgccgattgcagaaaaagaaagcgggacccggaagcctcgaattgtgcgggctcccatcacagaaaaccgcatcactgaaaaagcgaaaaaagatgagagtgatgtccaaccttgtagagcacaacggggtcctggaatcagaagccggacaacctcaagctctgggatctagtggaacctgctcttcattgaaaaaacagaagctgcgtgccgaaagcgatttcgttaagtttgacactccctttctgccaaaacctctctttttcaggagagccaagtcttcaacagctactcacccgcctggaccagcagtacagctaaacaaaacccccagtagctctaagaaagtgacctttggattaaatcggaacatgacggcggaatttaagaaaacagataaaagcattcttgtcagcccgactggaccaagtagggtggcttttgatccagaacagaaaccactgcacggagtgctgaaaactccaacctccagcccagcttccagccctttggttgccaagaaacccctgactacgactcctagacgtaggcctcgggctatggactttttttag

SEQ ID NO: 239171 - DNA, 780 bp, Artificial Sequence
  Description of Artificial Sequence: Synthetic coding sequence
atgcctggagccaattaccgggctggggcaggcgcaggtgcaggtgcccgacgcccaagaggcgcacgcgatagggaagaggatgggggtggactggagcctgccgctgtggcgagggatctcctccgagggacctcaaacatgtcctttgaggaactgctggaactgcagtcccaagtgggaactaagacttataagcaactcgtggctgggaactccccaaagaagcaggcaagcaggccaccaatccagaacgcatgcgttgcagataagcatcggccactcgagatgtccgccaagattagggtgcccttcctgcggcaagtcgtgcctatctcaaaaaaggttgctcgagaccccaggttcgatgatctgagcggagaatataatcctgaggtgtttgataagacttatcagttcctcaatgacatccgggctaaggagaaggagcttgtgaaaaagcaactcaaaaaacatttatctggcgaggagcacgaaaagttgcagcagcttcttcagagaatggagcaacaagagatggcccagcaagagcggaagcaacaacaggaactacatctggccttgaaacaagagcgccgagcccaggcccagcagggccataggccttatttcctgaagaagtccgaacagcgacaacttgcactggcggaaaagtttaaagagctgaaaaggtccaagaaactggagaatttcctttcccgcaagcggcgacggaacgctggcaaggaccgaaggcatctccccttgtccaaagagtag

SEQ ID NO: 239172 - DNA, 4233 bp, Artificial Sequence
  Description of Artificial Sequence: Synthetic coding sequence
atggacatctacgacacgcagactctgggcgttgtggttttcggaggattcatggttgtgtcagcgattggaattttcctcgttagcaccttttctatgaaagagacttcttacgaggaagctctggcaaatcagaggaaggagatggccaaaacccaccaccagaaggtggagaagaaaaaaaaggagaagacagtggaaaagaaggggaagactaagaagaaggaagagaaacctaacgggaaaatcccagaccacgatcccgctcccaatgtcaccgtcctgttgagagagcccgtacgggcacctgccgtcgccgttgcacctaccccggtgcagccacctataatcgtggctccggtggccaccgttcccgcaatgccacaggagaagcttgcttccagtccgaaagataaaaaaaaaaaggagaaaaaggtcgcgaaagtcgagcctgcagtctcaagcgtggttaatagcatacaagtgctcacctccaaggccgctatcctggagacggcccctaaagaggtacccatggtggtagtcccccctgttggcgctaaaggaaacactccagccacgggaaccactcagggtaagaaggctgagggaacgcagaaccagagcaagaaggcagagggcgcacctaatcagggtagaaaagccgagggcacccctaaccaggggaagaaaacagagggcactccaaatcaggggaagaaggccgagggcacacctaatcagggaaagaaggccgaaggcacaccaaatcaagggaagaaggctgagggcgctcagaaccaggggaaaaaggtcgacacaacacccaaccagggtaaaaaagtcgagggcgctccgactcagggccgaaaggctgagggcgctcaaaaccaggctaagaaggtggagggtgcacagaatcagggtaaaaaggccgagggggcacagaaccagggtaagaaaggcgaaggagctcaaaatcaaggcaaaaaggccgaaggcgcacaaaaccaggggaaaaaggccgagggagctcaaaaccagggcaaaaaggcagaaggggcacagaatcaggggaagaaggccgagggggctcagaatcaagggaaaaaggcagagggcgcacagaaccagggcaaaaagtccgaaggagctcaaaatcagggtaagaaggtggagggcgctcaaaaccaaggaaaaaaggccgagggcgcacaaaatcaggggaagaaggccgaaggggctcagaaccaaggcaaaaaggctgaaggagcgcagaaccaagggaagaaagctgagggagctcagaaccaggggaagaaggctgagggcgctcagaatcaggggaaaaaagccgaaggcgctcagaaccagggaaagaaagctgagggggcacagaatcaaggcaaaaaggtggagggggcacaaaatcaaggcaaaaaggctgagggcgctcaaaaccagggcaaaaaagctgagggtgcacaaaatcaaggcaaaaaggctgaaggcgctcagaatcaaggccaaaaaggtgaaggggctcaaaaccagggcaaaaagactgagggagctcagggcaagaaagccgagcgtagtcctaatcaaggtaagaagggagagggagcgcctatccaaggtaagaaagcggatagtgtggccaatcagggcaccaaggtcgagggcatcaccaaccaggggaagaaggcggagggaagcccttctgagggcaaaaaagccgaaggatcaccaaaccaggggaagaaagcggacgcggctgcgaatcaaggtaagaaaaccgagtctgcatcagttcaagggagaaacacagacgttgcccaaagccctgaggcccctaagcaggaagcccctgctaaaaaaaaaagcggcagcaagaagaagggggaacccggtcctccagacgcggacggtcctttgtatctcccttacaaaaccttagtgtccacagtgggtagcatggtttttaacgagggcgaggctcagagactaattgaaatccttagcgagaaggctgggattatccaggatacatggcataaagctacccaaaagggcgacccggttgccattctgaaacgacagctggaagagaaggagaagttgctggctaccgagcaggaggacgcagccgtcgccaaaagtaaactacgagagcttaacaaggagatggcggctgagaaagctaaagccgcagccggtgaggctaaggtgaagaaacaactagtcgctagagagcaggagatcactgccgtacaggcacgtatgcaagccagctaccgggaacacgtaaaagaggtgcaacagctgcagggaaagatacggacattacaagagcaactggagaacggcccaaacacccagttagcgaggctgcagcaggaaaattctattctccgtgacgcactcaaccaggctacatcccaagtggagtctaagcagaatgccgagctggccaaactgagacaagagctcagcaaagtgtccaaggagttggtggaaaaaagcgaagctgtccgacaggacgaacaacaacgcaaagccctcgaagcaaaggccgcagccttcgagaagcaggtgttgcagcttcaggcatcccacagggaatccgaagaagcattgcagaagagattagatgaagtttcccgcgagctgtgtcatacgcaatcctcccatgccagcttgcgggctgacgcagagaaagcccaggagcaacaacagcaaatggctgaactgcactccaagcttcagagttcagaagctgaggtgcggtccaagtgtgaggaactgtctggattgcatggccagctccaggaagcccgagccgagaatagccagttgacagaacgaataaggtcgatagaagccctactcgaggcagggcaagcccgagatgcccaagacgtacaggcctctcaggcggaggccgaccagcagcaaaccagactcaaagagctggagagccaggtgagcggcctcgagaaggaggccattgagctgagagaagctgtggaacagcagaaggtgaagaacaatgatctacgcgagaaaaattggaaggccatggaagcgctggcgacagcagaacaagcatgtaaggagaagctgctaagcctgacacaagctaaggaggagtctgaaaagcagttgtgtttgatcgaagcacaaaccatggaagcattgctggccctcctgcctgagctatctgtgctggcacagcagaactacaccgaatggcttcaggatttaaaggagaagggcccaacacttctcaagcacccccctgcaccagcagagccttcttccgatctggcctccaagttaagagaggctgaggaaacccaatctacactccaggcagagtgtgatcagtacaggtcaatactcgcagagaccgaaggcatgctgagggacctgcagaaaagtgttgaggaggaggagcaggtatggcgagccaaagtcggggcagctgaagaagagctccagaaaagccgagtcacagtgaagcacttggaagaaatcgtcgagaagttaaagggcgagttagaaagcagcgaccaggtcagggagcacactagccatttggaggcagagctggagaaacatatggccgcagcctcagctgagtgccagaactacgcaaaggaagtggcaggcctaagacagcttctgttagaatcgcagagtcaactcgacgccgcaaaatctgaagcacagaaacagtctgacgagctggctctggtgcgtcagcagctttctgagatgaagtcccatgtcgaggatggtgatattgccggagcacccgcaagttcccccgaggcgcctccggcagaacaggatccagttcagctcaagactcagcttgagtggaccgaggcgattttggaggatgaacaaactcagcgtcagaagttgacggcggaattcgaggaggcccagacttccgcatgccggctccaggaggagctggagaagctgaggacagcaggaccactggaaagcagcgaaacagaggaggcctctcagctgaaagagcggctggagaaagagaagaagctgacctcagacttaggacgcgcagccacccgtctgcaggagctgctgaagaccactcaagaacagctggcgcgtgagaaagatactgtgaagaagttgcaggagcagctcgagaaggcagaagatggctcctcttccaaagaagggaccagcgtgtag

SEQ ID NO: 239173 - DNA, 2934 bp, Artificial Sequence
  Description of Artificial Sequence: Synthetic coding sequence
atggatatctatgatacacaaaccctgggggtagtggttttcggcggtttcatggtcgtttcagcaatcggtatatttctcgtatccaccttcagcatgaaggagacatcctacgaggaagcccttgcgaatcagaggaaggagatggccaagacacaccatcagaaggttgaaaaaaagaagaaagagaaaaccgttgaaaagaaggggaagacaaaaaaaaaggaggaaaagccgaatgggaagatacctgaccacgacccagctccaaatgtaactgtgctgctccgggaaccagtgcgggctccagcagttgccgtcgctcccacaccagtgcaacctccaattattgtggcgccagtggccacggttcctgccatgccacaggagaagcttgcgtctagccccaaagacaaaaaaaagaaggaaaagaaggttgcaaaggtcgagccagccgtgagctcagtggtcaactctatccaggtgttgactagtaaagctgcaatcctggagactgcaccaaaagagggtaggaatactgacgttgcccagagccccgaagcacccaaacaggaagccccagcgaagaagaagagcggtagcaaaaagaaaggtccaccagacgctgatggccctctgtacctgccatacaagacgctagtgagcaccgtcggaagcatggtgttcaatgaaggcgaggcacagcgcctgatagaaatacttagtgaaaaggccggtataatccaggacacatggcataaagccacacagaaaggggacccagttgctatactcaagaggcagctggaagaaaaggagaagctcctcgccactgagcaggaagacgccgctgttgcaaagtccaaactcagagaactcaacaaagagatggccgcagaaaaagcaaaagctgccgcaggagaggcaaaagtgaagaaacaactggttgcccgagagcaagaaatcactgctgttcaggcaaggatgcaggccagctatagggaacatgtcaaggaagtgcagcagctgcagggcaaaatccgaacactgcaggaacaactggaaaacggacccaatacccagctggccagactgcagcaggagaattcaatcctaagagatgccctaaatcaggccactagccaagttgagagcaaacagaatgcagaactcgcaaaactgcgccaagaattgtccaaagtgtccaaggaactcgttgaaaaatccgaagccgtccgacaggacgagcagcagaggaaggctctcgaagctaaagcagctgcgtttgaaaagcaggtactgcaactgcaggcctctcatcgcgagtccgaggaggccctccagaagcgcctggatgaggtcagtagagagttgtgtcacacacaatcctcacacgcctccctgagagcagacgccgagaaggcccaggagcagcagcaacagatggccgaactgcactccaagcttcagagtagcgaagctgaggtgcgttctaaatgcgaagaattatccggactccatgggcagcttcaggaagccagagccgaaaatagtcagctgactgagaggatacgaagtatcgaggccctacttgaagccggtcaggctagggacgcccaagatgtgcaggcttctcaggctgaggcagatcagcaacagactcgtctcaaagagcttgaaagtcaagtgagcggactcgaaaaggaagccatcgagttaagggaggctgttgagcagcagaaggtgaagaataacgacctgcgcgagaagaattggaaagccatggaggccctggctactgccgaacaggcctgtaaagaaaaactgttgagtctgactcaggcaaaagaagagtcagaaaaacaactctgcctgatagaggctcagacgatggaagctctgctggccttactgcccgaattgagcgttttggcccagcagaactatacagagtggttacaggatctcaaagaaaagggcccaacgttgcttaagcaccctccggctccagccgagccaagttccgatttggccagcaaattacgtgaggccgaggaaactcagagcactctacaggccgaatgcgaccagtacagaagcatcttggctgaaacagaaggcatgctgagggacctccagaaatcggttgaagaggaggagcaagtgtggcgcgcaaaagtgggcgcagctgaggaggagctgcagaaaagccgtgttacggtcaagcacttggaagagattgtagagaagctgaaaggggagttggaaagctcggatcaggtccgcgagcacacctcacatctggaagcagagctcgagaagcacatggcggcagcctctgctgaatgccaaaattatgccaaggaagtcgccggtctgagacaactcctgctggagagccagtcccagctggacgcggctaaaagcgaagcccagaaacagtcagacgagctcgctctggtgagacagcaattatccgaaatgaaaagccacgtggaagacggggacatagctggagctccggcttcaagcccggaggcgcctccagcagagcaggaccctgtccagttgaaaacccagctagagtggaccgaggccatactggaagacgaacaaactcagcgacaaaagcttacggcggagttcgaagaggcccagaccagcgcttgtagactgcaagaggagttggaaaagctgagaacagccggacctctagaatcaagcgaaactgaggaagcgagccagctgaaggaacgactggagaaagaaaagaagctgacatcggatctgggcagagccgctacaagattgcaagaacttctgaagacaacccaagagcaattggcaagagaaaaagataccgtgaaaaagctgcaagaacaactggagaaggccgaggatgggagctctagcaaagaagggacctctgtgtag

SEQ ID NO: 239174 - DNA, 2934 bp, Artificial Sequence
  Description of Artificial Sequence: Synthetic coding sequence
atggatatctatgatacacagaccctcggggtagtagtattcggcggatttatggttgtgtctgccatcggaattttcctggtgagtactttctctatgaaggagacatcgtatgaagaggccctggccaatcaacggaaagaaatggccaaaactcaccatcagaaggtggaaaagaagaaaaaagagaagaccgtggagaagaaaggcaagacaaagaagaaggaggaaaaaccaaatgggaaaatacccgatcacgatcccgctcccaacgtgactgtgctgcttcgtgagcctgttcgggcacccgctgttgctgtggcaccgacacccgttcaacctcctataatagtcgctcctgtggcaactgttcctgctatgcctcaggaaaagctcgccagttcccccaaagacaagaaaaagaaagaaaaaaaggtcgccaaggtcgagccagccgtgagctcggtggtgaactccatccaggtgttgacttccaaggctgcaatcctcgaaacggccccaaaagagggcagaaacacagatgttgctcagtcccctgaagctccaaaacaggaggctccagcaaagaaaaagagtggttcaaaaaagaagggcccacccgacgcagacgggcctttgtatttgccatataaaacactcgtttccacagtcggatccatggtcttcaacgaaggggaggctcagaggctgattgaaatcctcagcgagaaagccggaatcattcaggatacgtggcataaggccacccagaaaggcgatccagttgccatccttaagagacagcttgaagagaaggaaaagctgctggccaccgaacaggaggatgcagccgtggctaagtcaaagcttcgggagctgaacaaggagatggctgccgaaaaggcaaaagcggcagcaggggaggcaaaagtgaaaaaacaactggtggcgagggagcaggagattactgcagtacaagcacgcatgcaagcctcctacagagagcacgtgaaagaggtgcaacagcttcagggaaagattcgcaccctccaggagcagctcgagaatggtccaaacacccaactcgcaagactgcagcaggagaactcaattctgagggatgcactgaatcaggcgacttcgcaggtagaatccaaacagaacgccgaactggccaaactgaggcaggaacttagcaaagttagcaaggagttggtggaaaagagcgaagccgtgcgccaggatgagcaacaacgaaaggctctggaggcaaaagctgcagctttcgaaaagcaggtgctgcagctgcaagcttctcatcgcgagtcggaggaggctttgcaaaaaagattagacgaggtgtctcgcgaactgtgccatactcagagttcacacgcctccttacgggcagacgcggaaaaagctcaggagcaacagcagcaaatggctgaacttcatagcaagctgcagagttcggaagcagaggtgcgtagcaaatgtgaggaattgagtgggctgcacggacaactgcaggaagccagagcagagaactcacaactcaccgagcggatacgtagtatcgaagcactcctagaggcgggtcaggcaagagatgcccaggacgtgcaggcctcccaggccgaggccgaccagcaacagacacggcttaaggaattagaatcacaggtgtccggattagaaaaagaagcgatagagttgcgggaggctgtggaacagcaaaaggtgaagaataatgatctgagggagaagaactggaaggccatggaagccttagcgacggccgagcaggcgtgtaaggaaaagctattgtccctgacgcaggcgaaagaggaatcagagaaacaactctgcctaattgaggctcagacaatggaggcactgctggccctgctgccagaactgagcgtgctcgcgcagcagaattacactgaatggctgcaggacctgaaggaaaagggacccaccctgctgaagcatccacccgctcctgccgagccttccagcgatctggcctctaagctgagggaagccgaagagacccagtccaccctccaggcagaatgtgatcagtatcggtcaattctggccgagaccgaaggaatgcttagagacctgcagaaaagcgtagaagaagaggagcaggtgtggagggcaaaagtcggagctgccgaggaggaactgcagaaatccagggttaccgttaagcatctggaggagatcgtggaaaaactgaaaggggaactggagtcgagcgatcaagtgcgggaacacaccagccacctagaggccgaactggagaagcatatggccgctgcttccgccgagtgccagaactacgcgaaagaggtagcaggcctcagacagctactattagagagtcaatctcaactggacgcagctaagtcggaggctcaaaaacagagcgacgaactggcactggtgcgacagcagttaagcgaaatgaaaagccatgtagaggacggggacattgccggtgctcccgcatccagcccagaggcccctcccgctgagcaggacccagttcagctgaaaacccaactggaatggacagaggcgatcttggaggacgagcagacccaacgccaaaaactgacagccgagttcgaggaagctcagaccagcgcgtgtcgccttcaggaagaactggagaagctgcgaaccgccggacctctggagtccagcgagaccgaagaggcctcccagcttaaagagagactagaaaaagaaaaaaaactgacatccgatctcggcagagccgctacacgcctacaggagcttcttaaaaccacacaggaacaactggctcgggaaaaagatactgtcaagaagctccaggagcagctcgaaaaagccgaggacggctcaagctccaaagagggtacatcggtgtag

SEQ ID NO: 239175 - DNA, 4233 bp, Artificial Sequence
  Description of Artificial Sequence: Synthetic coding sequence
atggacatctacgacacgcagacccttggagtggtggttttcggtgggttcatggtcgttagtgctataggaatttttttggtgtcaaccttctccatgaaagagacatcttacgaagaagcactggcaaaccagagaaaggaaatggccaagacacatcatcaaaaggtcgagaagaaaaagaaagaaaagaccgtagagaagaaaggcaaaacaaagaagaaagaagaaaaacccaatggcaagatcccagatcatgatccagcacctaacgttacagtgttactccgggagcccgtcagagcacccgctgtggcagtagctcccacacccgtgcagcctccaataatcgtggcacccgtggctactgtgcctgcgatgccacaagagaagttggcatcttcaccaaaggacaagaaaaaaaaggaaaaaaaggttgccaaggtcgagccggctgtgtcaagcgttgtaaactccattcaggtgttaacgagcaaggccgctatcctcgaaacggcacccaaagaagtgcccatggttgtggttcctccagtcggggctaaggggaatacacccgctaccggcacgacacaaggaaaaaaggcagaaggcacacagaatcagagcaaaaaggcagaaggggcacccaaccaggggaggaaggctgagggaactcccaatcaaggaaagaaaaccgagggcacgcccaatcagggaaaaaaggcagagggaaccccaaaccagggtaagaaagctgaaggtacacctaaccaagggaaaaaggccgaaggggctcagaaccagggcaaaaaagtggatactacccccaaccaaggcaaaaaagtggagggtgcccctacccagggccgaaaggctgagggcgcacagaatcaggctaaaaaggttgagggcgctcaaaaccaggggaagaaagccgagggcgctcagaatcagggcaaaaagggagaaggtgcccaaaaccaaggcaagaaggccgaaggggcacagaaccagggaaaaaaagccgagggcgctcaaaaccagggtaagaaggcagagggggcacaaaaccaaggcaaaaaggctgaaggggctcagaaccaaggaaaaaaagctgagggagcccaaaatcagggaaagaaatcagagggcgctcagaaccagggtaagaaagtggagggtgcccaaaaccagggaaagaaggccgagggtgctcaaaaccaaggaaaaaaagcagagggcgctcaaaaccaggggaaaaaggccgagggcgcacagaaccaggggaagaaagctgagggcgctcagaatcagggcaaaaaggcagagggtgctcagaatcaggggaagaaggccgagggggcacagaaccaaggcaaaaaagctgaaggcgcacagaaccagggcaagaaggttgagggggcacaaaaccagggcaagaaagccgaaggcgcacagaaccagggaaagaaagccgaaggagcccagaatcaggggaaaaaggccgaaggtgcacagaatcaggggcagaaaggagaaggggcacagaaccagggcaagaaaaccgaaggggctcagggaaagaaggcagaacgtagccctaatcagggtaaaaaaggcgaaggggcaccaattcagggaaagaaagcggactctgtcgcaaaccagggaaccaaggtggagggaataaccaaccaggggaagaaggcagaagggagtccctccgagggaaaaaaggctgaagggtcccctaaccagggaaaaaaagcggatgctgccgctaaccaaggaaaaaaaacagaatcagctagcgtccagggaagaaacacagatgtcgcccaaagtcccgaagcgcctaaacaggaggcaccggcaaaaaagaagagtgggtcgaaaaagaagggtgagccgggacctccggatgccgatggccctctgtatctgccttataagactctggtgagtaccgtgggatcaatggttttcaacgaaggggaggcccagcgcctgatcgaaatactgagtgaaaaagctgggatcatccaagatacgtggcacaaggctactcagaagggcgatcccgtagcaatcctgaaaagacagctcgaagagaaggagaagctgctggccactgaacaggaggacgctgctgtcgccaaaagtaaactacgtgagcttaataaggagatggcagccgaaaaagccaaagccgcagcgggagaagctaaggttaagaagcagcttgtggctcgggaacaggagataaccgcggtccaagcgaggatgcaggcgtcttaccgagagcacgtaaaggaggttcaacagctgcagggtaagatcaggactctccaagaacagctggagaacggtccaaatacccaactagcaagattgcagcaggagaattccatcctcagggacgcactaaaccaggctacaagccaggtggagagcaagcagaatgccgagctggcgaagctgcggcaagaattgtctaaagtctcaaaagagcttgtggaaaaatcagaagctgttcggcaggatgagcagcagcgaaaggcactcgaggcaaaagctgctgcttttgaaaaacaggttctacaactgcaagcctcacacagggagagcgaagaagcgttgcagaagaggcttgatgaagtctcaagagagctttgtcatacgcagtccagtcacgcctccctcagggccgacgcggagaaggctcaggagcaacagcaacagatggcggagctacactctaagctgcagtcctcggaagctgaggtgaggtctaagtgcgaagagctgagtgggctccacgggcagctccaggaggcaagggctgagaatagccagctcactgagcgcattaggagcatagaggctctgctcgaggccggacaagcacgggatgctcaggacgttcaggcttcacaggccgaggccgaccagcagcagactagattaaaggagctcgaatcccaagtgagcggattggaaaaagaagccattgaactcagggaagctgtggaacagcagaaagtaaaaaacaatgacctgagagagaagaattggaaagcaatggaagccctggccaccgctgagcaggcatgtaaagagaagctcctatccctcacgcaggcaaaagaggagtctgaaaagcaactctgtctgatcgaggcacagactatggaagcactcctcgccctgctgcctgagttgtcagtgttggcgcaacaaaattatacagaatggctccaagacctaaaggaaaaaggcccaacactgcttaagcacccacccgcacccgcagagccttctagcgacctagcatcgaagctccgagaggccgaagagactcaatctacattgcaagccgagtgtgaccaataccggtcaattcttgccgagaccgaaggaatgctgagagatttgcagaagtcagtggaggaagaagagcaagtatggcgcgctaaagtcggagccgctgaagaggagctgcagaaatctcgggtaactgtaaagcatctggaagaaatcgtcgagaagctcaaaggcgagcttgaatcttccgaccaggtgcgcgaacacacctctcatctggaagctgagctagagaaacatatggcggctgcttccgcagagtgccagaattatgccaaggaagttgccggacttagacagttactcttggagtctcaaagccagctggacgcagctaagagcgaggcccagaagcagtctgatgagcttgcactggtgcgacagcagctttctgagatgaagtcccatgtggaggacggcgatatagcaggcgctcctgcatctagtccagaagctcctccagctgagcaagatccggtgcagctgaagacccagctagagtggacagaggctatccttgaagatgaacagacacagaggcagaagctcactgcggaattcgaggaagctcagacatcagcgtgtaggctacaagaggagctcgagaagttacggacagctggcccactggaatcctcagagactgaggaagccagccagctcaaagagaggttggagaaggagaagaagctgacatcagacctagggagagccgctacacgactgcaggagctactaaaaacaactcaagagcagctagccagggaaaaagacacggtaaaaaagctccaagagcagctggaaaaggctgaagatggttctagcagcaaggaggggacatccgtttag

SEQ ID NO: 239176 - DNA, 903 bp, Artificial Sequence
  Description of Artificial Sequence: Synthetic coding sequence
atggacatttatgatacacaaactttgggcgtggttgtattcggaggctttatggttgtatccgctattggtatctttcttgtttctacgttcagcatgaaggagacgtcctacgaggaggctcttgctaaccaacgcaaagagatggcaaaaacacaccaccagaaggttgagaagaagaaaaaggagaaaacggtggagaaaaaaggcaaaaccaaaaagaaggaggaaaaacccaatggaaaaatcccagatcatgacccggcacctaacgtgaccgtgcttctacgggaacctgtgagagccccagctgtggcagtggccccaacccctgtgcagcctccaatcattgttgccccagtcgctacagtccccgcaatgccacaggaaaagctggcgagcagtccaaaggacaaaaaaaagaaagaaaagaaagtggccaaggtggaaccagccgtctcgtcagtggtgaactctattcaagtgctgacctcaaaagctgccatcctggaaaccgccccaaaggaagttcctatggttgtggttcccccagtaggcgctaaaggtaacaccccggctactggaaccacacaaggtaagaaggccgagggaacccagaatcaatctaaaaaagcggagggcgcacccaatcaaggtaggaaagcagagggcactcccaatcaaggcaagaagacagagggaacccccaatcagggcaaaaaggccgagggcaccccgaatcaggggaagaaggctgaaggcacgccgaaccagggtaaaaaggctgaaggggctcagaaccaaggcaaaaaggtagatactacccccaatcagggcaagaaggtggagggtgcgcctacacagggtaggaaggcggagggggctcagaatcaggccaaatag

SEQ ID NO: 239177 - DNA, 2256 bp, Artificial Sequence
  Description of Artificial Sequence: Synthetic coding sequence
atggtgtttaacgaaggcgaggcccagcggcttattgaaattttgtccgagaaggctgggatcatccaggatacatggcacaaggccactcaaaagggtgacccggtggctatcttgaaacggcagctcgaagagaaggaaaaactgctcgccaccgaacaggaggacgcggcagtggcaaagtccaagctgagagagcttaataaggagatggcggctgaaaaagctaaggcagctgccggagaagccaaggtgaagaagcagctcgtggctcgtgaacaagaaatcacagcagtgcaggctcgtatgcaggcgagttaccgggagcacgtcaaggaggtacaacaactgcagggcaagatcaggacactccaggagcagttggagaacggaccaaacactcagcttgccaggctgcagcaggaaaactctatattgagagacgctctcaatcaggcaaccagccaggtggaaagtaaacagaacgcagaactggccaagctaagacaggaactgtccaaagtgagcaaagaactggtcgaaaagtctgaagccgtgagacaagatgaacagcagagaaaagcgctggaggctaaagccgcagcattcgaaaagcaagtactgcaactgcaggcctcccatcgtgaatcagaggaggccctccaaaagcgcctcgacgaagtgtccagggaattgtgtcacacccagtctagccatgcctctctgagagccgacgctgagaaggcccaggaacaacagcaacagatggccgaactccattcgaagctccagtcctctgaggctgaggtgagaagtaagtgcgaagagctttctgggctacatggacagctccaggaggcaagagctgagaactcccagctcactgaacgcatccgtagcatcgaggccctgttagaggctgggcaggcaagggacgcacaggatgttcaggccagccaagcggaagccgatcaacagcagacccgtctgaaggagctcgagtcgcaggtctcgggtctggagaaggaagcaatcgagttaagggaggccgtcgagcagcagaaagtgaaaaataacgatctgcgagagaagaattggaaagccatggaggcgctggccacggcagaacaggcttgtaaggagaagttattgtcactgactcaagccaaggaggagtctgagaagcagttgtgtctcatcgaggcccaaaccatggaggcattacttgcactactgccggaactcagcgtactggcccagcaaaattacactgagtggctgcaagaccttaaagaaaaaggccctactctgctgaagcacccccctgctccagccgagccttcttctgaccttgcttcaaaattaagggaggcggaagagacccagtcaactctccaagccgagtgcgatcagtaccgctccattctggccgagactgaaggaatgcttagagatctgcagaaaagcgtcgaggaggaagagcaggtctggcgtgcaaaggtcggcgcagccgaagaggaactgcagaagtcacgggtaactgttaagcacctggaagaaattgtagaaaagctgaagggcgaactggagtcttctgatcaggtgcgggaacatacttctcacctcgaagccgaactggagaaacatatggctgctgcaagcgcagagtgtcaaaattatgccaaagaagtagcgggtctccgtcagctcctcttggagagtcagagccagttagacgcagctaagtccgaggctcaaaagcagagcgacgagctggcgctcgtcaggcaacagctgagtgaaatgaagtctcacgtagaggacggtgatatcgccggagccccagcttcgagccccgaagccccacctgccgagcaggacccagtacagcttaaaacacagttggagtggaccgaagccatattggaggatgaacaaactcagcgccagaagttgaccgcggaattcgaagaggcccagacatcggcctgtcggcttcaggaagagctggagaaactaagaactgccggtcccctggaatcttccgagaccgaggaggcgtctcaattgaaagagcggctggagaaggagaaaaaactgacttctgatctcgggcgtgctgctaccagactccaagagctactcaaaaccactcaagagcagctcgccagagagaaggatactgttaagaagctgcaggagcagcttgaaaaagctgaggatgggtcgtccagcaaggaaggtacttccgtctag

SEQ ID NO: 239178 - DNA, 663 bp, Artificial Sequence
  Description of Artificial Sequence: Synthetic coding sequence
atggcatcaggatgtaaaatcggcccttcaatcctcaattctgatttggccaacctgggtgcggagtgtctgaggatgctagattcaggcgcagattacctacatctcgatgtgatggatggctatatgcatatgatggtgagcaagccagaacagtgggtgaagcctatggcagtcgctggcgcaaaccagtatacattccacctggaggcgaccgagaaccctggagcgctaattaaggatatacgggaaaatggcatgaaaagctgttccgtgacacaggctgaagtacagtggcacagtcaaggtccgcttcaggtgggattggccataaaaccgggaacctctgtggagtatttggccccttgggccaaccaaatcgacatggccctcgtgatgactgttgagccgggatttggaggtcagaagttcatggaggatatgatgccaaaggtgcattggctgcgcacgcaattcccctctctggatattgaggtggacgggggtgtggggcctgacaccgtacataagtgcgccgaggcgggagcaaacatgatagtgtccggttctgcaataatgaggtctgaagatcccaggtcagtgattaacttgttgcgaaacgtgtgcagtgaggccgctcaaaagcgttcactggataggtag

SEQ ID NO: 239179 - DNA, 687 bp, Artificial Sequence
  Description of Artificial Sequence: Synthetic coding sequence
atggccagtggctgcaaaattggcccttcaatcctaaactctgatttggcaaatttgggagccgagtgcctcagaatgctggacagcggagcagattacctccacctggacgtgatggacggccactttgttccgaacataacattcggtcaccctgttgtggaatcactcagaaagcagctgggccaggacccgttttttgacatgcacatgatggtgtccaagcccgagcaatgggttaaacccatggcagtcgctggcgcaaatcaatacactttccacctcgaggcaacggagaacccaggcgctctgatcaaagatatccgtgagaacggcatgaaagtgggcctggcaataaagcccggaacgtctgtggaatatctggctccatgggcgaatcaaattgacatggctctagtgatgaccgtcgaacccggattcgggggacaaaaattcatggaggatatgatgccaaaggtccattggctccgcactcagtttccttcgctggatatcgaagtggacggcggtgttggccctgacacggtgcataagtgcgccgaagcaggagccaacatgatcgtgagcggatcagctatcatgcgtagcgaggatcctcgctctgtaattaatctccttaggaatgtgtgctccgaggctgcccagaagagaagcctggacagatag

SEQ ID NO: 239180 - DNA, 537 bp, Artificial Sequence
  Description of Artificial Sequence: Synthetic coding sequence
atgcatatgatggtgagtaaacccgagcagtgggttaaaccaatggccgttgccggtgctaaccaatataccttccacctggaagccacagaaaatcccggagctctgataaaagacatacgggagaacgggatgaaatcttgttccgtcactcaagcagaggtccagtggcactcccagggccctctccaggttgggctggctatcaagcctggcacaagcgtggaatatctggccccttgggccaaccagatcgatatggctctggtcatgacggtggagcccggtttcggtggccagaagtttatggaggatatgatgcctaaagtgcactggcttaggacacaatttccatccctggacatagaagtcgatggaggtgtcggccctgacactgttcacaagtgcgctgaggccggagccaacatgatcgtcagcggtagtgcaatcatgagaagtgaggatccacggtcggtgatcaacctgttgcgaaatgtgtgctctgaggctgctcagaaaaggagtctggaccgttag

SEQ ID NO: 239181 - DNA, 537 bp, Artificial Sequence
  Description of Artificial Sequence: Synthetic coding sequence
atgcatatgatggtgagcaagcctgagcaatgggttaagcctatggctgtcgcgggtgcaaatcagtatacatttcacctggaggcaactgaaaatcccggagctctgataaaggacattcgagaaaacggaatgaagagctgctcagtgacgcaggccgaggtccaatggcattcccaggggcctcttcaggtgggcctggcaattaagcccggtacttcggtcgagtatctcgcaccctgggccaatcagattgacatggccctggtaatgacagtggagcctgggtttggtggccagaaattcatggaggacatgatgccaaaagtgcattggctgcgaacccagttcccatcactggacatcgaggtcgacggaggagtgggccctgatacggtacacaaatgcgccgaggctggagctaacatgatcgtgtctggctctgctataatgcgttccgaggacccaaggtcagtcattaacctactccgcaatgtgtgtagcgaggccgctcaaaagaggagcctggaccgatag

SEQ ID NO: 239182 - DNA, 285 bp, Artificial Sequence
  Description of Artificial Sequence: Synthetic coding sequence
atgcatatgatggtctccaaacctgagcagtgggtgaagcctatggcggttgccggagccaatcagtataccttccacctggaggcgactgagaatcccggtgcactgatcaaagatatcagagaaaatggaatgaagagctgcagtgtcacacaggctgaagtgcaatggcacagccagggccctttgcaagtgggattggctattaaaccaggcacttcggtggaatacctggccccttgggccaatcaaatcgatatggcactcgttatgactgtcgagtag

SEQ ID NO: 239183 - DNA, 537 bp, Artificial Sequence
  Description of Artificial Sequence: Synthetic coding sequence
atgcatatgatggtgtccaaacccgaacaatgggtcaagcctatggccgttgccggagcgaaccagtatacgttccacctggaggcaacagaaaacccaggtgcactcatcaaagacatccgtgaaaatggcatgaagtcttgtagtgtaactcaggcagaggtacagtggcactctcagggtcctctgcaggtcggattggccattaagcctggcacctctgtcgaatatctggccccatgggccaaccagattgatatggctcttgtgatgacagtagagccgggattcggaggacagaagttcatggaggatatgatgccaaaggttcactggctgcgcacccagttcccttctctagacatcgaggttgacggaggcgttggccctgatactgtgcacaagtgcgccgaggcaggcgctaacatgatagtgagcggatcagcaataatgcgctctgaggacccacgaagtgtgattaatttgcttagaaatgtgtgttccgaagccgctcagaagagaagcctggatcgttag

SEQ ID NO: 239184 - DNA, 600 bp, Artificial Sequence
  Description of Artificial Sequence: Synthetic coding sequence
atggcttccggatgtaaaatcggaccttctatcctgaacagtgacctggccaacttaggagccgaatgtctgagaatgctggactcgggagccgattacctgcatctagacgtgatggatggtcactttgttcctaatatcactttcggtcaccccgtcgtggaatccctacggaagcagctgggacaggacccttttttcgacatgcacatgatggtcagtaaacccgagcagtgggtgaaaccaatggccgtggccggagcgaatcagtacacattccatctcgaggctactgagaaccctggggcacttatcaaggacattcgggaaaatggtatgaaggtcgggttagctatcaaacctggaacgtcggtcgaatatctggctccttgggcgaatcaaatcgatatggcactggtcatgaccgtcgaacccggtttcggcggacagaagttcatggaggacatgatgcctaaggcaggggctaatatgatcgtttctggatctgccatcatgcggtcggaggacccccgttccgtgattaatctgctgcggaatgtatgtagcgaagccgcacagaaaaggtccctggacagatag

SEQ ID NO: 239185 - DNA, 3159 bp, Artificial Sequence
  Description of Artificial Sequence: Synthetic coding sequence
atgcgtgaagcagccgaacgtagacagcagctccaactggagcacgaccaggctcttgccgtcctgtcagcaaagcaacaagagatcgacctcttgcagaaatccaaagtaagggagctggaggagaagtgtaggactcagtcagaacagtttaacctgctaagtcgagacctcgaaaaattccgacagcacgctggaaaaatagatcttcttggcggtagcgcagtagcaccacttgacatcagtactgctccatccaagcccttcccgcaattcatgaatggcctcgctaccagcctaggaaaaggtcaagaatcagcaatcggcggatcatctgctatcggagaatacatccgcccactcccgcagcccggtgacaggcctgagcctctcagtgcaaagcctacattccttagccgctccggcagcgctagatgtcgatcagaatctgacatggagaatgagcgaaacagcaacacatccaagcaacgatactccggaaaagtgcatctctgcgtggcccgatatagctacaaccccttcgacggcccaaacgagaatcccgaagccgaattgccgctcacggctgggaaatatttgtacgtatacggtgacatggatgaggacgggttttacgagggcgagctgctggatggccagcgtggccttgtaccatccaacttcgtggactttgtgcaggataacgaaagccggctcgcttcaacgctcgggaacgagcaggatcagaacttcataaatcactccgggattggtctggaaggtgagcatatcctcgatctgcacagccctacccatatagatgcgggaatcaccgataattccgctgggacactggacgtcaacattgatgatatcggagaggacatcgtaccttaccccaggaagatcaccctcataaaacaacttgctaagagcgtgatcgtgggatgggaacctccagcagtgccgcctggatggggcacagtatcctcgtacaatgtgctggtggataaggagacgcgcatgaacctgactctgggctcacggacaaaggctctaatcgaaaagctgaatatggcggcttgcacctacagaatttcagtccagtgcgtaacaagcagaggtagctctgatgagcttcagtgcacgctgctcgtgggtaaggatgtggtcgtggccccaagccacctcagggtggacaatatcactcagatctccgctcaattgagttggttgccgacaaacagtaactactcccatgtaatcttccttaatgaagaggaattcgacatcgtgaaggcagcgcgatataaatatcagttctttaacctgcggccaaatatggcctataaggtgaaggtgctcgcgaaaccgcatcagatgccatggcagctgcctttggagcagcgagaaaagaaggaggcctttgtggagttcagcaccctgcccgcaggccctcctgcccctccccaggacgtgacagtgcaggcgggagtaacccccgctactattcgcgtaagctggagaccccctgttctaacacctaccggcctctcaaatggggctaacgttacgggctacggcgtttacgctaaggggcagcgcgtagcggaggtcatatttccgacggcagatagcactgctgtcgagcttgttaggctgcgctccctagaggctaagggcgtgacagtcaggaccctgagtgcacagggggaaagtgtggacagcgccgtcgcagcggtaccgccagagctcttggtccctcccactcctcatcctagacctgccccacagtccaagcctctggctagcagcggtgtgcctgagaccaaggatgaacacctcggcccacacgctcgtatggatgaggcatgggagcagtcccgggcacctgggcctgtccatggtcatatgctggagccccctgttggtcccggaaggcgctccccatcaccttcgcgcatccttccacagccccaaggcacccccgtctccactaccgttgcgaaagctatggccagagaggctgcacagcgtgtagccgaaagttcgaggttggaaaagagatctgttttcctggagcggtccagcgcaggccagtacgccgcttccgacgaagaggacgcctacgatagtccagacttcaagcggaggggtgcctcagtggacgacttcctgaaggggtccgaattgggaaaacagccccactgttgccatggagacgaataccacactgagtcaagcagaggatcagaccttagtgacattatggaagaggacgaggaggaattatatagcgaaatgcaactggaggacggcggacgacgtagaccatctggcacgtcccataacgcattgaagatattagggaaccctgcgtccgcagggagggtggatcacatgggccgacgctttccacgcggttccgcgggaccgcagcggagcaggccagtgacggtcccttcgattgatgactacggaagggaccgcctatctcctgacttctacgaggaaagcgaaacagatcctggcgcagaggagctccccgctaggatttttgtggcactgttcgactacgatccgctcactatgtctcccaatcctgatgccgcagaggaggagctcccatttaaagagggtcagattattaaggtttacggcgacaaagacgctgacggcttctatcgtggagagacctgcgccaggttgggactgatcccatgcaacatggtctctgagatccaggctgacgatgaggaaatgatggatcagctgttgcgccagggtttcctgccattgaatacccctgtggagaagatcgagaggtctaggcgatctggccgtagacatagcgtgtccaccagaagaatggtagcattgtatgattatgatccaagagaaagcagccctaacgtcgacgtcgaggctgaactgacgttttgcacaggcgatatcatcacagtgtttggggagatcgacgaagacggattctactacggtgaactgaacggccagaaaggacttgttccttcaaacttcctggaggaagttcccgatgacgttgaagtctacttatctgatgcgcctagtcattactcgcaggatacccctatgaggtcaaaggctaagaggaagaaaagcgttcatttcactccatag

SEQ ID NO: 239186 - DNA, 1938 bp, Artificial Sequence
  Description of Artificial Sequence: Synthetic coding sequence
atgaatgggttggcgacctcactgggaaaaggccaggagtcagcgatagggggatcaagcgccattggggaatacatcagaccactgccacaacccggtgatcggccagaaccgctttcagcgaagcctaccttcctgagccgaagcggatctgcccgatgtcggagcgagagcgacatggagaacgagcggaactctaatacgagcaagcagagatatagcggaaaggtgcacctctgcgtagcccgttattcctacaacccatttgacgggcctaatgagaatcccgaagcagagctgcccctgaccgctgggaaatatctttatgtgtatggtgatatggacgaagacgggttttatgagggggagctgctcgatggacagcgcggactggtgccttctaacttcgtggatttcgtgcaggataacgagtcacgcttagcctccacattaggaaatgagcaggatcagaactttataaaccattccggcatcggtctggagggcgagcacatcctggatttgcacagcccgacacacatcgatgccggaattactgacaactcggccggtacattggatgtgaatatagacgatataggggaagacatagtgccataccctagaaagatcaccctgattaagcaattagccaagtcagtgatcgtcgggtgggagcctcccgctgtcccaccagggtggggaaccgtgtctagctataatgtgctagtggataaggagacccgtatgaacctgaccctcgggtcccgtacgaaggcactcatcgagaaacttaatatggccgcttgtacataccgaatttccgtgcagtgcgtcacttcccggggatcctccgacgagctacagtgtacactgctagtcggtaaggacgtggtggtcgcccctagtcatctacgtgtggataacattacccaaatctccgcacaattatcctggctgcctaccaattctaactactcgcacgtaattttcttaaacgaagaggagttcgatatcgtgaaggcggctcgctacaaatatcagttctttaatctgaggcccaacatggcttataaggtgaaggtgctggctaagccgcatcagatgccgtggcagctgcccctggagcagcgagagaagaaagaagcctttgtggagttttctacactgcctgctggtcctcctgcgccacctcaggacgtcactgtacaggctggtgttacacccgctacgatccgggtctcctggcgtcctcccgtgttgaccccaactggccttagtaacggcgctaacgtcacaggctacggggtgtacgccaaaggtcagcgtgtcgcagaggtgatcttccctactgcagattctaccgccgtagagttagttagactgagaagtcttgaggccaagggcgtgacagtgcggacactgtctgcgcagggcgagtctgtggatagtgccgtggcggctgtcccccctgagctcctggtgccacctacaccccatccacgacctgctccgcaaagcaaaccattagcaagctctggtgttcccgaaaccaaagacgagcaccttggaccacacgcgaggatggacgaggcctgggaacagtctcgggcaccaggtcctgttcatggccatatgctggagccacccgtcggcccagggagacgatctccctcacccagtaggatcctgccccaaccccagggcacgcccgtgtctactactgtggccaaagcaatggccagagaagctgcccagcgggttgccgaaagtagccgactggaaaaacgaagtgtttttctcgagcgctcaagtgccggacagtacgccgcatccgacgaagaagacgcctacgactctcccgacttcaaacgcaggggggcaagtgtcgatgattttttgaaaggatccgagctgggaaaacaaatggcttcttag

SEQ ID NO: 239187 - DNA, 1938 bp, Artificial Sequence
  Description of Artificial Sequence: Synthetic coding sequence
atgaatgggcttgccaccagtctgggcaaggggcaggagtctgcgattggcggatcgtctgctatcggcgagtatatccgcccactcccccagcccggagataggcctgaacctctctccgccaaaccgacctttctctcaaggtccggatctgcacggtgtcgctcggagagcgatatggaaaacgagcgaaacagcaatacaagtaagcagagatacagcggtaaggtacacctctgcgtggccagatattcttacaatccctttgacggtcccaatgaaaaccccgaagcagaactaccgctcaccgctgggaagtatctttatgtatatggagacatggatgaggatggattctacgaaggtgagctgctcgatggacagcgcggacttgtgcccagcaactttgtagattttgtccaggacaatgagtcccgattagcgtctactctgggcaacgagcaggatcagaatttcattaaccatagtggaataggattggagggcgagcatatcttggatctgcactctcctactcacatcgacgcgggaattacggacaattcagcaggaaccctggacgttaatatcgatgatattggtgaggacatcgtcccatatccaaggaagatcacacttatcaaacaactcgcaaaatctgtgatcgtgggctgggagccccctgcggtgccccctggctggggtaccgtgagttcgtacaatgtgctggtggataaggaaactagaatgaacctcacactgggtagccgaaccaaagcactgatcgagaaactgaatatggctgcctgcacctaccggataagcgtgcaatgcgtgacatctcggggatcctctgacgaactgcagtgcacactgctcgttggcaaggacgtggttgttgctcccagccatctcagagtcgataatatcacccagataagcgctcaactctcctggctccctacaaattcaaactactcacatgtgatcttcctcaacgaggaagagtttgatatcgttaaggccgcacggtataaataccaatttttcaatctgagacccaacatggcctacaaggtgaaagtcctggccaaacctcatcagatgccttggcagctgcctctggagcagcgtgagaagaaggaagccttcgttgaatttagtacgctccccgcaggtcctccggctccaccccaggacgtgacagtacaggccggagtgacacctgcaaccatcagggtgagctggcgccctccagtgctgacaccaacggggctttcaaatggcgctaacgtgactggctacggggtgtacgccaaagggcaacgagtggcggaagtaatttttccgacagctgactcaactgcagttgaacttgttcgcctcagatccctggaggcgaagggagtgacagtgagaactctcagcgcccaaggcgagtctgtagatagcgctgtagctgccgtgccaccagaactcctggtgcctcccaccccacatccacgccctgcaccccagagtaagcccctggcctctagcggcgtccctgagacgaaggacgaacatctcggacctcatgctcggatggatgaggcttgggaacaatcacgggctcctgggcctgtgcacggccacatgctcgagcctcctgtggggccagggcgacgaagtccctccccatcgagaatactgccccaaccgcagggtaccccggtgagtacaaccgtggcgaaagcgatggcgagagaggctgcacagcgcgtagcagagtcttcccgattggagaagaggtccgtgtttctcgagaggagttccgctggacagtacgcagcctcagatgaggaggacgcatatgactcacccgacttcaaacgtcgaggcgcatccgtcgatgatttccttaagggttcagagttgggaaagcagatggtttcctag

SEQ ID NO: 239188 - DNA, 4638 bp, Artificial Sequence
  Description of Artificial Sequence: Synthetic coding sequence
atgcagcgagagcgggaggcagaaatcagacaacttcttagatggaaagaggccgagcagcggcagctgcagcagttactgcaccgggagagggatggagtcgttagacaggccagagagctccagcgtcagctggccgaggagctcgtcaacagaggccattgctcaagacccggagcttccgaagtgagtgcagcccaatgccgctgcagactgcaggaggtgctggcccagcttcgctggcagaccgacggggagcaggcagcccgaattaggtatctgcaggctgcattggaggttgaacgacagctgttcttaaagtacatccttgcccactttcggggtcatcctgctctctcaggcagccctgatccgcaagctgttcacagcctggaggagccgctcccgcagacgtccagtggttcctgccatgcgccaaagcccgcatgccagcttggctccttagactcattgtccgctgaggtgggagtgagaagcaggagcctagggctcgtgtcttccgcatgttcgagctctcccgatggcctcctgagtacacacgccagctctttagactgctttgcaccagcatgcagtcggtcattagactcgacccgatctctccccaaggcctcaaaatccgaggagaggcctagcagtccagatacctcaacccccggttctagaaggctgagccccccaccttctccactgccacccccacctcctccctcagcacatcggaagctatctaatcctcgcggaggagagggctctgagtcccagccatgtgaagtccttactccttcaccaccagggctgggccatcatgagctcatcaagctgaactggctgctggccaaagcgctctgggtcctggcacgcaggtgttacactctgcaggccgaaaacaaacagcttagacgggcaggctgtccctaccaggcagatgaaaaggtgaaacgcctgaaagtgaagagagccgagctcaccggcctcgccagacgtctggctgaccgcgcaagaaagctgcaggaaacaaacttgagagccgttagcgcaccaatcccaggcgagtcctgtgcaggactagagttgtgccaggtatttgctcgtcagcgggcacgcgatttatctgaacaggcctcagccccactagcaaaagacaaacagatcgaagagctcagacaggagtgtcacctgcttcaggcacgggttgccagcggcccatgctcggacctccatactgggagaggtggcccatgcacacagtggctgaatgttcgggacttagacaggcttcagagggagtcgcaacgcgaggtgctgcggctgcagcggcagctcatgctgcagcaggggaatggaggggcttggcctgaggccggaggccagtcagccacttgcgaagaggttagaagacagatgttagcactggaaagagaactcgatcagcgtaggcgggagtgtcaggaattaggcgcacaggccgctcccgctaggcgtcgaggagaggaggctgagacgcagctgcaagccgctctcctgaagaatgcctggctcgccgaagagaatggcagacttcaggctaagacagactgggttaggaaagtcgaggcagaaaactccgaggtgcgcggtcacctggggcgtgcctgtcaggagcgcgacgcttcaggcctcatcgctgagcagctgctccagcaggcagctagaggccaggatcggcagcagcagctgcagcgggacccacagaaagccctgtgtgacctgcatccttcttggaaagaaatacaggcgcttcagtgcagacctggacacccgccagagcagccctgggagaccagccagatgcctgagtctcaagtgaaagggagcaggcgtccaaaatttcacgcacgccctgaggactatgcggtcagtcagccaaaccgtgatattcaagaaaaacgggaagcctcacttgaggagtctccagtagctttgggcgaaagtgccagtgtgcctcaggtgtctgagaccgtgccagcctcccagccattgagtaagaagaccagcagccagtcaaattctagttcagagggcagcatgtgggccaccgtgccgtcctcccctacattggacagggacaccgccagcgaggtggatgacttggagcctgactccgtgtcccttgccttagagatgggcggttccgcggctcccgcagccccaaagctgaagatcttcatggcacagtacaactataatcctttcgaaggcccaaatgaccacccagaaggggagcttccactgaccgccggagactacatctatattttcggcgacatggacgaggatggcttctacgagggcgaacttgaagacggacggagaggactcgtgccaagtaatttcgtggagcagattcctgattcttatattcctggatgcctgcccgcaaagtcccccgacctcggccctagtcagcttcctgccggtcaagatgaggccctcgaagaggatagcctgctcagcggcaaggctcagggcgtggttgacagggggctgtgccagatggtcagggtgggttctaaaactgaagtggcaactgagattctggacacgaaaaccgaagcatgccagttaggcctacttcagagcatgggcaagcagggcctgtctcgcccactgctaggcacaaaaggagttcttagaatggcccctatgcagctgcatttgcagaacgtcacggctacatctgctaacatcacatgggtctacagttctcatcggcacccacatgtagtgtatctggacgaccgggagcatgctctgaccccagctggagtgtcttgctacacgtttcagggcctctgtcccggaacccactatcgcgcacgggtggaagtcagactacccagggacctgctgcaggtgtactggggcactatgtcaagcacagtcacatttgataccctccttgcgggacctccctacccccctctggatgtgctggtcgaaagacatgcctcacccggagttctagtggtgagctggctgcctgtgacaatcgacagcgcgggaagttcaaacggcgtgcaggtcaccggatatgccgtgtatgctgacgggctgaaggtgtgtgaggtcgctgatgctacagcaggctcaactctcttggagtttagccaacttcaggttccgctaacttggcaaaaagtttcggtcaggactatgtccctgtgtggtgagtccctggattccgttccggctcagattcccgaagactttttcatgtgccatcggtggcccgaaacgccaccctttagttatacctgcggggaccccagcacttatcgggttaccttccctgtgtgtccgcagaagttgtctctcgctccgccttcagccaaggcctctccacacaaccccggatcgtgtggggaaccacaggcaaagtttctggaggctttttttgaagagccaccaaggagacagtcaccggtctcaaatctggggagcgagggggagtgcccttcaagcggtgctgggagccaggcacaagagttggctgaagcttgggagggctgtcggaaggatctgttatttcagaagtcccctcaaaatcatcgacctccctccgtatcagatcagcccggtgaaaaggagaactgctcgcagcacatggggacgtcgaagtcacccgcacccggttttattcacttacgaacggagtgcggtccgaggaaagaaccttgccaggaaaaggcagcgctcgaacgagttctccgtcagaaacaggatgcccaaggttttaccccccctcagctcggggctagccagcagtatgccagcgacttccataatgttttgaaggaggaacaggaggcgttgtgtctggacctgtggggtaccgaaagaagagaagagagaagggagccagagccccactcccgccaaggccaggccttaggtgtcaaaagggggtgtcagctgcacgagccttccagtgccttgtgccctgctccatctgctaaggtgattaaaatgcctcgagggggaccccagcagttgggcacgggagccaacacacccgctcgagtgtttgttgccctgtccgactataacccactcgtgatgagtgccaacctgaaggccgctgaagaagaactggtgtttcagaaaagacagctgctaagggtgtggggttcccaggacacccacgacttttacctatccgagtgtaataggcaagtaggtaatattccgggtcgcttggtggccgagatggaagtcggtacagagcagacggataggaggtggaggagcccggctcagggtaatctccctagcgtagcgcacctggaggactttcaggggctgaccattccacaggggtcttccttggtgttacaaggaaattccaaaaggttacccttatggacccctaagataatgatcgcagctctggactacgatccaggagatgggcaaatgggcggtcagggcaaaggacggttagccctgagggccggtgatgtggttatggtgtacggcccaatggacgatcagggcttttactatggcgagctggggggacatcgcggactggttccagcacacctgctcgatcatatgagtctccacggacattag

SEQ ID NO: 239189 - DNA, 4920 bp, Artificial Sequence
  Description of Artificial Sequence: Synthetic coding sequence
atggccaaggattcacccagtcctctaggggcttcccctaagaaaccagggtgttccagcccagccgctgcggtcttagaaaaccaaaggagagaactggaaaagctgagagccgagctcgaggcagagagggcagggtggcgggctgaaagaagacgttttgccgctcgcgagaggcaattgagggaagaagctgagagggaacgcagacagctggccgaccggcttcgatctaagtgggaggctcagagatcacgggagctgaggcagctgcaggaagaaatgcagcgggagcgggaggccgaaattcgccagctgttaaggtggaaagaggccgagcagaggcagcttcaacagttacttcatcgcgagagagacggagttgttcggcaagccagggaacttcagcggcagttggccgaggagcttgtgaaccgaggacactgttcacgaccgggtgcatctgaagtgagtgcagcgcagtgtcggtgccgtctgcaagaggtgttggcccagctgcgatggcagacagatggcgaacaggctgcccgaattagataccttcaagctgctcttgaggtggaaagacagcttttcttaaagtatattttagcacattttcggggacatcccgcactgtccggctcaccagatccacaagcagtgcatagtttagaagagcctttaccgcagaccagcagcggatcttgccacgctcctaagcctgcctgccagttaggaagtcttgatagcctgtctgccgaagtaggggtaaggagccggagcctgggtcttgtgtctagtgcctgcagttcttctcctgacggcctgctatccacccacgccagtagtttagactgcttcgccccagcgtgttctaggagtctggactccactcgctccctgcccaaggcaagcaagtctgaagagcgcccttccagccccgatacaagcacacctggatctcggcgtctgagccctccaccttcccccctcccaccgccacccccaccttcagcccatcgcaagctttccaatccgaggggcggtgaggggagcgagtcccagccctgcgaagttctgacaccaagtcctcccggactgggccaccacgaactcatcaaactgaactggctcttggccaaagcgttatgggttctcgccaggcggtgctacactctgcaggcagagaataaacaactgagacgagcaggatgcccataccaggcggatgagaaagttaaacgcctcaaagtgaaaagggctgagctgaccgggctagcaagacggcttgccgatagagcccgtaagctgcaggagaccaatcttagggccgtttcggccccaatcccaggtgaatcttgtgccggtctcgaattatgtcaggtgtttgccaggcagcgagctcgcgacctctccgagcaagcctcagctccactcgccaaggataaacagatcgaggagctgcggcaggaatgtcacctgctgcaagcaagggtggcttcaggtccgtgctcggacctccatacagggaggggaggcccatgcacccagtggctgaatgtcagagaccttgaccgcttacagagggaatctcaacgcgaggtccttagattgcagaggcagctgatgctccaacaaggcaatggtggtgcatggcctgaggccggaggacaatccgccacttgtgaggaagtcaggcgccaaatgctggctttagagagggagctggatcagagaaggcgcgagtgccaggaactgggggctcaagctgcccctgcacgacgaagaggtgaggaggccgagacccagctgcaggctgctttattaaaaaacgcttggctggctgaggaaaatggcaggctgcaggccaagacagactgggtccgcaaggtggaggctgagaactctgaagtgcgagggcacctgggacgcgcttgtcaggagcgcgatgctagcggattgatcgccgagcagctgctgcaacaggcagcacgtggccaggatagacagcagcagctgcagagagatccacagaaggccctgtgcgatttgcaccctagttggaaggagatccaggctctgcaatgccgcccaggccacccgccagagcagccttgggagacctctcagatgcccgagtcacaggtaaagggcagcagaagacccaagttccatgctcggcctgaggattacgcagtgagtcagcccaacagggacatccaagaaaaacgagaggcctccctggaggagagccccgttgctctgggagagtcagccagcgtcccccaagtgtcggagaccgtgcctgcctctcagccgctatctaagaaaaccagctctcaaagcaactcctcaagcgagggaagtatgtgggcaacagtgcctagttctcccacccttgacagagataccgcatctgaggttgacgatcttgaaccagatagtgtgtctctggccttagagatgggcggttcagcagcccctgccgctccaaagctcaagattttcatggcacagtacaactacaatccctttgaaggcccaaatgaccacccagagggagagctgcctcttacagcaggcgactacatctacatcttcggcgatatggacgaagacgggttttatgagggagaactcgaagatgggcgacgcggactggtgccttctaactttgtcgaacagatcccagattcttatatccctggctgtctcccggcaaagtcccctgatctgggtccttcacagcttcccgcaggccaggatgaggctctggaggaggacagtttactgtcaggtaaggcccagggcgtcgttgatcggggtctgtgtcagatggtgagggtaggcagcaaaaccgaggtggcgacggagatcctggacaccaagacggaagcttgtcaactgggactgctccaatctatgggcaaacaggggcttagtcggcctctgttgggaaccaaaggcgtacttcggatggcaccgatgcaactacatctgcagaatgtgaccgccacctctgccaacattacctgggtgtatagctctcacaggcaccctcacgtcgtttatcttgatgatcgagagcacgcattaacccctgctggcgtgtcctgctacaccttccagggcctctgcccaggcacacactatagagccagggttgaggtccgactgccccgagatttgctacaggtgtactggggaacaatgagctctaccgtgacgttcgatacgttgttggctggcccaccatatccacccctggatgttcttgtagaaaggcatgctagccccggagttctggtcgtgtcatggttgcccgtgactatcgatagcgctggctcatccaatggggtccaagttacgggatacgccgtgtacgcagacggactgaaggtgtgtgaggtcgctgatgcaaccgcgggttccacgctgctagagtttagccagctgcaggttccattaacttggcagaaggtttccgtgcgcactatgagcctctgcggcgaatcacttgattctgtgcccgctcagattcctgaggacttcttcatgtgccaccggtggcctgaaacccccccattcagttacacctgcggtgacccgagcacctatcgagtgacctttccagtgtgccctcagaaactctccctggcaccaccctctgccaaggcgagtccacacaatcctggctcgtgtggtgaaccgcaggctaagttcctggaagcttttttcgaggaaccgcctcgtcggcagagtccagtgagcaacctggggagtgagggagaatgtccgagctcgggcgcaggttcgcaggctcaagagctggctgaagcatgggaaggatgtaggaaggacctgttgtttcaaaaaagccctcaaaatcacaggccaccttccgtgagcgaccaaccaggagagaaagagaattgcagccaacatatgggcacttccaagtccccagctccagggttcatccatttgcgtaccgagtgtgggcctcgcaaggaaccatgccaagagaaagctgctctagagcgagtcctgaggcaaaagcaagacgcccagggatttacacccccacagctgggagcaagtcaacagtacgctagtgactttcacaacgtactaaaggaagagcaagaagcactgtgcctggacctatggggcacagaacgtcgggaagagcgacgggaacccgaaccccattcgagacaaggccaggctctgggcgttaagcgtgggtgccagttgcacgagccttctagtgcactgtgtcccgcaccatccgcaaaagtcataaagatgccacgtggcggaccacagcagctggggacaggcgcaaacacaccagcacgcgtgttcgtggcgttgtcagattacaatccactcgtaatgagtgctaacctcaaggccgctgaggaggagctggtgttccagaagaggcaattgttgagagtgtgggggtcccaggacacacatgatttctatctgagtgagtgtaatcgccaggtgggaaacatcccaggacggttggttgccgagatggaagtgggaactgagcagactgaccgccgatggaggtcacctgcccaggggaatctgcccagtgtagctcacttggaagactttcagggcctaaccattccacaaggctcttctctcgtgttacaggggaactccaaacgcctgccgctatggaccccaaaaatcatgatcgcagctctagattatgatccaggagacgggcaaatgggtggtcaggggaagggcaggctggcccttcgagctggcgatgtggttatggtctacggtcccatggatgatcaagggttctattatggtgagcttgggggacacagggggctggtcccggctcatttattagatcacatgagccttcacggtcactag

SEQ ID NO: 239190 - DNA, 4638 bp, Artificial Sequence
  Description of Artificial Sequence: Synthetic coding sequence
atgcaaagggagagagaagctgagattcgccaactgctcaggtggaaggaggccgaacagcgtcagttgcagcagctgttgcaccgcgagcgcgatggtgttgtccggcaagcacgcgaactgcagagacaactagctgaagaactggtaaaccggggacattgttcaagacctggcgcatctgaggtatctgcagcccagtgtaggtgccggctacaagaggtcttggcacagctaaggtggcagactgatggcgagcaggcagccagaataaggtatctgcaggctgctctcgaagtggagcgccagctgttccttaagtacatcctcgcgcatttccgcggacatccagctttgtccggaagtcccgatccccaagcggtccactctctggaggagccactgccccagacttccagtgggtcatgtcacgcccctaaaccagcctgccagctagggtccctggatagcttatctgcggaagtcggtgtgcgctcacgttctctggggctagtgagttctgcatgttcctcgtcccccgatggactactctccacacacgccagtagtctggattgttttgccccagcgtgttcaaggtcactggactctactcgttctctccctaaagcttcaaaatccgaagaaagaccgtcgtctcctgatacatctaccccgggttcacgccgactgtctccgccaccaagtccattgcctcctccacctcctccatctgcccaccgcaagctgtccaatccacgaggtggcgagggaagcgaatcccagccatgcgaggtgttgaccccgtctccccctggactcggccaccatgagcttataaagctcaattggcttctggctaaagcgctgtgggtactagcccgtagatgttacaccctgcaggaggagaataaacagcttagacgagccggatgtccataccaggctgacgaaaaggtcaagcgcctgaaagtgaaacgcgcagaactcaccgggcttgcgagaaggctggctgacagggccagggagctacaggaaacaaacttgcgcgcagtgagcgcccctatacccggtgaaagttgtgcgggtcttgaactgtgtcaggtgttcgctcggcagcgagccagggatctttccgagcaggctagcgcaccattagccaaggataagcagatcgaggagttaagacaagagtgccaccttctccaggctcgggtagcatccgggccttgttccgacctccacaccggcaggggcggtccatgcacccagtggctgaacgttcgggatctagaccgcctacagagagagagccaacgggaggtcttacgcttgcagcggcaactcatgctccagcagggaaacggcggtgcatggcccgaagcaggcggtcagagtgccacatgcgaggaagtgagaaggcagatgctggcgctggagcgcgaactggaccagcggagacgggagtgtcaggaacttgggactcaggctgcccctgccaggcgcaggggcgaagaagctgagacgcagctgcaagcagctctgctgaaaaacgcttggctagcggaagagaatggacggttacaggctaagacagactgggttaggaaggtcgaagctgaaaatagcgaagtgcgcggacacctcgggcgagcttgtcaggaaagggacgccagtggccttattgcggagcagctcctgcagcaggccgcacggggacaggaccggcagcagcagctgcagagagacccacagaaggccctttgtgacctccacccctcatggaaagagatacaagccctgcagtgccgcccaggccaccctccggagcagccctgggagacaagtcagatgcccgagtcacaagtcaaaggatctagacggccaaaattccatgcccgaccagaggactacgctgtgagccagccgaatagggatattcaagaaaagagggaggcctcccttgaggaatcaccagtcgcactgggagaaagtgctagtgtacctcaggtgtcagaaacggtgcctgcttcccagcccctctccaagaagacttccagccagagcaatagttcctcagaggggtccatgtgggcgactgtgccgagtagtcccactttggacagggacaccgcctcagaggtcgacgatctggagccagattcggtctctctcgctctggaaatggggggatcagctgccccagcagccccaaaactcaaaatattcatggcacagtataactacaaccccttcgagggcccaaatgatcaccccgaaggcgagctacctctaaccgctggagactacatttacattttcggcgatatggatgaggacggcttttatgaaggggagctcgatgacggtcggaggggactcgtgccgtctaatttcgtcgagcagattcccgacagttacatcccaggatgtctgcctgcgaagtcaccagacctgggaccgagccagctccctgcagggcaagatgaggccctggaagaggacagccttctgtcaggcaaagcccagggcatggtggaccggggactctgccagatggtcagagtcggttctaaaacggaggtagccaccgagatcctcgataccaagaccgaggcctgccagctggggttactccagagcatgggtaagcaaggacttagcagacccctgcttgggactaaaggggtgctaaggatggcacctatgcagctgcatctgcagaacgtgaccgcaaccagcgccaatatcacttgggtttactcgtcccatagacatcctcatgtagtgtacctggacgaccgcgagcatgccctgacgccagccggtgtgtcctgttatacattccaaggtttgtgtcctggcactcattatcgcgtacgggtggaagtgcggttgccttgggacttactccaggtgtactggggaactatgagttctactgtcactttcgacactctgctggctggcccaccctatcctcctctagaggtgcttgttgagagacatgcctctccaggagtgttggtggtgtcatggctgccagtgactatcgacagcgccggttcctctaacggagtgcaggttactggctatgccgtgtacgcagacggactgaaagtatgtgaagtcgccgatgctaccgcaggctctaccgtcctcgaattctcacagttgcaggtacccctgacatggcagaaggtgagtgtgcgcactatgtccctctgcggagagtcactggacagtgttcccgcacaaattcccgaagacttctttatgtgccatagatggccagaaacaccgcctttttcatacacatgcggggatccctcaacatatagagtgactttcccagtttgtccccagaaactgagcctagcaccaccgtccgccaaagctagtccacataacccgggtagctgtggtgaaccccaggccaagttcttggaggcattcttcgaggaaccacctcgacggcaaagtcctgtgagtaatttagggagcgaaggtgaatgcccgtcgtcaggggctggcagccaggctcaggaactggctgaggcctgggagggttgtagaaaggatctgctgttccagaagagcccacaaaaccatagacccccaagcgtcagcgatcaaccaggggaaaaagagaattgttaccagcacatgggcacctccaagagccctgccccaggcttcatccacctgcgcactgagtgcggacctcggaaagagccctgccaggaaaaagccgctctagaacgggtgctgcgtcaaaagcaagatgcacagggttttactcctccacagctgggagcttctcagcaatacgcttccgactttcacaacgttttgaaggaggagcaggaggcactttgtctggatctccgaggaactgagcgccgtgaggagagaagggaaccggagcctcactcgagacaaggccaagcactgggagtgaagcgtggttgccaacttcacgaaccttcatcagcactgtgccctgcccctagcgcaaaggttataaagatgccccgtggagggcctcagcagctgggcacaggcgctaatacacccgcacgcgtcttcgttgctctaagtgactacaatcccctcgtcatgtccgctaacctcaaggccgctgaagaggagttggtctttcagaagagacagctgcttagagtctggggctcccaggacacccatgacttctacttgtccgagtgcaatcggcaggtaggcaacattcccggtcggcttgttgcagagatggaggtcggaaccgaacagacagatcgacgttggagaagtcctgcacagggacacctgccaagcgtggcccacttggaagacttccaaggcctgacgattccccaaggctcctccctggttcttcagggtaactcgaaacggctacccttgtggacacccaagatcatgattgccgctctcgactatgaccctggcgatggtcagatgggcggtcagggaaaaggacggctggcccttcgcgcaggagacgttgttatggtctacggcccaatggacgaccagggtttctattacggagaactcgggggtcatcgtggcctagtgcccgctcatcttttagatcacatgtcactgcacggccactag

SEQ ID NO: 239191 - DNA, 4920 bp, Artificial Sequence
  Description of Artificial Sequence: Synthetic coding sequence
atggcaaaggacagcccatccccactgggcgcttcacctaagaagccagggtgttcctctcctgccgcagctgtgctcgagaatcagaggcgtgagctggaaaaactccgtgccgaacttgaggcagagcgggctgggtggcgggcagaaagaaggcgtttcgccgctagagagcggcaactccgggaagaagccgagcgggagcgcagacagctcgccgatcggctacgttccaagtgggaagcccagcgctcaagggagcttagacagcttcaggaggagatgcaaagggaacgggaggcagagattaggcagctgctacggtggaaggaggcagagcagaggcagctgcagcaattgcttcatagggaacgcgatggtgtggtaagacaggctcgcgagctgcagcgccagctggcggaagagctggtcaatcgcggtcactgcagccggcctggagcatccgaggttagcgctgcgcagtgtagatgtcgactccaggaagtgctggcccaattgaggtggcagacagatggggagcaggcagctagaatcagatacctgcaagcagcactcgaggtggagaggcaactgttcttaaagtacattcttgctcacttcagaggccatcccgctctgtctggatcaccagacccacaggcggtccactccctagaagaacctctgccacagacatcaagcgggagctgtcatgccccaaaaccagcgtgccagctggggtcactagacagtctgtctgcagaagtgggggttaggtccagatctcttggactagtatcttccgcctgctcgtcttcacccgatgggctactgtctactcacgcgtcaagcctcgattgctttgcccctgcttgctctagatcattggattcaacgaggagcttgcccaaggctagcaaatcagaggaaagaccatcctctccggacacatctacccctgggtcaaggagattgtccccccctccctctcccctccctccaccacccccacccagcgctcacagaaagctctctaacccacgcggaggggagggatccgagagtcagccttgtgaggtactgacaccctctcccccaggactaggtcaccacgaactaattaagttgaattggctgctcgcgaaggccttgtgggtgttggcccgtagatgttatactcttcaagaggagaacaagcaactgaggagagccggttgcccttatcaggccgacgagaaagtgaaacggctgaaggtgaaaagagccgagctgacgggtctcgccagaagactggcagacagggctagggaactgcaggagaccaacctgagagctgtgtctgctcccattccgggtgagtcttgcgctggccttgaactttgccaggtgttcgcgcgacagagggcccgagatctctcggaacaggcctcggcaccccttgctaaggacaagcagattgaggagctgagacaggagtgccacttgttgcaagcaagggtggcctcaggaccctgcagcgacttacacactggcagggggggaccctgcacccagtggctcaatgtccgcgacctggataggctacagcgggagagccagcgggaagttttgagactacagagacaactgatgctgcagcaaggaaacggtggggcttggcccgaagcaggcggacagtcagcaacatgtgaagaagttcggcgtcagatgctcgctctggaaagggagctggaccagcgacgccgtgaatgccaggagttgggtacacaagccgcacctgccagaaggagaggtgaggaggccgagacccagctacaggccgcactgctaaagaacgcgtggctagctgaggaaaatggcagacttcaggcgaagacggactgggttcgaaaggtggaggctgagaactcagaagtcagggggcacctgggaagggcttgccaagagcgcgatgcgagcggtttaattgcagaacagctgctgcagcaggctgcacgcggacaagatcgccagcagcagttgcagagagacccccagaaggccctgtgcgatctgcacccaagctggaaagagatccaggcattgcagtgtagacccggacaccccccagagcagccctgggaaacgagccagatgccagaaagtcaggtgaaaggatcccgaaggcctaaatttcacgccaggcctgaggactatgccgtgtcccaaccaaatcgggatatccaggaaaagcgtgaggcgtccctggaggaatccccagtcgcccttggagaaagtgcctctgtgcctcaggtttccgaaacagtgccagcttctcagcctctctccaagaagacaagcagtcagtccaacagttcttccgaagggtctatgtgggctactgtgccctccagccctactctggaccgggacaccgcctctgaagtggacgatctggaacccgattctgtctcgctggcgcttgagatgggagggtctgcggctccggcagcgcctaaactaaaaattttcatggcccagtacaactacaatcctttcgaaggcccaaacgaccatccggaaggggagctcccgttgaccgcaggggattatatttacatattcggcgacatggatgaggacggattttatgagggtgaactggacgacgggagacgcggtctcgtgccttcaaactttgtggaacagattcccgacagctatattcctggctgcctccccgctaagtcgccagacctcgggccatctcagctgcccgcaggtcaggacgaagcactcgaagaggactccttattatctggcaaggcacagggcatggttgaccggggattatgccagatggtacgcgtaggctccaagaccgaggtggcgacggaaatcctagatacaaaaaccgaagcctgtcagttagggctgcttcagtccatgggcaagcagggcttgagtaggccacttctgggcactaagggcgtgttgcgcatggcgcctatgcaacttcacctccaaaatgtgacggcaacctccgccaacatcacatgggtgtattcctcccaccggcaccctcatgttgtgtatctggatgacagggagcatgctttgacccctgcgggagtcagttgctacacttttcagggcctgtgtcccggaacccattacagagtgagagtggaggtgcggctaccatgggatctgttacaagtctattggggcactatgagctccacagtaacatttgatacactgctcgctggtcctccgtacccccctctcgaggtcctggtagagagacatgcatcgcccggagttttggttgtatcttggctacccgtgacaattgacagcgccggaagcagcaacggtgtccaggtgactggatacgccgtttacgcggacggactgaaggtctgtgaagtcgcagatgctacagccggaagtacagtgctggaatttagtcaacttcaggtgcccctgacctggcagaaggtgtctgtgcgtactatgtctctgtgcggcgaaagcctcgattccgtccccgctcagataccggaagacttttttatgtgtcatagatggccggagacgccccctttttcatatacatgcggtgacccatccacttatcgggtcacctttcccgtgtgcccgcagaaactatctctggctcctcccagcgccaaagcgtccccccacaaccccggatcctgcggtgagccacaggctaagtttcttgaggctttcttcgaggagcctcccagaaggcagtcgccagtaagcaacttgggtagtgaaggcgagtgtcctagttccggggctgggagccaggcgcaggaactggccgaggcctgggaggggtgcagaaaggatctcctgttccagaaatccccccagaatcaccgacctccttccgtcagcgaccagccgggagagaaggagaactgttatcagcacatggggacaagtaagtctcctgcccctggttttatccatctgcgcaccgaatgcggtccgcgaaaggagccatgccaggaaaaagccgctctggagcgggtactgcgtcagaaacaggatgctcaaggattcacacctccgcagcttggcgcatctcagcagtacgcttccgatttccacaacgtgctgaaggaggagcaagaagccctgtgtctggacctccggggtaccgaaagaagggaggaacgtcgagaacccgagccccacagcaggcagggacaagctcttggtgtaaaaaggggttgtcagctgcacgagcccagctccgccctttgtcctgcaccttccgccaaagtgatcaaaatgccccgaggtggcccacagcaactgggcacgggggctaacactcccgctagggttttcgttgcgctttctgattataacccactcgtaatgtccgccaacctgaaggctgcggaggaagagttagtgtttcagaaaaggcagttgctaagggtgtggggcagtcaggatactcacgatttctatctgtcagagtgcaacagacaagtcgggaatattcctggcagacttgtcgccgagatggaagttggaactgagcagacagacagacgttggcggtccccagcgcagggccacttgccctccgtggcccacctggaagattttcagggtcttactattccgcagggttcatctcttgtcctccagggaaacagcaagagactgccactctggactcccaaaattatgatagccgctctcgactacgaccccggagacgggcagatggggggacaagggaaaggacggctggcactgcgcgcaggtgatgtagttatggtgtacgggccaatggatgatcaggggttttactacggcgagttgggaggtcacaggggactggtacctgcacacctgttagaccacatgtctctgcacggtcactag

SEQ ID NO: 239192 - DNA, 4638 bp, Artificial Sequence
  Description of Artificial Sequence: Synthetic coding sequence
atgcagcgtgaacgggaagccgaaattagacagctcctgaggtggaaagaagccgaacagcgccagctccagcagctgctgcaccgcgagagggatggcgtcgtccgccaggcgcgagaactccagagacaactggcagaagaactcgttaatcggggacactgtagtagacccggtgccagcgaggtatccgctgcccagtgccggtgtaggctgcaggaggttttagctcagcttcgctggcagactgacggcgaacaggccgcacggatccgctacctgcaggctgctttggaggtggagagacagctgtttctaaaatatatcttagctcacttcaggggccaccccgctctgtccggcagcccggacccacaggcagttcattcccttgaggagcccctgccccagacctcctctggatcttgtcacgcacccaaacccgcttgtcagctcggttccctggatagtctgagtgctgaggtgggtgtgcggtcacggagcctgggcctcgtgagctcagcctgtagttcttcaccagacggtcttctttcaacgcacgctagttcgctcgattgcttcgcccctgcttgttcacggagcctggacagtacaaggagcctgccaaaggcttccaaaagtgaagagagaccttcgtctccagatacatcaacacccggtagtcgtcggctcagcccccctccaagcccgctccctcctccgccacccccatcagcccaccgaaagctcagtaatcctcggggaggcgagggcagcgaaagccagccttgtgaggtgctgactccatcaccaccagggctggggcaccatgaattaatcaagctgaattggctgcttgctaaggcgctctgggtgcttgccagaagatgttacaccctccaggaggagaacaagcagttgcgcagggctggttgcccataccaggcagacgagaaggtaaaacggcttaaggtgaaacgggcagagctaacaggcctggcccgacgcctggcggatcgggcacgggagctgcaggagaccaacctgagggctgtgtcggcacccattcctggggaaagctgcgcgggtctggaactatgtcaggtgttcgctcgccagcgtgctcgcgatttatcagagcaagcatcagccccactggcgaaagacaagcagatcgaggaactgcgacaagaatgtcaccttctgcaggcccgagtggcctctggaccctgcagcgatttacatacaggaagaggcggaccctgtactcaatggttgaacgtgcgggatctggataggctccaacgagaatcccaaagagaagtcttgaggctccagcgccaattaatgctgcagcaggggaacggtggggcatggcccgaagccggtggccagtcagcaacatgcgaagaagtgagaaggcagatgctggccctggagagggaactcgatcagagacgacgggagtgccaggaactgggtacacaggccgcacctgctcggagacgtggggaggaagcagaaactcagcttcaggctgccctgctgaaaaatgcttggctggcggaagagaacggtcgccttcaggcgaagactgattgggttagaaaggtggaagccgagaacagcgaagtccgcggtcacttggggcgtgcctgtcaagaaagggacgctagtggcctaattgcagagcagttgctgcagcaggccgcaagaggccaggaccgccagcaacaactgcagagggacccccagaaggctctgtgcgatctgcatccctcttggaaggagatccaggccctccagtgccgtcccggacacccccctgaacagccgtgggaaactagccaaatgcccgagagccaggtgaagggctcacgaagaccaaaattccacgcacgccctgaggactacgccgtttcacagcccaaccgtgatatccaggagaaaagagaggcatccctggaagagagccctgtggcactgggtgagagcgcctccgtgcctcaggtcagcgaaacagttcccgcaagccaaccgttgtctaagaaaactagtagtcaatctaacagctcaagtgaggggagcatgtgggccaccgttcctagcagtcctaccctggatcgagacaccgcaagcgaggtcgacgacctggagccagactccgtatccctggcacttgagatgggcggatcggctgcaccggcagcaccgaaactgaagatatttatggcacagtataactataatccctttgagggccctaatgatcacccagaaggagaactaccgctcactgccggtgactacatctatattttcggtgatatggacgaggacggcttctacgagggcgagctggatgatggaagaaggggactggtaccctcaaatttcgtggagcagattccggattcctacatacctgggtgtctgcctgctaagtctcccgaccttggtcctagtcagcttccagcaggccaggatgaggcacttgaagaagactcactgctgagcgggaaggctcaaggcatggtggacaggggtctgtgccagatggtgcgggtcggctcaaagacagaagttgccacggagatccttgataccaaaactgaggcatgtcagctaggcctcctgcagagtatgggcaagcaaggtctgtctcgtccgctactcggtaccaaaggggtgctgagaatggcacccatgcaactgcatctgcagaatgtgacagctacctctgccaacatcacttgggtctactcatcccatcgccacccacacgtggtttatctcgatgatcgagaacatgccctcacacccgcaggcgtgagttgttacacattccaggggctgtgcccaggcacacactatcgtgtccgggtcgaagtcaggctgccctgggacctgctccaagtgtattgggggacgatgtccagcaccgtgacctttgataccttgctagcagggcctccatatccacctctcgatgtgttagtcgaacgccacgcctccccaggtgtgttggtcgtgagctggctccccgtcacaattgacagtgcgggaagtagcaacggcgtgcaagtgaccgggtacgctgtctatgctgacggtttgaaggtgtgcgaagtagcggacgccaccgccggttcgacggtgctggaatttagccaactgcaagtcccccttacgtggcagaaggtgtccgtgagaacgatgtccctctgcggagaaagcctggattccgtgcccgctcagattcctgaagacttctttatgtgccacagatggcccgaaacaccccctttctcatatacatgcggagatccttccacctatagggttaccttccctgtgtgtcctcaaaaactgagccttgcaccaccctctgcgaaagcatcaccccacaaccccggtagctgtggagagcctcaagccaaatttctcgaggcattctttgaggaaccaccccgacgtcaatctcccgtgtctaatctgggtagtgaaggtgaatgccccagttccggagccggtagccaggcacaagaactggctgaggcttgggaggggtgccgcaaggatctgctgttccaaaaatctccccagaatcatcggccaccttcagtttccgatcaacccggagagaaggaaaactgttatcagcatatgggaacttctaagtcccccgcacctggtttcatccaccttcgcaccgagtgcggtcccaggaaggagccctgtcaagagaaagccgctcttgaacgggtattaaggcagaagcaggatgcacagggtttcactcccccacagctgggagccagtcagcagtatgccagtgactttcacaatgtgcttaaggaggaacaggaagccctgtgcctcgatctgaggggaacggaacggagagaggagcggcgtgaaccagagccgcattcaagacagggacaggccctgggcgtcaagaggggttgtcagctccacgaaccttcctccgctctgtgccccgctccttccgctaaggtgatcaaaatgcctagaggtgggccacagcaactgggtactggggctaatacacccgcaagggtttttgtggccctgtccgattataaccctttagtcatgtccgccaatcttaaagctgccgaagaggaactggtctttcagaagaggcagctcctccgcgtgtggggctcccaggatacccacgatttttacctttctgagtgcaatagacaagtgggtaacatccccggtcgtctagttgcagagatggaagtgggaaccgaacaaactgatagaagatggcgaagtcctgcccagggccacttaccctccgtcgctcaccttgaagactttcaggggctaataattcctcagggatcgtcgctcgtgctccaagggaatagtaagcggcttcctttgtggactcctaagattatgattgccgctctcgactatgatcccggtgacgggcagatggggggtcaagggaaaggtaggttagctctgagagctggcgatgtggtgatggtgtacggccctatggatgaccaaggattctattatggggagctgggcggacatcgtgggctggtgcctgcccacctcctagaccatatgagtttacacggccactag

SEQ ID NO: 239193 - DNA, 4920 bp, Artificial Sequence
  Description of Artificial Sequence: Synthetic coding sequence
atggcgaaggactctcctagtccactgggcgcttcgcctaagaaaccagggtgtagtagtccggcagccgctgtgcttgaaaaccagaggcgggaattagaaaaacttcgagccgagttggaagccgagcgcgctggatggagggctgaaaggcggagattcgccgctcgcgagcggcagctgagagaggaggcagagagagaacgcagacagctggcagacagactccgcagtaagtgggaggctcaacggtcacgagagctgagacagctgcaggaggaaatgcagagggagcgggaagctgaaattagacagctgttaaggtggaaggaagccgagcagcgccagctgcaacagcttcttcacagagagcgggatggggtggttcgtcaagctcgcgaactgcaacggcagctggctgaggagttagtcaatcgtggacactgtagccggccaggcgcatccgaggtgtccgcagctcagtgcaggtgcaggctgcaggaagtccttgcccagctcagatggcagactgacggtgagcaggccgcacgcattcgttatctacaggcagccttggaagtcgaaagacagttgtttttgaaatatattttagcccatttccgtggacaccccgcactctccgggtcccccgaccctcaagctgtgcactccttagaagagccactgccacagacgagttccggtagttgtcacgcacctaaacccgcttgccaactgggtagtctggactcgctcagtgccgaggtcggagtccggagccgcagtcttggtctcgtaagcagcgcgtgcagttccagcccggacggtctcctaagcactcatgccagcagccttgattgctttgcacccgcatgttcccggagtctcgatagcactaggtcacttcctaaggcctctaagtccgaagaacgtcctagcagcccggatactagcacgcctggatcacgccgtctgtcgcctccaccaagccccctcccccctcctccaccgcctagcgcacatagaaagctctccaatccccgaggtggcgaaggctctgaaagtcagccgtgtgaggtgttgaccccaagccccccaggtctcggtcaccacgaactcattaaactgaattggttgctcgcaaaggccttatgggtgctggctagacggtgctacactcttcaggaggagaacaaacagctaaggcgagctggctgtccttatcaggcagatgaaaaggtaaagaggttgaaggtgaagagggctgagctgaccggcctggctagacggctggcagatcgagccagagagcttcaagagaccaatctgagagccgtctccgctcccatccctggtgaatcgtgcgccggtctcgaactgtgccaggtatttgccagacagagggctagagacttgagcgagcaggcttcagcaccgttagccaaggacaaacagattgaggaactgaggcaggaatgccatctgctgcaggctagggtcgcttcaggaccttgctccgatttgcatacaggcagagggggtccctgtacacagtggctaaacgtgagagatctggaccggctgcagagagaaagccagcgggaggtcttgaggctccaaagacagttaatgctgcaacaggggaatgggggagcttggcctgaggcagggggacagtctgctacatgtgaggaggtgcgtcgccaaatgttagcgttggagagggaactggatcagcggcgtagggaatgtcaagagctgggaacgcaggctgctcctgccaggcgtcggggagaggaggccgaaacccagcttcaggccgcactcttgaagaacgcctggctggcggaagaaaatgggaggctacaggccaagaccgattgggtgcgcaaggtggaggcggagaatagcgaggtcagggggcatctggggcgagcatgtcaggagagagacgctagcggcctaattgctgagcaattgcttcagcaagcagcccgagggcaagatcgtcagcagcagctgcaacgagatccgcaaaaggccctctgcgatctgcatcccagctggaaagagatccaggcgctgcagtgtcgacccggtcacccccctgaacagccctgggagaccagccagatgccagaatctcaagttaaggggtctcgcaggcctaagttccatgcacgcccagaagattacgccgtttcccagcccaacagggacatacaagagaagagagaagcttcattagaagagtctcctgtggcgctcggtgagagtgctagcgtgccacaggtgtcggagactgttcccgcttcccagcctttatcaaaaaaaacctcatcgcaatccaactctagcagcgaaggatccatgtgggccacggtgccaagttcacccacactggatcgcgacacagcttctgaagttgacgatctggaacctgacagcgtgagcctggccctggaaatggggggttctgcagcgcctgccgctcccaagctgaaaatatttatggcccagtacaattataatccctttgaagggcctaacgatcacccagagggtgaactacctctgacagcaggtgattatatctatattttcggtgatatggacgaagatggtttttacgagggcgagctcgatgatgggaggagagggcttgttccttctaactttgtggagcagatccctgatagctatataccgggttgtctccctgccaagtctcctgacctgggtccctctcagctgcccgctggccaggacgaggcccttgaggaggacagtctcctgtcagggaaggcacaaggaatggtagatcgtggcctgtgccagatggtgcgggtcggaagtaaaacagaggtagctacagagattctcgatactaagactgaggcctgccagctcggtcttcttcagtcaatgggcaagcagggactatccaggccccttctgggtacaaaaggggtgctccgaatggctccaatgcagctgcaccttcaaaacgtgactgctacctcggccaacatcacatgggtatatagttctcatcggcatccgcatgtggtctacctcgacgacagagagcacgcgctgacgcctgcgggtgtgtcctgctacacatttcaggggctgtgtccaggaacacactaccgggtccgcgtggaagttagacttccctgggacctgctgcaagtctactggggaactatgagcagtacagtcacgttcgacacactcctggccggtcccccatacccacccctggacgtcctggtggagagacacgcatccccaggtgtgctggtggtgtcatggctgcctgtaaccatcgactcagcgggtagttccaacggagtgcaagttacaggatacgctgtatatgccgacggcctgaaggtctgcgaggtcgcagacgcgacggccggttcaactgtgctggagttttcccaactgcaggtcccattgacatggcaaaaagtatctgtacggacgatgagcctttgcggcgagagcctcgactccgtgcccgcacagattccggaagattttttcatgtgtcaccgctggccggagaccccccctttttcctacacttgtggggatccctcaacctatagggtcacatttcccgtgtgtcctcagaaattgtcactcgcgcctccctccgcaaaagcgtctccccataatcctggaagctgcggcgagccccaggcaaaatttcttgaggccttctttgaagagcctcctcggagacagtcccctgtatccaacctcgggtcagaaggggagtgtccatcctcgggcgcagggtcccaggcccaagagctggctgaagcatgggaaggatgcaggaaggacctgttgttccaaaagagccctcagaaccataggcctcccagtgtgtccgatcaacctggcgagaaggaaaattgctaccaacatatgggcacttcgaaatctccagcccctggattcatccatctccgcacggagtgcggtccacgcaaggagccatgccaggaaaaagccgctttggagcgcgtactgaggcaaaagcaagacgcacagggttttactccaccccagctgggggcaagccagcagtacgcgagcgactttcataacgtcctcaaggaagagcaagaagctctgtgcctggacctaagagggactgaaagacgcgaagagcgccgtgaacctgagccacacagccggcagggccaggccctcggcgttaagcgcggatgccaacttcatgagcctagctctgcactgtgtccagccccatctgccaaggtgattaagatgcctagaggcggaccacagcagctgggtacaggagcaaatacacccgcacgcgtctttgtcgctctttcagactataacccactcgtaatgagtgcaaatcttaaggcagccgaggaggaactagtgttccaaaagcgtcaactgttgcgagtgtgggggtcccaggatacgcatgacttctacctgtccgaatgcaacagacaggtaggaaatatacccggacggttggtagccgagatggaggttggaactgaacagacggaccgacgatggcgctctcccgctcagggccatctgcccagcgtggcacacctcgaggactttcagggactaatcatcccacagggatcatccctagttctgcaaggcaattccaaacgactcccactgtggactcctaaaatcatgatcgccgcattggactatgatccaggggacggccagatgggtggccaggggaaggggcgactggccctcagagcaggcgatgtggtcatggtgtatgggcctatggatgatcagggtttttactatggggaactcgggggacaccgaggcttggtcccagcccacctgttggatcatatgtctcttcatggtcactag

SEQ ID NO: 239194 - DNA, 3402 bp, Artificial Sequence
  Description of Artificial Sequence: Synthetic coding sequence
atgcctgtccaggcaccccagtggactgattttctctcatgtcccatatgtacccagacgttcgatgagacaattcggaagccaatctctctgggttgcggccacacggtttgtaagatgtgcctgaacaaactccacaggaaggcctgccctttcgaccaaaccacaatcaacaccgacattgaattactacccgtgaacagtgcactgttgcagctggtcggggctcaggtgcccgaacagcagcccatcacattatgtagcggagtagaggacacgaagcattatgaagaggctaagaaatgtgtggaggaactggcgttatatctcaagcccctctcttcagcaaggggcgtgggcctgaacagcacaacccagagcgttctttcaagaccaatgcagaggaagttagtcaccctggtgcattgtcaactggtggaagaggaaggccgaatcagagcgatgagagcagccagatcactgggcgagaggacagtcacggagctgatcttacagcatcagaaccctcagcagctatcctccaacctttgggctgccgttcgggctagaggctgccagtttcttgggccagcaatgcaggaagaggctttgaagcttgtcctcttagctttggaggacgggagcgccctgtcccggaaagtgttggtcctgtttgtggttcagagacttgaacccagattcccacaggcaagcaagacctcaattggtcatgtggtccagctgctgtatcgggcttcatgttttaaggttaccaaacgcgacgaggactccagcctgatgcagttgaaggaagagtttagaacgtatgaggctctgaggcgagaacacgacagtcagattgttcagatcgcaatggaggcaggcctgagaattgctcccgaccaatggtccagccttctgtatggggaccagtcccacaagtcccacatgcagtccattattgacaaactacagactccagcaagcttcgcccaaagtgtccaggagctgaccatcgctttgcagaggacaggagatcccgcaaatcttaacagattacggcctcatctcgaactactggctaacatcgatcctagccctgatgcccctcccccaacctgggaacagttagagaatggcctcgtggccgtgagaacagtggtgcacggccttgttgattacattcagaatcattccaaaaaaggcgctgatcagcagcagccaccgcaacactccaagtacaagacatacatgtgcagagacatgaagcagagagggggatgtccacgtggcgcatcatgtactttcgcacacagccaggaggagctcgaaaagtttaggaagatgaacaagcgcctggtgccccgacgacctctgtctgcatctctgggccagctgaatgaagttggcctccctagcgccgctatcctgccagacgagggggcagtggacctgcctagtcgaaaacctcccgctctgcctaatgggatagtcagtactgggaacactgtgactcagctgatcccgaggggcacagaccccagctatgatagttccctgaagccaggcaagatagaccatctctcatcctcggccccaggctcccctccggacttactggaatccgtgccaaagtctatttctgctctgccggtgaacccacactcaattccacctaggggtcctgctgaccttccacccatgcccgtgaccaagccactgcaaatggttcctcgagggtcacaactgtaccccgctcagcagacagacgtgtattatcaagatccacgcggagctgcccctccattcgagccagccccatatcagcaaggcatgtactatacaccacctcctcagtgcgtttccagattcgtgagaccaccaccctccgctccggagcccgctcccccatatctggaccactaccccccttatcttcaggagagggtggtgaactcacagtatgggactcagccccagcagtatccacctatctacccgtcccactacgacggcaggcgggtgtatcctgctccgagttatacaagggaggagattttccgggaaagccccattccgattgagatcccaccggcagcagtcccttcttacgtgcccgagtctcgtgagcgctatcagcagattgagagttattaccctgtcgctccacatcccacacaaatccgtccatcataccttcgggaacccccatattcacgcctgccacctcctccacagccacatccatccctggacgagctgcaccggagaaggaaggaaatcatggctcaactggaggagaggaaggtcatttctccaccaccatttgcgccttctcccacactgccacccactttccacccagaagagtttctggatgaggatctgaaggtcgcaggcaaatacaaagggaatgactattctcaatatagcccatggagttgcgatactatcgggtcctatatcggtaccaaagatgctaaacctaaagatgtcgtcgccgcaggatccgtggagatgatgaacgtggaatctaagggcatgcgggatcagcgattggatttgcagcgacgtgccgcagagacctcggacgatgacttgataccattcggggaccgcccaaccgtgtcaaggtttggcgctatttctcgaacgtccaagacaatataccagggagctggtccgatgcaggctatggcccctcaaggtgctccgactaagagtattaacatcagcgactactctccctatggaacccacggcggatggggcgcatcaccatacagcccccatcaaaacattccgagccagggacatttctctgaaagagagcggatctcgatgtccgaagtagcatcacatgggaagcctctaccttccgccgagcgagaacagttgaggttggagttacaacaactaaaccaccagatcagtcagcaaactcagttgagaggattggaggccgtaagcaaccggctcgtcttacagcgcgaggcaaacacactggctggacaaagccaaccgccacctccgcctccaccaaagtggcctggcatgatctcctctgaacagctgtccttagaactgcaccaggtcgagcgcgagataggaaagcggaccagggagttgtctatggagaatcagtgtagcctggatatgaagagtaagctcaatacaagtaaacaggctgagaatggacaacccgagccccagaataaagtgccagcggaggatctgaccttgacattttcggatgtgcccaatggcagcgcactgacacaagagaatatctctctgctgtccaataaaacaagttctctaaacctcagcgaggaccccgaaggcggaggcgataataatgatagccaaagaagcggcgtcacacctagttccgccccttag

SEQ ID NO: 239195 - DNA, 3378 bp, Artificial Sequence
  Description of Artificial Sequence: Synthetic coding sequence
atgcctgtgcaggccccacagtggacagactttctctcatgccctatctgcactcagacatttgacgagactattcgcaaacccatttccctcgggtgcgggcataccgtatgcaaaatgtgcctaaataagctgcaccggaaggcttgcccctttgaccaaactactataaacacggacatagaactgctgccagttaactccgccctgctgcagcttgtcggggctcaggtccccgagcaacagcctatcacgctgtgttcaggggtggaggacaccaagcattacgaggaagccaagaaatgcgtggaggagttggccttgtatctcaagcctctgagcagcgctaggggcgtaggactgaatagcacaacacaatccgtgctgagcagaccaatgcagcgcaaactggtaaccctcgtacactgtcagttagtggaggaggagggacggatccgcgcaatgcgagctgctaggtcacttggcgaacgaactgttacagaattaatcctccagcaccagaatccccagcaactgtcatctaatctttgggccgctgtgagagcacgaggttgccagttccttggtccggctatgcaggaagaggccctgaaactggttctgctcgccctggaggacggatccgcgctcagtcggaaagtcctggttctttttgtggtccagaggctggaaccacgcttcccccaggcctctaagaccagcattggccatgtggtgcagttgctgtatcgtgcttcttgtttcaaggtcaccaagcgtgatgaagattcgtctttgatgcagctgaaggaggagttccgcacctacgaggcgttacgtcgagaacacgattcgcaaatcgttcagatcgccatggaggccggactgcgaatcgcccctgatcagtggtcaagcctcttatatggcgaccagagtcacaaatcgcacatgcagtccatcatcgacaaactgcagactccagcctccttcgcgcaaagcgtacaggagcttaccatagctctgcagaggacaggagatccagccaatttgaaccggctgaggccccacctggagctactggccaatattgacccatcacccgacgcaccaccaccgacctgggaacagctggagaatgggttagtcgcggtgagaacggtggtccacggcctggttgattacattcagaatcatagcaaaaagggggctgaccagcaacagcctccacagcatagtaaatacaagacatatatgtgtcgcgatatgaagcaaagggggggatgccccaggggcgcttcctgcacctttgcccattcccaggaggaactggaaaaatttcgcaagatgaacaagaggctcgtccctagaagacccctgagtgcctcccttgggcagctcaacgaggtcgggctccccagcgccgcaatccttccagatgagggggctgtcgacctgccaagtagaaaacctccagccctgcctaacggcattgtgtccactggaaatacagtgacacagcttatcccgcgtggcactgacccctcctatgactcctccctgaagcccggaaagatcgaccacctcagttctagtgctcccggatcacctcctgacctactggagtcagtgccaaagagcatatccgccctccccgtcaacccgcacagtattcctccgagagggccagcagacctgcccccaatgccagttacaaagccactccagatggtacccagaggctcccagctgtatccggctcagcaaaccgatgtgtattatcaggaccctagaggagcggcacccccattcgaaccagcaccttatcagcagggcatgtactatacacctccccctcaatgcgtttctcgcttcgtgcgtccacctccttccgcgccagagccagccccaccctatttggaccactacccgccatacctccaggagagagtggtgaattcacagtatgggacacagccacaacaatatccgcctatctacccctcccactatgatggcagaagggtgtaccctgctcctagctacacccgggaggagattttccgtgagtctcctatccccattgagattccacccgcagcggttcccagttatgtgcctgaatctagagagcgatatcagcagattgagagctactatccagtagcgcctcatccaacacagattcgtccctcatacctgagggaacctccttactctcgccttccccctccacctcagccacacccttctctggatgagctacacagacggaggaaagagatcatggcccagttagaggagaggaaagtgatatcaccgccacccttcgctccctctccaacccttccaccaaccttccaccctgaggaattcctggacgaagacttaaaagtagccggtaagtacaagggcaatgattattcgcagtactcaccttggtcttgtgacacgataggaagttacatcggtacgaaggatgcgaagcctaaggacgtggttgcagcaggatcagtggaaatgatgaatgtcgagtcaaaaggcatgagggatcagagacttgacctacagcgacgcgctgcggaaacctctgacgacgacctgatccccttcggggacagacccacagtgtctagattcggagccatttctaggactagcaagactatttaccaaggggctggccctatgcaggccatggcccctcaaggagcccctactaagtcaattaacatcagtgattattccccctacggcacccatggcggatggggagcaagcccctattcccctcatcagaacatcccttcgcagggccacttttccgagcgcgagaggataagcatgtcagaggttgcaagccacggtaaaccactaccgtccgcggagcgagaacagttgcgccttgagctgcagcaacttaaccaccagataagccagcaaacacagctgagggggctggaaagagaagctaacacccttgcaggccagtcccagcccccaccacctccacccccaaagtggccaggaatgatctctagtgaacaactcagcctcgagctgcaccaagtggagagagagatcggaaaacgtactagggagttgtctatggaaaaccagtgctccttagacatgaagagcaagctgaacaccagcaagcaggcggagaacgggcagcctgagcctcagaacaaagtgcctgcggaagatttgactttgacattctcatcagatgtgccaaacggctcggcactgacccaggaaaacatcagtctgttgtccaataagactagctccctcaatttatcagaggatcctgagggcggtggggacaataatgatagccaacgatctggcgtgaccccttctagtgcaccctag

SEQ ID NO: 239196 - DNA, 3402 bp, Artificial Sequence
  Description of Artificial Sequence: Synthetic coding sequence
atgccggtgcaagctccgcagtggaccgatttcctcagctgccccatatgtactcagacctttgacgagaccatccggaaacccatcagccttgggtgcggacatactgtgtgtaaaatgtgcttgaacaagctgcatcgtaaggcttgcccgttcgatcagactacaatcaataccgatattgagctgctccctgtgaattcagcattactccagctggtcggcgcacaggtaccggagcagcagccgattacattgtgtagcggggtcgaagataccaaacattacgaagaggccaagaagtgtgtggaagaacttgccctgtatttaaaaccactgtcctccgcaaggggagtcgggctgaactctacaacacaaagcgtgctctccagacctatgcagcgtaagctggtgacactcgtccactgtcagcttgtggaagaagaaggaaggattagagccatgcgcgcagccaggtccctgggtgagcgcacggtcacagagctcatccttcagcaccagaaccctcagcaactgagtagcaacctgtgggccgcagtacgcgctcgcggatgccagtttctggggcctgctatgcaggaagaggctctgaagttggtgcttctggctttggaggacgggtcagcattatcaaggaaggttctggtcctgttcgtcgtacaacggctcgagccacgctttccccaagccagcaagactagtataggccatgtggtgcaactcttgtatagggcctcctgctttaaagtaaccaaaagggacgaagactcttccctgatgcaattgaaagaggagtttagaacttacgaagctctgagacgggagcatgactctcagatagttcagatcgctatggaggccggacttcgaattgcacccgatcaatggtcctcgctcctatatggagatcagagtcataagtcccatatgcaatcaataatcgataagctccagaccccagcgtcatttgcccagagcgtccaggaattgaccattgccctccagaggaccggcgatccggcaaatctgaaccggctcaggcctcacctagaactactggcgaacatcgacccatccccagacgcaccacctccaacctgggagcagttggagaacgggcttgtcgcggttcggacagtggtacatgggctcgttgattacatccagaatcattccaagaaaggagctgaccagcagcagcccccacaacatagcaaatataaaacttatatgtgccgggacatgaagcagagaggaggttgtccaaggggcgcatcatgcactttcgcgcattctcaagaggagctggagaagtttcgaaagatgaacaagaggcttgtgccgcgaagacctctgagcgcaagcttaggccagctgaacgaagttggactgcctagtgcagcaatcctacccgacgaaggggcagtggatctcccaagtcggaagccacccgctctgccaaacgggattgtgtctaccggcaacaccgtgacgcagctgatccccagaggcaccgaccccagctacgactcctctctcaagccaggaaagatcgaccacctctccagctcagcacccggatcccctcccgatctgctcgaaagcgtgcctaaaagtatttctgcgctgcctgtaaatccccactccatcccccctaggggtcccgcagacctgccccctatgcctgttactaagcccttgcaaatggtgcccagaggtagccagctgtatcccgctcaacaaactgatgtctactaccaggacccccgaggagccgcaccgcctttcgaacctgctccataccagcagggcatgtattatacgcccccaccccagtgcgttagcaggttcgtgcggccacctccatcagcgcctgaacccgctcccccttatttggatcactacccaccctacctccaagaacgtgtggtgaattcccaatatggaactcagcctcagcagtaccccccaatctaccccagccactacgacggaaggcgagtgtatcccgcaccgagctacaccagggaagagatcttcagggagagccctatccccatcgagattccgccagcagcagttccctcttatgtccccgagagtagagaacgataccagcaaattgaatcttattatcccgtcgctccacatcccactcagatccgcccatcttacctccgtgaacccccatacagccgcctgccccctccaccgcagcctcacccgtcactcgatgaacttcacaggagacggaaagaaatcatggcccagcttgaggagaggaaggtgatctccccccctcccttcgctcccagcccgacactgcccccaacattccaccctgaggagttcttagacgaggacctgaaagtggccggaaaatacaaaggtaacgattactctcagtattctccgtggtcatgtgatactatcggcagttacatcggaaccaaagatgccaaaccaaaagatgtggtggctgctggctccgtggagatgatgaatgtagagagcaaaggtatgcgcgatcagaggctggacctgcagcgcagggccgcagagacctccgacgatgacctcatcccctttggcgaccgtccaaccgtatctcggtttggggctatctctagaacatccaagaccatctatcaaggtgccggtccaatgcaggcaatggctccccaaggggctccaaccaaaagcattaatatctccgactacagcccctatggaacccatggcggttggggggctagtccgtattctccccatcagaacatcccttcccaaggccatttctctgaaagagagaggatctccatgagtgaggtggctagtcacgggaaacctttgcctagcgctgaaagagagcagctcagactggagctgcagcagctgaaccatcagatttcccaacagacccagcttcggggtcttgaggccgtcagtaaccgcttagtcctgcagcgggaagcgaacacgttggccggacagtcccagccgcctccaccacctccacccaagtggcctggcatgataagtagtgagcagttgtctctggaactgcaccaggtcgagagagaaattggaaaacgcacccgtgaactaagcatggaaaatcaatgtagcctggatatgaaatccaagctgaatacctcaaaacaggcagaaaatgggcagcccgaacctcaaaacaaggtgccggctgaggaccttactttgactttttccgacgttcctaacgggtcagcactgactcaggagaacattagccttcttagcaacaaaacttccagcctcaacctgagcgaagacccggaaggagggggtgataacaacgactcacagcgctcgggcgtcacaccatcctcagccccatag

SEQ ID NO: 239197 - DNA, 984 bp, Artificial Sequence
  Description of Artificial Sequence: Synthetic coding sequence
atgtgggccacatgctgtaattggttttgcctggacggacagcccgaagaagtgcccccaccccaaggtgctaggatgcaggcttatagcaaccctggctatagctcctttccgagccccacgggattggagccgtcctgtaagtcttgcggagcccacttcgctaatacagccagaaagcaaacatgcctggattgtaagaagaacttttgcatgacatgctcttctcaggtcgggaatggcccaaggctgtgcctgctttgccagcggttccgcgctaccgcgttccaaagagaggagttgatgaagatgaaagtgaaggacttaagagattacctgtccttacacgacatctccactgagatgtgccgggaaaaagaagaactcgttttgctggtgttaggccagcagccggtcatttcccaggaagatcgcacccgggcttcaaccctgtcccccgacttccccgagcagcaagcctttctcacccaaccgcacagcagcatggtgcctccaacatcaccaaacctgccctcaagctcggctcaggcaactagtgtccctcctgcgcaagtgcaggaaaaccagcagtctatcgacagcgaagacagctttgtgcctgggcgtcgagcctcattaagtgacttgactgatctggaggacattgagggactcacagtgcgccagcttaaggagatcctcgccagaaatttcgtcaattacaagggatgctgcgagaagtgggaattaatggagcgggtgacacggctgtacaaagaccagaaagggctgcaacacctgggcggtgccgtgccgtccggcttagaagaaaatctctgcaagatatgcatggattcacctatcgactgcgtgttgcttgagtgtggtcatatggtgacttgcactaaatgtggtaagagaatgaatgagtgccctatttgtagacaatacgtgattagagccgtgcacgtgtttcgtagctag

SEQ ID NO: 239198 - DNA, 1092 bp, Artificial Sequence
  Description of Artificial Sequence: Synthetic coding sequence
atgtgggcaacttgttgtaactggttttgtctcgatggacagcccgaggaagtcccgcctccacagggtgcaaggatgcaggcctactccaatcctggctactcctcattcccctctcccacgggcctggagccatcctgtaaatcctgtggggctcactttgcaaacacggcgaggaaacaaacatgtctggattgcaaaaagaatttttgcatgacatgtagttcccaggttggcaacggccctagactgtgcctgctctgtcaacgcttccgagccacagccttccaacgggaagagctgatgaaaatgaaggtgaaagacctgcgagactatctgtcactgcacgacatctctaccgaaatgtgccgcgagaaggaggagttggtgctgctggtgctcggccagcagccggtcatcagtcaggaggacagaacaagggcatctaccctcagtccggacttccccgagcaacaggcctttctgacacagcctcactcctccatggtgcctccaactagccctaatctgccaagtagtagcgcccaggccaccagcgtgcccccagcccaggtgcaggagaaccaacaagctaatggtcacgtgtcacaggaccaagaggagcctgtgtacctggaatcagttgctcgggtgcccgctgaagacgaaactcaaagcattgactccgaggacagttttgtacccggaagaagggcgagcctgtccgatctaacggacctcgaagacatcgagggacttaccgtgaggcagcttaaagagattcttgcacgtaactttgtcaactacaagggttgctgtgagaagtgggagctgatggaacgcgtcacaagactctacaaggatcaaaaaggcttgcagcacctggtgtctggtgccgaggatcaaaatggaggcgcagtgccaagcggtttagaggaaaacctgtgcaaaatatgtatggacagtcccattgattgcgtcttactcgaatgtggacacatggtgacatgtactaagtgcggcaagcgtatgaatgagtgtcctatttgcagacaatacgtgatccgagccgttcacgtattcaggtcatag

SEQ ID NO: 239199 - DNA, 1068 bp, Artificial Sequence
  Description of Artificial Sequence: Synthetic coding sequence
atgtgggccacctgttgcaattggttctgcctggatggacagcccgaagaggtccctccacctcagggggctaggatgcaggcctattctaacccaggatactctagctttcctagcccaactggtttagaaccaagctgtaaatcctgtggagcccacttcgccaatactgcaagaaagcagacatgcctagactgtaagaagaatttctgtatgacctgtagctctcaggtcgggaatggaccaaggctgtgtctcctttgtcagcggtttcgagctaccgccttccagagagaggagcttatgaagatgaaagtgaaagacctgcgcgattacttgagcctacatgacattagcactgaaatgtgcagagagaaagaagagctggtcctcctggtgcttggccaacagcccgtgatcagtcaagaagatagaactcgggcatccactctttccccggacttcccagaacagcaggcatttctgacccagccccacagctccatggtaccgccaactagtccaaatcttcccagctcgtcggcacaggcaacatctgtacccccagcccaggtgcaggaaaatcaacaggcaaatggacatgttagtcaggaccaagaagagcctgtgtatctggaaagcgttgcacgggtgcctgcagaagatgaaacccagagtatcgacagcgaggatagttttgtccccggacggcgagcgtcactttccgatctgaccgatttggaggacatcgagggcctaacggtccgccagctgaaagagattttagctaggaattttgtgaattacaagggatgctgcgagaagtgggaattgatggagagagtgactcggctctataaggatcaaaaggggctgcagcacctcggaggcgcagtgcctagcggcctggaggaaaacctctgtaagatttgtatggattcacctattgactgtgtcctgctcgaatgtggacatatggtcacctgcacaaagtgtggcaaacggatgaacgagtgtcccatttgccgccagtacgtcatccgagccgtacacgtctttagaagttag

SEQ ID NO: 239200 - DNA, 1092 bp, Artificial Sequence
  Description of Artificial Sequence: Synthetic coding sequence
atgtgggctacttgctgcaattggttttgcctcgatggacagccagaggaggtcccgcctccacagggcgcaaggatgcaggcttatagtaacccaggctattcgtcctttcctagtcctacagggttggaaccttcgtgcaagagctgtggcgcacacttcgccaataccgcgagaaaacagacatgcctcgattgtaagaaaaacttctgcatgacctgttccagccaggttggaaatggcccaagactgtgcctcttgtgtcaacgttttcgcgctactgcgtttcagcgcgaagaactcatgaaaatgaaggtgaaggacctccgcgattacctcagtctccatgatatctccacagaaatgtgccgggagaaggaggaacttgtattgctcgttctggggcaacagcccgtaatttctcaggaggaccgcacacgcgcttctacactgtcgccagacttccctgagcaacaggccttcctaactcagccgcacagcagcatggtgccacctacaagtcccaacctgccctccagcagcgcacaagccacatcagtgcctccagcccaagtccaggaaaaccaacaagcgaacggtcatgtttctcaagaccaggaggaacctgtgtatctcgagtctgtcgcacgagttccggctgaggacgagacacagagtattgactctgaagatagtttcgttccgggtcgcagggcatctctgtctgacctaacagacctggaggacattgaggggctgacggttcggcagctcaaagagatacttgcacgtaattttgtcaattataaggggtgttgtgagaagtgggagctaatggaacgcgtgacacgactgtataaggatcagaaagggctgcagcatcttgtgtccggagccgaggatcagaatggaggagccgtcccctccgggctggaagagaatctgtgtaagatttgtatggattcccctatcgattgcgtcctgttggagtgcgggcacatggttacgtgtactaaatgtggcaagagaatgaacgaatgcccaatttgtcgtcagtacgtcatcagagccgtacatgtgtttagatcctag

SEQ ID NO: 239201 - DNA, 816 bp, Artificial Sequence
  Description of Artificial Sequence: Synthetic coding sequence
atgtgggctacatgctgtaactggttctgccttgatggccagcctgaagaagtgccacctccccagggagccagaatgcaggcttattcgaacccgggatattccagttttcctagtcctaccggcctagaaccttcctgtaagtcttgtggggcacactttgccaacacagccagaaaacaaacatgtctggattgcaagaagaacttttgcatgacctgtagctcacaagtgggcaacggacctcggctgtgcctcctctgtcaaaggtttagggccaccgcttttcaaagggaagagctgatgaaaatgaaagtgaaagatctgcgggactatctgagcttgcacgacatctcaacagaaatgtgccgggagaaggaagagttagtacttttggttcttggacagcagccagttatctcccaggaagaccggacgcgtgccagcaccttgagcccggacttccccgagcagcaagcatttctgacacagcctcactcttctatggtgccaccaacatctccgaatctcccctcttctagtgcgcaggccacttcggtgcctcctgctcaggtgcaggaaaaccagcaggctaatgggcatgtctcccaggatcaagaagaacccgtctacctggaatcggtggccagagtgcctgcagaagacgaaactcagtcaatcgattccgaagattcctttgtccccggacggagggcatcacttagcgatctgacagatctggaagacattgaggggctgacggtcaggcaactcaaagagatcctagctcggaattttgtgaactataagggatag

SEQ ID NO: 239202 - DNA, 402 bp, Artificial Sequence
  Description of Artificial Sequence: Synthetic coding sequence
atgtgggccacatgctgcaattggttctgcctggacggccagccagaggaggtgccgccaccacaaggcgcaaggatgcaagcatactccaatcccggttatagcagcttcccatcccctaccggattagagccatcatgtaaatcatgcggagctcacttcgcaaacactgcaaggaagcaaacttgcctggactgtaaaaagaatttctgtatgacctgctcaagtcaggtcggcaacggtcccagactctgcctcctctgccagcgttttcgcgctacagcatttcagcgagaggagctgatgaagatgaaggtcaaggatctgagggactacctatccctgcacgacatctccaccgagatgtgcagagagaaggaggaactggtcctgctggtttag

SEQ ID NO: 239203 - DNA, 570 bp, Artificial Sequence
  Description of Artificial Sequence: Synthetic coding sequence
atgtgggctacatgttgcaactggttttgccttgatgggcaacctgaggaggtccctccgcctcagggagcccgaatgcaggcctatagtaaccccggatactcttcatttccctcgcccactggactcgagccatcttgcaagagttgcggggctcattttgccaacactgccaggaaacagacatgtctggactgtaaaaaaaatttttgtatgacatgctcctcccaggttggcaacgggcctagactttgcctcttatgtcaaaggttcagagctaccgcatttcaaagagaggagctcatgaagatgaaagttaaagatctgcgggattatctgagtctccacgatattagtactgagatgtgtagggagaaagaagaattggtcctcttagtgctgggccagcagcctgtgatcagtcaagaagataggaccagggcatcgacattgtccccggattttccagaacaacaggcatttctgactcagccacacagttcaatggtaccacctacgtctcccaatctgccctcctccagcgcccaggccacgagtgtcccaccctag

SEQ ID NO: 239204 - DNA, 138 bp, Artificial Sequence
  Description of Artificial Sequence: Synthetic coding sequence
atgtgggccacctgttgtaactggttctgtctcgacgggcagcccgaggaggttccgcctccacagggagccaggatgcaagcttacagtaaccctggttacagctcatttccctcacctacaggattggagccttag

SEQ ID NO: 239205 - DNA, 2124 bp, Artificial Sequence
  Description of Artificial Sequence: Synthetic coding sequence
atgtcaggctccaggcaggctggctcaggctcagcaggaactagtccaggaagcagtgctgcgtcatcggtcacatctgcatcctcaagcctttcaagctcaccaagtcccccttcggtggcggtgtccgccgcagcccttgtctccgggggtgttgcacaagccgctggcagtggcggtctgggcggacccgtgcggcctgtcctggtcgctccggctgtttccgggtctggcggtggcgcagtttccacagggctgagcaggcatagctgtgcagctcgcccttcagcgggagttggaggcagctcatcctcactaggaagtgggtcccgcaaacggccattactcgccccactgtgcaacgggctcatcaactcgtacgaagacaagagcaacgattttgtgtgtcccatttgctttgatatgattgaggaagcctatatgacgaaatgcggtcactcattttgctacaaatgcatccatcagtcactcgaagacaataacaggtgccccaagtgcaactatgtagtggataacatagaccacttgtaccctaattttcttgtgaacgaactgatccttaagcagaagcaacgctttgaggagaaaagattcaagctagaccattcgaacggacacaggtggcaaatttttcaggactggctggggactgaccaggacaacctggacctggccaatgtcaatctgatgttagagctgttagtccagaagaagaaacagttggaggctgaatcccacgctgcacagctgcaaatattgatggagttcttaaaagtggcccgaaggaataagcgcgaggagatgtcaggtctgtactctcctgtaagtgaagatagcacggttccacaattcgaagcccctagcccctctcatagctcaatcatagatagcactgagtatagtcagcccccaggcttttcgggctctagccagacaaagaaacaaccctggtacaactccaccctggcctctcgtcggaagcgccttacagctcattttgaagacctcgaacagtgctacttcagcactaggatgtcaaggatcagcgacgatagccgaaccgcgtcacaactggacgaattccaagaatgtttaagcaaatttacccgctataacagtgtgcgcccactggctaccttgtcttatgcatcagacctatataacggcagtagtatcgtaagctctattgaatttgatcgcgattgtgattatttcgccatcgcgggagttacaaagaaaataaaggtttatgaatatgatacagtaattcaggatgcagtcgacatccactatcctgaaaatgaaatgacatgtaactccaagatttcctgcatttcctggtctagttaccacaaaaatctgctcgcttcctcagactacgagggaaccgtgatactctgggatgggtttacaggccaacgctcaaaagtctatcaggaacacgaaaaacgatgctggagcgtggacttcaatcttatggatcccaaactacttgcaagcggatcagacgacgccaaggtgaaactgtggtcaacaaacctcgacaactctgtggccagtattgaggccaaggccaacgtttgttgcgtgaaattttcgccctcgtctaggtaccatctggcattcgggtgtgccgatcactgcgtgcactactatgacctcaggaatactaaacagcccatcatggtgtttaagggacaccggaaagctgtcagctacgcaaagttcgtgtctggagaagagattgtttccgcctcaacagactcccagttaaaactgtggaatgtgggcaaaccatactgcctccggagtttcaaagggcatatcaatgagaagaactttgtgggcctcgcaagtaacggggactatatcgcctgcggaagtgagaacaacagcctttacctgtattacaaaggcctgtcaaagacactgctaacatttaagtttgatactgtgaaatccgttctggacaaagatcggaaggaggacgacactaatgaatttgtatctgctgtgtgttggagggcattgccagacggggaaagtaatgtgcttatcgcggctaactcacaaggcacgattaaggtgctggaattggtgtag

SEQ ID NO: 239206 - DNA, 1521 bp, Artificial Sequence
  Description of Artificial Sequence: Synthetic coding sequence
atggaattcctgaaggtggccagacgaaacaaaagagagcagctcgagcaaattcagaaggagctgtcagtactagaggaggatataaaacgggtggaggagatgtctggtctgtattctcccgtgtccgaagattctaccgtgcctcagttcgaggctcctagcccaagtcattcctcaattatcgactcaaccgagtactcccaacctcctggattttcaggaagcagtcaggctggggtgcagtggcgatacttaggtagtctccagccaccccctcccagatataaacgcttctcctgccttacacttccttctagctgggactaccgtcgtctgccaccgcatctcaccaagaaacagccctggtataactccaccctcgcctctcgcagaaaacggctgactgcccattttgaggaccttgaacaatgctatttctctactcgcatgagcagaatttcagacgatagtaggacagcttctcaactcgacgaatttcaggagtgcctgtcaaagtttacgagatacaatagtgtgcgccctctcgctaccctttcatatgcctccgacctctacaacggcagtagtattgtgtcttccattgaatttgatagagattgcgactacttcgctattgctggcgttaccaaaaaaataaaagtgtatgagtatgacactgtgatacaggatgccgttgacattcactaccccgaaaatgagatgacatgcaatagcaagatttcttgcattagttggagcagctatcacaagaatctgctggcgtcatctgactatgaggggaccgtaatactctgggacggattcactgggcaacgcagtaaggtctatcaggagcacgagaaaagatgctggtcagtggatttcaatttaatggaccctaaacttttggcctccgggagcgatgatgcgaaggtgaagctttggagcactaacctagataattccgtcgccagcatcgaggcaaaggccaacgtctgttgcgtcaaatttagccccagctctcgctatcaccttgcgttcggttgcgcagatcactgcgtgcactactatgatcttcggaacacaaagcagccaatcatggttttcaagggacacagaaaagccgtaagctatgcgaagtttgtgagtggtgaagaaattgtgtcagccagcacagattcccagcttaagctctggaatgttggaaaaccctattgcctgaggagctttaagggacatatcaacgaaaaaaatttcgttggactggcatctaacggcgactacatcgcgtgcggtagcgagaacaatagcctgtatttgtactataagggcttgtctaaaaccctgctcaccttcaaatttgacacagtgaagtccgtgctggacaaggaccgaaaggaggatgacacaaatgagtttgtgagcgctgtgtgctggcgggcactgccggacggcgagtctaacgtcttgattgccgctaacagtcaggggactatcaaggtgctagcgctgctctag

SEQ ID NO: 239207 - DNA, 2196 bp, Artificial Sequence
  Description of Artificial Sequence: Synthetic coding sequence
atgtccggatcacgacaggcgggttcggggtccgccggaaccagtcccggttcttcagctgcctcaagtgttaccagtgcttccagtagtctcagcagtagcccgtctccaccttcagtcgctgtgtccgcagccgcacttgtctccggcggtgtcgcccaagccgcaggtagcggagggctgggaggcccagtaaggccagtcttggtggctccagcggtctccgggagtggtggcggagctgtgtccacagggctgtcacgccattcctgcgctgccagaccctccgcaggggtgggtggctccagttcatcccttggctccggcagtcggaaacgccctctgctggcacccctgtgcaatgggctcatcaacagctacgaagacaagtccaacgattttgtctgcccaatttgcttcgacatgattgaggaggcgtatatgacaaagtgcggacacagcttctgttataagtgcatacaccagtcattagaggacaataaccgctgtcctaagtgtaattacgtggtggacaacattgatcacctttaccccaactttcttgtaaatgagctcatactcaaacaaaaacagcggttcgaggagaagcggtttaagctcgatcattctgtgtcctcaacaaatggtcatcgctggcagatttttcaggactggctcggcactgaccaggataacctggacctggcaaacgtgaaccttatgctggaactcctagtgcagaagaagaagcaattagaggcagagtctcatgccgctcagttacagattttgatggagtttttaaaggtggcacgccgtaacaagcgggagcagcttgagcagatccaaaaggaactgtcagttttagaggaagacatcaagcgcgtggaggagatgtccggactctattcgccagtgagcgaggactctactgtgccccagtttgaagcccctagcccttctcactccagcattatcgactctacagaatattcccaacctccgggattctccggtagtagccagaccaagaaacagccctggtacaactctaccctcgcaagccgacggaaaaggctgacagctcatttcgaggatctggagcaatgttacttcagcacccgcatgagtcgaataagcgatgactcaaggacggctagtcagctggatgaatttcaagagtgtttgtcaaagttcactcggtacaattcagtgcgccctcttgctacactttcctatgcttctgatttgtataacggatcatccattgtgtccagtatcgagtttgaccgcgattgcgactatttcgcaattgccggagtgactaaaaagatcaaggtttacgaatacgacacggtgatccaagacgccgtggacatccattatcctgagaatgaaatgacttgtaactctaagatctcatgtatttcatggagtagctatcacaagaatctactggcttcgtcagactacgaggggacagtgatcctctgggatggattcacaggccagcgctctaaggtctaccaggaacatgaaaaacggtgctggagcgtggattttaacctcatggatccaaagctattggcgtcagggagtgacgacgccaaggtgaaattgtggtcgacgaacctggacaattccgttgcgagtattgaagcaaaggctaatgtatgctgcgtcaaattctctccgtccagtcgttaccatctggccttcggctgcgcggatcattgcgtccactattatgacctgcgcaacaccaaacagcccataatggtcttcaaaggacaccgaaaagcggtcagctacgctaagtttgtgtcaggggaggagattgtgtctgcttctaccgattcacaattgaaactctggaatgtgggaaagccatactgcctcagatccttcaagggccacattaatgagaagaacttcgttggacttgcctccaatggggactacatcgcctgcggatccgaaaataattcactatacttatattacaaggggctgagtaagacactgcttacattcaaattcgacacagtcaagtccgtgctggataaagaccggaaggaggatgacaccaacgagtttgtttccgccgtgtgctggcgggcattgcccgatggagagtccaatgtcctcatagccgctaactcacaggggacaatcaaggttttggagctcgtatag

SEQ ID NO: 239208 - DNA, 774 bp, Artificial Sequence
  Description of Artificial Sequence: Synthetic coding sequence
atgtcaggttctcggcaagccggatctggatccgcaggcacatctcccggtagcagtgcagctagttccgtcacatccgccagcagcagtctgtccagcagcccctccccgccatccgtggccgtttctgcggctgcccttgtgagtgggggagtggcccaagctgcaggcagtggaggcctcgggggacctgtccgtcccgtcttggtggcacccgctgtcagtggatcaggaggaggggctgtctcaaccggcctgagtcggcactcctgtgcagctcggccaagcgcgggtgtgggcggaagctcatcctcactcggctccggcagtcgcaagcggccactcctggcacccctgtgtaacggcctgattaattcttacgaagacaagagtaacgactttgtgtgtcctatatgtttcgatatgattgaagaggcatatatgacaaaatgcggtcactccttttgttataaatgcatccaccaaagccttgaggataataatcggtgccctaagtgtaactatgtcgtcgataacatcgatcatctttaccctaactttctcgttaacgagctaatcttaaagcagaagcagcgcttcgaagaaaagcggtttaagctggatcattccgtatcttccactaatggtcatcgctggcagatatttcaagactggcttgggactgatcaggacaacttagatctggctaacgtgaatttaatgctcgagctgcttgtccagaagaataagaaaaagaaaaagaaaaagaaatag

SEQ ID NO: 239209 - DNA, 2325 bp, Artificial Sequence
  Description of Artificial Sequence: Synthetic coding sequence
atggcccacgaggcaatggaatacgacgtacaggtgcaactgaaccacgcggaacagcaacctgctccagcaggaatggcatcaagtcagggcggtccagccctgcttcagcccgttcccgcagatgtggtgtccagccagggcgtcccctcgattttacagcccgcacccgctgaagtcattagctcacaggctactcctcctttactgcagcccgcaccccagctgtccgtcgacctgacagaggtcgaggtactcggtgaagataccgtagagaacatcaatcctcgcacatccgaacagcatcgccaaggcagcgatgggaatcatacaatacctgcttcaagtttgcactctatgaccaacttcatctccggtctgcaaagactccatgggatgctcgaattcctaaggccatccagtagtaatcactcagtcggtcccatgaggacaagaagacgcgtgtcagcctcacgcagagctcgagccggagggtctcagaggaccgactccgcccgtctccgggctccacttgatgcctatttccaggttagccggacccaaccggatcttccagccaccacctacgatagcgagaccagaaatccggtttccgaggaattgcaggtgagcagttcatcagattccgatagcgatagttcagcagagtatggcggagtggtcgaccaggccgaggaaagtggggctgttatcctcgaagagcaattggccggagtgtctgcagaacaggaggtgacatgcatagatggcggaaagacattgcccaaacagccatctcctcaaaagtcggagcctcttttgcctagcgcttctatggacgaggaggaaggggatacgtgtactatctgcctggaacagtggactaatgcaggcgaccatcgactaagcgcacttagatgcggacatttattcggatataggtgtatctcaacgtggttgaaaggtcaagtgaggaaatgcccacaatgtaacaagaaggccaggcattccgatatcgtcgtcctctacgccaggacactgcgggctctggacacatcagagcaggagagaatgaagtcatcattgcttaaggagcagatgctgaggaaacaggcggaattggaatctgcccagtgccgactccagcttcaggtgctaaccgataaatgtacgcgtcttcaacgtcgcgtgcaagatcttcaaaaactgacctcccatcagtcacagaacctgcagcagccacgtggtagccaagcctgggtcctgtcctgtagcccttcgtcccagggccagcacaagcacaaatatcacttccagaaaaccttcacagtttcacaggccggtaattgcaggataatggcctactgtgatgctctatcatgtttagtcatttcccagcctagccctcaagccagttttctacctggattcggtgtgaaaatgctgtcaactgccaatatgaagtcaagtcagtacatcccaatgcatgggaagcagataagaggtttagcgttttcttcctacctgagaggcctgttgctctcagcaagtctcgataacaccatcaaattgacctctctagagacgaacaccgtcgtccaaacatacaacgccggtagaccggtgtggtcctgctgctggtgtctggatgaggcaaactacatctatgccggactggcgaacggaagcatactcgtgtacgatgtacggaatactagctcccacgttcaggaactcgttgcacagaaggccaggtgccctctagtgtccctgtcttatatgcctcgagccgctagcgctgctttcccctacgggggagtgctggctggaacactcgaggacgcaagtttttgggaacaaaagatggacttcagccattggcctcatgttcttccactggaaccaggtggttgtattgacttccagaccgagaactctagcagacattgtctggtaacatatcgccctgacaaaaatcatactactatccgaagcgtattgatggagatgagttaccgtctggacgacaccggtaatccaatctgctcatgtcagcctgtgcatactttctttggaggccctacatgtaaattgctcaccaagaatgctattttccaaagccctgaaaacgacggcaatatactggtatgtacgggcgacgaggcagcaaatagtgccttactgtgggatgccgcaagtgggagcctgctacaggacctgcagacggatcaacctgtgctcgatatctgtcccttcgaagtgaaccgcaattcctatctcgctaccttgaccgaaaagatggtgcacatatacaagtgggaatag

SEQ ID NO: 239210 - DNA, 792 bp, Artificial Sequence
  Description of Artificial Sequence: Synthetic coding sequence
atggcacacgaagcgatggagtatgacgtgcaggtgcagcttaatcatgctgagcagcagcccgcacccgctggtatggcttcctcgcagggaggcccagcactccttcagccagtgcctgctgacgtggtgtcaagccagggagtgccatctatcctgcaacccgctccggcagaggtaatcagcagccaggccactccgccactgctacagccagctccgcagctgagtgtcgatttgactgaagttgaggtgctgggagaggataccgtggagaacattaatcccaggacctcagagcagcataggcagggatccgacggaaatcacactatcccagcctcctccttgcattccatgcctcttgagccgggaggctgcatcgattttcagacagagaatagctcaaggcattgcctcgtgacatatcggccagacaaaaaccataccactatacggagcgtactcatggagatgtcctatagattagatgatactgggaacccaatttgcagctgccagcccgtacatactttcttcgggggacccacctgtaagctgttaacgaagaacgcaatttttcagagccctgagaatgatggtaacattctcgtatgtaccggcgatgaggccgctaattctgccctgctgtgggacgctgcttctgggtcactccttcaggacttgcagacagatcagcctgtcctggacatatgcccattcgaagtgaatcgtaattcttatctagccaccctgaccgaaaagatggtccacatatataagtgggaatag

SEQ ID NO: 239211 - DNA, 2058 bp, Artificial Sequence
  Description of Artificial Sequence: Synthetic coding sequence
atgaatcaatcaaggtcacgctctgacggaggaagcgaggaaacgctcccccaggaccacaaccaccatgagaacgaaaggcgctggcagcaagagcggctacacagagaggaagcctactaccagttcattaatgaactgaatgacgaggactatagacttatgagagatcataatcttcttggcactccaggggaaattacgtctgaggaacttcagcagaggctggatggggtgaaagagcagctggcttcccaaccagacctgagggacggcaccaattatagagatagtgaagtgcccagagaaagctcccatgaagacagcttgctggagtggcttaacacctttcgacggactggaaacgcgacaagatctggccagaatggaaatcagacctggagagctgtttctagaaccaaccctaacaatggcgagttcagattctccctcgagatccacgtcaatcatgagaatagagggttcgagatccatggagaagattatactgacattccactttcggactccaacagggatcataccgctaaccgacagcagaggtctacctctcccgtcgctcgacgcacacgaagtcagaccagtgttaattttaacgggtcttcatctaacattcccagaaccaggctggctagccgagggcagaaccccgctgagggttcattttctaccttaggccgactgagaaatgggatcggtggggcagccggaatccctcgagcgaatgcctctaggaccaacttctccagtcacacgaaccagagcgggggtagtgaacttcgacagcgggaaggtcagcggtttggagctgcacatgtctgggagaacggggcaaggtcaaatgtgacagtgcgcaatactaatcagcgattggaacccatcaggctgaggtccacttccaactccagatcgaggtcgccgattcagagacaaagtggcaccgtttaccacaactcacagcgcgagagtaggccagttcagcagacaaccagaagaagcgtccgccgaaggggtagaacgcgggtcttcctcgaacaagaccgcgaacgagagaggcggggtaccgcatatacgcctttcagcaactctcgattggtgtctcgaattaccgtggaggagggcgaagagagttccagaagttccaccgctgtgcgaagacacccgaccatcacgctcgatcttcaagtgcgcagaataagaccgggagagaatcgggatagagattcaatagctaacaggacacgctcccgggttggactcgccgagaatacagtaactatcgagagcaattcaggaggttttaggcgtacaattagccgactggagcgaagtgggatcaggacctacgtgagcacaataactgtgccactgcgtcggatctccgagaatgagctggtcgaaccatcttctgtggccttgcggtctatcctgagacagataatgactggattcggcgagctcagctccctgatggaggctgatagcgagagcgaactccagagaaacggccagcatttgccagacatgcattctgagttgagcaacctgggcactgacaacaatcgttcacaacaccgagagggatcatcacaggatcggcaggctcagggggactccaccgaaatgcacggcgaaaacgagaccacacagccccacaccaggaattccgactcacgcggtggtagacaactgcgaaatccaaataacttggtggagaccggcacactgcccatccttagactcgcccacttttttcttctcaacgagagtgacgacgatgacagaatcaggggcctgaccaaagaacagatcgacaatttaagcactcgccactatgagcacaatagtatcgactccgagttgggcaaaatttgttctgtgtgcatcagcgattacgtaaccggtaacaaattaaggcaactcccttgtatgcacgagttccacattcattgtattgatcgctggctttctgaaaattgtacatgtccaatttgtaggcagccagtccttgggagcaatatcgcaaataatggatag

SEQ ID NO: 239212 - DNA, 2058 bp, Artificial Sequence
  Description of Artificial Sequence: Synthetic coding sequence
atgaaccaatcgcgctcccggtcagacggcggtagtgaagaaaccttgccgcaagaccataaccatcatgagaatgagagaaggtggcagcaggagcgacttcatcgggaggaggcttactaccagtttatcaacgagctcaacgatgaagactatagactgatgagggaccacaatctgctagggacaccgggtgagatcaccagtgaggagctgcagcagaggcttgacggcgtgaaggagcagttggctagccaaccagacctgagggacggtactaactaccgagactctgaggtgcccagagagtcctcacacgaagattcgctattggagtggctgaatacatttagacgaaccggaaatgccaccagatcaggacagaatggaaatcagacctggcgtgccgtgagccgaacgaatccaaataacggagagttccggttctcactggagatacacgttaatcacgagaacagaggattcgagattcatggcgaagattacacagatattcccctgagcgatagcaaccgcgatcataccgccaatcgccagcaacggtcaacatctccagtcgctaggagaacacgatctcagacttctgtgaacttcaacgggagctcaagcaatatacccagaacacggttggcttctcggggacaaaatcctgccgaaggctcgttctccaccttgggacgactccggaatggcattgggggtgcggctggcataccaagagctaatgcttctaggaccaatttcagttctcacacaaaccagtctgggggatccgagctgagacagagagaaggtcagcgttttggagccgctcacgtgtgggagaatggagcgaggagcaacgtgacagtaaggaatactaaccagagactggaacccattcgcctaagaagcacatctaactcacgttcacggagtcccattcaaagacagtctggtacggtgtaccacaactcgcagcgagagtcccggcctgtgcagcagaccacgagacgatcagtgcggagaaggggcaggaccagagtttttttagagcaggatcgagagcgcgagcgacggggaacagcttacaccccattcagcaattcccggctggtcagccgaatcaccgttgaagagggagaagaaagcagccgttcctccacggctgttcggaggcaccctactataacattagatctgcaggtgcgcaggataaggccgggagagaatagggacagggattccatcgccaataggacccgctcacgggtgggactggcggaaaataccgttaccatcgaatcgaatagtggaggttttcgacgaacaatttctaggctggagagatctggcattaggacatatgtgagcacaatcaccgtgcccctccggcgaatatcggaaaatgaattggtcgagccaagtagcgtggctttacggagcatcctgagacaaatcatgactggctttggcgagctcagctcactgatggaagctgattctgaatctgaactgcagcgtaacggccagcacctgcctgacatgcactcagaactctcaaacttgggaactgacaacaacagatctcagcacagagagggatcgtcacaagataggcaggcccaaggtgatagcaccgaaatgcacggtgagaatgagacgactcagcctcatacccggaactcagacagtagaggcggacggcagcttcggaatcccaataacctggttgagacagggaccctgcccattctaaggctggctcatttttttctgctgaatgagtctgacgacgacgaccgcatacggggactgaccaaagagcagatcgacaatttgagcacccgacactatgagcacaactccatcgatagcgaactgggcaaaatctgcagcgtgtgcataagcgattacgtaacaggaaataaactacgccagttaccctgtatgcacgagttccacattcattgtatagaccgatggctgtccgagaactgcacctgtcctatttgtcgacaaccagtcctgggaagtaacattgcaaacaacggctag

SEQ ID NO: 239213 - DNA, 2058 bp, Artificial Sequence
  Description of Artificial Sequence: Synthetic coding sequence
atgaatcagtctcgatccaggagcgacggagggtccgaggagaccttgccacaagaccacaaccatcatgaaaacgagcgcaggtggcagcaggagagattacaccgagaagaagcgtactaccagttcatcaatgagcttaacgacgaagactataggctgatgcgggatcataacctgctgggcaccccaggcgaaataaccagcgaagagttacaacaacgactggatggcgtgaaggagcagttggcctcgcagccagacctaagagacggaacgaattatcgcgattctgaggtccctagagagagctctcacgaggattctttgctggaatggctgaacacattcaggcggactggtaacgctacgcgcagtggccagaacggaaaccagacctggcgtgcggtatctaggaccaatcccaataacggtgagttcagattctcacttgagatacatgtaaaccacgaaaatcggggttttgagatccacggagaggactacaccgatatccccttgtccgactccaacagggatcataccgccaacagacagcagagaagcacgtccccagtggcgaggcgtacacggtctcaaaccagtgttaactttaacggctcttcaagcaacatccctcgtactcggctagccagtagaggacaaaaccctgcggagggcagcttttcaaccctagggcgattgagaaatggcataggcggagccgctggaattccacgcgcaaacgcatcaagaactaacttttcatcccatacaaatcagtccggaggtagtgaactccgacagcgagaagggcagaggttcggggcagcccacgtgtgggagaatggtgctcgtagcaatgtaacggtgcgcaacacaaatcaaagattggagccaattcgcctccgatctacctcgaatagccgaagccggtccccgattcaacgacagagcggcaccgtgtaccacaactcccaacgtgaaagccggcctgtgcagcagacaaccaggaggtcagtgcgaagaaggggcagaacacgcgtgttcctggagcaggatagagagagagagcggagaggtaccgcttacaccccattcagcaattcccgactcgtttcacggatcactgtcgaagagggggaggaaagctcacgatccagcaccgcggtacgcagacaccctactattacgctcgatcttcaggtacggagaattagaccaggcgaaaaccgcgatagagattccatcgccaatagaaccagatccagagtcgggctggcagagaatacggtgactatagagtctaactccggcggatttaggagaactataagccgcttagaacgctcagggatcaggacctacgtgtcaaccatcacagtgccactaaggcgaatctctgaaaacgagctcgttgagcccagctctgtggctctgagatccatccttaggcagatcatgaccggatttggcgaactcagctcacttatggaggccgactcggagtcagagctgcagagaaacgggcagcacttgcctgacatgcactcagagctgtcaaatctaggtactgacaacaaccggagtcagcatcgcgagggaagtagccaggacaggcaggctcagggtgattctacggagatgcacggcgagaacgagactacccagccacacactcgcaacagcgactcacggggaggcagacagctcagaaatcccaataacttggttgagacgggaactttgcctatcctaagacttgcgcacttttttcttttgaatgagtctgacgatgatgatcgcatccgtggtctgacgaaggaacagatcgataatctttctactagacactacgaacataactccatagacagcgagcttgggaagatatgtagcgtttgtattagtgactacgtgacaggtaataagttgcggcagcttccctgcatgcatgaattccatattcattgtattgacaggtggctgtctgaaaattgtacatgcccaatctgccgccagccagtgctgggaagcaatatagcgaataacggttag

SEQ ID NO: 239214 - DNA, 990 bp, Artificial Sequence
  Description of Artificial Sequence: Synthetic coding sequence
atgcagctggaagtcgataagatggggacaaagctaggggaattgctcgtttcacgcatcactgtggaggagggagaagaatcctcgaggtcctccactgccgtcaggcgtcacccaactattacacttgatctgcaggttcgtcgaatccggcctggggaaaaccgcgatcgtgatagtattgccaacaggactcgctcaagggtggggctggccgagaatactgttacaatcgagagcaactcgggtgggtttcggagaaccattagccggctggagcggtcaggtatacggacctatgtctctactattaccgtgcctctaagaagaatctccgaaaatgagcttgttgagccttccagcgtggccctgagatccatacttcggcagattatgactggattcggtgagttaagttccttgatggaggctgattccgagtcagaactgcagcgcaatggacagcacctacctgacatgcactccgaactgtccaacctgggcacggacaacaacaggtcccagcatcgagaagggagctctcaggatagacaggcccagggtgacagcacggaaatgcacggcgaaaacgaaactacccagccccatactcgcaacagtgactctcggggagggagacagcttaggaacccaaacaacctggttgagactggtacattacccattttgagattggcgcattttttcttgctgaacgagtcagacgacgatgatcggatacggggtttgaccaaagagcagatagacaacttgtccactcgccattatgaacataattcaatagattctgaacttggaaagatttgtagtgtctgtatcagcgattacgtcaccggaaataaactacgacagctgccctgcatgcacgaattccacattcactgtatcgatagatggctgtccgagaactgcacgtgcccaatctgccgacaacctgtcttgggctccaacattgcaaataacggctag

SEQ ID NO: 239215 - DNA, 1221 bp, Artificial Sequence
  Description of Artificial Sequence: Synthetic coding sequence
atgaccactccagctaacgcccaaaatgcatccaaaacatgggagctgtctttatatgaactgcatcgcacccctcaggaggcaatcatggatgggacagaaatagccgtcagcccaaggtctctccacagtgagctgatgtgtcctatatgtctcgatatgctcaaaaacactatgaccaccaaggagtgcctgcaccgattctgctctgactgcattgtcaccgctctgaggtcaggcaacaaggaatgtcccacctgcaggaaaaagctcgtcagcaaaaggagtctacggcctgatcctaattttgacgcccttataagtaaaatttatccttcccgtgaagagtatgaagctcaccaggacagagttctgatcagactgtccagactgcacaatcagcaggcactctcatcgtccatagaagagggccttcggatgcaggccatgcacagggcccagcgcgtacgcagacccattcccggatctgatcagacgaccactatgagcggtggggaaggggagccgggtgagggggaaggcgatggggaagacgtctcttccgacagtgctcccgattcggcacccggaccagcccctaagcgtccgaggggcggtggagcaggcggaagtagcgtgggcaccggaggcggtggaactggcggtgtcggaggcggagccggaagcgaggactctggcgatagggggggaacactgggcggagggaccctgggtcctccatcccccccaggagcaccttcccctcctgaacccggtggagagattgaactggtttttcggccacatcccttgttggtggaaaagggggagtactgccagaccaggtacgtgaaaacgacaggaaatgccaccgttgaccatctctccaagtatctggctcttcggattgccctggagagacgacagcagcaggaagccggagagcccggtggcccaggtgggggtgcgtctgataccggtgggcctgatgggtgcggcggagagggaggaggcgctgggggaggcgacggccctgaggagccagccttgccgtccctagaaggagtatctgaaaagcagtacacaatctacattgccccaggcggtggagcgttcaccacactcaatggaagcctcaccctggagttggtgaacgagaagttttggaaagtctcccgaccattggaattgtgctacgctccaaccaaagaccccaaatag

SEQ ID NO: 239216 - DNA, 1221 bp, Artificial Sequence
  Description of Artificial Sequence: Synthetic coding sequence
atgactacccctgctaatgctcagaatgccagcaagacttgggaactttccctgtacgaactacacaggacgcctcaggaggcaatcatggatggcacagagatcgccgtgagcccgaggtcactacactctgagctcatgtgccctatatgtcttgatatgctaaaaaacaccatgaccactaaggagtgtctgcataggttttgctccgactgcattgttacggcattgcgaagcggcaataaggaatgtccaacatgtcgtaagaaactcgtcagcaagcgttccctgcggccagacccaaactttgacgcactaatttctaagatttacccatctagggaagaatacgaagcacaccaggacagggtattaatcagattgagcagattgcacaatcagcaggccctgagctcgagtattgaagaaggattgcggatgcaagcaatgcatcgcgctcagagggttcgaaggcctatcccaggttccgaccagacaaccactatgtctgggggagagggggaaccaggggaaggggaaggcgatggtgaggacgtatccagcgacagcgctccagattccgcccctggacctgctcctaagcgcccaagaggaggtggagccggtgggtcctccgttggcacaggtggcggaggtacaggaggggtgggtggaggggcaggcagtgaagacagcggagaccgcggagggacactcgggggaggtactctggggcctccatcaccccctggggcaccatctccccctgagcctggtggagaaatcgaactcgtatttaggccccacccacttcttgttgagaaaggcgagtattgccaaacgcgatacgttaaaacaacaggaaacgccacagtcgatcacctatccaagtaccttgctctacggatcgcacttgaaaggcgccaacagcaagaagctggtgaacctggaggacctggcggaggtgcaagcgacactggcggacccgatggatgcggtggtgagggaggcggtgctggagggggtgatgggccagaggaacctgcattgccctccctcgagggagtctcagagaaacaatatacaatctacatcgcccctggaggcggtgcctttacaacacttaatggaagcctgaccttggaactcgtcaatgaaaagttctggaaggtaagccgcccactggaactgtgctacgcacctacaaaagaccctaagtag

SEQ ID NO: 239217 - DNA, 1221 bp, Artificial Sequence
  Description of Artificial Sequence: Synthetic coding sequence
atgactacccctgcgaacgcgcagaacgcaagtaaaacgtgggagctcagcctgtatgagttgcacagaacgccccaagaagccatcatggatggaacagaaattgcagtaagcccccgaagtttacacagcgagttaatgtgtcctatctgcctggacatgctgaaaaacactatgaccacaaaggagtgcttgcatagattctgctctgactgtatcgtcaccgccctcaggagtggcaataaagagtgtcccacatgccgaaagaaactggtgtctaaacgatctctgaggcccgatcctaactttgatgccctgattagcaaaatttacccttctcgtgaagagtacgaggcacatcaggacagggtacttataagactgagccgactgcataatcagcaggcccttagctcttctatcgaggaaggtctgaggatgcaggctatgcacagagctcagcgtgtccggagacctatccccggttccgaccagactactacaatgagcggcggagaaggcgagcctggggagggagagggggatggagaggacgtgagctccgattctgccccagactctgcgccagggcctgccccaaaacgcccacgtggaggtggcgctggaggttctagcgtgggaactggcggtggtggaaccggaggagttggtggcggagctggaagcgaggactccggggaccggggaggcaccctcggcggtggcacattaggcccaccttccccaccaggtgccccatccccgccagagccaggcggtgaaattgagctggtgtttagaccacacccacttctcgttgagaagggagaatattgccagacgcgctacgttaagacaacaggaaatgcaaccgtggatcacctgagtaagtacctagccctgaggatcgcgcttgaacggaggcagcagcaggaagcgggtgaacctgggggacccggtggcggagcctccgacacaggaggcccagatggatgcggcggagagggcggaggagcagggggaggtgacggccctgaagagccagctcttcctagtctggagggagtctccgaaaagcagtacactatatatattgcacccggtggcggtgccttcaccactctcaacgggtcgctgacactggaattggtgaatgagaagttttggaaggttagcaggcccctggagttgtgttacgctcctaccaaggacccaaaatag

SEQ ID NO: 239218 - DNA, 1221 bp, Artificial Sequence
  Description of Artificial Sequence: Synthetic coding sequence
atgacaacaccagctaacgcccagaacgcgagcaagacttgggagctgtccctgtatgagctgcatcgaaccccccaggaagccattatggatggcaccgaaatagctgtgagtccgcgaagtctgcacagtgagttaatgtgtccaatttgcctggacatgctgaagaacaccatgaccacaaaggagtgtttgcaccgcttctgtagcgattgcatcgttactgccctgcgctccgggaataaagaatgccctacgtgtagaaagaagttggtgtccaaaaggagtttgcggccagatcccaacttcgacgccttgatatctaagatctatccttcccgcgaagagtacgaagcccaccaagacagggttctgatccgcctgtctcggctgcataaccaacaggcccttagtagctcaatagaggagggactcagaatgcaggccatgcaccgggcacaacgtgtcagacgaccaattccaggctcagatcagaccactacaatgtccggcggagagggagaaccaggcgagggcgagggggacggggaggatgtctcgagcgattcagcacctgacagcgccccaggaccagctcctaagcgacctcgcggtgggggtgcaggaggctcttccgtagggaccggcggtgggggaactgggggagtgggcggtggtgccggatcagaagacagtggcgatagaggcggaaccctcgggggaggcacattaggcccaccctctcctccaggcgctccctccccacctgaacccggaggcgagatcgaactcgttttccggccacacccccttcttgttgagaagggcgagtactgtcagacccggtatgtgaagacaaccggtaatgctacagtggatcacttatccaaatacttagccctccggattgccctggagcgcaggcaacagcaggaggccggtgagcccggaggacctgggggaggtgccagcgataccggcggacctgatggttgcgggggagagggtggaggggcaggtgggggagatgggccagaggaacccgctctgccttccctagagggggtgtccgagaaacagtacacgatctacattgcccctgggggtggggcatttactacactgaacggttccttgactctggagctcgtcaacgaaaaattttggaaagtctcacgccctctggagctctgctatgcacccaccaaggatcctaagtag

SEQ ID NO: 239219 - DNA, 1221 bp, Artificial Sequence
  Description of Artificial Sequence: Synthetic coding sequence
atgaccaccccggcaaatgcccagaacgcctccaagacttgggagctgagcctatatgaattgcaccgcactccacaggaagccattatggacggaaccgagattgctgtgtccccaaggtcactgcactccgagctcatgtgccccatctgtttagacatgctgaagaatacaatgacgacaaaagaatgcctgcaccgcttctgctcagattgcatcgtgactgctctacgctccgggaataaggagtgtcctacctgtcgcaaaaaattggtcagtaagcgaagtctcagacctgaccccaatttcgatgccctcatcagcaagatctacccatctagggaggaatacgaggcccaccaggatcgtgttctgataagactgtcccgacttcacaatcagcaggctttgtcgtcctctatagaggagggactgaggatgcaggcaatgcatcgcgcacagagagtgcgcagaccgatacccggtagtgatcagactacgacgatgagcggtggcgaaggagagccaggcgagggggagggggacggggaggacgtgtccagcgattccgccccagacagcgccccaggtcccgcaccgaagaggcctaggggaggaggtgctgggggatcctccgtgggtacaggaggaggcggtaccggtggcgtgggaggcggagcgggatccgaggacagcggcgaccgcggtgggaccctgggcggaggtaccctgggcccacccagtccccctggcgctccatcaccgccagaaccaggcggagaaatcgagcttgtctttcgtccgcatcccctgctggtggaaaagggagagtactgtcaaacacgatatgtgaaaacaaccgggaacgctaccgtcgaccatttgtctaaatatttagccctgcggatagctcttgagcgccgacagcagcaggaagccggagaacccggtggtcctgggggtggagctagcgacacagggggtcctgatgggtgtgggggagagggtggtggcgcaggaggtggggatggcccagaagagcccgcactgccctcactggaaggagtctctgagaagcagtataccatctacatcgctccaggaggtggcgctttcacaactcttaacggcagcttgacccttgaactcgttaacgagaagttctggaaggtgtcaagacccctggagctctgttacgcacccacaaaagaccctaagtag

SEQ ID NO: 239220 - DNA, 1221 bp, Artificial Sequence
  Description of Artificial Sequence: Synthetic coding sequence
atgactacccccgcaaacgcgcaaaatgccagcaagacctgggagctgagtctgtacgaactgcacaggactcctcaggaagcgatcatggacggtactgagatagccgtatcccctcggagtctgcactctgaactgatgtgtccaatctgcttggacatgctcaagaacaccatgactacaaaggaatgtctccacagattctgtagcgactgcatagtcacagccctaagatccggcaataaggagtgccccacatgtcgaaagaagctcgtgtccaagcgctctctgcgcccagacccaaactttgatgctctgatcagcaaaatttatccttcccgcgaggagtatgaagcacatcaggaccgggtgctcattcgactgagtagattgcataaccaacaagccctttctagctctatcgaagaagggctgcgtatgcaggctatgcatcgggcacagagagtgaggcgaccaatacccggttccgatcagaccacaacaatgtcaggcggagagggcgagcccggtgagggagagggagatggagaggacgttagttctgacagcgctcccgattccgctcctggacccgcaccaaaacgaccccgagggggtggagccggtggctcgagtgtgggcacgggcggaggaggcactgggggtgtgggcggaggagccggtagcgaagattctggcgatcgaggtggcaccctggggggtggcacgctaggtccaccgtcaccacccggtgcaccaagcccgccagaacccggaggagaaattgagttagtatttcgcccacatccacttctagttgagaaaggagaatactgtcagacgcgctacgtgaaaacgacaggaaacgctactgtcgatcacttgtctaagtacctggcattaaggatcgctcttgaaaggcgccagcaacaggaagctggagaacccggagggccaggaggcggagcttcggacaccggaggaccagacggttgtggcggagagggaggaggcgctggtggaggggatgggcctgaagagcctgccttgccttccctggagggggtttctgaaaagcagtacaccatctatattgcccctggtggcggtgcgttcacaacactgaatggcagtttaacactggagctggttaatgaaaaattctggaaggtgtcacgaccgctcgagctgtgttacgcccctacaaaagatcctaaatag

SEQ ID NO: 239221 - DNA, 465 bp, Artificial Sequence
  Description of Artificial Sequence: Synthetic coding sequence
atgggaaattgcctgaaatcccccacctcagatgatatctccctgcttcacgagtctcagagtgaccgcgcatcctttggagaaggtacggagcccgaccaggaaccccctcccccatatcaggagcaggtaccagtgcccgtctatcatcccaccccatctcaaactcggcttgcgactcagctaacagaagaggagcagatccgtatcgcccagaggatcggccttatccagcacctccctaaaggagtgtatgatcccggacgggacggatctgaaaaaaaaattcgcgaatgtgtcatttgtatgatggacttcgtgtacggtgatccaattaggtttctgccatgcatgcacatttaccacctagattgtattgatgactggctgatgcggtcattcacctgtccgagctgtatggagcctgttgatgccgctctgctgtcctcgtacgagacgaactag

SEQ ID NO: 239222 - DNA, 1896 bp, Artificial Sequence
  Description of Artificial Sequence: Synthetic coding sequence
atgcctcgcccagcgctgtccgtgacttctttctgtcacaggcttggcaagcgggaacgtaaacaaagttttatgggaaattctggaaacagctggtcgcacactcctttccctaaattggagctcggcttgggccctcagccaatggcaccaagagagctgcctacctgcagcatctgtctggagcggttgagggacccaatctctttggattgtggccatgacttttgtatccgttgtttctctacgcatcggctccctggatgcgaacccccttgctgtccagagtgccggaagatttgcaagcagaaacgtggcctccggtcactgggagaaaaaatgaaactccttcctcaacgaccactgcctcctgccctacaggaaacttgccccgtgcgagctgagccgttactgctagtgcggattaatgcatctggaggtctcatcctccggatgggagcaatcaatagatgtctcaagcatcccttggcacgggacacccctgtgtgtctgctggccgttttgggcgagcaacattctggcaaatcatttctgcttaaccacctgttacagggtctaccagggttggaaagcggggaggggggaagacctaggggcggagaagcgagcttgcaaggctgtcggtggggcgcaaacgggttagccagaggcatttggatgtggtcccatccttttctactcggcaaagagggaaagaaggtggccgtcttcctagtcgataccggggacgccatgtccccagagctatccagagaaaccagaataaaattgtgtgcactgacaaccatgctaagttcgtaccagattctctctacaagtcaggagctgaaggatacagatctcgattacctggagatgttcgtgcacgtggcggaggtgatgggaaagcattacggaatggtgccgatacagcacctggacctactggtgagagattcctctcaccctaacaaggccggtcaggggcatgtgggcaatatttttcagcggctctcaggaagataccccaaagtacaggagcttctccagggcaaacgtgccagatgctgtctactcccagcacccggtagacgacggatgaaccagggccatgcgtcgccaggagatacggatgacgatttccgacatttattgggtgcctatgtgtctgacgtgctgagcgcagccccacagcacgctaaatcccgctgtcagggctattggaatgaaggacgtgcagtcgcaagaggcgaccggcgactcctgacaggccagcaattagcgcaggaaattaaaaatcttagcggatggatgggaagaacaggtcccggttttacaagtcctgatgagatggccgcacagttacacgacctgcgcaaagtggaggctgcaaagagagagtttgaagaatacgtccggcaacaggacgtcgcaaccaagagaatcttttctgccctgcgcgttctgcccgacactatgcggaacttgttatctactcaaaaggacgccattctggctcgtcatggcgtcgctcttctgtgtaagggacgtgatcagacactggaggccctagaagcagagctccaggccacggcaaaggcttttatggacagctatacaatgcggttctgtggccatctcgccgcagtcggcggtgccgttggcgcaggactgatgggcttagcaggcggagtggtcggagccggaatggccgctgcggcactggctgccgaggccggtatggtggcagccggagccgctgtgggggctactggtgccgctgtcgtgggcggaggcgtgggcgcaggcctcgccgcaacagtcggctgcatggaaaaagaggaagatgagcgcctcctcgagggcgatagggagccgctcttgcaggaagagtag

SEQ ID NO: 239223 - DNA, 687 bp, Artificial Sequence
  Description of Artificial Sequence: Synthetic coding sequence
atggccgcacaacagcgcgactgcggtggtgctgcgcagttggcagggcctgccgcagaagccgatccactgggcaggttcacttgtccagtgtgcttagaagtctatgaaaagccagtccaggttccctgcggccacgtattctgttcagcatgcctgcaggagtgcctgaagccaaaaaagccggtgtgtggcgtatgccgctccgccttggcgccaggcgtcagagcggtggagctcgagcggcagatcgagtctaccgagacctcttgtcacggatgtagaaaaaatttcttcctatcaaaaatcaggtcccatgtagctacatgcagtaaatatcaaaactatatcatggagggcgtgaaagctactatcaaggacgcgagcctgcaaccgagaaacgtgcctaaccggtatacgttcccttgtccatattgccccgaaaaaaatttcgaccaggaagggttagttgaacactgcaagctctttcactcaactgacacgaaatcagtggtttgtccaatttgcgctagcatgccatggggagatccgaactatcgctctgccaactttagagagcatattcagagaaggcacaggtttagctatgacacattcgtagactatgatgtcgatgaagaggacatgatgaatcaggtgcttcagcggtccatcatcgaccagtag

SEQ ID NO: 239224 - DNA, 576 bp, Artificial Sequence
  Description of Artificial Sequence: Synthetic coding sequence
atggccgctcagcaacgcgactgcggtggggctgcacagctcgccggaccagcggctgaagccgatcctctcggcaggtttacatgtcctgtctgcctagaggtctatgagaaaccagtgcaggttccttgcgggcatgtgttttgctccgcctgtctgcaggaatgcctgaagcccaagaaacccgtttgcggggtgtgtcgctctgccctagcacccggagtgagggcggtggaactggaaagacaaatagaaagtacagagacaagctgtcacggctgccgcaagaatttctttttatccaagattcggtcccatgtcgcaacctgttcaaaatatcaaaactacatcatggaaggagtaaaggcaaccattaaagatgcttccttgcagccaaggaacgtgcctaataggtatacttttccctgtccatactgtcccgagaaaaatttcgatcaggaaggcctggtggagcattgtaagctgttccactccaccgataccaagtccgttacgtctgagcagagcccctgcctcctgagcgtgagctgctacagagctagtatcacctattag

SEQ ID NO: 239225 - DNA, 1287 bp, Artificial Sequence
  Description of Artificial Sequence: Synthetic coding sequence
atgggacccccacccggagcgggagtgtcctgtagagggggttgtggattctccagactccttgcatggtgtttcctactcgccctctccccccaggccccaggcagccgcggagccgaggccgtgtggaccgcctacttaaatgtatcctggcgcgtgccccacacaggggttaaccgaaccgtatgggaactgtccgaagaaggagtctatggacaggactctcccctagaacccgttgctggggttctagtgccccctgatggcccaggagccttaaacgcctgtaaccctcatacaaactttacagtgccaactgtgtgggggagcaccgtgcaggtctcatggctggcccttatccaacggggagggggttgcactttcgctgacaagatccatctagcctacgagcgaggcgcaagtggcgcagtgatcttcaactttcccggtacccgaaacgaagtaatcccaatgagccaccctggcgcagtagacatcgtggctataatgatcgggaatctgaaagggacaaaaatcctccaaagcatccagagaggaattcaggtaactatggtgattgaggtggggaaaaagcatggcccttgggtcaatcattattcaatattctttgtttctgtgtcattcttcatcatcaccgctgctaccgtaggatacttcattttctacagcgctagaaggctgcggaatgcacgcgctcagtcgagaaagcagcggcagctgaaggctgacgctaagaaggccatcgggcgtctgcagctccgcacattgaagcagggagacaaagagattggcccagacggagactcctgcgccgtctgcatcgagctgtacaagcccaacgatctggttcggatactcacatgtaaccacattttccacaagacatgcgtggatccctggctgctcgaacataggacgtgtccaatgtgcaagtgtgatattcttaaagctttgggtatagaggttgacgtagaggatggtagcgtatccctgcaggttccggtgagtaacgagatcagtaactctgcttcttctcacgaagaggacaatcgatccgagaccgcctcttccgggtatgcttccgtgcaggggacagacgagccacctttggaagagcacgttcaatccaccaacgagtctctgcagcttgtgaaccacgaagctaattccgttgcggtggacgtcatcccccacgtcgacaacccaacattcgaagaggatgagacgccaaatcaggagaccgcggttcgagagattaagagttag

SEQ ID NO: 239226 - DNA, 1209 bp, Artificial Sequence
  Description of Artificial Sequence: Synthetic coding sequence
atgaatcaggaaaacagatcgtcatttttctggttactagtcatctttacatttctacttaagattaccgcctctttttcaatgtctgcctacgtgactgtcacgtactataatgagacctcgaactacacggcaatcgagacatgcgaatgtggagtgtacggactggcgagcccagtggcgaatgccatgggcgtcgtggggatccctaagaacaacaactaccaggcgtgcgaccataacaccgaatttagcaacacaaaaaaaccctggatcgctcttatcgagaggggcaactgcaccttttccgaaaaaattcagacggccggtcgcagaaacgcagacgccgtggtgatttataatgcacctgagactggtaatcagacaatccaaatggcaaattttggcgctgttgacatagttgcgatcatgattggaaacctgaagggtactaaaatcctccagagcatacaaagaggaattcaagtgaccatggttattgaggtgggaaaaaagcacggtccatgggtcaaccactactctatctttttcgtctccgtttcctttttcatcatcactgctgctacagtgggttacttcatcttctattctgcgcgtagactgagaaacgcgagggcgcagtcccggaagcagcggcagctcaaggccgacgccaagaaggccatcggaagactccagctaaggacactaaaacaaggagacaaggaaatcggaccggacggagattcttgcgccgtttgcatagagttgtataaaccaaacgatctcgtccggatcctgacctgtaaccacatctttcacaagacctgtgtggatccgtggctgttagagcatagaacatgccctatgtgcaaatgcgatatcctaaaggcccttggaattgaggtggacgttgaggatggatccgtttccctccaagtcccagtgagtaacgagattagtaactcagcctcttctcatgaagaggacaatcgctccgagacagcgtcatctggatacgccagtgtccaagggaccgatgaaccccctctggaggaacacgtccagagcaccaatgagagcttgcagctggtgaatcatgaagctaacagtgtggctgtagacgttatcccccacgtggacaatcccacttttgaggaagacgaaactcctaaccaggaaactgctgtaagggagatcaagagttag

SEQ ID NO: 239227 - DNA, 750 bp, Artificial Sequence
  Description of Artificial Sequence: Synthetic coding sequence
atgtccgcttacgtaactgttacctactacaacgaaacaagtaattatacagccatagagacctgtgaatgcggggtgtacggcctagcatctcctgtggccaatgcaatgggagtggtgggaattcccaaaaataacaactaccaggcatgtgatcataacacggagttctctaatactaagaagccctggatcgcgcttatagagcgaggcaattgcaccttttccgagaagatccagaccgccggtcggcgtaacgccgacgccgtggttatctacaacgcccctgagaccggaaaccagactatacaaatggcaaacttcggcgctgtcgatatcgtggcgatcatgatcgggaaccttaaaggcactaaaatcctgcagtccattcagcggggaattcaagtcactatggttattgaagtgggcaagaagcatgggccttgggtgaatcactatagcatctttttcgtgagtgtgtcattctttatcattacagccgcaactgtgggctattttatcttttattctgcacgccgactcagaaatgcacgcgcacagagccggaaacagcgccaactcaaggccgatgccaagaaggctatagggagattgcagctgaggacattaaagcagggtgataaggaaattgggcctgacggcgactcatgtgctgtctgtatcgaattgtacaagcccaatgaccttgtccggattttaacttgtaaccacatcttccacaaaacatag

SEQ ID NO: 239228 - DNA, 633 bp, Artificial Sequence
  Description of Artificial Sequence: Synthetic coding sequence
atggcgggactgggattgggcagcgccgtgccagtgtggttggccgaggatgatctggggtgtattatctgtcagggtctcttggactggcccgctactttgccatgcggtcactctttttgccgacactgtctggaggctctttggggagcaagagatgccagaagatgggcttgcccaacttgtcgtcagggtgccgctcagcaaccacacttgcgcaaaaacacactcctgcaagacctggccgacaaatatcgcagggccgcacgggaaattcaggctggatccgaccctgcccattgcccttgccctggatcttcttcccttagcagtgccgctgctagacctcgaagacgtccggagttacagcgcgtcgcggtggagaagagcattactgaagtcgcacaggagcttacagagttagtggaacacttggtcgacattgtgagatcccttcagaatcagcggcctctcagcgagagtggtcccgacaatgaactctctatcctcgggaaggaaaattcgtggaaacctagactcccccctcatgcccattgcctgacacgcgcaacattgcactcaggagaacttctcggattattaagtgggccaagcatccagccactgacttag

SEQ ID NO: 239229 - DNA, 1299 bp, Artificial Sequence
  Description of Artificial Sequence: Synthetic coding sequence
atggccggactaggattaggcagcgctgtaccggtttggctcgctgaggacgatctgggctgcatcatttgccagggtttactggactggccagctacactgccgtgcggacactcattctgcaggcattgcctggaggcactgtggggcgcaagagacgcccgaaggtgggcatgtcctacatgtcgtcagggggctgcccagcagccgcatctgagaaaaaatacactgttgcaggacctggcagacaagtatagacgcgctgccagggagattcaagctggctccgacccggcacactgcccttgccctggctcctccagccttagttctgccgctgcgcgtcccaggaggcgccctgaactacagcgagtggctgttgagaagtcaatcacagaggtcgcccaggaattgacagagctggtagagcacctggtggacatagttagatccctccagaatcagcgtcctctgagtgaaagtggacctgacaacgaattatcgatactgggtaaagcctttagttctggagtggacctctccatggcaagccccaaacttgtaacctccgataccgcagccggaaaaatccgggacatccttcatgacctcgaagagatccaggagaaattacaggaatcagtaacgtggaaagaagctccggaggctcagatgcagggcgagctgcttgaggccccttcctcttccagctgcccgctgcccgatcaatcacatccagccctacggagagcatctaggttcgctcaatgggcaatacatcccaccttcaatctgaaaagtctgtcatgtagcctggaagtgtcaaaagactcacgaacggtcacagtatcacaccggcctcagccttacagatggtcttgtgagcgattcagcacatcacaggttctttgctctcaggccctgtcttctggaaaacattattgggaggtggatacacgtaactgctctcattgggctgttggcgtcgcctcctgggaaatgtctagagatcaggtcctcggacggaccatggactcatgttgtgtagagtggaagggcacgagccagttgagcgcatggcacatggtcaaagagaccgttcttgggtctgacaggccgggagtcgtgggcatctggctgaatctggaggaagggaagctagccttctactctgtggataatcaggaaaaactgctgtacgagtgcacgatatccgcttcctcccccttatacccggctttttggctttacggcctgcaccctgggaactacctgattatcaagcaagtcaaagtgtag

SEQ ID NO: 239230 - DNA, 255 bp, Artificial Sequence
  Description of Artificial Sequence: Synthetic coding sequence
tgaaaggaagcgcctgaagcacagatgcagggaagcctcttgccaaggctcgagtgctcagggacgataacagctgccagcattagccaggcccaggaaaactcctggaagccccgtctacctcctcacgctcactgcctcacacgcgctacgttgcacagtggtgagctgctgggcctgctgagtgttccccctcgcggagagcttatcgctaaagcaaaacaggttgagacccttgatccacgggctctgtag

SEQ ID NO: 239231 - DNA, 291 bp, Artificial Sequence
  Description of Artificial Sequence: Synthetic coding sequence
gcacagcagccacatctgcgcaagaacaccctgctacaggatctcgctgacaaataccgcagggctgctagggagatccaggccggttccgaccccgctcattgcccatgtcctggaagtagctcactgtcatctgctgctgctcgccctagacgaaggccagaacttcagagagaaaactcatggaagccccgtctccccccacacgctcattgccttacccgagccacactgcatagtggcgagttgttgggcctgctttcgggaccaagcattcaacctctgacctag

SEQ ID NO: 239232 - DNA, 861 bp, Artificial Sequence
  Description of Artificial Sequence: Synthetic coding sequence
atggccggtctgggcctcggtagtgccgtgcctgtatggctggccgaggatgaccttggctgtatcatttgccaaggtctcctcgactggcctgctacgctaccctgcggccactccttctgccgccactgcctggaagcactgtggggagcaagagacgccagaaggtgggcctgccctacctgtcgccagggggctgcccagcagccccacttgcgtaaaaacacacttctgcaagacctggcggacaaataccggagagccgctcgggaaattcaagccggaagcgaccctgctcactgtccatgtccaggctccagcagcctgagcagcgcggctgcgaggccaagacgccgtccggagctccaaagggtggctgtggagaaatccatcacagaggtggcgcaagagttgacggagctggtggagcatctggttgatattgtgcggtcactgcaaaatcaacgacccctgagcgagagcgggcctgataacgagctctctatcctgggcaaagcattctcctccggggtcgatcttagcatggccagccccaaactagtcacaagcgacaccgcagcaggcaagatccgcgatatcctccacgacctggaggaaatccaggagaagttgcaggaaagtgtgacgtggaaggaagccccagaagctcaaatgcagggcagcttgctgcctaggctcgaatgttctggaacgatcactgctgcttcgatttcgcaggcccaggagaacagttggaaaccacgactgcctcctcacgcacattgtctcactcgcgctacgttgcattcaggtgagcttctgggcctcctgagcggccctagtattcaaccgctgacttag

SEQ ID NO: 239233 - DNA, 756 bp, Artificial Sequence
  Description of Artificial Sequence: Synthetic coding sequence
atggcaagccctaagcttgtcacctccgacactgccgcaggaaaaatccgcgacattctgcatgacctggaagagattcaggaaaagctccaagagtcggtgacctggaaggaagcccctgaagcccagatgcagggtgaactgttggaggctccttcatccagctcgtgtcccctaccagatcagtcccatcccgctctcagaagggccagcaggttcgcccagtgggccatacaccctaccttcaacctgaagtcactgtcatgcagtctggaggtgtcaaaagatagccgaacagtcacagtgtcacaccgcccacaaccttaccgctggtcatgtgagaggttcagcactagtcaggtgctttgttcacaggcattatctagtggaaaacactattgggaggtggacactaggaactgctcccattgggctgttggggtggccagctgggagatgtcacgcgatcaagtgcttggcagaacaatggactcgtgctgcgttgagtggaagggaacctctcagcttagcgcctggcacatggtgaaagagactgtcctgggctccgatagacccggagtagtgggaatctggctgaatctggaggagggcaaactcgctttctactccgtggataatcaggagaagctgctgtacgaatgtaccatttctgccagtagtcctttgtacccagccttctggctgtacggcctacaccctggcaactacctgataattaaacaggttaaagtgtag

SEQ ID NO: 239234 - DNA, 1995 bp, Artificial Sequence
  Description of Artificial Sequence: Synthetic coding sequence
atggccgcagtcgggccacctcaacagcaggtgcggatggctcaccagcaggtctgggcagctctggaagtcgccttgagggtgccctgcctgtatattattgacgccatctttaattcatacccagattcatcacagtccagattttgtattgtgctgcaaatatttctgcggctcttcggggtgttcgccagctcgatagtcctcatcctttcccagaggtccctgtttaagttctacacgtattccagtgcattcctactggcagccacctcagtcctggtgaactactacgcatcactccacattgatttctacggggcatacaatacaagcgccttcggtatagaactccttcctcggaaaggccctagcttatggatggccctcatcgtgctgcagctcacatttggcatagggtatgttacactgctccagattcacagcatctattcgcagttgattatcttggatctgctcgtgccagtgattggattaattactgagctgcccctccacattcgggagactctcctgttcacttcttccctgattttgaccctgaataccgtgttcgtcctggcagttaagttgaaatggttctactatagcactcggtacgtctacttgcttgttcgccacatgtacagaatctacggactccagctgctgatggaggacacatggaagagaattaggtttccggatattctgcgagtgttttggctgaccagggtcaccgcgcaggctacagtgttaatgtacattcttcgtatggccaatgagactgacagcttttttatctcttgggatgacttttgggatctcatatgcaacttgatcattagtgggtgtgattcaactctgaccgtattgggaatgtccgccgtgatcagctccgtggcccactacttgggcctagggattctcgcattcattggttccactgaagaagatgataggcgtctggggtttgtggctccggtcctcttcttcattctagcattgcagacaggcctttcaggcctgcggccagaggagcggctgatccgtctgagccgcaatatgtgccttcttctgacagccgtgctgcattttatccacgggatgactgaccctgtgctgatgtccttgtccgcttcccacgtgtcctcattccgtagacacttccctgtgctgttcgttagcgcctgcttgtttatcctgcctgttctgctgtcctatgtgctctggcaccattatgccctgaacacatggcttttcgccgttacagcgttttgcgtagagctgtgccttaaggtgatcgtctctctgacagtatacacactgttcatgattgatggttactacaatgtcctttgggagaagctggatgattatgtgtactatgtcaggtcaactggctcgatcattgagtttatattcggagtggttatgtttggtaatggtgcatatacgatgatgtttgaatcaggttctaaaatcagagcattcatgatgtgccttcacgcatacttcaatatttatttacaggccaaaaacgggtggaagacattcatgaataggcgcacagctgtcaagaagattaactccttgccggaaatcaagggaagccgtctgcaggaaatcaatgatgtctgtgccatctgttaccatgaatttaccactagcgctcgaatcactccatgcaatcattactttcatgccctgtgtttacgcaagtggctgtatattcaggacacatgccctatgtgccaccagaaggtgtatattgaggacgacataaaagacaatagcaacgtatccaacaacaacggtttcatacccccaaacgagactcctgaagaggccgtacgagaggccgctgcagagtctgatcgggagctgaacgaagacgacagtaccgactgtgacgatgatgtgcaacgtgaacggaatggggttatccaacataccggggctgcagctgaagaattcaacgatgacactgactag

SEQ ID NO: 239235 - DNA, 1425 bp, Artificial Sequence
  Description of Artificial Sequence: Synthetic coding sequence
atgtccagcgaagacagagaggcccaggaagacgaactgctggctttagcatccatctacgacggagatgagttcaggaaggcagagagcgtgcaaggcggagagactaggatctatctggatctgcctcagaacttcaaaatatttgtaagcggcaacagcaacgagtgtcttcagaactccggatttgagtacacaatttgtttcttaccgcctctggtacttaacttcgagcttcctcccgactacccctccagtagtcccccatccttcacactttcaggaaaatggctctcacccactcagctgtctgcgctctgtaagcatctcgataacctctgggaggagcaccgcggtagcgtcgttctcttcgcatggatgcagttcctaaaggaagaaactctggcctacctgaatattgtgagccccttcgagctcaagattggctcccagaagaaggtgcagagacggactgcccaggcatcccccaatacggagctggatttcggcggtgcagcaggcagcgatgtggatcaggaggagatagtggacgagagggctgtccaggacgtggaatctttgagtaatctgattcaggaaatcttggattttgatcaggcccagcagattaagtgtttcaacagcaaactctttctctgcagcatttgtttctgcgagaaactgggctcggagtgcatgtactttctcgagtgccgccacgtatactgcaaagcatgcctgaaagattatttcgagatacaaatccgagacggccaagtgcagtgtctgaattgtccggaacccaagtgccctagcgtggccactcctgggcaggttaaggagctcgtcgaggctgagctgtttgcaagatacgatcgtcttttactgcagtctagtctcgacctgatggcagacgtggtctattgtccgcgtccatgttgccagctcccagtgatgcaggaaccgggttgcaccatgggaatctgttcttcgtgcaactttgccttttgcacattgtgcagactgacataccacggtgtgagcccatgtaaagtgaccgctgaaaaattgatggatctgaggaacgagtacctgcaggctgacgaagccaacaaacgactgctggaccaacgatacggaaaaagggtcattcagaaggcacttgaagagatggaatcaaaggagtggctggagaaaaatagtaaatcctgtccctgctgtggtacacctattgaaaagctcgacggctgcaacaaaatgacctgcactggatgtatgcagtatttttgctggatctgtatgggtagtctgagtagagccaacccttacaagcacttcaacgacccagggtccccatgcttcaatcggcttttttacgccgttgatgtagacgatgatatctgggaagacgaggtggaggactag

SEQ ID NO: 239236 - DNA, 1425 bp, Artificial Sequence
  Description of Artificial Sequence: Synthetic coding sequence
atgtcttctgaggatcgtgaggcacaggaggacgaactgttagctcttgcctcgatctacgacggcgacgagttccgaaaggccgagagcgtacagggaggcgaaaccagaatctacctggatctgcctcagaacttcaagatattcgtgagcggcaacagtaatgaatgtctccagaactctgggttcgagtatacaatatgcttcctcccccctctagtgctcaactttgagctaccgccagattatccttcttcaagtcctccctctttcaccttatctggtaagtggctgagcccgacacagctgagtgcactgtgtaaacacttagataatctttgggaggaacacaggggcagcgtcgttctcttcgcctggatgcagtttctgaaggaagaaacgctggcttatcttaacattgttagcccatttgagctcaagattggatctcaaaaaaaggtgcaacgccgtaccgcacaggcttcccccaatactgaacttgacttcggcggtgcagctggatctgatgttgatcaagaagaaattgtggacgagagggccgtccaggacgtggaaagtcttagcaacctgattcaggagattcttgactttgaccaagcacagcagattaaatgcttcaatagcaaacttttcctgtgttctatctgcttttgcgagaagcttggatctgaatgcatgtattttctcgaatgcaggcatgtgtactgtaaggcctgtctgaaggactactttgagatccagatccgtgacgggcaggtccaatgcctgaattgccccgaacctaagtgtccatcagtggctacacctggccaagtgaaagagctagtggaagcagagctgtttgcgaggtatgatcgtcttttgttgcaatctagcctcgacctgatggccgacgtggtttattgtcccaggccctgttgtcaactgcccgtaatgcaagaacctgggtgcaccatgggaatatgctcttcttgcaactttgctttttgtaccttgtgtcgactcacctaccatggagtgtccccatgtaaggttacagccgaaaaattgatggacctgagaaatgagtacctgcaggccgacgaagcaaacaaaagactcttggaccaaagatatggaaaacgtgtgatacagaaggccctggaggaaatggagagtaaggaatggttagaaaaaaacagcaaaagctgcccctgttgtgggactcccattgagaaacttgatgggtgtaacaagatgacctgcaccggttgtatgcagtacttttgttggatatgtatgggatccctctctcgtgccaacccatacaagcatttcaatgaccccggaagcccatgctttaatcggttattctacgctgtcgacgtcgatgacgatatctgggaggatgaagttgaggactag

SEQ ID NO: 239237 - DNA, 1047 bp, Artificial Sequence
  Description of Artificial Sequence: Synthetic coding sequence
atgcagttcttgaaggaggaaacactggcttatctgaatatcgtaagtccctttgaactcaaaattggtagccagaaaaaagtccaacggcgaacagcgcaagcatcaccaaacacagagttggatttcgggggagccgcaggatccgatgtggatcaggaagagatcgttgacgagagagcagtccaggacgtcgagtctctaagtaacctgattcaggaaatactcgatttcgaccaggcccagcaaatcaaatgttttaatagtaaactgttcctctgtagcatttgtttttgtgaaaagctgggctcagaatgtatgtactttctagaatgccggcatgtctactgcaaagcttgcttaaaagactactttgagattcagattcgggacggacaggtgcaatgcttgaactgccctgagcccaagtgcccctcagtggccactcccggtcaagtgaaggagctggtcgaggccgagttattcgcaagatacgataggcttctactgcagtcatcactagatctgatggctgatgttgtgtattgtcctcggccatgttgccagttacctgtcatgcaagagcctggatgtaccatgggtatttgcagctcttgtaacttcgctttctgtaccctttgtaggctcacctaccatggggtctcaccatgcaaggtgaccgccgagaagctaatggatctgagaaacgagtatttgcaggctgacgaggctaacaagagactgctggatcagcgatacggcaaaagggtgatccagaaggctttggaagaaatggagtccaaagagtggctggagaagaacagcaagtcatgtccatgttgcggaacccctatcgaaaaacttgacggttgcaataagatgacatgcaccggatgtatgcagtatttttgctggatctgtatggggtcactgagtagagctaatccatacaagcactttaacgatcccggttccccatgttttaatcgcctgttttacgccgttgacgtggatgacgacatttgggaggacgaggttgaagactag

SEQ ID NO: 239238 - DNA, 897 bp, Artificial Sequence
  Description of Artificial Sequence: Synthetic coding sequence
atgagcagtgaggatagagaagcccaagaagatgaactgctggcgctggctagcatttatgacggcgatgaattccggaaggccgagtcagtgcagggaggggaaacgcggatttatctggatctgccacagaattttaagatattcgtcagcgggaacagtaatgaatgtctacaaaacagcggcttcgagtacacgatatgctttctccctccactggtcctcaattttgaactgcctcccgactatccttcctcctcgccacctagtttcacactgtcagggaaatggctgtcgcctacacaagtgaaggaactcgttgaagctgaattgtttgctcgctatgaccgcctgctactgcaaagtagtctggacctaatggcagatgtagtgtactgtcccagaccatgttgtcaactgccagttatgcaagagcctgggtgcaccatgggaatctgttctagttgtaattttgccttctgcacgttgtgccggctgacatatcacggagtgagcccctgcaaagttaccgccgagaaactgatggatctgcgaaatgagtatctccaggcagacgaggccaataaacggctgctcgatcaaagatacgggaaacgggtgatccagaaggccctggaagagatggagtcaaaagagtggttggagaagaacagcaagagctgcccctgctgcggaacccccattgagaagctggatggatgtaacaaaatgacttgcactggatgtatgcaatacttttgctggatctgcatgggcagcttatctcgcgctaatccatacaaacacttcaatgacccgggatccccgtgtttcaatcgtctgttttacgccgtggatgttgatgacgatatttgggaggacgaagtcgaagactag

SEQ ID NO: 239239 - DNA, 1425 bp, Artificial Sequence
  Description of Artificial Sequence: Synthetic coding sequence
atgtccagtgaggacagggaagcccaggaagacgaactgctggcccttgctagcatctacgacggagacgaattccgcaaggctgagtctgtacagggaggggagacacgcatatacctcgaccttcctcaaaattttaagatcttcgtgtcggggaacagcaacgaatgcctgcagaatagcggcttcgagtacaccatttgttttctccctcccctagtgcttaatttcgagctgcctccggactacccaagctcttcccccccttctttcacactgtccgggaaatggctgtctcctacacagcttagtgcattatgcaagcatctggacaatctttgggaggagcaccgcggaagcgtggtgctgtttgcatggatgcaatttctcaaagaagaaactcttgcttacctaaacattgtctctccctttgaactgaagataggatctcagaaaaaagtccagcgaagaaccgcccaggcatctcccaacaccgaactagatttcggcggtgctgcaggctccgatgtcgaccaggaggagatagtcgacgagcgggctgttcaggatgtggagagcctgagcaatctgatccaggagatcctggacttcgaccaagctcagcagatcaagtgcttcaattcgaaactgtttctgtgttcgatatgcttttgcgagaagcttgggtcagaatgtatgtattttctggagtgtcggcatgtttactgtaaggcatgcttaaaagactattttgagatacaaattcgagacggacaagttcagtgcctgaactgtcctgagcccaagtgtccctcagtggctaccccaggacaagttaaggagctggtagaggccgagttgttcgctcgctatgatcggctgctcctccaaagttcacttgatctgatggccgatgtggtgtattgccctagaccctgctgtcagctgcctgtcatgcaagaacctggctgcacgatgggtatatgctccagttgtaacttcgctttttgcactttgtgccggctaacataccacggtgtctcaccttgtaaggtgacagccgaaaagctgatggatctgcgaaacgagtacttgcaggcagatgaggccaacaagcgtttgcttgaccaaagatacggcaaaagggtaattcagaaagcactggaagagatggaatctaaggagtggttagaaaaaaacagcaagagctgtccctgctgtggtacccctatcgaaaagttagacgggtgtaacaagatgacatgcactgggtgcatgcagtatttctgctggatctgtatgggaagtttgagcagggctaacccttacaagcatttcaatgacccaggcagtccctgctttaatcgccttttctacgccgtggacgtggacgatgatatttgggaagacgaagttgaggattag

SEQ ID NO: 239240 - DNA, 1425 bp, Artificial Sequence
  Description of Artificial Sequence: Synthetic coding sequence
atgtcatcagaagaccgagaggctcaggaagatgagttactggcgctggccagtatttatgatggcgacgagtttcggaaggcagagtctgtccagggaggcgaaacccgtatctaccttgacctaccacagaacttcaaaattttcgtgtcaggaaattcaaatgaatgccttcagaattccggcttcgagtataccatttgcttccttcctcccctcgtgttaaacttcgaattgcccccagattacccctcgtccagccccccatcattcactttgtctggtaaatggctttccccaacgcagctgtctgcgctgtgcaagcatctggataatttatgggaggagcatagaggttccgtggtcctgtttgcatggatgcaattccttaaggaagagacgctggcgtatctgaacatagtctctccgtttgaattaaagattggaagccagaagaaagtgcagaggaggacggcccaggccagtccaaatacggagcttgatttcgggggagccgcaggttcagatgtcgatcaggaagagattgtggacgaacgagccgtccaggatgtcgagagcctctcaaatctgatccaggaaatccttgactttgaccaagcacagcagatcaagtgctttaacagcaagttattcctgtgttcaatctgtttttgtgagaagcttggctcagagtgtatgtatttcttagaatgtagacacgtttactgcaaggcatgcttgaaagactatttcgagattcaaattcgcgacggacaggttcagtgcctgaactgtccggaacccaaatgtccatccgtggccactcctggacaggtgaaggaattggttgaggcagagctgtttgccaggtatgaccgtttactgcttcagtccagcctggatttaatggccgacgttgtctactgtccacgcccttgttgccagctgccagtgatgcaggaaccgggttgcaccatgggaatttgttcctcttgcaacttcgctttttgtactctgtgccgactgacataccacggggtgtctccctgcaaagtgaccgccgagaagctgatggacttgcgaaacgaatacctgcaggctgatgaagctaacaagaggttacttgatcagcgctacggtaaacgggtgatccagaaggccctggaggaaatggagtccaaagagtggcttgaaaagaacagcaagagttgtccctgctgcggaacccctatagagaaactggatggatgcaacaaaatgacctgcaccggctgtatgcagtacttttgttggatatgcatgggaagcctgagcagggccaatccttataagcactttaacgatccaggatccccatgtttcaatcggttgttctacgccgttgatgtagatgacgacatctgggaagatgaagtggaggactag

SEQ ID NO: 239241 - DNA, 48 bp, Artificial Sequence
  Description of Artificial Sequence: Synthetic coding sequence
atgtcgtccgaggatagagaggctcaagaggatgagctgctggcctag

SEQ ID NO: 239242 - DNA, 399 bp, Artificial Sequence
  Description of Artificial Sequence: Synthetic coding sequence
atgtcctccgaggatcgggaggctcaggaggatgagttgttggctctagcctctatttatgacggtgatgaatttcggaaggctgaatctgtgcagggcggagaaactagaatttacctggatctacctcaaaacttcaagatttttgtgtccggcaattccaatgaatgcctccagaactccggcttcgagtacacaatttgcttcctgcctcctttggtactgaattttgaactcccccctgattaccctagttcatccccaccctcatttacacttagcggaaagtggctgtcacctacccaactgtccgccctctgcaagcacttggataatctatgggaagagcatcgaggctcagttgttttgtttgcctggatgcagttcttaaaggaatag

SEQ ID NO: 239243 - DNA, 516 bp, Artificial Sequence
  Description of Artificial Sequence: Synthetic coding sequence
atgagttctgaggatagagaagcccaggaggacgagttgctggctctggcctccatttatgacggcgacgagttccggaaagctgagagcgtgcaaggcggagaaacaaggatttacctcgatctgccccagaatttcaagattttcgtgagcgggaattccaatgagtgccttcagaattctgggtttgagtacaccatctgcttccttccccctcttgtgctgaactttgaactgcctcccgattatcctagttcaagcccgccttcttttaccttgagtgggaaatggctgtcgcccacccaactgagcgccctatgcaaacatctggacaacttgtgggaagagcatcgcggatctgtggtgctattcgcctggatgcaatttctgaaagaggagaccttggcatatctgaatatagtcagcccttttgagcttaagatcggctctcagaaaaaggtgcagaggcgtactgctcaggcatctcccaatacagagctcgatttcggcggttag

SEQ ID NO: 239244 - DNA, 558 bp, Artificial Sequence
  Description of Artificial Sequence: Synthetic coding sequence
atgagcagcgaggatcgtgaagctcaagaagatgagctattagcactcgcatccatctatgacggagatgaatttcgaaaagccgagtctgtgcagggtggagaaactcggatctacctggacctgccccaaaacttcaaaattttcgtgagcggaaatagcaacgagtgtctgcagaactctggcttcgaatatacaatttgctttctgccacctctggtcctcaactttgagttaccacctgattacccatccagctccccgccttcttttacactctccggcaagtggctgtcaccaacccagcttagcgccctctgcaagcaccttgataatctgtgggaggaacacagaggatctgttgtgttgtttgcttggatgcagtttctcaaggaagagaccctggcctacctgaatattgtctcccccttcgaactcaaaattggcagtcagaagaaggtgcagcgcaggaccgcacaagccagtcccaatactgaactcgacttcggcggagcggcaggctccgatgtggatcaggaagagattgtcgatgaatag

SEQ ID NO: 239245 - DNA, 186 bp, Artificial Sequence
  Description of Artificial Sequence: Synthetic coding sequence
atgagttcagaggatagagaagcacaggaggatgagctactcgcactggcatcgatatacgacggagacgaattcaggaaggctgaaagtgtacagggaggggaaacaaggatatacttagatttgccccaaaattttaaaatcttcgtgtcaggcaatagtaacgagtgcctgcaaaattcatag

SEQ ID NO: 239246 - DNA, 837 bp, Artificial Sequence
  Description of Artificial Sequence: Synthetic coding sequence
atgagttccgaagacagggaagcccaagaggatgagctgctggccttggcgtcaatttatgatggagatgagttccgcaaggccgagtccgtacaggggggagagactcggatataccttgatttaccccagaattttaagatcttcgtaagcgggaattccaacgagtgtctccagaactctggttttgaatacaccatctgcttcttacctccattagtgttaaattttgagctaccaccagactatcccagttccagtcctccctccttcactctgtctggcaagtggttaagtcccactcaactgagtgccctgtgtaaacacctcgataatctgtgggaggagcatcgtggttctgtggtcctgttcgcatggatgcagtttttaaaagaagaaactctggcctatctgaatatcgtgtctcctttcgaactcaagatcggatcccagaagaaagtgcagagaaggaccgcacaagccagccctaacactgaacttgatttcggaggagccgctgggtctgacgttgaccaggaggaaattgtcgatgaacgagccgtccaggacgttgagagcctctcaaacctgattcaggaaatcttggatttcgaccaagcacagcaaataaagtgctttaactccaaacttttcctgtgttcaatctgcttctgcgaaaagctgggcagcgagtgcatgtatttcctcgaatgccggcatgtttactgtaaggcctgtttgaaggattatttcgagatccagatccgggacgggcaggttcagtgtttgaactgtcccgagcctaagtgtccctcagtcgctacacccggtcaatag

SEQ ID NO: 239247 - DNA, 300 bp, Artificial Sequence
  Description of Artificial Sequence: Synthetic coding sequence
atgtcgtcagaagacagagaggcccaggaggatgaactgttggcacttgcttccatctacgacggagacgaattcaggaaagcagaaagcgttcaagggggagaaaccagaatatatttggacctaccccagaatttcaaaatattcgtctccggcaactctaatgaatgcttgcaaaactcaggatttgaatataccatctgcttcttgccccctttggtgctgaactttgagctcccccctgattacccgtcttcctcccctccctccttcaccctctctgggaagtggctgagctag

SEQ ID NO: 239248 - DNA, 516 bp, Artificial Sequence
  Description of Artificial Sequence: Synthetic coding sequence
atgtcgtcagaagaccgtgaagctcaggaggatgagctgttggcactagcgagcatctacgacggagacgagtttcggaaagccgagtcagtccaagggggagagacacggatctatttggacttacctcagaacttcaagatcttcgtttcggagaaactaatggacttgagaaacgagtatttgcaggccgacgaagcgaacaagcggctcttagaccagcgatatgggaaacgagtaatccagaaggcgctggaggaaatggagagtaaggaatggttggaaaaaaatagtaagtcctgtccgtgttgcggaactccaatagaaaagctcgacggatgcaacaagatgacttgtacaggatgcatgcagtacttttgttggatttgtatgggtagcctgagccgtgcaaacccgtataagcacttcaacgaccccggaagcccctgcttcaaccggttgttctacgctgtggacgtggatgacgacatctgggaggatgaagtggaagactag

SEQ ID NO: 239249 - DNA, 1077 bp, Artificial Sequence
  Description of Artificial Sequence: Synthetic coding sequence
atggctggctgcggtgagattgatcactctatcaacatgctgcccaccaacaggaaggctaacgagtcatgctccaatactgcgccatccctcacagttcccgagtgtgccatctgtttacagacctgtgtgcaccctgtctctctgccctgtaagcacgtgttctgttatctctgcgtgaaaggcgcatcctggctcggcaagcgatgcgcgctgtgtaggcaggaaatcccagaagattttctcgacaagccaaccctgctgagtccagaagagctgaaggctgccagccggggaaacggcgaatatgcgtggtactacgaaggcaggaatggatggtggcagtacgatgaacgcacatcaagagaacttgaggacgctttctctaaagggaagaaaaacacggagatgctgattgccggatttctgtatgtggcagacctggagaacatggtccaatacagaagaaacgaacacggccgaagacgcaagatcaaaagagacataattgatatcccgaagaaaggcgtcgccggtctccgattggactgcgacgccaatacagttaatctggcccgagaaagctccgcggatggggcagactccgtgtctgcgcaaagcggagcaagcgttcagcccctcgtcagttctgtgagaccactgacatcagtggacgggcagttgacttcaccagctacccctagtcccgacgcttccaccagcctggaggattctttcgctcatctgcaactttctggggataacacagctgagcgcagccaccgaggcgagggcgaggaagaccacgagtcccccagctctgggagggtgcctgcccctgacactagcatcgaagaaacagagtccgatgcttcttctgactccgaggatgtgtcagctgttgttgcccagcatagcctcacacaacagaggctgctagtgtcaaatgctaatcagacagttcccgatagatccgacagatccggaaccgatagatcagtcgctgggggtggcactgtcagcgttagtgttcggtctcgcagacccgatggccaatgcacggtcactgaggtctag

SEQ ID NO: 239250 - DNA, 1077 bp, Artificial Sequence
  Description of Artificial Sequence: Synthetic coding sequence
atggccggatgcggcgagatcgaccactcaattaacatgctgcccaccaataggaaggcaaacgaatcttgctccaatacggcgccatcccttactgtaccagagtgcgcaatatgcctgcagacctgcgtgcaccccgtgtcactcccgtgcaaacatgtgttttgctacctctgtgttaaaggcgcatcctggcttggtaaaagatgcgccttgtgtcgccaggaaatacctgaagacttcctggataagcccaccctcctgtcccccgaggagctgaaggcagctagtcgaggcaatggagagtacgcctggtactatgagggacgtaatggatggtggcagtatgatgagaggactagcagagagctggaagacgctttctcgaagggaaagaaaaatactgagatgcttattgccggatttctgtatgtggccgatctggaaaacatggtccagtaccggagaaacgagcacgggcgaagaagaaagattaaacgcgatatcattgatattccaaaaaaaggagtcgcgggtttgcgcctggattgcgatgcaaacacagtgaatctggccagagaatctagcgctgatggtgctgatagcgtgtcagcacaaagtggagccagtgtccagcccctggtgtcatctgttaggccccttacttcagtcgacggccagttgactagccccgctaccccttcacctgatgcttcgactagccttgaggacagcttcgcacacctgcagctgtcgggcgataacaccgctgagagatcccataggggggaaggagaggaggatcatgaatctcccagttccgggagggttcccgctcccgacacctccatagaggagaccgaaagcgacgcttcctctgactctgaagatgtgtccgccgtcgttgcacaacattcactaacacagcaacgcctcctcgtctccaacgcaaaccagaccgttcctgataggagcgaccgctctgggaccgatcgctcagtggccggtggcggtacagtgagcgtctccgtcaggtcccgacgcccagacggacagtgcactgttaccgaagtgtag

SEQ ID NO: 239251 - DNA, 1080 bp, Artificial Sequence
  Description of Artificial Sequence: Synthetic coding sequence
atgatggccggatgcggggagattgatcattcaatcaacatgttgcctaccaatcggaaggcgaacgaatcgtgtagcaatacggccccatcccttaccgtaccagagtgcgccatatgtctccaaacctgcgttcaccccgtgagtctcccttgtaaacatgtgttctgttacctgtgtgtgaaaggcgctagctggcttgggaagagatgtgccctttgccgccaagaaatacctgaggactttttggacaagcccacacttctcagcccagaggaactgaaggccgcaagtaggggaaatggcgagtacgcctggtactacgaaggtcgaaacggttggtggcagtatgacgagcggaccagccgggaattggaagacgcattcagtaaggggaaaaagaacacggaaatgctcattgccggatttctgtacgtggcggacttagagaatatggtgcaatacagaaggaatgagcacggacggaggcgcaaaatcaaaagagatataatcgacatacccaaaaaaggggtggctgggctgaggttggactgcgatgccaatacggtaaaccttgctcgggagagttccgctgacggcgcagactccgttagtgctcagtccggagccagtgtgcagccgctagtttcgtccgtgcgccctttaacttctgtggacgggcagctgacctcaccagccactccgtcccctgacgcgtccacaagtctggaagatagcttcgcacaccttcagctgtccggcgataataccgctgagcgatcccacagaggcgaaggggaggaggaccacgaatctccatcctccggacgtgttccagcaccagacacatcaatagaggagacagagagcgatgcgtcatcagacagtgaagacgtctctgcagtggttgcacagcactctctgacccagcagcggctcctggtcagcaatgccaatcagactgttcccgaccggagcgatagatctgggacagatagaagtgtggccggaggaggaaccgtaagtgtctctgtgaggtccaggcggccagacggtcagtgcactgtaaccgaggtatag

SEQ ID NO: 239252 - DNA, 1716 bp, Artificial Sequence
  Description of Artificial Sequence: Synthetic coding sequence
atggcgctgcccaaggatgcaattcccagtctcagtgaatgccagtgcgggatttgcatggagatcctcgtagaacccgtcactctgccttgcaatcatacgctgtgcaagccctgttttcagtctacggtagagaaggccagtctgtgttgtcccttctgccgtagacgcgtgtcatcttggacacggtaccacacgagaaggaatagcttagtgaatgtcgagttatggacgatcattcaaaaacactacccacgcgagtgtaagctacgtgcttcgggccaggaaagtgaggaagtggcggatgactatcagcccgtcagacttctctccaaaccaggcgaactgcgccgagaatacgaggaagagatcagcaaagtggccgcagaaagacgggctagcgaagaggaagaaaataaggcctcagaggaatatattcaacggctcctggcagaggaagaggaagaggagaaaagacaggcagagaagcgcaggcgggcaatggaagagcagcttaagagtgatgaggagttagcgagaaaactatcaattgatatcaacaacttttgtgaaggttctatttcagcatccccattgaactcgcggaagagtgaccccgtgactcccaagtctgagaagaaatctaagaacaagcagcggaacacaggagatattcaaaaatacctcacacccaaatcacagttcggttccgcttcacattccgaggctgtgcaggaggtgcgtaaggacagcgtcagcaaggacatagactccagcgacaggaagtctccaactggtcaggataccgagattgaggacatgcctacgctgtccccgcagattagtctgggggtgggggagcagggggcagattcctcgatagaatctcccatgccatggctctgcgcctgtggggctgagtggtatcacgaaggaaacgtaaagacacgcccatctaaccacggcaaggaactgtgtgtgctgtctcacgagaggcccaaaacaagggttccttacagtaaagagaccgccgtaatgccctgtgggagaacggaatccgggtgcgcccctacatctggggttacacagactaatggaaacaatacaggcgaaacagagaacgaggaatcttgccttttgatatccaaagaaatctctaaacgcaagaaccaagagtcaagttttgaggccgtaaaagacccttgcttttccgccaaaagacgcaaagttagccccgagtccagtcccgaccaagaggagactgaaatcaacttcacccaaaaactgatagaccttgagcacctactgttcgagcgacataagcaggaggagcaggatagattgctcgccctacagctgcaaaaagaggttgataaggagcagatggtgccaaaccgtcaaaagggttcacccgacgagtaccatctgagagccaccagtagccctcccgataaagtgctgaacgggcaaagaaaaaaccccaaggacggtaactttaagcgccagacacacactaagcacccgacccctgagcgaggctctagggacaaaaatcgccaggtctcactaaagatgcagttgaagcagagcgttaatcggcgaaaaatgcccaattctacgagagaccactgcaaagtgtccaaaagcgcccatagtctgcagccttctatttctcaaaaaagtgtgtttcagatgtttcaaagatgtaccaaatag

SEQ ID NO: 239253 - DNA, 1716 bp, Artificial Sequence
  Description of Artificial Sequence: Synthetic coding sequence
atggctctcccgaaagatgccatcccatccctgagcgagtgtcaatgtggtatttgtatggagattcttgtcgagccagtaaccttaccctgtaatcacaccctctgcaaaccatgctttcagtccaccgtcgaaaaggcctcactctgctgccccttctgtcgaaggagagtgagcagctggaccagatatcacaccagacggaactctcttgttaatgtcgagctgtggacaatcatccaaaaacactatcctcgtgagtgcaagctgcgagcaagcggccaggagtccgaagaagtggcagacgattatcagcccgtgcggttgctgagtaagcccggtgaattaaggcgagaatatgaagaggaaatctcaaaagtggccgcagaacgtagggcctcagaggaggaggagaataaagcttccgaggagtatatccagagactactggccgaagaggaagaggaagagaaaaggcaagcagagaagcgaaggcgggcaatggaggagcagctaaagtctgacgaagagctcgccagaaagttatccatcgatatcaacaacttttgtgaggggtccattagtgcatcacccctcaattctcgtaaatcggatccagttactccgaaatccgaaaagaaatcaaaaaataaacagaggaataccggggacatacagaagtatctcacacccaaaagccagttcggctctgccagccactccgaggctgtgcaggaggtgcgaaaggatagtgtgtctaaggacattgacagctccgaccgaaagagtcccaccggccaggacaccgagatcgaggatatgcccaccctttctccacagatcagcctcggggtgggtgagcagggcgcagacagttctattgaatctcctatgccatggctttgtgcatgtggggctgagtggtaccacgaaggaaacgttaaaactagaccttccaaccatggaaaagagctctgcgtgctgtcccacgagcgaccaaagacacgtgtcccgtatagtaaggagactgccgtgatgccctgcggcaggaccgagagtggctgcgctcctacctctggtgtaacccaaactaacggcaataacaccggggaaaccgagaacgaagagtcttgtcttctcatctcgaaggagatttcaaagagaaagaaccaagagtctagcttcgaagccgtgaaagacccatgtttttccgcaaaaaggaggaaagtttctcccgagtcctcccctgaccaggaagagactgaaattaactttactcagaagttgattgacttagaacatctgctatttgagcgtcataagcaggaggaacaagacaggctgctcgccctgcagctgcagaaggaggtcgataaagaacagatggtaccaaacaggcagaagggcagccctgacgaataccacctaagagcgacatcaagcccaccagataaggtgctcaatgggcagagaaaaaatcctaaggacggcaacttcaaaaggcagacgcacaccaagcacccaacgcctgagcgcggatcaagagacaagaataggcaggtgtctctgaagatgcagctcaagcagtcagtgaataggcgaaagatgcccaattccacgagggaccactgcaaggtctctaaatccgctcacagcttacagccctctataagccaaaagtctgtgttccagatgtttcagaggtgtaccaagtag

SEQ ID NO: 239254 - DNA, 4872 bp, Artificial Sequence
  Description of Artificial Sequence: Synthetic coding sequence
atggccgctgaggcatccaaaactggaccatcaaggtcttcctaccagaggatgggaagaaagtcgcaaccctggggagccgctgagattcaatgcacaagatgtggaagaagagtgtcccggagctccggccatcattgcgagttacagtgcggacacgcattctgcgagctatgtcttcttatgacagaagagtgtacaaccataatttgccccgactgtgaggtcgccacagctgtcaatacacggcagaggtactatcccatggccggttatatcaaggaagactctatcatggaaaaactccagcctaagacaattaaaaactgttcgcaggattttaagaaaactgctgaccagctgacaacaggcctcgaaaggagcgcatccacggacaagacacttcttaacagtagcgccgttatgctggacactaataccgcagaggaaatcgatgaggcacttaacactgcccatcacagctttgaacagctatcaattgccggtaaagcactggaacacatgcagaagcagactattgaagagagggagagggttattgaagtggtggagaagcagtttgaccagcttctcgctttttttgattctagaaaaaagaatctgtgcgaggagttcgccagaacgacagacgattacctctcaaatctgattaaggcaaagagttatatcgaggaaaagaagaacaacttaaatgcagcgatgaatattgccagggctcttcagctcagtcctagcctgcgcacatattgcgatttgaaccagattatccgaactttgcagttaacatctgattctgagcttgcccaagtgagcagcccccagctgcgcaaccctccaagactgtccgtgaactgctcagaaattatttgcatgttcaacaacatgggtaaaatagaatttagggatagcactaagtgttaccctcaggagaatgagattcggcaaaatgtccagaagaagtacaacaataaaaaggaattgtcttgttacgatacatatccacccctagagaaaaaaaaagttgatatgtcagtactcacctctgaagcgccacctccccctttgcagcctgagactaacgacgtacatctcgaggccaagaattttcagccccagaaggacgttgccacagcatccccaaaaacaatcgcagttttgcctcaaatgggttcctccccagacgtgataattgaagagattatcgaggataacgtcgagtcgtccgccgaactggtcttcgtctcccacgtgattgacccatgtcacttctatatcaggaagtatagccagataaaagatgcaaaggtgctggagaagaaagttaacgagttttgtaaccgctcttcccatctggatcctagcgacatactcgagttaggggctcgaatcttcgtgagctctatcaaaaacgggatgtggtgccggggaaccatcactgaattgataccaattgaggggagaaacacaaggaagccttgctcccctactcgcctttttgttcacgaagttgccctaattcagatatttatggtcgactttggtaattcagaggtcctaatcgtgacaggggttgtggatacgcatgtccggcctgaacactcagcgaaacaacacattgccctgaatgacctttgtctggtgctgagaaagagcgagccctatactgaaggccttctaaaggatattcagcccctcgctcagccatgcagtctgaaagatatcgtaccccaaaattcaaacgaagggtgggaagaagaggcaaaggtggaattcctgaagatggtaaataataaagccgtgagcatgaaagtctttagggaggaggatggggtcttgatcgtcgacttgcagaagcccccacccaacaagatcagctccgatatgccagtctcactgcgagacgccctggtgtttatggagctcgctaaattcaaaagccagtctctgcggtctcatttcgagaaaaatacaactttgcattaccacccaccaatcctgcccaaggaaatgactgatgtgagcgttacagtgtgtcacatcaattctccgggagacttctaccttcagctaattgagggtcttgatatactatttcttttgaaaacgattgaggagttctacaagagcgaggatggggagaacctcgagattttatgcccagtgcaggaccaggcgtgcgtcgccaagtttgaagatggcatctggtaccgggcaaaagtgattggacttccaggccatcaggaggtcgaggtaaaatatgtggatttcggcaacaccgcaaagataactatcaaagatgtacgaaaaattaaagacgaatttctgaatgcccctgagaaggcaatcaagtgtaaacttgcctatattgagccatacaagagaactatgcagtggtctaaggaggcaaaagagaagtttgaggagaaggcccaggacaaattcatgacttgctcggtcatcaaaattctggaggataacgtgctgctggtcgaactgttcgactccctgggcgctccagaaatgactaccaccagcatcaacgaccagctggtgaaagagggcctggcctcttacgagatcgggtatatcctaaaggacaacagccaaaagcacatcgaagtgtgggacccctcaccggaggagataatttcaaacgaagtgcacaacctgaatccggtgagcgccaaatccctccctaacgagaatttccaatcactttacaacaaagagctgcctgttcatatttgtaacgtgatctcaccagagaaaatttacgttcaatggctgctcacagaaaacctgttgaattcactggaggaaaagatgatagccgcttatgaaaactctaagtgggagcccgtgaagtgggagaacgatatgcactgcgccgtgaagattcaggacaaaaaccaatggcggagaggacagattatcagaatggtgaccgatacattagttgaagtgctgctttacgacgttggcgtggaactggtggttaatgtggattgccttaggaagctggaagaaaatttgaagactatgggcaggttgagcctggaatgcagcctcgtcgacataaggcccgcaggagggagtgacaaatggactgccaccgcctgcgactgcctgtcactatatctgacaggagccgtcgccactattatcttacaggtcgattctgaagaaaataacaccacgtggccattgccagtgaagatcttttgtagagacgaaaagggggaacgcgtagacgttagtaagtatctgattaagaagggcctggccctcagggaacgacgtatcaataatctggataatagccactccttgagtgagaaatctctggaggttccgttggaacaggaagactcagtggtgacgaattgtataaaaacaaacttcgacccagataaaaaaaccgcggatattatctccgaacaaaaagttagcgagtttcaggagaagattctggaaccaaggacaacaagaggatacaagcccccagccatcccgaatatgaacgttttcgaagcgactgtgagttgtgtgggggatgacggcaccatttttgtagtgcctaagttgagcgaattcgagctgataaaaatgactaacgagatccagtctaatcttaaatgtttggggctcctggaaccatatttttggaaaaagggtgaagcgtgcgctgtgcgcggttctgatacactgtggtatcgaggaaaagtaatggaggtggtggggggagctgtgagggtccagtatctggaccacggttttactgagaagattccgcagtgtcacctgtatcctatactactttaccccgacattccccagttctgcataccttgtcagctccataacaccacccccgttggaaacgtctggcaacccgacgctatcgaagtccttcaacagcttttgtctaagagacaggtcgacatccacattatggaactccccaaaaacccctgggagaagctgagcatccatctgtacttcgacggaatgtctctgagttattttatggcatattataaatactgcacgagcgaacacaccgaggaaatgttgaaggaaaagccaagaagcgaccacgataaaaagtatgaggaagagcagtgggaaattcggttcgaggagcttctaagtgccgagaccgatacacccctgctaccaccctacttgtcttcatctcttccgtctccaggggaactgtatgctgtacaggtaaagcatgttgtttccccaaatgaggtctacatctgtcttgattcaattgagacatctaaccagtctaaccagcacagcgacacagacgactcaggcgtgagcggcgaatcagagtccgaaagccttgatgaggcactccagagagtcaacaagaaggtcgaggccttgccccctttgactgactttcgcactgaaatgccctgcctggccgaatatgacgatggcctctggtatagggccaaaattgtggcaatcaaggagttcaatcccctgtccattctggtgcagttcgtcgactacggtagcaccgctaaactcactctcaacagactgtgtcaaatccccagccacctgatgcggtatccagccagagccataaaggtgctgctggctggctttaaaccaccactgcgggacctgggagagactaggattccttactgccctaagtggtctatggaggccctgtgggccatgattgattgtctgcagggaaaacagctctacgctgtgtccatggcccctgcacccgaacagatcgtaacactgtacgatgatgaacagcaccccgtgcatatgccactagtcgaaatgggactggctgataaggacgagtag

SEQ ID NO: 239255 - DNA, 1350 bp, Artificial Sequence
  Description of Artificial Sequence: Synthetic coding sequence
atggctgctgaggcctcaaagacagggcctagcagatcatcataccaaaggatgggaaggaaatctcagccatggggcgcagcagaaattcagtgcacccgctgtggaagacgcgtgtcccgttcatcaggccatcactgcgaattacagtgcggacacgccttctgtgagttgtgcctactgatgaccgaggaatgtacaacaatcatctgccccgactgtgaagtggcgaccgcggtgaatactcgccagagatactaccctatggctggatatattaaagaagatagtataatggagaagcttcagcccaaaaccattaagaactgcagccaggacttcaagaagaccgcagatcaattgacgaccgggttagagcgctctgcaagcacggataagaccctgctaaacagttcggctgttatgttagacacgaacactgctgaggaaatcgatgaagcactgaatactgcccatcactccttcgagcaactctcgattgccggtaaagctctggaacacatgcaaaaacagaccatagaggagcgcgaaagagtgatagaggtggtggagaagcagttcgaccagttgttagcattttttgacagccggaagaagaatctgtgcgaggagtttgctaggaccactgatgactatctctcaaatcttatcaaggcaaagtcttacatagaagagaaaaagaataatttaaatgccgctatgaacattgccagagcccttcagctgtcaccaagtctgagaacttattgcgacctgaaccagatcattcggactctgcagctgaccagtgactcagagctagcgcaagttagctcgccccagctcagaaatccccctcgcttgtccgtgaattgctccgagataatatgcatgtttaataatatgggcaagatagagtttagggactccactaaatgctatcctcaggagaacgagattcgacagaacgtccaaaagaagtacaataacaagaaagagctgtcgtgctacgatacctacccgccactcgaaaaaaagaaagtggatatgtcagtgctgacttccgaggccccaccacctcccctccaaccagagacaaatgatgtgcatttggaggcaaagaattttcagcctcaaaaggacgtggctaccgcatcaccgaagacaattgctgtgctaccccagatggggtccagtcccgatgtcatcatcgaagagatcatcgaggataatgtggagacttgtggcactgatgatctgggcgagactcccagatatcccaaaaagcccctgcagaaaaattctagcgttccttttgggagcaaggcggacactgtcacaactgtctag

SEQ ID NO: 239256 - DNA, 4746 bp, Artificial Sequence
  Description of Artificial Sequence: Synthetic coding sequence
atggccgcagaggcctctaagaccggaccctcacgatctagctaccaacggatggggaggaaaagccaaccctggggcgcagccgaaattcagtgcacccggtgcggccgaagagttagtcgctctagcggtcatcactgcgagctgcagtgcggtcacgcattctgcgagttatgcttgctgatgactgaggaatgtactaccattatttgcccagactgcgaggtggcaaccgcagttaacactagacaacgctactatcccatggctgggtacatcaaagaagattctataatggagaagctgcagcctaagaccatcaagaattgtagtcaggattttaaaaagaccgccgaccagctgacgactggactggaaagatccgcatccacagataaaacacttctcaactcttccgccgttatgcttgacacgaatacagcagaagaaattgatgaagcgcttaacaccgcacatcactccttcgagcagttaagcattgctggcaaagccctcgaacacatgcagaagcagaccatcgaagaacgagaacgggttattgaggtggttgaaaagcagtttgaccagttgctggcattcttcgactctagaaaaaaaaacctttgcgaggagtttgcccgtactacggatgattacctctcaaacctcattaaggctaaatcctacatagaggaaaaaaaaaataacctcaacgccgctatgaatattgcaagagccctccagctttcccccagccttagaacttactgcgacttaaaccagatcataagaacactccagctgacctccgactctgagcttgcccaggtttcatccccacagcttcgaaaccctccacgtctctcagtgaattgtagtgagatcatctgtatgtttaataacatgggcaagattgaattcagagactcaaccaagtgctacccccaggagaacgaaattagacagaacgttcagaagaaatacaacaacaaaaaagagttgtcatgttacgacacatatcccccactcgaaaagaagaaggttgatatgtccgtgctcaccagcgaggccccaccacccccactgcagcccgagactaacgacgttcatctcgaggcaaaaaactttcagccccaaaaggatgtcgccacagcctcaccaaaaacgattgccgtacttccccagatgggaagctcacccgacgtaattattgaagagatcatagaggacaatgtggagtcctccgcagagctcgtatttgtgagccacgtgatcgatccttgtcacttctacatcagaaagtacagccagattaaagatgccaaagtcctggagaagaaggtgaatgagttctgcaatcggtcttcgcatctagaccccagtgatatcctcgagctgggtgccaggattttcgtgtccagcataaagaacggtatgtggtgccggggtactattacagagcttattccaatcgagggacgcaatactcggaagccctgtagccctacaaggctatttgtgcacgaggtcgctctgatccagatctttatggtcgatttcggtaattccgaggtgctgatcgttacgggtgtagtcgacacccacgtgaggccggagcactctgccaagcaacacatcgctttaaacgatctttgcctcgtactcagaaagtccgaaccctataccgagggattactgaaggacatccagccactggctcagccctgtagtctgaaggatattgtacctcaaaatagcaacgagggctgggaagaagaagcaaaagtggagttcttgaaaatggtcaacaacaaggccgtctcaatgaaagtctttcgcgaagaggatggggtgttgatcgtggacctgcagaagccgccacctaacaagatctcatccgatatgcctgtgtcactacgagacgcactggtctttatggagctcgccaaattcaaatcccagagtctccgtagtcacttcgagaaaaacacaacactacactatcacccacccatcttgccaaaagaaatgaccgacgtgtccgtgaccgtctgccacatcaatagtcctggcgatttttaccttcagctgattgaaggccttgatattttgttcttgctgaagactatagaggaattttacaaatccgaagatggcgagaaccttgaaattctgtgcccggtgcaggatcaggcctgcgtggccaagtttgaggatggcatctggtacagagctaaagtgatagggttgcccggacaccaagaggtcgaggtaaagtatgtagactttggaaacactgcaaagattacaatcaaagatgtgaggaagatcaaggacgaattccttaatgccccagagaaggcgataaagtgcaaacttgcatacatagaaccctacaaacgcaccatgcagtggagcaaagaagctaaggagaagtttgaggaaaaagcccaagataaattcatgacctgctccgtgatcaaaatactcgaagacaatgttctgctcgtcgaattgttcgacagtctcggggcaccggagatgacgaccaccagcatcaacgatcaactcgtcaaggaaggcctggcttcctatgagataggctacatcctgaaggacaatagccaaaagcatatcgaggtatgggatccctctcctgaggaaatcatatcaaacgaggtccacaaccttaaccctgtgtccgctaagtcactccctaacgagaattttcagagcctgtacaataaagagctgcctgttcacatctgcaacgtgattagtccagaaaagatatatgtgcagtggttactgaccgaaaacctgcttaactctctggaggaaaagatgattgcagcttatgaaaactccaagtgggaacctgtgaagtgggaaaatgacatgcattgtgccgtcaagatccaggacaaaaatcagtggcggagaggtcaaattattcggatggtaacagacacccttgtggaggtgctgttgtacgatgtcggcgtagagctggtcgtcaacgtggactgtcttagaaaattagaggaaaacttgaaaaccatgggcagactctcgctggagtgttcattggtggacatccggcctgcaggcggttctgacaagtggactgctactgcctgtgattgtctgagcctttacttgaccggcgcagtcgcaaccattatactacaggtggattctgaagaaaataacacaacatggccactcccagttaagatcttctgccgtgacgagaagggtgagagagtggatgtgagcaagtacctgatcaagaaaggcttggcgctcagagagcggaggatcaataaccttgacaatagccattccctgtccgagaaatccctggaggtgccgctggaacaggaggacagcgttgtgaccaattgcataaagactaacttcgaccccgataagaaaaccgccgatatcatcagcgagcagaaggtgagtgaattccaggagaagattctcgaaccccgaacaacccgcggttataagccccctgctatccctaacatgaatgtgttcgaggcaacagtttcttgtgtgggtgacgatggcacaatctttgtggttcccaaattgtctgagtttgagctgattaaaatgaccaacgagatacagagtaacctaaagtgcctgggactgctcgaaccgtacttttggaaaaaaggagaagcgtgcgctgtgagaggctccgataccttgtggtatcgtggcaaagttatggaggtcgtgggaggcgcagtgagagtgcagtacctcgatcacggctttaccgaaaagataccacagtgccatttataccctattcttctctaccctgatattccacagttttgcattccatgccaactgcacaacacaacccctgttgggaatgtttggcagcccgacgccatagaggtcctccaacaactactatctaaacggcaggtggatatccacattatgaagcccagatccgaccacgacaagaaatatgaagaggaacaatgggaaatccgctttgaggagctactgtccgctgaaaccgatacccccctgctccctccttatctgtcaagttctctgccatctcctggcgagctttatgccgtgcaagtcaagcacgtggtgtcacctaacgaagtgtatatttgtctcgattctattgaaacttcaaaccaatccaaccagcactctgacactgacgattcaggggtaagcggtgagagcgaaagtgagagcctcgacgaggccctgcaacgggtgaataagaaagttgaggcactgccacccctgacagacttccggacagaaatgccctgtctggccgaatacgatgatggcctttggtatagagccaaaatcgtggctataaaggagttcaatccactgagtatactcgttcagtttgtggattacgggtcaacggcaaaactaactcttaaccggctttgccaaatcccttcgcatttaatgcggtatccggctagagccatcaaggtgctgttggctggctttaaacccccattaagagacctgggtgagacgcgtataccctattgtcctaagtggtccatggaggctctctgggcaatgattgactgcctgcagggcaagcagctctacgccgtgtcaatggcaccagctcccgagcagattgtcaccctctatgacgacgagcagcatcccgtgcacatgcctctggttgaaatggggctcgccgataaggatgaatag

SEQ ID NO: 239257 - DNA, 3207 bp, Artificial Sequence
  Description of Artificial Sequence: Synthetic coding sequence
atgttagacactaacacagccgaggagatagacgaggccctgaacactgctcatcattccttcgagcagctaagcatagccggaaaggccctcgaacacatgcaaaaacaaactatagaggagagagaacgggttatcgaagtggtggagaagcagtttgaccagttgctggcctttttcgactcccggaaaaaaaacctctgcgaggaatttgccagaacaaccgatgactatctgagcaaccttataaaagccaagagctacattgaggaaaaaaagaataacctcaacgcggcaatgaatattgcacgggctcttcagctttcaccatccctaagaacctactgtgatctgaaccaaataatacgaacactccaattaacctccgatagtgagttggcgcaagtgtcatccccccaactgcgcaacccccctcgtctgtctgtaaattgcagcgagatcatctgcatgttcaataatatgggcaagattgaatttagagattcgacgaaatgctaccctcaggagaatgaaattcgccagaacgtgcagaagaaatacaataataaaaaagagctaagttgttatgatacctatccacccctggagaagaaaaaagtggatatgtcggtgctgaccagcgaggccccaccacccccactgcagccagagaccaacgatgtccacctagaggccaaaaatttccagcctcagaaagacgtcgcaacagcatcccctaagaccatagcggtcttgccacagatgggcagctcccccgacgtgatcatagaagaaataattgaagacaatgtagaaagcagcgctgagctggtctttgtatctcatgttattgacccctgtcacttttacatccgaaaatatagccagatcaaggatgctaaggttctggagaagaaggttaacgaattttgtaatcgatcttctcacctcgatcccagtgatattttggagctgggtgctcgcattttcgtgagttcaatcaagaatggaatgtggtgcaggggcaccataaccgagctaatacccatcgagggtaggaatactcgaaagccatgtagtcccacgcgccttttcgttcatgaggtggctctgatccagattttcatggtggatttcggcaacagtgaagtgctgattgtcaccggggttgtggacacacatgtgaggcctgagcactccgccaagcagcatattgcccttaacgatctgtgtcttgtacttcggaagtccgagccttatacagagggcctcctgaaagatattcaaccgttggcgcagccttgcagtctgaaagacattgtgccccagaattcgaacgaggggtgggaggaagaagccaaggtcgaatttctgaaaatggtcaataacaaagccgtgtccatgaaggtttttcgagaggaggatggagtgctcattgtggacttgcagaagccaccacccaacaaaatctcctctgacatgcccgtgtcgttgagggatgctctggtgtttatggagttggccaagttcaaaagccaatccctacgttcacactttgagaagaataccactttgcattatcatcccccaattctgcctaaagagatgacagatgtgagcgtgaccgtctgtcatattaactcgcccggtgatttctacctgcaactaattgaggggctggacatcctgttcctgttgaagactattgaggagttctataagagcgaggatggggagaacctggagatcttgtgtcctgttcaggatcaggcctgtgtcgctaaattcgaagacggaatctggtatcgagccaaggttatcggcctgccagggcaccaagaagtggaagtgaagtacgtcgactttggcaatacagctaagatcaccatcaaggacgtgcggaaaattaaagatgagttcttgaacgctccagaaaaagccatcaagtgcaagctggcttacattgaaccatataaacggaccatgcaatggtctaaggaagccaaggagaagtttgaagaaaaggctcaggacaaattcatgacctgttcagtgattaaaattctggaggataatgtgctcctggtggaactttttgacagtctgggcgcacccgaaatgacgaccacttccatcaacgatcagctagtcaaagaaggccttgctagctatgaaataggatatatcctgaaagataacagccaaaagcacattgaggtatgggacccatcacctgaagaaatcatttctaacgaggtccataatttaaatcccgtctcagccaaatcactgccaaacgagaatttccagagtctgtataacaaagaactcccagtgcacatctgtaacgttatctctcccgaaaaaatctatgttcagtggctgcttaccgaaaacttgcttaattcattagaggaaaaaatgatcgcggcttacgaaaactcgaaatgggagcccgtgaagtgggagaatgatatgcattgtgcagtgaaaattcaggacaaaaatcagtggcggagagggcagataatccgcatggtaacggatacactggtggaggtgctgctgtacgatgtgggcgtcgagctggtggtgaacgtggattgcttgaggaagttggaggaaaacctcaaaaccatggggcgtttgtctttggaatgctctctggtagatatccgcccagccggaggatctgataaatggaccgccacagcatgcgactgtctctctctgtacctgactggagcagtggccacaataatcctgcaggtcgactccgaagagaacaatacaacttggcctctccctgtgaagatcttttgcagggacgagaagggcgaacgtgtagacgtatctaaatacctgatcaaaaaagggttagctctccgcgagaggagaatcaataacctggacaattcccattctctctccgagaagagtctcgaggtccccctcgagcaggaggactctgtggtaaccaactgtataaagacaaatttcgaccccgacaaaaagacagctgacattattagtgagcagaaggtgtcagagtttcaagaaaaaattttagagcccaggaccacgcggggatataagcccccagccatcccaaacatgaatgtgttcgaggctacggtgtcctgcgttggtgacgatgggacgatcttcgttgtgcctaaactgtccgagtttgagttgataaaatag

SEQ ID NO: 239258 - DNA, 462 bp, Artificial Sequence
  Description of Artificial Sequence: Synthetic coding sequence
atggcttcatactttgatgagcacgattgtgagccatcggacccggaacaggaaacccggaccaacatgttgttagagctggcccgaagcctctttaatagaatggacttcgaagatttgggcctcgtggtggactgggatcatcatctgcccccaccagccgctaagactgtcgtcgaaaatctgcccaggaccgtaatccggggatcccaggccgagctgaaatgtcccgtctgcctgttagagttcgaagaagaggagactgctatagaaatgccctgtcatcatctctttcatagttcttgtatcctcccctggctttcaaaaaccaactcttgccccttgtgtcgttacgagctgccgactgacgacgatacctacgaggaacaccgtcgggacaaagcccgtaaacaacaacagcagcaccggctggagaatctccacggcgctatgtatacatag

SEQ ID NO: 239259 - DNA, 684 bp, Artificial Sequence
  Description of Artificial Sequence: Synthetic coding sequence
atggcatgtaccaaaactctgcaacagtctcagcccatatccgcaggggcaaccaccactactactgctgtcgctccggcaggaggccactcagggagcactgaatgcgacctcgagtgcctggtgtgccgagaaccatattcttgtcctaggctccccaaactgctcgcatgccagcacgctttctgcgccatctgcctgaagctgttgctgtgtgttcaggacaacacctggtccatcacatgccccctctgtcgtaaggtgaccgctgtaccgggaggcttaatctgctccctgcgagaccatgaggccgtcgtggggcagctggctcagccttgcacagaggtgagtctctgtcctcaaggcctggtggaccccgctgatcttgcagccggtcatccgtctctggtgggggaggatggacaggatgaagtgtctgcgaatcacgttgctgcacggaggcttgctgcacatcttctcttgctggcactcttgatcatactgatcggaccctttatctaccccggtgtactgcgatgggttctcacatttatcattgccctggcgttattaatgtccaccctgttttgttgtctcccttccacccggggatcatgttggcccagtagtcggaccttgttctgcagagagcagaagcatagccatatttcctccatcgcttag

SEQ ID NO: 239260 - DNA, 795 bp, Artificial Sequence
  Description of Artificial Sequence: Synthetic coding sequence
atgagtcaggctgtgcagactaatggcacacaaccactgtctaaaacctgggaactgagcctttatgagttgcaacgcaccccccaggaagctatcaccgacggtttagagattgtcgtgagtcctaggtccctccacagcgaactcatgtgcccaatctgcctcgacatgctcaagaatactatgacgaccaaggaatgtttacacagattttgcgctgattgcatcatcaccgctttgcgctctggcttgcagcgagggaaaaaacagcaaatagaaaacggatccggagcagaagacaatggtgattcctcccactgcagcaatgccagtacacacagcaatcaggaggctggccctagcaataaaaggacaaagacatctgatgactctgggctcgagctcgataacaacaatgccgcaatggccattgacccggtgatggatggggcatcagagatcgaattggtctttcggcctcatcctactctgatggaaaaggatgactcggcacagacacgctacattaagacaagcggaaacgcaacggtggatcatctttcaaaatacctcgccgtgaggctagccctggaggagctgaggagcaagggggaatcaaatcagatgaatctcgacaccgctagcgaaaaacaatacaccatttatatcgctaccgcaagcgggcagtttaccgtgcttaacgggtccttctctcttgaactggtttctgagaagtattggaaggttaataagcccatggaactgtattatgccccaaccaaagaacacaaatag

SEQ ID NO: 239261 - DNA, 1011 bp, Artificial Sequence
  Description of Artificial Sequence: Synthetic coding sequence
atgagtcaggccgtccaaacaaatggcacacaacccctgtctaaaacgtgggaactctccttgtatgagttgcagaggacaccgcaagaagcaatcacagacggtctggagatcgtcgtgtcacctagaagcttacacagcgaattaatgtgtccgatttgcctggatatgctgaaaaatactatgacaacaaaggagtgcctgcacaggttctgcgctgattgtattataacggcacttcgaagcggaaataaggaatgcccaacctgccgcaagaagcttgtctccaagaggagtttgcgccctgaccccaactttgacgcccttatcagcaaaatatacccaagccgcgatgagtacgaggcccatcaggagcgtgtattggcaagaattaacaaacataacaatcagcaggcgctctcccactccatcgaggagggtcttaagattcaggccatgaaccgattgcagaggggaaagaaacaacaaatcgaaaatggtagcggcgcagaggataacggagatagctctcactgtagcaatgcatctactcacagtaatcaggaggcaggacctagcaataagaggacaaagaccagtgatgattccggacttgaactagacaataataatgctgcgatggccatcgatcccgtgatggacggcgcatccgaaatcgaactcgtgtttcgcccacaccccactctcatggaaaaagatgacagtgcccagactcgatatatcaagacatctggcaatgctactgtcgaccacctgtctaaatatctggctgtacgattagccctcgaagagttgagaagcaagggcgagtctaatcagatgaacctggatacagcctccgagaaacaatatacaatctacatcgccaccgcaagcggccagttcacagtgttaaatggatcttttagcctggagctggtcagcgaaaaatattggaaggtcaacaagcctatggagttgtattatgctccaaccaaagaacacaagtag

SEQ ID NO: 239262 - DNA, 741 bp, Artificial Sequence
  Description of Artificial Sequence: Synthetic coding sequence
atgagtcaagcagtccagactaacggcacacagcctctgtcgaaaacgtgggagttatcactgtatgagctgcagcggactccccaggaagcgatcacagatggcctggaaattgtagtgagccctagaagtctgcactccgagctgatgtgccctatctgtctggacatgttgaagaacacgatgacaactaaggaatgcctccatagattctgcgctgactgcattataacagctctccgctcagggaataaggagtgccccacctgcaggaaaaagttggtgtctaagcgctctctaaggcccgatcctaacttcgacgctctgatttcaaagatctatccaagtagggacgaatatgaggcccaccaagaacgcgtgttggctaggataaacaagcataacaaccaacaagctctgtcacattcgatcgaggaaggccttaagatacaggcaatgaaccgactgcagcgcggaaagaagcagcaaatcgagaatggctctggtgctgaggataacggagacagtagtcattgctcgaatgcttccacccattccaatcaagaggccggaccctcaaataagcgcacaaagacctcggacgacagcggcctggagctcgataacaataacgctgccatggccatcgacccagttatggatggggcaagtgaaattgaacttgtcttccggcctcatccgacactgatggagaaagacgattctgcgcaaacacgctag

SEQ ID NO: 239263 - DNA, 822 bp, Artificial Sequence
  Description of Artificial Sequence: Synthetic coding sequence
atggcaaattgggtcttttgtaaccgctgctttcaaccccctcatcgcacatcatgctttagtctgacgaactgtggccacgtgtattgcgatgcttgtctggggaaggggaaaaaaaacgagtgcctcatatgcaaagcgccatgcagaaccgtcttactaagcaagcacaccgatgccgacattcaggccttttttatgtccatagattccctgtgcaagaaatattcaagagagacatcacaatacctgcgcctctctagaggctgttgtaggttgaaactttgccccgctacatcttccaaggaggtgcccagaggaagcacccacggctcgcaggccgcagctcgggatccgcaagaacattgggtttcgaccaccagagctccgcgaccagggtgccgacggagtcagtcccaacccgaggcccagggaaatacaatccaagacgcccctcaccctttgacactgctgcacccctctcggacgctgattcatacaaaatccccgtggggccaaaagctgctggagtttataaagcatgtgtgctaccaccgacatcagtctcatagaccatgcgcaccaggttggttttgtcaggttcttcagaggcctggcgcagtgtcgggcgagaagacccagcagacgcggccagccccaccagccacgtgtttgctttgtctgtcctgtctgtcagggttccggcacggcccttggcgcagtcaggcacttccttcagatctcgttgctccactattcgtttcatatacagtcgaggtgtccattactaatgcaggctggagctttccggctgccgtgtag

SEQ ID NO: 239264 - DNA, 699 bp, Artificial Sequence
  Description of Artificial Sequence: Synthetic coding sequence
atggcaaattgggtgttctgcaaccgctgcttccagcctccgcaccgtacttcgtgtttctctctaacgaattgcggccacgtgtattgcgatgcttgcctcgggaaaggaaaaaagaacgagtgcctgatatgtaaggccccttgcagaacagtactactttccaagcatacggatgcagacattcaggctttctttatgagtatcgacagtttgtgtaagaagtattcaagagagacttcacagatcttggagtttcaagaaaagcaccgtaagcggctcctcgctttctaccgtgaaaaaatcagtaggcttgaagagagtctgcgcaaatctgtgttgcagatcgagcaactgcagagtatgcgaagcagtcagcagacagcattctctacaatcaagtcttccgtgagtacgaaaccccacggctgcctgctgccaccccacagttcggcccctgatcggttagagtccatggaggtggacctgagcccaagtccaattcgcaagagcgagatagcagctgggcctgcacgcatctcaatgatctcccccccacaggatgggcgaatggctccttgcgcaaggagagtttgtcatttccagaggttcacaatgtttctgcatcggagactgtccagcctggccgctcctccgtccgtgcagttttggaaagctcgcggaacgcatcagctctag

SEQ ID NO: 239265 - DNA, 894 bp, Artificial Sequence
  Description of Artificial Sequence: Synthetic coding sequence
atggcaaattgggtattttgtaataggtgttttcagcctccccacaggacttcctgctttagcctaacaaattgtggtcatgtatattgtgatgcatgtctgggcaagggtaagaagaatgagtgcctcatctgcaaggcgccttgccggacagtcttgctgagcaaacacacagatgctgacattcaggccttcttcatgtcaatcgactcattgtgcaaaaagtacagccgtgagacatcccagatccttgagtttcaggagaagcaccgaaagaggctgctggccttttaccgtgagaagatatctagacttgaagagtctctacgcaagtctgtgctgcagatagaacagttgcagagcatgaggagcagtcagcagacagcctttagcacgattaaatcttccgtttcgaccaagccccacgggtgtctactccctccccacagctctgcgccagatcgccttgagtccatggaggtcgatctgagcccatccccgatccggaagtcagaaatcgccgctggaccagctaggatcagtatgattagcccaccacaggacggtaggatgggtcctcacctgaccgcctccttttgctttatcccatggctcactctttcaaaaccgccagtgcctggggagtgtgttatcagccgcggtagcccctgcttttgtatcgatgtgtgccctcattggctcctgctgctggccttttcctctggcagacacggcgagctgactaatagtaagacgctacctatctacgcagaggttcagagagctgtgttattcccatttcagcaggctgaaggtaccctggacacatttaggaccccagccgtttctgtagttttcccactgtgccagttcgagcggaagaaatcattctag

SEQ ID NO: 239266 - DNA, 3192 bp, Artificial Sequence
  Description of Artificial Sequence: Synthetic coding sequence
atggaatgcccaagctgccaacacgtttcaaaggaggagaccccgaagttttgctctcaatgcggtgagcgactgcccccagctgcacccatagcggatagtgaaaataacaacagcacgatggcttccgcgagcgagggagagatggaatgcggccaggagctgaaggaggagggcggaccttgcctatttccagggtcagacagttggcaggaaaaccctgaggagccttgcagcaaagccagctggacggtgcaggagtcaaagaagaaaaaaaggaagaagaaaaaaaagggtaacaagtctgcaagctcggagctcgccagtctcccgctgagtccggctagcccatgtcaccttaccttgctatccaatccttggccccaggacactgctctgccacattcccaagcccagcagagcgggccaacagggcagcctagccaacctccaggcacagcaacgacaccactcgagggcgatggcctttctgctccgaccgaagtcggtgatagtccactgcaagcccaggccctgggggaagccggagttgcaacgggaagtgaggctcagtcatcccctcagtttcaagatcatactgagggggaggaccaggatgcctcaatcccttccgggggacgagggctatcccaagaaggtactggtccccctacctccgcgggtgaagggcacagccgcactgaggacgctgctcaggaacttttattacctgaatccaagggaggctccagcgagcccggtacggagctccagaccaccgagcaacaagctggagcttctgcaagcatggccgtagatgccgttgccgagcctgccaatgccgtgaaaggcgcaggtaaagaaatgaaagagaagacccagcgaatgaagcagccccctgcaacaactcctcctttcaaaacacattgtcaagaggctgagacaaagaccaaggatgagatggcagcagccgaggaaaaagtggggaagaacgaacagggagagcctgaggacctgaagaagcccgaagggaagaatcggtccgccgctgcagtcaagaacgagaaagaacagaaaaatcaggaggctgatgtgcaggaagtgaaagcctcgaccttaagtcctggcggtggtgtgactgtcttttttcacgctatcatcagtctgcactttccattcaatccagaccttcacaaggttttcattaggggtggcgaggaattcggagagagcaagtgggactcgaatatttgcgagctgcactatacccgggatctgggacatgatcgggtactggttgagggaattgtgtgcatcagcaaaaagcacctggacaagtacattccctataaatatgtgatctataatggagaatcattcgaatacgagttcatttataagcatcaacaaaagaagggcgagtatgttaatcgctgtctgttcattaaaagctctttgcttggttccggtgactggcatcagtactacgatatagtttacatgaaaccccatggcaggctccagaaagtgatgaaccatattacggacgggcctcgcaaggatctcgtcaagggcaaacagatagcagccgcactcatgctggactccacatttagcatccttcagacatgggacaccattaacctgaacagtttctttactcagttcgagcaattctgctttgttctccagcaacctatgatctatgaaggacaggcccaactatggacagatcttcagtaccgggaaaaagaggtgaagcgctacctttggcagcacttaaagaagcacgttgtcccactgcccgatggaaaaagcaccgactttctccctgtggactgccccgtacgctccaaactgaaaaccggtctcattgtcttgttcgtggtggagaaaatcgagctgcttctggagggatcattggactggttgtgccacctgctgacgtcagacgcctcgagcccagacgaattccatagggatctctcacatatcctggggataccacaatcgtggcgcctttatctggtgaatttatgccagaggtgcatggacaccaggacctacacatggctgggtgccttgcccgtcctgcattgctgcatggaattggccccaagacacaaggatgcatggcgccagcccgaggatacatgggcggcactagagggactttccttttccccattccgtgaacaaatgttggatacatctagtctcctccaattcatgagggagaagcagcatcttctgtcgatagatgagcccttgttcagaagctggttctctcttttgcctctgtctcatctcgtcatgtacatggagaactttatcgagcatctgggcaggttccccgctcatatccttgactgcctcagcggaatttactatcgcttgcccggactggagcaggtgctcaatacccaggatgttcaagacgtccaaaacgtacagaatatattggagatgttgctcaggctgctggatacctatagagataagattcctgaagaggccctctcaccatcttaccttaccgtgtgtctcaaattacacgaggctatttgtagcagtacaaagcttctgaagttctatgagctgcccgctctgtctgcagagatcgtgtgtaggatgatccgactcttgtcccttgtggattccgcagggcaacgcgacgaaacaggaaacaatagcgtgcagacagtgttccaaggcacactggccgcaactaagaggtggctgcgagaggtttttaccaaaaatatgctaaccagctcaggtgcaagttttacctatgtaaaagagatcgaagtgtggcgcagactcgtcgagatccagtttccagcagagcacggctggaaagagtctctcctgggcgacatggagtggcggctgacaaaagaggagcctctttcacagataactgcctactgcaactcatgttgggatacaaaaggcctggaagattccgtagctaagacattcgaaaagtgtattattgaggcagtctcttctgcttgtcaagtcaacaacctgtcatcttgggaaaccgacagcggctcacagctatgttcggcaatgacccagctgagagctatgaagcacccgctgggcctgagttcatccgcaaactcagaaatagggaagtgggctccatcttccctggccaagggtaacggggctgagatctag

SEQ ID NO: 239267 - DNA, 9842 bp, Artificial Sequence
  Description of Artificial Sequence: Synthetic coding sequence
atggtgtgcgacggtgattgggagcattgctacctcccttctgccttttctcagcacaaagtttttgtaacaccgcaggccccattggaggccatccaggcctaccttgctggtcactatcgagtgccaaaacagacactatccgcggcagccgtatttaatgaccgcctttgcgtaggcattgtggccagcgagcgcgcaggcgttggcaaaagtctgtacgtgaaaagactgcacgataagatgaagatgcaactgaacgtgaaaaacgtgcctttaaagaccattaggctgatagatccccaggtcgatgagagccgcgtcctgggcgcattgttacctttcctggacgcacaatatcagaaggtacccgtcctgtttcatctcgacgtaaccagtagcgtgcaaactggcatctgggtttttctgttcaaactccttatcctccaatatctgatggatataaatggaaaaatgtggctgaggaacccttgtcacttatatatcgtcgaaatactggagcgcaggaccagcgtcccgtctcgtagcagctctgccttacgaacccgagtcccacaattttcattcttggacatcttccctaaagtgacatgccgtccgccaaaggaggtgatcgacatggagctctctgctcttcggagtgacactgaaccaggcatggatctctgggaattctgttcagagacatttcagagaccatatcagtacttgagaaggttcaatcagaaccaggacctggacacgttccagtaccaggagggcagtgtagaggggacacctgaagagtgcctgcaacattttctgtttcattgtggggtgataaatccaagctggtccgaactgcgaaattttgctaggttcctgaactaccaacttagggactgtgaggcctctcttttttgtaatccatccttcattggggacaccctccgcggatttaagaagttcgtggtcacctttatgatcttcatggccagggattttgctacaccatccctgcacacaagcgaccagagtcctgggaaacatatggtcactatggatggggtgagggaggaggacctcgcccctttctcccttcgcaagagatgggagtctgaaccacacccatacgtgttttttaatgacgaccacactaccatgaccttcatcgggttccaccttcagcccaacatcaacgggagcgtagacgctatctctcaccttacaggcaaggtcattaagcgagacgtcatgactcgggatctgtatcagggtttacttttgcagagagtgccctttaatgttgattttgacaaacttccgcgacataaaaaattggagagactgtgtctcacgctgggtatcccgcaggccaccgatcccgataaaacgtacgagctgactactgacaacatgttgaagatcctcgccatcgaaatgcgcttcaggtgtggaattcctgtgatcattatgggcgagactgggtgtggaaaaacacggctcatcaaattcctgagcgatttgagaaggggaggcaccaacgcagacaccattaaacttgtgaaggttcatgggggaaccacggcagatatgatctactcacgagtaagagaggccgaaaatgtggctttcgccaataaggatcagcatcaactggataccattctgttctttgacgaagctaacacaaccgaagctattagttgcattaaggaggtcctctgtgaccatatggtagatggacagccactggccgaggattccggcctccacataattgctgcatgtaatccataccgcaagcactctgaggaaatgatttgcaggcttgagtctgctggcctcgggtaccgtgtctctatggaggagactgcagaccgcttaggtagtattcctttgcgccaactggtgtatagggtgcatgccttgccaccgagcctgatccccctggtgtgggactttgggcagttgtccgatgttgccgagaagctttatatacaacaaattgtgcagcggctcgtggaaagcatctctttggacgagaatgggactagagttatcaccgaagtgctctgtgcaagtcagggctttatgcgtaagaccgaagacgaatgttccttcgtcagcctgagagatgtagaacgatgtgtaaaggtcttccggtggttccacgagcattctgctatgctgctggcccagcttaacgctttcttatcaaaatcaagcgtgtccaaaaaccatactgaacgcgaccctgtcctgtggagtctgatgcttgctatcggcgtgtgctaccacgctagtttggagaagaaagactcttatcgaaaagcaatcgcaaggtttttcccaaaaccgtatgacgattcaagactgctacttgacgaaatcaccagagcccaggacctgtttctggacggagtgccactccgcaaaacgatcgcaaaaaatctggcactgaaggagaacgtgttcatgatggtggtatgcatcgaactgaagatcccactgttcctcgtcggaaaacctggttctagcaaatcactggccaagaccatcgttgccgacgcgatgcagggccctgccgcatattccgatctcttcaggagcctgaaacaggttcatcttgtatcatttcagtgtagcccacattcaaccccacagggaatcatctcgaccttccggcaatgcgcccgtttccagcagggcaaggaccttcagcagtacgtcagcgtggtggtgttagacgaggtgggtcttgccgaagacagtccaaagatgcctctgaagactcttcatccactcctggaggatggctgcattgaggacgatcctgctccgcataagaaggtgggctttgtgggaattagcaattgggcactcgatccagccaagatgaacagaggtatctttgtgtcgaggggttcccccaatgaaaccgagcttatcgagtcagctaaagggatctgtagctctgacatcttagtacaggacagggtgcagggatatttcgcttcctttgccaaagcttacgaaacagtttgtaagcgccaagacaaggaattctttggcttaagagactactattctctcattaaaatggtgttcgctgcagcaaaagcctctaaccgaaaaccgtccccccaggatatcgctcaggccgtgcttcgcaatttttctggcaaagacgatatccaggccctggacatattcctggctaatctgcctgaggctaaatgctccgaggaagtctcacccatgcaacttattaagcagaacatctttggcccaagccagaaagtgccagggggagagcaggaggacgccgaaagtcggtaccttcttgtgctgacaaagaattacgtcgccctgcagattttgcagcagaccttcttcgaaggcgaccagcagcccgagatcatctttggcagcggctttcctaaggatcaagagtatacacagctctgccgtaacattaatagggtgaaaatctgcatggagacggggaagatggtgcttctgctcaatctccagaacctgtacgagagtctatacgacgcgctgaaccagtactacgtccatctgggtggacaaaagtacgtagacctgggcttgggcactcaccgtgtgaagtgcagggtgcatcctaactttaggcttattgtcatcgaggagaaggacgtcgtgtacaagcacttcccaattcccctcattaaccgcctggaaaagcattaccttgacataaatacagttcttgagaagtggcagaaatcgattgtggaagaactctgcgcctgggtagaaaagttcatcaacgttaaggcccatcacttccagaagaggcacaagtactcaccttccgatgttttcatcggataccactccgacgcctgcgcctctgtggtcctgcaggtgatagagcggcaaggcccacgggctctaacggaggaattgcaccagaaagtgagtgaggaggccaaatcaattctgctaaattgtgccacacctgacgccgttgtccgcctctctgcctattcgctcggcggatttgctgcagagtggctctcccaggagtatttccatcggcagcggcacaattcatttgctgactttctacaggcacatctgcacactgcggacctcgaacgacacgccatttttaccgagattacaaccttttctagactgctgacatcgcacgactgtgaaatcttggagagcgaagtcaccggccgtgcccctaagcctacactcctatggctgcaacaatttgacactgaatacagctttctgaaggaagtccggaattgcctaacgaacacagcgaaatgcaaaattctgatcttccagactgactttgaagacggcatcaggtctgcacagctgatcgcatctgctaaatattctgtgattaatgagattaacaagatccgggaaaatgaggacagaatttttgtatactttattactaagctttcccgagtcggtagaggaactgcgtacgtgggatttcacggaggtctctggcagtccgttcacatagatgacctgagacggtccactctgatggtgagtgatgtgacgcggttgcagcatgtgacaatttcacagctttttgctcctggggacctccccgagctgggactggagcaccgagcagaggatgggcacgaagaggccatggagaccgaggcctcaaccagtggcgaggtcgcagaggtggctgaggaagccatggaaacagaaagcagcgaaaaggtaggtaaagagacctctgaattaggtggaagcgatgtttctatcttagacaccacacggctgctccgctcttgtgtccagtctgccgtggggatgttgagggaccagaatgagtcctgcacccgcaacatgcgcagagtcgtcctcttacttggcttgctcaatgaggacgacgcttgccacgcctcattccttcgggtgagcaaaatgcgtttgtctgtcttcctgaaaaaacaggaggagtcccaatttcatcccttggagtggctggcacgcgaggcctgcaatcaggatgctttgcaagaggccggtacctttcggcacacactttggaagcgagtgcagggggcagttacaccactgttggctagtatgatcagcttcatagatcgggacggtaatcttgagttactaactcgccctgacactcctccatgggcccgtgatctctggatgtttatcttctccgataccatgctgttaaatatcccccttgttatgaataacgagaggcataagggcgagatggcgtacatcgtggtgcagaatcatatgaacctctcagagaacgcaagcaacaatgtacctttttcttggaaaattaaagattatctggaggaattgtgggtgcaggcacagtatatcactgacgcggaaggtctcccaaagaagttcgtggacatttttcaacagactcccctaggacggtttcttgctcagttacatggcgagccccagcaggagctcctgcaatgctacctgaaggatttcatccttctgacaatgagggtgtcaacggaagaggagctaaaattcctccaaatggccctttggtcatgtacacggaaacttaaagcagctagtgaagcgccagaagaggaggtcagcctcccttgggtccatctcgcttatcaaagattcagatctcggctgcagaactttagtcgtattctcacaatttatccacaggtgctacatagtctgatggaagcgaggtggaatcacgagttggcgggatgcgagatgaccctggatgcatttgcagctatggcttgtactgagatgctgacccggaataccctgaaaccttccccacaagcatggctccaactggtgaaaaatctgagcatgcctctggagctgatatgctcagatgagcacatgcagggttccgggtcattggctcaggcagtgatcagggaagtccgggctcagtggagccgaattttttcgacagccctgttcgtggaacacgtcctgctgggtaccgaatcaagagtgcccgagctgcagggcttggtgacagagcatgtatttctgctcgataagtgtttacgagagaattccgacgtgaagactcacggcccatttgaggcagttatgcgtacattgtgcgagtgcaaagagactgccagcaaaaccctgagtcgctttggcattcagccttgtagcatatgcctcggggatgccaaggatcccgtatgcctgccatgtgatcatgtccattgcctccgctgcttgcgcgcttggtttgcctcggaacagatgatctgtccctattgtcttacagcccttccagacgagttttcccctgctgtgtcccaggcccaccgcgaggctatagaaaagcacgccagattcagacaaatgtgcaactctttcttcgtagatctggtttctactatctgcttcaaggacaacgccccaccagagaaagaggtgatagaatctctgctgtctctgctgttcgtgcagaagggaagactgcgggatgctgcacaacgacactgtgagcacaccaaatctttgagcccattcaatgacgtggtcgacaaaacccccgtgatccgctccgtaatcctcaaactgttgctgaaatactcattccatgatgtgaaggactatattcaggagtacctcacactcctcaagaagaaagctttcatcacagaggataagactgagctttatatgctgttcattaattgtctggaggattctatcctcgagaagaccagtgcttattctagaaatgatgagctgaatcacctagaggaagagggacgctttctgaaggcttattctccagccagcaggggcagggaacccgctaatgaggcatctgtcgagtacctgcaggaggtggcacggatccgcctgtgcctggatcgagcagccgactttctttcagagcccgaggggggaccggagatggccaaggagaagcagtgctatctgcagcaggtcaaacagttttgcatcagggtggaaaacgattggcacagggtctatctggtgcgtaagctctcttcccagcgcggaatggaatttgttcagggactgagtaagcccggaaggccacaccagtgggtgtttcccaaagacgtagttaagcagcaggggctaagacaggatcacccgggtcagatggatcgatatttagtgtatggcgacgagtataaggctctgagagacgccgtggctaaagccgtgttggagtgtaaaccattggggatcaaaaccgccttgaaggcgtgtaagactccgcagtcccagcagtccgcatacttcctgctaacactgtttcgtgaggttgccattctgtatcggtcacataacgcgtccctgcaccctacccccgagcagtgtgaagctgtgtccaaatttattggggagtgcaagatcttatcgccaccagacatttcaagatttgccaccagcctggtggataatagcgtcccactgctgcgggcagggccaagcgattctaatctggacggaacagtaaccgagatggctatccacgcagcagccgtgctcctttgcggccagaatgaactgctcgaaccgctgaagaacctcgcctttagtccagccaccatggcgcatgcatttctgcccacaatgccggaggacctgttagcacaggccagaaggtggaaaggcctcgaaagggttcactggtacacctgtcccaacgggcatccttgcagtgtcggcgagtgcgggagacctatggagcaatccatctgcatcgactgccatgcacctatcggagggatcgatcacaagccgagggatggcttccacctcgtgaaggataaagccgatcgcactcagactggccacgtgctgggaaatccacaacgcagagatgtcgttacatgtgaccggggactgccgccagtggtatttctgcttatccggctcctcacacacctcgcccttcttctgggcgcaagtcagtccagccaggccctaataaatatcatcaagccccctgtcagagaccctaagggattccttcagcaacacatactgaaggacttggaacagctcgcaaagatgttaggccattctgccgatgaaaccatcggagtagtgcaccttgtcttgagacggcttcttcaggagcaacaccagctgagtagccggaggctgctaaattttgatactgaactgtccaccaaggaaatgaggaataactgggagaaagagatcgctgcagtcatttccccggagcttgaacacctggataagacacttccaacaatgaacaacttgatcagtcaggataaacgtatttcttctaatcctgtggctaagatcatttatggagaccctgtaacattcttacctcacctcccacgcaaaagtgtcgtccactgctctaagatctggtcctgcaggaagaggatcacggtggaatacctgcagcatatcgtggaacaaaagaacggcaaggagcgggttcccatcctgtggcactttctgcagaaggaggccgaactgcgtttagtgaagttcctgccagagattctagccctccagcgtgacctggtaaagcagtttcagaatgtacaacaggtggagtacagtagcatccgtggcttcctctccaagcactccagtgatgggctgcgacagctactgcacaacagaatcaccgtattcctcagcacatggaataagctcagaaggagtttggagacgaatggggaaattaatttaccaaaggattattgcagcacggatctcgacttggatacagaatttgaaattctgctgcctcgccgacgaggcctggggctgtgcgctacagccctggtgagctatctcattcgtctgcacaatgagatcgtatacgcggtggagaaattatccaaggaaaacaacagctattctgtggacgcagctgaagttaccgagttacacgtgatatcttacgaagtggagagggacctgacacccctgattttatctaactgtcaatatcaggtcgaggagggacgggaaaccgtccaagagttcgatctagagaaaattcagcgccagattgtttcgagattcctacaagggaaacctagactcagcctcaagggaatccccactctcgtttatcgacacgattggaactatgagcacctatttatggacatcaagaacaaaatggcccaggacagcctaccaagcagcgtgatctcggccattagcggtcaactccaatcctattctgacgcatgcgaggttctgagtgtcgtcgaggttaccctgggatttctctccaccgccggaggagacccgaatatgcagcttaacgtgtacactcaagacattttacagatgggtgatcaaaccatacatgttctcaaggctctgaacaggtgtcagctgaagcacactattgctctctggcaattcctgtcggctcataaatctgagcagctgctgcggctccacaaagaacccttcggtgaaatatcatctcggtataaggccgacctgagtccggagaacgctaaactgttaagcacattcttgaatcaaaccggactggacgcctttttgttagaactccatgagatgataatcctaaagttgaaaaacccccagacgcaaacggaagaaagatttcgcccacagtggagccttagggacacattggtctcctacatgcagactaaggagtctgaaatccttccagagatggcgtcccagttccctgaggaaattctgctagcgagctgtgtttccgtctggaagacggccgcagtcctcaagtggaatcgagaaatgcgtta

SEQ ID NO: 239268 - DNA, 4653 bp, Artificial Sequence
  Description of Artificial Sequence: Synthetic coding sequence
atggagtgtccgtcttgtcagcatgtgagcaaggaagaaaccccgaaattctgctcccagtgcggtgaacgcctcccccctgcagcgccaatcgccgattccgaaaacaataactctaccatggcctccgcatccgagggcgagatggagtgtgggcaagagcttaaagaggagggaggcccttgcctgtttcccggaagcgactcttggcaggagaatcctgaagaaccttgcagcaaagcttcctggactgtacaggagtcaaaaaaaaaaaaacggaagaaaaaaaaaaagggaaacaaaagtgcctcttccgaactcgcaagcttgccactatctcccgcttctccttgccacctgaccttactgtctaatccttggccccaggacactgccctgccgcactctcaggcgcagcaaagtggtcccactggccagccatcccagcctcctgggactgcaaccactcccttggagggggacgggctttccgctcccactgaagtgggtgattcccctctgcaggcccaggctctgggggaggcgggtgtggcgaccggcagtgaggcacagagcagccctcagttccaggaccacaccgaaggagaggatcaggatgcctcaatcccaagcggcggtagaggacttagccaggaaggaactggacctcctacttctgccggagaggggcactctcggactgaagatgcagcgcaggagctccttctgccggagagtaaagggggttcaagtgaacccggtactgagcttcaaactactgagcagcaggccggagcctccgcttccatggctgtcgacgccgtcgccgaacccgcaaatgccgttaagggggctggcaaggaaatgaaggaaaagacccagaggatgaagcaacccccagccaccacaccacccttcaaaactcactgtcaggaggcagagactaagaccaaggacgaaatggctgccgctgaggagaaagtcggaaagaacgaacaaggcgagccagaggatctcaagaagcctgaagggaagaacaggagtgccgcagcagtcaaaaatgaaaaagagcagaaaaaccaggaagccgatgttcaggaggttaaggcctccactttgtcccccggaggcggtgtgaccgtattcttccacgctatcatctcccttcatttccccttcaatccagacttacacaaggttttcattagggggggagaagaatttggggagtccaaatgggactccaacatctgtgagctgcattatacgcgtgacctgggacatgatagagtgctggttgagggtattgtgtgtataagtaagaaacatttggacaagtatatcccatataagtatgtgatctataacggcgagagttttgaatatgagtttatttataagcaccagcagaaaaagggtgagtacgtaaataggtgtctctttatcaagtccagtctcctgggctccggagactggcaccagtactacgacatagtgtacatgaagccccacgggcgactgcagaaagttatgaaccatatcaccgatggcccaaggaaggacctggtgaagggtaaacaaatcgccgcagcattgatgctggattctacttttagtatccttcaaacgtgggatactattaacctgaacagtttctttacccagtttgaacaattttgtttcgtcctgcagcagcccatgatatacgagggccaggctcaactctggacagatctgcagtatagagaaaaggaggtaaagcgttacctgtggcagcacctgaagaaacacgttgtgcccctgccagatgggaaatctacagactttctgcccgttgactgtcccgtgcggtctaagttaaaaacaggactcatcgtcctttttgtggtcgaaaagatagagttactcctcgagggaagtcttgattggctttgtcatctcctcaccagtgatgcaagtagtcccgatgagtttcaccgagatcttagccacatccttggcataccacagtcctggaggttgtatcttgtgaacctgtgtcagcggtgcatggacacacggacatatacgtggctcggtgccctccctgtgctgcattgctgtatggagctcgccccacgacacaaggatgcttggagacagcctgaggatacctgggccgctctcgagggactgtcattttccccctttagagaacaaatgctggacacctcttctcttctacagttcatgagggagaagcagcatttgctgtcaatcgatgagcctctgttcaggtcttggttttctctcctgccactatcccacctcgttatgtatatggaaaacttcatagagcacctcggaaggttccccgcacacatcctagactgcctgagtggcatctattatcggttaccgggattagagcaagtgctaaacactcaggatgtacaagacgttcagaatgtgcagaacattctcgaaatgctactgagactgctcgatacctacagggacaaaatccccgaagaagcactcagcccgagttatcttaccgtgtgtctgaagctccatgaagcaatatgctcatctaccaagctgttgaagttctatgagctgccggctctgagcgctgagatagtgtgccggatgattcgccttctgagccttgtggacagcgccggacagcgggacgaaactgggaacaactccgtgcagacagttttccaaggtacacttgcggctacaaaaagatggctgagggaagtgttcaccaagaatatgctcacctcctccggggcttccttcacatatgtgaaagagatcgaggtctggaggcgcctggtcgagatccaattcccagccgagcatggatggaaagaaagcctgctgggggacatggaatggcggcttacaaaagaggaaccactgtcccagattacggcctattgcaattcctgctgggatactaagggcctcgaagactccgtcgcgaaaaccttcgaaaaatgcattatcgaggccgtttcttctgcttgtcagtcacaaacaagcatcttgcagggcttcagctattcggacctgagaaaatttggcattgtcctctccgccgtgattacgaaaagttggccacgcacagccgacaactttaacgacatcctcaagcacctcttgactctggccgacgtcaaacatgtgtttaggctgtgtgggacagatgagaagattctggcaaatgtgactgaggatgctaagcgtcttatcgctgttgctgattcagtgctgacaaaggtggtgggagatttgctcagtgggaccatactagtggggcagctggagctgatcattaaacacaagaatcagtttttggatatatggcagttgagggagaagtcactgtcccctcaggacgagcagtgtgccgttgaagaggccttggattggcgcagggaagaactgctgttgctaaaaaaagagaaacgatgcgtagacagtctgctgaaaatgtgcgggaatgttaagcacctgattcaggtagattttggggtcctggctgtgcgccatagccaggacctctcatctaaaaggcttaacgatacggtaaccgtccgtcttagtacgagctctaattctcaacgagccacccattaccatctgtcctctcaggtacaggaaatggcaggtaagattgaccttctccgagactctcacattttccaactgttttggagggaggcagctgagcccctctctgagccaaaagaggatcaggaagctgcagaactgttgtcggagccagaagaagaatctgagaggcacatcttggaacttgaggaggtgtacgattatctgtaccagcccagctaccgcaagtttatcaagcttcaccaggacctgaagagcggtgaggtgacactggcagagatcgatgtgatctttaaagactttgtcaacaagtataccgatctagacagtgagttgaagatcatgtgtacagtagaccatcaggatcagagggattggattaaagacagagttgaacagataaaggagtatcaccacctgcaccaggctgtgcatgctgccaaagtgattttgcaagttaaggaatcgttaggcctgaacggggattttagcgtactcaacactctccttaattttactgacaattttgacgactttaggcgcgaaacactggaccaaattaatcaggagttaattcaggccaagaaactcctgcaggatatctccgaggctcggtgcaagggcctgcaggccctgagtcttcggaaggaattcatttgctgggtgcgagaagccctggggggtatcaatgagctgaaggtctttgttgacctggcttcaatctctgccggtgaaaatgacatcgacgtagatcgagttgcttgttttcacgatgcagtgcagggatatgcatcccttcttttcaagttggatcccagcgtggattttagtgcgttcatgaagcacctgaagaaactgtggaaagcgctggacaaagatcagtatctgccacgcaaactagtttctctaattttgtcgctaatgcaaatattgctcaatagagccctcctctccaatgttcgggcagtaaccgtggaaatggtggcccacctatgcggcaggtttgttcacagtcggtttcagtag

SEQ ID NO: 239269 - DNA, 15770 bp, Artificial Sequence
  Description of Artificial Sequence: Synthetic coding sequence
atggagtgcccctcctgccagcatgtcagtaaggaggagactccaaagttttgctcccagtgcggagagagactcccccctgctgctcccattgctgactccgaaaataataattcgacaatggccagcgcaagtgagggtgagatggagtgtggtcaggagctcaaggaagaaggcggtccatgtctttttccaggatctgattcttggcaagaaaaccccgaagagccctgttccaaggcctcatggaccgtccaggagggggcaacctcagaagttctcgttgatgctgcagtggatctgattagtgatgagtgggaagccgctaacgctatcccaagtaagcggagaaaacaggatgcagcccctttggaggccgcaagtgtgcccagcgctgattgtgagcaatcaaagaagaaaaagcgcaaaaaaaaaaagaaagggaataaaagtgccagctctgagctcgcttccctacctttaagccctgccagcccatgccaccttacattgctgtctaatccttggccacaggacactgcccttccgcactctcaggcccagcagagcggccctacaggccaaccaagtcaaccacctgggaccgccaccacgccactggaaggcgatggcttgtcagctcccaccgaggtcggagactcccccctacaagcccaggcccttggcgaagcaggcgtcgctacgggttcagaggcccagtcctcccctcagtttcaggatcacaccgaaggagaagatcaagacgcctccattccctcaggtggtaggggattgtcccaagaagggactggccctccaacctccgcaggcgagggccacagcagaacggaggatgctgctcaggagctgctcttaccagagtcaaagggagggtctagtgaacctggcacagagttgcagactacagaacagcaggcaggcgcatccgcaagtatggcagtcgacgctgtggctgagcctgctaatgcagtgaagggggcaggcaaggagatgaaagagaagacgcagcgcatgaagcagccacccgctactacccccccttttaaaacccattgccaagaagcagaaaccaaaactaaagacgagatggctgcggcagaggaaaaggtcggcaaaaatgagcagggtgagcccgaggatttgaagaagccagaggggaagaaccgttccgcggctgcggtgaaaaacgagaaggaacagaaaaatcaggaggctgatgtgcaggaggtgaaagccagcaccctgtccccaggaggtggcgtaacagtcttctttcatgcaataatcagcctgcactttccgtttaacccagatctccataaggttttcatcagaggcggagaggaatttggagaatccaaatgggattcaaacatctgtgaattgcattacactagggacctgggccacgaccgggttctcgtggaaggaatagtgtgcatctccaaaaaacatcttgataaatatattccttataaatacgtgatctataacggagagtcttttgagtatgagttcatctacaagcatcagcagaagaaaggagaatacgtcaaccgatgtctctttatcaagtcatccctcctgggcagcggcgattggcaccaatactatgacatcgtttacatgaagccacacggccgactccagaaagtaatgaatcacattacagacggccctcggaaagatttggtgaaggggaaacagattgccgctgctcttatgcttgattctactttcagcatactgcagacgtgggacaccattaatcttaactccttcttcacacagtttgagcagttttgtttcgtccttcaacaaccaatgatctatgaagggcaggcccaactctggaccgatctgcagtatagggagaaagaagtgaaacgatatctgtggcagcatctgaagaagcatgttgtccctttacccgacggcaagtcgacggactttctccctgttgattgcccagtgcggtccaaactgaagactggcttgatcgtgctgttcgtggtggagaagatcgaactactgcttgagggctctctcgattggctgtgccatctgctgacctctgacgcatcctctcccgatgagttccaccgcgatctaagccacatcctgggtatcccacaaagttggcggctttacctggtgaacctttgccagcggtgtatggacacaagaacctacacgtggctcggggcactgccggttctccactgctgcatggagctggcaccaagacacaaggatgcctggaggcagcctgaagacacatgggctgcactggaaggcctctcattttccccattccgtgagcagatgctggacactagctcactgctacagttcatgagagagaaacaacatctcctgtcaattgacgagcctctgttcagatcttggttctcacttcttcccttatctcacctggtgatgtacatggagaactttattgaacacctggggcgttttcccgcacatatcctagattgtctgtcaggcatatattataggcttccgggactggaacaggttcttaacactcaggatgtccaagatgtgcagaacgtacagaacattctggaaatgctgctgcggctcctggacacttatcgggataaaatacctgaggaagccctttcaccctcctacctcactgtttgcctgaagctgcacgaggccatctgttcttctaccaaactgctcaaattttacgaactcccagcactctcagccgagatagtgtgccgcatgattcgcctcttgtccctggtcgacagtgccggtcagcgagacgaaactgggaacaattctgtgcagacagtgtttcagggaacgctcgccgctacaaagagatggctccgcgaggtctttactaagaatatgctgacctccagcggagcctctttcacatatgtgaaggagatcgaggtgtggcggagactggtggaaatacaatttccagctgaacacggatggaaggagtccttactgggagacatggaatggcgactgacaaaggaggaacccctttctcagatcacagcttattgcaattcctgctgggacaccaagggtctcgaggatagcgttgccaagaccttcgaaaagtgtattatcgaggccgtgagctcagcgtgtcagagtcaaacgtccattctgcagggattctcttactctgatttaaggaagttcgggatcgttttaagcgcagtgatcacaaagtcttggcctcgaacagctgacaatttcaacgatattctgaaacacttacttacacttgcagacgtgaaacatgtctttagactgtgcggcacagatgaaaagatcctcgctaacgttactgaggacgcgaagcgtttgattgctgtcgcggatagcgttctgaccaaagtggtgggtgatctcctctcaggtacgattcttgtgggacaattagagctcatcatcaaacataagaatcagttcctggacatttggcagttgcgggagaaaagcctgagccctcaggacgagcagtgtgctgttgaggaggctctcgattggaggagagaagaattattactgctgaagaaggaaaagaggtgcgtcgacagtcttctgaagatgtgcggtaatgtcaaacacctgatacaagtcgacttcggtgtgctggctgtaaggcatagccaggacctctcatctaagagacttaatgatacagttactgttcggctgtctacttcaagcaattcgcagagggccactcactaccacctctcctcccaggtacaggagatggccggaaagattgatttacttagagactctcatatatttcagctcttctggcgagaggccgctgaaccattatcagaacctaaagaagatcaagaagcagctgagctgctctcagagcctgaggaagagagtgagcgccatatcctggaattagaggaggtgtatgactatttgtaccagccttcatacaggaaatttattaaactccaccaggacctgaagtccggtgaggtcaccctggctgaaattgacgtgatctttaaagattttgtcaacaagtatactgatctggatagtgaactgaaaattatgtgtacagtagaccatcaggaccaacgagactggatcaaggatcgagtggaacagatcaaggaataccaccatctgcaccaggcagtacacgccgcaaaggtgattctccaggtcaaggagagcctggggctaaacggggacttctccgttctgaacaccctactgaacttcacagacaatttcgacgactttagacgagagacactcgaccagatcaaccaggaactgatccaggcgaagaaactgctgcaggatatcagcgaggccagatgcaaaggcttgcaggcactgtctctgaggaaagaatttatttgctgggtccgggaagccctgggtgggatcaacgaactgaaagtgttcgtcgatttagcctccatttcagccggagagaatgacatcgatgtagatcgagttgcgtgcttccacgatgccgttcagggatacgcatcactgctctttaaactcgacccgagcgttgatttctctgcttttatgaagcacctcaaaaagctttggaaggccttagataaagatcagtacctaccacgtaagctctgtgattcggcgagaaatctggagtggctcaagactgtcaacgagtcccacggcagtgtcgagcgcagttctctgacactcgcaaccgccattaaccagaggggaatttatgtgatccaggctcccaagggtggtcagaagatatcacctgatacagtcctgcacttaattctccccgaaagcccgggaagtcatgaggaatctcgcgaatacagtttggaagaggtgaaagaactgctgaacaaattaatgcttatgtctggaaagaaggatcgcaacaataccgaagtggagcgtttctctgaggttttctgctccgttcagaggctctctcaagctttcatagacctccactcggctggtaacatgctgtttcgcacttggattgctatggcgtattgcagcccaaaacaaggcgtgagcctccaaatggacttcggcctggacttggtgactgagctgaaagagggcggtgatgtaaccgagctgctggcagccctgtgccggcagatggaacacttcctcgacagctggaagaggtttgtcacacaaaagcgcatggaacacttttatctgaacttttatacagctgaacagctagtgtaccttagtacggaactgaggaaacagccaccgagcgatgctgcacttacgatgcttagtttcattaaaagcaactgtacgttgagagacgttctgcgggcaagcgtggggtgcgggtccgaagctgcacggtaccggatgcggagagttatggaggaactgcccttgatgttgctgtctgaattctctctggtggataagctcaggattattatggaacagtccatgcggtgtctgcctgccttcttgccagattgcctggacttggaaactctcggtcactgcttggcacacctagccggtatggggggatctcctgtagagcggtgcctgccgaggggtctccaggtaggacagccaaacttggttgtgtgcggacattctgaggttctgcctgctgcacttgccgtgtatatgcagacccccagccaacccttaccgacctatgacgaggtgcttctgtgcaccccagccaccacatttgaagaggtggccctgctccttcgtcgctgtctgacacttgggtcgcttggacacaaggtctacagtctgctatttgctgaccagctttcatacgaagttgccagacaggcggaggaactctttcacaatctgtgcacccaacagcatagagaggactaccagctggtgatggtctgcgacggcgattgggaacactgttacttgccctcagctttttcacaacacaaggtgtttgttacaccccaggctccactggaagccattcaggcctacctcgctggccactaccgcgttcccaagcagaccctgagcgccgcagcagtgttcaatgacagattgtgcgtgggaattgtggcaagtgagagagccggagtgggcaagagcttgtacgtgaagcgactccatgacaaaatgaagatgcagctcaatgtgaaaaatgtccctctgaaaacaatccgtctgattgatccacaagtggatgaatctcgggtcttgggagctctacttccattccttgatgcccagtatcagaaagtcccggtgttattccatctcgatgtcacaagtagtgtacagacaggcatatgggttttcttgttcaagctgctgattctgcagtatcttatggatatcaatggtaagatgtggctacggaacccttgtcacctctacattgtagaaattctggaacgcagaacctctgtaccaagtcgttcgtcgtccgccctgaggactcgtgtgccccagttttcgttcctagatatctttcctaaggtgacatgtagacctcccaaggaggtgatagacatggagctgagcgccctgaggagcgatactgaacccggaatggacttgtgggagttctgctcggagaccttccagaggccatatcagtatctgaggaggttcaaccagaaccaggacctggacacctttcagtatcaggagggcagtgtggagggcacccccgaagagtgcctccagcattttctatttcattgcggagttattaacccctcatggtctgaactcagaaactttgctcggtttttaaactatcagctcagagactgcgaggcctcactcttttgtaaccctagttttattggcgacacacttagggggttcaaaaagttcgtggtcacgttcatgattttcatggcgagggatttcgctacccccagtcttcatacatctgaccagtcgcctggcaaacacatggtgactatggatggggttagagaagaggacttggctcccttttctctgcgtaagcgctgggagtccgagccacatccttacgtgttctttaatgatgaccatactaccatgaccttcatcggtttccatctccaacctaacatcaatgggagtgtagacgccatttctcatctcactgggaaggtgattaagcgcgacgtaatgacccgagacctctaccagggactgctgctgcagcgagtcccttttaatgtcgactttgataagctgccgcgacacaagaagctcgaaagactgtgccttactttgggcatcccgcaggcaaccgaccctgacaaaacatatgaactcactaccgataacatgctgaagatcctcgctatagagatgaggtttcgctgcggtatcccggtcatcatcatgggcgagacgggatgcgggaagacccggttaattaagttcctgtccgacctccgtcggggaggaacaaacgccgacaccattaaactggttaaggtacatggaggtaccacggccgacatgatctacagtagagttcgggaggctgagaatgtggctttcgccaataaggatcagcatcagctcgatactatactgttctttgatgaggcgaacacaacagaggccatttcatgtataaaagaagtgctttgtgatcatatggtggacggccagcctttggcggaggattccggcttgcatattattgccgcatgtaacccataccgtaaacattcggaagagatgatttgcaggttggaaagtgcaggcctggggtatcgcgtctccatggaggaaaccgccgacaggctgggaagcataccactccgacagctcgtatatagggtccatgctcttcccccatctctgatccctctggtttgggactttggacaactgtctgatgttgcggaaaagttatacattcaacagattgttcagagactcgtcgaaagtatttcacttgatgagaatgggactagagtcatcaccgaagttctgtgcgcctctcaggggttcatgcgtaagacagaagacgaatgctcctttgtttctctgagggatgtcgagcgctgcgtcaaagtctttcgctggttccatgaacacagtgctatgctgctcgctcagttgaacgcctttttatcaaagagtagcgtgtccaagaaccacacagagcgcgatcccgttctttggagcctcatgctggccataggcgtttgttatcacgcgtccctggaaaaaaaggattcttacagaaaagccattgcaagatttttccccaagccctacgacgactctagactactgctcgacgaaatcactcgcgcacaggacttatttctcgatggagtgcccctaaggaaaaccatcgcaaagaacctggcacttaaagaaaatgtattcatgatggtggtctgcatagagttaaagatcccgctgttcctggtgggaaaacccggatcaagcaagtcacttgccaagacaatcgtggctgacgcaatgcagggcccagccgcatacagtgacctgttccgtagtctaaagcaggtccatttggtctcgtttcagtgcagcccgcattccacgccacagggaattatcagtaccttcagacagtgcgcacgcttccaacagggtaaggatctacagcagtatgtgtccgtggtggtgcttgatgaggtaggcttggcagaagattccccgaagatgccgcttaagactctgcatcccctcctcgaggacggctgcattgaagatgatcccgcaccccataagaaggtgggctttgttggtatctcaaactgggctctcgatcccgctaagatgaaccgcggaatttttgtcagtcgcggtagtccaaatgaaacagaattgattgaaagtgcgaagggaatctgcagcagcgatattctggtgcaagatcgcgtccagggatactttgctagcttcgccaaggcatacgagactgtatgtaaacgccaggataaggaatttttcggacttagagactactacagcctgattaaaatggtgttcgcggctgctaaggcaagcaatagaaagccaagcccccaggacatcgctcaggctgtgttgcgaaacttctcaggcaaggatgacatccaggccctagatatctttcttgccaacctacctgaggccaaatgttctgaagaggtgtcaccgatgcaactgatcaagcagaacatcttcggcccttcccaaaaggttccagggggtgaacaggaggacgccgagagccgttatctgctggtcctgacaaagaattacgttgcccttcagatccttcaacaaactttttttgagggcgatcaacaacccgagattatatttgggagcgggttccccaaagaccaggagtacacccaactgtgcagaaatatcaacagggtgaagatctgcatggagactggaaaaatggtgttattgctgaatctgcaaaatctttacgagagtctatatgatgccctgaaccagtactacgtccacctgggcggacagaagtacgttgatttgggattggggacacatcgcgtgaagtgccgtgttcatccaaactttcgcttgatcgtgattgaggagaaggatgtggtgtataagcactttcctattcccctcattaaccggctggagaagcactaccttgacatcaataccgttttagaaaagtggcagaaaagcatagtggaggaactgtgcgcctgggtcgaaaagttcattaacgtaaaagcacatcactttcaaaagcggcataaatatagccctagcgacgtttttatcggctaccactccgatgcttgtgcctctgtcgtactgcaggtcatcgaacggcagggacccagggccttgacggaggaactgcaccagaaggtgagtgaagaggcgaaaagtatactgctaaactgtgccacgcccgacgccgtagtccggctgagcgcttactccctgggcggatttgctgccgaatggctgtctcaggagtacttccataggcagagacacaactctttcgccgatttcctacaggcacacctgcatacggcggatctggaaaggcacgccatttttaccgaaatcaccacattcagtagactgctgacatcccatgactgtgagattctcgagagtgaggttaccggacgcgcacccaagcccacactgctgtggctccagcaattcgatacagaatacagctttcttaaggaggtccgcaattgcctcacaaataccgcgaaatgcaagattttgattttccaaactgattttgaagatggcatcagaagtgcccagctgatcgcaagcgccaagtattcggtgataaatgagatcaataaaatacgtgagaatgaagacagaatcttcgtttactttatcaccaaactgagccgcgtgggccgtggaacagcttatgtcggcttccacggcggtctctggcagagcgtgcatattgacgacctcaggagatctactttaatggtctccgatgtgacccgactacagcatgttacaatctcccaacttttcgcacctggagacctgccggagcttgggctcgagcatcgagccgaagacggacatgaagaggcgatggagaccgaggcctccacctccggagaggtggcggaagtagccgaagaggcgatggagacggagtcttctgagaaagtggggaaggagacatccgaacttggaggatccgacgtgtcaattctcgataccaccaggctgttaagatcttgtgtgcagagcgctgtgggcatgcttcgggaccaaaacgagagttgcaccagaaacatgaggagggtcgtgttactgctgggcctgctgaacgaggatgatgcttgtcacgcttcctttctgagggtttccaaaatgagattgtccgtgttcctgaaaaagcaggaggagagccagttccatcccctggagtggctcgcacgggaggcttgcaaccaggacgccctgcaagaagctgggacgtttcgtcacaccctgtggaagagggtgcagggtgcagttactccactgctggccagcatgatcagcttcatcgaccgagatggcaatctggagctgttaaccagaccagacacgccgccttgggctagagacctttggatgtttattttctcagatacaatgctcctcaacattccacttgtgatgaacaatgagcggcacaaaggagaaatggcctacatcgtggttcagaaccatatgaacctgagcgaaaacgcaagcaacaacgtcccgttcagttggaaaatcaaagattacttagaggaactgtgggtgcaggctcaatacatcacggatgcggagggcttgccaaagaagtttgtggacattttccagcagactcctcttggacggttcctcgcacagttacatggagagccccagcaggaacttcttcaatgctaccttaaagactttattctgctgactatgcgggtgtcgaccgaggaggagctcaagtttctgcagatggctttatggtcctgtacaaggaagctgaaggctgcttctgaggcccctgaggaggaggtgtcccttccctgggtccacttggcctatcaaagattccgatcccggctccagaacttctctagaatcttgacgatttatccccaggttctgcactctttaatggaggccagatggaaccacgaattagccggttgtgagatgactctcgacgctttcgccgctatggcgtgcactgagatgctgacacggaataccctgaaaccatcccctcaggcctggcttcaactcgtgaagaatctgagcatgcccttagaacttatatgcagtgacgagcatatgcaaggatctgggagcctcgctcaagcagttatccgcgaagtgcgagctcagtggagtagaatcttctcaacggcgctgtttgttgagcatgtgctactgggcacagagtcccgagtacccgagctgcaaggcttagtgactgagcatgtgttcctgctggacaagtgtctacgtgaaaattccgatgtgaagacccatggaccctttgaggctgtgatgcggacgctgtgtgagtgtaaggagaccgcgagcaagaccttgagtcggtttggaattcagccatgtagtatctgcctcggcgatgctaaggatccagtgtgtctaccgtgcgaccatgtgcattgcctacgatgcctgcgagcttggtttgccagcgaacagatgatttgcccctattgtctcactgctctgccagatgaattcagcccggcagtgtcccaggcacacagagaagcgattgaaaaacacgccaggttccgacagatgtgcaattccttttttgtagacctggtgagcaccatctgctttaaggacaacgcacccccagaaaaagaagtgattgagtcgcttctctcccttctgttcgtgcagaagggtagactgagagatgcagcccagagacactgtgaacacactaagtccctgtctcccttcaacgatgtcgtagacaagaccccagtaattcgatccgtcatactgaaactcctactgaaatactcattccacgatgtcaaagactacatacaggaataccttaccctgttgaagaagaaagcatttataaccgaggacaagactgagctttacatgttgttcattaactgcctcgaggattcaatcttagaaaagacttcagcttactctaggaatgacgaactgaaccatttagaagaggaggggaggtttttgaaggcctactctcctgcgtcaagaggtcgcgagcccgctaacgaggcttcagtggagtatctccaggaggttgcacgaatcaggctctgtctggacagggccgctgactttctctctgaacctgagggaggcccagaaatggcaaaggaaaagcagtgctatctgcagcaggtgaaacagttttgcatccgtgtggaaaatgactggcaccgagtctacctggtgcggaaactgagctctcaacgcggaatggagttcgttcaagggttgtcaaagcccggtaggccgcatcaatgggtgtttccgaaggacgtcgtgaagcaacaggggcttcgccaggaccatcccggacaaatggaccgctacctggtatatggcgacgagtacaaagccctgagagacgctgtggctaaggccgttctggaatgcaaaccgttgggaatcaaaaccgctttgaaggcgtgcaaaactcctcaaagccagcagagcgcatacttcctgttaaccttattcagagaagttgcaattctgtatagatcacataacgcatcactgcacccaactccagagcagtgtgaagctgtgagtaaatttattggagaatgtaaaatcctctcgccgccagacatctcacggtttgccacgtctctcgttgacaacagtgtgccactgctgcgagccggtccaagtgacagcaatcttgacggaaccgtcactgagatggcgatccacgcagccgcagtccttttgtgtgggcagaacgaactgctggagccattgaagaaccttgcattctctccagccacgatggctcatgcattcttgccaacaatgcctgaggatttactggcccaggccaggcggtggaagggtctggaacgcgtccattggtacacatgccctaatggacatccatgttctgtgggcgaatgtggacgtccgatggaacagtcaatctgtatcgactgtcatgccccaatcggcggaattgatcacaaacctagggacgggtttcacttggttaaggacaaagccgacagaacacagaccgggcatgtgttaggaaatccccagcgaagggatgtagttacttgcgaccgaggcctgcctccagttgtctttctgctgattcgtctgctcacacaccttgcattgctgctgggcgctagccaaagctctcaggctctcatcaatatcattaagccccctgtacgagacccgaagggcttccttcagcagcacatcctcaaagatttggagcagttggcaaaaatgctgggccacagtgccgacgaaaccatcggagtggttcacctggtcctccggagattgctgcaggagcagcaccagctgagttctcggagactgcttaattttgatacagagctgtccaccaaggaaatgcgtaacaattgggagaaggagatagccgctgtgatcagtccagaacttgaacatttggataagacattgcctaccatgaataatctgatttctcaggataagaggatctctagtaacccagtggcaaagattatctacggcgacccagtgaccttcctgccccacctgccccgtaagtccgttgtgcattgctccaagatatggtcttgccgtaagcgcattactgtcgagtacctacagcacatcgtagagcagaaaaacgggaaggaaagggtgcccatactgtggcatttcctgcagaaggaggccgaactgcggctggtgaagtttctgcccgaaatacttgccctccaaagggacctggttaagcagtttcagaatgtgcagcaggttgagtatagttcgattcgtggctttttatccaaacactcgagcgacggcttaagacagctcctacataaccgcattaccgtgttcttgtcaacttggaacaaattaagacggagccttgaaactaatggggaaataaatttacccaaggactactgcagtacggacctcgatctggatacagagttcgaaatcctcctgccacggaggaggggactgggcctctgcgctacagctctcgtgtcgtacctgatccgactccataatgagatcgtgtacgcggtggagaaactgtccaaggagaacaactcgtactctgttgacgcagcagaggtgacagaactgcacgttattagttacgaggtagaacgggatcttaccccccttattctctctaattgccagtaccaagtagaggaagggcgagaaaccgtacaagagttcgacctggaaaagattcagagacagatcgtctcaaggtttctccaaggaaagcccagactcagtctcaagggcattcctactttagtgtacaggcatgattggaactatgagcacctgttcatggatattaagaataagatggctcaggacagtctgccgtcaagcgtgatctccgccatcagcggccagttgcagtcgtactctgacgcctgtgaggtgctcagcgtggtcgaagtgaccctcggctttttgtccaccgctgggggtgatccgaacatgcaactaaatgtgtatacacaagacattctccagatgggtgaccagactattcacgtgctcaaagccttaaaccgatgccagctgaaacacactatagctctttggcagttcctgtcagctcacaagtcagagcagctgcttaggctgcataaagagccttttggagaaattagttccaggtacaaggcagatctgtctcccgagaacgccaagctgctgtccaccttcctgaatcagacaggtttggacgccttcctgctggaactgcatgaaatgatcatactgaagctgaagaaccctcagacccagactgaagaaagattccgcccacagtggtctttgcgagacacacttgtctcttacatgcagacaaaagagtcagaaattctgccagagatggccagtcagttccctgaggaaattctcctggccagctgtgtgtctgtctggaagactgccgcagttctcaaatggaatcgtgagatgcgcta

SEQ ID NO: 239270 - DNA, 15624 bp, Artificial Sequence
  Description of Artificial Sequence: Synthetic coding sequence
atggagtgtcctagttgccagcatgtttccaaggaagaaactcccaagttctgctctcagtgtggggagaggttgccacctgctgccccaattgctgacagtgagaacaataattctacaatggcgtcagcatcagaaggtgaaatggagtgtggacaagagctcaaagaagagggcggtccctgtctctttccgggatcagattcttggcaggagaatcccgaggaaccttgctccaaggcttcgtggacagtgcaggaaagtaagaaaaaaaaacggaagaagaagaaaaaaggtaataaatcagcatcttccgaactagctagtctgcctctgtctcctgccagtccatgtcatcttacactgttgagtaacccttggcctcaggataccgccctaccacacagtcaagctcagcagtcggggcctacaggccagcctagccagcctccaggcactgccacaactcccctagagggtgacggtctgtcggcacccactgaggtgggggattcccccctacaggcgcaagcactgggtgaagcaggtgtggctactggcagtgaagcccagtcctccccacagttccaggaccataccgaaggagaggatcaggatgccagcattccctcagggggtcgaggactcagccaagagggcactgggccacccacttccgccggtgaaggacatagcaggaccgaggacgcagcgcaggagctcttgctgccagaaagcaaagggggaagttcggagcccggaaccgagctgcagacgactgagcagcaggcgggagctagcgccagcatggctgtggatgctgtcgctgaacctgccaatgctgtgaagggcgcaggcaaggaaatgaaggaaaaaacccagcgcatgaaacaacctcccgctacgaccccacctttcaagacccactgccaggaggctgagactaagaccaaagatgagatggcagctgcagaggagaaagtgggaaaaaatgaacagggtgagccagaggatttaaagaagccagagggcaaaaatcgctcagcggctgctgttaaaaacgaaaaggagcagaagaaccaagaggctgatgtgcaagaggttaaagctagtacactgtctcccggaggcggagttactgtgttcttccacgctatcatctcactgcatttcccttttaatccagacctccacaaagtcttcattagaggcggtgaagagtttggagagagtaagtgggatagcaatatctgcgagctccattacacacgagacctcggccacgatagagtgctggtcgaaggaatcgtctgcatctcaaaaaagcacctcgataaatatattccttacaaatacgtaatctacaacggagagtccttcgagtacgagttcatctataaacaccagcaaaagaagggcgaatacgtgaaccgatgcctgttcatcaagtccagtctcctgggaagcggggattggcatcagtactacgacatcgtgtacatgaagcctcatggcagactccagaaggtcatgaatcacatcacagatggaccacgtaaagatctcgtgaaaggcaagcaaattgcggctgctctgatgctggactccacttttagcattctccagacctgggacacaatcaacctcaactcttttttcacgcagtttgagcagttctgctttgtgttgcaacaacccatgatttatgagggacaggcccagttgtggactgatctgcaatatagggagaaggaggtgaaacgatacctgtggcagcacctgaaaaaacacgtagtgccgttacccgacggcaagagtactgatttcctgccagtggactgccctgttaggagtaagcttaagacaggattgatagtgttgttcgtggtggaaaagattgaactgttacttgagggatcactggactggctgtgccatctcttaacatcagatgcttctagccccgacgaattccacagggacctgagtcatatactcggtattccccagtcgtggagactttacctggtgaatctttgccagcgatgcatggacaccagaacctatacgtggctgggcgcactgcccgtcctccattgttgcatggaactggctcctcgccacaaggatgcctggcgacagccagaggacacatgggccgctctcgaggggctctccttcagccctttccgcgaacaaatgttagacaccagttctttactacagttcatgcgggagaaacagcaccttctgagtatagacgaaccgttgttccgttcatggttctctttgctgcccctgagccatttggtcatgtacatggagaattttatcgaacacctgggccgattcccggctcacattctggactgtctgtcgggtatatattacaggctgccaggactggaacaagtgttaaatacccaggacgtgcaggatgtccagaacgtgcagaatattctggaaatgctgttacgactgctcgatacctacagggataaaatccccgaagaggccctgtccccctcctaccttacggtctgtctaaaactccatgaggctatctgctcatctactaagctgcttaagttctatgagctaccggctctaagcgccgaaatagtctgtagaatgatccgccttctgtctcttgtcgacagcgctggccagagagatgagaccgggaataattcagtacagactgtgttccagggaacactggcagccaccaagcgttggctccgagaagtgttcaccaaaaacatgttgacctccagcggcgcaagctttacatatgttaaggagatagaggtctggagacggttagtagagatccaatttcctgccgaacatggctggaaggaatcacttttgggagatatggagtggcggctgaccaaggaggagccactgtcacagattaccgcttattgcaattcctgctgggataccaaagggctagaggactccgtagctaaaacgttcgagaaatgtataatagaggctgtaagcagcgcttgtcagagtcagacttcaattctgcagggcttttcatactcagacctgaggaagttcggcatcgtcttatcagctgtgattaccaagtcctggccacgtacagccgacaatttcaacgacattctgaagcacctactgactcttgccgatgtaaaacacgtttttagattatgtggcaccgacgagaaaattctggccaatgttactgaggatgcaaaacggttgatagccgttgccgactcagtgttaacgaaagttgtgggcgatctcctgtccgggacaattcttgtgggccaactggagctgattatcaaacacaagaaccagtttctggatatttggcagcttcgcgaaaaatctttgagtccgcaggacgagcaatgtgccgtggaagaagcgctcgattggagaagggaagaattactgctcctcaaaaaggaaaaaaggtgtgtggatagtctgcttaaaatgtgcggcaatgtgaagcatttgattcaagtggacttcggggttctggccgtgcgccacagccaggacctctccagtaagaggctgaatgacaccgtgactgtgagattaagtacaagtagcaatagtcagagggccacccattaccacctgtccagtcaggttcaagagatggccggaaagattgatctgttgagagacagtcatatctttcagctgttctggcgtgaggctgcagaacccttgtccgaaccgaaggaggatcaggaagcagctgagctgctgagcgagcccgaagaagagtccgaacggcacatcttagagcttgaggaggtatacgattatctgtaccagccgtcttaccggaagtttatcaaactgcatcaagatctgaagagcggcgaagtgacactggccgaaatcgacgttatctttaaagacttcgtgaacaagtataccgacctagatagcgaactcaaaataatgtgtacagtggatcatcaagatcaaagagactggattaaagacagagtagagcagataaaggaataccatcacctgcatcaggcggtgcacgccgctaaggtgatactgcaagttaaggagagcctcggtttaaacggggactttagtgtgctgaatactctgctcaattttaccgataatttcgacgatttcagaagagaaaccctcgaccagattaaccaggaactcatacaggctaagaaactgttgcaggacatctctgaggctagatgcaaggggctccaggccctatccctgcggaaagagttcatatgttgggtgcgggaagccctcgggggaatcaatgagctgaaggtgttcgtggacttggcaagcattagcgcaggggaaaacgatatcgacgtggatcgcgtggcttgctttcacgacgctgtccagggctatgcttcattgctgtttaaactcgatcccagcgtagactttagcgcttttatgaagcacttaaagaaactctggaaagctctggataaggatcagtacctacccaggaaactctgcgactccgccagaaacctggagtggctgaaaacagtcaatgagtctcacggctccgtggagagaagctctctaaccttggcaaccgccattaatcaaaggggcatatacgtcatacaagccccaaaggggggtcagaagatttcacctgacactgttctgcacctgatcttacctgaatcccccggaagccacgaagaaagtagggaatacagtttagaagaagtcaaggagcttctcaataagctgatgctgatgtccggaaaaaaggacaggaataacacagaggtggaacgcttcagcgaggttttctgctctgtgcaaaggttatcccaggcgttcattgacctacactctgccggaaacatgttgtttcggacatggatcgccatggcctactgcagcccaaagcagggagtctcactccagatggacttcggcctagatctcgtgaccgagctcaaagaaggcggtgacgtgactgaactgctcgccgctctttgcagacaaatggagcactttcttgatagctggaagcgctttgtcactcagaaacggatggagcacttctatctgaatttctatacggctgaacagctggtgtacctaagcactgaattgagaaaacagcctccatccgatgccgcactgactatgctgagctttattaagagcaactgcaccctgcgcgatgtgctccgggcttctgtcggctgcggcagcgaggcagccagatatcgtatgcgtcgcgtcatggaggaactgccacttatgctgctcagcgaatttagcctcgtcgacaaactccgcattatcatggagcaatccatgagatgccttccagcctttctcccagattgcctggacctggaaaccttgggccactgtctggcgcacttggccggtatgggcggatcaccagtggagaggtgccttccgagaggactgcaggttgggcagcctaatttggtggtttgtgggcatagtgaagtgctgccagctgctctggcagtatacatgcagaccccaagtcagccccttcccacttacgatgaggtcctgttatgtactcctgcaactacttttgaggaggtagcactactcctccggcgatgcttgaccttgggatccctcggccataaggtgtatagcttattgtttgccgatcagttgagctatgaagtggcacggcaagcggaagaattgtttcacaacctctgcacccaacagcatcgcgaggactatcaattagtgatggtgtgcgatggggactgggaacattgttatctgccaagtgcgttttcacaacacaaggtgttcgtcacgccacaggcgcctcttgaagccattcaggcctacctggccggacattaccgcgtgccgaaacagacattatccgcggctgctgttttcaatgaccggctgtgcgtaggcatcgttgcctccgagcgggcaggggtggggaagtccctgtacgtgaaaagactccacgacaaaatgaaaatgcagctcaacgtgaaaaatgtccccttaaaaacaattcgcctgatagacccccaagtggatgagtctagagtgctcggcgcattgctgccttttctagatgcccaatatcagaaggtccccgttctatttcacctggatgtcacgagttccgtgcaaacaggcatctgggtgttcctgttcaaactcctaattctgcaatatctgatggacatcaacgggaagatgtggctgcggaacccatgtcacctgtacattgtggaaatccttgagagaaggacttccgtgccaagccgcagttccagcgccctccggacgagggtgcctcagttttccttcctggatatattccccaaggtaacatgccggcctccaaaggaggtgattgacatggaactatctgcactgcgaagcgataccgagcccggaatggacttgtgggaattttgtagtgaaacatttcaacgtccatatcagtatctgcgccgatttaaccaaaatcaagatctcgacacattccaatatcaggaaggcagcgttgaaggcactccagaggaatgtctccagcacttcctgtttcactgcggcgtgataaatccatcttggagcgagctgcgcaatttcgcgaggtttctgaactatcagctgcgagactgtgaggccagtctgttctgtaaccccagtttcatcggagatactctacgcggtttcaagaaattcgtggtcacctttatgattttcatggccagggatttcgccaccccctccctgcataccagcgaccagagtcccggaaaacacatggtgacaatggatggcgtgagggaggaggacctcgctccgttcagccttagaaaacggtgggagtctgaaccccacccctacgtcttctttaatgatgatcacactactatgaccttcataggcttccatctccagcccaacatcaatggctctgtagatgccattagtcatctgaccggcaaggtaattaaaagagacgtaatgacccgggacttataccaggggctgctccttcagcgcgtaccattcaacgtggacttcgacaagctgccacgacataagaagctggagaggctgtgtctgacattaggcatccctcaggctacagacccggataaaacatatgagcttactaccgacaacatgttaaaaatcctggcaattgagatgcgcttccggtgtggcattcccgtgattatcatgggggagactggctgtggaaagaccagactgatcaagtttctcagcgatcttcgccgaggagggacaaacgccgatacaatcaagctggtcaaagtgcacggagggacgactgctgatatgatatatagccgggttagggaggccgaaaatgtcgcatttgccaacaaggaccagcaccagctagacacaatcctgtttttcgacgaggccaataccacagaagcaattagctgtatcaaggaggtgctctgcgaccacatggtcgacgggcaacccctcgcagaggatagcggattgcacatcatagccgcatgtaatccatacaggaagcacagtgaggaaatgatctgccgcctggagagcgcagggctcgggtaccgggtgagtatggaggaaaccgccgacagactgggctccatccccctcagacaactggtgtaccgcgtccacgcactgcctccaagcctgattcccctggtgtgggatttcgggcagctgagtgacgtggctgaaaagttgtatatccagcagatcgttcaaagactcgtcgagagtatctccctcgatgaaaacggaaccagagtcatcacagaagtcctgtgcgctagccagggcttcatgcggaagacggaggatgaatgttcattcgtgagtcttcgggatgtagagcgctgcgttaaggtgttccgttggttccatgaacatagcgccatgctgttagcccaactgaacgccttcctgtctaaatcatctgtcagcaaaaatcataccgagagggatccagtcctgtggagtcttatgcttgcgattggcgtgtgctaccacgcatctcttgaaaaaaaagatagctacagaaaagccatagcacgctttttccctaaaccttacgacgactcaagactgctgctcgacgagatcactcgcgcacaggatctgttccttgatggtgtccctctgcggaagaccatcgccaagaatttggctcttaaggagaatgtgttcatgatggtagtgtgtatcgagctaaaaattcctctttttttggtgggaaagccgggaagctccaaatcattagctaaaaccattgttgccgatgccatgcagggtccagctgcttattcggatctgtttagatccctcaagcaggtgcatcttgtatcttttcagtgctcccctcactcaaccccacagggaatcatctccacgttccggcagtgcgcgcgatttcagcagggaaaggacctgcagcagtacgtgtctgtcgtggtgttggatgaagtcggactggctgaagattctcccaaaatgccgctgaagacacttcatcccctgctcgaggacggatgcattgaggatgatcctgctcctcacaaaaaagtggggtttgtggggattagtaattgggctctggacccagccaaaatgaatagaggaatttttgtgtctcggggatcacccaatgagacagagctaattgaaagcgcaaagggaatttgttcctcagatattttagtgcaggaccgcgtccaagggtactttgcgtcgttcgctaaggcctacgaaaccgtctgtaaacggcaggacaaagaattctttggactgcgcgattattactctctgattaagatggtcttcgcagcggcaaaggctagcaatcgtaaacctagcccccaggacatcgctcaggccgtcttgcgcaatttttccggcaaagacgacatccaagccctcgatatctttttggccaatttgccggaagctaaatgctccgaggaggtctcccctatgcagctgatcaagcagaacatattcggccctagccagaaggtgccagggggtgagcaggaggatgctgaatcaaggtacctgttggtcctaaccaagaactacgtcgccctgcagatacttcagcagaccttttttgaaggtgatcagcagccagagatcatctttggctccggattccctaaggaccaggagtatacacaactttgtaggaatatcaaccgagtgaagatatgcatggagacgggcaagatggtgctgctgctcaatctgcagaacctgtacgagtccctttacgacgcccttaatcaatattacgtgcacctaggcggacagaaatacgtggatctgggcctgggcacacatagagtgaaatgcagggtgcacccgaacttccgtttaattgtgattgaagagaaggatgttgtgtacaagcacttcccaattcctctcataaatcggctggaaaagcactacctcgacatcaacaccgtgctggaaaaatggcagaaatcaattgtcgaagagctgtgtgcgtgggtcgaaaagtttattaacgtgaaggcacaccacttccagaaacgccacaagtatagtccctcagacgtctttatcggatatcacagcgacgcctgcgcatctgtggtcttacaggtcatcgaaagacagggccctcgcgcattgactgaggaactccaccaaaaggtgagcgaggaagcaaagtccatccttctgaactgtgccacccccgatgcagtcgtccggctgtccgcatactccctgggaggtttcgccgcagagtggttatcccaggagtatttccatcgacaaaggcacaatagcttcgccgactttttacaggcacacctgcatacggctgatcttgagcgccatgcaatcttcaccgaaatcaccacattctcccgcctcctgacctctcacgactgcgaaattctggagtcagaagtgactggcagagcacctaaacctacgctgctatggctgcagcaatttgatactgagtactcctttcttaaagaggtgagaaactgtctcacgaataccgccaaatgcaagattctgattttccagacagacttcgaggacggtatccgctctgcccagctaattgccagcgcaaagtacagtgtgatcaacgaaatcaacaagatccgagagaatgaagaccggatctttgtatattttatcaccaagttatcaagggtgggcaggggcaccgcttacgtggggttccatgggggattgtggcagagcgtccatattgatgacctcagacggagtaccctgatggtcagtgatgtgacgcgtctccagcatgtgactatctcgcagctctttgcccctggcgacctgcccgaattgggcctggagcatcgtgcagaagatggacacgaagaggccatggaaactgaggccagcacctccggagaggtggccgaggtcgccgaggaggctatggagaccgaatctagtgagaaggttggcaaagaaacatcagagctaggaggcagcgatgtgtctatcctcgacactacccggctgttgcgatcctgcgtccagagcgcggtaggcatgctccgggatcagaacgagtcctgtacacgaaatatgcgtagagttgtgctcctgttgggactgttgaacgaagacgatgcttgccatgcaagctttctaagggtgagcaaaatgaggttgtccgtttttctcaagaagcaggaggaaagccagttccaccctctcgaatggctcgccagggaagcctgcaaccaggatgcattacaggaagccggaacattccgacacactctgtggaagcgcgtgcagggagccgtcacccccctcttggccagcatgattagctttatagatagagacgggaacctcgagctcctgacccgccctgacacccctccgtgggcgagagatctgtggatgttcattttctctgacacaatgttactgaatattccactcgtgatgaacaacgagcggcataagggagaaatggcctacattgttgttcagaatcacatgaatctgagtgaaaacgcttctaataatgtccctttcagttggaagattaaagattatctcgaggaactttgggttcaagcccagtacattactgatgccgaggggctgcctaaaaagttcgtggacatcttccagcagaccccgctgggtagattccttgctcagttgcacggggaaccgcagcaggagttactgcaatgctacctgaaggacttcattttgctcactatgcgggtctcaacagaggaggagctgaagttcttacagatggctctgtggtcctgtacgcgcaagctcaaggcagcttctgaggctccagaagaggaggtcagcttgccatgggttcacttagcatatcagcgatttagaagcaggctgcagaatttcagccggattctcacgatttatccacaggtgctgcattcactgatggaggccagatggaatcacgaactagccggttgcgagatgacattggatgcctttgccgcaatggcctgcacggagatgttgacaaggaacacgctgaagccaagcccgcaggcctggctacagttggtgaagaatctgtccatgcctctggagctgatctgctcagacgaacatatgcaggggtctggctctctcgctcaagccgtgatccgggaagttagagcgcagtggtcaaggattttctccaccgcattgttcgtggagcacgtgctgctaggaacagaaagtcgagttccggaactccagggtttggtcacagaacatgtgtttctgcttgataagtgccttcgcgagaactcagacgtcaagacccatgggcctttcgaggcagtgatgcgcactctatgcgagtgtaaagagaccgcttccaagaccctatcacgattcggaattcagccatgttctatatgtctcggtgatgcaaaggaccctgtgtgtcttccctgtgatcatgttcattgtctgcggtgtctgcgcgcatggttcgcttcagagcaaatgatctgcccttattgcctgaccgccttaccagacgaatttagccctgctgtctctcaggcccatagagaggccatcgaaaagcacgcgagattccgccagatgtgcaacagctttttcgttgatctcgtctcaaccatttgcttcaaagataacgcaccaccagagaaggaggttattgagtcactgctcagcctgctgtttgtgcaaaaagggcgtctgcgggatgccgcacagcgtcactgtgaacacacaaagagcctctctcctttcaatgacgttgtcgacaaaacgcccgtgattaggtccgtgattctcaagctgttactgaagtattccttccacgatgtgaaagattatatccaggaatacctcacattactcaagaagaaggcctttattacggaagacaaaacggaactatacatgttattcataaattgtctggaagattccatccttgaaaaaacaagcgcttattccaggaatgatgaactcaaccacctcgaggaagaggggaggttcctgaaagcttactcccctgcgtctcggggacgggaacccgcaaacgaagcttcagtggagtaccttcaggaagtagcacgaatccgtctctgcctggatagggccgcagatttcctgtccgagcccgaaggcggtccagagatggccaaggagaaacagtgttacttacagcaggttaaacagttctgcatcagggtggaaaacgattggcatagggtctacctggtcaggaaactgtcaagtcagcggggaatggagtttgtgcaaggcctgtcaaagccaggtcgaccacatcaatgggttttccccaaagacgtggtgaagcagcagggcctccggcaagatcacccaggtcagatggatagatatctggtgtacggtgatgagtacaaagccctgcgcgacgcagtggctaaagcagtcctggagtgtaaaccgttggggatcaaaaccgccttgaaggcttgcaagacaccacagagccagcaatctgcttacttcctcttgaccctgtttcgggaggttgcaatcctgtataggtcacataacgctagcttgcaccccacgccggaacagtgcgaggccgtttccaaattcatcggagagtgtaaaatcttgagcccacctgacatatctagatttgccacctccctggttgataattccgtgcctctcctgcgcgctggaccaagcgattcaaatctggacggcactgtgaccgagatggcaattcacgccgcagcagtcctcctgtgcggccagaacgagcttctggaacctttgaaaaacctggcattcagccccgctaccatggctcacgcatttctgcccaccatgcccgaagatcttcttgcccaggctcggcgttggaagggtctggaaagagtgcattggtacacctgtcctaacggacatccctgtagtgtgggggaatgtgggcgacccatggagcagagtatatgcatcgactgtcacgcgcctattggaggcatcgaccacaagccgagggatggtttccatctggtcaaggacaaagccgatagaacccagactggacacgtcctgggaaatccacagcgacgggacgtcgtcacatgcgatcgtggactgcctcccgtggtgttcctcttaataaggttgcttacgcacttggctctgcttttaggcgcatcccagtcctcccaagccctcatcaacattattaagccacccgtccgggacccaaaaggctttctccagcaacacatcctgaaagatcttgaacagctcgcgaagatgctgggacactccgctgatgaaacaattggcgtcgtacatttagtactgcgccgattgctgcaggagcagcaccagctcagctcgagaaggctgctaaatttcgatacagaactcagcaccaaagagatgaggaataactgggagaaagaaatcgccgcagtaatttcacctgagctggagcatctagacaaaacgctgccaacgatgaataaccttatcagccaagacaaaagaatctcctcaaatcctgtagctaagataatatatggcgaccccgttacgtttctgccacatcttccccgtaagagcgtcgtgcactgctccaaaatttggtcctgcagaaagagaatcacagtagagtacctacagcacatcgtggagcagaagaatggcaaggagcgcgtgccaattctttggcattttttacagaaagaggccgagttaaggcttgtgaaattccttccggagatcctggctcttcagagggatctggtgaaacagtttcaaaatgtacagcaggtggagtactccagcattaggggttttctcagcaagcattcaagcgacggtctgagacagctcctgcataatcggataacggtttttctcagcacctggaacaagttacgacggagcctggagacaaatggtgaaataaatttgcccaaggactattgtagtacggatctggatcttgacaccgaattcgaaatcctactcccaaggaggaggggtctgggcctctgcgccacggcacttgttagctacctgatccggctacataatgagatcgtgtacgccgttgagaaactgagcaaggagaataattcatactccgtcgatgcggcagaagttacagaattacatgtcatctcctacgaggtcgaacgagatctcacccccttgatcctctccaactgtcagtaccaggtcgaagagggaagagagacagtgcaggaattcgatctggagaagatccaacgacagatcgtgtctagattcttacaggggaaacccagactatctcttaagggaatcccgaccctggtttaccgccatgactggaactatgaacacctgtttatggatataaagaataagatggcccaggattctctcccctccagcgtcatcagtgccatatcgggccagctgcagtcttactctgatgcctgtgaggtgttaagcgtggtggaggtgactttaggcttcttatcaactgcgggaggcgacccaaacatgcagttaaatgtgtatacccaagatatcctgcaaatgggggaccagactatacacgtgctcaaggccctgaataggtgtcagcttaagcacactatcgccctgtggcagtttttaagcgctcacaaaagtgagcagctcctgaggctgcacaaggaaccttttggcgagatcagcagtcgttacaaagctgaccttagcccagagaatgctaagctccttagcacttttctaaaccagacaggattagatgctttccttctggaacttcatgagatgattatcctcaagttgaagaatcctcagacgcagacagaagagagattccggccacaatggtccctgagggatactctcgtctcatacatgcagacaaaggagtctgagatactaccagagatggcctcacagttccctgaggaaatcctgcttgcctcttgcgtttctgtgtggaagaccgctgcagtgctgaagtggaatagggaaatgcgataa

SEQ ID NO: 239271 - DNA, 2772 bp, Artificial Sequence
  Description of Artificial Sequence: Synthetic coding sequence
atggaggaagggaacaacaacgaagaagtgatacacttgaataactttcactgtcatcgcggacaggaatggatcaacctcagagatgggccaatcactatttccgattccagtgatgaggagcggatccctatgttagtcaccccggcaccccaacaacacgaggaagaagacctggacgacgatgtaattctcactgagacgaacaagccgcagcgcagtcggcctaatttaattaaacccgcagcgcagtggcaggatctcaagcgccttggtgaagaacggcctaagaaaagcagagctgccttcgaatccgataagagcagttacttttcagtctgcaataacccattgtttgattccggtgcgcaggacgattccgaagacgattatggcgagtttttggatctcggtccaccaggtatcagtgagttcaccaagccaagtggccagactgagcgcgagcctaagccaggcccttctcacaatcaagctgccaacgatatcgtgaatcctaggtcggaacaaaaggtgataatcttggaagagggatccttactctatactgagtctgatcctctggaaactcagaaccagtcctccgaggactctgagacggagctcctctctaatctcggtgaaagcgcagcactggcagatgaccaagctatagaggaggattgctggctggatcacccatacttccagtcactgaaccagcagcccagggagattacgaatcaggtcgtacctcaggagcggcagcctgaggcagaattggggagactcctgttccagcatgaatttcctggacctgctttccccagacctgagccccagcaaggagggataagcggcccttctagcccccaacctgcacaccccttgggggagttcgaggatcagcagctggcttcggatgacgaggagcctgggcctgctttccccatgcaggagagtcaggagcccaacctggaaaatatttggggccaggaggccgctgaggttgatcaggagctggtggagctcctcgtgaaagagacggaagccagattccctgacgtggccaacggcttcatcgaggagattatccactttaaaaactattatgacttaaacgtgctttgtaacttccttctggaaaacccagattacccgaagcgcgaggaccggattattataaatccatctagctcgctgctcgctagccaggacgaaaccaagttgcctaagattgacttctttgactattcaaagctgactccgctcgaccagcgatgtttcatccaggctgctgatttgctgatggccgatttcaaggtgctcagtagccaggatatcaaatgggcactacacgaattgaaggggcattacgccataacacgtaaagccctctcagatgcgatcaagaagtggcaagagctgagcccagaaacaagcggcaaacggaagaaaagaaaacagatgaatcagtattcttacatcgattttaagttcgagcaaggagacattaaaatcgagaagcgcatgttctttttggaaaataaaagacgccattgtaggagctacgatagacgagcactgctaccagccgttcagcaggagcaagagttttacgagcagaagattaaagagatggctgagcacgaggatttcttgctggcccttcagatgaatgaagagcagtaccagaaagatgggcagttaatcgaatgtagatgttgttacggagaatttccttttgaagaacttacacagtgcgctgatgcacacctcttttgcaaagaatgtctaatccggtatgcgcaggaagcagtgtttggaagcggaaagctggagctatcctgtatggaggggagttgtacgtgtagctttcccacgtcagaactggaaaaggtcttgccccagactatcctgtacaagtattatgagcgcaaggctgaagaagaagtggcagcggcatacgcagatgagcttgtgcgatgtccctcatgctcttttccagcgttattggactctgacgtgaagcggttttcctgcccgaatccacattgtagaaaagaaacgtgtcggaagtgccagggattgtggaaggagcataacggtctcacatgcgaggaattagcggagaaagacgacataaagtaccgcacctctatcgaagaaaagatgaccgccgcaaggattagaaagtgtcataagtgtggaactggcctcattaagtctgaaggctgtaaccggatgtcatgtagatgcggggctcagatgtgctacctgtgcagagtgtctatcaatggctacgatcacttctgtcagcacccacggagtcccggagccccatgtcaggagtgctcaagatgctctctctggaccgaccctactgaggacgatgagaagctcattgaagaaatccagaaagaggctgaggaagagcagaagcgtaaaaatggggaaaatactttcaaacgaatcggtccccctctggagaagcccgtggagaaagtgcagcgcgtggaggcactacctagacctgtccctcagaatttaccccagccccaaatgcccccatatgcattcgcacatccaccgtttcctctgccacccgtgagacccgtgtttaacaactttccattgaacatgggccctatccctgccccatatgtgccacccctacccaatgtccgagtaaattatgacttcgggccaattcatatgccgttggaacacaacctgcccatgcatttcggcccacaacctcggcatcgattttag

SEQ ID NO: 239272 - DNA, 63 bp, Artificial Sequence
  Description of Artificial Sequence: Synthetic coding sequence
atggaggaaggcaacaataatgaagaggtgatccacttgaacaattttcactgtcacagatag

SEQ ID NO: 239273 - DNA, 2601 bp, Artificial Sequence
  Description of Artificial Sequence: Synthetic coding sequence
atggaggaaggaaataacaacgaagaagtgatccacttaaataactttcactgtcaccgtgggcaagagtggattaacctgcgcgatggacctattacaatcagcgattcctcagatgaagagagaatcccaatgcttgtgacccctgccccacagcagcacgaggaagaagacctcgatgacgatgtcattctgactgaggatgatagtgaagacgattacggggaattcctcgatctgggtcctccagggatcagcgagttcaccaaaccttccggacagaccgagcgagagccaaagccaggcccaagccacaaccaggcggctaatgatatcgtgaatcctaggtcagaacagaaggtgatcatactagaggagggtagcctgctctatactgagagtgaccccctggagacacagaaccagtcctctgaggattccgagaccgagctgctctcgaacctgggagagtccgccgcactagcagacgatcaggccatcgaagaggactgctggttggaccacccctactttcagtcgctgaatcagcaacctcgggagatcactaaccaagtcgtcccgcaggagcggcaacccgaggcagaactcggacggttactgtttcagcacgagttccccggacccgcttttcctagaccggagccgcagcagggcggaatttccggaccatcctcacctcagcctgctcaccctctaggtgagtttgaagatcaacaactggcgtcggatgatgaagaaccgggaccggcttttcccatgcaggagtcccaggaaccgaatttggaaaatatctggggtcaggaggccgctgaagtggaccaggagctggtggagctcctggtgaaggagacagaggcgaggtttcctgacgtggctaacggatttattgaggagattattcatttcaaaaactactacgacttaaatgtgctctgcaatttcttgctcgagaaccctgattacccgaagcgagaggacaggattataattaacccaagctcttcattacttgctagccaagacgaaacaaaactcccaaagatagacttttttgactatagcaagcttacccccctggaccagcgctgcttcatccaggccgctgatttactgatggcggactttaaggttctctcttctcaggacatcaagtgggctttgcatgagctaaaagggcattacgcgatcactcgcaaggcactctctgatgccatcaaaaaatggcaagaactatctcccgaaacttccggaaagagaaagaagcgaaagcagatgaatcagtattcatacatagactttaaattcgaacagggcgatatcaaaattgagaaacggatgttctttttggagaacaaaaggcgacactgtcgatcatacgaccgcagagcccttttgccagcagtccaacaggaacaagaattttatgaacagaagatcaaggaaatggctgaacacgaggactttttgcttgccttacagatgaacgaagaacagtaccagaaggacgggcagctgattgaatgccggtgctgttatggtgagtttccattcgaggaattgactcagtgcgctgatgcacacctgttttgcaaggagtgcctgatcagatatgcccaggaggcggtgttcggctcagggaaactagagctcagttgcatggaagggtcctgtacttgcagtttcccgacaagcgagcttgagaaggttttgccccagactattctttataagtattatgagcgtaaggcagaggaggaggtcgccgctgcctatgctgacgagctcgtccggtgccccagttgctcttttccagcgctcttggatagcgatgtcaagcgattctcttgtcctaatcctcattgtcgaaaggagacttgcagaaagtgtcagggcctgtggaaagaacacaacgggctcacatgtgaagaactcgctgaaaaagacgatatcaaataccgcacctctatcgaagagaaaatgacagctgcgaggatccggaagtgccacaaatgcggcacaggactaataaagagtgagggttgtaaccggatgagttgtaggtgcggcgcacagatgtgttatctgtgcagggtctccattaatggatacgaccacttttgtcagcatcctcggtcccctggggctccatgtcaagagtgttctcggtgctctctttggaccgatcctactgaggacgacgagaagcttattgaagaaattcaaaaggaggctgaagaagagcagaagagaaagaacggcgaaaacactttcaagagaatcggcccaccgcttgaaaaacctgtggagaaggttcagcgcgtggaagctctgcctcgacctgtaccacaaaacctcccacagccccagatgcctccctacgcttttgctcaccccccttttcctcttccacctgtgagacctgtgtttaataatttcccgttaaacatggggcctatcccagccccttacgtgcctcctttgcccaacgtcagagttaactacgacttcggcccaatccacatgccactcgaacacaatctgcccatgcattttgggcctcagcctcgtcacagattctag

SEQ ID NO: 239274 - DNA, 2037 bp, Artificial Sequence
  Description of Artificial Sequence: Synthetic coding sequence
atggaggagggcaacaataacgaggaggtcatacatctcaataacttccactgtcacagaggacaggagtggatcaaccttagggatggccctattactatttcggacagttctgacgaggaacgcatcccaatgctcgtgacgcctgctccacaacagcatgaggaagaggatcttgacgacgatgtgatactcacagaaaccaataagcctcaacgaagtagaccaaatttgattaaacctgccgctcagtggcaggaggcagctgaagtggaccaggaactggtagagctgctggttaaagagacagaggccagattccccgacgtagccaatggattcattgaagagattattcacttcaagaactactacgaccttaatgttctgtgcaatttcctactagaaaaccccgactacccgaagagagaggataggattattatcaatccttccagcagcctcctcgcaagccaggacgaaactaaactccccaagatagattttttcgattattcaaagctgacgcctttagatcaaagatgcttcattcaagctgccgacctcttgatggcggacttcaaggtcctgtcgtcccaggacattaagtgggcattgcatgaactcaagggccattacgccatcacacggaaagccctgtccgacgccattaaaaagtggcaagagctgtcccctgaaacttcagggaagcggaagaagcgcaagcagatgaatcagtatagttacatcgatttcaaattcgagcagggcgacataaaaatcgaaaaacgaatgttcttcctcgagaataaacgacgacactgccggagttatgataggcgcgctctgttgccagccgtacagcaagaacaggagttttacgaacagaagataaaggaaatggccgaacatgaggactttttacttgccctacagatgaacgaagaacagtaccagaaagacggccagctaatcgagtgtcggtgttgttacggagaattcccctttgaagagctcacccagtgcgctgacgcacacctgttttgtaaggagtgtctgatcaggtatgcccaggaagcagtttttggttctggtaagctggaactctcatgtatggaggggagctgcacttgttcctttcccactagtgagctagagaaggttcttccgcagactatactctataagtactatgagaggaaagccgaagaagaggttgccgctgcatatgctgacgagctagtcaggtgtcccagctgttccttccctgctctactggatagcgatgtcaagcggtttagctgcccaaatccccactgccgtaaggagacctgtaggaaatgccagggcctgtggaaagagcacaatggcctgacgtgtgaagaactcgctgaaaaggatgacataaaatatcgtacctccatagaggagaaaatgactgccgctaggattcgtaaatgtcataagtgtggaactggcctgatcaagagtgaggggtgcaaccgtatgtcctgccggtgtggcgctcaaatgtgctacctgtgtagggtctcaataaatggctatgaccatttttgtcagcatccacgctcccccggtgctccatgtcaagagtgttccaggtgcagtctgtggaccgacccaaccgaagacgatgagaagctgatcgaggagatccaaaaagaggcagaggaagaacaaaagagaaagaatggagagaacactttcaagcggataggaccacctttagaaaaaccggtcgagaaagtgcagagggtggaggctctcccccgacctgtgccccaaaacctgcctcagccacagatgcctccctacgcatttgctcatccgccttttcccctacctccagtacggccagttttcaataacttcccattgaacatgggcccaattcccgctccgtatgtacctcctctgcctaacgttagggtcaattacgattttggcccaatccatatgcctctggagcataacctgccaatgcacttcggcccacagccccgacatcggttttag

SEQ ID NO: 239275 - DNA, 447 bp, Artificial Sequence
  Description of Artificial Sequence: Synthetic coding sequence
atgtcatcggacttccctcattacaattttaggatgcccaacattggttttcagaacctcccactcaatatatacatcgtggtgtttgggactgcaattttcgtatttatcctctctttgcttttctgttgctatttgataagactccgacatcaggcacacaaggagttctatgcttacaagcaggttatcctaaaggagaaagtcaaggagctgaacctccacgagctctgcgcagtatgcttagaagactttaaacctcgcgatgaactcggaatttgcccatgtaaacacgcctttcatcgtaagtgtctcatcaagtggctcgaggtcagaaaggtttgccctctttgcaacatgccagtcttgcaattagcccagctacactctaagcaagaccgcggtcctccgcaggggcctctgccaggcgcagagaatattgtgtag

SEQ ID NO: 239276 - DNA, 447 bp, Artificial Sequence
  Description of Artificial Sequence: Synthetic coding sequence
atgagctctgatttcccacattacaacttccgcatgcctaatatcggttttcagaatcttcccctaaacatttacatagtcgtctttgggactgcaatcttcgtgtttattctttccttgttgttctgctgttatcttattagacttcggcaccaagctcacaaggagttctacgcttacaaacaagtaatacttaaagagaaggtgaaggagttaaacctgcacgaactctgtgcggtctgcctggaggactttaaaccccgagacgaactggggatttgcccatgtaagcacgccttccaccggaagtgcctcatcaagtggctggaggtccgcaaagtgtgcccactgtgtaatatgccagtattgcagttagcacagttgcatagcaaacaggacagagggcctcctcagggccctctccccggagcagaaaatatcgtctag

SEQ ID NO: 239277 - DNA, 510 bp, Artificial Sequence
  Description of Artificial Sequence: Synthetic coding sequence
atgctgaacaaatccggtgaatccagatatcccgcattattccccgtgcttgggggatcttcaatgtcctctgacttcccgcactacaattttcgcatgcccaacatagggtttcaaaatctgcccctcaacatctatattgtcgtctttggtactgccatttttgtctttatcctgtcgctcttattctgctgctacctgatccgtctgagacaccaggcccataaagaattttatgcctacaagcaagtgatcctgaaggaaaaggtcaaggagttgaacctgcatgagctttgtgctgtgtgccttgaggattttaaacccagggacgagttaggcatttgcccgtgcaagcacgcttttcatcgaaagtgtttaattaaatggctggaagtgcgcaaggtgtgtccgctgtgcaatatgcctgtccttcagctggcacaactccacagcaagcaagacagagggccaccacagggccctctgccaggtgcggaaaatattgtatag

SEQ ID NO: 239278 - DNA, 510 bp, Artificial Sequence
  Description of Artificial Sequence: Synthetic coding sequence
atgctcaacaagtcgggggaatcgcgctaccccgcacttttccccgtcctcggaggttccagcatgtcatccgacttccctcattacaactttcgcatgccgaatatcggcttccaaaacttgccgctgaatatctatatcgtggtgtttggaacggcaatctttgtgtttattctttcattgctgttttgctgctacctcattcgcctgcggcatcaggcccataaggagttctatgcctacaagcaggtcatcctgaaggaaaaggttaaggaactcaaccttcacgagctttgcgctgtatgtctggaagattttaagcctcgggacgaactcggcatttgcccctgcaaacacgctttccaccgaaaatgtctgattaagtggttagaggttcgcaaggtatgccccctatgcaacatgcccgtgctgcaactcgcccaattacactccaagcaggaccgaggaccccctcagggccctctcccaggcgcagagaacatcgtgtag

SEQ ID NO: 239279 - DNA, 1302 bp, Artificial Sequence
  Description of Artificial Sequence: Synthetic coding sequence
atggaggccgtttatctggtcgtgaacgggctcggactggtgcttgacgtcctcacgctcgtcctggaccttaactttctcctggtcagtagccttctcgcctccctggcttggttgctggcctttgtttacaatctcccccataccgtcctgaccagcttgttgcatctcggccgtggggtgttgctgtcattgttagcgttaattgaagccgtggtaaggtttacttgtggaggcttgcaagcactttgcactctcctatactcttgttgctctggtcttgagtcattgaaactgctcgggcaccttgccagccacggggctttacgcagccgagagattctgcatcgcggagtcctgaacgttgtttcgtctgggcacgcgctacttaggcaggcttgtgacatctgtgcaatcgccatgagcttagtggcgtatgtaatcaatagccttgtgaacatctgtctcattgggacacaaaacttgttctccctcgttttggccctatgggacgcggttaccggtcctctctggaggatgacggacgtcgttgccgcttttctggctcacatttcttcaagcgccgtggcaatggctattctcctctggacaccctgtcagctggcacttgagttgctggcgagcgctgccaggctcctcgcctcttttgtcttagttaacttaacggggctcgtgctcttggcatgtgtgctggccgtaaccgtaacagtcctacacccagacttcacccttagactggcaacacaggctcttagccagctgcacgctaggccctcctatcaccgactccgggaggatgtcatgcgcctgtctcggctggccctgggttccgaggcttggagacgcgtgtggtcacggagtctacagctggccagctggccgaaccgaggtggcgctcccggagctccccagggagatcccatgagggtgttttcagtgagaacccgcaggcaggacactcttccggaagcgggaaggcggtccgaggctgaagaagaagaggcgaggactatcagagttacccccgtccgcggacgtgagcgactgaacgaagaggaacctcctggtggacaagacccttggaagctcctgaaagaacaagaggagaggaagaaatgtgtcatctgccaagatcagtcaaaaacagtgctgctgcttccctgcagacatttgtgtctgtgccaggcctgcacggaaatattaatgcgccatccagtgtaccacagaaactgtcctctctgtaggcggggtatcctccaaactctgaacgtttatttgtag

SEQ ID NO: 239280 - DNA, 3219 bp, Artificial Sequence
  Description of Artificial Sequence: Synthetic coding sequence
atgcctggagaggaagaggagcgggcttttcttgtggccagagaggaactggcctcggcccttcggcgagatagcggccaggccttttctttggagcagctgcgtccactgctggcctccagcctgccactggcagcacgatacctacagctcgatgctgcacgtcttgtacgctgcaacgcccatggggaaccacggaactatctcaatactctgagcactgccttaaatatcctagagaaatatggtaggaacctactcagcccccagcgacctagatactggcgcggagttaagttcaacaacccagtgtttaggtctacagttgatgctgtccaagggggacgagacgtgctcagactctatggctatacggaagagcagccagatggactaagtttccctgagggtcaggaagagccggatgaacaccaggtggctacggtgaccctggaggtgctcctcctgcggactgagctgtcactgctcctccagaatacccatccgcgacagcaagccctggagcagttactggaagataaagtggaggatgacatgctacagctttcggagttcgatcccctgctcagagaaattgcacccggacccctgacaacaccttccgtgccaggtagcacccctggaccatgtttcctttgcggcagcgctccaggaactctgcattgcccatcctgcaaacaggctctctgtcctgcctgtgaccacctgttccacggacaccccagccgagcacatcacctgcgtcagaccctgcctggggtgctacaagggacacacctgtccccctcgttaccggcatcagctcagcctaggccacaaagtacttctctcttagctctgggtgattctagcctcagttcccccaatcccgcttcggcccacctgccatggcattgtgcggcttgtgcaatgttgaacgaaccttgggccgtgctgtgtgtcgcctgcgacaggcccagaggatgcaaagggttgggcttaggaactgaaggcccacaaggcactggaggtctggaaccagatttagcccgtgggagatgggcatgccagtcgtgtacattcgagaatgaggcagctgccgtcctctgctctatatgcgagaggcctaggctagcacaaccacctagcttggtcgtggacagtcgagacgctgggatttgtctccaaccccttcagcagggtgatgcattacttgccagcgcccagagccaggtatggtattgcatccactgtacgttttgcaactcaagtccaggatgggtgtgcgtgatgtgtaatcgaacgtcctcccccattccagcccagcacgccccacgcccttatgcaagttcccttgagaaggggcctcctaaaccaggccctcccagacggctgtccgcgccactcccgtcaagttgcggcgaccccgaaaaacagcgtcaagacaaaatgcgagaggaggggctgcagctcgtgagcatgatcagggagggagaggccgcaggcgcatgccccgaggagatctttagcgcacttcagtatagcggcaccgaggtgcctttacagtggttgaggtctgagcttccttacgtccttgaaatggttgccgaactggcaggccagcaggacccaggcctgggggcattttcttgccaggaagccagaagagcttggcttgatcgacacggaaatcttgatgaggcggtggaggagtgcgtccgaacaaggcgcaggaaagttcaggagctgcagagtttagggttcggaccggaagaaggcagtcttcaggcccttttccagcatggaggtgatgtctctcgcgctttaacagagctgcaacgacagagattggaacctttccggcaacgtctgtgggacagcggaccggagcccactccatcttgggatggcccagacaagcagtctctggttcgacgacttttggccgtgtacgccttaccttcctggggacgggctgagctggccctgtctctgctgcaagaaacccccagaaattacgagctaggagacgtggtcgaggcagtgcgccattctcaagaccgagcctttttgagaagactcctggctcaggaatgcgcagtgtgcggctgggcattgcctcataaccgaatgcaggccctcactagttgcgagtgcaccatctgccccgattgtttccgacagcatttcaccatcgccctgaaagagaaacacattactgacatggtctgcccggcatgcggtagaccggatctgacggatgatacccagttattgtcctattttagcactttggacatccagctccgcgaatcactggagccagacgcgtacgccctattccacaagaaacttactgaaggagttctcatgcgcgatcctaagttcctgtggtgcgctcagtgcagcttcggcttcatctatgagagggagcagttggaggccacctgtccacagtgtcatcagacattctgtgtgcgctgcaagcggcagtgggaagagcagcaccggggtcgcagctgcgaggattttcagaactggaagaggatgaacgacccagaatatcaggcgcaaggacttgcgatgtatctgcaggaaaacggaattgattgtcccaagtgcaaattttcatacgccctggccaggggagggtgtatgcacttccactgtacacaatgtcgccatcagttttgttccgggtgttataacgccttttatgccaaaaacaagtgccccgagccgaattgcagagttaagaagtccttacatggtcatcatcccagggattgcctgttttacttaagggactggactgccctgcgtctgcagaagttactgcaagacaataatgtgatgtttaatactgaaccccctgcaggcgcaagggccgtccctggtgggggatgcagggtgatcgaacagaaggaagtgccgaatggcttgagggatgaggcatgcggaaaggagacccctgctggctatgcaggtctctgccaggcacactacaaggaatacctcgtgtctctcatcaacgcccattcccttgacccagccacactctacgaagtggaggaattggaaactgccacagaaagatacctccacgttagaccacagcctttagcaggggaagacccacccgcttaccaggctaggctcttgcagaaactcactgaggaagtgccattaggccagagcattcctcgcaggcgcaagtag

SEQ ID NO: 239281 - DNA, 1518 bp, Artificial Sequence
  Description of Artificial Sequence: Synthetic coding sequence
atgcccggtgaggaggaggagcgcgcatttctggtggctagggaggagctggcatccgctctgaggcgtgactctggtcaggctttttcacttgagcagttgcgtccactgctggcctcctccctgccactagccgcaaggtatcttcagctggacgcggcaagactggtaaggtgcaatgcccacggcgagccacggaactatctgaacacgctaccaaccccctcatgggacggccctgacaaacagtctttagtccggagactcttggcggtgtacgccctcccaagctggggaagagccgagttggctctgagcctgttgcaggaaactccacggaactatgaactgggcgacgtcgtggaggcagttagacactctcaggacagagcatttctccgaaggttgctggctcaggagtgcgctgtctgcggctgggctctgccacataatcgcatgcaggcactcacatcgtgcgagtgcactatctgtccagattgcttccgccaacattttacaattgcgctcaaggaaaaacacatcacagacatggtatgccctgcctgtggtaggccagatcttaccgatgacactcagctgctgtcatatttttcgaccttagatattcaattgagagagagtctggagccagacgcgtatgctctgtttcataaaaaactcacggaaggggtcttgatgagggacccgaaatttctctggtgtgcccagtgctcttttggcttcatctacgagcgggaacagctcgaggctacatgcccacagtgccaccagacgttctgcgtgagatgtaaacgccagtgcgaggactttcagaattggaagcggatgaatgaccccgagtaccaagcccagggattggctatgtatttgcaggaaaatggcatcgactgtcccaaatgcaaattctcatacgctctggcccgaggaggctgtatgcatttccactgcacccagtgccggcaccagttctgttcagggtgttataacgccttttatgctaaaaacaaatgccctgaacctaattgccgggtgaaaaagtcgcttcacggtcaccaccccagagactgtctcttctatttaagagattggaccgcactgagactgcagaagcttttacaggataacaacgtgatgtttaacactgagccaccggctggggcacgggctgtacctggcggaggatgcagagtaatcgagcagaaagaagtcccaaacggcttgcgagacgaagcttgtggaaaggaaacccccgcaggatatgccggtctgtgtcaggcgcactataaagagtacctcgtttctctaattaacgctcactccctggatcccgctacgttatatgaagtagaggaactggaaaccgctacagagagatacctccacgtgcgacctcagcccttagcaggggaggaccctccagcctaccaagcgaggctcctgcagaagctcaccgaggaggtccctttgggccagtcaatccctcggagacgcaagtag

SEQ ID NO: 239282 - DNA, 2766 bp, Artificial Sequence
  Description of Artificial Sequence: Synthetic coding sequence
atggacctatgtacccgagcaggggaaccctccttgacccagaacacacatcctcggcagcaggcgctcgaacaattgcttgaggataaggttgaagatgacatgttgcagctctctgagtttgacccattactgagggagatagcacctgggccattaacgacgccctccgtccctggcagcacgcctggcccatgcttcctctgcggctccgccccagggaccctgcattgcccaagctgcaaacaggccctctgtcccgcttgcgaccacctttttcatgggcatccctctcgtgcgcatcaccttcggcaaacgctgccaggtgtcctgcaaggaacccatctttctccctcactccccgcatctgcccagccccgtccacaaagtacctcattactggctctaggcgactcttcccttagctcacctaaccccgctagtgcgcatctcccttggcactgcgcggcatgcgccatgctgaatgagccatgggccgtcctgtgcgtggcatgtgatagaccacgcggatgcaaggggttagggctgggcaccgaggggcctcaagggacaggcggtttagaacctgatctggcacgaggtcgatgggcttgtcagtcatgcaccttcgaaaatgaggctgctgccgtgttatgtagtatatgtgagagaccaaggctggctcaaccccctagcctggtagttgattccagagacgctggaatctgcttgcaaccactccagcagggcgatgccctgctggcaagcgctcaaagtcaggtttggtactgtattcactgcaccttttgcaatagcagcccaggctgggtttgcgtgatgtgcaataggacatcatctccgattccagctcagcatgcccctaggccttatgctagttctctggagaagggacccccaaagcccggtcctcccagaaggctgagtgcccctctccctagtagctgcggtgatcccgagaagcagcggcaggataagatgcgtgaagaagggctgcagctcgttagtatgattcgcgagggggaggctgccggagcttgtccagaggaaatattctctgccctgcagtacagcgggacggaggtgccacttcaatggctacgtagcgagctcccctacgtgctcgaaatggtagctgagcttgcaggacagcaggacccgggactgggcgcttttagctgtcaagaagcgagacgcgcatggctggacaggcacggcaacctagacgaagccgtggaagaatgcgtgagaacacgacgtagaaaggtgcaggaactgcagtccctcggcttcggccctgaggagggcagcctgcaggcgctattccagcatggcggtgatgtctcgagggccttgacggaactacagcgccagcggctggagccatttagacagcgcctgtgggactctggaccggaacctaccccctcttgggacgggcctgataaacagtccttggtgcgtagactactcgctgtctacgccttgccgtcttggggcagggctgaactcgctctttcgttgcttcaggagaccccccgaaactatgagcttggagacgtcgtggaagcagtgcggcattcccaggacagggcattcctgcgcagactgcttgcacaggaatgcgccgtttgtggctgggcactcccccacaataggatgcaggcgctcaccagttgtgagtgcaccatctgccctgactgtttccgccagcatttcactatcgccctgaaagaaaagcatatcacggacatggtctgtccagcgtgtggaagaccagatttgactgatgacacacaactcctcagctacttttcgacactggacattcagttgcgagaaagtctcgagcccgacgcctatgccctgttccataagaaactcactgaaggtgttctgatgagagacccaaaattcttgtggtgcgcccagtgttctttcgggtttatctacgagagagagcagttggaggcaacctgtcctcagtgtcatcagaccttttgcgtgaggtgcaagagacagtgggaggagcagcataggggcagaagctgcgaagactttcagaactggaaaaggatgaatgaccctgagtaccaggcccagggactggccatgtacttacaggaaaatggtatcgattgccctaaatgcaaattttcttatgctttagccagaggaggatgtatgcactttcattgcacccagtgccggcatcagttttgcagtggatgttacaacgctttttacgcgaagaataagtgtccagaaccgaattgcagggtgaaaaaatctcttcacggacaccatccccgagattgcctgttttacttgcgcgattggacagcgctgcgactccagaagctgctccaggacaacaatgtgatgttcaatacagaaccgccagcgggtgcacgcgcagtaccgggaggcggatgcagggttatcgagcagaaggaagtgccaaacgggctccgggatgaagcatgcggaaaggaaacccctgccggttacgccggactatgccaggctcattacaaggaatacctggtgtccctcattaatgcccacagcctagaccccgctactctgtacgaagtcgaggagttggaaactgccaccgaacgctacctccacgttagaccgcaacctctcgccggagaagatccccctgcctatcaggcccgactgctgcagaaactcaccgaagaggtgcccttgggacagtcaatccctagaagacgcaaatag

SEQ ID NO: 239283 - DNA, 513 bp, Artificial Sequence
  Description of Artificial Sequence: Synthetic coding sequence
atgcccggagaagaggaggagcgggctttcctcgttgcaagggaggaactggcatcagccctgcgacgggattcagggcaggcgttcagcctcgagcagctccggccactgctggcctcctccctgcccctcgctgcaaggtatttacagctggacgcagcgaggctggtgcgatgtaatgcacacggcgaaccccgaaactatcttaacactctgtctacagcattaaatattctggaaaaatacggacggaacctacttagtccgcaacgacccaggtattggcggggtgttaaattcaacaaccctgtgtttaggtccacagtcgacgccgtgcagggcggtcgcgatgtgcttcgcctatatggctataccgaggaacagcctgacggactaagctttcccgaggggcaggaagagcccgatgagcatcaggtggcaaccgtcactcttgaggtgctgcttcttcggaccgagcttagccttctccttcaaaatactcaccctaggtag

SEQ ID NO: 239284 - DNA, 171 bp, Artificial Sequence
  Description of Artificial Sequence: Synthetic coding sequence
atgcccggagaggaggaggaacgtgcatttctggtggccagagaggagctcgcctctgctctccggagagatagcggtcaggcttttagcctagagcaacttaggcctctacttgcctcttccttgccattagccgctcggtatctgcagttagatgcggctaggctgtag

SEQ ID NO: 239285 - DNA, 1122 bp, Artificial Sequence
  Description of Artificial Sequence: Synthetic coding sequence
atgcgcaaggcaggggcaacatcaatgtgggccagttgttgcgggcttttaaatgaagtcatgggcacgggcgctgtgcgcggacaacagagtgcctttgcaggagctacagggccttttagattcacacctaatcctgagtttagcacatatccacccgcagctaccgaaggaccgaacatcgtatgtaaagcatgtgggttgagcttctcggtcttccgtaaaaagcacgtctgctgcgactgcaagaaagacttctgtagtgtgtgttcagtgttgcaggaaaacctgaggaggtgtagtacctgtcatcttcttcaagagacggcctttcagcgaccacaactgatgcggttgaaagtaaaggatctgaggcagtaccttattctgaggaacattcctatcgatacttgtcgggagaaggaagacctcgttgatctcgtgctgtgtcatcacggcctaggatcagaggacgatatggacacttcatctctcaatagcagtaggtctcaaacatcaagcttctttactagatccttcttcagtaactatacggcgcctagtgcaaccatgtcgagctttcagggggaacttatggatggcgatcaaacttctcggtccggagtaccagctcaggttcagtctgaaattaccagtgcaaatacggaggatgacgacgacgacgacgacgaggacgatgatgatgaggaggaaaacgcagaggatcgaaatcccggtctgtccaaggagagggtccgagcgtccttgtctgacctcagttcactggacgacgtagagggcatgtccgtcaggcagcttaaggaaatcctcgcccgtaactttgtgaactactccggttgttgtgagaagtgggagctagtcgagaaggtgaacagactgtataaggaaaacgaagaaaaccaaaaatcatatggcgaacggttacagctccaggatgaggaagatgacagtctctgtaggatttgtatggacgctgtgatcgattgtgtattgctcgagtgtggccatatggtaacctgcaccaagtgcggcaagagaatgtcagagtgcccaatctgcaggcagtatgtggtgcgtgcggtccatgtattcaaaagctag

SEQ ID NO: 239286 - DNA, 1119 bp, Artificial Sequence
  Description of Artificial Sequence: Synthetic coding sequence
atgaaagccggagctacatccatgtgggcttcctgctgcgggctgttaaatgaggtgatgggcaccggcgcagtaaggggccagcaatcggctttcgctggggctactggacccttcagatttactcctaatccagagttcagtacatatcctcctgcagctacagagggcccaaacatcgtctgcaaagcctgtggtctatccttctctgtattccgcaaaaaacacgtctgctgcgactgcaaaaaagacttctgtagtgtgtgctcagtactccaagagaacctgcgacggtgtagcacatgccaccttttacaagagaccgcttttcagagaccacagcttatgcgcctaaaggttaaagatttgcggcagtacctgattctgaggaacatccccattgatacttgtagggagaaggaggacctagttgacctggtgctttgtcatcatggcctgggttcagaagatgatatggacactagttctctgaattcatcccgaagtcagacctcatcattctttacaagatcttttttctccaattatactgcccctagtgctaccatgtctagctttcagggcgaactgatggatggggaccagacgagccggtcgggagtgcctgcccaggtgcagagcgagatcacttctgcgaatacagaggacgacgacgacgatgatgacgaggatgacgacgatgaagaagaaaatgctgaggatagaaatcctggcctatccaaggaaagagtcagagccagtcttagcgatctctcaagtctggatgacgtcgagggtatgtccgtcagacaactgaaagaaatcctggcacgaaactttgtgaactacagcggctgctgtgaaaaatgggaactcgtcgaaaaggtgaatagactgtacaaggagaacgaggaaaaccaaaagtcatacggtgagcggctccagctccaggatgaggaggatgatagcctctgtcgtatttgcatggatgcagtgattgattgtgtcctgcttgaatgtggccatatggtgacatgcacaaaatgcgggaagagaatgagtgaatgcccgatctgtcggcagtatgtcgtgagagcagtgcatgtgtttaaatcctag

SEQ ID NO: 239287 - DNA, 1122 bp, Artificial Sequence
  Description of Artificial Sequence: Synthetic coding sequence
atgaggaaggccggtgccacatccatgtgggccagctgctgtgggctgctcaacgaggtcatgggcacaggagcagtgaggggtcagcagtccgccttcgccggtgccacgggccctttccggtttacaccaaaccctgagttttctacataccccccagcggcaacagaaggccctaacatcgtctgcaaggcctgcgggctctcctttagcgtctttcggaaaaagcatgtctgttgtgactgtaaaaaagacttttgttccgtgtgttcagtgctgcaggaaaacctgaggcgttgcagtacttgccacctcctgcaagaaacagcctttcaacgaccgcaactcatgcgcctgaaggtcaaagacttaagacagtacttgatcctgcggaacattcccattgacacgtgcagggaaaaagaggatttagttgacttggttttgtgccatcatggattgggctctgaggacgacatggacacaagttcccttaactccagcagatcccagacatcatcctttttcacacgtagtttttttagcaattataccgcaccatctgcgaccatgtcatctttccaaggagaactcatggatggggaccagacatcccggtcaggtgtgccagcgcaagtccagtccgagattacttccgccaatacggaggacgatgatgatgatgacgacgaagatgatgacgacgaagaggagaatgccgaggacagaaacccgggattgagtaaagaaagagtgcgagcctcactgtctgacttatcttcactcgacgatgtcgaaggaatgtctgtcagacagctcaaagagatcctggctagaaatttcgtaaactatagtgggtgttgtgagaagtgggaacttgtggagaaagtgaacaggctgtacaaagagaatgaggagaaccagaagagctacggagagcggctccagttacaggacgaggaggatgattcactatgccgtatttgtatggacgccgtgatcgactgtgtgctgctggagtgcgggcacatggtgacttgtaccaagtgtggtaagcgtatgagtgaatgccccatctgtcgacaatacgtggtgagggctgtccacgtttttaagtcctag

SEQ ID NO: 239288 - DNA, 1548 bp, Artificial Sequence
  Description of Artificial Sequence: Synthetic coding sequence
atggcatgcaaaatctcgccaggcgcaaacagcgcctcgctgcccggacaccccaataaggtgatctgcgagcgtgtgcgccttcagagcctttttccgctgttgccaagcgaccaaaacacgactgttcaggaggatgctcacttcaaggctttcttccagtcggaggactctccatcccctaagagacagaggctgagccatagcgtgttcgattacacttccgcaagcccggctccctctcccccaatgaggccatgggagatgacatctaacaggcagccaccctctgtccgcccatcccaacatcacttctccggggagcgttgtaatacccccgctaggaaccggaggtcccctccagtgagaaggcagcgcggaaggcgcgacagattgtcgcgtcataactccattagtcaggacgagaattatcaccacttgccgtatgcccagcagcaggcaattgaggagccacgagcttttcatcccccaaacgtttcccccagactgctgcaccccgcagctcacccaccgcaacaaaatgccgtgatggtagacatccatgatcaactgcatcaaggcaccgtccccgtctcttacactgtcacaaccgtggcccctcacgggattcctctctgtacaggccaacatatccctgcttgctccactcagcaagtgcctggttgctcagtggttttttcagggcaacacctcccagtgtgctcagttcctccacccatgcttcaagcctgttcggttcagcacctgcctgtaccctacgccgcattcccccctctcatatcatcagatcccttcctcatccacccaccccacctcagtcctcatcaccctcctcatctgccacctcccggacagtttgtcccatttcagacacagcagtcaagatccccactgcagcggattgagaatgaggtcgaactgctgggcgagcatctgccagtgggagggttcacctacccgccttcagcccatcccccaaccctgccgccaagtgcccctttacagttcctcacccatgatccactgcatcaggaagtttctttcggggttccttaccccccttttatgccccgaagattaacagggcgatctcggtatcggagtcaacaacccattccacccccaccttaccacccttctttgctcccttacgtcttatccatgcttccagtaccaccagctgtgggtcctacattcagctttgagttagatgtggaggacggggaggttgaaaactatgaagccctgttgaacctggctgaacgcctgggagaggcaaaacctcgcggattgacaaaggcagatatcgagcagcttccttcatacagatttaaccccaacaatcatcagtctgaacagaccctgtgcgtggtgtgtatgtgcgactttgaatcccgacagcttctcagggtgttaccttgtaaccatgagttccacgcaaagtgcgttgacaagtggctcaaggcgaatcgcacatgccctatatgccgtgccgatgcttcagaggttcacagggacagcgagtag

SEQ ID NO: 239289 - DNA, 1299 bp, Artificial Sequence
  Description of Artificial Sequence: Synthetic coding sequence
atgcgcccttgggaaatgacctctaatagacagccaccttcagtgcgcccttctcaacaccacttttccggagagcgttgcaatacaccggctcggaacagacggtcacctcccgtgcgaagacagcgaggcagaagagatcgtctgagccgacataactccatttcacaggatgagaactaccaccacttaccatacgcccaacagcaggcaattgaagagcccagagcctttcatcccccaaatgtgtcacccagactgctccatccagctgcccacccccctcaacaaaacgctgtgatggttgacatccacgaccagctccaccaggggaccgtccctgtgtcatatacagtaaccaccgtggctccacacggtattcccctgtgtacaggccagcacatccctgcttgcagcacgcagcaggttcctggatgcagcgtcgtcttctccgggcagcacctacctgtgtgtagtgtgcctcctccaatgctgcaggcatgttccgtgcagcatctgcccgtaccttatgcggctttcccccctctcatttccagcgatccgtttcttatacacccgccacatttgtccccacaccaccctccacatttgccaccccctggacagttcgtaccgttccagacccaacagagccggagcccacttcaacgcatagaaaatgaagttgaactgttgggagagcacctacctgttgggggattcacataccccccatcggcacaccctcccaccctgccaccttcggcaccgctccagtttcttacacatgatccattacaccaagaagtcagttttggcgtgccctaccctccattcatgccacgtagattaacaggacgctctcgttacagatcacagcagcctatccctcctcctccataccacccttcattgctaccatatgtcctttctatgctacccgtcccccctgcagtggggcctaccttctcattcgaattagatgttgaggacggcgaggtggaaaactatgaagccttgctgaatctggcagaacggctgggcgaagctaaaccacgcggacttaccaaagccgatatcgagcagctgccctcctatagattcaaccccaacaaccatcaaagcgaacagacactatgtgttgtctgcatgtgtgatttcgagagccggcagctgctacgtgtgctcccttgtaaccacgaattccatgctaagtgcgtggacaaatggctaaaagctaacaggacatgtcctatttgcagagctgacgccagcgaagttcatagagacagcgagtag

SEQ ID NO: 239290 - DNA, 1398 bp, Artificial Sequence
  Description of Artificial Sequence: Synthetic coding sequence
atggcctgcaagtccgaggactcccctagcccgaagcggcagagactgtcccacagcgtgttcgactatacaagcgctagtcccgctccttcccctcctatgcgcccttgggagatgacatccaacaggcaaccaccatccgtgcggcctagtcaacaccatttctcgggtgagcgttgcaatactccagcacgcaataggcggtcgcccccagttcggaggcagagagggagaagggataggttgagcagacataattctatatcacaggatgagaattatcatcatctcccttatgcacaacagcaggctatcgaggagcctcgagccttccatcctccgaatgtatctccgagattattacaccctgcggcacatcctcctcaacagaacgctgtgatggtggacatccatgatcagctccatcaaggtaccgtcccagtgtcctacactgttactaccgttgcccctcacggaatccctctgtgcacaggccaacacatcccagcttgctcaacacagcaggtacccggatgctccgttgtcttctccggccagcatctgcccgtatgctctgtccccccacccatgctgcaagcctgctctgtgcagcacttgccagtgccctatgcggcatttccacccctgatctctagcgacccgttcctgatccatcccccacacttgtcaccacatcatccaccccatctgcctccgcctgggcagtttgtcccgttccaaacccagcagtcacggagccccctgcaaagaattgaaaacgaggtcgagttactcggcgagcacctacctgtgggaggcttcacctacccccctagtgcgcatcctcctactctcccaccaagcgcccctctgcagttcctcactcacgaccccctgcatcaagaagttagctttggagtgccataccccccattcatgccacggaggctcaccggaagatctaggtatagatcccagcagcccatcccccctcccccttaccacccatcactcttaccttatgttctgagcatgctccctgtgccccctgcagttggaccaaccttctctttcgagctcgacgttgaggacggggaggtagaaaactatgaggccctgctcaatttagctgagagacttggggaggcaaagcccagggggttaacaaaagctgacattgaacagctcccaagctacaggttcaacccgaacaaccatcagtcagagcaaaccctatgcgtggtatgcatgtgtgattttgagtcacggcagttgttaagggtgctgccatgcaaccatgaattccacgctaaatgtgtggacaagtggctcaaggccaacaggacgtgccctatttgtcgggctgatgcgagtgaggtgcatagggattccgagtag

SEQ ID NO: 239291 - DNA, 1299 bp, Artificial Sequence
  Description of Artificial Sequence: Synthetic coding sequence
atgcgcccttgggaaatgacctccaacaggcagccaccatcagtgcggccttcccagcaccactttagtggagagcggtgcaatacccccgcaagaaatcggaggagtcctccagtaaggcgtcagcgtgggcgaagagaccggttgagccgccacaactccattagtcaggacgaaaactaccaccacctcccctatgcccagcaacaggcgattgaagaaccgagagcctttcacccgccaaacgtgtctccgcgtctgttgcaccccgctgcacatcctccacagcagaatgctgtaatggtcgatatacacgaccagctccatcagggcaccgtgcccgtttcctacaccgtaacgacggtcgctccccatggcatccccctctgcacgggccaacacatcccagcatgttctacccagcaggtgcctggctgcagcgttgtgttttccggtcagcacttacccgtgtgttcagttccgcctcctatgcttcaggcttgttctgtgcagcacctcccagtcccatacgcagcttttccccctttgatctccagcgatccattcctgattcatcctcctcacctgagccctcatcatccacctcacctacccccaccaggccaattcgtgccgttccagacgcagcagagcaggtcccccctacagcggattgagaacgaggttgaattgttaggtgaacatttaccagtgggtggctttacctaccccccatcagcacatcccccaaccctcccaccttctgctcctctgcagtttcttactcatgatcctcttcaccaggaagtgagctttggcgtcccatacccgccatttatgcccagaaggctgacgggcagatctaggtaccgatctcagcaaccaatcccacctcctccctaccatccgtccttgctgccatacgtactgagcatgctgcccgttcctccggcagtcggccctactttttcattcgagctggacgtggaagacggcgaggtcgaaaactatgaagcactccttaatctggctgagcggctgggcgaggccaagccccgaggactcactaaggctgatattgagcaattacctagttaccgattcaatcctaacaaccaccagtcagagcagactctgtgtgtcgtgtgtatgtgtgactttgagagcaggcagctgctaagggttttaccatgcaaccatgagttccacgcaaaatgcgtagacaaatggttgaaggcaaacaggacttgtcctatttgtagggccgatgccagtgaggtccacagggatagcgaatag

SEQ ID NO: 239292 - DNA, 1320 bp, Artificial Sequence
  Description of Artificial Sequence: Synthetic coding sequence
atgcagcacacctgcacgcagcaaaagaaggtgacgtataagcatattgcacgattctctcccagaaaccgactttgccaggccgatgctgtgttcaacaataatcttgctggtttccagttgcaatctccgccagtccgcagacaaaggggcaggagggaccgactctcccggcacaattcgatatcacaggatgagaactatcaccatctgccctatgcacaacagcaggcaatcgaggagcctcgggctttccaccctccaaacgtgtcaccgaggttattgcatccagccgctcaccctcctcagcagaatgctgttatggtcgacattcatgatcagctccaccagggaacagtgccggtgagttatacggtcactacggtggctcctcatggcattcccctttgcactgggcagcatatcccagcttgctcgacccagcaggtgcccggttgttcagtggtcttcagcggccagcatctccccgtgtgctccgtgccaccaccaatgctgcaggcatgctccgtacaacacctccccgtcccgtatgctgccttccctccactgatctcaagcgacccatttcttatccatcccccacatctcagcccccatcatcctcctcacctaccccctcccggacagtttgtgcctttccaaactcaacagtcccgttcacctctccagcggatcgagaatgaagtagagctcttgggcgaacacctgcctgttggcggttttacctacccaccctcagcacacccccctacgttgccccctagtgcacccctgcagttcctcacccatgacccgctgcaccaggaagtttcttttggggtgccgtacccacccttcatgccccgtaggctgaccgggagatcccggtatcgctctcaacagccgatcccccctccgccataccacccatccttattgccatatgttctgtccatgctccctgtgcctcccgcagtggggccaaccttcagtttcgagcttgacgttgaggatggagaggtggagaattacgaggcgctgctgaaccttgccgagagactgggagaggcgaagccccgaggcctcacaaaggccgatattgaacagctaccgtcttatagattcaatcccaataaccaccagtctgagcaaacactgtgcgtggtgtgtatgtgcgatttcgagtctcgccagctgctacgcgtgttaccttgcaaccatgagtttcatgccaaatgtgtggacaaatggctgaaagcgaaccgaacatgccccatttgtagggcggacgcaagtgaagtgcaccgcgacagtgaatag

SEQ ID NO: 239293 - DNA, 999 bp, Artificial Sequence
  Description of Artificial Sequence: Synthetic coding sequence
atggttgatatacacgaccaactgcaccagggaacagttcccgtttcatacaccgtgacaaccgtggctccacatggaattcccttgtgcactgggcagcatattcctgcctgcagtacccagcaggttcctgggtgtagtgtggtcttctccggtcagcacttaccagtctgtagcgtgcctccacccatgcttcaagcctgttctgtccagcatctacctgtaccatacgccgcattcccgccactgatctcctctgatccattccttatccatccccctcatctcagcccccaccaccctcctcacctaccccctcctggacagttcgttccctttcagacacagcaatctcgatcccccctccagagaatcgagaatgaggttgaactcctcggagagcacttgcccgtgggaggcttcacctaccccccttctgcgcacccacccactctgccccctagtgccccactgcaattcctgactcacgatcctctccaccaagaagttagcttcggggtgccctacccccctttcatgcccagacgccttaccggaaggtcaagataccgctcacaacagcctatcccccctccaccatatcatccatctctactgccttatgtcctgagtatgctgcctgttcctcccgctgtaggccctaccttctccttcgagctggatgtggaggacggagaggttgagaactacgaggccctgctaaatctcgctgagcgcctcggagaagccaagcccagagggttgacaaaagctgatatcgagcaactgccaagctacagatttaatcccaacaaccaccagtcagagcagaccctctgcgtggtgtgcatgtgtgatttcgaatctagacagctgctgagggttcttccctgtaatcatgagttccacgctaaatgcgtcgataaatggctgaaggctaaccgcacatgcccaatatgccgcgctgatgcttccgaggtacatagggactccgagtag

SEQ ID NO: 239294 - DNA, 1320 bp, Artificial Sequence
  Description of Artificial Sequence: Synthetic coding sequence
atgcaacacacttgtacccagcagaaaaaagtgacttataaacatattgctcgattcagtcctcgcaataggctctgtcaggccgatgcggtgtttaacaataatctggctggcttccagctgcaatcaccaccagtaagaagacaacgtggcaggcgagatcggctgagtcggcataactcgatctcccaggatgagaactaccaccatttgccatacgcacaacagcaggctatcgaggagcccagagccttccacccacccaatgtgtcccccaggctccttcacccggctgctcacccacctcagcaaaatgctgtcatggttgatattcacgaccagcttcatcagggcactgtccctgtgtcttacactgtgacaaccgtggctccccacggtattcctctatgcacaggacaacatattcccgcttgttctacacagcaggtgccaggttgctccgtggtctttagcgggcagcatctgcctgtttgtagcgtgcctccgccaatgttgcaggcctgcagcgtgcagcatctgcctgtgccctacgcggctttccctccgcttatttcatcagatccatttctgatccacccaccccacctgtcaccgcatcatcctcctcacttgccccctcccggacagttcgtgccttttcagacgcagcagagccgctctcccctgcagcgcattgagaacgaggtggagctactcggcgagcacctgccggtggggggtttcacctacccaccttctgcacatcctccgactctgcctcccagtgcccctctccagttcttaacccatgatccgctccaccaggaggttagctttggagtgccatatcccccatttatgcccaggcgacttaccggccgatctcgctataggtcacaacagccaatccctccaccaccatatcacccttccctgctcccatacgttctgtccatgctgcccgtcccacccgcagtgggacccacctttagctttgagcttgatgtagaagatggggaagtagagaattacgaagcacttctgaatctggctgagcgtttgggcgaggcgaaacccagggggctcactaaagccgatatcgaacagcttcccagctaccgattcaatccgaataaccatcaatcagaacagacactgtgcgtagtgtgtatgtgcgacttcgaaagccgccaactcctgcgggtcctaccatgtaatcacgagttccacgccaagtgtgtagacaaatggctcaaagccaatcggacttgccctatttgtagggctgatgcaagcgaagtgcatcgcgacagcgagtag

SEQ ID NO: 239295 - DNA, 1299 bp, Artificial Sequence
  Description of Artificial Sequence: Synthetic coding sequence
atgagaccttgggagatgacatctaaccgccagccaccaagcgtgcgtccaagccaacaccacttctccggagagagatgtaatacccctgcaaggaatcgcaggtctccgccagttcgacggcagcgcggacgcagggaccgcttatccaggcacaatagtatttcccaagatgagaattaccatcacctaccatacgcccaacagcaggcaattgaagaacctagagccttccatccccctaatgtatcgcctcgtctgttgcacccggctgcccatcctcctcaacaaaacgcggtgatggtcgacattcatgatcagctacaccagggtacagtgccagtctcctatacagtcacaactgtagcccctcacgggattccattgtgtaccgggcaacacattcctgcttgttctacacagcaggtgccgggatgcagcgtcgtcttcagtggccaacatctccctgtgtgtagcgttcccccacccatgttgcaggcttgttcagtgcagcacctgccagttccatatgcagcttttccccctctgatatctagcgacccttttcttatccacccccctcacctgtccccacaccatcccccacatctgccaccccctggacagtttgttccattccagactcagcagagtcggtctcccctacagcgcatcgagaacgaagtggaactgctgggggaacacctgccagtgggcggattcacctacccaccgagtgcccacccacccaccctgcccccaagcgcgcctttgcaattcttaactcacgacccactacaccaggaggtgtccttcggtgtgccatatcccccttttatgccaaggcgcctgacgggccgatcgagatatcgctctcagcagccaatcccaccgcctccctaccaccccagcctattaccttatgtcctgtctatgctgcccgttcctccagccgtgggtcccaccttctcctttgagttggatgtagaagacggggaggtggagaactacgaggccctcctaaatttggccgagcgactcggcgaagccaagccacgtggactgaccaaggccgacattgaacagctgccgtcatatcgctttaatcccaataatcaccagtccgaacaaaccctgtgcgtagtctgcatgtgtgacttcgaaagtcgccaacttctgcgggtgttgccttgcaaccatgaattccacgccaaatgtgtcgacaagtggctgaaggcgaatcggacctgccccatctgtagggccgacgccagcgaagtgcacagggattcagaatag

SEQ ID NO: 239296 - DNA, 1263 bp, Artificial Sequence
  Description of Artificial Sequence: Synthetic coding sequence
atgtggtggcgcgacctgacccggcttcgcctctggctgaagcgcgaggctatccctggcgaggggaggaaagcagctaaagtcaacgctggagttggggagaagggtatttataccgcttctagccgcggagggcctccttctgctaggtctaaggccgttacagtggtcgcagagggcgctgccagtagaagttggctgagcatggacgccccagaactcggccctgggttggtggaaaggttggaacagctggccacatgcccactgtgtggcggaagcttcgaagaccctgtgcttctcgcctgtgagcatagcttctgcagggcctgcctagcaaggagatggggcacccctcctgctactggaactgaggcctctcccacggcctgcccgtgttgcggattgccttgcccaagacggtcactccgctccaacgtgcgattggcagtggaggttaggatatcacgagagttgagggagaaactcgccgagcctggagctagagctggtcggaggcgcggtgggaggattccaactatgggatgcctggatctcccaggggaagacatgagaaaaacctggcgcagattcgaagttccaacgtctaaaagttcaaactctgaggacgatctgccggaagattaccctgtcgtgaaaaaaatgctccatcgccttactgcggatctgaccctcgatccaggaacagcccaccgacgccttttgatttctgctgaccgcaggtctgtccagctggctccaccgggtactccagccccacctgacgggcctaagcgcttcgatcagctgcctgccgttctaggtgcccaaggattcggtgccggtcgccattgctgggaagtggagacagccgacgctgcatcatgccgagactccagcggggaggacgcggatgacgaagaatctcattacgcagtgggcgctgctggcgaaagtgtccaacgaaaggggtgcgtgcgtctttgccccgcaggagccgtgtgggctgtcgagggaagaggcggacggctgtgggccctcacagcccctgagccaaccctgcttgggggtgtggagccaccgcctcgacgcatccgggtcgacttggactgggagcgcggacgcgtcgctttttacgatggaagatcccttgatctgctctacgccttccaggcccctggacccctaggcgagaggatcttcccactattttgtacttgcgacccccgagccccactgcgcattgtgccggcagagtcttag

SEQ ID NO: 239297 - DNA, 756 bp, Artificial Sequence
  Description of Artificial Sequence: Synthetic coding sequence
atgtggtggcgagacctaacgagactaagactgtggctgaagagggaagccattcccggtgaaggccgtaaagccgcaaaggttaatgcaggtgtgggcgagaagggtatctacacagcaagttccagaggcggacctccttccgcacgttccaaagcggtgacagtggtcgcagaaggcgcagccagtagaagctggctcagcatggatgcccctgaactgggtccgggattagtcgaaagactggagcagctggcaacatgtccactctgtgggggatcatttgaggatccagtgctgctcgcttgcgagcattcattctgcagggcctgtttagccaggcggtggggcaccccaccggctactggaaccgaggcgtcaccaactgcctgtccctgttgcgggctcccttgtccaagaagaagcctgcggagcaatgttcgactcgcggtggaggttcggatctcccgtgagctcctctttgggggtgggattcctcactcattcctgggcacacattcccacgcacactgtcgctccatcaacagcaacccgcattttagacctaaaatcatgcggccacatttggtatctacttttccacgaccctgctcgaaacccaacccctttctgccatcgggttcacaaaatctcctttctccaacagctaccaccgtgctgcccgacttcagccactctaatcactcgaggcctgcgatggggaaccgccctagtccgtctgtactggtcaagtag

SEQ ID NO: 239298 - DNA, 1065 bp, Artificial Sequence
  Description of Artificial Sequence: Synthetic coding sequence
atgtggtggcgggatctgaccagacttcggctctggctgaaacgggaggcaattcctggcgagggcaggaaagctgcaaaggtcaatgccggtgtcggcgagaaagggatctacaccgcctcttcgcggggtggtcctccctctgcccgaagtaaagctgttaccgtagtcgcagagggagctgcgtctcgctcctggctgtccatggatgccccagagctgggccctgggcttgttgaaagattggaacagctcgccacatgtcccttatgcggaggatccttcgaggatccagtgttgctcgcttgcgaacacagcttctgtcgggcttgcctggctcggcgatgggggactcctccagcgacaggcactgaggctagtcccactgcatgcccttgctgcggcctaccgtgcccgaggcgttctctgcgaagcaatgtccggctggctgtggaggttcgcatttcaagagaactgagggagaagctggccgaaccgggagccagagccggtcggcgacgcggaggcaggatccccacaatgggctgcttggatctccctggagaagacatgcggaaaacttggcgcagatttgaagtgcctacccccaagtcctccaactccgaagatgacttgccagaggattaccccgttgtgaagaaaatgttacatcggctgaccgctgacctcactctggacccgggaactgcacacagaaggttgctgatttccaccgacaggcgatcggtgcagctggcgccacccggaactccggcacctcccgatgggccaaaaaggtttgaccagctgccagctgtgctgggggcacaggggtttggggcagggcgacattgttgggaagtggaaaccgcagacgctgcctcgtgtagagattccagcggcgaggatgaagacgatgaagaaagtcactacgccgtcggagccgctggggagtccgtacagagaaagggttgtgcaccaggtcccctgggtgagcgcatcttccctctgttttgtacgtgtgacccccgagcgccactcaggattgtgccagctgaatcctag

SEQ ID NO: 239299 - DNA, 1065 bp, Artificial Sequence
  Description of Artificial Sequence: Synthetic coding sequence
atgtggtggcgagacttgacacgcttgcgactgtggcttaagcgggaagctatcccaggcgaaggccgaaaggcagctaaggtcaacgcaggtgtgggcgaaaaaggcatctacacagccagctcgagagggggaccaccatccgcaaggagtaaggcagttaccgtagtggcggagggagctgcatcccgatcatggttgtctatggatgctccagagctggggccaggattagtggagcggctggagcaactggcgacatgcccactttgtggaggatcattcgaggacccagtgctgttggcttgtgagcactcattctgtagagcatgcctcgccagaaggtgggggacaccaccggctacaggtacagaggcttcccctaccgcgtgtccttgctgcggattaccatgtccacggaggagcctaaggtctaacgtccggttggcagtagaggtccgtatttcaagggaactgcgggagaagctcgctgagccaggcgcaagagctggacgtagaagggggggacgcattcctacaatgggttgcctggacctgccaggcgaagatatgcgaaaaacgtggcggagattcgaggttccaacttccaagtcgtcgaacagtgaagatgacctcccagaagattaccccgttgttaaaaagatgttgcacagactcaccgccgacctgacattggatccaggcacagcacatcggagactattgattagtgctgatcggcgttctgtccagctggcgccacctggcacccccgctcctcccgatggaccaaaacggttcgatcagctccctgcagttctgggggctcaggggttcggggctgggagacattgctgggaagtagaaaccgcagacgcggcatcctgtcgagacagttccggggaggatgctgatgatgaggagtcccactacgcagtaggagccgcaggcgaatccgtccaaagaaagggctgcgccccaggcccacttggcgaacggatatttcctctcttttgtacgtgtgatccacgtgcccctctgaggatcgttcccgcagagagttag

SEQ ID NO: 239300 - DNA, 1263 bp, Artificial Sequence
  Description of Artificial Sequence: Synthetic coding sequence
atgtggtggcgggatctgacccgtcttagattgtggttgaagagggaagccattcccggtgagggaaggaaggcagccaaggtcaatgcaggtgtgggcgagaaaggtatttacacagcctcttctagaggcggaccaccaagcgcacgctccaaggcagttactgtggtggcagagggcgcagccagccgctcctggctgagcatggacgcacccgagctggggccaggcctcgtggagaggctggagcaactggcaacctgcccactgtgcggtggatcgttcgaagacccggttctgctggcctgcgagcacagcttctgccgcgcatgcctggccaggagatggggaacgccccctgcgaccggcactgaagctagtcctactgcttgcccctgctgcggtctgccttgtccaagacggagcctgagatcaaacgtgagactcgctgtggaagttaggatctcaagagagttgcgggaaaaattggccgaacccggtgctcgagccggacgcagaaggggagggagaattccaactatgggttgcttagatctgcccggtgaagacatgcgcaagacttggcgacgattcgaagtccccacaccaaaatcttccaacagcgaggatgatctcccggaagattaccctgtcgtgaaaaaaatgctacaccgcctgacagcggatctcaccctggacccgggaaccgcgcaccggcgactgctaatctcaaccgatcgacgttcggtccagctggccccacccggaacccctgcacccccagacggacctaagcggttcgatcaactcccggctgtgctcggcgctcaaggattcggtgctggcaggcactgttgggaggtcgagaccgccgatgccgctagctgtagggactcatccggcgaggatgaagatgacgaagaatcccactacgctgtgggagccgctggggagagcgtgcagcgaaagggctgtgtccgcctgtgccccgctggcgctgtctgggccgttgaggggcgaggcggtaggctatgggcactgacagccccagaaccgacgctccttggtggcgtagagccccctcccagaaggatccgcgtggaccttgactgggaaagaggtagagtggcattctacgacggtcggagcctggacctattgtatgctttccaggcccctggcccacttggagaaagaatcttccccctgttttgtacttgcgaccctagagcaccgctgaggattgtacctgcagagtcatag

SEQ ID NO: 239301 - DNA, 1065 bp, Artificial Sequence
  Description of Artificial Sequence: Synthetic coding sequence
atgtggtggagggacttaacccgtctgaggctgtggctgaagcgtgaggccatcccaggggagggtcgcaaagctgcaaaggtgaacgccggagtgggagaaaagggaatttatacggcatcttcccggggtggcccaccctcagctcggagcaaggctgttacagtggtggcggagggtgcagcttctcgcagctggctgagtatggacgcgcctgaactgggcccaggtctggttgaacgactggagcagctagccacctgtcctctatgtgggggatcttttgaggatcctgtcctactggcgtgtgagcactccttctgccgtgcttgcctggctcgcaggtgggggacccctcctgcaactggcaccgaagcctctcctacagcttgtccatgttgtggcctcccctgccccaggagaagcctgcggtcaaatgtaagattagcagtcgaagttcgaatcagtcgggaactgagagaaaagctggccgaaccgggagcgcgagctggcagacggagaggcggacgaattccaactatggggtgtctggacctacctggtgaggatatgaggaaaacttggcgtaggtttgaggtcccaacatccaagagctctaactcagaggacgacctgcccgaggactacccggttgttaagaagatgctgcaccgtttgaccgccgatctgacactggaccctgggactgcgcacaggagacttttgatttccgctgaccgaagatctgtacagctggcaccgccagggacccccgcacccccagacggcccaaaacggttcaaccagctccctgcggtcctgggggcacagggcttcggcgctgggcgacattgctgggaagtggagacggccgacgcagcatcatgccgcgatagttctggagaagacgccgacgatgaagaatcccactatgccgtcggggctgccggagaatccgtacagaggaagggttgcgcccctggcccattgggggagagaatcttccctctcttttgtacatgcgaccctcgggcacctctgaggatcgtgcccgcagagtcatag

SEQ ID NO: 239302 - DNA, 1263 bp, Artificial Sequence
  Description of Artificial Sequence: Synthetic coding sequence
atgtggtggagggatctgacaagacttagactgtggctgaaacgagaggccatcccaggagaaggccgaaaagcggctaaagtgaacgcgggagtaggggagaaaggaatttacaccgctagctctcgcggtgggccaccgtccgcgaggagcaaggccgtgactgtcgttgccgaaggcgctgccagtcggtcttggctctccatggacgcccctgaacttggaccaggactggtggagagactagaacaattggccacgtgtcctctctgcggtggaagctttgaagatcccgtactgcttgcatgcgagcatagcttctgtcgggcttgcttggctaggcggtggggcactccaccagccactgggactgaggcctctcctaccgcttgcccatgttgcgggctgccgtgcccccgaagatctctcagaagtaatgtgagattagctgtggaagtgcgtatatctcgtgaattaagagagaagcttgccgagcctggagctcgagccggtaggagacggggtggcaggattcctaccatggggtgcttagatctgcccggagaggacatgcgcaagacctggcggaggttcgaggtgcccacctcaaaaagttccaacagcgaagatgatctgcccgaagactatcctgtggtgaagaaaatgttgcatagattaaccgcggacctgaccctagatccaggcaccgcacaccggaggttactgatatccgcagatagacgctccgtacaactggcccctccaggtactcccgctcccccagatgggccaaaacggtttgaccagcttcccgctgttctcggtgcccaggggttcggagctggccgacattgctgggaagtggaaacagccgacgccgcttcctgtcgagacagctctggcgaggacgccgatgacgaagagagtcactacgctgttggagctgccggagagagtgtgcaaagaaagggttgcgtgagactctgtcccgctggggcagtgtgggcagtcgggggtagaggtggtagattgtgggccctaacagctccggaaccaaccctgttggggggagtggaacctccacccaggaggattagagtggatttggattgggagaggggcagagtggccttttatgatggcagaagcctcgatctgctctatgctttccaagcgcctggaccattaggcgaacgcatatttcccctcttctgtacttgcgatcctcgcgcaccgctgcgcatagtgccggctgagtcctag

SEQ ID NO: 239303 - DNA, 1263 bp, Artificial Sequence
  Description of Artificial Sequence: Synthetic coding sequence
atgtggtggagagatcttaccaggttgcggctgtggctaaaacgtgaggctatccctggcgaagggaggaaagcagcaaaagttaatgctggcgtgggagagaagggcatctacacagccagttcgagaggagggcctccatctgctcgttccaaggcggtcactgtagtggccgagggagccgcaagcaggtcctggctgtccatggacgctccggaactcggcccaggtctcgtcgagcgactggaacagctggccacttgtcccttatgtgggggatcttttgaagatcccgtgctcctcgcctgcgagcactctttctgtagggcttgcttagcacgtcgctggggaacacccccagcaacagggaccgaggccagcccaacagcatgcccatgttgcggcttaccatgtcccagacggtcattgaggagcaacgtgagactggctgtcgaagtgcgtattagccgcgaactgcgggaaaaactcgcagaacccggagctagagctggacggaggcgaggcggtcgcatccctactatgggctgcctggatctaccaggcgaggacatgcgtaagacctggagaagatttgaggtcccgacctcaaagtcaagcaacagcgaggatgatctgcctgaggattatccagtggtcaagaagatgcttcaccgtctgaccgctgacctaacactagatcctgggactgcacaccgacgcttgctgatctccgcagataggcggagtgtccagctcgcccctccaggcacccccgcaccacccgacggaccaaagcgttttgatcagctccccgctgtgctgggcgctcaaggttttggcgcaggacggcattgctgggaagtggaaactgcagacgctgcaagttgcagggactcgtccggtgaggatgcagacgacgaggagagccactatgctgtcggagcagctggtgagtctgtgcagaggaaagggtgtgtcagattatgccccgctggtgctgtctgggctgtggagggacgaggtggtaggctatgggctctaacagcccctgagcccaccctgctcggtggcgtcgagccaccaccccgacgcattagggtggacttagattgggagagaggacgtgtggccttttacgacgggaggtccctggatctactctacgccttccaggcccctggtcctctgggagagagaatcttcccactcttctgtacatgtgacccacgggcacctctgcggatcgtgccggctgagagctag

SEQ ID NO: 239304 - DNA, 1263 bp, Artificial Sequence
  Description of Artificial Sequence: Synthetic coding sequence
atgtggtggcgggatttaactcggctccgattatggcttaagagagaggccatccccggtgaagggcgaaaggctgctaaagttaacgccggagtaggtgaaaaaggtatttacacagcaagcagcaggggaggtccgcctagtgccagatccaaggccgtgaccgtggtcgccgaaggtgccgcttccagaagttggctgagcatggacgccccagagctgggccctgggctggtggagcgcctagagcagttggccacctgcccactttgtggcggatcattcgaagatcctgtgcttctggcctgcgaacacagtttttgtagagcttgcctggcccgacggtggggaacaccgcctgccaccggcacggaggccagtccgacagcttgcccgtgctgcggccttccgtgccctcgtcggtctctaaggtccaatgtgcgactggctgtggaggtccgaatttcacgggagctgagggagaaactggctgaaccaggcgcaagagcgggaagacgcagaggagggcgtatcccgaccatgggctgcctggacttaccgggagaagatatgagaaagacatggcggaggttcgaggtacccacgtcaaaaagctcaaacagcgaggatgacctgccggaggattatccagtcgtcaagaaaatgcttcatagattgactgctgatctcactctggatcctgggactgcccatcggcgactgcttatctcggccgacagacgctccgtccagctagctccaccgggtactcctgcccctccagacggtccgaagcgcttcgatcagttaccagcggttctgggggcacaaggattcggggctgggaggcattgctgggaagtggagacggctgacgccgcaagttgtcgcgactcctccggtgaggacgctgatgacgaggagtcacattacgctgtgggagccgcaggtgagagcgtccagagaaaaggttgtgtgagactctgcccagccggagcggtgtgggctgtggaagggcgtggtgggagattatgggctctgactgctccggagcctaccctgctaggcggagtagaacctccaccaaggagaatccgggtggacttagactgggagcggggaagggtggccttttatgacggtcgctccctggacctgctctatgctttccaggccccagggccattgggtgaaagaatatttcccctcttctgtacttgcgaccctagggccccactgcggatagtgcctgctgaaagttag

SEQ ID NO: 239305 - DNA, 1065 bp, Artificial Sequence
  Description of Artificial Sequence: Synthetic coding sequence
atgtggtggcgggacctcactcggctcaggctctggctcaaacgcgaagcaataccaggagaagggaggaaggccgcaaaagtgaacgccggtgttggtgagaaaggaatttacactgcttcatcgagaggcggacctccaagcgcccgaagcaaagccgtcactgtagtggcagaaggtgccgcatctcggtcttggcttagcatggacgccccagagctgggaccaggacttgtggagaggctggagcagctcgctacctgccctctttgtgggggttcattcgaggatcccgtcctacttgcttgcgaacattccttctgcagggcttgcctcgcgaggcgatggggaaccccgcctgctacaggcactgaagccagcccaaccgcttgcccgtgctgtggcctgccgtgtcctcgcagaagcttgcgctcaaacgtcagattggctgtggaggtccggatctcaagagagctgagggaaaaactcgccgagcccggagccagagcagggaggaggagggggggacgcatccccaccatgggctgtctcgatctccccggtgaggatatgcgtaaaacctggaggcgctttgaagtgcccacatcaaaatccagtaattcagaggacgatcttcctgaagactatcccgtggtcaagaaaatgcttcaccggctgacagctgatctgaccttagatccagggacagcccacaggcgtctccttatatccgcagaccggaggtccgttcagctggctccaccaggcaccccagcaccccctgatggacccaaacggttcgaccagctacccgctgtgctaggtgcccagggatttggagccggacgacattgctgggaggtcgaaactgcggacgccgcttcttgcagggattcaagtggagaagacgcagacgatgaagagagccactacgctgttggggcagctggagaatccgtccagcggaaaggttgcgcaccaggtcccctgggtgagcggatctttcccctgttttgtacttgcgacccccgagctcccctgcgcatagtgccagccgagtcatag

SEQ ID NO: 239306 - DNA, 1065 bp, Artificial Sequence
  Description of Artificial Sequence: Synthetic coding sequence
atgtggtggcgagatcttaccaggctgaggttatggctgaaacgtgaagcgattccgggtgaggggaggaaggcagcgaaggtcaatgccggtgtgggcgagaaagggatttataccgcatcttcacgaggtggcccaccttctgcaaggtccaaggcagtgacagtcgtggcggaaggagccgcaagccggtcttggttgtcaatggacgccccagagctgggaccaggacttgtggagcgcttagaacagctggctacttgtcctctgtgcggtggctcatttgaagacccagtcctgctggcctgtgaacacagcttttgtagagcgtgcctggccagacgctggggcacaccacccgcaactggtacagaggctagccccacagcctgcccatgttgtgggctgccatgccccaggcgcagcctaagatcaaacgtgcgcttagccgtggaggtgcggatatcgcgggaactccgggaaaaactggcagagcctggcgcacgggctggtaggcggaggggcggtcgaatccccacaatgggctgtttggacctgcccggtgaagatatgcggaagacatggcgaagattcgaggtcccaacgtccaaatctagcaactccgaagacgacttacctgaagactatccagtggtcaagaaaatgctgcatagactcaccgccgacttgacgctggaccccggtacagcgcatcgtcggttgttgatatccgctgaccggaggagtgtgcagctggcgcctcctggaacccctgctccaccagacggacctaagagatttgaccagctccctgctgtgcttggtgcacagggattcggcgcaggtagacactgttgggaggtggaaaccgctgacgccgcatcctgcagggactcatccggcgaagacgccgacgacgaggaatcccactacgccgttggggcagccggagagtccgtacagagaaaagggtgtgcacccggtccactgggcgaaaggatcttcccactgttctgtacttgcgacccaagagcaccactgaggattgtgcccgctgaatcctag

SEQ ID NO: 239307 - DNA, 1065 bp, Artificial Sequence
  Description of Artificial Sequence: Synthetic coding sequence
atgtggtggagggatctgacccggttgaggctgtggctgaagagggaagccatcccaggagaaggcagaaaggccgcaaaggttaatgcgggagtgggtgaaaaggggatctacaccgccagctccaggggtggaccccctagtgctaggagtaaggcagtcaccgttgtggctgagggcgcagcctcccgtagctggctctccatggacgcacccgagctggggccaggtcttgtggagcggttggagcagctcgctacctgccccctgtgcggcggatcattcgaggaccccgttctgcttgcgtgcgagcacagtttttgtagggcatgcctagcgaggaggtggggaacaccccctgccactgggaccgaagcaagcccaactgcctgcccatgttgcggtctgccctgccctcgcaggtcactcagaagcaacgtaaggcttgcagtggaggttcggatctccagggagctccgagaaaaacttgcagagcctggagctcgggcaggacggaggagaggcggaagaatccctaccatgggatgtcttgacctgcccggagaggacatgcgcaagacatggaggagattcgaggtgcccacttcaaaatcatctaactccgaagacgacctgcctgaagactacccggtagtcaaaaaaatgttgcatcgcttgacagctgaccttactctagaccctgggactgcacacaggcggctgttgatctccgccgataggaggtctgtccaactcgccccacctggtacccctgcacctccagatggccctaaaaggtttgaccaactgccagccgtgttgggtgcacagggcttcggggctggcaggcactgttgggaggttgagaccgctgatgctgcttcttgtcgagactcctccggcgaggacgcagatgacgaggagtcccattatgccgtcggcgctgctggagaatcagtccagcgaaagggctgcgcccctgggccacttggggagcgaattttcccactgttttgtacatgtgaccctcgggctcccctgaggatcgtgcccgctgagtcatag

SEQ ID NO: 239308 - DNA, 1263 bp, Artificial Sequence
  Description of Artificial Sequence: Synthetic coding sequence
atgtggtggcgggacctgacacgactgagactgtggctgaagcgggaggcaattccaggagagggacgcaaggccgctaaggtcaatgccggtgtaggggaaaaagggatttacaccgcctcatctagagggggacctccatcagcaaggtcaaaagctgttacggtagtggccgagggagcggctagtaggagctggctgtcaatggatgcgccagaactggggccaggactggtggagaggctagagcagcttgccacttgtcctctgtgcgggggatccttcgaggaccccgtcctcctcgcctgcgagcactcattttgtcgagcttgcttagccagacgatggggaacaccgcctgccactggaaccgaagctagccccactgcatgcccctgttgtggcctgccttgcccaaggcgttccttaagaagtaatgtcagattagctgtggaagtcaggatctcccgggaactccgagaaaaactagccgagcccggagcgcgagccggaaggagaaggggcggtagaatccccactatgggctgtctcgacttgcctggcgaagacatgcgaaagacctggcggaggtttgaggttcccacaagcaaaagcagtaattccgaggacgacctacccgaagactatccagttgtcaaaaagatgcttcacaggctgaccgcagatctgactttggatccaggtacagctcacaggagactgcttatcagtgcggaccgcaggtctgttcagttagcaccaccaggcaccccagcgcctcccgatgggccaaagagatttaaccagcttcccgcagtgctcggcgctcagggcttcggtgccggacgacactgctgggaggttgaaacagcagatgcggctagctgcagggattcctccggcgaggacgcagatgacgaggagtcccactacgccgtgggggcagctggggaatctgtccagaggaagggatgtgtgagactctgccccgctggtgccgtgtgggctgtggaaggtagaggcggaagactgtgggcccttaccgcccctgaacccactcttctgggcggtgtggaaccccctccccgaaggatccgcgtagacttggactgggagcgaggcagggtcgctttctatgacggcaggagcctggacttactgtacgcatttcaggctccaggccctctgggggaacgcatttttcctctgttctgtacctgtgaccccagggcccctctaaggatcgtgcccgctgagtcatag

SEQ ID NO: 239309 - DNA, 1263 bp, Artificial Sequence
  Description of Artificial Sequence: Synthetic coding sequence
atgtggtggagggacctgacacgccttcggctatggctgaaaagagaagccatcccgggagagggcaggaaagctgctaaggtgaacgctggggtgggcgaaaagggaatctatacagctagcagccgcggtggacccccatccgcccgaagcaaagccgtgactgtggtagctgaaggcgcagcctcaaggagctggttgtccatggacgcgccagaacttggtcctgggctggtggagagactggaacagctggcaacatgtcccctctgcggagggtcctttgaggatcctgtactgctggcttgtgaacacagcttctgccgcgcttgcctggctaggagatggggtacccccccagctacaggaacagaagcaagccctactgcctgcccctgctgcggtctgccgtgtcctcggcgaagtctcagaagcaacgtcaggctcgcagtcgaggtgaggatctcgagggaattgcgggagaaactcgccgaacccggagctcgcgctggcagaaggaggggcggtagaattcctactatgggctgtctggacttgcccggtgaagatatgagaaagacatggcgcagattcgaggtgcctacttccaaatccagcaattcggaagacgacttgcctgaggattatccagttgtgaagaaaatgctgcatagactgacagccgacctgactctagatccaggcaccgcacatagacgtttgctaatatcggccgatcggagaagcgtacagctcgctccaccgggaaccccggctccacccgacgggccaaagcgtttcgatcagttgcctgcagtgttgggagcacagggcttcggcgctgggaggcactgctgggaggtggaaacggccgacgccgcaagttgtagggacagctcaggagaagatgcagacgacgaagaatctcactacgccgtgggggctgctggtgagtcagtacagagaaagggttgtgtgcgcctctgtccagcgggagccgtgtgggctgtcgaaggaaggggcggtaggctatgggctttgaccgctccggaaccgaccctgctcggcggtgtggaacctccccctcgcaggattagggtcgatcttgactgggagcgcggtagagtcgccttttacgatgggcgatcactggatcttctttacgccttccaggcccctggcccactgggtgaacggatctttccactgttctgtacatgcgatcctagagcacctctcagaatcgtacctgcagaaagctag

SEQ ID NO: 239310 - DNA, 1065 bp, Artificial Sequence
  Description of Artificial Sequence: Synthetic coding sequence
atgtggtggagggatttgacccgcctacgtctatggttgaagcgcgaggcaatccctggagagggaagaaaagccgctaaagtgaatgccggagtgggagaaaagggcatctatacagcgtcatcaaggggtggaccaccaagtgcaaggagcaaggccgtgacagtcgtcgcagaaggggctgcctcacgctcctggctgagcatggatgcaccagagttaggcccaggacttgttgagcggctggagcagctggcgacttgtccattgtgtggtgggagctttgaggatcccgtcttattggcctgcgagcactcgttttgtcgcgcttgcctggctcggagatgggggactccgccagcgaccggcaccgaggctagccctacagcgtgcccctgttgcggtttgccatgtcccaggaggtccctccgaagcaacgttagactggctgtggaggtgcgcatctcaagagaacttcgcgagaagctcgccgagcctggcgctagggctggcaggagaaggggcggtcggattcccactatgggctgcctggatctgcctggcgaggacatgcgcaaaacctggcggcgatttgaggtgccaacctctaagtcctcaaactccgaagacgaccttcccgaggattaccccgttgtgaagaaaatgctccataggctcactgccgacttaactctggaccccggaacagcccaccgtagactgctcatttccgcagaccgtagaagcgtccaacttgctcctccaggaacaccagccccacccgatggacccaagcgattcgaccagcttcctgcagtccttggggcacagggttttggggcagggagacactgctgggaagtggaaacagccgacgccgcaagttgccgcgatagttcaggggaggatgccgatgacgaagagtcccactatgccgtgggagctgcaggtgagagcgttcaaaggaaaggttgtgctcccggtccattgggagaacgcatcttcccactgttttgtacatgcgacccacgggctcctttgaggatcgtcccagctgagtcctag

SEQ ID NO: 239311 - DNA, 1263 bp, Artificial Sequence
  Description of Artificial Sequence: Synthetic coding sequence
atgtggtggcgggacctgaccagactcaggctgtggctgaagagagaggcaataccaggcgaggggaggaaggctgcaaaagtgaatgctggcgtcggggaaaaaggcatatataccgctagctcacgtggtgggccaccgtccgctagatccaaagctgttacagtggtcgctgagggggcagcatcccgatcctggctgtcgatggacgcacctgagctgggcccaggcctggtggaacggttggaacagctggccacctgtccactctgtggagggtctttcgaggatcctgttcttcttgcatgtgagcatagcttttgcagagcctgtcttgcaaggcggtggggtacgcctcctgcgactggaactgaggctagccctacggcctgcccctgctgtggcttgccatgcccacgtcgctccctcaggagcaatgttcggctggctgtggaggtccgtatatctagggaactcagagagaagctggccgagccaggcgctcgcgctggacgccgtaggggaggaaggatcccaacaatgggttgcttagatctgcctggcgaagacatgcgcaaaacttggcggagattcgaggtgcctacctcgaaaagctcaaactccgaggatgacctccccgaagattacccggtagtcaagaaaatgcttcacagactcaccgccgatctgacgttagaccctggtacagctcaccgccgtctgctgattagtgctgacagacggtctgtccagcttgcccctccaggcaccccggctccaccagatggtccaaagcgcttcgaccagctgccagccgtgctgggagctcagggctttggcgcaggcagacattgctgggaagtcgagactgccgatgcggcttcttgccgcgattcctccggcgaggatgcggatgatgaagagtcccattacgccgtgggcgctgcaggcgaatctgttcaaaggaagggctgcgttagactctgtcctgccggagccgtctgggcagtggaaggtaggggcggacgcctctgggcattgacagcccctgaacctaccctgctcggaggggtcgagccccctcctaggcgtatcagagtggacttggattgggaacgcggacgtgtggccttctatgacggccgtagcctggatctgctttatgcatttcaggctccaggccctctgggcgagagaatctttcctctgttttgcacatgcgatcctagagccccattgcgaatagttcccgcagagagctag

SEQ ID NO: 239312 - DNA, 1065 bp, Artificial Sequence
  Description of Artificial Sequence: Synthetic coding sequence
atgtggtggagagacctgactcgtctgagactctggctgaaacgtgaggctatcccaggtgagggaaggaaggccgcaaaagtgaatgcaggcgtgggagagaagggcatttacaccgcctctagcagaggcggtcctccgtcagctcgctcgaaggccgtcactgtggtagcggagggggcagcctcacgtagctggctgtctatggatgccccagagctgggccctggccttgtggaaaggctcgagcagttggccacttgcccactgtgtgggggtagtttcgaggatccggtgctgctagcctgtgagcacagtttttgtcgcgcatgtttagcacgcagatggggcactccccctgctactggcaccgaggcctctccgacagcctgtccctgttgtggccttccttgccccaggaggagcttgcgctcaaacgtcaggctcgcagtcgaggtccgtatttctagggagcttagggagaagctagctgagcccggagcccgtgccggaagacgaagggggggtcggatccccacgatgggctgcttggatttacccggagaggacatgcgtaaaacttggcgccgattcgaggtcccaacatccaagtcgtctaacagcgaagatgacctacccgaggactaccctgtagtgaagaagatgctacaccggttaactgccgatctcacgctcgaccctggcacagcccatcgacgcctattgatctctgccgacagaagatctgtgcagctcgctccacccggaacaccagcacccccagacggcccaaagaggttcgaccagctgcccgcagtgctcggggcacagggatttggtgccggtaggcactgctgggaagtggaaaccgccgacgccgcatcttgtcgggatagctccggagaagacgccgacgacgaggaatcccactatgccgttggggctgccggagagtccgtacaacgcaaggggtgcgctccagggccactaggcgaacgcatctttcccctcttttgcacctgcgaccccagggctccccttagaatcgtgccagctgagtcatag

SEQ ID NO: 239313 - DNA, 756 bp, Artificial Sequence
  Description of Artificial Sequence: Synthetic coding sequence
atgtggtggcgggacctcacccgtctgcggttgtggcttaagcgcgaggctattccaggggaggggagaaaagccgcaaaagtgaatgccggagttggagagaagggcatttacactgcttcctcacggggaggccctcctagtgcacgctctaaagctgtcacagtggtcgctgaaggggcagcgtccagaagttggctgtcaatggatgctcctgaactgggccctggcctggtcgaacgcctcgaacagctcgccacctgtcccctgtgcggaggtagtttcgaagatccagtgttactggcctgcgaacacagcttctgtcgtgcctgcctcgctcggagatggggcacgcccccagcaacgggaacagaagctagccctactgcctgcccctgttgtggtcttccctgcccgagacgctctctgcgatccaacgtccggttggctgtcgaggtacgcatcagcagagagctgctgtttggcggaggaatcccgcatagctttctcggcactcactcccacgcacattgcagatcaataaactctaatccgcacttccggcctaagatcatgagacctcatctagtttcaacattcccaagaccgtgcagcaaaccgaatccttttcttccatctggatcacagaaccttttgagtcccacggccactaccgttttgcctgacttctctcactcaaatcactctcgacccgcaatggggaatagacccagtccctcagtacttgttaagtag

SEQ ID NO: 239314 - DNA, 756 bp, Artificial Sequence
  Description of Artificial Sequence: Synthetic coding sequence
atgtggtggcgggatctgacccgcctgagactgtggctcaagcgtgaagcaatccctggcgaaggcaggaaggcagccaaggtcaatgcaggagtaggcgaaaaaggaatttacactgctagctctcgcggaggccctccaagcgctcgaagcaaagcggttactgttgtggctgagggagcggcttctcggtcctggttgagcatggatgcaccagagctcggaccgggtcttgtggaacgcctggagcaactcgcaacatgccccctgtgtggtggcagttttgaggaccccgtgctactggcgtgcgagcactccttctgcagagcctgtcttgctaggcgttggggcacaccgccagcgaccggaactgaggccagtcccaccgcctgtccatgctgtgggctaccttgccctaggaggagcttgaggtccaacgtgcgcctggctgtggaggtgcgaatctcaagggagttactctttggaggagggattccccacagttttcttggcacccactcacatgcccattgtaggagcattaatagtaacccacactttcggcctaaaatcatgaggccccatctggtctcaactttcccgagaccctgtagcaagcctaaccccttcctgccctccggtagtcagaacctcctatctcccaccgcaacaacagttttgccagatttctcacactcaaaccatagtagaccggcaatggggaatagaccctcgccctcagtgcttgtgaaatag

SEQ ID NO: 239315 - DNA, 756 bp, Artificial Sequence
  Description of Artificial Sequence: Synthetic coding sequence
atgtggtggagggacctcactaggctgaggctgtggctgaaacgggaggccattccaggcgagggaagaaaggcagcaaaggtgaacgctggcgtgggcgagaaagggatttacaccgcctctagcaggggcggaccacctagtgcacgctccaaggccgtgacagtggtagcagaaggggcagcgtctaggagttggctgagtatggatgcgcctgagctgggccctggactggtggaacggctcgaacaactggctacgtgcccactgtgcggcggaagcttcgaagatcctgtcctgttagcttgtgagcattctttttgtcgtgcatgcctggccaggcgctggggcaccccaccagcaactggcaccgaagcaagtcccacggcatgcccgtgttgtggcctgccgtgcccacgacgaagcctccgaagtaatgtcagactggctgtggaagtccgaatctctagggaactccttttcggcggtggtattcctcattcatttctgggaacgcactcacacgcccattgtagatccattaacagcaatccccatttcagaccaaaaatcatgcgcccacatctggtaagcaccttcccacgcccttgcagcaagcccaacccctttctcccaagcggctcccagaatctcttgtctcctaccgccactactgtgctccccgacttcagtcacagcaaccacagcaggcccgctatgggcaaccgtccttccccctccgtcctggtgaaatag

SEQ ID NO: 239316 - DNA, 756 bp, Artificial Sequence
  Description of Artificial Sequence: Synthetic coding sequence
atgtggtggagggacttgactaggctccgactgtggctgaagcgagaggcaatccccggagagggcaggaaggccgcaaaagtaaacgcaggggtcggcgaaaaagggatatataccgcctcctcgaggggcggtcccccaagtgctcgctccaaggccgtgacagtggtcgccgaaggggcagcgtctaggtcctggttgtccatggatgcacccgagctgggacctggcttagtggaacgcttagagcagctggctacgtgtcccctctgtggtggatcattcgaggaccctgtgttgctggcttgcgaacactcgttttgtcgggcatgtctggccagaagatgggggacgcctccagcaacaggtacagaggcctccccaaccgcctgcccttgctgcggcctgccttgtcctcgacgatctcttcggtctaatgtgaggctagcagtggaggtgcggattagcagggagctcctgttcgggggaggcatcccccactccttcttagggactcattcccacgctcactgcaggtcaatcaacagtaatccccatttccgtcccaagatcatgcgccctcacctcgtgtcaaccttccccaggccgtgctcaaaacctaaccctttcttgccttccgggagccaaaaccttttgtccccaacagccacaaccgtcctgccggatttttcacactccaaccactcgcgacccgctatgggcaaccggcctagtccgtctgttttggtcaagtag

SEQ ID NO: 239317 - DNA, 756 bp, Artificial Sequence
  Description of Artificial Sequence: Synthetic coding sequence
atgtggtggcgggacctcacgagactgcggctgtggttaaaacgggaagccattcccggagaggggaggaaggccgctaaagtcaacgcaggcgtgggtgaaaagggaatttacactgcctcatccaggggaggtccccctagcgccagatccaaggccgtgacggtcgtggccgagggcgcagccagcaggtcatggctctccatggatgcgcctgaactgggcccaggtctggtcgagaggctcgagcagttggcaacttgccccttgtgcggtggctcattcgaagacccagtgcttctcgcgtgtgagcattctttttgcagggcttgtctggcgcgacgttgggggacaccgccagcgaccggcacagaggcatccccgacagcctgtccatgttgtggtttgccgtgccctaggcgttcactgcggagcaacgtacgcctggccgtggaggttcgcatcagccgagaattgctctttggtggcggaattccacacagtttcttgggcacacactcccacgcccactgtcgtagtatcaattctaatccacatttcaggccaaagatcatgcgtccccacctggtgtctacatttccccgaccttgctctaagccaaacccttttctgccttcaggtagtcagaacctgctcagccctactgccacaactgtgctacctgacttttcccactccaatcactcgcggccagcaatggggaaccgtcctagcccctcggtattagttaaatag

SEQ ID NO: 239318 - DNA, 756 bp, Artificial Sequence
  Description of Artificial Sequence: Synthetic coding sequence
atgtggtggcgcgacctgactcgccttcggctgtggttgaagcgcgaagccatccccggagagggcagaaaagccgcaaaggtaaacgccggagttggcgaaaagggcatctatactgcctcgtctcggggaggacctcccagtgctcgatctaaagccgtcaccgttgttgctgagggagctgcttcaaggagctggctctcgatggacgctcctgagctgggcccaggcctcgtcgagcgcctggagcaactcgcaacatgtcccctgtgcggagggtcatttgaggaccctgtgctcctcgcttgcgagcacagtttctgccgggcttgcctcgcaagacggtggggtacacccccagcgactggcaccgaagccagtccaactgcatgcccatgttgcggactcccgtgtcccaggcggagtctgcgctccaacgttcgtcttgcggtggaggttagaatctctcgcgaactgttatttgggggagggatcccccatagcttccttgggacccacagccatgctcattgccggagcattaatagcaatcctcacttccgacccaaaatcatgcgaccacaccttgtcagtaccttccctcggccttgctcaaaacccaacccattcctcccatccgggtctcaaaacctgctgagcccaaccgctgccactgtcctgcccgatttcagccacagtaaccattctcgtccagccatgggtaacaggccatcccctagcgtgctggtgaagtag

SEQ ID NO: 239319 - DNA, 756 bp, Artificial Sequence
  Description of Artificial Sequence: Synthetic coding sequence
atgtggtggagagatcttacaagactacggctctggctgaagagagaggcgatcccaggcgagggcaggaaggcagcaaaagtcaatgccggagtgggagagaaaggcatttatacggcaagttcccgcggtggcccaccgtccgctaggtccaaggctgtcaccgtcgtcgccgaaggcgcagcctctagatcttggctcagcatggacgcacccgagctcgggcctggcctggtggaacgcctagagcagctggccacatgcccattatgcggcggatccttcgaagatcctgttttgctggcctgcgaacattctttctgcagagcatgtctggcacgacgctgggggactcccccagccacaggtaccgaggcatccccaacagcctgcccctgctgcggccttccttgcccacgcagaagcctgaggtccaacgtaagattggctgtcgaagtccgcatctctagggagcttcttttcggtcgcggaatcccgcattccttccttggcacacatagccacgcccactgtagaagcataaactcaaatccacattttcggccaaagataatgcgcccacacctggtcagtaccttcccccatccttgttcaaaaccgaatccctttcttccttctggctcccaaaacctgcttagccccacggccacaacagtgctaccagacttttcgcattccaatcattcccggccagcgatgggtaacaggccatccccttcagtcttggtgaagtag

SEQ ID NO: 239320 - DNA, 573 bp, Artificial Sequence
  Description of Artificial Sequence: Synthetic coding sequence
atgagtacccggaagcgaagaggaggagccatcaatagtcgccaggcacaaaaacgcacaagggaggcaacatccacccccgagatctctttggaggccgagcccatcgagctcgtggagaccgcaggagatgaaatagtggacctcacctgcgagagccttgagccagtcgtcgtcgacctgacacataatgattccgtggtaattgttgacgaacgcagacgtccacgcagaaacgccagaagactgccccaggatcatgccgacagttgtgtcgtttctagcgacgacgaggagttgtcacgcgatcgcgacgtttacgtcacgacacacacgccacgcaatgcacgggacgagggcgctacggggctgcggccatccggtactgtcagctgtcctatctgcatggatggatacagtgaaatcgtacaaaacgggagactgattgtgagcaccgaatgtggccacgtgttttgtagccagtgcctgagagattccctcaagaatgccaacacgtgtccgacatgtcgtaagaagattaaccacaagaggtaccatcccatctatatctag

SEQ ID NO: 239321 - DNA, 18 bp, Artificial Sequence
  Description of Artificial Sequence: Synthetic coding sequence
atgagcacaagaaagtag

SEQ ID NO: 239322 - DNA, 573 bp, Artificial Sequence
  Description of Artificial Sequence: Synthetic coding sequence
atgtccacgcggaagagacgaggaggagccattaattcccgtcaggcacaaaagcggactcgggaagctacaagcacgcctgagatctcattggaggctgagcctatcgagctcgtcgagacagccggagacgaaatagtagacttgacatgcgagtccttggagcccgtggtggtcgacttaactcacaacgacagtgtggtcatcgtggacgaacgcagacggcctagaaggaatgctagaagacttcctcaggaccatgccgacagttgcgttgtttctagcgacgatgaggaactgtctcgggatcgagatgtttatgtgacaacacatactccgcgaaatgcccgagatgaaggtgctacgggactgcgcccttccggtaccgtgtcctgccccatttgcatggatggatattctgaaattgtgcagaatggcagattgattgtgtctaccgagtgcgggcacgtcttttgctctcagtgtctgcgggacagcctgaagaatgctaacacttgtcccacctgccgaaagaaaatcaaccataaaaggtatcatcctatttacatttag

SEQ ID NO: 239323 - DNA, 573 bp, Artificial Sequence
  Description of Artificial Sequence: Synthetic coding sequence
atgtctaccaggaaaagacgtggcggagcgataaatagtagacaggcccaaaagcggacccgagaggcaacctcaacaccagagatctccttggaggctgagcctatagagctggtggaaaccgcaggcgatgaaatcgtggatctaacttgcgaaagtttagagccagtagtcgtggacctaacacataatgacagcgtcgttatcgttgacgaacgcagaaggcctaggaggaacgcgagacggttgccccaggatcatgccgactcttgcgtcgtctcctcagatgacgaagagttgagtagggaccgggacgtgtacgtgacaacccatacgccgaggaatgccagggatgagggagccacaggacttcgcccaagcggcaccgtgagctgtcccatctgtatggatggatattctgagatcgtgcagaatggtagactgattgtatcaacggaatgcggacacgtgttttgctcccagtgtttgcgcgatagcctgaaaaacgccaacacgtgccctacttgtcgcaaaaagattaaccacaaaaggtatcatcctatttacatctag

SEQ ID NO: 239324 - DNA, 165 bp, Artificial Sequence
  Description of Artificial Sequence: Synthetic coding sequence
atgtctacccggaaacggagaggcggagctatcaactctaggcaagcgcagaaacgcacacgcgaagcgacctcaacaccagaaatttctctcgaggccgagcctattgaactcgtggagacggctggtgacgagatcgtagatcttacgtgcgagagtctctag

SEQ ID NO: 239325 - DNA, 345 bp, Artificial Sequence
  Description of Artificial Sequence: Synthetic coding sequence
atgtccacccgtaaacgcagaggaggtgcaattaattctcggcaagctcaaaaaaggactagagaggctacctcgacaccagagatttccctcgaggcagagccaattgagttggtggagactgccggtgatgagatagtggacctgacctgcgaaagcctcgagcccgtcgtggtggacttaacccacaatgacagtgtggttgttagtgtcggcgtgccgcaagtactctcagttgtgcctagtgcatggaccgatacccagagatcatgtaggatggatgtgagttccttccctcagaacgcggcaatgtcctcagtggcctccgcttcagtcattccttag

SEQ ID NO: 239326 - DNA, 573 bp, Artificial Sequence
  Description of Artificial Sequence: Synthetic coding sequence
atgtcgacccgaaagaggcgcggaggagcaatcaatagccggcaagcccaaaagcgaacccgagaagccacgtctacccctgagatttctctcgaggccgagcccattgagctcgtggagacggccggagacgaaatcgtggacctgacttgcgaatccctggaaccggtggtcgtagatctgacacacaatgactccgtggtggtgtccgatgaacgaagaagacccagacggaatgcccgaaggctgccccaagatcatgcggacagctgcgtggtctcttctgacgacgaagagcttagcagagacagggatgtatatgtgacgacacacactcctcggaatgcacgggatgagggggctactggcctgcgacccagtggaaccgtgtcttgcccgatttgtatggatggatactctgagattgtgcagaatggcaggctcatcgtttctacagaatgtggccacgtgttctgctctcaatgtctacgagactctctcaaaaacgccaacacatgtcctacctgtaggaagaaaattaaccacaaacggtaccatcccatttacatttag

SEQ ID NO: 239327 - DNA, 342 bp, Artificial Sequence
  Description of Artificial Sequence: Synthetic coding sequence
atgagcacacggaaacggagagggggagctatcaacagccgtcaggcccagaaacgaacaagggaagctacctctacaccggagattagcctcgaagcagagcccatagagttggtagaaacagctggcgacgagattgtggacttgacctgcgaatccctggaaccagtggtggttgacttgacacataatgacagcgtagtgattgtcgacggtcctcaggttctgtcagtagtgccttccgcatggacagatacacagcgtagctgtaggatggacgttagctctttccctcagaacgccgcaatgtcgtccgtggctagcgcgtccgtaatcccatag

SEQ ID NO: 239328 - DNA, 2352 bp, Artificial Sequence
  Description of Artificial Sequence: Synthetic coding sequence
atgagcggcggacaccagctccaactggcagctctctggccttggctgctcatggctaccctccaggccggttttggcaggacgggcctagttctcgcagctgccgtggagagtgagcggtctgccgagcaaaaggccatcattagggttatacccttgaagatggaccccaccggtaagttaaatctgacactggagggcgtgttcgcaggggtcgccgagatcacaccggcagaggggaaactcatgcaatctcaccccttatacttgtgtaatgcttcagatgatgataacctagagcccggttttatatccatcgttaagctggagagcccgaggcgcgctccccgaccatgcctgagcctcgcgagcaaagcacggatggctggcgagcggggtgccagcgccgtccttttcgatatcactgaagatagagctgctgccgaacagcttcagcagccgctgggcctgacttggcctgttgtgctcatctggggaaatgatgctgaaaaattaatggagttcgtgtataagaatcagaaggcccacgtgaggatcgaactgaaggaacccccagcttggcctgattacgatgtgtggatcctcatgaccgttgtcggaaccatcttcgtcatcatcctggctagcgttctccgcattcgctgtagaccaagacatagtcgcccagaccctcttcaacaaagaaccgcatgggcgatctcacagctcgctacgcgacgctatcaggccagttgtcgtcaggctagaggcgagtggccagacagcgggtcctcgtgctccagcgcccctgtgtgcgcgatatgcctcgaggagttttctgagggtcaggagctgagagtgatctcttgcctgcacgaattccacagaaattgtgtcgacccctggctccaccagcatcggacttgtcccctatgtatgttcaacatcacggaaggggattcattctcccagagtctgggcccttccaggtcatatcaggaacctggtcgtcgtctccacttgattcggcagcacccagggcacgctcactaccatttgcctgccgcttacctgttaggacccagtaggtctgccgtggccaggcctcctaggcctggcccttttctgccttcccaagaaccaggtatgggccctaggcaccataggttccctcgagccgctcaccccagggctcccggtgaacagcagcgactggcaggtgcacagcacccttatgctcagggctggggattgtcccatctgcagagcacctcgcagcatcctgcagcatgtcctgtcccgctaaggcgcgcaagaccccctgatagcagcggttctggcgagtcctattgcactgaacgcagtggataccttgccgatggtcccgctagcgattccagttctggaccgtgtcacggtagtagctccgattcagttgttaattgtacagacatctctctgcagggcgtgcatgggtcatcaagcactttttgctcatctttaagctctgatttcgatcccctagtgtactgctctcccaaaggggacccccagagggtagacatgcagcccagcgtgacaagccgccctagaagtctagactccgtggtgcctaccggagaaactcaggtcagcagccatgtgcactaccatcggcaccgccatcaccactacaagaagcggtttcagtggcacggcagaaaacccggacccgagactggtgtcccacaaagcaggccgcctattccgaggactcagccccagcctgagccaccctcacctgatcaacaggttacccgcagcaatagtgctgctccaagcggacgcctaagcaacccgcagtgcccccgagccttgccagaacctgcgccaggtccagtcgacgcatcctcaatttgcccatctacctcctccctgttcaacttgcaaaagagctccctgtctgccaggcaccctcagcgtaaacggaggggtggcccatccgagcccacacctggatcccgcccacaggacgctacagtacatccagcctgtcagattttcccacactatacccctagcgttgcatacccatggagccccgaggcacaccccctgatttgtggcccacctgggctggacaagagattactgcctgaaaccccaggtccctgctattctaactcacagcctgtgtggttatgtctgaccccccgacagccactcgaaccgcaccctcccggtgaagggccaagcgaatggagcagtgacactgcggaagggaggccctgtccatatcctcactgccaggtactaagcgctcagccagggtcggaggaagagctcgaggaactgtgtgaacaagctgtgtag

SEQ ID NO: 239329 - DNA, 2229 bp, Artificial Sequence
  Description of Artificial Sequence: Synthetic coding sequence
atgtcaggtggacaccagcttcagttagctgccctgtggccttggctgctgatggccactctgcaagccggattcggccgaacaggacttgtgttggcggcagccgtcgagagcgagagatccgccgagcagaaggcaatcattagggttatccccctgaaaatggatccaaccgggaagctcaacctgaccctggaaggcgtatttgccggagttgcggagatcactcctgccgagggcaagttgatgcaggctaggatggcaggggagaggggagccagcgccgtcctctttgacatcaccgaggaccgtgctgcagccgaacagctgcagcaacccctcgggctgacctggccagtggtgttaatctggggcaacgatgctgaaaagctaatggaattcgtatataaaaaccagaaggcccatgtgaggatagaactaaaggagccaccggcttggcccgattatgatgtgtggatactgatgacggttgtgggcactatctttgtaatcatcctggcaagcgtgctccggataaggtgtcggcctcggcatagccgacctgaccctcttcaacagcgcacagcatgggccatcagtcagcttgccactaggagatatcaggcctcttgccgtcaggctaggggcgagtggcctgactccgggagcagttgcagcagcgcacctgtctgtgccatctgcctcgaggaattctcagaagggcaagaactgcgtgtcatatcgtgcctccacgagttccatcggaactgcgttgacccttggttacaccagcataggacttgcccactttgtatgttcaacattaccgagggagattcatttagccagtcattgggtcccagtcgcagctatcaggagcccggtcggagactgcatctaattcgacagcaccccggacacgctcactatcacttgccagctgcttatcttctgggaccatcacgctccgctgttgcacggcctcctaggcctggccctttcctgccaagccaagagccgggaatgggacctaggcatcataggttccctcgtgccgcacatcccagggccccaggcgagcagcagagacttgcaggagcacaacacccatacgcccaaggctggggcttgtcccacctgcagagcacaagccaacatccagctgcctgccccgtgcccctcaggcgggctagaccgcctgacagtagcggctctggcgaaagttactgtacggaacgcagtggctatctcgccgacggacccgcttctgactcttcaagtgggccatgtcacggcagctcttctgattccgtagtgaactgtaccgatatttccctgcaaggcgtccacgggtcgagttccactttctgcagtagcctctctagcgatttcgacccactagtgtattgctcacctaaaggcgacccacagagagtcgatatgcaaccatctgtcacttcaagacctcgaagccttgattcagtggtgcccacaggagagacacaagtgtcctctcacgtccactaccaccgccacaggcaccatcattacaagaagcggttccagtggcatggcagaaaacctggccctgagaccggcgtaccccaaagtcggcctcctattcctcggacccagccccagcccgagccgccatcccccgaccagcaggttacgcgcagtaatagcgccgctccctctgggaggctaagcaaccctcagtgtcctcgggctctgcctgagccagcgcctggacctgtcgacgccagtagcatctgtccatcgactagtagcttgtttaatttgcagaagtcaagcttgagcgccaggcatcctcaacgaaagcgcaggggtgggccaagcgagcccacccctggctcgcggcctcaggatgcaactgtgcacccagcctgccagatcttcccacactataccccgagtgtggcctatccttggagtcccgaggcccatccactgatctgtggccctcctggactcgataaaaggctcctgcctgagacccccggaccctgttactccaactctcagcctgtgtggctctgtcttaccccaagacagcctctggagccgcatcctcctggggaaggcccttcagagtggagctcagacactgccgaggggcgtccttgtccataccctcattgccaagtcctcagcgcccaaccaggttcagaagaggaattggaggagctgtgtgagcaggcagtatag

SEQ ID NO: 239330 - DNA, 543 bp, Artificial Sequence
  Description of Artificial Sequence: Synthetic coding sequence
atggctgctgcagaggaagaagatggtgggcctgaaggacccaaccgggagcgtggcggagccggagctacttttgaatgtaacatttgcttggaaacagcacgagaggccgtcgtgagcgtgtgtgggcatttatactgctggccctgcctccatcagtggttggaaacgcggcctgagcgccaggagtgtcctgtgtgtaaagccggtatctctcgggagaaagtggttcccctgtacggacggggaagtcagaaaccacaagatcctaggctaaaaactcctcctcgccctcagggacagagacctgctccggagtcccggggagggtttcagccgtttggggatacggggggtttccatttttctttcggggtaggggcattccccttcggtttctttactaccgtcttcaacgcccacgaaccattcaggagaggaacgggcgtggatctgggacagggccatcccgcatcttcgtggcaggactctctctttttgttcctcgcaattttcttttttttctggttgctgagcatttag

SEQ ID NO: 239331 - DNA, 543 bp, Artificial Sequence
  Description of Artificial Sequence: Synthetic coding sequence
atggcagccgctgaggaggaagatgggggtcctgaggggccaaatagggaacgtggcggagcaggggcaaccttcgagtgcaatatatgtctggagaccgccagagaggctgtagtgagtgtatgcgggcatttgtattgctggccttgcttgcatcagtggctggagacaaggccagaacgccaggagtgccccgtctgcaaagccggtatctcacgcgagaaagtagtacctctttacggtcggggttcccagaagcctcaggaccctcgcctcaagaccccaccaaggccccagggtcagcggcctgcccctgaaagtcgtggaggcttccagcctttcggggacacgggcggatttcatttctcctttggcgttggagctttcccattcgggttctttacaactgttttcaatgcacacgaaccattccgccgtggaaccggagtggacctgggtcagggccaccctgcttccagctggcaagatagcctgttcctgttcctcgctattttttttttcttctggctgctatccatttag

SEQ ID NO: 239332 - DNA, 549 bp, Artificial Sequence
  Description of Artificial Sequence: Synthetic coding sequence
atggctgccgctgaggaggaagatggtggcccagaaggcccaaacagagagagaggcggagcaggggcaacctttgaatgtaacatctgtctagaaaccgctagagaagctgtggtatctgtttgcggccacctatattgttggccatgcctgcatcaatggctggaaactcgaccagagcgtcaggaatgccctgtgtgcaaggcgggaatcagcagagagaaagtggtaccgctatatggtaggggctcccagaagccacaagacccacggttgaaaactccacctagaccacagggccagcggccagcgccagagagcagaggcggttttcagccatttggcgacacgggaggcttccatttttctttcggcgtgggagcattccctttcggatttttcaccacggtatttaacgcgcacgaacccttccgtcgcggaaccgggcctttctccacctcaccagctttcttccactacctgatcggaaatacttcgcgggagtttcggggtaggatatacaacttctggctgccaagaaacctttag

SEQ ID NO: 239333 - DNA, 543 bp, Artificial Sequence
  Description of Artificial Sequence: Synthetic coding sequence
atggccgctgctgaggaagaggacgggggtccagaaggccctaaccgagaaagaggcggtgccggagccactttcgagtgtaatatctgcctcgaaaccgccagagaggcggtcgtgagcgtgtgtggtcatctgtattgttggccctgtttacaccagtggttggagactcgcccagagcgacaggagtgtcctgtctgtaaggcgggtatttctcgcgagaaggtggtgcccctgtacggaaggggatctcagaaaccccaagatccgcgtctgaaaacgcccccacgcccacagggacagaggcctgctccagagagcaggggcggtttccagccttttggagacacgggaggtttccacttctcttttggggttggagcctttccatttggcttttttacaacagtctttaacgcgcatgagcccttccgccgaggaacgggcgttgatctcggtcaggggcaccccgctagcagctggcaagatagccttttcttattcctggctatctttttttttttttggctgttaagcatttag

SEQ ID NO: 239334 - DNA, 543 bp, Artificial Sequence
  Description of Artificial Sequence: Synthetic coding sequence
atggcagccgcagaagaggaggacggcggtcccgagggccctaacagggagcgcggaggtgccggtgctactttcgaatgtaacatctgtctcgagaccgcacgcgaagccgttgtgtccgtgtgtgggcacttgtactgttggccatgtctgcaccagtggctggagacaaggccagagcggcaagagtgtcctgtatgtaaagctggcatttcacgggagaaagttgtccccctttacggtagaggctcccagaagcctcaggatccccgtttgaaaactccaccgcgtccccaaggccagcggcctgctcccgagtccaggggcggattccagccattcggagatacagggggttttcacttttcgttcggcgttggagccttcccatttgggtttttcaccacagtgtttaatgcccacgagccctttaggagaggtaccggcgtggatctgggccaaggccatccagcatcctcatggcaagactctcttttcctgttcttagccatattcttcttcttttggctcctgagcatctag

SEQ ID NO: 239335 - DNA, 543 bp, Artificial Sequence
  Description of Artificial Sequence: Synthetic coding sequence
atggctgccgctgaggaagaggacggaggtcccgaagggccaaatcgggagaggggcggtgccggagctaccttcgaatgtaacatctgcctggagacggctcgcgaggccgtggttagcgtgtgcggacacctgtattgctggccatgcctccaccagtggctggagactcggcctgagcgacaggaatgcccagtgtgcaaagccggaatcagccgtgaaaaagtggtcccactttacggtaggggtagccagaagcctcaggaccctcggctgaagaccccaccacgtccccaagggcagcgcccagcccctgaatccagaggaggcttccagccattcggggacactggcggattccacttttcctttggggtgggggcatttcccttcgggttctttaccaccgtgttcaacgcgcacgagcctttccgcaggggaacgggcgtcgatctcggccagggccaccccgcttcctcctggcaggacagcctcttcttgtttctggccattttcttcttcttttggctgctaagcatctag

SEQ ID NO: 239336 - DNA, 543 bp, Artificial Sequence
  Description of Artificial Sequence: Synthetic coding sequence
atggccgctgcagaagaagaagatggcggacctgaaggcccaaatagggaacggggaggtgccggagcgacatttgagtgcaacatttgtctggaaaccgctagagaagccgtggtttcggtatgcgggcatctttactgctggccctgtctccaccagtggctcgaaaccaggcccgaaaggcaggagtgccccgtctgtaaggcagggatctcccgggagaaggttgttcccttgtacggcagagggagccagaagccacaagaccctcgacttaaaactcctcccagaccacaggggcagcgcccagctcctgaatctagaggaggctttcagcccttcggagacactggtggatttcatttttcctttggtgtaggcgcattcccatttggcttctttaccaccgtgtttaatgcacacgagccttttaggagagggaccggggtcgacctcgggcagggtcatccagcttctagctggcaggacagtctgttcctcttcctggccattttctttttcttttggctcttaagtatatag

SEQ ID NO: 239337 - DNA, 543 bp, Artificial Sequence
  Description of Artificial Sequence: Synthetic coding sequence
atggccgcagcggaggaagaggacggcggacccgaaggcccaaaccgcgaacgtggcggtgccggagctactttcgagtgtaacatttgtctggaaacagcaagagaagcagtggtcagcgtgtgcggtcacctctattgttggccttgcctgcaccagtggctcgaaacccggcctgaaaggcaggagtgtcccgtctgtaaagcagggatctctagagagaaggtagtgccattatatgggcgtggttcccaaaaaccccaagacccgaggctgaaaactcctccccgaccgcaggggcaacgccctgccccagagagcagaggagggttccagccatttggtgacactggcggtttccacttctccttcggtgtcggtgcgtttccctttgggtttttcaccacagtgttcaacgcccatgaaccattccggagaggcacgggggtcgacttgggtcagggccaccctgcctcaagttggcaggattccctcttcttgtttctggcaattttttttttcttttggctcctctccatctag

SEQ ID NO: 239338 - DNA, 549 bp, Artificial Sequence
  Description of Artificial Sequence: Synthetic coding sequence
atggccgcagcggaagaagaagacggaggtccggaaggtcctaaccgggagaggggaggggcaggggctactttcgagtgtaacatctgtctcgagactgcacgtgaagcagtggtatccgtgtgtggacatctgtactgttggccctgtctgcaccagtggctggagactcgcccagagaggcaggaatgtccggtgtgcaaagccggtatctcacgggaaaaagttgtaccactctatgggagggggtcccagaagccccaagaccctcgtctgaagactccacctcgccctcagggccaaagaccagctccggaaagccgcggagggtttcaacctttcggagatacaggcggtttccatttttcattcggggtgggggcattccccttcggatttttcacaaccgtgtttaatgcacatgagccgttccgcagaggcacaggccctttctcaaccagtcccgctttctttcattatctaattgggaacacttccagagaattccgcggaaggatctataatttttggctgccccgtaatctctag

SEQ ID NO: 239339 - DNA, 549 bp, Artificial Sequence
  Description of Artificial Sequence: Synthetic coding sequence
atggctgctgctgaggaggaggatggaggacctgaaggcccaaacagagagcggggaggcgctggggctactttcgagtgtaacatttgtctggaaacggccagagaggccgtggtatctgtatgtggtcatttatattgctggccctgcttgcatcagtggcttgagactcggcctgagagacaggagtgccccgtgtgcaaggctggcatctctcgcgaaaaagtggtgcccctttatggtcgaggatcgcagaaaccccaggacccccgattaaagaccccacccaggcctcaagggcagagaccggcaccagagtctaggggagggttccaaccctttggggatacagggggattccattttagtttcggcgtgggtgccttcccatttggtttctttaccactgtgttcaatgctcacgagcctttccgcagagggactggtcctttctcaactagcccagccttcttccactacctgatagggaatacttctcgggagtttagagggcgtatctacaatttctggttgccaaggaatctgtag

SEQ ID NO: 239340 - DNA, 549 bp, Artificial Sequence
  Description of Artificial Sequence: Synthetic coding sequence
atggccgctgccgaggaagaggacgggggtcctgagggccctaatagggagagggggggagctggagccacttttgagtgtaatatctgccttgaaactgccagagaggccgtggtgtccgtttgcggacacctatattgttggccgtgcctgcaccagtggttggagacgcgcccagagcggcaggaatgccctgtgtgcaaagccggaatctcacgagagaaggttgtgccactatatgggcgagggtcacaaaaaccccaggatcccaggctgaaaactccaccaaggccccagggtcagcgtcccgctcccgaaagcagagggggttttcagcccttcggagacaccgggggatttcactttagcttcggagtcggcgcattcccatttggtttctttacaaccgtattcaacgcacacgaaccttttagaagaggcacgggcccattctcaacatctccagctttcttccactatctcatcggcaacacctctcgagagtttcgcggacgcatatataatttttggttgcccagaaatctgtag

SEQ ID NO: 239341 - DNA, 549 bp, Artificial Sequence
  Description of Artificial Sequence: Synthetic coding sequence
atggctgctgcggaggaagaagatggaggcccagaggggcctaacagagaaagaggcggtgccggtgcaaccttcgagtgcaacatatgcttggaaaccgccagagaggcagtagtgtctgtgtgcggacatctttactgttggccttgtctgcaccagtggctagagacacgacctgagcggcaagaatgtcccgtgtgcaaggcaggtattagtagagagaaagtggtccctttatatggtcgcggtagccagaagccacaagatccacgtctcaagactccgccacgcccacagggtcagcgaccagccccagaaagtaggggcggttttcagccatttggcgataccggcggatttcacttcagctttggtgtcggtgccttcccatttgggtttttcactaccgtttttaatgctcacgagccctttagacggggaaccggcccattctctactagcccagccttcttccattatctgattggcaacacgagccgggaattccggggacgaatttacaacttttggttgccacggaacctgtag

SEQ ID NO: 239342 - DNA, 549 bp, Artificial Sequence
  Description of Artificial Sequence: Synthetic coding sequence
atggcggcagctgaggaggaggacggaggcccagagggaccgaatcgagagagggggggagccggtgcgacttttgaatgcaacatatgccttgagacggcacgggaagctgtggtgagcgtgtgtggtcacctatactgttggccttgcctgcatcagtggctggagacaaggccagaacgtcaggagtgtccagtgtgcaaagccggaatcagcagggagaaggtggtgccactctatgggaggggtagtcagaagccgcaggacccacgcctgaagacgccacccagacctcaaggacagcggcctgctcctgagtcaagaggcggttttcaaccattcggtgacacaggcggattccacttcagcttcggagtgggcgcattcccattcgggttctttactactgtctttaacgcccatgagccctttagacgtggcacagggcctttctctacaagccccgcttttttccactatttaatcggaaatacctcgcgcgaattcagagggcgtatctacaacttctggctgccacgcaacctgtag

SEQ ID NO: 239343 - DNA, 549 bp, Artificial Sequence
  Description of Artificial Sequence: Synthetic coding sequence
atggccgctgccgaggaagaggacggcggaccagaggggcctaatcgcgagagaggcggtgcgggagccacatttgagtgcaatatctgtctggagactgcgcgagaagccgtggtgtcagtttgcggccatctgtactgctggccctgtcttcaccagtggctggaaacacgcccagagagacaagaatgtcccgtttgtaaggccggaatttccagggagaaagtcgtccccttatatggtagaggtagtcagaagccccaggacccacgtcttaaaactccccctcggccacagggccagcgccctgccccagagagcagagggggtttccagccgttcggagataccggtggctttcatttcagcttcggtgttggcgcattcccattcggatttttcaccactgtgtttaatgctcatgagccgttccgaagggggaccggacctttctccacctctcccgctttcttccactacctaatcggtaatacttcccgggaatttcgtggcaggatttacaatttctggctgccgcgaaacctgtag

SEQ ID NO: 239344 - DNA, 342 bp, Artificial Sequence
  Description of Artificial Sequence: Synthetic coding sequence
atggccgatgtggaagacggagaagaaacctgcgctttagcctcccactccggcagtagcggcagtaagtccgggggagataagatgttttcactgaagaagtggaacgccgttgccatgtggtcctgggatgttgagtgcgacacctgcgctatttgccgagtccaggtgatggatgcatgcctccgatgccaggctgaaaacaaacaggaggattgcgtggttgtgtggggagaatgtaaccacagttttcacaactgctgcatgtccctgtgggtcaagcaaaacaacagatgtccgctgtgccaacaggattgggttgtgcaacgcatcggaaaatag

SEQ ID NO: 239345 - DNA, 273 bp, Artificial Sequence
  Description of Artificial Sequence: Synthetic coding sequence
atggcggacgtggaagacggtgaagaaacatgcgcgttggcatcccacagcggcagtagtggtagtaagtccgggggtgacaagatgttctccctcaaaaagtggaacgcagtcgcaatgtggtcctgggacgtcgaatgcgacacgtgtgcaatttgtagggtgcagatgccagtcctggacgtcaaactgaaaactaataagcggactgtgctctggtccggcgagaacgtgatcatccccagcaccaccgctgcatgcccctgcggttag

SEQ ID NO: 239346 - DNA, 294 bp, Artificial Sequence
  Description of Artificial Sequence: Synthetic coding sequence
atggccgatgttgaagacggggaggaaacctgtgcgctggcctcccacagtgggagctcagggtctaaatctggtggcgataaaatgtttagtctgaaaaagtggaacgcagtggcaatgtggtcatgggacgtcgaatgcgatacgtgcgccatatgccgcgtgcaagtgatggtcgtctggggcgagtgtaatcactcctttcacaattgctgcatgagcctgtgggttaaacaaaacaaccgatgcccactctgtcaacaggactgggttgtgcagcgcatcgggaagtag

SEQ ID NO: 239347 - DNA, 1875 bp, Artificial Sequence
  Description of Artificial Sequence: Synthetic coding sequence
atggaaaactcagattcgaatgacaaaggttctggcgaccaaagtgctgctcagaggaggagccaaatggacagacttgaccgtgaggaggccttttaccagttcgttaataacctgtctgaggaagactatcgattaatgcgagacaataatttgctcggaaccccaggcgagagcaccgaagaagagctgctgaggcggttacagcagattaaggaaggacctcctcctcagaactctgacgaaaaccgtggaggtgatagttccgatgatgtatccaacggagactctatcatcgattggttgaattctgtacgccagactggaaatactacccggtcaggtcagcgaggaaatcagtcttggagggccgttagccggacgaatccgaactccggcgactttagattttcccttgaaattaacgtcaatcgcaataacggcagtcaaaactctgagaatgagaacgaaccaagtgctcggaggtcttctggcgaaaatgtggagaataactcccagagacaggtggagaaccccagatcagagagcacaagcgctcgtccctcccgcagtgaacgcaacagtacagaggccctgaccgaggtccccccaacccggggacagcgacgagccagatccaggtccccggaccaccggcgaacgcgggcaagggcagagaggtcacgctcccctttgcatccgatgtcggaaatccctaggaggtcccaccactctatttcatcccagactttcgagcatcccctggtcaacgaaactgagggctctagtaggacccgtcaccacgtgacactcaggcaacagatctcggggcctgagctgttgtccagagggctcttcgctgcgagcgggacaagaaatgccagccaaggagcaggaagtagcgacacggccgcttcaggagaatctacagggtccggccaaaggcctccgactatcgtcctggatctccaggtcaggcgggtgagacccggtgagtataggcagcgcgactcgatagcgtcccggacacgctctcgcagccagacacccaataacacagtgacatacgaatctgaacgcggaggtttccggcgaacgttcagtcgttccgaacgagcaggtgtgcgtacctatgttagcactattaggataccgattcggcgaatactaaatacagggctgtccgagaccacgtctgttgccattcagacaatgctcagacagattatgacaggattcggcgaactgtcctacttcatgtattctgactccgactcagagcccaccggaagcgtcagcaacaggaacatggagcgggctgagagcagatccggaaggggcggaagcggcggaggctcaagtagtgggtcctcttctagttccagcagcagctcgtcttcttcttcctccagctcttcctccagttcaccatcctcttcctcaggaggcgagtcctcggaaaccagctcagacctgtttgagggtagcaacgagggtagctccagttccgggtcatccggcgcacggagggaagggcgacatagagctccagtgacgttcgatgagtccggatccctgccgttcttgtcactggctcagttctttctcctgaacgaggacgatgacgaccagcccaggggtttaaccaaggagcagattgacaacctcgcgatgcggagctttggcgagaacgacgcacttaaaacctgctctgtgtgtattacagagtatacagaaggaaacaagctcaggaaactcccctgtagccacgagtatcatgttcactgcatagatcggtggttgagcgagaatagcacctgtcccatatgtcggcgagccgtcctggcatcaggcaaccgggagtccgtggtgtag

SEQ ID NO: 239348 - DNA, 1875 bp, Artificial Sequence
  Description of Artificial Sequence: Synthetic coding sequence
atggaaaacagcgatagtaatgacaagggcagcggcgatcagagtgctgctcagagaaggtcccagatggacagattggacagagaagaggctttttatcagtttgtgaataacctttcagaagaagattataggcttatgcgggataacaacttgttaggaacacctggtgaaagtaccgaggaggaacttcttcgcaggctccagcagattaaagaaggaccaccaccccagaattctgacgagaacagaggtggcgacagttcagacgatgtgagtaatggggactccattattgattggctcaatagtgttaggcagacagggaacactacaaggagcgggcagcggggaaaccagagttggagggcagtctcacggacgaaccccaactcgggggatttcagattcagcctcgagattaatgtgaacagaaataatggctcacagaatagtgagaatgagaacgaaccctccgccaggcggagttccggagagaacgtcgagaataactctcagcggcaggttgagaacccacggtcggagtctaccagcgctcggccatcgcgaagcgaacgcaattccaccgaagccttaacggaggtgccacccactaggggccagaggagggctcgcagccggtctcctgaccaccggagaactcgagcgagagctgaacgcagtaggagtcccctgcacccaatgtccgaaattcccaggagatcccaccattctatctcaagccagaccttcgagcaccccttggtgaacgaaacggaagggtccagccgtacccgtcaccacgttaccttgcgccagcaaatttctggcccagaactgctcagccggggactctttgctgcatctggaactcggaacgcatcacaaggcgctggatcatctgatacagcagcctcaggcgagagcactgggagcggtcagcggcctccaacaatagtacttgatctccaggtgagaagagtgcgccctggggagtaccgccaacgtgactcaatcgcgtcaagaaccaggagcaggtcccagactcctaacaacactgttacttacgagagcgagcgcggtgggttcaggcgaaccttttcccgcagcgagagggctggagtgagaacttatgtcagcaccatccgaattccaattcgcagaatcctgaacacgggcctttctgaaactacttctgtggccattcagacaatgctccgacaaataatgaccggctttggagagctcagctattttatgtacagcgattcagacagcgaacctaccggcagcgtaagcaaccgaaatatggaacgggcagaaagtagaagtgggcgagggggatctggtgggggtagttctagtggctcctcttcctcttccagctcctcctcaagctcttcttcttcgtcctcttcttcctcaagcccgtcgagctcatcaggaggggagtcttcagaaacatcatctgacctgttcgagggctctaatgaaggcagcagcagcagcggctcatccggggctaggagggaaggtcgacatcgagcccctgtaacatttgatgagagtgggagcctaccttttctgagcctggcacaattttttttgctgaacgaggacgacgacgatcaacctcgcggattgaccaaagaacagatagacaatctggctatgcgcagcttcggggagaatgacgcactgaaaacgtgctccgtgtgcattaccgagtacaccgagggcaataaactccggaagttgccctgcagccacgagtaccacgtgcactgcatcgatcgctggctaagtgagaacagcacttgccccatttgcaggcgggcagtgttagcaagcggtaatagggagtcagtggtttag

SEQ ID NO: 239349 - DNA, 954 bp, Artificial Sequence
  Description of Artificial Sequence: Synthetic coding sequence
tgactgcccgcaccggctgctgccttgcccggagctcctcctccgcctccaggcgttcggggttacccagccagggcgcgaggcttgcagggagccagtggtggagctcgctttccttctagcctgtctctcccggtaccgggaaagggcggatgggtggtgtcgcgcgctaagtttcccgctctcgacagttgtgagatcacgaccgcccaccctagactgtgttttgctgtgtcccccccattcagctgctcattgcccttgccctcactctttcctcattccccgctcctaggcagacctaagcgacaggccaaacccgcagccgatgaggggttttgggactgttcagtgtgcacattccggaactccgctgaggccttcaaatgttccatatgcgatgttaggaaggggactagcactcggaagcccagaatcaactcacagcttgttgctcaacaggtggcccaacagtatgctacccctcccccacccaagaaagagaagaaagaaaaagtcgagaaacaggacaaggagaaacctgagaaggataaggagatctcaccctccgtgacaaaaaaaaacacgaataagaagacaaagccgaaatccgacattttaaaggacccacctagtgaagcaaattccatccagtcagcaaatgcgacaaccaaaacttctgaaaccaaccacacctcaagacctaggctcaaaaacgtcgaccggtcaacagcacagcaattggccgtgaccgtgggcaatgtaaccgtcattatcacggactttaaagagaagacgagatctagttctacttcaagctccaccgtgacttctagcgcaggctccgagcagcagaaccagagctcatccggttcggagtcaacggacaaggggagctccagatcatccacccccaagggagacatgtctgccgtcaatgacgaatcattctag

SEQ ID NO: 239350 - DNA, 456 bp, Artificial Sequence
  Description of Artificial Sequence: Synthetic coding sequence
atggattccgcagcatgcgccgcagcagctaccccggtccccgcactggccttggcgttagctccggacctggcccaggcaccacttgctcttcccggattgctgtctccaagttgtcttctgtcaagtgggcaggaggtcaatggctcagagaggggcacctgtctgtggcgcccttggctgagctccactaatgatagtcctagacagatgcggaagctggttgatctcgcagcaggaggggcaaccgcggctgaggtgaccaaagccgagtcaaagtttcaccaccctgttaggctgttctggcctaagtctagatccttcgattacctgtattctgccggtgaaatcctgctacagaacttcccagtgcaggccacgattaatctctatgaggactctgactccgaggaggaagaggaagacgaagaacaggaagacgaggaagagaaatag

SEQ ID NO: 239351 - DNA, 315 bp, Artificial Sequence
  Description of Artificial Sequence: Synthetic coding sequence
atggattccgcagcttgcgccgctgcggcaactcctgtcccggctctggcattggcgttggcccctgacttggcccaagcccctctggcgttgcctggcctgctctctccctcttgtctgcttagtagcgggcaggaggtgaacggctccgaacgcctgttttggcccaagtcacgcagcttcgattatttatatagcgccggagagatcctgctacagaacttccctgtccaggccacaatcaacttgtacgaggatagcgactcagaagaggaggaggaggacgaagaacaagaggacgaggaagagaaatag

SEQ ID NO: 239352 - DNA, 213 bp, Artificial Sequence
  Description of Artificial Sequence: Synthetic coding sequence
atgcccgacgggcctggtatgaccgctgccagtgggaagctgtaccagttccggcaccctgtgcgcctgttctggcctaagtcgaaatgttacgattacttgtaccaggaagcagaggctttactgaaaaatttcccaatccaggctaccatttccttttatgaagattctgactctgaggacgaaatagaagaccttacatgtgagaactag

SEQ ID NO: 239353 - DNA, 387 bp, Artificial Sequence
  Description of Artificial Sequence: Synthetic coding sequence
atggaaaatgccggaggcgctgagggtacagagtccggtgcagccgcttgcgcagcgactgatggtcccactaggagggccggagcggattccggttacgccggtttctggcgtccgtgggtggacgccggtggtaaaaaagaggaggaaacgccgaatcacgcagcagaggctatgcccgatggccctggtatgaccgccgcatccgggaaactgtaccagtttcgccaccccgtccgcctcttctggccgaagtcgaagtgctatgattacctgtaccaggaagcagaggcccttctcaagaactttcctattcaagcaaccatcagtttctacgaagacagtgattctgaagacgagatcgaagatctcacttgtgagaactag

SEQ ID NO: 239354 - DNA, 444 bp, Artificial Sequence
  Description of Artificial Sequence: Synthetic coding sequence
atggccgcagcagcagactcctttagtgggggaccagccggagtgcgtctccctaggtccccacccctcaaagttttggccgagcagctgcgccgtgacgcggaaggcggtccaggcgcttggcgtctgagcagggcagcggcaggacgcggacccttggatctggcagcagtctggatgcagggcagggtggtgatggctgatagaggggaagccaggctgagagatccctcaggcgattttagtgtccggggattggagcgtgtgccacgcggacgcccatgcctcgtgcccggaaagtacgtcatggtgatgggcgtggtacaagcatgcagccccgagccgtgtttgcaggcagtgaaaatgaccgatctctccgataatcccattcacgagtccatgtgggaactcgaggtggaggatttacataggaacattccgtag

SEQ ID NO: 239355 - DNA, 255 bp, Artificial Sequence
  Description of Artificial Sequence: Synthetic coding sequence
atgaagcaaactcaagtgggctcattgttcagtctcggaattcggaatcctgagcccggacccgtatctgggaccgcagtgccaagacagctggcatggaaaagcggcaaatatgttatggtcatgggggtcgttcaggcttgcagccctgagccatgcctgcaggctgttaaaatgacggacctgtccgataaccctatccatgagagcatgtgggaattagaggtcgaagatctgcataggaatatcccgtag

SEQ ID NO: 239356 - DNA, 1431 bp, Artificial Sequence
  Description of Artificial Sequence: Synthetic coding sequence
atggctaattctgcaaaagccgaggaatatgagaaaatgtcgctcgagcaggctaaagctagtgtgaatagtgaaactgaatcttccttcaacataaatgagaataccactgcgagcggcacagggttatcagaaaagacttctgtatgtagacaggtggacattgcacgcaagagaaaggaatttgaagatgatctggtgaaggaaagttcctcctgcggcaaggatacaccgtccaagaaacggaagctcgaccctgaaatcgttcccgaagagaaggattgcggcgatgccgagggaaactctaaaaagcgtaaacgcgagacagaggatgttcctaaagataagtcgagcacaggggatgggactcagaataagagaaaaatcgccttagaggatgttccggagaaacagaagaacctggaagaaggacacagttctactgtcgccgctcattataacgagcttcaggaagttggactcgaaaaacggagccagtcccgcatattctatctccggaatttcaacaactggatgaagtccgttctgattggtgagttcctggagaaggtgcgacagaaaaagaagagagacataacagttctggatctgggctgtgggaagggcggagatctcttaaagtggaagaagggacgtatcaacaagctggtctgcacggacatcgccgacgtatctgtcaagcagtgtcagcagcggtacgaagacatgaagaatagacgtgacagcgagtacatatttagcgctgaatttattactgcggattccagtaaagagctactgatcgacaagtttcgcgatccgcagatgtgctttgacatctgcagttgtcagttcgtgtgtcactactctttcgaaagttacgagcaggcagacatgatgctacggaatgcctgtgaacggctctccccgggaggatactttataggaactacgccaaatagcttcgagctgatacggaggcttgaggcttctgaaactgaatctttcgggaacgagatctataccgtgaaattccagaagaaaggtgattacccactgttcggatgtaaatacgacttcaatctcgagggcgtggtagacgtccccgaattcctcgtgtacttccctttgttgaacgaaatggcgaagaaatataatatgaagctcgtctacaagaagaccttccttgaattctacgaggagaagatcaaaaacaatgagaataagatgctccttaagcgcatgcaagccctggagccgtatcccgctaacgagagctctaagctcgtgtctgagaaagtggacgactacgagcatgccgcaaaatacatgaagaacagccaggtgcgactacccctggggaccctttcaaaatctgagtgggaggccacgtcaatctacctggtgttcgcatttgagaagcagcagtag

SEQ ID NO: 239357 - DNA, 1431 bp, Artificial Sequence
  Description of Artificial Sequence: Synthetic coding sequence
atggcaaacagcgcgaaggctgaagaatatgaaaagatgtctttggaacaggcgaaggcatctgtaaacagcgagaccgaaagctctttcaatatcaacgagaacactactgcctctggaacgggcctgtccgagaagacgagtgtttgccgccaggtggatattgcccgaaagcggaaggagtttgaggacgacctggtgaaggagagctctagctgtggaaaagatactccaagcaagaaacggaagctggatccagagatagtccccgaagagaaggattgcggcgacgccgagggaaactctaagaagagaaagcgagagacagaagatgtcccaaaggacaaaagtagcacaggtgatggaacacaaaacaagcggaaaatagccctggaggacgttcccgagaagcagaagaacctagaggaaggccactcctccacagtggctgctcactacaacgaactgcaggaagtgggactggaaaaacgctcgcagtcacgcattttttatctccgaaacttcaataactggatgaagtccgttctcatcggcgaattcctagaaaaggtgcggcaaaaaaagaaaagagacattacagtgttagatttgggttgcggcaagggaggagacttgctgaagtggaaaaagggaagaatcaataagctcgtgtgtaccgacatcgctgatgtctctgttaaacagtgccagcagagatatgaagatatgaagaaccggagagactctgagtatattttctctgccgagttcatcactgccgacagcagcaaagaactcctgatcgataagtttcgggatccacagatgtgctttgatatctgctcctgtcaattcgtgtgccattatagctttgaaagctatgagcaggctgacatgatgctgcgaaacgcatgcgagaggctgtcacccggtggctattttattgggacgacaccaaattcctttgaactcataagaaggctggaggccagtgaaactgaatccttcggcaacgaaatctacacggtcaagtttcaaaagaaaggtgactacccgctgttcggatgcaagtatgatttcaacctcgagggagtcgtagacgtgcccgagttcctggtttactttcctctgctcaacgaaatggctaagaagtacaacatgaaactggtatataagaaaacattcctggaattctatgaggaaaaaatcaagaacaatgagaataagatgctccttaaacgaatgcaggccctggaaccctatccagctaacgagagctcaaagctggtatccgaaaaggtcgatgattatgagcacgccgcaaaatacatgaagaattctcaggttcgcctgccccttggcacccttagcaaatctgaatgggaagctactagcatctacctcgtgttcgcgtttgaaaagcagcagtag

SEQ ID NO: 239358 - DNA, 705 bp, Artificial Sequence
  Description of Artificial Sequence: Synthetic coding sequence
atgaagaataggcgggactctgagtacatcttctccgctgagtttatcaccgccgatagcagtaaagagctgctgatcgataagttcagagatccacaaatgtgctttgatatttgctcatgtcagtttgtgtgtcactacagcttcgagtcatatgaacaagcagatatgatgctgcgcaacgcctgcgaacgcctttctcccggaggttacttcatcggtaccactcccaactcttttgaactgatcagacgcctggaggcgtccgaaaccgagagttttggcaacgaaatctatactgtaaaattccagaaaaaaggagactacccactcttcggctgcaagtatgactttaacttggaaggtgtagtcgacgtcccagaatttctcgtctacttcccattactgaacgagatggccaaaaagtataacatgaaacttgtctacaaaaagacattcctggaattctatgaggagaaaattaaaaacaatgagaataagatgcttctaaagagaatgcaggcactggagccctatcctgccaatgagtcatcaaaacttgtgtcggaaaaggtggacgattatgagcatgcggctaaatacatgaagaattctcaagtgagactaccgctcgggacactgtccaagtctgagtgggaagcaaccagcatctatctagtgtttgcttttgaaaagcagcaatag

SEQ ID NO: 239359 - DNA, 1431 bp, Artificial Sequence
  Description of Artificial Sequence: Synthetic coding sequence
atggctaactcggccaaagccgaagagtatgagaagatgtcactagagcaggccaaggcatctgttaattctgagaccgagtcctccttcaacatcaacgaaaacactaccgcttcgggtacaggcctatctgagaagacgagcgtatgccggcaagttgatatcgccaggaaacgtaaagagttcgaggatgacctcgttaaggagtcatcttcctgcggaaaggacacaccgagtaaaaaaaggaagctggatcctgagattgtgcccgaggaaaaggactgcggggacgccgagggcaacagtaaaaaacgcaagagagaaacagaagacgtgcccaaagataagagtagcaccggggacggcacccaaaacaaacggaaaattgcattagaagacgtccccgaaaaacagaagaacttggaagaagggcattctagcacagtggccgcacactataatgagttacaggaagtcggattagagaaacggagtcaaagccggattttttaccttaggaacttcaacaactggatgaagtccgtcctgattggggagttcctggaaaaagtccgacagaagaagaagcgagacattacggtattggacctcggctgcggtaagggcggagatctcttgaagtggaagaagggcaggattaataaattagtgtgtaccgacatcgcagacgtgtccgtgaaacagtgtcagcagcgctacgaagacatgaaaaatagaagagacagcgagtatatctttagcgctgaatttataactgccgatagctccaaagaactgctgattgataaatttcgggatccccaaatgtgttttgatatctgcagctgccagtttgtgtgccattactcctttgaaagctacgaacaggcagacatgatgttgcgcaatgcttgcgagcggttgagccccggaggctacttcattggcaccacacccaacagttttgagctcatccgcaggctagaggcgtccgaaacagaatccttcgggaatgagatatacacagtgaaattccagaagaagggagactaccccctgtttggttgcaagtatgattttaacctcgagggtgtggttgacgtccctgaatttctggtgtattttccactgctcaacgagatggccaaaaagtataacatgaagcttgtctataagaaaacatttttggagttctacgaagagaagatcaagaataacgagaataaaatgttgcttaagaggatgcaagctctcgagccatacccggcaaacgaatcttctaagctggtctccgagaaggtcgacgactacgagcatgcagccaaatacatgaagaatagtcaggtaagactgccactgggcactctgagtaaatccgagtgggaggctacctcgatctatcttgtgttcgcctttgagaagcagcagtag

SEQ ID NO: 239360 - DNA, 390 bp, Artificial Sequence
  Description of Artificial Sequence: Synthetic coding sequence
atgaagtctgttctaataggagaattcctggagaaggtgagacagaaaaagaaacgtgacatcaccgtgcttgaccttggttgcgggaaaggcggtgatctcttaaaatggaaaaaaggtcgaatcaacaaacttgtctgtactgacattgctgatgtgagtgttaagcaatgccagcaacgatatgaggacatgaaaaaccgcagggactcagaatatatcttcagtgccgagttcattacggcggatagcagtaaagaactgttgatcgacaagttccgtgatcctcagatgtgttttgatatctgcagttgtcagttcgtctgccattattccttcgagagctatgagcaggcagacatgatgctgagaaatgcctgtggaacctag

SEQ ID NO: 239361 - DNA, 468 bp, Artificial Sequence
  Description of Artificial Sequence: Synthetic coding sequence
atggccccacgaacttggtgccccgcagggattttcgggctgttctgccccctgacccttgcctgttcatctctgaccattgccctgaccgactgccagcctattatacttgtgagtccgacactgtcgctttggatggtggtcagatctgtgtggatcatgcaggcctctctgttaggggagcccgaagaagtcgccctgggtccgatgggtgttgtcgccgctacacttgaagtggtcggcacccgggcaatgggggttgccggaatcatgaccgtcgacctggaaggaatggatatggatatggacgtgcccgaaacaatcatggctgaaacccgggtggtgatgacagccacgcaggaggagataacagagaccattatgacaacggaaatgagacacgcccacaatatcggagaaacctggatctcagctctcagcgaaccagtatgccatacactgagttag

SEQ ID NO: 239362 - DNA, 474 bp, Artificial Sequence
  Description of Artificial Sequence: Synthetic coding sequence
atgtcctccgaggaaggcaagttatttgtgggaggcttgaactttaacaccgacgaacaggcgctggaggatcacttttcttcattcggacctataagcgaagttgttgtagtgaaggatcgggaaacccaacgctcgcgaggtttcggattcataactttcacaaatccagagcatgcctccgtcgcaatgcgggcaatgaacggcgaatcactggacggccgacagatacgcgtcgaccacgccggaaaaagcgcaaggggcacgagagggggtggcttcggcgctcatggcagaggcaggtcttatagccggggtggtggcgaccagggttacgggtcaggaaggtattatgactctcgaccaggtggttatggctacggatatgggaggtctcgcgactacaatggcaggaaccagggagggtacgataggtatagtggtgggaattatagggacaattatgataactag

SEQ ID NO: 239363 - DNA, 474 bp, Artificial Sequence
  Description of Artificial Sequence: Synthetic coding sequence
atgtcttccgaagagggtaagttattcgtagggggtttaaactttaatacggacgagcaggctttggaagatcatttctcctcattcggacccatcagcgaagttgttgttgtgaaggaccgtgagacccagagatcgcgcggatttggattcatcacctttaccaatccggaacacgctagcgtggccatgagagccatgaatggtgaatcactcgatggacgccaaatcagagttgaccacgctggaaagtccgcccgtgggacccgcggaggaggctttggggcacatgggaggggtcgatcctactcccgcggtggaggggatcagggctatggaagcgggagatactatgattcacgcccaggtgggtacgggtacggctacggtcggtccagagactacaacgggcgaaaccaaggtggatatgaccggtacagtggcggtaactaccgtgacaactatgataactag

SEQ ID NO: 239364 - DNA, 510 bp, Artificial Sequence
  Description of Artificial Sequence: Synthetic coding sequence
atggcccctcgcacatggtgccccgcagggatttttggccttttctgccctctgacccttgcatgttcctctctgacaatcgccctgactgattgtcaacccataatcctggtctctcctactttgagtctttggatggttgtccgcagcgtatggattatgcaagcatccctcctgggcgagcctgaggaggtagcactggggcctatgggagttgttgcagccacactggaggtggttgggacacgtgccatgggtgtggccggtattatgacagtggaccttgaaggcatggatatggatatggatgtgccggaaacaatcatggctgagacccgtgtcgtcatgacagctacccaagaggaaattactgagacaattatgactacggaaatgcgccatgcccacaacattgacacacagggcatcatttcggatcctggttccagtttccagatggctgtatttattaaagtgttcggggcagcaccaaagcatctcattttgtag

SEQ ID NO: 239365 - DNA, 2559 bp, Artificial Sequence
  Description of Artificial Sequence: Synthetic coding sequence
atggagtatgagaggcgaggcggaagaggcgataggacaggccgttacggggcaactgacagatcacaggacgacggtggagaaaaccggtccagagaccacgattacagagatatggattaccgaagctaccctagggaatacggaagtcaggaagggaaacacgattatgacgactcatcagaagaacagtcagcggagataagggggcagctccagagtcatggagtgcaggcacgcgaggtgcgcctgatgagaaataaaagctcaggtcagtcgcgaggatttgcgtttgtagagttcagccacctccaggacgccactcgctggatggaagccaatcagcactcacttaacattcttggtcaaaaagtcagtatgcattactcagatcctaagcctaagatcaacgaggactggctgtgcaataagtgtggcgtgcagaatttcaaaagaagggaaaagtgctttaagtgcggtgtgccaaagtcagaagccgaacagaagttgcccctgggcacaagattggaccagcagaccctgccccttggcggacgggaactttcccaagggttattgcccctgccacaaccataccaggctcagggcgtgctcgcctcccaggccctgtctcagggaagcgagccttcctctgaaaacgccaatgatacaattattctgcggaacctgaacccacatagcactatggacagcatccttggcgcacttgctccatatgctgtgctgagttcaagcaacgtgcgggtgatcaaggataaacaaacccagcttaacagaggattcgcgtttatccaactaagtaccatcgaggccgcacagctgcttcagatcctccaggccctgcaccctcccctgacaatcgatggcaagacaattaacgtggaattcgcgaagggaagcaagcgcgacatggcgtctaacgaggggtctaggatatctgcagcatctgtggccagtacagccattgccgctgcacagtgggctatatcccaggcgtcacagggaggcgagggcacctgggcaacaagtgaggaaccccctgtggactactcgtattatcagcaagacgaaggctatggaaactctcaggggactgagagtagcctctatgcccatggctacctgaaggggaccaaagggcctggtatcaccgggacaaaaggagaccctaccggtgcgggacccgaggcaagcttagagcctggggctgacagcgttagcatgcaggcgttttcccgggctcagcctggcgcagccccaggcatttaccagcagtccgccgaggcttccagttcccagggcactgccgcaaattctcagagttatactattatgagcccagctgtgctgaaatctgagctgcagtcccctacacatccctcttcggcgttgcctccagccacctcccccacagcccaagagtcctattctcaatacccagtgccagacgtgagcacctaccagtacgatgagacttctggatactattatgacccccagacgggtctgtactatgaccccaattcccaatactactacaatgctcagagccagcagtacctctactgggatggagaacgtcgcacctacgtaccagcactcgagcaaagcgcggatggccataaagaaaccggggcacctagcaaagaggggaaagaaaagaaggagaagcataagacgaaaactgcacagcagatcgctaaagatatggagcgctgggcacgtagcctcaataagcaaaaagagaacttcaaaaactcatttcaaccgatttcaagtttgagggacgatgagaggcgagagagtgcgaccgcggacgctggctacgccatcttagagaaaaagggagccctcgctgagaggcagcacacatcaatggacttgcctaaactggcgagcgatgatcgtcccagtccgcctcggggactagtcgccgcatactccggggagtccgattctgaggaggagcaggagcggggaggacctgaacgagaagaaaaactgacagactggcagaaattagcatgtctgctgtgccgccgtcagttcccttccaaggaggcactcatccgacatcaacagctctccgggttgcataaacagaacctggaaattcatcggagggcacacctgtctgaaaacgagctggaagctttggaaaaaaacgatatggaacagatgaagtacagggatcgtgctgcggagcggagggagaaatacggaatcccggagcctccagagcccaagcggaggaagtacgggggaatcagcacagcctcagttgacttcgaacaaccaacccgggacgggctggggtctgacaacatcgggtctagaatgctccaggcaatggggtggaaagaaggtagtggcctcggtaggaagaaacaaggcatagtcacaccaatcgaagcccagacccgcgttcggggatccgggttaggggcacgaggctcctcatatggagttactagtacagagagctacaaagagacattgcataaaactatggtgactcgcttcaacgaggctcaatag

SEQ ID NO: 239366 - DNA, 2562 bp, Artificial Sequence
  Description of Artificial Sequence: Synthetic coding sequence
atggagtatgagcgcagaggtggaaggggcgacagaacaggtagatatggtgctacagacagaagtcaggatgacgggggtgagaatcggtcccgcgaccatgattacagagacatggactacaggtcttatccacgagagtacggcagtcaggaaggcaagcatgactacgatgactccagtgaagaacaatctgcggaaattagagggcagctgcagtcgcacggggtccaggcaagagaagttcggttaatgcgcaataagtcgagtggacagagtaggggctttgccttcgtcgagttctcacacctccaagatgccacgaggtggatggaggcaaatcagcacagtctgaacatcttaggacaaaaggtgtccatgcattactcagatccaaagcctaagattaacgaagactggctctgcaacaaatgtggagtgcagaatttcaagcgaagagaaaagtgcttcaagtgcggagtccccaagagtgaagctgaacagaagctgccattgggaacacggctcgaccagcagacgcttccgctgggagggcgtgagttgagtcaggggctccttccgcttccccagccataccaggcccagggcgtgcttgcaagtcaggccctcagccagggtagtgagccgagcagcgagaacgcgaatgacaccatcattctacgaaacctgaacccccactctaccatggatagtattctgggtgccctggcaccttacgctgtgctctcttcctccaacgtgagggtgatcaaggataaacaaacacagctgaatagaggttttgccttcattcaactgagcacaattgtcgaggcagcccagctgcttcaaatccttcaggcactacaccccccactgaccatcgatggcaaaaccatcaatgtggagtttgcaaagggaagtaaacgggatatggcatctaacgagggttcacggataagcgccgcttctgtggccagcactgcaatcgcagcagcccagtgggccatttcacaggcctcccaggggggagaagggacctgggccactagtgaggagccacccgtggattattcctactaccagcaggatgagggatacggcaacagccagggaacagagagcagtctgtatgcccacggatatctgaagggcactaaagggcctggcatcacgggcacgaagggggaccctactggggcaggtcctgaagcctccctggaacctggcgcagactcagtctccatgcaagcttttagtcgggctcagcctggggctgctccagggatttaccagcagagcgccgaggcatccagttcccagggaacggcagccaatagtcagagctatactattatgtcccctgcagtcctcaaatctgaactgcagtctcctactcacccatctagcgcactccctcccgctaccagtccaacagcccaagaaagctacagccagtatcccgtgccagatgtgagcacgtatcaatacgacgagaccagcggatactactacgatccacaaactggcctgtactatgatcccaactcgcagtactattacaatgcgcagagtcagcagtacctctactgggatggggagcgaagaacatacgtgccggcactggagcagtctgcagacggccataaggagactggtgcaccttccaaggaaggcaaggagaagaaggaaaagcacaaaaccaagaccgcacagcaaatcgccaaggatatggagcgctgggcccgatcactcaataagcagaaagagaatttcaagaattcctttcagcccatttcctcactgcgggacgatgagcgcagagaatctgcaaccgcggacgcgggatacgcaattctggaaaaaaaaggggctttagccgagcgccagcacaccagcatggatctacccaaactggcaagtgacgataggccgtctccaccacgcggactggtggctgcttactcaggcgagagcgacagcgaggaggaacaagaacgcggtggccctgagagagaagagaagttgaccgactggcagaaactggcatgtctgctgtgtcggaggcagtttccgtcgaaggaagcactgatacggcaccagcagctgtccggtctgcacaagcagaatctcgagatacacaggcgagcccacctttcagagaacgagcttgaggcactggagaaaaacgatatggagcagatgaagtaccgggaccgcgctgcagaaaggagggaaaaatacggcattcccgagccacccgagccaaagcggagaaaatatggcggaatctctacagccagcgtggatttcgaacaacctacccgagatggcctgggcagcgataacatcggatccaggatgctgcaggccatgggctggaaggaggggtcaggactggggagaaagaagcagggaatcgtgacgcccatagaggcacagactagggtgcggggaagcggccttggggcaaggggaagctcttatggggtgacgagcactgagtcatataaagaaacgcttcataagaccatggtaacacgattcaacgaagcccagtag

SEQ ID NO: 239367 - DNA, 2793 bp, Artificial Sequence
  Description of Artificial Sequence: Synthetic coding sequence
atggaatacgagcgtcgcggagggcgaggcgatagaactgggaggtatggagccaccgaccgttcccaggacgatggcggagagaataggagcagggatcacgactacagggacatggactaccgatcctacccccgagaatacggaagccaggagggaaaacatgactatgatgattcgtccgaggagcagagcgccgaagacagctacgaggccagccctgggagcgagactcagcgtcggagaaggcggaggcaccggcactctccaacgggcccacctggctttccccgagacggagactacagggaccaggactaccgcacagaacaaggcgaagaagaggaagaggaagaagatgaggaggaagaggaaaaggcctccaacattgtgatgctcagaatgctaccccaggctgcgacggaggacgacattcggggtcagctgcagtctcacggggtccaggccagggaagtcaggctgatgagaaacaagtcctctggacagtcaaggggttttgcatttgttgagttcagccacctgcaagacgccacacgctggatggaggcaaaccagcattcacttaatattttgggccaaaaagtctcaatgcactatagtgaccccaagcccaaaatcaacgaggactggttgtgtaacaagtgtggggttcaaaattttaagaggagagaaaagtgttttaagtgcggtgtgccaaagtccgaggccgaacagaaacttcctctgggaacacggttagaccagcagactctcccactgggaggacgcgagctgagccaaggtctactacctctgccgcagccttatcaggcacagggcgtattggcgtcacaggcgctgtctcaaggctctgagccctccagcgagaacgctaacgatacaattattttgagaaaccttaatccccactctacaatggacagcatcctaggagccttggccccttacgcagtacttagtagctcgaacgtcagggtgattaaggacaaacagacccagttgaacaggggatttgcatttatccaactatccacaatcgtcgaagccgctcagttgctgcagatcttgcaagccttacacccccctctgactatagacggaaagaccattaatgtcgagtttgccaaaggatctaagagggacatggctagcaacgaaggcagccggatatccgccgctagcgtggcaagtaccgccattgctgctgctcaatgggcaatttcacaagcaagccagggaggagagggcacttgggccaccagtgaagagccaccagtcgactattcctactaccagcaggacgaagggtacggcaattctcaaggcacggaatcttccctgtacgcccatggctatctcaagggcacgaaggggccaggcattaccggtaccaagggtgacccgaccggcgcaggcccagaggcaagcctagaaccaggcgctgattcagtgtcaatgcaggcctttagccgcgcacagccaggcgcagcacctggcatttaccaacagtcagctgaggctagctcgtcccaagggaccgcagccaactcacagagctatactataatgagccccgcagtgttgaagtccgagctgcagagcccaacgcacccttcttccgcccttcccccagcaacttcacccacagctcaggagagctattcacaatatcccgtgcccgacgtgtcaacctaccaatatgatgaaacctcaggttactactatgatcctcaaaccggcctctactacgatcccaactcacagtactactacaacgctcagagccagcaatatctatattgggatggagaacggagaacatatgtaccagccctggagcagagcgcagacggtcacaaagaaacaggggctccaagtaaagagggcaaagagaaaaaagaaaagcacaagacgaagacagctcaacagatcgctaaggacatggagaggtgggcgagaagtttgaataagcaaaaggagaattttaagaattcattccagccaatttcaagcttgagagacgacgaaagacgggagtcagccacggctgacgctggctacgctatcctggaaaagaagggggctctggccgagaggcagcatacatcgatggatttacccaaactcgcgtcagatgatcggccttctccgccaaggggcctcgtagcggcatactctggggagtcagactcagaggaggagcaggagcggggaggccctgagagggaggaaaagttgactgattggcagaagctcgcctgtttactctgtcgcagacagttcccctctaaagaagccttaattagacaccagcagctgtcagggctccacaaacaaaacctcgagatacaccgtagagctcacctctcagagaacgagctggaagcattggaaaaaaacgacatggagcagatgaagtatagggatcgcgcagccgagagacgagaaaaatacggaatccccgagccgccagaacccaaacgcagaaaatatgggggaatctccaccgcttctgttgactttgaacaacccactagggatggtctgggcagcgataacattggaagccgcatgctgcaggctatggggtggaaagagggttccggtctgggcagaaagaaacagggcattgtcacgccaatcgaagctcaaacacgcgtgcgaggcagcggtttgggcgctcggggatcttcttatggcgttacaagcacagagagttacaaagagacacttcataaaaccatggtgacgagatttaatgaggcccagtag

SEQ ID NO: 239368 - DNA, 2010 bp, Artificial Sequence
  Description of Artificial Sequence: Synthetic coding sequence
atgaagatctttgttggaaacgtagatggcgctgacaccactccagaagaactcgccgctttatttgcaccttatggaaccgtgatgagttgcgccgttatgaaacaatttgcatttgtgcatatgagggagaacgccggagccctgcgtgccatcgaagctctccatgggcacgaactccgcccaggccgagccctcgtggtggaaatgtctcgccctagaccgctcaacacttggaagatcttcgtgggcaacgtgtctgctgcctgcactagccaagagctgcgctctcttttcgagcgaagggggagggttatcgagtgtgacgtggtcaaggactatgccttcgtgcacatggaaaaagaagccgatgccaaggcagctattgcacagctgaacggtaaagaagtgaagggaaaacggatcaatgttgaactttccactaagggtcagaagaagggaccagggttagccgtgcagagcggcgacaagaccaaaaagcctggggcaggagacaccgcgtttcctggtacaggtggattctcggctacgttcgattaccagcaggcattcggtaactcaaccggaggtttcgatggtcaggccaggcagcctacacctcccttcttcgggcgagaccggtctcccctgagacgttccccccctcgcgcaagctatgtagctccgttgactgcacagccagccacatacagagcccagccttctgtatctttgggcgcagcttatagggcccaacccagcgcgtctcttggagttggttaccggactcagccaatgaccgcgcaggctgcctcctacagggctcaaccgtcagtctctcttggggcaccataccgcggtcaattggcctccccttcaagccagagcgctgctgcttcttccttgggtccttatggtggagcccaaccaagcgccagcgccctcagcagttatggtggtcaagcggctgctgcctcatccctcaactcctacggggctcagggctcgagcctggcaagctacggcaatcagccctcctcctatggcgcacaggctgcaagcagttacggcgtgagggccgctgctagcagctataatactcaaggggctgcctcttcactaggcagttacggggctcaggccgcatcatacggcgctcaatcggccgcaagctctctggcttacggagcacaagcggcatcatacaatgcccagccttctgcgagttacaatgcgcaaagcgctccatatgcagcacaacaggcagccagctacagcagtcagcccgctgcctatgtggcacaacccgctacagccgctgcctacgccagtcagccagccgcatatgctgctcaggccacaactccaatggcgggatcatatggcgcacagccagtagtccagacccagctgaatagttatggtgcacaagccagcatgggattgagtggttcctacggtgctcagtctgctgccgcagccactggttcctacggagctgccgctgcatacggcgcacagccttcagccaccttggccgcaccgtaccgcacccagtccagcgcatccctggctgcttcctatgctgcccaacagcatcctcaggccgctgcatcatacagagggcagcctgggaatgcttacgacggagcagggcaaccatcagcagcttatctcagtatgtcccagggcgcagtggcaaatgccaacagcacacccccaccatatgagcggactcggcttagccctccgagagcttcatacgacgatccatacaaaaaagccgtcgcaatgtctaaaagatacggtagtgaccggagactggcagagctttctgattatcggcgtctctccgagagccagttgtccttccgtcgcagccctaccaagagtagtttggactataggagactcccagatgcacattccgattacgctcgctactcaggttcctataacgactacctccgggctgcccagatgcattctggttatcagcgcagaatgtag

SEQ ID NO: 239369 - DNA, 471 bp, Artificial Sequence
  Description of Artificial Sequence: Synthetic coding sequence
atgaaaatcttcgttggcaatgtggacggagccgacacgacccctgaggagctggccgctttattcgcgccttatggtaccgtcatgagctgcgcagtaatgaaacaattcgcatttgtgcatatgagggaaaatgcaggcgcactgcgcgctatagaggcccttcacggccacgagttgcgacctggcagggccctggtggtggaaatgtcccgacccagaccactgaacacttggaagatttttgttggcaacgttagcgcagcgtgcacatcccaggagctgcggtcgctgtttgaaagacgtgggagggtcatcgagtgcgatgttgtgaaggactatgcctttgtgcatatggaaaaggaggcagacgctaaggcagccatcgcccagttaaacgggaaagaagtaaaggggaagagaatcaacgtagagttaagtacgaagggaatggtgcctacaggcgtgtag

SEQ ID NO: 239370 - DNA, 360 bp, Artificial Sequence
  Description of Artificial Sequence: Synthetic coding sequence
atgaagatcttcgtggggaatgtcgacggagccgacaccacccctgaggagctcgctgccctgttcgcgccttacggaactgtaatgtcgtgcgccgtgatgaaacaatttgccttcgtgcacatgcgggagaacgcaggagcactgcgagccatcgaagctctccacgggcatgaactaagaccgggacgagcgctcgttgtggaaatgagcaggcccagacccctgaatacatggaagatctttgttggcaacgtctcagctgcctgtacaagtcaggagctccgtagcctttttgaaagacggggtcgggtcattgagtgcgatgtggtgaagggcatggtaccaaccggagtgtag

SEQ ID NO: 239371 - DNA, 2934 bp, Artificial Sequence
  Description of Artificial Sequence: Synthetic coding sequence
atgcggactgcaggccgagaccctgttcctagacgttctccaagatggcgacgtgctgtgccactgtgcgagacttctgccggtcgcagagtgacccagttgcggggagatgacctgcgcagaccggctacaatgaagggcaaagaaaggtcacccgtgaaagccaagcgcagcagagggggtgaagacagtaccagccggggtgagcggtcaaaaaaacttgggggatctgggggatcaaacgggtcctctagcggaaagacagactctggaggagggtcacgaagatcactccacctcgacaagtcatcatcaaggggtgggagccgcgagtacgacacggggggaggctcatcgagtagcaggttgcattcctactccagcccaagcacaaaaaactcatctgggggaggagagagccggtcctcctcccgagggggaggtggggaatctcggtccagcggagcggctagtagtgctcctggcggaggggacggcgcagagtataagaccttaaagatatccgaactcggatcacagctgtcagacgaagccgtcgaggacgggttgtttcacgagttcaagagattcggagatgtgtccgtgaaaatttcccacctgagtggatccggctccggcgatgagagggtggcatttgtcaacttcagacggcctgaagacgccagggccgcaaaacacgccaggggacgcttagtactctatgacaggccgctgaagattgaagcggtgtatgtcagtcggaggcgatctagaagtccactggacaaggatacttacccaccttctgccagcgtagtcggagctagcgtggggggacaccggcatcctccaggcggaggagggggacagagatccctttctcctggcggagcggctctcggctaccgggattatcgcctgcagcagcttgccctcggacggctgccaccaccacctcccccaccactgcccagggatctggagagggagcgagactatcccttttacgagcgggttcgccctgcatactcacttgagcctcgagtgggtgcaggcgctggagccgctcccttccgtgaagttgacgaaataagtccagaggacgatcagcgcgcaaatcggacactcttcttgggtaacctggacataaccgttacggagtcagacctgcggagagccttcgacaggtttggggtcatcactgaagtggacatcaagaggccgtcacgcggacagacctccacttatggctttctgaaatttgaaaaccttgatatgtctcaccgtgccaaactagcgatgagtggcaaaataattattagaaatcctataaaaattggttacgggaaagctacccccacgacgcgcctgtgggtcgggggattgggtccttgggtccccctggctgccctcgcaagggagttcgatagatttggcaccattcggacaatcgactacaggaaaggcgattcatgggcgtatattcaatatgagagtttggatgcggcacatgcggcatggacacacatgagaggattccctttgggcggaccagacagaagacttcgcgtcgacttcgcggacactgagcaccgataccagcagcagtacctccaaccactccctctcacacactacgaactggtgaccgatgcttttggtcaccgggctcccgacccacttcggggagctcgcgatcggacccctcccctgctctatcgtgatcgcgacagagatttatacccggactctgactgggtgccgcctcccccacccgttagagagcgtagcaccaggacagccgctacgtccgtccctgcatacgagccgcttgactctctggatagaaggcgtgatggctggtccctggacagggatcgcggagacagggaccttcccagctcccgcgatcaacctcggaagagaagattaccagaggagtcggggggtaggcacctggacaggtcccccgaatctgaccgcccacgcaaacgccactgcgcgccttctcccgacaggtcccctgaactgtccagttctagagacaggtacaatagtgataacgataggtcaagcaggttgctgctggaaagaccgagcccaattcgagacaggagaggttccctcgagaaatctcaaggggacaagcgagaccgaaaaaatagcgcgagcgctgagcgcgatcggaaacaccgtactaccgcaccgactgaagggaagagcccactgaagaaggaggaccgaagcgacggttccgcgcctagcacttcgaccgcctcatcaaagctgaaaagcccaagccagaaacaggatgggggaacggcccctgtagcctcagcgagccccaagctgtgcctcgcatggcaggggatgttgctgctgaagaatagcaattttccgtccaacatgcacctactgcagggcgatctccaggttgcttcctccctgctggtggagggaagcactgggggaaaggtggcccagctgaagatcactcagcgattgcgacttgaccagcctaagctagatgaagtcacaagacggatcaaagttgcaggccctaatggctatgcaattttattagcggtacccggtagtagtgactctcggagctcctcctcaagtgcggcatccgacacagccacatcgactcagaggccccttcgaaatttagtaagttacctgaaacaaaagcaggcagcaggagtcatcagtctgcctgtgggtggcaataaggacaaagaaaataccggggtgttacatgccttccctccttgtgagttcagccagcaattccttgattcccccgctaaggcgctcgcaaagtccgaggaagactacctagtgatgatcatcgtgcggggattcggattccaaattggggtaaggtacgagaataaaaaacgtgaaaacttggctctgacacttctctag

SEQ ID NO: 239372 - DNA, 2673 bp, Artificial Sequence
  Description of Artificial Sequence: Synthetic coding sequence
atgaagagacagagtgagcgggacagtagccctagtgggagaggatcaagctcttctgctaaaagacctcgcgaacgcgaacgcgaagcagaagctggaggtcgaagggccgctcacaaggccagcgggggagccaagcaccctgttccagctagagcccgtgacaagccaagaggaagcggttcaggtggcggaggccaccgagacggcagaggaacaggagacgcaaatcacagagcaagtagcggcagatcaagcgggagcggagctggaggcggaggcagaggcggtaaggctagcggtgatcccggagcaagcggaatgtccccacgggcttcacctttgcctccccctcctccccctcccggtgccgagccggcttgcccaggcagttctgccgcagccccagagtataagaccctactgatcagtagcctgagtcccgctctgccggctgaacacctggaggacagactctttcaccagttcaaaaggttcggcgaaatcagtctgaggctctctcacaccccagagttggggagagtggcctatgtgaattttcgacatccccaagacgccagagaggccaggcagcacgcacttgctaggcaacttttgctctatgaccggcctctcaaagtggagcccgtatatcttaggggaggagggggatcctcaagacgcagctccagttcctcagcagccgcttccacacctcctcctggacctccagccccagcggaccctctggggtacctccctctccacggagggtatcagtataaacagcggagcctctctccagtggcagccccaccactgagagagcctagggcacggcacgctgcagccgcttttgccttggacgctgcagcggctgcagccgtcgggctgagtcgtgagagggctttggactactatggcctgtacgacgaccggggacgaccgtatgggtatccagccgtttgtgaagaggacctgatgccggaagacgatcagagagctacacggaacctgttcatcggcaacctggaccattctgtatccgaggttgaacttagacgggcattcgaaaaatacggcatcattgaagaggtggtcatcaagagacctgctcgtggccagggcggagcatacgcattcttgaaattccagaacttagacatggctcaccgtgccaaggttgctatgtctggacgcgtgatcggcaggaatcccatcaagataggatatggtaaagcgaacccaacaacgcgcctctgggtgggcggtctaggccctaatacaagtctggctgccctggccagagaatttgatcgcttcggtagcatacgcaccatcgaccacgtcaagggagatagtttcgcatacatccagtacgaaagcttagatgctgcccaggcagcgtgcgcaaaaatgcggggatttccactggggggtcccgataggagactgagagtagacttcgccaaggccgaagaaaccaggtatcctcaacagtatcagccatcaccgttgcccgtccattatgaactactcacagacggctataccaggcaccgcaacttagacgctgatctggtgagagataggacccccccacacttgctgtattccgacagagacaggaccttcttagagggcgactggacaagcccatcaaagagctctgatcgcaggaactccctggaaggctatagtcgcagtgtgaggtccaggtccggtgagcgttggggagcagatggggatagggggctgcccaagccgtgggaggaaaggcgcaaacgccgatccctcagtagcgatagagggagaacaacccatagcccctacgaagaacgatccagaacaaagggcagcggccagcagtcggagcggggaagcgatcggaccccagaaagatcccgaaaagaaaaccactcaagcgaggggacaaaagagtcttctagcaattcattatccaatagccgccatggagcagaagaacgcggacaccatcaccaccaccacgaggcagcagacagctcacatggcaaaaaagctcgcgactctgagcgcaaccataggacgactgaggctgaacccaaaccattggaggaacctaaacatgagactaagaagctgaaaaatctctccgagtacgcacagactcttcagctggggtggaatggtttgttggtactgaaaaactcctgctttccaacttctatgcacatcctcgagggtgaccagggagttatatcttcgttgctgaaagatcatacctcgggcagcaaactcacccagctaaaaattgcccagagactccgacttgatcaaccaaagctggatgaggtcacgcgacggataaaacagggctcacccaatggctatgccgtactcttagcaacccaggcaacaccctctggactcgggacagaaggaatgcctacagtcgaaccgggactgcagcggagactgcttaggaatctggtcagctatctgaagcaaaaacaggccgcaggcgtcataagtttacctgtgggaggtagcaagggcagagacggaactggcatgctttatgcctttcctccttgcgacttctcccagcagtacctccaatcagccttaaggaccctgggaaaactcgaggaggaacacatggtaattgtcattgtgcgcgatactgcatag

SEQ ID NO: 239373 - DNA, 765 bp, Artificial Sequence
  Description of Artificial Sequence: Synthetic coding sequence
atggaaacggtggtgtgccccccatgggaggagcgcagaaagaggaggtcgctgtctagtgaccggggtcggacaacccatagcccttacgaagagaggtcacgcaccaagggaagcgggcagcaaagcgagagaggttcggaccggactcccgagaggtcacgtaaggagaatcattctagcgaaggtacaaaagaatcctcgtcaaattcattgtcaaactctaggcacggagcagaggagcggggtcaccatcaccatcaccatgaggccgctgattcatcgcacggaaagaaggctcgggactcagagcgcaaccaccgcactactgaagccgaaccgaagccgctggaggagccaaagcacgagactaaaaagcttaaaaacctttccgagtatgcacagaccctgcaactcggctggaatggtctgttggtacttaaaaactcatgctttcctacttctatgcacatactcgaaggggaccagggagtcattagttccctgctgaaggaccacacatctggctctaagctcactcagctgaagattgctcagagattacgcctggaccaacctaagctggacgaagttacccgccgaatcaaacaggggagcccaaatggttacgccgtcctgcttgcaacccaggccaccccaagtggactgggaactgaaggcatgccgaccgtcgagcctggcctgcagcgtcgtttgttaaggaacttggtatcatacctcaagcagaagcaggcggctggatag

SEQ ID NO: 239374 - DNA, 636 bp, Artificial Sequence
  Description of Artificial Sequence: Synthetic coding sequence
atgaagagacagtcagaaaggaatcacagaaccaccgaggctgaacctaagcccctcgaggagccaaaacatgagactaagaaactgaagaacctgtcggagtacgcccagaccctgcaactgggatggaacggactgcttgttctgaagaatagctgctttcccacaagcatgcacattttagagggcgaccagggtgttataagtagcttattgaaagatcacaccagcggcagtaaacttacccagcttaagatcgcacagaggctgcggctcgaccagcctaaactggatgaggttactagaagaattaagcagggcagtccgaatggttatgcagttttgcttgcaacacaggcgactcctagcggactggggacagagggcatgccaacagtggaacctgggttacaacgtcgcttgttaaggaatcttgtgtcttacctcaagcagaaacaggccgctggcgttatctcacttcctgtgggtggaagtaagggcagggacggtaccgggatgctgtacgcattccccccttgtgacttctcacagcagtatctgcaatctgcgctcaggacactgggaaagctggaggaggaacatatggtcatagtcatcgtaagggatacagcttag

SEQ ID NO: 239375 - DNA, 1692 bp, Artificial Sequence
  Description of Artificial Sequence: Synthetic coding sequence
atgccagaggacgatcagcgcgctacacgaaatctgttcataggcaatctcgaccactcagtcagcgaggtggagctgcgcagggctttcgagaagtacgggatcattgaggaggtggttattaaaaggcctgctaggggtcagggtggagcatacgcatttctgaagttccagaatctcgatatggcccaccgggctaaagtggccatgtccgggagagtgattggaaggaatcccatcaaaattggatatggcaaggccaacccaactactagactatgggtgggcggtctaggacctaacacgtccctggctgccctggcccgagaattcgacaggttcgggtcaattaggaccattgatcacgttaagggtgactcctttgcctatatccaatatgaatccctagacgcagcgcaagctgcctgcgcaaaaatgagaggctttcccttggggggtcccgatcgtcgtctacgggttgacttcgctaaagccgaagagaccaggtacccccagcagtatcagccctctcctctcccggttcactatgagttgctgactgatggatacacaagacacaggaatctcgatgccgacctcgtgagggatcggactcccccacacttgctctattcagaccgagaccggaccttcttggagggagactggacctcgccgagtaaatctagtgaccgccgtaatagcctagaaggctactccaggtctgtgaggtcccgaagtggagagaggtggggcgcagacggcgacaggggcctccctaagccatgggaggaacggaggaagcgtagaagtttgagttccgaccgcggacgcacaactcactccccttacgaggaaagatcccgtacaaagggcagcgggcagcagtcagaacggggttcggatcgtaccccagagcggagtcgtaaagagaaccatagcagcgaaggcacaaaggagagctcgagcaactcactatcaaacagtcgccacggggctgaggagcgtggacaccatcaccaccaccatgaggccgctgattcatctcacggcaagaaagcaagggactcagaacgaaatcatcgaaccactgaggctgaaccaaagcctcttgaggagccaaaacatgagactaaaaaacttaagaatctgagtgaatacgcacagactttgcagttaggctggaatggcctgcttgttctgaagaactcttgcttccccacctcaatgcatattttagaaggcgatcagggagtgatatctagccttctaaaggaccacacctcgggcagcaaacttactcaactcaaaatcgcacagcgactaaggttagaccaaccaaagctcgatgaggtgaccaggcgcattaagcaggggtcaccaaatggatacgccgtgctgctggccacacaggccacgccctcgggtcttggcactgaggggatgcctacggtggagcctggtcttcagcggaggctgctgcgaaacttagtttcctatttgaagcaaaagcaagccgctggcgtgatcagcttgcccgtcggcggttcaaagggcagggatggaaccggtatgctctatgctttcccaccttgtgattttagccagcagtacctgcagtccgccttgcggacgcttgggaaactcgaagaagagcatatggtgatcgtgattgtgagggacacagcttag

SEQ ID NO: 239376 - DNA, 732 bp, Artificial Sequence
  Description of Artificial Sequence: Synthetic coding sequence
atgggaagggtggggagggccggtcgtagtcagcgaactaagcagtcaaccgttctggcgcctgtaatagacctgaagagaggaggctcctcagatgatcgacaaatcgttgacaccccaccccacgtggccgcaggcctgaaggacccagtccccagcgggttttctgcaggcgaggtcctcatccccttagccgatgagtatgatccaatgtttcccaacgattacgagaaggtcgtgaaaagacagcgggaggaacggcaacgccaaagagaactggagcggcagaaagaaattgaggagcgggaaaaaaggaggaaggaccgccatgaagcctcaggattcgctcgtagaccagaccccgactctgatgaagatgaggattatgagcgtgagcgtcgcaaacgcagtatgggtggcgcagctattgctcctccaacctcgctggtcgaaaaggataaggaactacccagagatttcccttacgaggaggattctaggccacgaagtcagagcagtaaggcagccattcccccacccgtgtatgaggaacaagatcgccctaggagtccgaccgggccttcgaattctttcttagccaacatgggcggaacggtggcccacaagatcatgcagaagtacgggtttagagagggtcagggcctcggaaagcatgagcaaggactcagcaccgctctttctgttgaaaagacctcaaaacgcggagggtag

SEQ ID NO: 239377 - DNA, 1206 bp, Artificial Sequence
  Description of Artificial Sequence: Synthetic coding sequence
atgtccctttatgatgatcttggagttgagactagcgattcgaaaaccgaagggtggtcaaaaaactttaagctgctgcagagccagcttcaggtcaaaaaggcagcactcactcaggcaaagtctcagcggaccaagcaaagcaccgtgctggcccctgtgattgatctcaagagaggcggatcgtccgatgatcggcagatcgtcgatacccctccacacgtagcagccggtctcaaggaccctgtgccctccgggttcagcgctggcgaagtccttatcccgctcgcagacgaatacgatcctatgttccccaatgactatgaaaaagtcgtcaaaagacaaagagaagagagacagcgtcagcgggagctggagcgacagaaggagatcgaagaacgcgaaaagcgacgcaaagataggcacgaggccagtgggttcgctcgtcgcccagaccccgactctgatgaggacgaggactacgagagggagcgcaggaagcggtccatgggtggcgctgcaatcgcgccacctaccagccttgtcgagaaggataaagagctgcctcgggatttcccatacgaggaggattctagacccaggtctcaaagctccaaggccgctatcccgccacccgtttatgaagagcaggatcgtcctagaagtcccaccgggccaagtaattcatttctggcaaatatgggcggaacagtagcgcataaaataatgcagaagtatggcttccgagagggtcagggcttagggaagcacgagcagggacttagcaccgcattgtccgtggaaaaaacaagcaaacggggaggaaaaataatagtaggcgatgctacggaaaaagacgcttcaaagaagtccgatagcaaccctcttaccgagatcctgaagtgtcccaccaaggtagtgttactgcgaaacatggtgggagctggagaggtagatgaggatcttgaggtggaaactaaggaggaatgcgaaaagtacggcaaagttggcaagtgtgtcattttcgagatcccgggagccccagatgatgaggcagtcaggatatttttagaatttgagcgcgttgagtccgccattaaggctgtggtcgacctgaatggcagatatttcgggggacgcgtggttaaagcgtgcttctataatttagacaagttccgcgtgctagatctcgcagaacaagtctag

SEQ ID NO: 239378 - DNA, 639 bp, Artificial Sequence
  Description of Artificial Sequence: Synthetic coding sequence
atgagcttgtatgatgatttgggcgttgagacatccgactcaaagacagaagggtggagtaagaatttcaagcttctgcagtctcagctacaggtcaaaaaggcggcattgacacaggcaaaatcccagcggacaaagcagtcaacagtactcgcacctgttatcgacctcaaaagggggggatcaagcgacgacagacagatcgtagacaccccaccacatgtggccgctggcttaaaggaccccgtcccctccgggttttctgcaggcgaagttctcatcccactggccgacgaatatgatccgatgtttcccaatgactacgaaaaggtcgtgaaacgtcagcgcgaagagcgccagcggcagcgggagctggaaaggcaaaaagagatcgaggaaagagaaaaacgtaggaaggacaggcatgaggcatccggctttgcccgaagacccgacccggactccgatgaagatgaagattacgagcgggaacgcagaaaaaggtcaatgggcggtgccgctatcgcaccacccaccagccttgtggagaaggacaaggagcttccgagagattttccctatgaggaggactcaagacccaggagtcagtccagtaaggcagccatcccccctccatag

SEQ ID NO: 239379 - DNA, 666 bp, Artificial Sequence
  Description of Artificial Sequence: Synthetic coding sequence
atgagcctctacgacgatttgggtgtagagacttcagattcaaagaccgaaggctggagtaagaacttcaagttattacagtcacagctgcaggtcaagaaggcggcactaacgcaggctaagtcacagcgcaccaagcagagcacggtgctggcgcctgtgatcgatcttaagagaggaggctcttcggatgataggcaaatcgtggacactccgccacacgttgccgcaggcctgaaggaccctgtcccttcaggcttcagtgctggcgaggtcctcattcctctggcagatgaatatgaccccatgtttccaaatgattatgagaaggtggtcaagcgccagagagaggaacgtcagcggcagagggagttagagcggcaaaaggaaatcgaggaacgcgaaaagcgcaaagacagacacgaggctagtggcttcgcaaggcgcccagaccctgactcggatgaggatgaagactatgagagagagagacgaaaacgaagcatggggggagccgctatcgcaccgcctacttcactcgtcgaaaaggacaaggaactcccgagagacttcccatacgaggaggactcacgccctcggtctcagtcttcaaaagccgctattcccccaccagtctatgaggagcaggataggccccgttcctag

SEQ ID NO: 239380 - DNA, 732 bp, Artificial Sequence
  Description of Artificial Sequence: Synthetic coding sequence
atggggagagtgggcagagctggccgtagtcaaaggacaaaacagtcaacagtgctggctcccgtgatagacctaaaaagaggaggctcttccgacgaccggcagattgtggacaccccgccacacgtggccgctggcctgaaggaccctgttcccagcggtttctcagctggggaagtgctgattccacttgcagacgaatatgatcctatgttcccaaacgattacgagaaggtagtcaagaggcagcgggaggaacgccagcggcagcgagagctcgagcggcagaaagagatcgaagagagagagaaacgaagaaaggatcgacacgaggcctccggattcgcacgaaggcccgatcccgacagcgatgaagatgaagactacgaaagggaacgccgaaaacgtagtatgggaggagcggctattgcccctccgaccagtctcgtcgaaaaagacaaggaactcccacgtgattttccctacgaagaggattccaggccccgatcacagagttctaaggccgctatcccaccacccgtgtacgaggagcaagaccgtccacggtctccgacagggccttccaattcattcctggctaacatgggtgggacggtggcgcataagatcatgcagaagtacggtttcagggagggccagggcctggggaagcacgaacagggactgtccacagcgctgagtgtggagaagacatctaagagggggggatag

SEQ ID NO: 239381 - DNA, 1206 bp, Artificial Sequence
  Description of Artificial Sequence: Synthetic coding sequence
atgtcactgtacgacgatttgggggtggaaaccagcgattctaagaccgaagggtggagtaaaaacttcaagctgttgcagtctcaacttcaagtcaagaaggccgctctgactcaagcaaaaagccaaaggacaaaacaatcgactgtgctcgcgcctgtgatagacctgaaacgcggagggagcagtgacgataggcagatcgtggacaccccccctcacgtcgccgctggcctgaaagacccggtcccaagtggcttctcagccggagaggtcctcatcccccttgcagatgaatacgaccctatgtttcccaatgactatgagaaagtcgttaagcgacagcgggaggagcgccaaagacaaagggagcttgaacgccagaaagagattgaggaacgagagaagcggaggaaggatcggcacgaagccagtgggttcgcccgtaggcccgatcccgacagcgacgaagatgaagattacgagagagagcggagaaagaggagcatgggcggagcggcaatcgcccctcccactagccttgttgagaaggataaagaattgcctagagatttcccctacgaagaagattctagacctcggtctcagtcctccaaggcagctattccacctccggtatacgaagagcaagatcggccaaggagccctaccggcccatccaactcattcctcgccaatatgggcggtacggtcgctcacaaaatcatgcaaaagtacgggtttcgagaaggtcagggcctgggcaagcatgagcagggcctgagtactgcattgagcgtagagaaaacatcaaaacggggtggcaaaatcattgtcggtgacgcaactgaaaaggatgcctctaagaaatccgactccaacccattgactgagatactgaagtgcccaacaaaggtggttcttttacgaaacatggttggggcaggcgaggtcgacgaggatcttgaggtggagaccaaagaagaatgcgaaaagtatggaaaggtaggtaagtgcgtgatctttgagattcctggagccccagacgatgaagctgtccgaatctttctggaatttgagcgcgttgagtccgccattaaggccgtggtggatcttaacggaagatactttggagggagagtggtgaaagcctgcttctataacctcgacaagttccgggtgttggatctagctgagcaggtgtag

SEQ ID NO: 239382 - DNA, 678 bp, Artificial Sequence
  Description of Artificial Sequence: Synthetic coding sequence
taacccttggcggatgaatacgacccaatgtttccaaatgactatgagaaggtagtaaaacgccagcgagaggaacgacaacgtcagcgggagctggagcgccaaaaggaaatcgaagagcgggagaaacgaaggaaagatcgacatgaggcttctggttttgcaagacgacctgaccccgattcagacgaggatgaggattatgagagggagaggcgcaaaagatcaatgggaggggctgccatagctccccctacaagcctagttgagaaagacaaggagttacccagggacttcccatatgaagaggattctaggccacggtcccagagcagtaaagctgctatccccccaccagtctacgaagagcaagataggcctagatcccctacaggtcccagtaatagctttctggctaacatgggagggaccgtcgctcataaaattatgcaaaagtatggcttcagagagggccaggggttgggcaaacacgagcagggactgtcaacagccctcagcgtggaaaagacctcaaagcgcggtggcaaaatcattgtcggagatgcgacagagaaaggcgtctcccctgggaagagggtaacgcgtggaaagggactggcacccagtatcagcgatatggcatccttggatccacacgtgagcgcgggtggtcagtag

SEQ ID NO: 239383 - DNA, 3684 bp, Artificial Sequence
  Description of Artificial Sequence: Synthetic coding sequence
atggtgctggcagccgctatgtctcaagatgccgacccttctggacccgaacagccggatcgcgtcgcttgtagcgtgcccggtgcacgggcatcgccagcccctagtggcccaaggggcatgcagcaacctccccctcccccacagccccctcctcctccccaggctggactacctcagatcattcagaatgctgccaagttgttagacaaaaaccctttcagcgtgagtaatccaaacccactgctgccatcacccgctagcttgcagctggctcagcttcaggcccaattgacactacatcgcctaaaactggcgcagactgcggtgacaaacaataccgccgcagcaactgtcttaaaccaagtgctgagcaaagttgctatgagtcagcctttatttaatcagctgcggcacccctccgtgatcaccgggccacatggacacgcgggagtccctcagcatgctgcagcaatcccaagtaccagattcccgtccaatgctattgccttttctcctcccagtcagactcggggtcccggaccctccatgaatctaccgaaccagcccccttccgccatggtgatgcatccctttacaggcgtgatgcctcaaacgcctggccagcctgcggtgattctcggcatcggaaagaccggccctgcaccagctaccgccggattttacgaatacggaaaagcctctagcggccagacttacggcccagagacggacggtcagccaggatttctcccttcttccgccagcacctctggttctgtgacctacgagggccattactctcatacaggacaagacggccaggcagcttttagtaaagacttttacggcccaaatagtcaaggaagccatgtagccagtggtttcccagcggaacaggctggcggactcaagagcgaggtaggccctctgctgcagggcacaaatagccaatgggagtccccacatggattctccggccaatccaagcccgacctgacagcaggaccaatgtggccaccaccccacaatcagccttatgaactctacgaccccgaggagccaaccagcgatcgaactcccccaagtttcggaggcaggctgaacaacagtaaacaggggtttatcggtgcagggcgtagagctaaggaagatcaggctctcctcagcgtccgacccttgcaggctcatgaactgaacgattttcacggtgtggcccctttacatctaccccacatctgctctatctgtgacaagaaggtcttcgatttaaaagactgggaactccacgtgaaagggaagctacacgctcaaaagtgtctggttttcagtgaaaatgcaggcattcggtgcatcttgggctctgccgaggggactctatgtgccagcccaaatagtactgcagtttacaacccggctggaaatgaagactacgcctccaacctgggcaccagctatgtgcctatcccggcaagaagctttacacagagtagccctacgtttccacttgcttcagtcggcacaacgttcgcacagcgtaagggcgcaggacgggtggtgcacatttgtaatttgcccgaggggagttgcactgaaaacgatgtcattaacctgggcctgcccttcggcaaggtgactaactacatacttatgaagtccaccaatcaggcctttctggaaatggcctataccgaagccgcacaggctatggtgcaatattatcaggaaaagagtgctgtaataaacggggaaaagctcctgattcgtatgtctaaacggtacaaagaactgcagctaaaaaagcccggtaaggcagtagcagctataattcaggatatccacagtcagagagagcgtgatatgtttagagaggctgaccgttacggcccagagaggccacggtctcggagtcctgtgtcacgtagcttaagccctcggagccacacgccgtcattcacatcttgtagctcatcccacagtccccctgggccttcaagggcagactggggaaatggacgagactcttgggagcacagtccttacgcacggagggaggaggagcgggatcccgcaccctggcgcgataacggggatgacaagcgcgatcgcatggatccctgggctcatgacagaaaacatcaccccaggcaactcgataaggcagaactcgacgaacggcctgaggggggtaggccgcacagagagaaatatcctcgctccgggtcccctaacctgccccattcagtatcttcatataaaagtcgcgaggatgggtactaccgcaaggagcccaaggccaaatgggacaaatatttgaagcaacagcaggacgctccgggtcggagccggagaaaggacgaggcaaggctgcgagagtcccgccaccctcacccagacgactctggaaaagaggacggactgggtcccaaagtgacccgcgctcccgagggcgcaaaggccaagcagaacgaaaaaaacaagactaagagaacagaccgagaccaagaaggggcagatgaccggaaggagaatacgatggcggagaatgaggctgggaaagaggaacaagagggtatggaagaatcaccccagtcagtcggcagacaggaaaaggaagcagagttcagcgaccccgagaacacccggacaaaaaaggagcaggactgggaatccgagtccgaagcagaaggagagagttggtatcctaccaacatggaagaacttgttaccgtcgacgaggtgggcgaggaagaggatttcatcgttgaacctgatatccccgagctcgaggaaattgtgcctatcgatcagaaagataaaatttgccctgaaacgtgtctttgcgtcacaactactctggatttagatctggcccaggatttcccaaaagagggcgtcaaagctgtggggaatggcgctgcagagattagcctgaaaagccctcgcgaactgccttcagcaagtacgtcttgcccctcagatatggacgtcgagatgccaggcttgaatctcgacgccgagaggaaacctgcggaatctgagacaggattgtctctcgaggacagtgattgttatgaaaaggaggcaaaaggagtggaatcaagcgatgtccacccagcccctactgtgcaacagatgagctctcctaaaccggctgaggaacgagctagacagccaagcccattcgtggacgattgtaaaacacgcggtactcccgaggacggcgcttgcgaggggtctcctctagaagaaaaagcgtcccctcctatcgaaactgacctgcagaaccaggcatgccaggaagttctgacccctgagaattcacgttatgtggagatgaagtcgctcgaagtgcgatcaccggagtacaccgaagtagagcttaagcagcccctcagccttccatcttgggagccggaggatgttttctctgaactctcgatccctttgggtgtggagtttgtcgtccccaggactggcttttattgcaaactgtgtggacttttttacacatctgaggagaccgcgaaaatgtcccactgtcgttccgcggttcactacagaaacctacagaaatacctatctcaactggctgaggaaggcctcaaggagactgagggagctgactcaccaagaccggaggacagcgggattgtgcccagatttgagcgaaaaaaactgtag

SEQ ID NO: 239384 - DNA, 3378 bp, Artificial Sequence
  Description of Artificial Sequence: Synthetic coding sequence
atggtattggccgcagcgatgtctcaggatgcggatccaagtggcccagaacagccagatagagtggcttgctctgtgcccggagcacgggcttcaccagctccctctgggccaaggggaatgcaacagccccctcctcctccacagccaccaccgccaccacaggctggcctgccccaaatcatccagaacgccgctaagctgctggacaagaatcccttctccgtttctaacccaaaccccctgttaccgagccccgctagcctgcagctggcacagcttcaggcccaactgaccctgcatagactaaaactcgcccaaacagccgttacaaacaacactgcagcggcaacagtactgaaccaggtgctctccaaagtggcgatgtcccagcccctgttcaaccaactccgacacccttcagtgataacagggcctcacggtcatgccggtgtgccccagcatgcggcagccataccgtctactcgatttcctagtaacgcaatagctttttcaccccctagccaaaccagaggccctggtccctcgatgaacctgccaaatcagcctcccagcgccatggttatgcaccctttcactggagtgatgcctcagacccctggacagccggcagtcatcctggggatcgggaagacaggtcctgcgcctgcaacagcaggcttttatgaatacggaaaagcctcttccggacaaacttatggacctgagaccgatggtcagcctggctttcttcctagcagcgctagcacaagtggttccgtgacgtacgaagggcattactcgcacacgggtcaggacggtcaggccgcattctcaaaagacttttatggacccaactcacagggatctcatgttgcctcaggattccctgccgaacaagctggcggactgaaatctgaagtgggacccctccttcaaggcaccaactcccagtgggaaagcccacacggcttcagtggtcagagcaagcccgacctgaccgcaggcccaatgtggcctcctccacacaatcaaccctacgagttatatgatccagaagaaccaacatctgatcggactcccccatctttcggcggaagattaaataatagtaagcaaggattcatcggtgccggtcgcagagccaaagaagatcaggccctgctgtctgtacgccctctgcaagctcacgagctgaatgacttccatggagtggccccactacacttaccacatatctgttcaatttgcgacaaaaaagtgttcgacctcaaagactgggaactgcacgtgaagggcaaactgcacgcacaaaagtgtctcgtgttctccgagaacgcgggaatcaggtgtattttggggagcgcagaagggacgttatgtgcaagcccaaattctacagcagtttacaatccagccggaaatgaggactacgcctccaacctgggtacctcttacgttcctattcccgcacgctcctttacgcagagctctcccacgtttcccctggccagtgttggcaccacgttcgcccagcggaaaggtgccggaagagtcgtccacatctgtaacctgcccgaaggttcgtgcaccgaaaatgacgttatcaatctaggcttgccttttgggaaggttacgaattatatcttgatgaagagtaccaatcaggcattcctagaaatggcctatacggaggctgctcaagccatggtgcagtactatcaggaaaaaagcgctgtgatcaacggcgaaaaactcctaattcgcatgtctaagcggtacaaggagcttcagctgaaaaagcccggaaaggccgtggcagcgataattcaagacattcattcccaaagggaaagggatatgttccgggaggccgacagatatggcccagagaggccacgcagtcggagtccagtgtctcgttctctaagccccagatcacatacacccagtttcacctcctgttcctctagtcatagtccacctggtccatctagggctgactgggggaatggccgagactcctgggaacatagcccttacgccaggcgtgaggaagaacgagaccctgcaccctggcgcgataatggcgatgataaacgtgataggatggacccatgggctcacgaccggaaacatcaccctaggcagttggataaggccgagctggatgaacggccagaaggcggaaggccacatcgtgagaagtacccccgtagtgggtcacctaacttgccacactccgtaagctcctacaaaagccgggaggacggatactacaggaaggaaccgaaggccaagtgggacaaatacctcaagcagcagcaggacgctcctggacggagtcgccgtaaggatgaagcacgccttagggagagtcggcacccacaccctgatgacagtgggaaggaggacgggttaggtcccaaagtgaccagagccccagaaggtgctaaagccaagcaaaacgaaaagaataagaccaaacgtaccgaccgggatcaagagggcgcagatgaccggaaggaaaacactatggctgaaaatgaggctgggaaggaagaacaagagggcatggaggagagcccccagagtgtcggcagacaggagaaggaggccgagttctcagaccctgagaacacacgaactaaaaaagagcaggactgggagagtgaaagcgaggcagaaggggagtcatggtaccccacaaacatggaggaactggtgactgtggatgaggtgggagaggaggaggacttcatcgtcgagccagacatccccgaactggaggaaatcgtgccaatcgaccagaaagacaagatttgccccgaaacgtgcctttgcgtcaccacaacattagacctggatctggcacaggatttcccaaaagagggggtcaaggctgttggcaacggggcagctgagatttccctgaaatccccccgagaactgccgagcgcctccacgagttgtccatccgacatggatgtggaaatgcccggactgaacctggacgcagagcgcaaaccagccgaatcggagaccggtctgtctctcgaagatagtgattgctacgagaaggaggctaagggggtggaatcgtccgatgtgcacccagcccctacagtgcagcagatgtctagcccaaagccagccgaggagagagccaggcagccctctccgttcgtggatgactgcaagacccgagggacccccgaggatggcgcttgcgaggggagcccgcttgaagaaaaggcttctccacccatcgaaaccgacctgcagaaccaagcctgtcaggggtcagactctgatacacgcctggtatcggggtattcactgactcctcttgagaagacacccggaacgtggaaatag

SEQ ID NO: 239385 - DNA, 1263 bp, Artificial Sequence
  Description of Artificial Sequence: Synthetic coding sequence
atggcgacatccctaggctcgaacacttacaacaggcagaactgggaggacgctgacttccccatcctgtgtcagacttgcctgggtgagaacccgtacatccggatgactaaagagaagtacggcaaggagtgtaagatttgcgccaggccctttactgtgtttcggtggtgccctggcgttcgaatgcggtttaagaagaccgaggtttgccaaacctgcagtaagctaaagaacgtttgccagacttgtctgctggacctggagtatggtctacctatccaggtacgggacgcaggccttagtttcaaggatgacatgcccaagtccgatgtcaacaaagagtattacacgcaaaatatggaacgcgagatttctaactcagacgggacacgaccagttgggatgctgggaaaagctactagcaccagcgatatgctgctgaaattagcccgaacgacgccatactacaagcgaaatagacctcacatttgcagcttctgggtcaagggcgagtgtaagagaggcgaagaatgtccttatcgtcacgaaaagccgactgatcccgatgatccattggcagatcagaacatcaaagataggtactacgggattaacgatccagtggccgataagctgcttaagagggcttcaacgatgccaaggcttgacccacccgaggataaaacaattactacgctttatgttggaggcttaggagacacaattaccgagaccgatctgcgcaatcatttctaccagttcggcgagattcggaccataaccgtcgttcagcgacagcagtgtgccttcatccagtttgccacacgacaagcagctgaggttgcagccgagaaatcctttaacaagctcattgtaaatggcaggagattgaacgtgaagtggggacgaagtcaggctgcgagaggaaaggaaaaggaaaaagacggaaccaccgatagtggtattaaactcgaacccgtgccaggattgcctggagcactaccaccccctccagccgcagaggaggaagcttctgcgaactacttcaatctgccaccttccggacctcctgctgtggtgaacatcgcccttccacctccacccggaattgcacctcctccacccccagggtttgggcctcacatgttccatccgatgggacctccaccaccgttcatgcgggctcccggacccattcactatccgtctcaggatccccagcggatgggagcgcatgctggtaagcactcttctccttag

SEQ ID NO: 239386 - DNA, 1116 bp, Artificial Sequence
  Description of Artificial Sequence: Synthetic coding sequence
atggccacctcactgggcagcaacacctataacaggcagaattgggaagacgccgatttccccattttatgccagacttgcctcggcgaaaatccgtacatccggatgacgaaagaaaagtacggccttcctatccaagtaagggatgcaggtctgtctttcaaagacgatatgcctaagtcggacgtaaataaggaatactacacccagaacatggagagagagattagcaacagcgatggaaccaggccggtcggcatgctcggcaaggcaacatctacctcagacatgctgttaaagctggcccgaacgacgccctattacaaaaggaatagaccacacatttgcagtttttgggtgaaaggtgaatgcaagcgcggagaggagtgcccctatcggcatgaaaaaccgacagaccccgatgatccccttgccgatcaaaacataaaggaccggtactatgggataaatgatcccgtcgctgataaactgttgaagcgtgcctctaccatgccgaggctggatccaccagaggataagacgatcacaacactgtacgtggggggactgggcgatactattactgaaaccgacctacggaaccacttttatcagttcggagagatccggaccatcacggttgtccagcgccagcagtgcgcttttatccagttcgctacaagacaagcagcagaggtagccgcagagaagtcattcaacaaactaatcgttaatggcagacgcctgaatgtgaagtggggacgcagccaggccgctagggggaaagaaaaagagaaagacgggaccactgactcaggaattaaattagagccagtgccgggacttcccggtgctctccccccaccccctgcagccgaagaggaggcaagtgcaaattacttcaatttaccaccatctggtcctccagcagtcgtgaatatcgccctgcccccaccacccggaattgctcccccaccaccccctggattcggcccacatatgttccatcccatgggaccgccaccccctttcatgcgtgctcccggacccattcattatccaagccaggatccccaacgcatgggcgctcacgctggcaaacacagcagcccctag

SEQ ID NO: 239387 - DNA, 1116 bp, Artificial Sequence
  Description of Artificial Sequence: Synthetic coding sequence
atggccacttcattggggtctaacacctacaaccgtcagaactgggaggatgccgattttcctatcttgtgccaaacttgcctgggtgaaaacccttatatcaggatggaacgagagaagagcggcctgccaatccaggtgagagacgcaggactgagctttaaggacgacatgccaaagtctgatgtgaacaaagaatattacacccagaatatggagcgagagataagtaattctgatggcacaagaccggtcggaatgttaggaaaagcaacttcaactagcgacatgcttctgaaactagctcggactactccatactacaagcgcaaccgcccacatatttgtagtttctgggtgaaaggggaatgcaagcgtggcgaggaatgtccctatcgacacgagaagccaactgatcccgatgatcccctggccgatcagaatattaaggatcgctactatggtataaacgatccagttgctgacaaactcctgaagcgcgcatcaacaatgccgcgattggatcctcccgaagataagaccatcactaccctgtacgtcggcggactcggggataccatcaccgaaacagacctgcggaaccatttttaccagtttggcgagatcagaaccattacagttgtacagaggcagcagtgcgccttcattcaatttgccacgaggcaggccgctgaagtggccgctgagaaatcttttaacaagttaattgtgaacggacgtcgtctcaatgtgaagtggggcagatcacaggccgctcgcggaaaggaaaaggaaaaagacggtacaacagactcaggaattaaacttgaacctgtgccgggactgccaggcgctctcccacccccaccagctgcggaggaggaagctagcgccaattatttcaatctccctccttctgggccacccgcagtcgtcaacatcgccctgccaccgcctccagggattgcccctccaccccctcctggcttcgggcctcatatgtttcatcccatggggccaccacccccattcatgagagcaccagggcctatccactacccctctcaggatccacaacgcatgggtgctcacgcaggaaagcactctagcccctag

SEQ ID NO: 239388 - DNA, 2532 bp, Artificial Sequence
  Description of Artificial Sequence: Synthetic coding sequence
atgagtttccctccacacctgaacaggcctccgatggggatcccagcattaccccctggtatccctccacctcaatttccaggattcccccctccagtaccacccggtaccccgatgatacccgttccaatgtccatcatggctcctgcccctaccgtcctggtgccgaccgtctcaatggtggggaagcacctgggcgcacgaaaagaccaccctggcttaaaagctaaggaaaatgacgaaaactgcggacccacaaccaccgtgttcgtcggcaacatctccgagaaagcttccgacatgctgataagacagctgctggccaaatgcggccttgtgctgtcatggaaaagggtgcagggagcctctgggaagctgcaggcattcgggttttgtgagtataaggaacctgaatccaccctgagggccctgagactgctgcacgatttgcagataggagagaagaagctgctcgtgaaagtggacgcgaagaccaaagctcagctcgacgagtggaaagctaagaagaaggccagcaacggcaacgcacgccctgagacagtgactaacgacgacgaagaggccctggatgaagaaactaagcggagggaccaaatgataaagggcgctatcgaggtgttgatccgggagtattcctctgaactgaatgctcctagccaggaatctgactcgcacccccgtaaaaagaagaaggagaagaaagaagacatcttcagacgttttcctgtcgccccactaattccatatcccctgattactaaagaggacatcaacgctatcgagatggaggaggataagcgagatttgatttcccgcgagatctctaagttcagagatacgcacaagaaactggaggaagagaaaggtaaaaaagagaaggagagacaggaaatcgagaaggaacgacgagaacgagaaagggaaagggagagagaacgggagaggagagaacgtgagcgggaaagagaacgggagcgtgagagggaaaaggagaaggagagggaaagagaaagagagagagatcgggatcgagaccgcaccaaggaaagagatagagacagagatcgggaaagagaccgcgatcgcgaccgtgaaagaagcagtgatcgcaacaaggatagatctcgcagtcgcgagaaatcgcgcgacagagagcgcgaacgagaacgcgagcgggaacgagagcgggaaagggaacgggagcgcgaacgtgagcgcgagagagaacgtgagcgcgagcgagagcgcgaacgggaaaaagacaagaaaagggacagagaggaggacgaggaagatgcctatgaaaggaggaaactggagagaaagctgcgcgaaaaggaggcggcttaccaggagcgtctgaagaattgggagatcagagagaggaaaaaaacccgagaatatgagaaggaagcagaaagggaggaggagaggagacgcgagatggccaaggaggccaaaaggttgaaggaattccttgaagactacgatgatgaccgcgacgacccaaagtattaccggggatccgccctccagaagagactgagggaccgagaaaaagagatggaagctgatgagcgcgatcgaaagagagaaaaggaagagctagaggagattaggcagaggctgctggctgagggtcaccctgaccccgacgcggaactccagaggatggagcaagaggcagagcggagaagacagccgcagattaaacaagagcctgagtcggaggaggaagaggaagagaaacaagagaaggaggagaagcgagaggagcctatggaggaggaggaagagcctgagcaaaaaccctgcctaaaaccaacgttaagacctatcagttccgcgccatccgtgagcagtgcctctggcaacgccaccccaaatacccctggagatgaaagtccctgcggcattattatcccccacgaaaactcccccgatcaacagcagcctgaggagcatcggcctaaaatcgggctcagccttaagttaggagcttcaaattctccaggacagcctaacagcgtgaaacgaaaaaagctgcccgtagattcggtgttcaataagtttgaggatgaggacagcgacgacgtaccacggaaacgcaaattggtgcctctggactatggggaggatgataaaaacgctaccaagggaactgtgaataccgaggaaaagagaaagcacatcaagtccctaattgaaaagattcctaccgccaagccagaactgtttgcatatccactcgactggtcaattgtggatagtatcctgatggagcgaagaatccgcccatggataaacaagaagatcatcgaatatatcggcgaagaggaagctacacttgtcgacttcgtgtgctcaaaggttatggcacattcctctccccagagcattcttgacgacgtggcaatggttttagacgaagaagccgaagtttttattgttaagatgtggcgcctcctgatatatgagaccgaggctaagaaaattggcctggtgaagtag

SEQ ID NO: 239389 - DNA, 384 bp, Artificial Sequence
  Description of Artificial Sequence: Synthetic coding sequence
atgtccttcccacctcacctcaacaggcccccaatgggcatccctgccctgcccccaggtatcccgcctccacagtttcccggttttccacctcctgtgccccctgggactcccatgatcccagtacccatgtccattatggctcccgctcccactgtcctcgtgcccactgtatcgatggtggggaagcatttaggagcaaggaaggatcatccgggtctcaaggctaaggagaatgacgaaaactgcgggccaacaactaccgtgttcgtcgggaacatctccgagaaagcgtccgatatgctgatccgccaactgctggccaagtgcggcttggtgttgagctggaagagagttcaaggggcatctggtaagttacaatag

SEQ ID NO: 239390 - DNA, 903 bp, Artificial Sequence
  Description of Artificial Sequence: Synthetic coding sequence
atgtcatttccccctcacctgaaccgccctcctatgggtattccagccctccccccaggcatccccccaccccaatttcccggattcccgccacccgttccccctgggacccccatgatccccgtgcctatgtcaatcatggcccctgctccgacagtgctggtcccaacagtgtccatggttggcaagcaccttggcgctcggaaggaccaccccggtctgaaggccaaggagaatgatgagaattgcgggccaactacaaccgtcttcgtagggaatatcagcgaaaaagcttctgatatgctgataagacagcttttggcaaaatgcgggttggtgctgagctggaaacgggtccagggggcatcgggcaaactgcaggcctttgggttctgcgagtacaaggagcctgaatccactctccgcgcattacgtctgctgcacgatcttcagatcggtgagaaaaaacttctggtgaaggtagacgccaaaacgaaggcccagcttgacgagtggaaggccaagaaaaaagcttctaatggcaatgcccgaccagaaaccgtcacaaacgatgatgaggaggcccttgacgaggaaacgaagcggagggatcagatgataaaaggggctatcgaagtgcttattagagaatactcctcagaactcaatgctccttcccaggagagcgacagccatccaagaaaaaaaaaaaaggaaaagaaagaagacatattcaggcgctttccagtagcacctttgatcccatatccgctaataaccaaagaagatattaacgccatcgagatggaggaggataaaagggacctgatctcccgtgaaattagcaaatttcgtgacactcacaaggttgtgtttctaagcttccatctcatccctatctag

SEQ ID NO: 239391 - DNA, 885 bp, Artificial Sequence
  Description of Artificial Sequence: Synthetic coding sequence
atgtcattcccacctcacctgaatcggccaccaatggggatcccggcactgcctccgggtatccctcccccacagtttcctggtttccccccaccggtcccacccggaacgcccatgatccctgtccccatgtccataatggcgccagctcccacggtcctcgtccccacagtgtccatggtcggaaagcacctgggcgcacggaaggaccacccgggtctgaaggccaaggagaatgacgaaaattgcggtccgaccactaccgtcttcgtcggcaatatatctgagaaagcctctgatatgttgatccgccagttgctcgcaaagtgtgggcttgtcctttcttggaagagagtacagggggcaagtggtaagctgcaggccttcggcttttgcgaatacaaggagcccgagtccactctgcgtgccctccgactactgcacgacctccagattggggagaagaaacttctggtcaaagtggatgctaaaaccaaagctcaactggatgaatggaaggcgaaaaagaaagcttcaaatggtaatgcacgacccgaaacggttacaaacgacgacgaagaggccctggacgaggagacaaaacgcagagaccaaatgattaagggtgctattgaggtcctgatccgggagtattcttccgaattgaacgccccatctcaggaatcagattcgcaccctcgcaaaaagaagaaagagaaaaaggaagatattttccgacgctttcctgtcgcaccgttgatcccgtatccactcatcaccaaagaggacattaacgcgattgagatggaggaggacaaaagagacctcatttcccgtgaaatcagcaaattccgcgacacccacaaaagatcttatggagattag

SEQ ID NO: 239392 - DNA, 2532 bp, Artificial Sequence
  Description of Artificial Sequence: Synthetic coding sequence
atgagcttccctcctcacttaaataggcctcctatggggatccccgcacttccccctggaataccccctccacaattccccggtttccctcctcctgtccccccaggaactccaatgatacccgtgcctatgtctattatggctccagccccaacggtattagtcccaacagtttcaatggtaggcaagcatttaggagctaggaaagaccatcctgggctgaaggctaaggaaaatgatgaaaactgtggccctacaactacggttttcgtcggcaacattagtgagaaggcctcagacatgctgattaggcaactactggccaagtgtggtttggtcctatcctggaaacgtgtccaaggagctagcggcaaactgcaggcattcggcttttgcgaatataaagaacctgaatctacccttcgggcactgcgcctgcttcatgacctgcagattggggaaaagaagttgcttgtgaaggttgacgccaagacaaaggctcagcttgacgaatggaaggccaagaagaaagcctctaatggaaatgcccgtcctgagaccgtgactaacgatgatgaagaagccttggatgaagaaactaagcgcagagatcagatgattaagggcgctattgaggtcctcatccgcgagtacagctccgaattgaacgcccctagtcaggaatcggattcccatcctcgaaaaaaaaagaaggagaagaaggaagatatctttaggagatttccggtcgctccactgatcccctatcccctcatcaccaaggaagatatcaatgccatcgagatggaggaagacaaacgggacctcatttccagagagattagcaaattcagagacacccataagaagctggaggaagaaaagggtaagaaagagaaggagcgccaggaaatcgagaaagaacggagagaaagggagcgagagagggaacgcgaacgcgaacgacgcgagagagagcgagagagagagagggaacgcgaacgagaaaaggagaaggaaagagagcgcgagcgagagcgggacagagatcgggaccgcacgaaggaacgcgacagggatcgcgaccgtgaacgcgacagggatcgggatagggagaggagcagtgaccggaataaggaccgtagtcggagtcgcgagaaatccagggacagggagagagaaagagaaagggaaagagagcgtgaaagagaacgggagagagaaagggaaagagaacgcgaaagagagagagaaagggagagggaaagggaacgtgagaaggacaagaagcgcgaccgcgaggaagacgaggaagacgcttatgaacggcgtaaactggagaggaaactgcgcgagaaagaagccgcataccaagagcgactgaagaattgggaaatacgagaacggaaaaagacacgagaatatgagaaggaagctgagcgcgaggaagagcggcgtcgcgagatggcgaaggaggcgaaacggctcaaggagttcttggaggattacgatgatgatcgggatgacccaaagtattaccgtggcagtgctctccagaagcggctgagggatagggagaaagaaatggaggctgatgaacgggatagaaaaagggagaaggaagagttggaggagatccgacagcgattattggccgagggtcatcccgatcctgatgcagagctgcagcggatggagcaagaggcagagcgacggcgacagccccagataaaacaggagcccgagagcgaggaggaggaggaagaaaagcaggaaaaggaagaaaagcgcgaggaaccgatggaagaagaggaagaacccgagcagaaaccctgtctgaagccaaccttgaggccgatctcgtccgccccatccgtgagctctgcctctggcaacgctacccccaacacccctggcgatgagtctccgtgtgggatcattattccacatgaaaacagccccgatcagcagcagccagaggaacatcgacccaagatcggcctctcactgaaactcggggcatcaaacagtccgggacagcccaacagcgtgaaacgcaagaagctgccggtggacagtgtgtttaataaatttgaagacgaggacagcgacgacgtgcctcggaaaaggaaactggtacctttagactacggtgaagatgataagaatgctacaaaagggacggtgaacacagaagaaaagcgcaaacatatcaaatcattgatcgaaaagatcccaacggccaaacccgagctgttcgcctacccactggactggtcaattgtcgacagtatcttaatggaaagacgcattagaccgtggattaataaaaagattattgaatacataggggaggaagaggcaaccctcgtggatttcgtatgttctaaggtcatggcacatagttcgccacagtccattttagacgatgttgcaatggtcttagatgaggaggccgaggtctttatcgtcaaaatgtggaggctcctgatctacgagactgaggcaaaaaagatcgggctagttaagtag

SEQ ID NO: 239393 - DNA, 732 bp, Artificial Sequence
  Description of Artificial Sequence: Synthetic coding sequence
atgagcttccctcctcatctgaatcgcccaccaatgggcatccctgccctcccgccaggcatcccccctccccagtttccaggattccctccacctgttcctccgggaacacctatgatcccagtgccgatgtcgataatggctcccgctccaacggtgctggtacccactgtcagcatggtaggaaaacatctcggcgcacgtaaggaccaccccggattgaaggctaaagagaacgatgagaactgtggtcctacgaccacagtgtttgttggaaatatctccgagaaagcgtctgacatgctcattaggcagctgctcgccaagtgcgggctggtcctgagctggaagagagtgcagggcgcttccgggaagcttcaggcctttggattctgtgagtacaaggagccagaatcgaccctgcgtgcattaaggttactccacgatttgcagatcggcgaaaagaagctgcttgttaaggtggacgcaaagacaaaggcgcagcttgacgagtggaaggctaaaaaaaaggcctccaacggaaacgctagaccagaaactgtgactaatgatgatgaggaagcgctagacgaggagaccaagcgtcgcgatcagatgattaaaggcgctatcgaagtgctgattcgtgaatactcatcagaactcaacgccccttctcaggagtcagattcacaccccagaaagaaaaaaaaggagaagaaggaggattag

SEQ ID NO: 239394 - DNA, 885 bp, Artificial Sequence
  Description of Artificial Sequence: Synthetic coding sequence
atgagctttcccccacacttgaataggccccctatgggcattccagccctcccaccaggcatcccaccaccccaatttcccggtttccctcccccagtacctccaggaacgccaatgatcccagtgcccatgagcataatggcaccggctccaacggtcctagtcccaaccgtctcgatggtcgggaagcatcttggcgctagaaaggatcaccctggattaaaggccaaagaaaacgacgaaaattgcggcccaaccaccaccgtcttcgtggggaacataagtgagaaggctagcgatatgctaattcgacagctgcttgccaagtgcggcctggttttgagctggaaaagagtgcagggcgcaagcggcaagctgcaggcgtttggattctgtgaatataaggagccagaatcaaccctacgggctctgcggctcctgcacgatctgcagattggagagaaaaagctgctggtgaaagtggacgccaaaacaaaggcccagcttgatgaatggaaggcgaagaaaaaagcctccaatggcaatgcaagaccagagaccgtcaccaacgatgatgaagaggcactagacgaggagactaagcgtcgcgaccagatgatcaaaggagcaatcgaagtccttatccgggaatactctagcgaattaaatgccccttcccaggagtccgactcccacccacggaagaagaagaaagagaagaaggaggatatttttagaaggtttcccgtcgcccctttaatcccatatcctctcatcacaaaagaggacattaacgccattgaaatggaggaggataagagagacctgatatctagagagatctccaagttccgggacactcacaaaagaagctacggcgattag

SEQ ID NO: 239395 - DNA, 1350 bp, Artificial Sequence
  Description of Artificial Sequence: Synthetic coding sequence
atgctcccagcagctaccgcctccctcctcggcccattgctgacggcatgcgccctgctacccttcgcacagggccagacccctaattacaccagaccagtgttcctgtgtggcggtgacgtgaagggggaatctggctacgtggccagcgagggctttcccaacctttatccacccaataaagagtgcatatggactatcactgtccccgagggccagaccgtctcccttagctttagggtcttcgatctcgagctccacccagcatgtaggtatgatgctcttgaagtgtttgctggatccggcacatccgggcagcgactgggcaggttttgcgggacattccggcctgccccactcgttgctccagggaaccaggtgaccttgagaatgaccacagacgaaggcaccggcggtagaggcttcttgctgtggtattccggtcgcgcaacatccgggacagaacatcagttctgtgggggacgactcgagaaagcgcagggaaccctgactactcctaactggccagaatcagattacccccctggcatcagctgttcctggcacatcatcgcgccaccggaccaggtgatcgccctgaccttcgagaagtttgacctggaacctgatacctattgccgctatgattcagtctctgtcttcaatggcgctgtatccgatgactctcggaggctcgggaaattttgcggtgatgctgtacccggttccattagctctgaaggaaacgagctgttagtgcagtttgtcagcgacctgagtgtgaccgcagatggctttagcgcctcctataagaccctgccccgtggcacagcaaaggagggtcaaggccctgggcctaagagaggaaccgagccaaaggtgaagctccccccaaagagccaacctcctgagaagactgaagagagcccaagcgctcctgatgctccgacctgtcctaagcaatgccgtaggaccgggacactccagagtaatttctgtgcctcatccttggtggtcacagcgaccgtgaaaagcatggtgcgcgagcctggcgagggcctggcagtcaccgttagcctcatcggagcctacaaaaccggaggcctggatctccctagtcctccaacaggggcatctttgaagttttatgtaccctgcaaacaatgcccacctatgaaaaaaggagtaagctacctcctcatgggccaggtggaagagaatcgcggacctgtgctgccacctgagtctttcgtggtcttacaccgccctaatcaagatcagattttgaccaatctgagcaagcgcaagtgcccttcacagcctgtccgcgctgcggcatcacaggattag

SEQ ID NO: 239396 - DNA, 1857 bp, Artificial Sequence
  Description of Artificial Sequence: Synthetic coding sequence
atggctggactgaccctattcgtgggacggctgccaccttccgccaggtccgagcagctggaagaacttttttcacaggtgggcccagtaaaacagtgttttgttgtcaccgagaagggacgtactgttgctgtcgattgggcggtcgccaaggataaatataaggatacccagtcagtgagtgctattggggaggagaagtctcatgagtcaaagcatcaggaaagtgttaagaagaagggtagagaggaagaagatatggaagaagaagagaacgatgatgacgacgatgacgacgacgaggaagacggcgtgttcgacgacgaagacgaagaagaagagaatatcgaatcaaaagtcacaaagccagtccagatacaaaaacgcgcagtgaagaggcctgctccagccaagtcctccgaccattctgaagaagactctgacctggaggaatcagatagtatagatgatggtgaggaactagcccagtcggacacaagcacagaggaacaggaggacaaagccgtccaagtgagcaataaaaagaagcggaagctcccctcagacgttaacgagggcaagacggtgtttatccgtaacctttctttcgattcagaggaggaagagctcggggaactcctgcagcagttcggtgaattaaagtatgtgagaatcgtgctccaccctgataccgaacactccaagggatgcgcattcgctcagtttatgacacaggaagccgctcaaaaatgtcttcttgctgcctctccggagaatgaggccggtggcttaaaattggatggcaggcagctgaaagttgatcttgcggtgacccgagacgaggcagccaagctgcagaccacaaaggttaaaaagccaaccggcaccagaaacctttacctcgcaagagagggtctcattagggcaggtactaaagctgctgaaggagtcagcgccgctgacatggctaagagagaaagatttgaactccttaagcaccagaaactaaaggatcagaatatcttcgtcagtcgtacacggctgtgtctccataacctgccgaaggctgtcgacgataagcagctgaggaagttactgctgagcgccacttcgggagagaaaggggtgcgtatcaaggagtgccgggtgatgcgtgatctgaagggggtgcatggaaatatgaaaggccagagcctgggatatgcctttgccgaattccaggagcacgagcatgcccttaaagccttgagactgattaataacaatccagagatctttggtccactgaaaagaccgatagtggagttctctcttgaggacagacggaaactgaaaatgaaggaactacggatacagaggtccctccagaagatgcgctctaaaccggcaacaggtgagccccagaagggacagccagagcctgccaaggatcagcagcagaaggccgctcaacaccacacagaagagcagagcaaggtgccccctgaacagaaacggaaggcaggatcaacctcctggaccggcttccagacaaaagcggaggttgaacaggtcgagttacctgacggcaagaagaggagaaaggtgctagcacttccgtctcaccggggacccaagatcaggctgcgggacaagggtaaggttaagccagtgcaccctaaaaagcccaagccgcagattaaccagtggaagcaagaaaagcagcagctatcatcggaacaagtttcccggaagaaagctaagggcaacaaaaccgaaacaagatttaaccagctggtcgaacagtataagcagaaactgttggggccatcaaagggggctcctctggctaagcggagtaagtggtttgattcctag

SEQ ID NO: 239397 - DNA, 720 bp, Artificial Sequence
  Description of Artificial Sequence: Synthetic coding sequence
atgcttcttcaacctgcaccatgtgcgccttctgccggattcccacgccctctggcagcaccaggtgcgatgcacggcagtcagaaggacacaacattcaccaagatctttgtgggcggactgccataccacaccacagacgcttcgctcaggaaatacttcgagggattcggagacatcgaggaggctgtggtgataaccgatcgacagaccggtaagtcaagaggttacgggtttgtgaccatggcggatagggccgcagctgagagagcctgtaaggaccctaatcctatcattgacggcagaaaagctaatgtgaacctggcatatctaggagctaagccccgatctttgcagacaggtttcgcaatcggggtgcaacagctgcatcccacactgattcaacgaacatacggcctgaccccacactatatttatcctcctgctatagtacagccaagtgtggtaatccccgcagctcctgtgcctagtctgtccagcccctatatcgagtatacccccgcttccccagcgtacgcacaatacccaccagcaacctatgaccagtatccatacgcagccagccctgccacagccgctagtttcgtcggctactcatatccagccgctgtccctcaggccttgtcggcagcggctcccgcagggacaacatttgtccaataccaggcaccacagctgcagcctgaccgcatgcagtag

SEQ ID NO: 239398 - DNA, 477 bp, Artificial Sequence
  Description of Artificial Sequence: Synthetic coding sequence
atggctgaccgagcagcggcagagcgggcatgcaaggatccgaacccaatcatcgatggcaggaaggcgaatgtgaatctcgcctatttgggcgcaaaacctaggagccttcagaccggatttgccataggagtacaacagctgcacccaaccctcatccagagaacctatggactcactcctcattatatttacccaccagcgatagtgcaaccctctgtggtgatccccgctgcacctgtgccgtcgttgtcctccccttatattgaatatacacccgcatcccctgcctacgctcagtaccccccagccacgtatgaccaatacccatatgccgcatctcccgctaccgccgcttcattcgttgggtattcttatcctgccgctgtaccgcaggccctcagtgctgctgccccagctggaactacattcgtgcagtatcaggccccacaactgcaacccgaccgaatgcagtag

SEQ ID NO: 239399 - DNA, 366 bp, Artificial Sequence
  Description of Artificial Sequence: Synthetic coding sequence
atgctcctgcagccagcaccctgcgccccatctgcagggttcccgagacccctggcggctcccggagctatgcatggaagtcagaaagacactaccttcaccaagatctttgtgggtgggcttccttaccatactaccgacgcatctttgcgaaagtatttcgagggttttggcgatattgaggaagctgtagtgattaccgaccgacagactggaaaatcacgtggatacggatttgttacaatggccgacagagctgccgctgagcgcgcttgtaaagatcctaaccctatcatcgacggccgaaaggcaaacgttaacctggcttatctcggcgctaaaccaaggagtctgcaaacaggctag

SEQ ID NO: 239400 - DNA, 1095 bp, Artificial Sequence
  Description of Artificial Sequence: Synthetic coding sequence
atggtgaaactcttcattggcaacctcccaagagaagccactgaacaggagatcaggagtcttttcgagcagtatggcaaagtgctggagtgcgacatcattaaaaactacggttttgtgcacatagaagataagaccgctgctgaggatgcaatcaggaacttgcaccattacaagctccatggggtgaatataaacgtggaagcaagtaaaaacaagagtaagacatctacaaagctccacgtggggaatatttcacccacgtgcacaaataaggaattacgggctaagtttgaggagtacggtccagttattgagtgcgacattgtgaaagattatgccttcgtgcacatggagcgcgctgaggacgcggtggaggccattcgcggactagataacacagagtttcagggcaaaaggatgcacgtccaactttctaccagcagactgagaaccgcacccggaatgggggaccagtccgggtgctacaggtgtggcaaggagggccactggtctaaggagtgtcctatcgacaggtcaggaagagtggcggatttaaccgaacagtataacgagcagtatggggcagtacggacaccatacacaatgtcctacggtgactctctttactataataatgcctatggagctctggacgcctactacaaaaggtgccgcgctgctaggtcatacgaggcagtggccgctgccgcagcgtcagtttacaactatgctgagcagaccctgagtcagctcccgcaagtgcagaatacagcgatggctagtcatctgacgagtacgagtctcgatccctacgataggcacctactgccaacctcgggggcagcggcaacagccgcagccgcagccgcagcagctgccgcagtgacagctgccagtacatcgtattatggtcgggacagatctcctcttcggagggccactgcgcctgtgcccaccgtgggtgagggctacggctatggtcacgaatcagaactgagccaggcctctgcagcagctcgtaacagcttgtacgatatggcaaggtatgagcgtgagcagtacgctgatcgggcacggtactctgcgttctag

SEQ ID NO: 239401 - DNA, 1095 bp, Artificial Sequence
  Description of Artificial Sequence: Synthetic coding sequence
atggtcaaattattcatcgggaacctaccgagagaagccactgaacaggagatacggagcctatttgagcagtatggaaaggttcttgagtgtgacattattaagaattatggattcgtgcacatcgaggataagaccgctgcagaggacgcaattcggaatcttcatcattacaaactacacggcgttaacattaatgtcgaagcttccaaaaacaagagcaagacatctaccaaactgcatgtaggcaatataagcccaacgtgtaccaataaagagttgcgtgccaagttcgaggagtatggaccggtgatcgagtgcgacattgttaaggactatgccttcgtgcacatggaacgtgccgaagacgccgtcgaagctatcaggggactggataacaccgaatttcagggcaaacggatgcatgtccaactctctacatcaaggctgagaacggcacccggtatgggtgaccaatccgggtgttatagatgtgggaaggaaggccattggtctaaggaatgtcccattgatcgaagcggcagggtggctgacctgacagagcagtacaacgaacagtatggagcagtcaggaccccgtacactatgtcttacggcgattctctgtactacaacaacgcgtatggggcattagacgcctattataagcgctgtagggctgctcgcagctacgaagctgttgctgctgccgctgcatcagtttataattacgctgaacagacactgagccaactcccccaggtgcagaacaccgccatggcaagccatctcacctccaccagtctcgacccctatgatcggcatctgctgcccacctctggcgcagcagccaccgctgccgcagccgctgccgctgcagccgctgtaacagccgcttccacgtcgtattacggcagagatagatcgcccctgagaagagccacagctcccgtacccactgtgggcgaagggtatggttacggccatgagagtgagctcagtcaggcctcagcagctgctaggaactcgctgtacgacatggcccgttacgagcgcgaacagtacgctgaccgggctagatattctgccttctag

SEQ ID NO: 239402 - DNA, 1095 bp, Artificial Sequence
  Description of Artificial Sequence: Synthetic coding sequence
atggtgaagctgttcatcggcaatctgcctcgagaggcgactgaacaggaaatccggagcctcttcgagcaatacggcaaagtactcgagtgcgacatcattaagaattatgggtttgtacatatcgaagataaaactgccgctgaggacgctatcagaaatttacatcattacaagctgcacggggtgaacattaacgtggaggcctcgaagaataagtctaaaacctccaccaaactgcatgtgggaaacatctctccaacgtgcaccaacaaagaactgagagccaagtttgaagaatacggacctgtcattgaatgcgacatcgtgaaagactatgcttttgtccatatggaaagagcggaggacgccgtagaggctatccgcggactggacaatacagagtttcagggcaaacggatgcacgttcagctctcgacttcgcgtttacgaacggcgccaggtatgggtgatcaaagtggctgctaccgctgtggaaaggaaggtcattggtctaaggaatgccccatcgaccgcagcggcagagttgccgatctcacagagcagtataatgaacagtacggagccgtgcgcaccccgtacaccatgagctatggggatagtctctactacaacaatgcctacggagctctggacgcttattataaacgatgcagggcggcaaggagctacgaggcggttgctgctgccgctgctagtgtctataactatgccgaacagaccctgtcacagctaccccaagtccaaaacaccgccatggctagccacttgacatccacctccctcgatccctacgacaggcacctcctgcccaccagtggggctgccgcaaccgcagctgctgcagccgctgcggctgccgcagttactgctgctagtacatcctactatgggagagatcggtctcctcttcggagagccactgctcccgtgcccactgtcggcgagggatacggctatggccacgagtctgagttgtcgcaggcctccgccgctgcaaggaactcactctatgacatggccaggtatgaaagagaacaatatgcagatcgcgcacgatactccgctttctag

SEQ ID NO: 239403 - DNA, 534 bp, Artificial Sequence
  Description of Artificial Sequence: Synthetic coding sequence
atggtcaaactgttcatcgggaatctaccacgggaagcaaccgagcaggagatccgatcactcttcgaacaatacggcaaagttctcgagtgcgatatcatcaagaattacgggttcgtgcatattgaagataaaacagccgctgaggacgcgattcgaaacctgcaccattataaactacatggcgtgaatattaacgtcgaagcttccaagaataaaagcaagactagcaccaagcttcacgttggaaatataagccccacatgcactaacaaagaactgagggctaaatttgaggaatatggcccagtcattgaatgcgacatagtcaaggattatgccttcgtgcacatggagcgtgctgaggatgctgtcgaggccattcggggactggacaataccgaattccagggtgaaccccctagtctgggcagaggcttaaacacacgactttgtgctgaaaacgggtggatttcaaagcggcgtgggctagtgaaaatcacagccgtggggtggctggtgatgaagaagtag

SEQ ID NO: 239404 - DNA, 534 bp, Artificial Sequence
  Description of Artificial Sequence: Synthetic coding sequence
atggtgaagctgtttatcggaaaccttccccgtgaggcgaccgagcaggaaattcggtctctatttgagcagtatgggaaggtattggagtgcgatatcattaagaattacggtttcgtccacatcgaggataagaccgcagccgaggacgcgatccgaaaccttcaccattataaactgcacggggtcaacattaacgtggaagccagcaagaataagagcaaaacaagtacaaagcttcatgtgggcaacatctcacctacatgcacaaataaggagctccgcgctaagttcgaagaatatgggccagtcattgaatgtgacattgtcaaggactacgcgtttgtgcatatggaacgcgctgaggatgcagtggaggccatacgaggactggacaataccgagtttcagggggaacccccttcgcttgggagaggattgaatactcgtctgtgtgcagaaaatggatggatcagcaagcggcgtggccttgtgaagatcaccgctgtcggctggctcgtgatgaaaaagtag

SEQ ID NO: 239405 - DNA, 522 bp, Artificial Sequence
  Description of Artificial Sequence: Synthetic coding sequence
atggtgaagctgtttatcgggaatcttccgagggaagcaacagaacaggagatcaggtccctttttgagcaatacggcaaggtactggagtgcgatataattaagaactacggctttgtccacattgaagataaaacagctgccgaagacgcgatccggaaccttcatcactataaacttcacggggtgaacattaatgtggaggcttccaagaacaagtctaagactagtaccaaactgcacgtagggaatatttctcctacgtgtacgaacaaagaactgcgcgctaaattcgaggaatatggacctgtgattgaatgtgatatagtgaaagactacgccttcgttcatatggaacgggctgaggatgctgtggaggctatcaggggcttggacaataccgaattccaaggcaagattacacccgtgacagaaggctattgctgctgcaacaaaggccatacatatattttcaagaattgcaacttgatactggaatctaggaagtctcgccgatgttag

SEQ ID NO: 239406 - DNA, 432 bp, Artificial Sequence
  Description of Artificial Sequence: Synthetic coding sequence
atggtgaaattattcattggtaacttgccgcgtgaagccacagagcaggagatacgctcacttttcgaacagtacggtaaagtgctggaatgcgatattattaagaattacgggttcgtgcatattgaagataaaactgcggctgaagatgccattcggaacctccatcattataaactgcatggcgtcaacataaatgtagaggcttccaagaataagtccaagacgagtaccaaactgcacgtaggtaatatttccccaacatgcaccaacaaggaactgagagcaaaatttgaggaatacgggccagtaattgagtgcgatatcgtgaaggactacgcgttcgtgcacatggaaagggccgaggatgctgtggaagcaattagggggctggacaataccgagttccagggaggcatgtgcgtagggtag

SEQ ID NO: 239407 - DNA, 1443 bp, Artificial Sequence
  Description of Artificial Sequence: Synthetic coding sequence
atggctggtgctgggcctgccccagggctacctggcgctggcggacctgtcgtccctggcccaggcgctggaatacctgggaagtctggcgaggagcgcctcaaggagatggaagcagagatggctttgttcgagcaggaagtcctgggcgctcctgttcctggcattccaacagctgtgcccgcagttcccacagtccctactgtccctactgtagaagccatgcaggtcccggctgctccggttatcaggccgatcatcgccactaacacctaccagcaagtgcagcaaaccctggaagctcgcgcagcagcagctgcaacagtggtccccccaatggtcggcggtcctccttttgtaggaccagtgggattcggaccgggtgacaggagtcaccttgatagcccggaggcacgggaggcaatgtttctacggagagctgctgtggctccccagagagctcccatcctcaggcctgccttcgtgcctcacgttctacagcgagcagattcggctttgtccagtgcggcagcgggaccaaggcctatggcactgaggccgcctcaccaagcgctggtcggaccacccctcccaggacctcctggtccacccatgatgcttcctccaatggctcgggcacctgggccaccgctggggtcaatggcagcgctgcggcctcccctggaagagccagccgcaccacgagagttagggctcggtttagggctcggcctgaaggaaaaggaagaggctgtggtggccgcagccgctggactggaggaagcatcagccgcagtcgcagtgggggcagggggtgccccagccggacctgcagtgattgggcctagcctacctctagctctggccatgccattacctgagccagagccgctacctctcccactagaagtcgtacgcggactgctgcccccactccgcattcctgagctgctgtcgctgaggcccagaccccgaccaccacggcctgagcctccccctggactgatggctctggaagtaccagagcctctgggagaggacaagaaaaaggggaaacctgagaaactgaaacgatgtatccgcacagcagcgggatcttcttgggaagacccttcattgttggagtgggacgcagacgactttcgcatcttctgtggggacctgggaaatgaggtgaatgacgatatcctggctagggccttcagcagattcccttcttttttgaaagcaaaggtgattcgggataagaggacgggtaaaaccaagggttatggcttcgtcagctttaaagatccttccgactacgttcgcgctatgagagaaatgaatggtaagtacgtcggaagtcgaccgatcaagttacggaagagcatgtggaaggatcgcaacttagacgttgtgaggaagaaacagaaggagaaaaagaagttggggctccgttag

SEQ ID NO: 239408 - DNA, 1356 bp, Artificial Sequence
  Description of Artificial Sequence: Synthetic coding sequence
atggcaggagctggacctgccccaggcttgcctggtgccggtggtccagtggtgcctggtccaggggctggaataccaggaaaaagcggagaggagcgcttaaaagagatggaggcggagatggccttgttcgagcaggaagttcttggtgctcctgtgcctggcattccgacagccgtgcccgcagtgcccaccgttcctaccgtacccacggttgaggccatgcaagtccccgcagcgcctgtgatccgacctatcatcgctaccaacacctaccagcaggtccaacagacactggaggcacgcgcagctgctgccgcaacggtagtcccacccatggtgggtggcccaccgtttgtcggtcccgttgggtttgggcctggggacaggtctcacttggatagccctgaggccagggaggctatgtttttaaggcgcgctgccgctgggcctcgccctatggccttgcgcccaccacaccaggctctggttggacccccactgcccggaccccctggcccacccatgatgctccctcctatggcaagggccccagggcctccacttgggagcatggccgctctgcgcccacccctggaagaaccagcggctccaagggagctgggcctgggcctgggactggggttgaaggaaaaggaagaggccgtcgtagccgcagccgctgggctggaggaggccagcgctgccgtggccgtgggcgctggcggagcccctgccggtccagcggtgatcggcccatcccttcctttggccctggccatgccattgcccgagccggagcctctgccactgccactggaagtcgtacgcggtctgctgccacctttgaggatccccgaactactgtctctacggccaaggcctaggccacccagaccagagccacccccagggctcatggccctagaggtccccgaaccattgggcgaggataagaagaagggtaagcccgagaagctgaagcgctgtattcgcaccgctgccggttcatcgtgggaggatccgtctctcctggaatgggacgccgatgactttagaattttctgtggtgacttggggaatgaagtgaatgacgatatcctggctagagctttttcccgattcccaagctttctgaaagcgaaggtgatccgcgacaaacggaccgggaagaccaaagggtatggttttgtcagctttaaggacccaagtgattatgttcgagcaatgcgggaaatgaatggcaaatatgtggggtctcgcccaattaaactcagaaaaagtatgtggaaggacagaaacctagacgtcgtccggaagaagcagaaggagaagaagaaactgggactgcgctag

SEQ ID NO: 239409 - DNA, 801 bp, Artificial Sequence
  Description of Artificial Sequence: Synthetic coding sequence
atgggggctgccgctgctgaggcagaccgaaccctgttcgtgggcaacctggaaacaaaagtgaccgaagaactcctattcgaactttttcatcaggccggtcctgtcatcaaggtgaagattccaaaggataaggacggaaagcccaagcagttcgcattcgtcaattttaaacatgaagtcagtgttccttacgccatgaaccttctgaacggaatcaaactgtatggtcgtccaatcaagattcagtttaggagcggctcctctcacgcacctcaagatgtgtcactgtcttatccgcagcatcatgtgggcaattcaagtccaacttccacctctccgagtagatatgagcggaccatggataatatgaccagctctgcacagatcattcagagaagttttagctcccctgaaaacttccagcggcaggctgtcatgaactcagcacttcgacagatgtcctatgggggaaagttcggttcttcacctctggatcagagtggtttttcaccttccgtgcaaagccacagtcactcctttaatcagtccagcagttcacaatggaggcaagggacaccaagtagtcaacgcaaggttagaatgaactcctatccctacctcgcagatcgccactatagcagagaacagcgatacactgaccatgggagcgaccaccattatcgaggcaaaagggacgattttttctacgaggaccgcaaccacgatgactggagccatgattacgataaccggagggactcgagcagggatgggaaatggagatccagtcgccattag

SEQ ID NO: 239410 - DNA, 525 bp, Artificial Sequence
  Description of Artificial Sequence: Synthetic coding sequence
atggccgacgtgctggacctccacgaggcagggggtgaagacttcgctatggatgaagacggggatgagtcgatccacaagttaaaggaaaaagcgaaaaaacggaaggggaggggcttcggcagcgaagagggaagtcgagccagaatgagggaggattatgactcagtcgaacaggacggagatgagcccggaccgcaacgcagcgtggaaggatggatcctcttcgtaacaggcgtgcacgaagaggccactgaagaggacatccacgacaagttcgctgaatatggggagataaagaatattcaccttaacctggatagaaggacaggctaccttaaaggttatactctggtagaatacgagacctacaaggaggctcaagccgctatggaggggcttaatggccaggacctgatgggacagccaataagcgttgactggtgttttgtgcggggaccgccaaaagggaagaggcggggtgggaggcggagatcaaggtctccggacaggaggcggagatag

SEQ ID NO: 239411 - DNA, 522 bp, Artificial Sequence
  Description of Artificial Sequence: Synthetic coding sequence
atggcagacgtacttgatttacacgaggccggtggagaagattttgctatggacgaagacggagacgaaagcattcataagctgaaggagaaggcgaagaagagaaagggacgcggtttcgggtctgagggctcaagggctagaatgcgtgaggactacgacagtgtggagcaggacggcgacgaacctggaccgcaaaggtcagtagaggggtggatattgtttgtcactggtgtgcatgaggaagcaacagaggaggacatacacgataagtttgccgagtacggtgagatcaaaaacatacacttaaatctggacaggcggacaggttatttaaaggggtacactcttgtcgaatatgagacatacaaggaggcacaggcggcaatggaagggctaaatggacaggacctcatgggccaacccattagtgttgactggtgcttcgttaggggacctccaaagggcaaacggaggggcggacgcagaaggtcccgcagtccagaccggagacgacggtag

SEQ ID NO: 239412 - DNA, 1179 bp, Artificial Sequence
  Description of Artificial Sequence: Synthetic coding sequence
atggtggaggctgatagacccggtaaactctttataggcggacttaacctggagaccgacgaaaaagcgttagaggcggaatttgggaaatacgggcgtattgttgaggtgctgttaatgaaagatagagaaacaaacaagagccggggatttgcgttcgttacctttgagtcaccagcagacgccaaggccgcagcaagggacatgaatgggaagagtctggacggaaaggcaattaaggtcgcacaggctactaaacctgcattcgagagcagccggcgaggtcccccaccccctaggtcacgaggtcggcctaggttcctgcgcggaacgcgcggtggcggtggcggaccacggagatccccaagtcgtggaggacccgatgacgacggtgggtacaccgcagattttgacctgagaccctcgagagcccctatgcccatgaagcggggtccccctccccgtagggtgggaccaccacctaaaagagccgctccctcaggtccggctaggtctagtggcggaggaatgagagggagagccctggcggtgcgcggaagggacggatactctggcccacctaggcgcgagcctctcccccctcgccgtgacccatatctcgggcctagagatgaggggtactctagcagagacggctatagttcgcgcgactatcgggagcccaggggattcgctccatcccctggggagtacacccatcgagactacggccatagttcggttagggacgactgtccactgcgcggatactccgatagagatggatacggcggacgggatagagattatggggatcatctgtctaggggtagccatcgtgagcccttcgaatcctatggcgagctgcgcggtgccgctccaggtagagggacacctcccagctatggtggcggtggaaggtacgaagaatatagaggatactcacccgacgcatactctggtggaagagattcctactcctcgagctacggcaggtctgatcgatattcccgcggtcgccacagggtgggtcgaccagaccggggactatcactatccatggagcgtgggtgccctccacaacgggatagctacagccgcagtggatgccgcgttccacgaggcggtggacgattgggaggccgtttagagcggggtggtggacggagccgttattag

SEQ ID NO: 239413 - DNA, 1491 bp, Artificial Sequence
  Description of Artificial Sequence: Synthetic coding sequence
atggtggaggccgaccatccgggaaaattgttcattggcggtctgaacagggagaccaatgaaaagatgttaaaagccgtctttggcaaacatggcccaatttcagaggtgctccttatcaaagaccgtacctccaaatcccgcggatttgcctttattaccttcgaaaacccagctgacgcaaaaaacgcagccaaagacatgaacggcaagtcactgcacggaaaggcaattaaggtagagcaggccaagaagccatcatttcagtcaggcggacgaaggagaccacccgcttcatcaagaaataggagtcctagtggcagcctacggagtgctcgcggaagcaggggcggaactaggggctggctaccctcccatgagggacatctggatgatggaggctatacaccggatttgaagatgtcctattctagagggttgatccccgtaaaacggggaccttcctccagatcaggaggcccaccacctaaaaagtcggcaccgtccgctgttgcgagaagcaattcctggatggggtctcagggaccaatgtcccaacgcagggagaattatggcgtgccacctcggagagccacaatctcttcatggcgtaacgatcgcatgtctacacgtcacgacgggtatgctactaacgacggaaatcacccttcttgccaggagacgagggattatgctcctccgtctagaggctatgcctatcgcgataacgggcacagcaatcgcgatgagcactccagtcgcggttatcgtaaccacaggtccagtagggagacgcgagactacgctccgcctagcaggggccacgcctaccgggactatggtcactcaagacgcgacgaatcatactcacggggttaccgtaatcgccgtagttcacgggagacacgggagtacgccccaccctcgaggggccatggataccgcgactacggccatagccggagacacgagtcttactcccgcggataccgaaatcacccatcatctcgggaaactcgcgattacgccccaccccaccgcgactatgcctatagggattacggtcactcttcctgggatgaacatagcagccggggttactcataccatgatggctacggtgaagccctggggagggaccactcagagcacctaagcggaagcagctaccgcgatgccctgcagagatatgggacttctcacggcgcaccccctgcaagaggtccacggatgagctatgggggaagcacttgccatgcatatagcaacacaagggatcgatatggacgctcgtgggagagttattcttcatgcggggattttcattattgtgaccgcgagcacgtctgtagaaaagatcaaagaaacccgccaagtctgggcagggtcctaccagatccaagagaagcttgcggcagcagttcttacgtggcctctatcgtggatggcggagagtcccggtccgaaaagggcgatagctccagatattag

SEQ ID NO: 239414 - DNA, 1491 bp, Artificial Sequence
  Description of Artificial Sequence: Synthetic coding sequence
atggtcgaggcggatcatccaggcaaattgtttataggcggtctaaaccgcgaaacaaacgaaaagatgctgaaggccgtgtttggcaaacacggaccaatttctgaagtgctgctcataaaagacaggacgagtaaatcccgaggcttcgctttcataactttcgagaatccagctgacgctaaaaatgccgctaaggatatgaatggcaagtccctgcacggtaaggctattaaggtcgagcaggccaagaaaccctctttccaatcaggcggtcgaagacgacctccggctagttctcgtaatcgttccccatctgggagtctccggagcgcgagagggagcagaggcggaacacggggatggctcccgtcccacgagggacacctggatgatggcggatacacgcccgacctgaaaatgagttattcgagaggcttaataccagtgaagcggggaccctcaagcaggagcggagggcctcccccaaaaaagtcagcaccaagcgctgtggctagatcgaattcctggatggggtcacaggggcctatgtcacagcggagggaaaattacggtgtccccccaagacgcgctaccatcagcagctggcgcaacgatcgaatgagtactcgccatgatggctatgccaccaatgatggcaaccatcccagctgtcaggagacccgggattatgctccaccatctcggggttacgcctacagagacaacggacattcaaacagagacgaacacagcagccgcggttatagaaaccaccgaagctcacgcgaaaccagggactatgcacccccaagtaggggccacgcctaccgtgactatggccattctcggagagacgagtcctactcccgcggttacaggaaccggaggagtagccgggagaccagggagtacgcccctcctagccggggacatgggtacagagattacggccactcaagaaggcatgaatcctatagccggggatatagaaatcacccctctagtcgggagactcgagattatgcccctccgcatagggactatgcatatcgagattacgggcatagttcctgggacgaacacagttccagagggtattcttatcacgatggatatggcgaggcgctcggcagagaccactccgagcacctctctggatcctcttatcgagatgcactgcagcggtatggaacatctcacggtgcccctcctgcgcgtgggccacgtatgagctatggtggctctacgtgccacgcctacagcaatactcgtgatcgatatggcaggtcttgggaatcgtactccagctgcggggacttccattattgcgaccgggagcatgtctgtcgtaaagatcagaggaacccaccatccttgggacgagtgctccctgatccgagagaggcttgcgggtcctccagctacgtggctagcatcgtcgacggtggtgagtctcggtccgagaagggcgactcctcacgatactag

SEQ ID NO: 239415 - DNA, 870 bp, Artificial Sequence
  Description of Artificial Sequence: Synthetic coding sequence
atgagcaccagacacgatggatacgccactaacgacggcaaccatccatcctgccaggagactagggactatgccccaccatcgagaggatatgcctacagggataatgggcacagcaatagggatgagcatagcagtcggggatatcgcaaccaccgttcttcaagagaaaccagggattacgcacccccttcgagaggccatgcctaccgcgattatggtcattccaggcgagacgaatcttactcacgcggttatcgcaaccgccgaagctctcgagagactagggagtacgcgccaccttctcgtgggcacggataccgtgactacgggcacagtcgccgacacgagagctactcccgcggatatagaaatcacccatcttccagagaaaccagggattacgcacctccccacagggactatgcttatcgcgattatggtcactcctcctgggacgagcactccagccgaggctactcttatcacgatgggtatggagaagccctgggacgggatcacagtgagcacttgtctgggagttcctaccgcgacgccttacagagatacggcacatcccacggcgctcccccagccaggggtccccgtatgtcttacgggggatctacttgtcatgcttattccaacacccgggaccggtacggacgcagctgggaaagctactcctcctgcggcgattttcactactgcgacagagaacacgtgtgtaggaaggatcagcgcaacccccctagccttgggcgtgtcctgccggatcctcgggaggcctgtgggagttcttcttatgtcgcaagtatcgtggacggaggcgaaagcagatccgaaaaaggggactcctcccgatattag

SEQ ID NO: 239416 - DNA, 1266 bp, Artificial Sequence
  Description of Artificial Sequence: Synthetic coding sequence
atggggaagaggctcgaccaaccacaaatgtatccgcagtacacctattattatcctcattatctgcagacaaaacaatcctacgctcctgcccctcaccccatggctccacctagcccctccactaatagtagctccaataacagcagtaacaattctagcggggaacaactgtccaaaactaacctatacattcgcggactgccacccggtacaactgaccaggatctgatcaagctgtgccagccgtacggaaagatcgtgtcaacgaaagccattctcgataaaaacacgaaccaatgtaaagggtacgggtttgtggacttcgactctcccgctgccgctcaaaaagccgtggccagtctgaaggctaacggcgtgcaggcccagatggccaaacagcaggaacaagacccaaccaacttgtacatatcaaacctaccgattagcatggacgaacaggaactagagaacatgttgaagccatttggtcacgtcatctccactagaattctgagggacgccaacggcgtttccagaggggtgggctttgctcggatggagtccacagaaaaatgtgaagtggtgatacagcactttaatggtaagtaccttaagacccctcccggtattcccgctccctccgaaccgcttttatgtaaattcgctgacggcggacagaaaaaaaggcagaatcagagcaaatacactcagaacgggaggccttggccacgtgaaggagaggccggaatggccctaacgtatgaccccaccgctgccattcagaatggtttttatagtagtccctacagcatagcaaccaatagaatgattccgcaaacatcaataacgcctttcattgccgcatctccagtaagtacctatcaggtccagtctacatcatggatgcctcacccaccctatgtcatgcaacctacgggcgcagtgattacacccaccatggaccatcctatgagcatgcagccagcaaatatgatgggacccctcacgcagcaaatgaaccatcttagtttaggcaccacgggcacctacatgaccgcagccgctcccatgcaaggaacatacattccccagtacacgcccgtgccacctactgctgtgagtattgagggggtggtagccgataccagccctcaaaccgttgctccatctagtcaagacacgtctggacaacagcagcagatagcagtggacacctcaaacgagcacgccccagcttacagctaccagcagagcaaaccgtag

SEQ ID NO: 239417 - DNA, 1263 bp, Artificial Sequence
  Description of Artificial Sequence: Synthetic coding sequence
atgggcaagcgattggatcaaccccagatgtacccacagtacacgtattactacccccactatctacagacaaagcaatcgtacgcgcctgcccctcatccaatggctcctccatctcccagcaccaactcctcttctaacaactcaagcaataactcatctggtgagcagctgtcaaagaccaatctttatatcagaggtcttccccctggtacaacagatcaggatctgattaagttgtgccagccttacggaaaaattgtgtcaaccaaagctattctcgacaaaaacacgaaccagtgcaagggctacgggttcgtagatttcgattccccagccgcagcccagaaggctgtggctagcctgaaggcgaacggcgttcaggcccaaatggctaaacagcaggaacaggatccgaccaacctgtacattagtaatctccctatatcaatggatgaacaggaattggaaaacatgctgaagcctttcggacacgtaatcagcactagaattctgcgcgatgcgaatggggtttcccgaggcgttggcttcgctcggatggagtcgaccgagaagtgtgaggtcgtgatacagcacttcaacgggaaatacctgaagacccccccaggaattcccgctcctagcgagccgctgttgtgtaaattcgccgacgggggacagaagaaacgacagaatcagtccaaatatacccagaacggcagaccctggccacgggaaggtgaggccggtatggcactcacctacgatccaacagcagccatccagaatggattctacagctccccttattctattgccactaataggatgattccacagacgtccatcaccccctttatagctgcttcccccgtgagtacgtaccaggttcagtccacctcctggatgccccacccaccttatgtgatgcagcctaccggagcagtcattactcctaccatggatcatcccatgtcaatgcaacctgccaacatgatggggccattgacacaacagatgaatcatcttagcttaggaaccacaggcacatacatgacagcagctgccccaatgcagggtacgtacataccccagtatacgccagtgccacctacagccgtgtccattgagggtgtggtggcagatacatctcctcagactgttgcccctagctcccaggacaccagcggacagcagcagcagatcgcagtcgatactagtaacgagcacgcccctgcgtatagctaccaacagagtaaatag

SEQ ID NO: 239418 - DNA, 1260 bp, Artificial Sequence
  Description of Artificial Sequence: Synthetic coding sequence
atggggaaaagacttgatcagccgcagatgtaccctcagtatacctactactatccacactacctgcagaccaagtcctacgcccctgctccacatcctatggcgccaccctcaccatcaactaattcatcatcaaataactcatcgaacaacagctctggcgaacagctgtccaagactaatctctacattagggggctgccgccaggaacaaccgatcaagatctgattaagttgtgtcaaccatatggcaagatagtgtcaacaaaagccatcttggacaagaatactaaccagtgcaaagggtatggatttgtcgacttcgattcccctgcagcagctcagaaggcagtggcaagtctgaaagccaatggcgttcaggctcaaatggccaaacaacaagagcaggatccaactaatttgtatattagcaatcttcctatcagcatggatgaacaagagctcgaaaacatgctgaagcctttcggccacgttatttcaaccagaattcttagagacgccaacggggtttccagaggtgttggtttcgctcggatggagtccactgagaaatgcgaggtggtgattcaacacttcaatggcaagtatttgaaaacaccccctggaatccccgctcccagtgaacccctgctctgtaagttcgccgatggtggacagaaaaaacgtcagaatcagtccaagtatactcagaacggacggccatggccgcgagagggtgaagctggcatggcgttaacttatgatcccaccgctgctatacagaacggattctacagcagtccatacagcatcgctaccaatcgcatgatcccccagacaagcattacaccttttatcgctgcatccccggtctccacttaccaaggggcagtgattacccctacgatggaccacccaatgtccatgcagccagctaacatgatgggccctctgacccagcagatgaatcacctatctctcggcacaacaggaacaatacagtcgcaggaccgcattatgattctgcaccagcttctctgccagtatatgaccgcggctgctcccatgcagggcacctacatcccacagtacacccctgtaccccctaccgcagttagtattgagggcgtggtagccgacacctctccccaaaccgtggcaccttcttcacaggacacctctgggcagcagcagcagattgcagttgacacttccaatgaacacgccccagcgtacagttaccagcagagcaagccctag

SEQ ID NO: 239419 - DNA, 1314 bp, Artificial Sequence
  Description of Artificial Sequence: Synthetic coding sequence
atggggaaacgacttgatcagccacagatgtatccacagtacacttactactatccccactacctgcaaacaaagcagtcttacgcccctgctccccatccaatggcgcctcccagcccctccactaactctagttcgaataactcttcgaacaattcctccggggaacaattgtcgaaaactaacctatatatccggggactgcctcccggtaccacggatcaggatttgatcaaactgtgtcagccttacggcaagattgtatccaccaaggctatcctcgacaagaatacaaatcaatgtaagggatatggcttcgtggactttgatagccctgccgcagcccagaaggctgtggcctctctcaaagctaatggtgtacaagcacagatggctaaacagcaagaacaggatccaactaacttgtatatatccaatctacccatatctatggacgagcaagagttagagaatatgctgaaacccttcggacatgtgatttcaacacggatcctgcgggatgcaaatggagttagtaggggtgtgggtttcgccaggatggaatctaccgagaagtgtgaggtggtgattcagcactttaatggaaagtatttgaagactccaccaggcattccagcccctagtgagccgctgctctgcaagttcgcagacggagggcaaaaaaaaagacagaaccaaagcaaatatacacagaacgggaggccttggcccagagagggagaagcagggatggccctgacgtatgacccaacggccgcaatccaaaatggtttttattcctcaccatactcaatcgccactaatcggatgatcccgcaaactagcattactccattcattgccgcatctcccgtgtctacctaccaggtgcagagcacatcttggatgccacaccctccatacgttatgcagccaaccggggcagtcatcacccctaccatggatcaccctatgagtatgcagcccgctaatatgatgggcccattgacgcagcagatgaatcacctgtctctgggcactacgggaactattcagagccaagatcggatcatgattctacaccagctgctgtgccagtatatgacagcagcggcaccaatgcagggtacttacattccgcagtatactccggtgcctcctaccgccgtcagtatagagggcgtggttgcagatacatctccacagacagtagccccaagctcccaagacacctccgggcaacagcagcagatcgcggtggacacatccaacgagcatgcacctgcttactcctaccagcagagcaagccttag

SEQ ID NO: 239420 - DNA, 1305 bp, Artificial Sequence
  Description of Artificial Sequence: Synthetic coding sequence
atggggaagcgcttggatcaaccccagatgtatccccaatacacatactattacccccattacctgcaaaccaagcaatcttacgctccagcaccccacccaatggctcccccaagtccatcaactaacagcagctccaacaactcaagtaacaatagctcaggggaacagctgtcaaagactaacctgtacatacgtggactccctcccggtaccaccgaccaggatctcatcaaattgtgccaaccctacggaaagattgtgagtactaaggcaattctggataaaaataccaaccagtgtaaagggtacggatttgtcgacttcgactcgcccgcagcggcacagaaagccgtagctagcctgaaagccaacggggtccaggcacaaatggccaagcagcaggaacaggaccctacgaacttatatatttctaacctgccaataagcatggatgagcaggaactggagaatatgctaaagcctttcggccacgtcattagcaccaggatattgagagacgccaatggggtttcccgcggagtcggcttcgccaggatggagagcactgaaaagtgtgaggtggtcatccagcacttcaacggaaagtacctcaagacaccacctgggatcccagcgcctagcgaaccactgctttgcaaattcgcagacgggggacaaaagaagaggcagaatcagtccaagtatactcagaacgggaggccatggcccagggagggtgaggttctgaggggcaggacagtgccacgacagaacagagaggcagggatggccctgacatacgacccgacagccgcaatccaaaatggattttatagttctccatacagtatagcaaccaatagaatgattccacagacttccataacaccatttatcgccgcttccccggtgtctacttaccaagtgcaatccacttcatggatgccacatcccccatatgtgatgcagccaacaggggctgtcatcacgccaaccatggatcaccccatgtctatgcagcctgccaacatgatggggccattaacccagcagatgaaccatctatctctcgggaccacgggtacctacatgaccgcagctgcaccgatgcaagggacgtacataccccaatacacacccgtccctcccacagctgtctctattgagggtgtggtggccgacacgagccctcaaacagtcgctcccagctctcaggacacaagcgggcagcagcaacagatagctgttgatacctccaacgagcatgctccggcttattcttaccagcagagtaaaccatag

SEQ ID NO: 239421 - DNA, 1311 bp, Artificial Sequence
  Description of Artificial Sequence: Synthetic coding sequence
atgggaaagaggctggatcagccccagatgtacccgcagtatacttattattaccctcattacctccagacaaagtcctacgcgcctgctccacacccaatggcccctccaagcccatccaccaactctagctccaataatagttcaaataattcatccggggagcagttgagcaagactaatctatatattcgcggattacccccaggaaccacagatcaggacctgataaagttgtgccaaccttatggaaaaattgtgagcacgaaagccattctggataagaacacaaaccagtgtaaggggtatggcttcgtggattttgactccccggctgccgctcagaaagctgtggcgtccctaaaagccaatggagtccaagcccagatggctaaacagcaggaacaagatcctacaaacttatatatttcaaacttgccaattagtatggatgagcaggaactcgaaaacatgctgaaaccctttggtcacgtgatctccacccgcatcctgcgggatgctaatggggtaagtcggggtgtgggatttgctcgtatggaatcaactgagaaatgcgaggtagtgatccagcattttaacggaaagtacctaaagacaccgccagggatccctgcgcctagcgaacccctattgtgtaaattcgctgatggaggtcaaaagaaacgacagaatcagtccaaatacacacagaatggcaggccatggcccagagagggagaagctggcatggccctgacctacgatcctacagctgccatccaaaacggattctattcttccccatatagtatcgcaaccaataggatgatcccacagacctcaataacacccttcatcgcggcatcacctgtctctacttaccaagtccaatctacttcttggatgcctcacccaccttacgttatgcagcccacaggagcggtaattacccctacaatggatcatccaatgtctatgcagcccgcaaatatgatgggcccactgacgcaacaaatgaatcatctgtcactgggcaccactgggacgatccagtcacaggaccgtattatgatcctgcatcaacttttgtgccagtatatgaccgcggctgcgcctatgcaggggacgtatattccccagtataccccggtgccgccaacagccgttagtatcgagggggtggtggcagacacgagtcctcaaacagtcgcaccctcaagccaggacaccagtggccagcagcaacagatcgcagtggacacttctaacgagcacgcccctgcttatagttatcaacagtcgaagccatag

SEQ ID NO: 239422 - DNA, 1302 bp, Artificial Sequence
  Description of Artificial Sequence: Synthetic coding sequence
atgggaaagaggctggaccaaccacaaatgtaccctcagtacacatactactacccacactacctacagactaagcagtcctacgccccagcacctcaccccatggcgccacctagtcccagtacaaattcatctagtaacaattcgtcgaacaacagttcaggggagcaactgtctaagactaatctgtacattagagggctgcctccgggaaccaccgatcaggacctgattaagctatgtcaaccttacgggaagattgtcagcacaaaggctatactcgacaaaaacaccaaccagtgcaaggggtacgggtttgttgacttcgattctcccgctgcggctcagaaggccgtagcttccctcaaggccaatggtgtgcaagcccaaatggccaaacagcaggagcaggacccgacaaacctctacattagtaacctgcctatttcaatggacgagcaggagctggaaaacatgcttaaacctttcggacacgttatcagcacacggatcctcagggacgccaatggagtctcgagaggcgtggggttcgccaggatggaatcaactgagaagtgcgaagtggtaatacagcatttcaatggcaaatacctcaagacaccgcctgggatacccgcaccctcagagcctctgctttgtaaattcgcagatggtggccaaaaaaaaagacaaaatcagagtaagtacacccagaatggaagaccctggccccgagaaggagaagtgctgaggggaaggaccgtgcctcgacagaaccgtgaggcgggaatggccctaacttacgatcctactgcagcaattcagaacggattttacagctcaccatacagtattgccaccaacaggatgattccccaaactagtatcacccctttcatcgctgccagtcccgtgtccacttaccaagttcagtccacatcatggatgccccatccgccttatgtgatgcagccgacaggtgcagtgatcacaccaacaatggaccaccctatgtccatgcagcccgctaatatgatgggacctctgactcagcagatgaaccatctgagtctgggtactaccggcacctatatgactgccgcagcccctatgcagggcacatacatacctcagtacacaccggtcccccctaccgcagttagcattgagggagtagtggcggacacgtcaccccagaccgtcgccccttcttcacaggatacgtccggacagcagcagcagatcgccgtagacacctcaaacgagcacgcacctgcatactcataccagcagtcaaaatag

SEQ ID NO: 239423 - DNA, 615 bp, Artificial Sequence
  Description of Artificial Sequence: Synthetic coding sequence
atgaacaatggcggaaaagccgagaaggaaaacacgcctagcgaggcaaatttgcaagaggaagaggtaaggaccctcttcgtaagtggacttccactggacattaaaccaagagagctgtatcttctgttcaggcctttcaaggggtacgaaggctcactcatcaagctcactagcaagcagcccgtgggattcgttagcttcgactccagaagcgaggcggaggctgctaaaaatgccttaaacggaattcggttcgatccagagataccccagaccctgcgccttgaatttgctaaagcaaatacgaagatggcaaagaacaaactggtcggaacacccaatccgtcaacccctctccccaacaccgttccacagtttatcgccagggaaccatatgagctgaccgtgcccgctctctacccctcctcgcctgaggtgtgggccccttaccctttatatccagcagagctggcgcctgccttgccaccgccagcattcacctacccggcttcactgcacgcccaactgtgtgagggccagactgttcggcgatcccatccacttagtgcaccatctcccgatagcgcctcccttgcttggttccctgtgtag

SEQ ID NO: 239424 - DNA, 591 bp, Artificial Sequence
  Description of Artificial Sequence: Synthetic coding sequence
atgaacaatggaggcaaggctgaaaaggagaacacacctagcgaggcaaatctgcaagaagaggaagtgcgcacattgtttgtgagcgggttacctctggatattaagccaagggaactatatttacttttccgcccattcaaggggtacgagggtagtctaataaaacttacctccaagcagcctgtaggctttgttagcttcgattcacggagcgaagccgaggccgctaagaacgctctgaacgggattcgctttgatcccgagataccgcagactttgcgcctggaattcgccaaggccaacactaagatggctaaaaacaagttagtaggtacaccgaacccaagtactcctctccccaacacggtgcctcaatttatcgcgagggaaccctatgagcttactgttcctgctctctatccaagtagccccgaggtttgggccccataccccctctaccccgcagagcttgccccagcactgcctcctccagcattcacctatcctgcttcccttcatgcccagatgcggtggctcccaccatcggaggcaaccagccaggggtggaaatctcgacagttttgctag

SEQ ID NO: 239425 - DNA, 660 bp, Artificial Sequence
  Description of Artificial Sequence: Synthetic coding sequence
atgaacaatggcggtaaggccgagaaggagaatacccctagtgaagcaaacctgcaagaagaagaggttcggacgttgtttgtaagtgggctgcccctcgatattaagcccagagaactttacctgctgtttcgaccctttaagggttacgaggggtccctgatcaagctgaccagtaagcagcccgttgggttcgtgtcgtttgattcacggtccgaggccgaggcagctaagaacgctctcaatgggataagattcgacccggagattccccagacactgcgcctagagttcgcaaaagctaacactaagatggctaagaacaaactggtgggaacaccaaacccgagcacacccctaccaaatacggtgccccaatttatcgctcgtgaaccctatgaactcaccgtacctgccctttatccaagcagcccggaagtgtgggctccctacccactatatcctgctgaactggctccggctttgcctccccctgccttcacatacccggcatccctccatgcacagtgtttctcccctgaggcaaagccaaacacaccagtcttctgcccgctgctgcagcagatccgtttcgtctctggcaatgtgtttgtaacgtaccaacctaccgccgatcagcaaagggagcttccgtgctag

SEQ ID NO: 239426 - DNA, 591 bp, Artificial Sequence
  Description of Artificial Sequence: Synthetic coding sequence
atgaacaacggtggtaaggccgagaaagaaaatacacccagtgaagctaatctgcaggaagaagaagtgcggacattgtttgtgtcgggcctgcctcttgatatcaagccacgggaactgtatctcctgttccggccatttaaaggatatgaagggtcattgataaaactgacgtccaaacagcccgtcggtttcgtctcatttgattccaggtctgaggccgaggccgcaaagaacgcactgaacggaataaggttcgatcctgaaattcctcagacactgcgcctcgagtttgccaaagcgaatacaaagatggcaaaaaataagctggtcggaacaccgaatcctagtacacccttgccgaacactgttccccaattcattgccagggagccttacgagttaaccgttcctgctctgtatccatcatccccggaagtctgggccccttacccgctataccccgcagagctggctcccgctttgcccccacctgccttcacttaccccgcaagcctacatgcccagatgagatggctccccccatctgaggctaccagtcagggatggaaatcccggcagttctgttag

SEQ ID NO: 239427 - DNA, 462 bp, Artificial Sequence
  Description of Artificial Sequence: Synthetic coding sequence
atgaataacggaggcaaagcagagaaagagaacacacccagtgaggccaatctccaggaggaagaagtgcgaacactctttgtttcaggattgcccttggacatcaagcctcgggaactgtatttactgttccgcccattcaagggctatgagggtagcctaattaaactaaccagcaaacaaccagtcgggtttgtcagcttcgatagccggtccgaagccgaggccgcaaagaatgctcttaatggaatccggttcgaccccgaaattccccagacactgagactggaatttgcgaaagccaacacaaaaatggccaagaacaaactggtgggcacaccgaacccgagcacacccctgcccaacacagtgccacagtttatcgccagggagccgttgatgcggtggctgcctccctcagaggccaccagccaaggctggaaatcccgacagttctgctag

SEQ ID NO: 239428 - DNA, 1257 bp, Artificial Sequence
  Description of Artificial Sequence: Synthetic coding sequence
atgctagcctctcaaggagtgttgctgcacccttacggagtgcccatgatcgtccccgctgccccttatctccccggattgatacagggaaatcaggaggctgcagccgcacccgataccatggcccagccatacgccagtgcccagtttgcacctccccaaaatgggatccctgctgagtacaccgcccctcacccacatccggctcctgaatacaccggacagacaacggtgcccgaacatacactgaatctgtaccccccagcacagacacactccgaacagagtcctgcagatacatccgcgcagaccgtctctgggacagccacccagactgatgatgctgcacctaccgacgggcaaccccagacgcagcccagcgagaacactgaaaataaatcccagcctaaacgcctgcatgtgtctaatatcccatttcgctttagggaccccgacctccgccaaatgttcgggcagttcggcaaaattctcgatgtggagattatttttaatgagaggggctcgaagggttttgggtttgtgaccttcgaaaacagcgcagatgcggaccgagccagagaaaagctccacgggaccgtggtcgaagggagaaagattgaagttaataacgccacggcgagagtgatgacgaataagaaaaccgtaaatccatacacaaacgggtggaaattgaacccggtggtgggagcagtttactccccagaattctacgctggtacagttcttctgtgccaggccaatcaggaaggcagctccatgtactccgccccatccagcctggtgtacacctctgccatgcccggtttcccttatcccgcagccaccgctgcggctgcttaccggggagctcatctccgaggacggggtaggacagtctacaacacttttagagcagcggctcctccgcctcctatccctgcttacgggggagtggtatatcaggaacccgtctacgggaacaaactgctgcaagggggttacgccgcatatcggtatgcccagcccacccccgcaaccgctgctgcgtatagtgattcatacgggagagtgtacgcagccgatccatatcaccacgctctggccccagccccaacctacggcgtcggggctatgaacgccttcgctcctctgacagacgcaaagacacgaagtcacgcagatgacgtggggcttgtgttatcctcattacaggcaagcatctaccgcggagggtacaaccgcttcgccccttactag

SEQ ID NO: 239429 - DNA, 1209 bp, Artificial Sequence
  Description of Artificial Sequence: Synthetic coding sequence
atgatagttcctgccgcaccgtatctgcccggacttattcagggaaatcaggaagctgcagctgcccctgacacgatggcacagccatatgctagcgcccaattcgcccctcctcaaaacggcataccagctgaatatacagcaccgcatccccaccctgcccctgagtacaccggccagacaactgtacctgaacacacccttaacctatatccacctgcccagactcattccgaacagagtccagccgatacctcagcccagacagtttcaggcaccgctacacagaccgacgatgccgcaccaactgatggccaaccgcagactcagcctagtgagaatacggaaaacaaatctcaaccaaagagactgcacgtatctaacattccttttcgatttcgggatcctgacctccggcagatgtttgggcagttcggaaaaattctggatgtcgagattatcttcaacgaaagagggagtaaagggttcggttttgtaaccttcgaaaactctgccgatgcagatagagcgagggagaagttacacggaacagtagtcgaggggagaaagattgaggtcaataatgctactgccagagtgatgactaacaagaagacagtgaatccatatacaaatggctggaaactgaacccagtagtgggggcagtttattcgccagagttctatgcagggaccgtgctgctctgccaggccaatcaggaaggttcttccatgtattccgctccatcctcgctcgtgtacacgtcagctatgccagggttcccgtaccctgcggcaacagcagctgcagcttaccgcggagcgcatctgcgcggacggggacgcaccgtctacaatacattcagagctgccgctccgccacccccaattcctgcgtacgggggagtcgtgtaccaagatgggttttacggggctgatatctacggcggttatgcagcttaccggtacgcacaaccaaccccggcaacagctgccgcatactcagactcctacgggagggtatacgctgcagacccgtaccatcacgcacttgccccagcaccgacctacggagtaggcgcaatgaatgcgttcgccccattgacagatgccaagacaaggagccacgccgacgacgtgggccttgtgttgagctctcttcaggccagcatctacagaggtggctacaacagatttgctccctactag

SEQ ID NO: 239430 - DNA, 1176 bp, Artificial Sequence
  Description of Artificial Sequence: Synthetic coding sequence
atgctggcttcccagggtgtattgctgcacccttatggagtcccgatgatagttcccgcagctccttatctgcccggactcatccaggggaaccaggaggctgccgctgcccctgacactatggcccaaccatatgccagcgctcaattcgcaccaccacagaacggcattcccgctgaatacacagcacctcatcctcaccccgcaccagagtacacaggccagacgacagtgccagagcataccctgaacttatacccccctgcacaaacacactcagagcaatcgccagctgatacatcagcccagacagtatcgggcacggcaacccagacggatgacgccgcacctacagatggccagcctcagacccagccaagtgagaacactgagaataaaagtcaaccgaaaagactgcacgtttctaatatcccattccgatttcgcgacccagacctgcgacaaatgttcggccagttcgggaaaatcctggatgtggagatcattttcaacgagcgcggtagcaagggcttcgggttcgtcacctttgagaatagcgcagatgctgacagggcacgagaaaagctacatggcacagttgtcgaaggccgaaagatcgaggtaaataatgcaacggccagagtgatgacaaacaaaaaaactgttaacccttacacaaatggctggaagctaaaccctgtcgtaggtgccgtctactctccagaattctatgccgttcccggtttcccttacccagcagccacagcagcagcagcctacaggggagcccacttacgcggaaggggaagaacggtgtacaatacctttcgggctgctgcgccaccaccccctatcccagcctacgggggagttgtgtaccaggagccagtgtatggtaataaacttttgcaaggcggatacgctgcttaccgctatgcccagcctacaccagccactgcggcagcatactctgatagctatggtcgggtctacgccgctgacccataccatcacgcgctagcaccagccccaacttacggcgttggcgcaatgaacgccttcgcccctctcacagacgctaaaacgcggagccacgccgacgacgtcggcctggtgttatcatcgctacaggcatcgatctaccggggaggatacaatcggttcgctccttactag

SEQ ID NO: 239431 - DNA, 1188 bp, Artificial Sequence
  Description of Artificial Sequence: Synthetic coding sequence
atgctcgcctctcagggagtgctcctccacccttatggggtcccaatgattgtgcctgcagcaccctaccttcctggcttgatacagggaaaccaggaggccgctgcagctccagataccatggcacaaccatacgcctccgcccagtttgcccctccccaaaatggtattcctgctgagtatactgcacctcacccacatcccgcacccgagtacaccggtcagaccacggtacctgaacatactctcaacctgtatccaccagcccagacccactccgagcagagcccagccgatacctcagctcaaacagtctccggcaccgcaacccagaccgacgacgcagcacctacagatgggcagccgcagactcagccgagcgagaatacagaaaacaagtctcagcccaaacgtctccacgtctccaacatacccttccggttccgcgatcctgaccttcgccaaatgttcggtcagttcggcaagatcctggatgtggagattatcttcaacgagcgcggaagtaagggcttcggctttgttactttcgagaattctgccgatgctgaccgtgcaagggagaaactgcatggaacagtagtggaaggcagaaaaattgaggtgaataacgccacagctagggtgatgaccaataagaaaacagtgaatccgtataccaacggctggaagctcaatcctgtcgtcggagccgtgtactcccccgaattttatgcgggtactgtcctgctctgtcaggctaatcaggaaggctcctctatgtattcagccccatccagcctcgtttataccagtgctatgccaggattcccctatccggcagcaacagctgctgccgcttaccggggagcacacctgcgcggtaggggcagaactgtgtacaatacattccgtgccgcagcgccacctccgccaatccctgcctatggcggtgtcgtttatcaggaacccgtgtatggcaacaaacttttgcagggcggttacgccgcatatcgatacgcccagccaactccagcaactgcggcagcctattccgataggaatcaatttgtgttcgtggctgccgatgaaatcagttgtaacacaagcgcagtgactgacgaattcatgctgcccaccccaacaactacccatttactccagcccccaccaaccgcactagtcccatag

SEQ ID NO: 239432 - DNA, 1179 bp, Artificial Sequence
  Description of Artificial Sequence: Synthetic coding sequence
atgctggcttctcagggcgtcctcttgcacccttatggagttcctatgatcgtgccagctgcaccctatctaccgggtctgattcaaggaaaccaagaagccgctgccgcaccagatactatggcacagccttacgcttcagcccagtttgctccgcctcagaacggaatccctgcggaatacaccgcccctcacccacaccccgctcctgagtacaccggccagactacggtccctgaacacactctgaacttgtatcccccagcccagacccattcagaacagtctcccgcagatacatctgctcagaccgtgagcggcaccgcaactcagacagacgatgctgctccgaccgacggccaacctcagacccagccatccgaaaacactgaaaacaaaagtcagccaaagaggctccatgtttcaaacatccctttccgatttcgcgaccccgatcttcgccagatgttcggccagttcggaaaaatactagacgtggaaatcatctttaacgagcgtggctctaagggcttcggctttgtgacattcgagaatagtgccgacgccgacagggccagggagaagctacacggcactgtcgtcgaaggcagaaagatagaggtcaacaatgccaccgcaagagtcatgactaataaaaagacagtaaacccgtacaccaatggctggaagctaaaccccgtagtcggggcagtttattcccctgagttctatgccggaacggtcttattgtgccaggcaaaccaagagggatcttccatgtacagcgccccttcttccctagtttatacatccgctatgcccggttttccatatcctgctgcaacggccgcagctgcttatcggggagcccacctgcgaggcagaggcagaacagtgtacaacacctttcgtgctgctgctcctcctccacccatcccagcctacgggggagttgtataccaggagccggtgtacggaaataagctccttcaaggtggctatgctgcatacagatacgcacagcccacccccgcaactgcagccgcatactctgattcctacgggagagtctacgcagctgatccctaccaccacgcactggcgcctgctcccacatacggggtgggcgctatggcctctatctatcggggtggctataataggtttgccccatactag

SEQ ID NO: 239433 - DNA, 1194 bp, Artificial Sequence
  Description of Artificial Sequence: Synthetic coding sequence
atgaactgtgagagggagcagttgcgcggtaaccaggaggcagccgctgcccctgatacaatggcacagccgtatgcatccgctcagttcgcaccgcctcagaacggcattccagccgaatatactgcccctcatccgcatcccgcacctgaatacactggtcaaacaacagtccctgaacataccctgaatctgtatccacctgcacaaacccattctgagcagagcccggctgataccagtgcacagactgtgtccggcactgctactcagaccgatgacgccgcacccacagatggccagcctcagacccagcccagtgaaaacaccgaaaataaaagccagcctaagaggctccatgtgtctaacatacccttcaggttccgtgatcccgatcttcgtcagatgttcgggcaatttggaaagatcctcgacgtggagataattttcaacgagaggggctctaagggttttggctttgtgacttttgagaactcagcagacgctgatcgcgcaagggagaaactacatgggaccgttgtggaaggacgcaaaattgaagtgaataacgctactgcccgagtgatgaccaacaaaaaaacagtgaatccttataccaatggctggaagctgaatcctgttgttggcgctgtctactccccggagttctatgccggaacggtccttctgtgtcaagctaaccaggagggtagcagtatgtactcggcgccaagcagcttggtgtatacctcagctatgcctggtttcccatatcctgctgccaccgctgcggctgcctatcgtggagctcatctgcgaggacggggtaggacagtctataacacctttagagctgcagcccctccacccccaatcccggcatacgggggagttgtgtaccaggatggcttttacggggctgatatatatggtgggtacgcggcttataggtacgcccagcccaccccggcaaccgccgcagcctactctgattcctacggaagggtgtatgcagccgacccctaccatcatgccttggcaccagcccctacgtacggcgtaggcgctatgaatgcattcgccccattaacagatgccaagaccagatcacacgctgatgacgtcggcctggtgctctctagccttcaggcctcaatctaccgcggaggatacaaccggttcgctccctattag

SEQ ID NO: 239434 - DNA, 1401 bp, Artificial Sequence
  Description of Artificial Sequence: Synthetic coding sequence
atggaaactggacagaggacccacgcttccggaacgtattcatttctggatagaactcagcactccgacatcaaagcagattgcaacacatgcgtggagattgaggacaggaaagtgagccggcagcaaatgaattgcgaacgcgagcagctgagaggcaaccaggaagcggctgccgctcccgataccatggcccagccatacgcaagtgcgcagtttgcccctccacaaaatggcattcctgcagagtatacagcccctcatccccatccggctccggagtatactggtcagacaacagtcccggaacacacactgaacctttaccctcccgcacagactcattccgagcagtctcctgcagatacgagcgcgcagactgtgtccggcacagctacccaaactgatgatgctgctcctaccgacggacagccccagacacagccatcggagaacaccgaaaataagagccagcccaagcgcctccatgtgtccaacatcccctttcgattcagggacccagacttgcgccagatgttcggtcaatttgggaaaattttagatgtcgagattatctttaacgaacgaggatctaaggggtttgggttcgttactttcgagaacagcgccgatgcagatcgagcccgagagaaactgcacggcaccgtggtggagggacggaagattgaggttaataatgccaccgccagagtgatgaccaataaaaaaacagtaaatccttataccaatgggtggaaattaaatcctgtggtgggggctgtctactctcccgagttctatgccggtactgtgctgctgtgccaggccaaccaagaagggagttccatgtacagtgccccttcgagtctggtgtacacttctgccatgccaggcttcccctaccctgctgcgacagctgccgcagcataccggggtgctcacctcaggggaagaggacgcaccgtgtacaacactttccgggctgccgctccaccacccccaattccagcgtacggaggggttgtttaccaggatggattctacggggcagacatttacgggggatacgcggcttaccgatatgcacagcctactccagctaccgccgcagcatactcagatagaaaccagtttgtctttgtagctgctgatgaaatctcatgtaacacttcagcagtcactgacgagttcatgcttcccacaccgacaactacacacctgctgcaaccacccccaacggcgctagtgccttgccctaaggttcctgctcctgcacagacttccgaggaactgtcctgtactttgccgggactgtgctgccaggcagcagagaacctgactgcaagtcccccactgctgcagttcatgtttaaggtgatcgttgcccaagagaggaaatag

SEQ ID NO: 239435 - DNA, 1194 bp, Artificial Sequence
  Description of Artificial Sequence: Synthetic coding sequence
atgaactgtgagcgcgagcagctgagagggaaccaggaggcagcagcagctccagacaccatggcacagccctatgccagtgcccagttcgcaccaccacagaacggcatacccgctgagtatactgcccctcatccccaccccgctccagagtacaccggacagactaccgtgcctgagcacaccctgaatctgtaccctcctgcacagacacactcagagcagagcccggctgatacatcagcgcagacagtatcaggcaccgcaacacagaccgatgatgccgcaccaactgatggtcagccacagacacagccttccgaaaatacagaaaacaaatctcaacctaagcgtcttcacgtgtctaatatccccttccgattcagggaccccgaccttagacagatgttcggccagtttggtaaaatcttggacgtggagatcatctttaatgaacggggatctaagggctttgggttcgtgactttcgagaactccgctgacgcagacagagcgagggagaagctgcacgggacagtggtggaaggccgtaaaattgaggttaataatgccaccgctcgcgtgatgaccaacaagaagacagtgaatccatataccaacgggtggaaactgaaccccgtggtcggcgctgtgtatagtccagaattctatgccggtacagtgctgctttgccaggccaatcaagagggtagcagtatgtacagcgccccaagcagtctggtctacacgtctgctatgccgggtttcccttatcctgcggctacagcggcagctgcctatagaggcgcacacctgagaggtcgtggtagaacagtttacaataccttcagggctgcagcgccacccccacctatacctgcctatggcggtgtagtttaccaggatgggttttatggtgcagatatctacggaggttatgcagcttatagatatgctcagcccacacccgctaccgcagctgcctacagcgactcctacggacgcgtatatgccgctgacccgtaccaccacgctctcgcacctgccccaacatacggcgtgggtgctatgaatgcattcgccccattaaccgacgccaaaacccggagtcacgccgacgatgtcggtctggtcctttccagtctgcaggcctccatttaccgcggaggctacaatcgattcgccccatactag

SEQ ID NO: 239436 - DNA, 792 bp, Artificial Sequence
  Description of Artificial Sequence: Synthetic coding sequence
atgaactgcgagagagaacagcttagaggaaaccaagaagccgctgctgcacctgatacgatggcccagccctacgcctctgcgcagttcgccccaccccagaatggcattcctgccgaatacaccgctccacatcctcatcctgccccagaatataccggccagactaccgtccccgaacatactctgaatctgtaccctcccgcacagacacattctgaacagtcacccgctgacacatctgcacagaccgtatcagggacggctactcagaccgacgacgccgcacccaccgatggacagccccaaactcagccatcagaaaataccgaaaataaatctcagccgaaacgcctgcatgtcagtaatatccccttcaggttccgtgatcccgacctgagacagatgttcggccagttcggaaaaatcctagacgtagagattatttttaatgaacggggaagcaagggctttgggttcgtgacgtttgagaatagtgccgatgcggatcgcgcacgcgagaaattacacggaactgtcgtggaaggcaggaaaattgaagttaacaacgccactgctcgggtcatgaccaataagaaaaccgtcaatccttacacaaatggctggaagctgaacccggtggtaggcgcagtctattcccctgaattttacgccggaactgtattgctttgtcaggccaaccaagaagggagcagtatgtatagcgctccttcgagtcttgtctacacatcagcaatgcccggtttcccttatcccgcagccacagcttag

SEQ ID NO: 239437 - DNA, 1113 bp, Artificial Sequence
  Description of Artificial Sequence: Synthetic coding sequence
atgaactgtgagagggaacagctgcggggaaatcaggaggcggctgctgcgcctgacacaatggctcagccatacgcttcagctcagtttgccccaccacagaatgggatcccagccgagtacaccgcccctcaccctcacccagcacccgagtacaccggccaaaccaccgtccccgaacacacattaaacctgtacccccctgctcagacacacagcgagcagtcccccgcagacaccagtgctcagactgtttcaggaactgccacacagacggatgatgcggcaccaacagacggtcaaccgcagacccaaccctccgaaaacacagagaacaagtcccagccaaaacgcctgcacgtttctaatatccccttcagatttagagatccagacctgaggcagatgttcgggcagttcggcaaaatcctggatgtggagataatcttcaatgaacgagggtctaagggtttcgggtttgtcaccttcgagaacagcgcagatgctgatcgcgcacgtgaaaagcttcatggcaccgtcgtcgaaggccgaaagatcgaagtgaataatgccactgcacgagtgatgaccaataaaaaaacggtgaatccatataccaacggctggaagctgaaccctgtggtgggggcagtgtactcccccgagttctatgcagtgccgggttttccctatcccgctgcaactgcagctgccgcatatagaggtgctcacctgcgagggagggggcgtactgtatacaatactttcagggccgctgccccacctccccctatccccgcttatggcggagtggtctaccaagacggtttctacggagccgatatctacggcggatatgccgcataccgctacgcacaacccactccggctacggccgctgcctattccgattcatatggaagagtctacgcggctgacccataccatcacgctctggcaccagccccaacatacggggtcggagccatgaatgcattcgctcccctgacagatgccaagacccgcagccatgcggatgacgttggtcttgtactgagttcactgcaggcatcaatttacaggggcggatataatagattcgcaccttactag

SEQ ID NO: 239438 - DNA, 1725 bp, Artificial Sequence
  Description of Artificial Sequence: Synthetic coding sequence
atggcgcataataaaattccgcctcggtggctcaattgtccgcgtcgtgggcagcccgtggccggtcgcttcttacccctgaaaactatgcttggtccacggtatgactcccaagtagctgaggagaacagattccatccaagcatgttgtccaactatttaaagtccctcaaagtcaagatgggcttgttagtggacctgactaatacttcacggttctacgacaggaacgacattgagaaggagggaattaagtacataaagcttcaatgcaagggtcatggtgaatgccccactactgagaacacagagacctttatacggctgtgcgagcggttcaatgagaggaacccacccgaactgattggagtgcattgtacccatggcttcaaccgcacagggttcctgatctgtgcattcctggttgaaaaaatggactggtccattgaagcggcagttgctacattcgcccaggcaaggcctccgggtatctacaagggcgattacttgaaggaactgttcagaagatacggcgatattgaagaggccccaccaccaccattgttgcccgattggtgctttgaggacgacgaagatgaagatgaggacgaggacggaaaaaaggagtcagagccaggcagctctgctagctttggaaaacgacggaaagagcgacttaagctgggtgccatctttttggaaggggtcaccgtaaaaggtgtcacccaggttactacccaacctaagctcggggaggtgcagcaaaaatgccaccagttttgcggctgggagggtagcggatttcctggggctcagcccgtatccatggataagcagaatatcaagctgctggatctcaagccatacaaagtgagctggaaagctgacgggaccagatacatgatgctgatcgacggtacgaatgaggtgttcatgattgatcgggacaacagtgtcttccatgtgtccaatctagaatttcccttccgtaaagatctgcggatgcacctgtccaatactctcttggatggggaaatgattattgaccgcgtaaacggtcaggccgtgcctagatatcttatctatgatataatcaagttcaactcacagcctgtgggagactgcgattttaatgtgagactacaatgtattgaaagagagatcatttcaccacgacacgaaaagatgaagaccggattgatcgacaaaacgcaagagccattcagcgtgagaaataagccattcttcgacatttgcacctccaggaaaaagtacaaacccggtcgctgtgatgatattctgaaatggaaacctcctagtttaaacagtgtagattttcggttaaaaataactcggatgggcggtgagggccttttacctcagaacgtaggactgttgtacgttggaggctatgaaaggccttttgcgcagattaaagtgactaaagagctcaagcaatacgataataagatcatcgaatgtaagttcgaaaacaactcatgggtattcatgcgacagcgcactgataaaagcttcccaaatgcctataacaccgccatggccgtgtgcaacagtatctcgaaccccgtcactaaagaaatgctctttgaattcattgatagatgcacagccgctagtcagggacagaaacggaaacatcatctggatcctgacacagagctgatgcctcccccacctccaaaaagaccacgacccttaacttag

SEQ ID NO: 239439 - DNA, 1626 bp, Artificial Sequence
  Description of Artificial Sequence: Synthetic coding sequence
atggcccataacaagatcccacctagatggttgaattgccctagaagaggccagcctgtcgccggacggttcctgcctctcaagacaatgttaggaccacgctatgactcccaggtggcggaagagaaccgatttcatccatctatgctatccaactacttaaagtctctcaaagttaaaatggggctgctggttgacctgacaaatacttctagattctatgacagaaacgacatcgaaaaagagggcattaagtatatcaaactacagtgcaagggacacggagagtgccccactaccgagaacacagagacatttataaggctatgcgagcgcttcaatgagagaaacccacccgagctaattggagtccactgtacccacggctttaatcgtacaggtttcttaatttgtgcctttctggtcgagaaaatggattggtccattgaagccgctgtggctaccttcgcacaggcccgaccgccaggcatctacaaaggggattacctaaaggaactgttcaggcggtacggggacatcgaggaggcgccaccccctccccttctgcctgattggtgctttgaggacgacgaagatgaggacgaggacgaagatgggaaaaaggagtctgaacctggatcctccgcttcttttggcaaacgcaggaaagagcggctgaaactgggcgcaatattcctcgaaggagttaccgttaagggcgtgactcaggtaactactcagcccaaactcggcgaggtccaacaaaagtgtcaccaattctgcgggtgggaaggttccgggttccctggcgcacagcctgtttccatggataagcagaacataaagctcttggatctgaaaccatacaaggtcagctggaaggcggacggtacacggtacatgatgctaattgatggcacaaatgaagtgttcatgatcgacagagacaactccgtgtttcacgttagtaatctggaattcccatttagaaaagatctcaggatgcacttgtccaatacattattggacggagagatgatcatcgatcgggttaatggccaagccgtcccacgctatctgatctacgacatcattaaatttaacagccagcccgtaggggattgcgactttaacgttaggttgcagtgtattgagagggagataattagccctcgccacgaaaagatgaagacgggactgattgataaaacacaagagcctttttcagtaagaaacaagccattcttcgatatttgtacatctcgcaaattgctagaagggaatttcgccaaagaggtgagtcatgagatggatggtttgatctttcagcctacaggaaagtataaacctggaagatgtgatgatatccttaaatggaagcccccttctttgaacagcgtggacttcaggctgaaaataaccaggatgggcggagaggggctcttaccacaaaatgtcggcctgttgtacgtcgggggatacgagagaccttttgcccaaattaaagtgtgcctattcatcttctccgtgttgtttctcgacgtgttactgtcgcgcatacaccagaatctcgccaataacaatcagcacatcaaaatatcttgtagctccacactgggcggttag

SEQ ID NO: 239440 - DNA, 1794 bp, Artificial Sequence
  Description of Artificial Sequence: Synthetic coding sequence
atggctcacaacaagatccctccgagatggctcaactgccccagacgaggccagcctgtggcaggccgattcctgcccctgaaaactatgctggggccaagatacgattcacaggtggccgaggaaaatagattccatccctccatgttgagcaactacttaaaatctctgaaagttaaaatgggactcctcgtcgaccttactaatacctctagattctacgaccgcaacgacatcgaaaaagagggtatcaagtatatcaagctgcaatgcaagggccacggtgaatgtcctacaactgagaataccgaaacctttatcaggttgtgcgagaggttcaacgagcgtaaccccccagagctaatcggcgtgcactgcacgcatgggtttaaccgcacaggctttttgatttgcgcgttcctggtggagaagatggattggagtattgaggccgcagtggctaccttcgcccaagcccgaccgcctggtatttataaaggagactacctcaaagaattatttcgcagatatggtgacattgaggaagcccctccaccacccctgctgccagactggtgcttcgaagatgacgaggatgaagacgaggacgaggatggcaagaaagagtctgaacccggttcatctgcatccttcggtaagaggcgaaaagaacgactgaaacttggggctatttttttagaaggagtcacagttaaaggagtgactcaggtgactacccagccgaaactgggagaagtgcagcagaaatgtcaccagttctgcggatgggaggggtccgggtttccaggagcgcagcctgtgtctatggacaagcaaaatataaagctgttggacctgaaaccctacaaggtgtcatggaaggctgatggcactcgatacatgatgttgatcgatgggactaatgaggtgtttatgatagatagggataattctgtgtttcacgtgtcaaatcttgagtttccttttcgcaaagacttgaggatgcacttatctaataccctactcgatggggagatgatcatagatcgtgtgaacggacaagcggtgcctcggtacctgatctacgatattattaagtttaattcacagcccgtgggggactgcgactttaacgttagactacagtgcattgagcgggaaatcatctctcctcgccatgaaaagatgaaaaccggattaatagataaaactcaggaacctttctccgtgagaaacaagcccttcttcgacatctgcacaagtagaaaattactcgaggggaacttcgctaaggaagtgtcccacgagatggatggacttattttccagccaaccggtaagtacaagccaggtcggtgcgatgatatactcaaatggaagcctccaagtttaaacagtgttgatttccgactcaaaatcacgcggatggggggtgaggggctccttcctcagaacgtgggactgctttacgtgggaggctacgagcggccattcgctcagataaaggttacaaaggagttgaagcaatacgacaacaagattattgagtgcaaatttgaaaataacagttgggtgtttatgcgtcagcgtacggacaaatcctttcctaatgcttataataccgccatggccgtttgtaattcaatctctaaccctgtaaccaaagaaatgctgttcgagttcatcgataggtgcaccgctgcttcacaaggacagaaaaggaagcaccatctcgacccggatactgagctgatgcctcccccacctccaaagcgacctaggcctcttacctag

SEQ ID NO: 239441 - DNA, 1707 bp, Artificial Sequence
  Description of Artificial Sequence: Synthetic coding sequence
atgttagggccacgatatgactctcaggtcgctgaggagaacagattccacccttccatgctgagcaactacctgaagtccctcaaggtaaagatgggcctgctggtggatctgacaaacacaagcaggttttatgacagaaacgacattgagaaggagggaataaaatacattaagctgcaatgtaaaggccacggcgagtgtcccaccacagagaatacggagacctttattcgcctttgcgagcgatttaacgagaggaatcccccagaactcatcggtgttcattgcactcacgggtttaaccgcaccggctttcttatttgtgcctttctggtcgaaaagatggactggtccatcgaggccgctgtcgccacctttgcgcaggccaggcccccagggatttacaaaggcgactacctaaaagagttatttcggagatatggggatatagaagaggcccctcccccacccctgttgcctgactggtgcttcgaggacgatgaagatgaagatgaagacgaggatggtaaaaaggaatccgagccgggtagctccgcctctttcggaaaacggaggaaggaacgattgaagctgggcgctattttcctggaaggcgttactgtaaaaggcgtgacacaagtgaccacccagccaaagctaggtgaggttcaacagaagtgtcaccagttctgtggatgggagggctctggcttccccggtgcccagcctgtgtcgatggacaagcagaacattaaattgctggacctcaagccctacaaggtgtcatggaaggctgacgggaccagatacatgatgctgattgacggtacgaatgaagtcttcatgattgacagagacaactcagtctttcacgtgtctaatcttgagtttccctttaggaaagacctacggatgcacctgagcaacaccttgctcgatggtgaaatgattatcgatcgcgttaatggccaggcggttcccaggtatctaatctacgacatcatcaaatttaactcgcagccagtaggcgactgtgattttaatgtgcgcttacagtgtatagaacgagagattatctctccgaggcacgaaaagatgaaaactggcctgatcgataaaacccaagagccattttccgtgcggaacaagccctttttcgatatatgcacgtcacgcaagctgctggaaggcaacttcgctaaggaggtcagccatgagatggacggtctgatcttccagccaacaggaaaatataagcctgggagatgcgatgatatcctgaagtggaaacccccttcactgaattccgtagattttagactgaagatcacccggatggggggtgaaggcctcttgccgcagaacgtaggattgctatacgtgggaggctacgagagaccttttgctcagatcaaggtgaccaaggaactcaaacagtatgataacaaaattatcgaatgcaagtttgagaacaactcttgggtgttcatgaggcagagaaccgacaaatctttcccaaatgcatataatacagctatggccgtgtgtaacagcattagcaatccggttacaaaggaaatgttgtttgaatttattgaccgatgcacagccgctagtcaaggacaaaagcgtaaacaccacctggaccccgacactgaattgatgccgccaccaccccctaaacgtccgagaccgctgacctag

SEQ ID NO: 239442 - DNA, 1545 bp, Artificial Sequence
  Description of Artificial Sequence: Synthetic coding sequence
atgggcctgctggtggacctgacaaatacttctaggttttacgatcgaaacgacatcgagaaagaaggtattaagtacattaaactccagtgcaaggggcacggcgaatgtcccactaccgagaacacagagacatttatacggctctgcgagaggtttaatgaacggaaccccccagaactgatcggagtgcattgtacccacggttttaaccggactgggttccttatttgcgctttcctggttgaaaagatggactggtccattgaggcagccgttgctacctttgcacaggcacgcccacccggaatttataagggagactatttgaaagagctgtttcgccgttatggcgacattgaagaggcgcctccacctcctctactgcctgattggtgcttcgaggacgatgaagacgaggacgaggatgaggacggaaaaaaggagtctgagccgggtagctccgcatcctttggtaaacgaaggaaagaacggctgaagctgggggcaattttccttgagggggtgaccgtgaagggggtgactcaagtgacaacacagccaaagctcggtgaggtccaacagaaatgccaccaattttgcggttgggaaggatcgggattcccaggggctcaaccagtgtccatggataagcagaatataaaactcttagacctcaagccatataaggttagctggaaagctgacggcacaaggtatatgatgcttatagatggcactaatgaagtttttatgattgatagggataacagtgtctttcatgttagcaaccttgagtttccgtttcgcaaggatcttcggatgcacctgagcaataccctgttagacggggaaatgatcatcgatagggtcaacggacaagctgttcctcgttatttgatatatgacatcataaaatttaactcccagcctgtgggtgactgtgactttaacgttaggttgcagtgtattgaacgcgaaattatttcccctcgtcatgagaaaatgaaaacggggctcatcgataagacccaggagccattttccgtgcgcaataagcccttcttcgacatctgcacctccaggaagaagtacaaacctgggcgatgtgatgacattcttaagtggaaaccaccatctttaaactctgtcgactttaggctgaaaataacccgcatggggggtgagggcctcctgcctcaaaacgtcggtttactctatgtagggggatacgaacgacctttcgcccagatcaaggtaaccaaagaacttaaacagtacgataacaagatcatcgaatgtaaatttgaaaataacagctgggttttcatgagacagagaacagataaaagtttccccaacgcctataataccgcaatggccgtctgcaactctatctcaaaccctgtgaccaaggagatgctattcgagttcatagaccgctgtactgctgcatcacagggtcaaaagagaaaacaccatttggaccccgacacagagcttatgccccctccaccacctaaacgcccacggccactgacatag

SEQ ID NO: 239443 - DNA, 1263 bp, Artificial Sequence
  Description of Artificial Sequence: Synthetic coding sequence
atggccgctctcgtcagaccggcacggtttgtggtccgccctttgctacaagtcgtacaagcctgggatctggatgccagacgctgggtcagagcccttagacgaagtcctgtcaaggttgtgtttccctctggggaagtcgttgaacagaagcgagcccctggcaaacagcccagaaaggccccatccgaggcaagcgctcaggaacagcgcgagaagcaacctcttgaagaatccgcttcacgcgctccttcaacttgggaggagagtggcttacgatatgacaaggcttatccgggagacagacgcctatcatccgtgatgaccattgtcaaatctagaccctttagagaaaagcaggggaagatcttgctggaagggaggcgattaatcagtgacgctcttaaggccggtgcagttcctaagatgttcttctttagccgcctggagtatttgaaagagctgcctgtggataaattaaagggcgtttcacttattaaggtgaaattcgaagatattaaagattggtctgatctggtgacccctcagggtataatgggtatctttgcaaaaccggatcacgtgaaaatgacgtacccaaagacccaattgcaacatagcttgcccctcctgctcatctgtgacaacctgagggatccaggtaatctgggcaccatcctcagaagcgccgcaggtgccggatgtagtaaggtgttgctgacaaagggctgcgtagacgcgtgggaacccaaagtgctgagagcaggcatgggcgcacactttagaatgcctattattaacaatctggagtgggagacggtaccaaattatctgccgcctgacacaagggtgtacgtggcagacaattgtgggctgtatgcacaggcggagatgagtaacaaagcctccgaccacgggtgggtgtgcgaccagagggtgatgaaattccacaaatacgaggaggaggaggacgtggaaacaggtgccagccaggactggctacctcacgtggaggttcagtcttatgacagcgattggacagaagcaccagcggctgtcgtgatcggaggggagacctatggagtctcgctagagagcctccagcttgcagagtctactgggggtaagagactcctgattcctgtggtccctggggtggactccctcaatagtgcaatggccgcaagcattctgctcttcgaaggtaagcgccagctccgcggtcgcgcagaggatttgtcccgcgatcggagttatcactag

SEQ ID NO: 239444 - DNA, 4182 bp, Artificial Sequence
  Description of Artificial Sequence: Synthetic coding sequence
atgttgagccgcccaaagcctggcgagagtgaggtggatctgctgcactttcagtcgcaatttctggcagctggagcagctcccgctgtacagctcgtaaaaaagggcaaccgcggtgggggtgacgctaacagtgaccggcctccacttcaggaccatagagatgtggtgatgctggacaatctgcccgacctccctcccgctctggtcccatcccctcctaagagggcaaggccgtcacctgggcactgcctcccagaagatgaggaccccgaagaaaggctgcgccgtcatgatcagcacatcaccgccgtgctcactaaaattatcgaacgggacactagtagcgtggcggtgaacctccccgtcccatcgggggtggccttccctgcggttttccttcgttccagggatacccagggcaagtctgcaacaagcgggaagcgttctatctttgcacaggagattgcagcgagacgaatagcagaagcaaaggggccatcggtgggagaggtggtgccaaacgttggaccacccgagggtgcagttacctgtgaaacacccacccccaggaaccaaggctgccagctacctggaagttctcactcatttcaaggccctaacctggtgaccgggaagggattacgtgatcaagaggccgaacaggaggcccagacaatacatgaagaaaacattgccagactccaggccatggcccctgaggagatcttgcaggaacagcagcgtctgctggctcaactcgacccaagcttagtggcattcctgagatcccactcacacacacaggagcaaaccggcgagaccgcttctgaagaacaacgtccaggaggcccaagtgcaaacgtaaccaaagaggagcccctgatgtccgcctttgcatccgagcccagaaagcgcgacaaactcgaacctgaagcccctgcattggctctcccagtcaccccccagaaggagtggcttcatatggacaccgtggagctcgagaagctccactggacgcaagatctgccgccagtacgtcggcaacagacgcaggagagaatgcaggctagatttagtttacagggggaacttctggcccctgatgtagacctgccaactcaccttggtttgcaccatcatggggaggaagctgaacgggcaggctactcattacaagaactgtttcatctcactcggagccaggtgtctcagcagagagccttggcattacatgtattagcccaggtcatctcacgcgctcaggctggtgaattcggtgacagattagccggaagtgtgctaagtctgctgcttgacgccggattcttgttcctcctgaggttttctttagatgacagagttgacggggtcatcgccacagccattagagcacttcgggctctcctcgtggcccctggagatgaggaactgctggattccaccttctcctggtaccatggagccctgacgttccccctaatgccatcccaagaggacaaggaggatgaggatgaggatgaagaatgcccagctgggaaggcaaagagaaagagcccggaagaagaatcacgccctcctcctgacttagcaagacacgacgttattaaagggctgctggccacttctctactcccaaggctcagatacgtacttgaggtgacctacccaggtccagcagtggtgctcgatattttggctgtgctcatccgtttggcccgacattcgcttgaatccgccacccgcgtgctcgagtgtcctagattgatcgaaacaattgtcagagaatttcttccaacctcttggagcccagtcggcgctgggccaaccccgagcctctacaaagttccctgcgccaccgcaatgaagctccttagagtcctcgcgagcgccggtagaaacatagcggcacggttgctaagtagttttgaccttaggtctaggctctgtagaatcattgctgaggcaccccaggagctggctttgccccctgaagaagctgaaatgctctctaccgaggccctacgtctttgggccgtggctgcaagctacggtcaaggaggatatctgtatcgagagctgtatccagtcttaatgagagctctgcaggtcgtgccacgagagctcagcacccatccacctcagccgttatccatgcagcgcatagccagtctgttgactctgcttacacagctgacgttggccgctggttccactccagccgagacaattagcgacagtgccgaggcttccctgtcagctactccaagccttgtgacttggacacaggtgagcggacttcagcctctggtcgagccatgcttgaggcaaacacttaagttattatcaagaccagagatgtggcgggcagtggggcctgtccccgtggcctgcctgttgtttttaggtgcttattatcaggcttggtctcagcaaccctctagttgtcccgaggattggctgcaggatatgcagaggctctccgaagaactcctgctgccacttctaagccagcccacgctgggttcactgtgggatagtctgaggcattgctccttgctgtgcaatcctctgagctgcgtccccgcacttgaggcaccgccttcactggtgtcgctgggctgttccgggggttgcccgaggttgagtcttgcgggatctgcttctccctttccttttttgactgccctgcttagcctgctgaataccctggcccagatacataaaggattgtgtgggcaactggctgcgatcttggctgcccctggcttacagaattattttctccaatgtgtggctcctggggcagccccacaccttactccctttagtgcctgggcgctgcgccatgagtaccatttgcagtatttggcactggcactggcccaaaaagcagctgcactgcagccactgcccgcaacccacgcggcactgtaccatggtatggcccttgcgcttctaagcagattgctccctggttccgaatatttgacgcacgaacttctgctctcttgtgtgtttcgattggagttcttgcccgagcgcacatctggcggacccgaggcggctgacttcagtgatcagcttagtctcgggagttctcgcgtgcccaggtgtggacagggaaccctgcttgcacaggcgtgccaggatttgccatcaatccggaattgttatctaactcattgcagtccagcgcgtgcaagcctactggcttcgcaggcccttcatcgaggtgaactgcaaagagtgccaacattactgcttcctatgcccaccgaaccattgttgccgaccgattggccattcctccctttgattaggttgtatcaccgagccagtgacacaccatccggactcagtcccactgacacaatgggcacagctatgcgcgtgctgcaatgggtgcttgtgctggaatcctggcggccacaggctttgtgggccgtacccccagccgctagactggctagacttatgtgcgtgtttcttgtggactctgagctcttcagagagtctccagtgcagcacttagtggccgctctgctggctcagctgtgccagcctcaggtattgcccaacctgaatttagactgtcgactccctggtttgacttcattcccagacctatatgccaatttcctggaccattttgaggccgtctctttcggcgatcacctgttcggcgctcttgtgcttctcccgctccagcgacgctttagtgtaactttgagactggcactgttcggtgaacacgtgggagcactgcgggctctgtctcttcccctcacgcagctgccagtctcactggaatgttatactgtgcccccagaagataatttagcgctgctacaactgtacttcaggactctggttaccggcgctcttaggcctcgatggtgccccgtgctttatgccgtggcagttgctcacgtcaactctttcatctttagccaggacccacagtcatccgacgaggtcaaagccgcaaggcgttctatgctgcagaagacttggctactcgcagacgaaggactacgtcagcatctgctccattacaagttgccaaattcgacactgccagagggattcgagctgtatagccagttgcccccactaagacaacactacttgcagcgcttgacatcaaccgtcctacagaacggagtaagcgagacatag

SEQ ID NO: 239445 - DNA, 1839 bp, Artificial Sequence
  Description of Artificial Sequence: Synthetic coding sequence
atggccgactttgccggtccaagctcagccggtaggaaggctggagctccccgatgctccaggaaggcagcagggacaaagcagacctcaactctcaaacaagaagacgcttccaaaaggaaagccgagttggaagccgctgtgaggaaaaagattgagttcgagcgtaaggccctacacattgtagagcagctgcttgaggaaaacattacggaggagttccttatggagtgcggacggttcattaccccggctcactattccgacgtagtggatgagcggtcaattgtcaaattgtgcggatatccgctgtgccaaaaaaaactgggcattgtccctaagcagaaatacaagatctctactaagacaaataaggtttatgacatcactgagcgcaagtctttttgttcaaacttttgttaccaagcatccaaattctttgaggcccagattccgaagactcctgtatgggtacgtgaggaagagagacaccctgacttccaattgctgaaagaagaacaaagtgggcacagcggtgaggaagtgcaactgtgttctaaggccatcaagacatcggatatcgacaacccctcacacttcgagaaacaatacgaatcatcctcttctagcacgcactcagactcgtcctcagataatgagcaggatttcgtctcttccattttgcccggaaatcgtcctaatagtacgaatatccggccacagctccaccagaagtcaatcatgaaaaaaaaggcagggcacaaagccaactccaaacacaaggataaagagcagaccgttgtcgatgtgactgagcagctgggggactgtaagcttgacagtcaggagaaggatgccacctgcgaactgccactgcaaaaggttaatacgcagtcatcttcgaactctacacttcctgaacgactgaaggcctcggaaaactcagaaagtgagtatagtcggtcagagatcacgcttgtggggatcagcaagaaatccgcagaacactttaaaaggaagttcgccaaatctaatcaagtgtcaagaagcgtgtctagttccgtccaggtgtgccctgaagtgggcaaacgcaacttgctaaaagttctgaaagagactctaatcgaatggaagactgaggagacattgcgttttctgtatggccaaaattacgcttctgtttgccttaaacctgaggctagccttgtgaaagaggaattggatgaggacgatattatctcagaccctgactctcatttccctgcctggagggagtcgcagaacagcctcgacgagagtctcccatttcgtggcagcggcacagcgatcaagccactgccgtcctatgaaaacctcaagaaggagacagaaaaactgaacctaagaattcgcgaattctaccgaggaaggtacgtgctcggggaggaaaccacaaagtctcaggactcagaggagcacgacagcacttttcccctcatcgatagtagttctcagaaccagatcaggaaaaggatcgtcctggaaaagctaagcaaggttctgcctggcctattggttccactgcagattaccctgggcgacatctacactcagttaaagaacctggtcaggacattcagactcactaaccggaacatcatccataagcccgctgagtggacactgatagccatggtcctgctgagcttactaactccaatcctgggcattcagaaacactctcaggaaggaatggtctttacaagattcctggatacactgctggaagagctccacctgaagaacgaagacctcgagtcgctaactataatttttcgcacgagctgcctgcctgagtag

SEQ ID NO: 239446 - DNA, 1755 bp, Artificial Sequence
  Description of Artificial Sequence: Synthetic coding sequence
atggccgactttgctggccctagcagtgcgggacggaaggccggagctccgagatgctctagaaaagctgctgggacgaagcaaacttcaacacttaagcaggaagacgcctctaaaagaaaagcagaattagaggccgcagtgaggaagaagattgagttcgagaggaaggcgctgcatatcgtcgagcagctgttggaggagaatataaccgaggaatttctcatggaatgcgggcgattcattacccccgctcactactctgacgtggtggatgagagaagtattgtaaagttatgtggttatcccttgtgtcaaaagaaactcgggattgttcccaaacagaagtataagatttccactaaaactaacaaggtctacgacatcaccgaacggaagtctttctgtagtaatttctgttaccaagcctccaaatttttcgaagctcaaattcctaagacccccgtgtgggtgcgggaagaagagagacacccagattttcagctgctgaaggaggagcaaagcggccacagtggcgaggaagtgcagctatgttccaaggcaatcaaaacctcggatattgacaaccccagccacttcgagaaacagtacgagagctcttcatctagcacccactcggattcttcgtccgacaacgagcaggactttgtgtcatccatactgcccggtaacagaccaaattccacgaacatccggcctcagctccatcagaagtcaatcatgaaaaagaaagccggacacaaagccaatagcaaacataaggacaaggaacaaacagtcgtggatgtgaccgaacagctgggggattgcaaactggactctcaggagaaggacgctacttgcgaattacccttacagaaagtgaatacacagagcagttccaactcaactttacctgaaaggttaaaagcatccgagaatagcgaatctgagtattctagatccgagatcaccctggtgggaatttctaagaagagtgccgagcactttaagcgcaaattcgccaagagcaaccaagttagccgatcagtgtctagcagtgtgcaagtgtgccctgaggttggtaagaggaaccttcttaaggtgctgaaggaaaccctgatcgaatggaaaactgaggagaccttgcgtttcctttacggccaaaactacgcgagcgtctgtctaaaacccgaagcctctttagtgaaggaagaactcgatgaagatgacatcatctctgaccctgacagccacttccccgcatggagggaatcccagaatagtttggatgaaagtttgcctttcagaggcagcggaacagcaatcaaacctctgcccagttatgagaatcttaagaaggagacagagaaactgaacctaagaattagggagttctaccgtgggaggtacgtcctgggcgaagagacgacaaagtcgcaagattccgaagagcacgactcaacgtttcccctgatcgactcctccagccaaaaccagataaggaagcgcatcgtgctcgaaaagctcagtaaagtgttacccggactgttggtccctctccagattactctaggggacatttatacgcagctaaagaatctcgttcgcacttttaggctaactaatagaaacataatccacaagcccgcagagtggaccctcattgctatggtcctactgtccttcttgctcaatgtaaagactaggatcaaaaccttcatgatgatctattttcatctcatgaatagctag

SEQ ID NO: 239447 - DNA, 1998 bp, Artificial Sequence
  Description of Artificial Sequence: Synthetic coding sequence
atgacaagtgcaaacaaggctatcgagctacagcttcaggtcaaacagaacgctgaagaactccaggattttatgcgtgatctcgagaattgggagaaagacatcaagcagaaagatatggaactgaggcgccaaaacggagtgccagaggagaatctcccgcctatccggaatggaaactttagaaagaaaaagaagggaaaggccaaggagtcctctaaaaaaacgcgcgaagagaatacgaaaaaccggatcaaaagctatgactacgaagcatgggccaagctggacgttgatcgaattctcgatgagctggataaggacgatagcactcatgagagcctgtctcaagaaagcgaaagtgaggaagacggtatccacgtcgactcccagaaggcactggtcctgaaggagaaaggtaataagtattttaaacagggtaagtatgatgaggccattgactgttatactaaaggaatggacgccgatccatacaaccccgtgttaccgaccaaccgggcttctgcatatttccgtcttaaaaagttcgctgtggccgagtctgactgtaacctggcggtcgccctgaacagatcttatactaaggcatatagcagacgtggtgcagccaggtttgccctccagaaactggaagaagccaagaaggattacgagcgcgtcctagaattagagcctaataactttgaagccacaaacgaattacgcaagatatcccaggccttggcctccaaggaaaactcttaccctaaggaagccgatatcgtgatcaaaagcacggaaggcgagcgcaagcagatagaagcacagcagaacaagcagcaggcaatatcagaaaaagaccgtgggaatgggttcttcaaggaaggaaaatatgagagagcaatcgagtgctacacaagggggatagccgctgatggtgctaacgcactgctgccggctaaccgggcaatggcttacctaaagatacagaagtacgaggaggcagagaaagattgcacccaggccatcctgctcgacggaagttactctaaggcgtttgcccgtagggggacagcaagaacattccttggcaaactcaacgaggccaagcaggactttgagaccgtgttgctgctggaacctggaaataaacaggccgtgactgagctttctaagattaagaaggaactgatcgagaaaggccactgggatgacgtcttcctggactccactcaaaggcagaacgtcgtcaaaccaattgacaacccccctcatccagggtcaacaaagccactgaaaaaggtgatcatcgaagagacagggaacctcattcagaccatagatgttccagatagcacaacggcagcagccccagagaataaccccattaatttagccaatgtaatcgccgctacaggaaccaccagtaaaaagaattcttcccaagacgacttgttcccaacatccgacactcccagagcaaaagtactgaagattgaagaggtgtcggatacgtcgtccttacagccacaggcttctctgaagcaggacgtctgccagagctacagtgagaagatgcctattgagattgagcagaagcccgctcagttcgctacaactgtgctccctccaataccggcaaactcatttcagctggagagtgatttccgtcagctgaaaagctctcctgatatgctttaccagtaccttaagcaaatagaaccatcactctatcccaaactgtttcaaaagaatttggatccggatgtgtttaaccagattgtgaagatcctgcacgacttttatatcgagaaggagaaacctctgctgattttcgagatcctccaaaggctgtcagaattaaagaggttcgacatggctgtgatgttcatgagcgagactgagaaaaagattgccagagcactgtttaatcatattgataaatctgggctcaaggactcaagcgtcgaagagctgaagaaacgttatgggggatag

SEQ ID NO: 239448 - DNA, 1896 bp, Artificial Sequence
  Description of Artificial Sequence: Synthetic coding sequence
atgacctccgctaataaagccatcgagctccagctgcaggtgaaacagaacgcagaggaactgcaggacttcatgcgggacctggagaactgggagaaggatattaagcaaaaagatatggagctaagaaggcaaaacggcgtgcctgaagagaatctgcctccaatcaggaatggtaatttccgtaagaaaaaaaaaggaaaagccaaagagagttctaaaaagactagagaggagaatacaaagaatcggattaagagttatgattacgaggcctgggccaagctcgatgtggaccggattcttgacgagttggataaggatgacagcactcacgaatcactcagccaggagagtgaaagtgaggaagacggcatccacgtggatagtcaaaaagcactcgttttgaaagagaaaggaaataaatactttaagcagggcaagtacgacgaagccattgattgctataccaaaggaatggacgcggacccttacaaccccgttctgcctactaatagggcctcagcctattttaggctgaagaaatttgctgtcgctgagtcggattgcaacttagcggtagccctgaacagatcctacaccaaagcctattcgcggaggggggctgccagattcgcccttcagaagctcgaggaggccaaaaaagattatgaacgtgttctggaactggaaccgaacaattttgaggcgaccaatgagctgcgtaagatatctcaggccctggccagtaaagaaaactcctatcctaaagaagctgatattgtgatcaagtcaaccgaaggggaaagaaagcagatcgaagctcagcagaacaagcagcaggcaatttccgagaaagatcgaggtaatgggttcttcaaggagggaaaatatgagcgtgccatcgagtgttacacacgagggatcgcagcagatggtgccaacgccttactgcctgctaacagggcaatggcttatctgaaaatccagaagtacgaggaagcagaaaaggactgcacccaggccattcttttggatggatcatactctaaggcctttgctcgacgaggtacagcacggacctttctgggcaaactgaacgaagcaaagcaggatttcgagacggtgctgctgctggaaccgggaaacaaacaagctgtgaccgaactgagcaaaatcaaaaaaaaacctctgaagaaggtgataatcgaggagacagggaacctgattcagaccattgacgtgccagatagcaccacggccgctgctcctgagaataatccgattaacctggcaaacgtcattgccgcaaccggtactacatcaaagaaaaacagctctcaggacgatttatttcccactagcgatacaccacgcgcaaaggtgctcaagatcgaggaagtgtctgatacctccagtttgcagccgcaggcttccctgaaacaggatgtatgccagagttattctgagaaaatgccaattgagattgagcaaaagcccgcacagtttgctaccactgtcctacctcctattcccgcaaattcattccagttagaaagtgacttcagacagctaaagagctcgccagatatgctgtaccagtacctgaaacagatcgaacccagcctgtaccccaaattgttccagaagaatcttgatcccgacgtgtttaatcagatagttaagatacttcatgatttttacattgaaaaggaaaaaccgctgttgatcttcgaaatcctccagagactctctgagttgaagcgctttgacatggccgttatgttcatgtccgagacagaaaagaagatagcccgtgccctgtttaatcatatcgacaagtctggcttgaaagactcctcagtggaagagctgaagaaaagatacggaggctag

SEQ ID NO: 239449 - DNA, 1521 bp, Artificial Sequence
  Description of Artificial Sequence: Synthetic coding sequence
atggacgccgatccctacaatccggtactccctactaatcgcgcatcggcatacttcaggttgaaaaaatttgccgttgctgagtctgattgtaatcttgccgtggcacttaatcgctcttacacaaaggcctattcccgcaggggagcagctcggttcgcgctccagaagctggaagaggccaagaaggattatgagcgggtattagagctggagccgaataatttcgaagcaacaaatgaacttcgcaaaatctcccaggccttggcaagcaaggaaaattcctatccaaaggaggccgatatagtgattaaatccacagagggggagcggaaacagatcgaagctcagcaaaacaagcagcaagccattagtgagaaggatcggggtaacgggttttttaaggaaggtaagtatgaaagagcaatcgagtgttacactaggggcattgctgcggatggcgcaaacgcccttctgccagccaatcgcgctatggcgtatttgaagatccagaaatatgaagaagccgaaaaagattgcacacaagccatcttgctcgatggatcctacagcaaagcatttgcgagaagaggaacagctaggacattcttaggcaaactcaatgaggctaaacaggacttcgagactgtgctccttcttgaacccggaaacaaacaggcagtgacggagctgagtaaaattaaaaaggagctcattgagaagggacactgggatgatgtcttcctcgattcaacacagcggcagaacgtggttaagcccatagataatccgccacaccctgggtccaccaagcccttaaaaaaggttatcattgaagaaaccggtaacctcatccagaccattgacgtgcccgactccaccacagccgcagcccctgaaaataacccgataaacttggctaacgttatcgccgctacgggaactacatcgaaaaaaaatagttcccaagacgacctattcccaacatccgacaccccacgggctaaagtcctgaaaatcgaggaagtgtccgatactagttctctgcagcctcaggcttcgttgaaacaagacgtttgccaatcctatagcgagaaaatgccaattgagattgagcaaaaacccgcacagtttgctaccacagtgctgcccccaatccccgctaattcattccaacttgaaagcgactttagacaactgaagagcagccccgacatgctataccagtatctgaaacagatcgaaccctcactatatccgaagttgtttcagaagaaccttgaccccgatgttttcaatcaaatcgtcaagatacttcacgacttctatattgagaaggagaaaccattgctgatctttgaaatcctgcagagactgtccgagctcaagcgctttgatatggccgttatgtttatgagtgaaacagagaagaaaattgcacgcgctctcttcaaccacatagacaagagcggactgaaagattcttctgtggaagagttgaaaaagcgttacgggggatag

SEQ ID NO: 239450 - DNA, 4820 bp, Artificial Sequence
  Description of Artificial Sequence: Synthetic coding sequence
atgatcgctgaacccgcacatttctacctgttcggcctcatctgtctgtgttcgggctcacgcctcaggcaggaggattttccaccacgcatcgtggaacaccctagtgacttgatcgtctcgaagggtgaacctgctaccctgaattgtaaggccgagggacgtccaacacctacaattgagtggtataaaggaggcgagcgggtcgaaacggacaaggatgaccccagatcacacaggatgctgctgccaagcgggtccctgttcttcctaaggattgtccacggaagaaaatcccgccctgacgagggggtgtatgtgtgcgttgccaggaactatctgggtgaggccgtctcgcacaatgccagtttggaagtggctattttacgggacgacttcagacagaacccctccgacgtaatggtggctgtcggggaaccagccgttatggaatgccagcctccacgagggcatccagaacccacaatctcatggaaaaaggatggctctccactagacgacaaagacgagcggatcactatcagggggggaaaactgatgatcacctacaccagaaagtcagacgcagggaaatacgtatgtgtcggcacaaacatggtgggggagagagagtccgaggttgctgaacttaccgtcctggaacggccatcttttgtaaaaaggccatcgaatcttgctgtcacagtagatgatagcgctgaatttaaatgtgaggccaggggagatcccgtgccaaccgtacgctggcgaaaggacgacggagaactgcccaagtctcgttacgaaatccgggacgaccatacgctgaagattcggaaagttaccgctggggacatgggttcttacacttgtgtggctgaaaacatggtaggtaaagccgaagctagcgccacattaaccgttcaggctccgtctgagcctcctcatttcgtcgtaaagccaagggatcaggttgtggcgctgggaaggacagtgacattccagtgcgaagcaaccggaaacccccaacccgctattttctggaggcgggagggctcccagaacttgctattctcatatcagcccccacagtcatcatcgcggttcagcgtgtcccagactggtgatttaacgataaccaacgtacaaagaagcgatgtgggttactatatatgccaaacactgaacgtcgctggtagcattatcaccaaggcctacttggaggtgactgatgtgatcgcagacaggcctccccctgttatcaggcagggaccggtcaatcagacagtggctgtcgacggcaccttcgtcctgagttgtgtcgccactggatcgcccgttcccacaattctgtggcggaaggatggggtgctggtaagcacacaagacagtaggatcaagcagcttgagaacggagtcctccagatacggtatgccaaactcggcgatacaggtcgctatacatgcatagccagtaccccgtccggagaggctacatggagcgcttacatagaggtccaagaatttggggtgcccgtgcagcctccaagaccaaccgaccctaatctgattccttccgcccctagcaaacctgaggtcaccgatgtgtctaggaacaccgtgaccttgagctggcaacccaaccttaattccggtgccactcccaccagttacattatagaggctttctcacacgcaagcgggtcctcctggcagaccgtcgcggagaatgttaagacagaaacctccgcaatcaagggactaaagcccaacgcaatttacttgttccttgtgagagctgccaatgcatacggaatctctgaccccagccaaatctctgatccagtcaagacccaggatgttctcccaacatctcagggggtcgatcacaagcaagtgcagagagaattagggaatgcagtcctgcatctccacaatcccactgtgttatccagtagttccattgaggtgcactggacggtagaccagcagtctcagtacattcaaggctataaaatactgtacagaccttctggggctaaccatggtgaatccgactggctggtgtttgaagtgcgaactcctgcaaagaattcagtcgtgattccagatctgcgcaagggcgtcaattatgagataaaggctcggccattttttaatgaattccaaggtgctgattccgagataaagttcgctaaaaccttggaggaggcgccttctgcgccaccacaaggtgtcactgttagtaagaacgatggaaatggaacagctattctggtatcatggcagcctcctccggaagacacccagaatggaatggtgcaggaatacaaagtctggtgcctgggaaatgaaactaggtaccacattaataagaccgtggacgggagcacatttagcgtggtgatcccttttcttgtgcctggaatcagatactcagtggaagtggcagctagcacaggagctggatcaggggtcaaatctgaaccccaattcatccagctagacgcacacggaaatcccgtgtcccccgaggaccaggtgagtctcgcacagcaaatttcagacgtggtgaaacagccagcgttcatcgcaggaatcggggcagcttgctggataatcctcatggttttttccatttggctgtataggcaccgcaagaagcggaacgggctcacgagcacgtacgcagggataaggaaggtgacgtatcagaggggaggcgaggccgtgtccagtggaggacggcctggcttgctgaacatctctgaacctgcagcgcagccctggttggcagacacttggcctaacactggtaataatcacaatgactgttccattagttgctgcaccgctgggaatgggaactccgactcaaacctaaccacctattccaggcctgctgattgcatagcaaactataacaaccagctcgataacaaacagacaaatctcatgctacctgaatcgactgtgtacggggacgtggaccttagcaacaaaatcaatgaaatgaaaacctttaactccccaaatctgaaagacggcaggttcgtgaatccatcaggccagcccacgccctacgctacgactcaactgatccaaagtaatctttccaacaatatgaacaacggttccggagattctggggaaaaacactggaaacccctcggccagcagaagcaggaagtcgcgcctgtccaatataatattgtcgaacaaaacaaacttaacaaagattaccgggctaacgacaccgtgccgccaactatcccatataatcagtcttacgatcaaaacactggcggaagttacaattcaagtgaccgcggatcgagcacgtccggaagccagggtcataaaaagggcgcacggacgcccaaagttcccaaacagggaggtatgaattgggcagatctcctgccaccccctcccgctcatcccccaccgcactctaattctgaagaatacaatatctcggtggacgagtcttatgaccaagaaatgccctgccctgtccctccagccagaatgtacctgcagcaggacgagctcgaggaggaggaggacgaacggggacccacccctcctgttcgcggagccgcaagtagcccagccgcagtgtcctacagccatcagtcgacggccactctgacaccatcccctcaggaagagttgcaacctatgctccaagattgcccagaagagacgggccatatgcagcaccagcccgacagacggcgtcagccggtctctccaccaccgccaccgcgtccgatctccccccctcatacttatgggtacatctccggaccgttagttagcgacatggataccgacgcgcctgaggaggaggaggacgaagcagatatggaggtggcaaaaatgcagacgcgtagactactactccgcggattagagcagacgccggctagctctgtaggagatttggagtctagtgtgacgggcagcatgatcaacggttggggatccgcaagcgaggaggataacatatcaagtgggcgaagctcagtgtcctcatccgacgggtcctttttcacagatgctgacttcgcccaggcagttgccgctgccgctgagtatgcgggactcaaagtggccagacgacagatgcaggatgctgcaggtcggagacactttcacgcctctcaatgcccacggcctacctctcctgttagcacagattcgaacatgagtgcggctgtgatgcagaaaactcggcctgctaaaaagttgaaacatcagccaggccatctgcgtagagaaacgtacacagacgacctccctcctccacctgtgcctccccctgcgatcaagagccctaccgcacagtcaaagactcagctcgaggtaagacccgtagtcgtgcccaaactgccttccatggatgctcgtaccgaccgcagcagtgacaggaagggttcctcctacaagggacgagaggttctggacggcaggcaggtagtggatatgcgcaccaatccaggggaccccagagaagcacaggagcagcagaacgacggcaagggaaggggcaacaaagccgctaagcgcgatttgcctccagcaaagacccacctgatccaagaggacattctcccctattgccgcccaacgtttccaaccagcaataatcctcgggacccaagctcatcatcgtccatgtcctcccggggatctggtagccgtcagagggagcaggcgaacgttggcagaaggaacattgccgagatgcaggtgttggggggttatgagcgcggtgaagacaacaatgaggagcttgaagagacagagtcata

SEQ ID NO: 239451 - DNA, 4968 bp, Artificial Sequence
  Description of Artificial Sequence: Synthetic coding sequence
atgaaatggaagcatgttccgttcctggtcatgatcagcctgcttagcctgtcacctaatcatctttttctggctcaattaatccctgatcctgaggacgtggaaagaggcaatgaccacgggacacccatcccaaccagcgataatgatgacaatagccttggctatactggaagtcggctgaggcaggaggatttccctccccgtatcgtcgagcacccatcagacttaatcgtgtccaagggtgagcccgcaaccctgaactgtaaagcagagggccgtccaacacctacaatagagtggtacaaagggggtgaacgtgtggagacggataaggatgacccacggtcacatagaatgctgctgccctctggctccctgtttttcttgcggattgtacacggtcgcaagtcaagaccagacgagggcgtgtatgtctgcgtggctcgcaactacctcggtgaagctgtgagccacaacgcttcgctggaagtcgcaatcctccgcgatgattttaggcaaaatccctccgacgttatggtggctgtaggtgaacctgccgtaatggagtgccagcctccacgcggtcatccagagcccactatctcttggaagaaggacggctctcccttggacgacaaggatgagcgcataacgatccgaggtggaaagctgatgatcacctacacaagaaaatcagacgccggtaaatatgtttgcgtgggcactaatatggttggtgagagggagagcgaagtagcggagctcacagttctggaaaggccctcattcgttaaacgccctagcaatctcgccgttactgtggacgattcagccgaattcaaatgtgaggccaggggtgaccctgtgcccaccgtgaggtggcgtaaggatgatggagagctgccaaagtccaggtacgagattcgcgatgatcatacattaaagatacgtaaggtaacagcgggagatatggggtcgtatacctgtgttgccgaaaatatggtgggcaaagccgaggcgtctgcgacactcactgtgcaggaaccaccacacttcgtagtgaagcctcgagatcaagtggtagctctgggtagaaccgtcactttccagtgtgaggccaccggtaatccccagcctgcaattttttggagacgcgagggtagtcagaaccttctgttctcgtatcagccgcctcagtctagctctaggttttccgtatcccagacgggagatctcactatcaccaacgttcagcgttctgacgttgggtattatatttgccagactctgaatgtggcaggttctatcattactaaggcctacctggaagttactgacgtgattgcagatcggcctcctccagttattcggcaaggacctgttaaccagaccgtggctgtcgatggcacctttgtgctttcgtgcgtcgctacaggctcccctgttccgactatcctgtggcgcaaagatggagttctagtatcaacccaggacagccggataaagcaactggaaaatggcgtcctgcagattagatacgccaagctgggggacaccgggaggtatacctgtatcgctagcaccccatctggtgaggctacatggagtgcatatatcgaggtgcagggcaaagtcaacgaattcggtgttccagtgcagcccccacgtcccactgacccaaatctgatcccttccgctcccagtaagccggaagtcaccgatgtgtcccggaacacagtgaccctttcttggcagcctaacctgaatagtggggctaccccaacttcttatattatcgaggcattctcccatgcatctggcagctcctggcagaccgtggccgagaatgtcaagaccgagactagcgcaatcaaggggctgaagccaaatgccatatacctgttcctagtgcgagccgctaatgcctacggcatcagcgatccctctcagatcagtgaccctgtgaagacccaggatgttctgcccacatcccagggggtggatcacaagcaggtgcagagagagctcgggaacgccgtgctgcatctacataatccaacagtgctgtcctcttcttccatcgaggtgcattggaccgtggaccagcagagccaatacattcagggatataagattctttatcggccatctggggcaaatcacggcgaatctgactggttagtgttcgaggtgagaacacccgctaagaactccgtggtgattcccgatctgagaaaaggcgtgaactacgagattaaagccagaccattttttaatgagtttcaaggagcagactcagagattaaattcgcaaaaaccttggaagaggccccatctgcccctccacagggagtcaccgtgtcaaaaaatgatggtaacggtaccgccatcttggtatcctggcaaccgcctcccgaagatactcaaaatggcatggtacaggagtacaaagtgtggtgcctcggaaacgagactcggtatcatattaataagaccgtggatggctccacttttagcgtggttattccttttctcgtgccaggcattcggtactcggttgaagttgcagccagcaccggggctggatcaggcgtgaagtcagaacctcagttcattcaactggacgctcacggcaaccctgttagtcctgaggatcaggtgtctcttgcccagcagatttctgatgttgtcaaacagccagcgttcatcgctggaatcggtgctgcttgttggatcatccttatggtgttttcaatctggctttatcgtcacaggaagaagcgaaatgggctgacgagcacatacgccggaattagaaaagtgccctccttcaccttcacaccgaccgtgacctatcagcgtggtggggaggcagtgagctcggggggacggccaggcctcttgaacattagcgaaccagctgcacaaccatggctagccgatacctggcctaacacaggtaataaccataacgactgctcaatatcatgctgcacagccggtaatggcaacagcgattccaatctgacgacctactcccgccctgcagactgcatcgcaaactataataaccagctggacaataaacaaactaacctgatgctgcctgaatcaaccgtgtacggagatgttgatctcagcaacaagattaatgaaatgaaaacgtttaatagtcctaacctgaaggacgggaggtttgtcaacccgagtggccagcctacgccctacgctaccacccagctgattcagagcaatctgagcaataacatgaataatggatccggtgatagtggcgaaaagcattggaaaccactgggccagcagaaacaggaggtggctccagttcagtataacatcgtcgagcagaataaactgaacaaggactacagggcaaatgacactgttccgcctaccatcccttataaccagtcctacgaccagaatacaggcggttcgtataatagctctgaccggggaagtagcacttccggttcccagggacacaaaaaaggcgcacgcactcctaaggtgccaaaacagggaggtatgaattgggctgatctcctgcccccaccacctgctcatccaccgccacattctaactctgaggagtacaatatttctgtggatgagtcatacgatcaggaaatgccttgtcctgtacctcctgcgagaatgtacttgcagcaggatgagctggaagaggaggaggacgagcgcggtccgacacccccagtacgcggagctgcttcatcgccagcggcagtgtcctattcccatcagagcaccgccactctgacccctagcccacaggaggaacttcaacccatgctgcaggattgccctgaagagaccggccacatgcagcatcaaccagacaggcggcgacagccggttagcccacccccaccccctaggccgattagcccccctcacacatacgggtatatctcaggccctctggtatctgacatggataccgacgctcctgaagaagaggaagacgaggccgatatggaagtcgcaaagatgcaaacccgtaggttactgctgcgcggactggaacagaccccagcgtctagcgtcggggatttggagtcttctgtgacaggctcaatgataaacggctgggggtccgcatcagaagaagacaacatctcctcgggacggtcctcagttagttccagcgatgggagtttcttcaccgatgcagattttgcgcaggctgtcgctgcagccgcagagtacgccggactcaaggtggctagacggcagatgcaggacgcggctgggcgtaggcactttcacgcaagccagtgcccaaggcccacttcccccgtcagcaccgattctaatatgagtgccgcagtgatgcagaagacaaggcccgcaaagaagctgaagcaccagcccggtcatttacgtcgtgaaacctacaccgacgacctgccacctccccctgttcctccccctgcgatcaagagccctaccgcccagtccaagactcaattggaagttcgaccagtggtagtgcccaagctgccctctatggacgccaggacagatcggagctccgacagaaaggggtcaagttataaaggtagagaggttttagatggacggcaggtggtcgatatgaggacaaaccccggtgatcccagagaggcccaggaacagcagaatgatgggaaaggcagaggtaataaggccgcaaaacgtgacctcccacccgctaagacacatctgattcaagaggatatactgccctactgtcgtcccacttttcctaccagtaacaatcctagggacccttcctcatcctcctccatgagcagccgcggtagcggctcccgtcagagagaacaggcgaacgtgggccgtaggaacattgcagagatgcaggtcttaggtggatatgagagaggagaggataacaacgaagagctggaggagccctcctcctag

SEQ ID NO: 239452 - DNA, 4838 bp, Artificial Sequence
  Description of Artificial Sequence: Synthetic coding sequence
atgatcgccgaaccagcccacttctatctctttgggctcatctgtctctgctcaggctcacgactgcgccaggaggactttccgcctcgcatcgtggaacaccctagtgatctgatcgtgagcaagggcgaacctgcaactctgaattgcaaagcggagggccgacccactcccacaatcgaatggtataagggaggggagcgagtggagaccgataaagacgacccacgcagtcatcgtatgctcctgcctagtgggagtctttttttcttaaggatcgtgcacggacgtaagtccagacctgacgagggagtctacgtctgtgtggcaagaaattacttaggcgaggcagtaagtcataacgcaagtctggaagtcgcaatactgcgtgacgactttaggcagaatcctagcgacgtgatggtcgccgtaggcgagccagcggtgatggaatgccaacctcctcggggtcacccagagccaacgatcagttggaagaaggacggaagtcctttagacgataaggatgaacgaattaccatcaggggaggcaaactcatgattacttatacccggaagtctgatgccggaaaatacgtgtgcgtcgggaccaacatggtgggtgaacgggagtctgaagtggcagaactcaccgttttggagcgcccttcctttgtcaagcgcccttctaatttagcggtcactgtggacgatagcgctgaattcaaatgcgaggccagaggcgacccagtgcccaccgtgcgctggcgaaaagatgacggcgaactgcccaaatccagatacgaaatccgggacgaccacacgcttaagattcgcaaagtgactgcaggagacatgggaagctacacatgcgtggctgaaaacatggttggcaaagctgaggcctccgctactctgactgttcaagagcccccacacttcgttgtgaagccgcgtgaccaggtggtcgccctcggacgcactgttaccttccagtgcgaagccaccgggaaccctcagcccgcaatcttttggcggagggaaggcagccagaatctgttattttcttatcagccacctcagagctcctctaggttcagtgtgtctcagactggagacctcacaatcaccaatgtgcagaggtccgatgtcggttactacatctgtcagactttgaatgtcgccggatcgattatcaccaaagcatacctggaagtgaccgatgtcattgccgataggcccccacccgtgatacgccagggcccagtcaatcagactgttgcagtggatggtacatttgtgctctcttgcgttgccacagggtcaccagttccgaccattctgtggcggaaagatggtgttctcgtctccacgcaggactcccggataaagcagctggagaatggagttttacaaattcgttatgccaagttgggtgacaccgggcgttacacctgcatagcctcgacgccctctggcgaggccacctggtctgcgtatatcgaagtccaggaatttggcgtacccgtccagcccccacgccctaccgatcccaacctgattccctctgcgccatctaagccagaagtaacagatgtgtctcggaacacggtgacactctcttggcaaccgaatctgaatagcggagccacaccaacctcatatatcattgaagcatttagccatgcttcagggagctcatggcagacagtggcggaaaacgtgaaaaccgagacctcggccattaagggactgaagcccaacgctatttatcttttcttggttcgcgctgcgaacgcatacggaatcagcgacccttctcagatctcagacccagtcaaaacacaggatgtgctgcccacaagccagggggtcgatcataagcaggtgcagcgcgaacttgggaacgccgttcttcacttgcacaaccctacagtgctgagctccagctcgatcgaagtccattggacagtggatcagcagagccaatacattcagggatataagatcctctatcggccttctggcgcaaaccacggagagagtgactggctggtgtttgaagttcggactcccgctaaaaactctgtagttatccctgacctgcgcaaaggagtgaactacgagatcaaggcccgtccctttttcaatgagtttcagggcgcagattctgagataaaatttgctaaaactctggaggaggcaccgagtgcaccaccgcagggcgtaacggtatcgaagaatgacggcaatggaactgccattttggtgagctggcaacccccacctgaggatactcagaatggaatggtgcaggaatacaaagtctggtgtctgggtaacgaaactcgctaccacatcaataaaaccgtcgatggctccacattttcagtggtgatccctttcttggtgcccggtattcgctactccgtggaagtcgccgcatccacaggggctggatctggcgtgaaaagtgagcctcagttcattcagcttgacgctcatggcaaccccgtctcaccagaagaccaggtgagtctcgcccagcagatctccgatgttgttaaacagccggctttcattgctgggataggggcagcatgctggatcatacttatggtgtttagtatatggttataccgccatcgtaaaaagcgcaacggcctgactagcacctacgccggtatcaggaaggtaccatcctttacttttactcccacagtgacatatcagaggggtggtgaggcggtgtcaagcggcggtcgccctggcctgctaaacatcagtgagccagcggctcagccctggctggcggacacctggccgaacacaggcaacaatcacaacgactgcagcatctcctgttgtacggccggaaacggcaattcggactctaatttgacaacctatagcagacccgctgactgtattgcaaactataataaccaactggataataaacagaccaacctcatgttacctgaatctacagtgtacggtgacgtcgacctcagcaataaaatcaacgaaatgaaaaccttcaatagccctaatttgaaggatggcaggtttgtcaatcctagcggtcagcccactccatatgctaccacgcaactcattcagtctaacctcagcaataacatgaataatggcagtggtgactcaggggagaagcactggaaaccgctagggcagcagaagcaggaagtcgcccctgtgcaatacaatatcgtggaacagaataaactgaacaaggattaccgtgccaacgataccgtgcccccaacgattccttataaccagtcatacgatcagaataccgggggaagctacaacagttccgacaggggtagttccacatcagggagccagggccataagaaaggcgcaaggacaccgaaagtacccaaacaagggggtatgaactgggcggatttgttgccgccaccgcctgcccatcccccaccgcattctaactccgaagagtacaatataagcgtcgacgaaagctatgatcaagagatgccttgccccgtgccacctgccagaatgtacttacagcaggatgagctggaggaagaggaagacgagagaggccctacgcctcccgtccggggtgcagcctcttctcctgcagccgttagttatagtcaccagagtacagcaaccctaaccccatctccccaagaagagctgcagcccatgctgcaagattgccctgaggagaccggccacatgcaacaccagccagaccggaggaggcaaccagtgtcccccccacctcctcccaggcccatttcgccccctcacacttatggttatattagtgggccactggtctctgacatggacacagacgcccctgaggaagaggaggacgaagcggacatggaagtggcaaagatgcagactcgccgtctcttactgagaggtctggagcaaacgcccgcttcctcagttggggaccttgaatctagtgtcacaggatcaatgatcaatggatggggatcagcatcggaggaggataatatcagctccgggaggtcctctgtgagcagcagtgatggctctttcttcactgatgcggatttcgcccaagctgttgcagccgctgccgaatacgccggattaaaagttgccagaaggcaaatgcaggacgccgcaggcagaaggcacttccatgccagtcaatgcccacggccaaccagccctgtgagtaccgactccaacatgtcggctgcggtcatgcagaaaactcgtcctgccaagaagctcaagcaccagccaggccatctacgccgagagacttacactgacgatttaccaccaccacccgtgccaccccctgcaatcaagagtcccacagcccagtctaagacacaactggaagttcgtcccgtggtcgtgcctaaactgccctctatggatgccagaactgacaggtctagcgatagaaagggatcatcttataaaggcagggaggtcctcgacgggagacaggtggttgacatgaggacaaaccctggggaccctcgggaagcacaggagcagcaaaatgatgggaaagggagagggaataaagcagccaagagggatctgccaccagcaaagactcaccttatccaggaggatatcctcccctactgccgtccaacatttcctacgtccaataacccacgggatcccagctcttcctcgtcaatgtcatctcgagggagcggaagtcgacagagggaacaagccaacgtggggaggcggaacatcgctgagatgcaggttctcggaggctacgaacggggtgaagataacaatgaggagcttgaagaaacagaatccta

SEQ ID NO: 239453 - DNA, 4955 bp, Artificial Sequence
  Description of Artificial Sequence: Synthetic coding sequence
atgaagtggaaacacgtccctttcttggtgatgatctccctgctgtcactgtctcctaatcatctcttcctggcccagctgatccccgatccagaagatgtggaaagaggaaatgatcacgggacacccataccgacctccgataacgacgacaattcattgggatataccggatccaggttacggcaggaagacttccctccccgtatcgttgaacatccttcagacctgatagtttctaaaggggagcccgctacattaaactgtaaagccgaaggaagaccgacacccacaatcgagtggtacaagggcggagagcgcgtcgaaactgacaaggacgaccctagatcccaccgcatgctactgcccagtggctccctttttttccttcggatcgtgcacggtcgaaaaagcaggcctgacgagggggtctatgtgtgtgtggcaagaaactacctgggcgaggccgtcagccacaatgcaagtcttgaagtggccatcttgcgagacgactttagacagaacccctctgatgtgatggtcgcagttggggaacctgccgtaatggagtgccagcctccacggggtcatcccgaacccacaataagctggaaaaaggatggtagtccgctagacgataaagacgagaggataacaattagaggaggaaagctgatgatcacttatacgcgtaagagcgacgccggaaagtacgtgtgcgtcggaaccaacatggtgggagagcgcgaatccgaggtagcagagctcactgtactcgagcggccttcttttgttaagagaccatcaaacctggctgtgactgtggatgattcagctgaattcaaatgcgaggctcggggagatccggtgccaaccgtaagatggagaaaagacgatggggaattgcccaagtcccggtatgagatcagagatgatcacacccttaagattagaaaggtcaccgccggagatatgggttcttacacatgcgtcgcagagaatatggtgggcaaagcagaggctagcgccacactgaccgttcaagagccacctcatttcgtcgtcaaaccaagagaccaagtcgtagccctagggcgaaccgtcaccttccagtgtgaagctacagggaacccacagccagctatattttggcgtagagagggctcgcaaaacctactgtttagctaccagccaccacagtcctcctctcgattttccgtatcccaaacaggggatctaacaatcaccaatgtacagaggtctgatgtgggatactatatctgccagacccttaatgtggccggatctataatcaccaaagcatatctcgaagtaactgatgtaattgccgaccggccacctcccgtcattaggcaaggccctgtcaaccagactgtagccgtggatgggacctttgtgctttcttgcgtggccaccggctcgcccgtgccaaccattctgtggagaaaagacggcgtgctggtttctacccaggactcaagaattaaacagctggagaatggtgtactccaaattagatacgcgaaactcggcgacactggtcggtacacctgcatcgcttctaccccctctggcgaagccacctggtctgcatatatagaggttcaggagtttggcgtacctgtgcagccgccacgccctaccgatccaaatctgattccctcagcaccatcgaaacctgaggttacagatgtcagccggaatactgtcacgctgtcttggcaaccaaatctgaactcgggggcaacgcctacgtcatatattattgaggcatttagccatgccagtggttcttcctggcaaacagtggcagagaacgtcaagaccgagacaagtgcgattaagggactgaagcccaacgccatttacttattcctcgtccgcgcagcaaacgcatatgggatttccgacccaagtcagattagtgatcctgtgaaaactcaagacgttctcccaacctctcagggggtggatcacaaacaagttcaacgtgaactcggaaatgcagttctccacctacataatcctaccgtgctgtccagttcatccatagaagtccactggactgtggaccaacagtcacagtatatccagggttataaaatactgtatcgaccatcaggcgcaaaccacggtgagtctgactggttggtgttcgaggtgcgaaccccagcaaagaattccgtagttataccagacctcaggaagggcgtgaactacgagataaaagccagaccatttttcaatgagttccagggcgcagatagtgaaataaaatttgctaaaacattggaagaggctccaagtgcacccccacagggcgttactgtgagtaagaacgatggtaacggcacggctattttggtgtcttggcagcccccacccgaagacacgcagaatgggatggtccaggagtataaggtatggtgcctcggtaacgagacaagatatcatataaacaagactgtcgatggcagtacattctctgtggtgatcccgttcctcgtgccaggtattcgatactctgtcgaagtggccgctagtacaggggctgggtcaggagtaaaatctgaacctcagtttatccagcttgacgcacatggaaacccagtgtcccccgaagatcaggtgagcctcgctcaacagatttctgacgtggtaaagcagcctgcgttcatcgctggcataggcgcagcatgttggatcatactgatggtcttcagcatctggctctaccgacatagaaaaaagcgtaacggcttaacttctacctatgctggaatccggaaggttccctcatttacattcacacccaccgtcacctatcagagggggggagaagctgttagctctggcggtcgcccaggcttacttaatataagtgagcctgctgcacaaccttggctggccgatacctggcctaacaccggaaacaatcacaatgactgcagcatctcctgttgtacagccggaaacggcaactctgactcaaatttgaccacgtattccaggcccgcagactgcatagctaactataataatcagctcgacaacaaacaaaccaatctgatgctcccagaatccaccgtgtatggggatgtagatctgtcaaataaaattaatgaaatgaagactttcaattcacccaatctcaaagacggtcgcttcgtgaatcctagtggccaacccaccccctatgcaacaacgcagctgattcagagtaacctctcgaacaacatgaacaacgggtccggggattctggtgaaaaacactggaaacccctggggcagcagaaacaggaggttgccccagtgcagtataatatagtggagcagaataaactaaataaggattaccgcgcaaatgatactgtgccacctactattccatataatcaatcctacgatcagaacacaggcggatcttataatagttctgacaggggctcttctacgtccggatcccagggtcacaaaaaaggcgcaaggactcctaaggtcccaaaacagggtggaatgaactgggcggacctgctccctcctccaccggctcacccccctcctcacagcaattccgaggagtataatatctcagtggatgagtcatacgaccaagaaatgccgtgccccgtgcctcccgcaaggatgtacctgcagcaggacgagctggaagaagaggaggatgagcgcggacctacaccacccgtacgcggagccgcatctagtcccgcagcagtgtcctatagccatcagtctaccgcaaccctgaccccctcacctcaggaggaattgcaacctatgcttcaagactgccccgaggagactggtcacatgcagcaccaaccagaccggagacgtcagcctgtctctcccccacctcctcccaggccgatctctcctccccacacctacgggtatatctctgggcctctggtcagcgacatggataccgacgctcccgaggaggaggaggatgaagctgacatggaggtggctaaaatgcagactcggcgactcctgttgcggggactggaacagacccctgctagtagcgtgggagacctcgagagtagtgtaacaggttccatgatcaacgggtggggttctgccagcgaggaagataatatctcctctggaagaagctccgtttcctcctccgacgggtcctttttcactgacgcagatttcgcccaagcagtggctgcggcagctgagtatgccggtctgaaggtagcaaggagacagatgcaggacgccgcagggaggcgccatttccacgcatcccagtgccccaggcctacaagtcccgtgtctacggactccaacatgtctgccgctgtgatgcaaaaaacacgccctgcgaagaagcttaagcatcagcccggacacctgcggagagaaacctatacggacgacctgcctccccctcctgtgcccccacccgctattaagagtccgaccgctcagtccaaaacacagttagaggtgaggcccgtcgtggtgcccaaactgccttccatggacgcaaggacggacagatcctccgatcgcaagggtagctcatacaaaggaagggaagtactggatgggaggcaggttgtcgacatgaggacaaacccaggcgatccacgcgaggcccaggagcagcagaacgacggaaagggtcggggtaacaaggcagcaaaacgggacctgcctccagcaaaaacccatctcatccaggaggatatcctgccatactgtaggcccactttcccgacttccaacaacccacgtgatccttcgtcaagcagctccatgtctagtagagggagcggctctagacagcgcgaacaggcaaacgtagggaggaggaatatcgccgaaatgcaggttctggggggttacgagcggggagaagacaataacgaggagctagaagagacagagtccta

SEQ ID NO: 239454 - DNA, 4656 bp, Artificial Sequence
  Description of Artificial Sequence: Synthetic coding sequence
atgatcgcggagcccgctcacttttatttgtttggactgatatgcctgtgttctggatctaggcttaggcaagaggactttccacctcgtattgttgaacaccctagcgacctgatcgttagcaagggcgagcccgctaccctcaactgcaaagccgagggccgacccacacccaccatagagtggtataaagggggagagagggtcgagaccgacaaagacgatcctcggtcacaccgtatgcttctgccaagtgggagtttgttcttccttcgaatagttcatggtcggaagagcagacccgacgaaggggtgtatgtttgtgttgcacgcaactaccttggcgaggccgtttcacacaacgccagtcttgaagtcgctattcttcgggacgattttcggcagaatcccagcgatgttatggtggccgttggcgagcctgctgtcatggagtgccaaccgccaaggggccatcccgagcctactatcagctggaaaaaggacggtagccctctggacgataaagacgaacgcatcacaattcggggaggcaagctgatgatcacatacacaaggaaaagtgacgccggaaaatacgtatgtgttggcaccaacatggtcggggagcgagaatcagaggttgcggaattaacagtgttggaacggccttctttcgtgaaaaggccctctaacctcgcggtgaccgtggatgacagtgccgaattcaaatgtgaggcccgaggcgaccccgtgcctacggttcgttggcgaaaggacgacggcgagttgccgaaatcccgatatgagatacgagatgaccacaccctcaagatccggaaagtgacggctggagacatgggctcgtatacgtgtgtggccgaaaatatggtcggtaaagcggaagcctcagccacgcttaccgtgcaagtgggatcagaaccaccacacttcgtcgtcaaacctcgcgaccaggtggtggccctcggtagaactgtgactttccaatgcgaggccactggcaatccgcagccggcaatcttctggagaagggaaggctctcagaacctgctcttcagctatcagccaccacagtctagctctcggttctcagttagccaaacgggtgatctgaccattaccaatgtccagaggtcggatgtagggtactatatttgccagactcttaacgtagctggctctattattactaaggcctacctggaggtcaccgatgtgattgcagatcggccacctcccgtgatccgccagggacccgtcaaccagactgtggccgtggatggtacatttgtgctgtcctgcgtggccactgggagtcctgtccccaccatcctgtggcgtaaagatggcgtgctggtgtctacccaggattctagaattaagcaactcgaaaacggcgtgctccagattcgctacgccaaattgggggacactggcaggtacacttgcatagccagtactccttccggggaagctacatggtcagcttacattgaagtgcaggaatttggcgtaccagtccagccccctagacccaccgaccccaacctgattccatccgcaccctccaagcccgaggtgactgatgtctctaggaatacagtgacgctgtcatggcagcctaacctcaactctggggcaacaccaacttcttatattatcgaagcctttagccacgcgtctggatcctcctggcagaccgtcgccgagaatgtcaagactgagacaagcgcgattaaaggccttaagcccaatgccatttacctatttctggtgagagcggcaaatgcctatgggatctccgacccttctcagatttctgatccagtgaaaactcaggatgtccttccgacttcccagggggtggaccacaagcaggtgcaacgggaactgggaaacgcagtcctacatctccacaaccctaccgtattgtcatcttcatctatcgaagtgcattggaccgtggatcagcagagccaatatattcagggctacaagatcctttatcgcccatcaggtgcaaatcacggtgaaagcgactggctggtgtttgaagtgcgcactccagctaaaaacagtgtggttatacccgacctgcggaagggagtgaattacgaaatcaaggccagaccgtttttcaacgagtttcagggggcagattcagagatcaagttcgcaaagaccctcgaggaagcgccaagcgcccctccacagggggtcaccgtttccaaaaacgatgggaacgggacggctattctggtctcctggcagcctccccctgaggacacccaaaacggcatggttcaagaatataaagtgtggtgcctggggaacgagactcggtaccacattaacaaaacagtggacggctccactttctccgtggtgattcccttcttggttccgggtatccggtattccgtggaggtcgcagcttccacaggggcaggctccggtgtgaaatcagagcctcaatttatccaactggacgcacatggtaatccagttagccccgaagaccaggtgtcactggcgcagcagatcagcgacgtggtaaagcagcccgcttttatcgccggaatcggagcggcatgttggatcatattaatggtgttcagcatctggctgtataggcatcgcaaaaagaggaacggcctgacatctacttatgccggtattcgtaaggtgacctaccagaggggaggagaagccgtgagttctggtgggaggcccggacttctaaatatatccgagcccgctgctcagccatggctcgccgacacatggcccaacacagggaacaaccacaacgactgctcaatcagctgttgcacagcaggaaatggtaattctgattccaatctaacgacctacagcagaccagggcagcctacaccctacgctaccactcagctgattcaatctaatttgtccaacaacatgaacaacggtagtggtgattccggggaaaagcattggaagccactggggcagcagaagcaagaggtggctccagttcagtacaatatcgtggaacagaacaagctgaacaaggattatagggctaacgacacggtccctccgacaatcccatacaatcagtcttacgaccagaacaccggcggttcctataactcaagcgatagaggttctagcaccagcggcagtcaaggacataagaaaggcgcaagaaccccaaaagttcccaagcaagggggtatgaattgggcagatctgctccctcctccaccagctcaccctccaccacattcaaactctgaagagtataacatttccgtggatgaaagctacgatcaggagatgccgtgccctgtaccgccagcccgaatgtacctacagcaggacgagctggaagaagaagaggatgagaggggcccaacaccaccagtgcggggagctgctagcagccccgcagctgtgagttacagccaccagtccacagccacgctcaccccttccccccaggaggaactccagccgatgctacaggactgtcctgaggagaccgggcacatgcaacaccagccagaccggcgaaggcagccagtgagcccaccaccccctcccaggcctatatctcctccccatacctatgggtacatttccggcccactggtgtccgacatggacaccgatgctccagaagaggaggaggacgaggctgacatggaagtggccaagatgcagactcgcaggctgcttttgcggggtctggaacagactcccgctagttcggtgggggacctggagtccagtgtcacggggagcatgattaacggctggggctctgcatccgaagaagacaacattagcagcggccgaagtagtgtgagttcttcagacggttctttttttacagacgcagacttcgcccaagcagttgctgcagcggcagagtacgctgggctcaaggtcgcacggcgtcaaatgcaagatgcagccggacgtcgccactttcatgcttcccagtgccctcggcctacctccccagtgagcacggactcaaatatgagcgctgcagtaatgcagaagactcggcctgccaagaagctgaaacatcagcccggacacctgaggagagagacctacaccgacgatctgcctccgcctccagttcccccaccggcaatcaagtcccctacagcccagtcaaagacccaactcgaagtgaggcctgtagtcgtaccaaagctgccttcaatggatgccaggacagacaggtccagcgaccgtaaaggcagtagctacaagggcagggaggtccttgatggccgtcaggtcgttgatatgaggacaaaccctggcgatcctagagaagcacaagagcaacaaaatgacggaaaggggaggggcaataaagctgccaaacgcgacttgcccccagccaaaacacatctgatccaggaggatattctgccatattgtaggccgacattcccgacctccaacaatcctagagatccatcatcttcttccagcatgagttcgaggggttctgggtcccgccagagagagcaggcaaatgtgggtagacggaatattgcagagatgcaagttctgggcggatacgagaggggcgaagataataacgaagagctggaggagacagaatcgtag

SEQ ID NO: 239455 - DNA, 4821 bp, Artificial Sequence
  Description of Artificial Sequence: Synthetic coding sequence
atgatagcagagcctgcccacttttacttgtttggccttatctgcttgtgtagtggatctagactgaggcaggaggacttccctccacgaattgtggagcacccttctgatcttatcgtgtcaaagggggagccagccactctgaactgtaaagcagagggacggccaactcctacaattgagtggtataagggtggcgaaagagttgaaaccgataaagacgatccacgaagccatcgaatgcttctgccctccgggagcctgtttttcctgagaatcgtgcacgggaggaagtcacgccctgatgagggggtgtatgtttgcgtggctcggaattatctcggagaagctgtgtcgcacaatgctagcctggaggtggccatccttcgcgatgacttcaggcagaatccttcagatgttatggtcgcagtgggggaacccgcagtaatggaatgtcagcctccacggggacatcccgaacccaccattagctggaagaaggacgggtcacccttagacgacaaggacgagagaatcacaataagggggggaaagctgatgatcacctacacccggaaaagcgatgctggaaagtacgtgtgcgtcggaacaaacatggtgggcgaacgtgagtccgaggttgccgagctcacagtgttagaacgaccatcctttgtaaaacgtccctctaatctcgcggtaaccgtggatgatagcgccgaatttaaatgtgaagcacgcggtgaccctgtgcctacagtgcgctggcgtaaagatgacggggagttgccgaaatctcggtacgagatacgggatgatcacacactgaaaatcagaaaagtcacggcaggagatatgggatcctacacatgtgtggctgaaaatatggtgggcaaggcagaggctagtgctacactaaccgtccaggtgggcagcgagccacctcacttcgtggtgaagccacgtgaccaggtggtggccctgggacgaacagtcacttttcagtgtgaggcgactggcaacccgcaacctgccattttttggagacgtgaagggtcccaaaatctgctgttctcctaccaacccccacagtctagcagcaggttctctgttagccagaccggcgatcttacaatcaccaatgtgcaacggtccgacgttggatactatatttgtcaaacgctcaacgtcgccggtagcatcattaccaaggcttacctggaagtgacggatgtgattgcagatcggcctcccccagtgattagacagggacccgtgaaccagactgtggcagtggatggtacgttcgttctctcgtgtgttgcgactgggagccccgttccaactattctgtggcgtaaggacggcgtgctggtaagtacccaggattcccgaataaaacagctcgaaaacggcgtgctgcagatcaggtacgctaaactgggcgacaccggcaggtacacatgcatcgccagtactccctctggtgaggccacttggtcggcatacattgaggttcaagagttcggggttccagtgcagcccccacggcctacagatcctaacctcataccttccgctccctctaagcctgaagttactgacgtctcaagaaataccgtcacattaagctggcagccaaatctgaactcaggcgcaacccccacaagctatattattgaggccttctctcatgcatcaggatcctcatggcaaactgtggccgaaaacgtcaagaccgaaacttccgccatcaaaggcttgaaaccgaacgctatttacctttttctggtgcgcgcagccaatgcctatgggattagtgatccgtctcaaatcagcgatccggtcaagactcaagacgtcctccccacctctcagggcgtggatcacaagcaagtccagagggaactgggaaatgccgttctgcacctgcataaccctaccgttctgagctcatcctctatagaggtgcactggacagtggaccagcagagccaatatatccaggggtataagatcctctaccgcccatccggagccaatcacggcgagtctgactggctggtgtttgaagtgagaacaccagctaaaaactccgttgtgatcccggacctgcgaaagggagttaactatgaaattaaggcaaggccttttttcaacgaattccaaggcgctgatagtgaaattaagttcgccaagaccttagaggaagccccatctgctccaccccagggtgttactgtaagcaaaaacgacgggaatgggactgccatattagtgtcatggcagccccctccggaggacacgcagaacgggatggtgcaagaatacaaggtgtggtgcttaggaaacgaaacgcgttaccacatcaacaaaaccgtcgatggcagtacttttagcgtcgtgataccatttctcgtaccaggcatcaggtatagtgtggaagttgcggcatcaacaggggcaggctctggcgttaagtcggagccacagtttatacaattagacgcccacggaaatccggtctcccccgaggatcaggtgtccctggcccagcagatcagcgatgtggtgaaacaacctgcttttatcgccggtatcggcgcagcatgctggattattcttatggtgtttagcatctggctgtataggcatcgaaagaagcgcaatggactcacctctacttacgctggcataaggaaggtgacctatcagcgcggaggtgaagcagtgtctagcggcggacgtcctggcttactcaacattagcgagcccgctgcccaaccctggctagcagatacttggcctaacacaggaaacaaccacaatgactgttctatttcctgttgtactgcaggaaacggtaactccgactccaacctcaccacatattcgcgaccagcggattgcatcgcaaactataacaaccaattggataataagcaaacaaacctcatgcttccagagtccactgtgtatggcgatgtggatctcagcaataaaatcaatgaaatgaagaccttcaacagccctaacttgaaggatggcagatttgtgaacccctctggtcagccaactccgtatgccacaactcagttgatacaatcaaatctgagcaacaacatgaacaatgggagcggggattctggggaaaaacattggaagcccttaggacagcagaagcaagaggtggcccctgtgcagtacaatatcgtggagcaaaataagcttaacaaggactatagagccaacgacactgtacctcctaccattccatacaaccagtcgtatgatcaaaataccggcggttcatacaactcgagtgatcgcggaagctccacttctggaagccaggggcacaagaaaggcgctcggacaccaaaagtacctaaacaggggggaatgaactgggccgacctactgcctcctcctcctgcgcacccacctcctcacagtaactccgaggaatataacatcagtgtggacgagagctacgatcaggagatgccgtgtccggtgccgccagccaggatgtacctccagcaagatgagcttgaagaagaggaggacgagcggggtccaacacccccagtgcgaggtgccgcttcgtcacctgccgctgtctcctatagccaccagtctaccgctactctgactccctccccccaggaggaactccagcccatgttgcaggactgtccagaagaaacaggacacatgcagcatcagccagataggcgtcgacagccggtcagcccccctccccctcctaggccaatctctcctccgcatacttacgggtatatctcgggaccattggtaagcgacatggacactgacgccccagaagaggaggaagacgaggcggacatggaagttgccaaaatgcagacccggagattactgctacgtggccttgagcagactccagcgagcagtgttggcgacctggagtctagtgttactggatccatgatcaacggctggggttccgcttctgaagaggacaacatttcctcaggtagaagtagcgttagttcaagcgatggaagtttcttcaccgacgccgacttcgctcaggcagttgcagcagctgctgaatacgccggacttaaggtggctcggaggcaaatgcaggacgccgcaggcaggagacactttcacgcctcccagtgcccaagaccaacttctcctgtgtctactgatagtaacatgagtgccgcagttatgcaaaagaccagacccgctaaaaaactgaaacaccagccgggtcacctccggagggaaacctacaccgacgacctcccaccaccccctgttccgcctccggctatcaagtctccaaccgcacagagcaagactcagctggaagtgcgacccgtggtcgttccaaagctaccatccatggatgcgaggactgaccgaagttccgacagaaaaggaagttcttacaagggcagagaggtcctcgacggtagacaagtagtggatatgcggacgaaccccggtgacccacgtgaggcacaggagcagcagaacgatggcaaaggccgagggaataaagccgctaaaagagatttgcctccagccaaaacgcacctcatccaggaagacatcctcccttattgtcgccctaccttccctacttcaaacaatcccagagaccctagctcctctagttcgatgtcaagcaggggttccgggagccgccaacgagagcaagctaacgtgggcaggcgcaatatagcagagatgcaggtgcttggcggatatgaaaggggggaggacaacaacgaagagctggaggaaaccgaatcatag

SEQ ID NO: 239456 - DNA, 3213 bp, Artificial Sequence
  Description of Artificial Sequence: Synthetic coding sequence
atggcgagaaggcatgagagagtgacaaggcggatgtggacctgggctccaggtttgctgatgatgactgtggtcttttggggccaccagggaaatggccagggacagggaagcagactccgccaggaggatttcccccctcgaattgttgaacatccatctgatgttatagtttccaagggtgagccaactactctcaattgcaaggccgagggcaggccaaccccaaccatcgaatggtataaggacggcgagcgagtagagacggacaaggatgatcctcgcagtcatcggatgcttcttccctcgggatctctgttctttttgcgaatcgtgcatgggcgaagatctaaacccgatgagggctcgtatgtatgtgtcgcaaggaactacctgggcgaggctgtcagcaggaatgccagtctggaagttgctctgttgcgagacgacttccgccagaacccaactgacgtagtggtggcagctggcgagcccgcaatacttgaatgtcagcctcccagaggccatccagagcctacgatctactggaaaaaggacaaggttcgaatcgatgacaaggaagagaggataagtatcaggggaggtaaactgatgatttcaaatacacggaaatccgacgcagggatgtacacatgcgtcggtaccaacatggtcggcgaaagagactccgatcctgcggagttgacagtcttcgagcgcccaacatttctgaggcggcctatcaaccaggtggtgctcgaggaagaggcagtggaattccgttgccaagtgcagggcgacccacagcctactgtccggtggaagaaggatgacgcggacctgcctaggggtaggtatgacattaaggatgattacacgttaaggattaagaaaacgatgtctacagatgaaggtacatatatgtgcattgccgaaaaccgcgtcgggaaaatggaagcctctgctacactcaccgttagaggcggagtgatcgcaccaccccagtttgttgtgaggccaagggatcagatcgtagcacaaggtcggactgtcacatttccctgtgaaactaaggggaatccccagcccgcagtgttctggcagaaggaggggtcccagaacctcttatttcctaaccagccccagcaacctaattctcggtgctccgtcagccccacaggtgatctgacgatcacgaacatccagaggagcgatgccggatattacatctgtcaagccctgaccgtggccggatcaatcttggccaaggcccagttagaagtgactgatgtgttaaccgacaggccaccacccattattctccagggccctgcgaatcagacactcgcagtggatggcacagcgcttctgaaatgtaaggcaaccggtgatcccctgccagtgatttcttggctaaaggagggtttcacatttcccggtcgtgacccacgagctaccattcaggaacaggggaccttacaaattaaaaacctgagaatcagtgacacagggacctatacctgtgtggcaacctcttcttctggagaaaccagttggtctgcagtgctggacgtgaccgaatccggcgctaccatcagcaaaaattatgatttgagtgacctgcccggtcctccctcaaagcctcaggtgaccgacgtcacaaaaaattcagtgaccctcagttggcaaccagggacccctggcaccctgcccgcttccgcctatatcatagaagccttctctcagagcgtgtcaaacagctggcagacggtggcaaatcatgtgaaaaccactctgtatacagtccgagggttaaggcccaatactatttatctttttatggtgcgagctataaacccccagggcctctccgacccctccccaatgtccgaccccgtcagaacacaggacatctcacccccagcacagggggttgaccaccgtcaagtgcagaaagagctgggtgacgttctggttaggctgcacaatcccgtggtgctgacacccaccaccgttcaggtcacctggaccgtggatcggcagcctcagttcatccaggggtatagagtgatgtaccgccagaccagtgggctccaggctacatcttcctggcagaacctcgatgcaaaggtgccaaccgagagatcagctgtgttggtaaacctgaagaagggagttacctacgaaatcaaggtgcgcccatactttaacgagttccagggcatggattcagagagcaagaccgtccggactacagaggaggcgccttcagcccctcctcagagtgtcacagtgttgacagtgggttcatataactccacttccattagcgtctcatgggatccacctccacctgaccatcaaaacggaatcatccaagaatacaaaatttggtgtcttgggaatgaaacaaggtttcatatcaacaagactgtagacgccgctataaggtccgtgatcattggcggactattcccaggtatccagtatagggtcgaagtcgcggcaagcaccagcgccggtgtcggagtgaagtcagagccacagcccattatcatagggagacgaaatgaggtggtcattacagagaataataacagcattaccgagcagattactgacgtcgtaaaacaacccgcattcatagccggtatcgggggtgcatgctgggttatattgatggggttctccatatggctgtactggagacggaagaagcgaaaagggctgtccaattacgcagtcacatttcagagaggcgacggaggtctcatgtcaaatgggtccaggcccggtctcttgaatgcgggtgacccatcctatccctggctcgccgactcgtggcccgctacttctctccctgtcaataattctaacagcggaccaaatgagatcggtaacttcgggagaggcgacgtactgcctcccgtccccggacaaggagacaagactgccacaatgctctctgatggcgctatctacagctcaatcgattttaccaccaaaacatcgtataacagttcctcccaaatcactcaggctaccccgtacgcaactacacagatcctacactctaattcaattcacgagcttgccgtcgatctgcccgacccacagtggaagtcatccatccagcagaagaccgatctgatgggattcggctacagccttcctgatcaaaataaaggcaacaacggggagtctggaagctag

SEQ ID NO: 239457 - DNA, 1713 bp, Artificial Sequence
  Description of Artificial Sequence: Synthetic coding sequence
atgtcgacagacgagggaacttatatgtgcatcgctgaaaaccgtgtcggtaaaatggaggcctcggcgaccctgactgtgcggggtggggtcatcgcacctcctcagttcgtagtccgccctcgcgaccagatcgttgcacagggcaggacagtcacattcccttgtgagaccaagggcaatccccagcctgcagtgttctggcagaaggaaggctcccagaacctgttattccccaatcagccacagcagcccaatagccgatgttccgtgtctcccaccggagatctgacaatcaccaatattcagagaagcgacgcgggatactacatctgtcaagctctcactgtggccggatccatcttggctaaagcacagttggaggtcacggatgtcctgaccgacaggcccccacctattattctgcaaggccctgctaatcaaaccctggccgtcgacggcactgccctgctgaaatgcaaggcgaccggggacccgttgccggtgattagttggcttaaggagggcttcacctttcctggcagagaccccagggcaactatacaagaacaggggactctgcagatcaagaacttgcgcatcagtgacacaggaacctatacatgcgtggcaacgtcaagctctggggagacatcttggtctgccgtgctggatgttaccgagtctggcgctactattagcaagaactacgacctgtccgatctgcccggtccaccctcaaaacctcaggttaccgatgtgaccaaaaacagcgtgacgctttcatggcagcctgggaccccagggacactgcccgcttctgcatatattattgaggcgttctcccaaagtgtgagcaattcctggcagacagtggctaaccatgttaagaccactctctatactgttcgcggactgcgaccgaacactatttacctgtttatggttcgggctatcaacccgcaggggctgagcgacccctcccccatgtcagatccagtccggacccaagatatctccccgccagctcagggtgttgatcatcggcaagtccagaaggagctgggcgacgtgttagttcggttacataacccggttgtgctgacccccaccacagtgcaggtcacttggaccgtcgatcgccagccacagtttatccaaggctaccgagtaatgtaccgccagacatcgggcttacaggctactagttcttggcagaacctggatgcaaaagtgccaacggaacggtctgcagtcctggtgaatctcaaaaagggcgtgacctacgagattaaagtgaggccctatttcaatgaattccaggggatggattcagagtcaaaaaccgtccgtactactgaagaggccccatcggctccccctcagtccgtgacagtcctaactgtcggctcttataactcaacctcaatcagcgtgagctgggatcccccacctcccgatcatcagaacggtatcatacaggaatacaagatctggtgcctcgggaatgagacaaggtttcatatcaacaagaccgtggatgcagctataaggagcgtaattataggcggactcttccctggcatccaataccgggtcgaggtggctgcgtctacctccgccggtgtgggcgtcaaatcagagcctcagcccaacaacaccggataccctatttgtcacgatacagatctggcctttcagcaacacacttag

SEQ ID NO: 239458 - DNA, 4185 bp, Artificial Sequence
  Description of Artificial Sequence: Synthetic coding sequence
atggccagaagacacgagcgggtgaccaggcgtatgtggacgtgggcaccgggtttattgatgatgacagtggtgttctgggggcatcagggcaatggacaggggcagggatcacggctgcggcaggaggatttccctccgaggatagttgagcaccccagtgatgttatagtcagtaaaggggagcccacaaccctcaattgtaaggccgaaggacggcctactcctacaatcgaatggtacaaagacggagaaagggtcgagactgacaaagatgacccgaggtcacatagaatgctgctgccttctgggagtctgtttttcctacgcattgtgcacggcagacggtccaagcctgatgaaggaagctacgtgtgtgtcgcccgaaactacctgggggaagccgttagtaggaacgcaagcctggaggtggccctcctccgcgatgattttcgacagaacccgactgatgtggttgtggcagcaggggaacccgctattctggaatgtcagccaccaaggggccaccccgaacctaccatctattggaaaaaagataaagtcaggattgatgataaggaggaacggatcagcattagaggcggaaagttgatgattagcaatactaggaagtctgacgccggtatgtacacttgtgtgggtacaaacatggttggggaacgggattcagaccccgcagaactgacagtctttgaacggcctaccttcctcagacgcccaattaaccaggtcgtgttggaggaagaggctgtcgagttcagatgccaggtccaaggtgatcctcagccgacggtgaggtggaaaaaagacgacgccgatctgccaagagggagatacgatattaaagatgactatactctacggattaaaaagacaatgtccaccgacgagggaacttatatgtgcatcgccgagaaccgggtgggcaagatggaggcatcggcaaccctaacggtgcgggcacctccccagttcgtcgtccgcccaagagaccagatagtcgcccagggcagaacagttaccttcccctgcgagactaagggtaatccgcagccagccgtgttttggcaaaaggaggggagccagaacctcctgtttcctaaccagccccagcagccaaatagccgctgttctgtaagccccacaggcgacctcaccatcaccaatattcagcggagcgacgccggttactacatatgtcaggctctgactgtcgcagggtccatactggccaaggcacaactggaagtgactgacgttttgacagatcggcctccgccaataatattacagggtcccgctaatcagaccctggccgtggacggtaccgctctgctcaagtgcaaagctactggggaccccctgccagtaatcagctggttaaaggaaggatttactttccccggacgggaccccagagccaccatccaagagcagggtactctgcagataaaaaacttacggatcagcgacacaggcacatatacgtgtgttgcaaccagtagctcgggagaaacaagttggagcgcagtgttggatgtgacggagtctggcgcaactatcagcaaaaattacgacttgagtgatcttccgggtccaccttccaaaccccaggtaacagacgttaccaagaactccgtcactctgtcttggcagccaggcacccccggaaccctgcccgcaagcgcctacataattgaagcattctcccagtccgtctcgaattcgtggcagaccgtggcaaaccatgtgaagactacactgtatactgtgcggggattgaggccgaacacaatttatctctttatggtgagggccattaatccacaaggcctgtcggatccctctccgatgagtgatcctgtacgaacacaggatattagtccccctgctcagggcgtggaccacagacaagtccaaaaagaattgggtgacgtgctggtgcggctgcacaatcctgttgttctcacccccacaactgtgcaggtgacttggactgtggacaggcagccccagttcatccagggttacagagtgatgtatcgacagacatcaggtctgcaagcaacgagttcgtggcaaaacctggatgcgaaagtgccgacggagagaagcgctgtgctcgtgaatctgaagaaaggcgtaacatatgaaattaaagtgcgaccctactttaacgagttccaggggatggattccgagtctaagacggtccggaccaccgaggaggccccttccgctcctcctcagtccgtgaccgtgctgacagtcgggtcctataatagcacttccatctccgtatcttgggatccaccaccccctgaccaccagaacggcattatacaggaatacaaaatttggtgcctggggaacgagaccagattccacattaacaaaactgttgacgccgcaatccgaagcgtgatcataggcggactctttcccggaatccaatacagggtcgaagtcgccgctagtacctccgccggagtcggggtgaaaagtgaaccccagccaatcataattggcagacgcaatgaagttgtgatcacagaaaataacaactccattaccgaacagataaccgatgtcgttaaacagcctgcctttatcgctgggatcggaggagcttgttgggttatcctgatggggttttccatttggctttattggcggagaaagaagcgaaagggactgagcaattacgccgtgactttccagcgaggagacggcggattaatgagtaatgggtcacgccctggtcttcttaatgctggtgatccgtcttacccgtggttagctgactcctggcctgccacttctctgccagtgaacaattccaacagcggaccaaatgaaataggcaacttcgggcgtggtgacgtgcttcctcctgtaccaggccagggcgataaaaccgcgaccatgttgagcgacggagctatctattcttctattgattttactactaaaaccagctacaatagttcaagtcagataacacaagccaccccttatgccaccacacagatactccattccaacagcattcatgaattagcagtggatttaccggacccacagtggaaatcctctatccagcaaaagactgacctaatgggatttgggtactccctcccagatcaaaataagggtaacaacggcggtaaagggggtaaaaaaaagaaaaacaagaactctagcaagccgcaaaaaaacaatggctcaacttgggcaaacgtgccactccccccacctcctgtacagcctttacctggtacagagttggagcattacgcggttgaacagcaggagaatgggtacgactcagacagttggtgtccaccattgccagtccagacctatcttcaccaggggctggaggatgagctggaagaagacgatgacagggtccccacacctccagtgagaggtgtggcctcctcccctgccatttcgttcgggcagcagtcaacagctactctcactccttcgccacgggaggagatgcaacccatgcttcaagcccacttggacgagctgacaagagcctatcagtttgatattgcgaaacagacctggcacatacagtcaaataaccagccaccacaaccacccgtgccaccgctgggatacgtgtcaggggcattgatttcagatctcgaaacagacgtagccgatgatgatgccgacgatgaggaggaggcactggagatcccgaggccgctgcgggctctggaccagactccagggtcttccatggacaatctggattcatccgtgactggaaaagcctttactagtagtcaacggccaagaccaacctcaccctttagcacagacagtaacaccagcgcagcgctctcccagtctcagagacccagacctacaaaaaagcacaagggaggaagaatggatcaacagcctgccttgcctcatcgcagggaggggatgaccgacgaggaggctcttgtgccatattccaagcccagtttccctagccccggtggacattcatcctcagggaccgcttccagcaaagggagcacggggcctagaaaaaccgaggtgctgagggccggacaccaacgtaacgcctccgatcttctggatatcggatatatgggcagcaattcccaaggccagtttacaggcgaactatag

SEQ ID NO: 239459 - DNA, 4137 bp, Artificial Sequence
  Description of Artificial Sequence: Synthetic coding sequence
atgtccttgttgatgttcactcagttattgctgtgcgggtttctctatgtacgggtcgatggttcccgtttgagacaggaggatttccctccaaggattgtggagcacccctccgatgtcattgtgtccaaaggagaacccaccacccttaattgtaaggccgagggacgccctacacccaccatcgagtggtacaaagacggtgaacgagtggagactgacaaggacgatccccgttcccataggatgctgttgcccagcggtagtctcttcttcctgcggatcgtccacggcagaaggtcaaaaccagatgaaggctcttatgtctgtgttgccaggaattatcttggtgaggctgtgtcccgtaatgcatctctggaggttgccctgctgagggatgacttcaggcagaacccaaccgatgtggttgtcgcagccggtgagcccgctatattggagtgtcaacccccacggggacatccggagcccaccatctactggaaaaaggacaaggtgcgaatcgatgataaggaggagcggattagtatccgcggaggaaagctgatgatcagtaacaccaggaaatcagatgccggaatgtatacttgcgtgggcaccaatatggtgggcgaacgagattctgatccagcagagttaacggtgttcgagcgccctactttcctgcgtaggcccataaaccaagtcgttctggaggaagaagcggtggagtttcgatgccaggtgcaaggagaccctcagccaactgtccggtggaagaaagacgacgctgatctgccacggggtcgctatgacatcaaagatgattatactcttaggattaaaaaaacgatgtccaccgacgaggggacatacatgtgtatcgctgagaaccgcgtgggcaagatggaagcctctgccacactcacagtccgcgcacctccacaattcgtagtccgccctcgagatcagattgtggcccagggtcgcacagtcactttcccctgtgagacaaaggggaacccccaacctgctgtgttttggcagaaggagggaagccaaaacctcctgtttcctaaccagccacagcagccaaattcccgatgcagtgtgtcaccaaccggggatttaactatcacgaatatccagagatctgatgccggttactatatctgccaagcactgacggtggcaggaagcatactggcaaaggcacaacttgaggttaccgatgttctgaccgaccgacctcctccgatcatccttcaaggaccggcaaatcagaccctggccgtcgatggtacggctttgctgaaatgtaaggccaccggcgaccccctccccgttatctcatggctgaaggaagggtttaccttccccggacgggacccacgagctactattcaggaacaagggacactccagattaaaaatctgcgaatttctgatactgggacctacacttgcgtcgccacctcaagttctggcgagacctcgtggtcagctgtcctggatgtgaccgaatctggggctacaatcagcaagaactacgacttatcagacctgccaggcccaccaagcaaacctcaggtgacggatgtgaccaagaactctgttactcttagctggcagcccggaaccccagggacactgccagccagtgcttacatcattgaagccttctcccagtccgttagcaattcctggcagactgtggcgaatcatgtgaagaccaccttatacaccgtgcgcggactgagacctaacacaatttacctgtttatggtgagggcgattaacccacagggcctgagtgacccaagccctatgtctgaccccgtaagaacgcaggacatttcaccgccagcgcagggagttgatcaccgacaagtgcagaaggaattaggtgatgtcctcgtccgacttcacaacccggtcgtgctgacaccaaccacagtgcaggtaacttggactgtggaccgacagccgcagtttatacagggctatcgggttatgtatcggcagacatccgggcttcaagccacatcctcttggcagaaccttgatgcaaaagtccctactgaacgatctgccgtattggtgaatctgaagaagggtgtgacttacgaaattaaggtgcgcccttatttcaatgagttccaggggatggactccgagtctaagacggtgagaacgaccgaagaagcgccaagtgctccaccacaaagcgttacagttctgaccgtgggttcctacaattccaccagcatctcagtttcatgggatcccccaccacccgatcatcagaatggcattatccaggaatataaaatttggtgcctaggcaacgaaacccgttttcacatcaataagactgtcgatgctgccattcgctcagtgattattggcggactctttcctggaattcagtatagggttgaggtagccgcaagcaccagcgccggagtgggggtcaaaagcgaacctcagcctattattattggccgaaggaacgaagtcgttataaccgagaacaataattccatcactgaacaaatcacggacgtcgtgaagcaaccggcatttatcgcgggaattgggggagcttgttgggtgatactgatgggcttttcgatctggctgtactggaggaggaagaaaaggaaggggctgagtaattacgcagttacattccagcgaggcgatggcggtctgatgtcgaacggctcgaggcctggcctgctgaatgccggagacccttcatacccttggctagccgactcctggccagcaacatccctgccagtgaacaatagcaattccggcccaaatgaaataggaaacttcggcaggggtgacgtgttgcccccagtgccaggccagggtgacaagaccgcaacgatgctgtctgatggggctatatatagctccattgacttcaccacgaagacatcgtataacagcagcagccagatcacccaggcaactccttatgccactacacagatcctacactctaactcaatccatgagctggcagttgacttaccagacccacagtggaagagttcaatccagcaaaagaccgatctaatggggttcgggtacagcctcccagatcagaacaagggaaataacggtggtaaaggcggaaagaagaaaaaaaataaaaatagttcaaaaccccaaaaaaacaacgggagtacctgggccaacgtgcctcttcccccaccccctgtgcagcccttacctggaactgagctggagcactacgccgtcgaacagcaggaaaacggctatgatagcgacagctggtgcccccctttgccggtgcagacttacctgcaccagggcttggaagacgagttggaggaagacgacgaccgagttccgacacctcctgttcgtggagtggcttccagtccagcaatctcattcggacagcagtcaaccgcaacattgaccccgagccctagggaagaaatgcagcctatgctccaggcacatttggacgaattaacacgggcatatcagttcgacatcgctaaacagacctggcatatccagtccaacaaccagccccctcagcccccagttccccctcttggttatgtgtcgggcgctctgatctcagacctggaaactgacgtggccgacgatgatgcagacgacgaggaggaagcgctggagattcctcggcctctgcgggcactggaccagacaccgggaagttctatggataatctggattcctccgttactggcaaggcttttacttctagccagcgcccacggcctaccagtcccttttcgacggatagcaatacgtcagcagccctgtcccagtcccagaggccaaggcccacgaaaaaacacaagggaggaagaatggatcagcagcccgcattaccacacaggcgcgaggggatgaccgacgaggaagcactggtgccatattcaaagccaagcttcccttctcctggaggacattcctcaagcggaacagcttcaagcaaagggtcaactggacccagaaaaacagaagtgctcagagctgggcatcagagaaacgcatccgaccttctggacatcgggtatatgggcagcaactcacagggtcagtttacgggcgaattgtag

SEQ ID NO: 239460 - DNA, 4185 bp, Artificial Sequence
  Description of Artificial Sequence: Synthetic coding sequence
atggctaggagacacgagcgagtgacgcgacgcatgtggacatgggcacctgggctactgatgatgaccgtcgtgttctggggacatcaagggaatgggcaaggacaagggtcaagactgcgtcaggaggatttcccacccaggatagtggagcacccctccgatgttattgtcagcaagggcgagcccacaaccctcaattgcaaagctgagggcagacccactccgactatagaatggtacaaagatggcgaacgcgttgaaaccgataaagacgacccgaggagtcatcgaatgctcctaccatcgggttctctgttctttttgcgaatcgtccacggcaggcgtagcaaacccgacgaaggcagttatgtatgtgtggcccgaaattacctcggagaggcagtatccaggaacgcttcactggaggtggcgctgctgcgggatgattttcgccagaatcccacagacgtggtggtcgccgctggcgagcccgctatcctggaatgccagcccccacgcggacacccagagccaaccatctattggaagaaggataaagtgcgaattgacgacaaagaggagcggatttccattcgaggtggtaagctgatgatctccaacacacgtaaaagcgatgccggaatgtatacttgcgtgggcacaaacatggtgggggaacgggatagcgaccctgccgaactcacagtcttcgagcggccaaccttcctgaggaggccaatcaaccaggtagtgctggaagaagaggccgtggagttccggtgccaggttcagggtgacccacaacccactgtcagatggaagaaggacgacgcagatctccctcgcggtcgttacgatattaaagacgactataccctgcgaatcaagaagactatgtcaacagatgaggggacctacatgtgcattgctgaaaatagagtcggaaagatggaagccagcgctaccctcaccgtgcgggctccccctcagtttgtcgtgcggccacgggaccaaattgtggcgcagggaaggacagtcactttcccttgtgagaccaagggtaacccccaacctgcggttttctggcagaaagagggatcccagaacctgctcttccccaaccagccacagcagcccaattctaggtgtagcgtctccccaacgggagaccttaccatcactaacatccagagatcagacgctggttactacatttgccaagccctcacggttgcgggtagtattctcgcaaaagctcaactggaagtgacagatgtgctgacagatagacctccgccaatcatcctgcaggggccagctaaccagacactagcagtggatggaacagccctgctgaaatgcaaagccaccggcgacccgctgcctgtcatctcgtggctgaaggagggttttactttccccggtcgcgatcccagagctacgattcaggagcagggtaccctgcaaattaagaatttgagaattagtgacacaggcacctacacctgtgtggccacctcttctagcggggagaccagctggtcagccgtactggacgtgaccgagagcggggctacaatttccaaaaattacgacctgtcagacctgccgggaccaccctccaaaccacaggtgaccgatgtcaccaagaactcagtcacactatcctggcagcctggaactcctggcactctccctgccagcgcatacatcatcgaagctttcagtcagtccgtgagcaacagttggcagaccgtcgccaaccacgtgaaaaccacactttatactgtgcgcggattaaggcctaatacgatctaccttttcatggtgagggccatcaacccacaggggctcagcgaccccagccccatgtctgatcctgttagaacccaggacatctcccctcccgcacagggcgtcgaccatcgacaggtgcagaaggagctaggcgatgtgctggtcagacttcataatcctgtggttcttacgcccaccaccgtgcaggtcacgtggacagtggatcgtcagccgcagtttattcagggatatagggtaatgtaccggcagacctcagggctgcaggctacctcgtcatggcagaacctggacgccaaagtgcccacagagagatccgccgtgctcgtgaacttgaagaaaggcgtcacatatgaaatcaaagtgagaccctacttcaatgagttccaaggcatggactctgagagcaaaaccgtgaggaccacagaagaggccccatccgcccctcctcagtcagttacagtacttacagtcggctcttacaacagtacatctattagcgtgtcctgggacccgcctcccccagatcaccagaacggaatcatccaggaatacaaaatctggtgtctgggcaatgaaacccgctttcacatcaacaaaaccgtggatgcagccatcaggagtgtgattattggaggacttttcccaggcattcagtaccgcgtggaagtggctgccagtacatccgctggagtgggtgtaaagagcgagccccagcccatcattatagggcgacggaacgaagtggtgattaccgagaacaataactccataacagaacagattacggacgtggttaaacagcctgcattcatcgcgggaatcggaggggcttgttgggtgattctgatgggattttccatctggttgtattggagacgcaaaaagcggaagggcttatccaattacgccgtcaccttccaaaggggcgacggaggactcatgagcaacggatcaagaccgggactactgaacgccggtgacccctcatatccctggctggccgacagctggcccgcaacttccctgcccgtaaacaacagtaactccgggcctaacgagatcggcaatttcgggaggggcgatgtgctgccacccgtgccgggacagggcgataagacggctacaatgttgagcgatggtgccatttacagttctattgacttcactaccaagacaagttataactccagtagtcagattacacaagctaccccatatgccactacacagatcctccactctaattctattcacgagcttgccgttgatctcccagatcctcagtggaaaagtagtattcagcagaagactgacctgatggggttcggatactccctcccagatcagaataagggaaataatgggggaaagggagggaaaaagaagaagaataagaattcctccaaaccacaaaagaacaatggtagcacctgggctaacgtccctctgcctccgccaccggttcagcccctgcctggtaccgagctagagcactatgctgttgagcagcaagaaaatggttatgactccgattcttggtgtcctcctctgcctgtgcaaacctatctgcaccaggggttggaggacgaattagaagaagacgatgacagggttccaactccacctgtccgtggcgtggcctccagtcctgctatctctttcggccagcagtctacagcaacactgactccctcgccaagagaagagatgcaaccaatgctacaagctcatctggacgagctgactcgcgcataccagttcgatatagcaaaacagacatggcatatccagagtaataaccagcccccacagcccccagtgccccctctcggttatgtctcaggtgccctgatctctgatcttgagacagacgtggccgacgacgacgccgatgacgaggaagaggcactcgaaattccgaggcctctgcgagccttagatcagacacctggtagcagcatggacaacctggactcttccgttaccggaaaagccttcacctcctcgcagaggcccaggcccactagccccttctcaaccgattccaacacctctgctgccctttctcagagtcagcgacctcgacctactaaaaagcacaagggtggtcggatggatcagcagccggcacttcctcatcggagagaggggatgacagacgaagaagctttagtgccttattccaaaccttcttttccatcccctggagggcacagctcttcaggtacagcctcttccaaagggtccactggcccaaggaaaaccgaggtgcttagggccggacaccagaggaacgcaagcgacctcctggatattggctacatggggtctaattctcagggtcaatttaccggcgaactgtag

SEQ ID NO: 239461 - DNA, 4161 bp, Artificial Sequence
  Description of Artificial Sequence: Synthetic coding sequence
atgttgcgctaccttctgaaaacactgttgcagatgaacttgttcgcagattcactggctggcgacatctccaacagcagtgaactgctgctggggtttaactcatccttagccgcactgaatcatacacttctccctcccggtgacccttcactcaatgggtccagagtgggacctgaggatgccatgccgcgaatcgtggagcagccacccgatttattggtttctaggggagagccagccactctcccatgtcgagcagaagggaggcctcgacctaacatcgaatggtacaaaaatggcgcacgcgtagctactgtacgagaggaccccagggcacacaggctccttctgccttccggagcactgtttttcccgagaatagtgcacggccgaagagccaggcctgatgagggcgtttatacttgtgtggctaggaactatctcggagcagccgcttctcgaaatgcctctctcgaagtcgcagttttgcgcgacgattttaggcagagcccgggtaacgtcgttgtggcggtgggagagccggcagtgctggagtgcgtgccgccacgcggacaccctgagcccagcgttagctggcgcaaggacggagccagattaaaggaggaggagggacggatcactattcgcggagggaaactgatgatgagtcacacgctcaaatcagacgcgggaatgtatgtgtgtgtagcttctaacatggccggagagcgtgaaagcgctgctgcagaggtgatggtactcgaaaggccctcattcctacgcagacccgttaaccaagtcgtgctcgcagacgccccagtgacatttctgtgtgaggtcaagggcgaccctcctccgagacttcggtggcgaaaagaggacggagagctgccaacaggaagatatgagatccgaagtgaccattcgctgtggattggccatgtgtcagcggaggatgaaggtacttacacgtgtgtggctgaaaacagcgtcggcagagctgaagcctcgggatcattgagcgtgcatgtgcccccacagctggtcacacagccgcaagaccaaatggcagctccaggagagagcgtggcctttcagtgtgagacaaagggaaatccccctcctgccatcttttggcagaaggaggggagtcaggtgctattgttccctagtcagtccctgcagcctactggccgtttctctgtgagtccaagggggcagctcaacatcacggcagtccaacgtggggatgcgggatactacgtttgccaagctgttagcgtcgccggtagtatactggctaaggcactgctggaaataaagggggcaagtctcgacggtctgccaccagtgatactccagggccctgccaaccagactcttgtactgggtagctcagtgtggcttccctgcagggtcaccggaaacccacagcccagtgtcagatggaagaaagacggccagtggcttcaaggggatgacctgcagttcaaaaccatggcgaacggaaccctgtacattgctaatgtacaagagatggatatgggtttttactcctgcgtcgctaaaagcagcaccggagaagcaacctggtcaggatggctgaaaatgcgtgaagattggggagtgtcacctgacccaccaacagagccatcttcacccccaggcgctccaagtcagccagtcgtgaccgagataactaaaaatagcattaccctaacttggaagcccaacccccagaccggtgcagccgtgacatcctacgttatcgaagcattttctccagctgccggtaatacctggagaacggtggcagacggagtccaactggagactcacactgtgagtgggcttcagcctaacacaatttacttgttcctggttcgggcagtcggcgcttggggactgagcgaaccctcaccagtgagcgagcccgtgcgtactcaggatagctccccttctcggccagttgaagatccctggcggggtcagcagggactggctgaggtggcggtcaggctgcaggaaccaattgtgttagggccacgcacactccaggtgagttggacagtagatggcccagtccagctagtgcagggtttccgcgtgtcctggcgagtagccggtccagagggcggatcgtggacgatgctggatctgcagagcccctcccagcagtctactgtgctccgagggctcccgcctggaacccagattcagatcaaagtgcaagcacagggacaagaaggactcggtgccgagagcctgtctgtcactcgcagcatccccgaggaagcacctagcggacccccacagggggtcgccgtcgctcttggaggcgatggaaacagctccatcacagtatcatgggagccccctttgccatcacaacagaacggtgtcatcacggagtaccagatctggtgcctgggcaatgaatctaggtttcacctcaaccggtctgctgctggctgggctagatcggctatgctaagagggctggtgcccggtcttttatacagaactctagtcgcagctgccacatcagctggtgtaggcgtgccaagcgctccagtgctggtccagctccccagtccgccagatctcgagccgggactggaagtcggagcaggattggccgtccgcctggccagagtgctaagggaacccgcatttttagctgggagtggagcggcatgcggagccctgttgctcgggctctgtgctgcgttgtactggagacggaaacagcgtaaggaactaagccattacactgcgagcttcgcctacacgccggctgtctctttcccccactcagaaggtctttctggtgcgtcttccaggccccctatgggccttggcccagctccctattcttggctcgccgactcttggccacatccgtctcgatctccttccgcccaggaacccagaggcagctgttgcccttcgaatccggatcctgatgatcgatactacaatgaggctgggatatctctgtaccttgcgcagactgcaaggggcaccgccgcaccgggtgaaggtcccgtttacagtaccattgatcccgcaggcgaggagctgcagacattccacggaggcttcccacagcacccatcaggcgacttgggcccatggagccagtacgccccacccgagtggtcccaaggtgactctggggcaaaagggggtaaagtaaaacttttaggaaagccggtgcagatgccaagccttaactggccagaggccctgcctccaccacctccctcatgcgagttgagctgcctggaggggccagaggaggagctcgagggctcatcagagcccgaggagtggtgcccaccaatgccagaaaggtcccacctcaccgagcctagctcctctggagggtgcctggtgaccccatcaaggcgtgaaacccctagccctacaccatcttacggacagcagtccacggcaacattgacgcccagtccacccgacccgcctcagcctcctaccgacatgcctcatctccaccagatgcctaggagggttccgctcggcccttccagtcccctttctgtgagtcagccaatgctggggattcgcgaggcccgtcccgcaggactgggggctggacccgctgcctcacctcacctcagcccatctcccgctcctagcaccgcgagctcagcccctggccgaacgtggcagggcaacggcgaaatgactccccctctccaaggacccagagcccgttttcgcaaaaaaccaaaagcactgccgtaccggcgagagaattctcccggagacttgccacccccaccactgccccctcccgaggaggaggcctcctgggcactcgaactgcgcgcagcaggatctatgtcttcactcgaacgcgagaggtctggcgagcggaaggccgtgcaggcagtgccactggctgctcaaagggtcctgcacccggatgaagaggcttggctgccctattccaggccctcttttctgagcaggggacaaggcacgagtacatgctcgaccgccggatccaacagttccagaggcagctcatcaagccggggaagtcgaggaccgggtaggagcaggtcccgatcccagagccggtctcagtcccaacgccctggtcagaaacgccgagaggagcccagatag

SEQ ID NO: 239462 - DNA, 4095 bp, Artificial Sequence
  Description of Artificial Sequence: Synthetic coding sequence
atggagcggcctgaggacagtctgtcactctggagtctcaatttgtcaccccagttcccatgcttgaatgcactgcgccatcccctgagccccggatctagagtgggcccagaggacgcgatgccccgtattgtggagcaaccaccagacctgctcgtgagcagaggtgaaccagccactctgccctgtcgcgcagagggtcgtccccgacctaatatagaatggtacaagaacggcgctcgcgttgcaaccgtgcgcgaggaccctcgggctcacaggttgttgctcccaagtggcgcactgttttttcctagaattgtgcatgggagaagagctcgccctgatgaaggagtctacacctgtgtggctagaaattacctaggagccgctgcaagcagaaatgcatcgcttgaagttgcggtgctgagagatgactttcgtcagtcacctgggaatgtggtcgtagccgtgggagagccagctgtactcgagtgcgtgcctccccgtggccaccccgagcctagcgtctcctggaggaaggatggcgcacgattaaaggaggaagaagggcgtatcacaatcagaggcggtaaactgatgatgtcccatactctgaagtctgacgccggaatgtatgtgtgtgtcgcctcaaatatggcaggcgaaagggagtctgccgctgctgaagtaatggtgttggagagacccagcttcctcagaaggccggtaaaccaagtggtattggcagacgcaccggttacatttctgtgcgaagtcaaaggtgaccctccgcctagattacggtggcgcaaagaagacggtgaactgcctactggcagatatgagattcgctcagaccactcgctgtggatcggccacgtgagtgcggaagacgagggcacgtatacatgcgtcgcagaaaactcagtgggacgagctgaggcctccggctcactctccgtgcacgtacctcctcagctggtgacccagcctcaggatcaaatggccgcacccggtgagtccgtggctttccagtgtgaaaccaaaggcaatccacctccagcgattttttggcagaaagagggctcccaggttcttctgttcccttcccagtctttgcaaccaacaggcagattctccgtgtcccccagggggcagttgaatatcaccgcggtgcagcggggagacgctggctattatgtatgccaggctgttagcgtcgccggatccatccttgctaaagccttactggaaatcaagggagcctccctcgatggtcttcctcccgtcatcctccaggggcctgcaaaccagacactcgttctcggctcgtcggtgtggctcccatgtagggtcacaggcaacccccaaccaagcgtgaggtggaagaaggacggacagtggctccagggtgacgatcttcaattcaaaactatggctaatggtaccctttacattgcaaatgtgcaggagatggacatgggtttttacagttgcgtggccaagagcagcaccggggaagccacttggtccgggtggttaaaaatgagagaggactggggggtcagccccgaccccccaacagagccaagctcaccaccaggagctccctcacagccagtagttactgagattaccaagaattcgatcacactgacttggaaacctaatccccagaccggggcagctgtcaccagttacgtcattgaggccttttctcccgctgctggaaatacctggaggaccgttgcggatggcgtgcagctggaaacccacacagtgtccggcttgcagccgaatacaatttacctcttcttggttcgggctgtgggcgcatggggtctttcagaaccgtctcccgtgtctgagccggtgagaacacaggacagctctcctagcaggcctgtggaggacccatggaggggtcagcaagggcttgccgaagtggccgtacggctgcaggagccgatagtcctgggcccacgcacactgcaggtgtcttggaccgttgatggccctgtgcagctggttcagggcttccgcgtgagctggcgcgtcgcaggtccagagggtggaagttggacaatgttggacctacaatcgcccagtcaacagtcaactgttctcaggggtctccctccgggtacacagatacagatcaaggtgcaggcacaaggccaggaggggctgggcgctgagagcctgtccgtgactcgcagtatacccgaagaagcaccctctgggcctccgcagggcgttgcagtcgcattgggtggtgacggcaattccagcattactgtgtcctgggagcccccactgcccagccaacagaacggcgtgattaccgaataccagatttggtgcctgggaaacgagtcccggttccacctcaaccgttccgccgctggctgggcacggtctgctatgctccggggactcgtccccggtttgctctatcgaaccctcgttgccgcagcaacttcggcgggagtgggggtcccctcagcgccagtcctcgtgcagcttccgagccctccagacctggagcccggactggaagtgggagccggacttgccgtccgcctggctagagtcctgagagagccagcatttctggccggtagcggcgctgcttgtggcgctttgcttcttggactctgcgccgcactttattggagacgtaaacagagaaaggagctcagtcactataccgcaagctttgcttacacacctgccgttagttttccacatagcgagggtttgagcggcgctagctcacggcctcctatgggtctcggacctgcaccatattcttggttggcagacagctggcctcacccaagccggagtccgagcgcgcaggaacctcgcggatcatgctgcccctcaaatcccgatcccgacgatcgatattataacgaagctggaattagcttgtatcttgcccagactgctcggggtaccgctgcaccaggcgagggtccggtttatagtactatcgatccagccggagaggagctgcagaccttccacggaggttttcctcagcacccctccggagatctggggccttggtctcaatatgcccctcccgaatggtcgcagggcgatagcggcgctaagggagggaaagtgaaactgcttgggaagcccgtccaaatgccaagccttaattggcctgaagctttgccgccaccaccgccttcttgtgagctgagctgcctggaagggccagaggaagagcttgaaggatcgagcgagccagaagagtggtgccctcctatgcctgaaagaagccacctgaccgagccaagtagctcgggcggatgcctcgtgacaccttccagacgcgaaacgcccagcccaactccttcttatgggcaacaatctaccgccacattaaccccctccccacctgacccacctcagccacccacagacatgccacatctgcatcaaatgccccgacgcgtacctctagggccatcttcccccttgtccgtttcacagcccatgctggggatccgcgaggctagacccgcagggctcggagctggcccagccgctagcccacacctgagcccgtcaccagcaccttccacggcctctagcgcgccaggaagaacctggcagggcaacggtgagatgacacccccactgcaagggccaagggcaaggtttcggaaaaagccaaaagccctgccatatcgcagagaaaatagcccaggggacctgcctccgcctcccctccccccaccagaggaggaggccagctgggcactcgagcttagggcagcgggaagcatgtccagcctggaaagggaacgcagtggcgagcggaaagctgtgcaggctgtccccttagccgctcagagggtgcttcaccctgacgaagaagcttggcttccgtactcccgacccagttttctgtccagaggccaagggacaagtacctgctctacagcaggctcgaatagctccagaggcagctctagtagccgcggtagccggggtcctggacgctctcgatccagaagtcagagccggtctcagagtcagcggcctggacagaagaggagggaagaaccgaggtag

SEQ ID NO: 239463 - DNA, 450 bp, Artificial Sequence
  Description of Artificial Sequence: Synthetic coding sequence
atgacaccccctctccaagggcctcgggcaaggttccggaaaaagcccaaggccttaccataccgacgggagaatagcccgggtgacctgcccccacccccactcccccctccagaggaggaagcctcatgggctcttgagcttcgggctgctggttctatgtcatctcttgagagagaaagaagcggcgagcgaaaagccgttcaagcggtgccactcgctgcacagcgcgtcctccatcccgatgaagaggcatggctcccatatagtaggccttcgtttctgagtagaggacagggtacatctacgtgcagtaccgccggttctaattcctctagagggagttccagctcccgaggttcacggggtcctggcagatcacggtcgagatcccagtcccgaagtcagtcccagaggccagggcaaaagcgacgcgaagaaccccgatag

SEQ ID NO: 239464 - DNA, 3024 bp, Artificial Sequence
  Description of Artificial Sequence: Synthetic coding sequence
atggggtctggcggagatagtctgctggggggtaggggctccctgcctctgctcctcctgctgatcatgggaggaatggcccaagactctccccctcagatcctcgtgcacccacaggaccagcttttccagggtccaggcccagccaggatgtcatgtcaggcctccggacagccccctcccaccatacggtggctcctaaacggtcagcccctgtccatggtgccccctgatcctcaccacctcctgcccgacggaacgctcctacttctgcagcccccagccagaggccatgctcacgatggtcaggcgctctctactgatctgggggtgtacacctgtgaagcttctaacagactgggtactgccgtcagtcggggagcaagactatcagtggcggtactaagagaggattttcagatccagccgcgtgatatggtggcagtggttggagagcagttcacgctggaatgtggaccaccctgggggcaccctgagcctactgttagttggtggaaggatggaaaacctttagctctgcaaccaggcaggcatactgtgtccgggggatccctcctcatggcgagagcagaaaaatcagacgagggaacttacatgtgtgtcgcgactaactccgctggtcaccgggagagccgcgctgcacgggttagtatacaggagccgcaggactatacggagcccgtggagctcctcgcagtccgcattcagcttgagaatgtgacgctgctgaatcccgatcctgccgaagggcctaaaccaaggcccgctgtgtggttgtcatggaaggtcagtggcccagcggctccggcacagtcttataccgcactgtttaggacccagacagcccctggcggacagggcgcaccttgggccgaagagttgttagccggatggcaatctgccgagctgggcggtctccactggggccaggactatgagtttaaggtgagacccagcagcggacgcgctagagggccagacagcaacgttctgctcctgcggctgcccgaaaaagtacccagcgcaccaccccaggaagtaaccttgaaacctgggaatgggaccgtattcgtgtcctgggtcccgcctcctgcggagaaccacaacggtattattcgtgggtatcaggtatggagtttgggcaacacgagtttacccccagccaactggaccgttgtgggtgagcagacacagcttgaaatagccacccacatgcccggttcgtactgcgttcaggtggcggctgtcacaggagcgggtgctggtgagcccagccgacctgtctgcctgctcttggagcaggcaatggagagggcaactcaggagcccagcgagcacggcccatggacgctcgaacagctccgcgctaccttgaaaaggccagaagtcattgctacctgcggggtagcgctatggctgctcctgttgggaacagctgtatgcatacaccgtcggaggagggcccgtgtgcatcttggacccggattgtaccgatatacatccgaggacgccattcttaaacacaggatggatcactctgatagtcaatggttggccgatacatggcgatctacatctggaagccgggatttgagctctagctctagcctgagcagccgcctaggcgctgacgctcgggatcctctggattgccggcgttcactgttgagttgggattctagatctccaggggtgcctctgttgcctgacacgagcactttttatggttcactgattgccgaactgccttccagtactcccgctcgtccaagccctcaagtgcctgcggtccgccgactccctccgcaactggcccagctttcttccccgtgttcctcctccgattctctgtgctcacgtcgaggcctgagcagtcccagattgagcttggcacctgccgaggcctggaaagccaaaaaaaaacaggaattgcaacatgcaaattcaagccccttgctgaggggaagtcactcattggagctgagagcctgcgagttgggtaaccgtggcagtaagaacttgtcacagtcaccaggcgctgtgccacaggccctggtagcctggagagcacttggtcctaaacttttatcttccagcaacgagctcgtaactcgtcatttaccccctgccccactgtttccccacgaaacacccccaacacagtcccagcagacccagcctcccgtagcgccacaagccccatcaagtatccttcttcccgctgctccaatccctatattgtccccgtgctctccgcctagccctcaggccagcagcctgtctggcccttctcctgcgtcaagccggctgtcatcatcgtccctgtcatccttaggcgaggaccaggacagcgtgttgacccctgaagaagttgcactctgcctggaactctccgaaggagaggagactcccagaaatagcgtctctcccatgccaagagctcccagtccacctacaacctacgggtatatcagtgtgcccaccgcctctgagtttaccgatatgggacgcactggcggaggcgtaggaccaaagggaggagttttgctgtgcccccctaggccatgcctgactccaactcctagcgaagggtcactggctaatggatggggctccgcctcagaagacaatgcagccagcgccagggcatcacttgtcagcagtagtgacggctctttcctggccgacgcccacttcgccagggccctggcggtggctgtggatagctttggcttcggcctcgaaccccgagaggctgattgcgtcttcatagatgcctcttccccaccatcaccacgagatgagatcttcctaacaccaaacctgtccctgccattatgggaatggcgcccagactggcttgaggacatggaagtcagtcacactcaaaggttaggtcgaggaatgcctccatggccacccgattcacagattagttcccagagatctcaactccactgccgcatgcctaaagccggtgccagcccagtggattactcttag

SEQ ID NO: 239465 - DNA, 2106 bp, Artificial Sequence
  Description of Artificial Sequence: Synthetic coding sequence
atgggtagcgggggtgacagcctgctcggcggtcggggaagcctgcccttactgcttttacttatcatggtccttagagaggacttccagatccaaccacgcgacatggtggcggtggtcggggagcagtttacgctggagtgcggtccgccatggggacaccctgagcccacagtttcctggtggaaggatgggaagcccttggctctccagcccggtcgccataccgttagtggcggaagcttgctgatggccagggccgagaagtcagatgagggaacatatatgtgcgtggccacgaatagtgcaggccatcgagaaagcagagcggctagggtcagcatccaggagcctcaggattataccgagccagtcgagttactggccgtgcgcatccagctggagaacgtgaccttgctgaacccagatccagcagaggggccaaagcccaggccggcagtttggctgagctggaaagtgagcgggccagcagcccctgcacagtcctacacagcgttgtttcggactcagacagcgcctgggggacagggagctccctgggccgaagaactgctggcaggctggcagagcgcagaacttgggggactccattggggacaggattacgagttcaaagttagaccttccagcgggcgagccaggggaccagattccaacgtgctgctgctacgcttgcccgagaaagtcccctctgcaccaccgcaggaagtcacactgaaacccggaaatggtaccgtgttcgtcagttgggtgcccccaccagcagagaaccataatggcatcattcgcggataccaagtgtggagtcttggcaatacttctctgccgccagctaactggactgtcgtgggggaacagacacagctcgaaatcgctacacatatgccagggagttattgtgtacaagtagctgctgtcacaggcgcaggtgccggtgaaccatctcggccagtctgcctgctattagagcaagcaatggaaagggccacacaggagccctcagagcacggtccctggaccctagagcagctcagagccaccctgaaacgacctgaggtgatcgccacctgtggcgtggctctgtggctgctccttctcgggactgccgtctgtatccaccgcagacgcagagcccgtgtccatcttggacccggactgtacagatatactagcgaggatgccatcctaaaacaccgcatggaccattccgactcacaatggttagcagatacctggagatccacatccgggagcagggacctttcatcgtcctcttccctcagcagtagattaggagctgacgctcgggatccgctggattgtcggaggtctctactttcatgggactcccgttcccctggggtcccgctccttcctgatactagtaccttttacgggtcactgatcgccgaactccccagttcaacccccgctcgcccatccccccaggtgcccgcagtcagacgcctaccccctcagctggcacagttaagttcaccctgcagttccagcgacagcctttgtagtcgccgtggtctgtcatctccacggctatccttggcaccagctgaggcatggaaagctaaaaagaagcaggagctgcaacatgccaactccagtccccttctacgaggtagtcactccctggagctgcgcgcttgtgaactcgggaaccggggtagcaagaacctgtctcagagtccgggagccgtgccacaggctcttgtcgcgtggagagctctcgggcctaagcttctgtcctcgtccaacgagctcgtcacacgccatctgccccctgcaccattgtttccacacgagacgccccctacacaaagccagcaaactcagcctccggttgctcctcaggccccaagcagcattcttctgcctgcagcgcctatccctattctgtccccgtgttcaccccctagtcctcaggccagtagccttagcggacctagcccggctagctctcgtctgtctagcagcagccttagcagcctgggggaggatcaggacagcgttctgacacccgaagaagtcgctctgtgcctggagctgagcgagggtgaggagaccccatag

SEQ ID NO: 239466 - DNA, 2589 bp, Artificial Sequence
  Description of Artificial Sequence: Synthetic coding sequence
atggtggcagtggtcggcgagcagtttaccctcgagtgtggccctccatgggggcaccctgagccaactgttagttggtggaaagacggaaaacccctggctctccaacccggtagacatacagtgagcggaggtagcttgctgatggccagagcagagaaatccgacgaagggacttacatgtgtgtggccacgaatagcgcgggacacagggaaagtagagctgcacgagtttccattcaggagccacaggattacactgagcctgtcgaactgctcgcagttcgcatccagttggaaaacgtgacactgctgaatccagacccagcagaaggaccaaagcccagacctgccgtgtggctgtcgtggaaagtctcaggaccggctgctcccgcacagtcatacaccgccctatttcggactcagacagcacctggcggacagggcgcaccttgggcagaggagttattggccggatggcagagtgctgagctgggcggtctacattgggggcaggattatgagttcaaggtgaggccatcaagcggcagggctcgcggacccgacagcaatgtgctgttgttgcgattaccagaaaaagtgcccagcgcccctccacaggaagttactcttaaacctggaaatggaacggtgtttgtgtcctgggtaccccctccagcagagaaccataacgggatcatccgcggttaccaggtgtggagcctcggcaatacctctcttcctcctgctaattggaccgtagtgggtgagcagacccagctcgagattgcgacgcacatgcctggatcgtactgtgtacaggtggctgcagtgaccggagccggtgctggggaaccgagcaggcctgtttgcctcctgctggaacaggcaatggaacgcgcaacccaagaaccttctgaacacggcccatggacactggaacagctcagagctacccttaagagaccagaggtcatcgctacttgtggcgtcgcactatggctgttacttctcggtaccgcggtatgcattcatcgacggagaagggctcgcgttcatctgggacctgggctgtatcggtatacaagcgaggacgccattctaaaacaccgcatggaccacagtgacagccaatggttggctgacacttggcgcagcaccagcggctcaagagacctctcgagctcgagctctctgtcttcgaggcttggggctgatgctagggaccccctcgattgtagaagaagcctgctgtcgtgggattcccggtcgccaggggtgccgcttcttccagatacgagtactttttatggcagcttgatagctgagctgccttcctcaacacctgccaggccttctcctcaggtgcccgcagtgagaagactccccccacaactggcgcagctgagttccccctgtagtagctcagacagcctgtgctccaggcgaggcctctcgtcacccaggctgtcactggccccagctgaggcttggaaagccaagaagaaacaggaactccaacacgccaacagttctcctttgctccggggatcacatagtctggagctccgcgcatgtgagctagggaaccgcggaagcaagaacctgtctcagtcccctggtgctgttccacaggctctggtggcatggcgtgcgcttggaccgaaactgttatcttccagcaacgaactggtaacgcgtcatctcccgccagcccctctctttccacatgagacaccgcctacacagtctcagcaaactcagcccccagtagctccacaggccccttcatccatcttgttacccgctgctccaatccccatcttgtccccgtgctcacccccatcaccacaggcgtcttccctgtcaggcccatcacctgcttcctcacgcctgagctccagtagcctctcttctctgggtgaagatcaagacagtgttctcaccccggaagaggtcgctctctgtttggagctgagtgagggcgaagaaactcccagaaatagcgtatccccgatgcctagagccccttctccacccacaacatacgggtatatttcggtgcccaccgctagtgaattcaccgacatggggcgaactggagggggtgtaggcccaaagggcggagtgctgctgtgtcccccaaggccttgccttaccccaacgcccagtgagggctccctggcgaacggctggggatctgcttctgaagataatgccgctagtgccagagccagtctggtcagctcgtcagacggtagcttcctagcagatgctcacttcgcacgggctcttgcagtcgcagttgactccttcggctttggtctcgaacctagggaggccgactgcgtatttatagatgcatcatctcccccttcacccagagacgaaattttcctgactccaaatctcagcctgccgctttgggaatggcgccctgattggctggaagacatggaggtctctcacacacagagactgggccgtggaatgcccccttggccgccagatagccagatttctagccagcggagtcagctgcactgccgcatgcccaaagccggtgccagtccagttgattactcctag

SEQ ID NO: 239467 - DNA, 3708 bp, Artificial Sequence
  Description of Artificial Sequence: Synthetic coding sequence
atgtccggccctactgacgagaccgccggagacctgcccgtgaaggacacagggcttaatctgtttggcatgggaggcctgcaggaaacaagcacgactcgcaccatgaaatccagacaggcagtttcacgtgtgtcccgcgaggaactggaagaccgattcctgagactgcacgatgagaacattctgctcaaacagcatgccagaaaacaggaagataaaatcaagcggatggctaccaagctcatccgcctggtaaacgataaaaagaggtatgagcgcgtggggggaggacctaaaaggctcggccgtgatgtggagatggaggagatgattgaacagttgcaggaaaaggttcacgagctcgagaagcaaaatgagaccttaaaaaaccgtcttatctccgctaagcagcagctgcaaacccagggctatagacaaaccccctataacaatgtgcagtcaaggatcaataccggcagacgtaaggctaacgagaacgcaggactacaggagtgccctaggaagggtataaaatttcaagacgccgacgttgccgaaacaccccatcccatgttcactaaatatggaaactccctcttagaagaggcccgtggcgaaatcagaaacctggaaaatgtgatccagtctcagagggggcaaatcgaggaactggagcacctggctgaaatattgaaaacgcagctaaggagaaaagagaatgaaatagagctttcactcctgcaactacgggagcagcaggcaaccgaccaacggagcaatatcagggacaacgttgaaatgataaaactgcataagcagctagttgaaaaatcaaacgcgctgtctgctatggagggaaagttcatccagctgcaggagaagcaacgaacattacgaatatcacatgatgcactgatggcaaacggagacgagctgaatatgcaattgaaggaacagagacttaagtgctgctctctagagaaacagctgcacagcatgaaattttccgaacgcagaatagaggagctgcaggataggattaacgacctggagaaagaaagggaactgctaaaggagaactacgacaagctttacgacagtgcattctcagccgcacatgaagagcaatggaagctcaaggagcagcagcttaaagtgcaaattgcacaattagagaccgcccttaagagcgacctgactgacaagaccgaaattttggatcgactaaagacagaacgcgaccaaaacgagaagttggtccaagagaaccgcgaattgcagctccagtatttagaacagaaacagcagctggatgagcttaaaaaacgaatcaaattgtataatcaagagaatgacattaatgctgacgagctttcggaggcgctgctgctgatcaaagcgcagaaagaacagaaaaatggtgaccttagttttttagtgaaggtcgatagcgaaataaataaagacttggagcggtccatgagggagctacaggcaactcacgccgaaacagtgcaggaactggagaagaccaggaacatgctcatcatgcaacacaaaatcaataaggattatcagatggaggttgaagcagtaacaagaaaaatggagaatcttcagcaggactatgagctaaaggtggagcagtacgtccacttgcttgatattcgcgcagcacggatccacaaattggaggcccagttgaaagatatcgcttacgggacaaaacagtacaaatttaaaccagagatcatgcctgatgatagcgttgacgagttcgatgagactatacacctggagaggggcgagaatttgttcgagatccacatcaataaggtgaccttcagctccgaagtgctgcaagcctccggagacaaagagccggtaaccttctgtacatacgccttttatgacttcgagctccagacaactccagtggtacgtggtctacatcctgaatacaacttcacgtcacagtatctggtgcacgttaatgacctgttcctgcaatacattcaaaaaaacaccatcacccttgaggtccaccaagcctactccaccgaatatgaaaccattgccgcatgtcaacttaagttccacgaaattcttgagaagtcaggacgaattttctgtacagcgtcattgatcggcacaaaaggtgatatcccaaacttcgggactgtagagtactggtttcgactgcgagtccccatggaccaggcaattagattatacagggagagggctaaggccttagggtatattacgtctaattttaagggccctgaacatatgcagagtctgtcccagcaggctccaaagaccgctcagctctcatcgactgatagtacggacggaaacttaaacgaattgcacattaccatccgatgctgtaatcatctgcagagtcgggctagccacctccaaccccacccatacgtggtgtacaagttcttcgactttgccgaccacgacacagccatcatcccgtccagtaatgatcctcaatttgatgaccacatgtatttccccgtccccatgaacatggatttggaccgctacctcaaaagtgagtctctgtctttctatgtctttgatgactctgacacccaggagaacatttatattggaaaagtaaacgttccactcatatctctggcccacgacaggtgtattagcgggatttttgagctgaccgaccaccaaaaacaccctgcgggaactattcatgttatcctgaagtggaagttcgcttacctccccccatcgggtagcattacaactgaggatctcgggaatttcatccgctccgaagaaccagaagttgttcagcgcctccctcccgcatccagcgtgtcaaccttggtgctggcacctcggccaaagcccaggcagcgactcacccctgtagataagaaagtctctttcgtggacattatgccgcaccagtccgatgtttcacaggagggttcggtagacgaggtgaaagagaataccgagaagatgcaacagggaaaagacgacgtgtctctgctatcagaaggacaactggccgaacagagtttggcaagcagtgaagacgaaactgagattaccgaagacttggaacctgaggttgaggaagacatgtctgcttccgattcagacgattgcattatccccggtcctatctctaagaacataaagcaaccatccgagaagattaggatcgaaatcatcgccttgagtcttaatgactcacaggtgacgatggatgacaccattcagcgcctctttgtagagtgccggttctatagcttgcccgctgaagagacccccgtgagtctgccaaaacctaaaagcggccagtgggtctactacaactattctaatgtgatttatgtcgacaaggaaaataacaaggccaagcgggacatcctaaaagcaatattacaaaagcaggaaatgccaaaccgttctctgaggttcacagtggtttcagacccgccagaagatgagcaagacctggaatgcgaagacataggagtggcccacgtggacctggctgacatgtttcaggaaggaagggatctcattgagcagaacatcgacgttttcgatgcaagggcagacggagagggcataggaaaactgagggtgacggtggaggccctgcacgccctccagtccgtgtacaaacagtatcgcgacgatttagaagcttag

SEQ ID NO: 239468 - DNA, 3948 bp, Artificial Sequence
  Description of Artificial Sequence: Synthetic coding sequence
atgagtggccctactgacgagaccgccggtgaccttcctgtgaaggatactggactgaacctgtttgggatgggcggtctgcaagaaacaagcactaccagaaccatgaagtctaggcaggctgttagccgggtcagcagagaggagttggaagacagattcttgaggttgcacgacgagaacattctgctgaagcaacatgctagaaaacaagaggacaagattaagcgaatggccactaaactcattcggctggtcaacgacaagaaacgatatgagagggtgggaggcggtcctaaacgactggggagggacgtcgaaatggaagaaatgatagagcagctccaggagaaagtgcacgaactggaaaagcagaatgagacccttaaaaaccggctcatttccgctaagcagcagctgcagacgcagggctaccggcagacaccttacaataacgttcaatcaagaatcaacaccggacggaggaaagccaatgaaaacgctgggctccaggaatgcccccgaaaggggattaagttccaagatgctgacgtggccgagacgcctcatcccatgtttaccaagtacgggaactcactgttagaggaagcaaggggtgagataaggaatctggagaacgtaatccaatctcaaagaggccagatcgaagagctggagcatctggccgaaatcctgaagacgcagttgcggagaaaagagaatgagatcgagttgagcttgctgcagctacgcgagcaacaggcaactgatcagaggtccaatatccgcgataacgttgaaatgatcaaacttcataagcagttagtggagaaaagcaatgctctgtcagctatggagggtaagttcatccagcttcaggagaagcagagaactctgcggatctctcatgacgccttgatggccaacggagacgagctgaacatgcaactgaaggaacagcggctcaagtgctgtagcttagagaagcaacttcacagcatgaagttctcagagaggcgaatcgaagagctacaggaccggattaacgacttggagaaggagcgcgaactgctaaaggagaactatgataaactctacgacagcgctttctccgcagcgcacgaagagcagtggaagctgaaggagcagcagctcaaggttcaaatcgcacaacttgaaacggccctgaagtcagacctcaccgacaaaacagagatactagaccgattgaaaacagagcgcgatcaaaatgaaaagctcgtacaggagaacagagagctgcagctgcaatacctggaacagaagcaacaactggacgagctgaagaaaagaattaaactatacaaccaagagaatgatatcaacgctgatgaattgtccgaagcccttctgctgatcaaagctcaaaaagagcagaagaacggggatctctcattcctggtcaaagtggactccgagatcaacaaagaccttgaaaggagtatgcgagagcttcaggcaacacacgcagaaacagttcaggagctcgagaagacccgcaatatgctaatcatgcagcacaagattaataaggactatcaaatggaggtcgaagctgtgactcggaaaatggaaaatctacaacaagattatgagctgaaagtggaacagtatgtccaccttcttgatattagggcagcaaggattcataaactggaggctcagctgaaagatatcgcatatggcacgaagcaatacaagttcaagcccgaaattatgcctgacgactccgtggatgaattcgatgagacaatccacctggagcggggagaaaatctgttcgagatccacattaacaaagtcaccttttcgtcagaagtgctgcaggcaagtggagacaaggagccagtaacgttctgtacctatgccttctacgacttcgagctacagacaactcctgtcgtgagaggactgcatccagagtacaactttacatcccagtatctggtccacgtgaatgatcttttcctccaatatatacagaagaataccattactctagaggtccaccaggcgtatagtaccgaatacgagacgatcgcagcctgccagttgaagttccatgagatcctcgaaaagtccggacgaatcttctgcaccgcgagtcttattggcacaaagggcgacattcctaacttcggcacagtcgagtattggttccgcctgcgagtgcccatggatcaggcgattcgcctgtacagagaaagggcaaaagcactggggtacataactagcaacttcaagggtcccgaacacatgcagagcctatcccagcaggcccctaagacagcccaactttccagcactgactctacagatggaaatcttaatgagcttcacatcacaattcgctgctgtaaccatttgcagagtagagctagccacctccagccacatccatatgtcgtgtacaagttcttcgattttgctgaccacgatacagccatcatcccatctagcaatgatccccagttcgatgaccacatgtacttccctgtgccaatgaacatggacttagacaggtatctgaaaagcgagtcattgagtttttacgtgttcgacgattctgacacccaggagaacatctacattggaaaggtgaacgtgcccctgatttcattggcacacgaccgttgcatttcgggcatctttgagctgacggatcaccagaagcatccagccggaaccattcacgtgatccttaagtggaagttcgcttacttgccccctagcggatctatcaccaccgaggatctggggaattttattcgaagcgaagagcccgaagtcgtgcagcgtctgccccctgcctcctcagtgagcaccctggtgctcgctccccgtcccaaacccagacaacgcctgactcctgtggacaaaaaagtaagcttcgtggatatcatgccgcaccagtcagacgaaacctcaccgccacctgaagaccgtaaagaaataagccctgaagttgagcatatccccgagatcgaaataaacatgcttactgtgccacatgtgcctaaggtgtctcaggaaggatccgtggacgaggtgaaagagaacactgaaaagatgcagcaagggaaggacgacgtcagtctcctgagcgaaggccagctggccgaacagagcctcgcatcgtctgaggacgagacagaaattacagaagatctcgagcctgaggtggaggaagacatgagcgcatccgattccgacgactgtatcattcccggtcccatctctaagaatatcaagcagagtctggctctgtcccctggcctcggttgctcatctgcaatcagcgcccattgtaattttcgccttcccggaagctccgactttccggcatcggcgtcccaggtggatgggattaccggcgcttgtcatcacactcagccgagcgagaagatcaggatcgaaatcattgcgctgtcgctgaatgactcccaggttactatggatgacacgatacaaaggctgttcgtggagtgtcgcttctactccctcccggcagaggagaccccagtgtctctaccgaagccaaaatcaggccagtgggtttattacaactattccaatgtgatatacgtagacaaagaaaataacaaagcaaaacgggatatcttgaaggctatcttgcaaaagcaagagatgcctaaccgaagtttaagatttacggtggtgtctgatccccctgaggacgagcaggaccttgagtgcgaggacataggagtggcacatgtggaccttgccgatatgttccaggaaggcagagatctgatagagcaaaacatcgatgtattcgacgctcgcgctgatggtgagggcattggcaaattaagggtgaccgtagaggcgctgcacgcactccagtccgtgtataagcagtaccgtgatgacctagaggcatag

SEQ ID NO: 239469 - DNA, 1956 bp, Artificial Sequence
  Description of Artificial Sequence: Synthetic coding sequence
atggccgctcccctgctgcatactagattacccggagacgccgcagcaagttctagcgcagtaaaaaagttgggggcatctaggactgggattagtaacatgagggcccttgaaaatgacttcttcaatagtccaccccgtaaaactgttcgctttggcggaacagtaaccgaggtgcttttgaagtataaaaaaggcgaaacaaatgacttcgagcttctgaagaaccagctcctcgatcccgacatcaaggatgatcagatcatcaactggttactggagttccgctcctcaatcatgtacctcacgaaggattttgagcagctcataagtatcatactcaggctcccctggctgaaccggagccaaaccgtcgtggaggagtatctggctttcctcggtaacctggtgtccgcacagacagtattcctgcgcccttgtttaagtatgatcgcttcgcatttcgtccccccacgagtgatcatcaaagaaggggacgtggacgtgtctgattctgatgacgaggacgacaatctaccagccaattttgacacctgccacagggccctgcaaattatcgctcggtatgtgcccagtactccctggttccttatgccaatcttagttgagaaatttccctttgtccgcaagtcagaacgcacacttgagtgttacgttcataatttgctgcggatatctgtgtacttccctactctcagacacgaaatactcgaacttataatcgaaaagcttttgaaacttgatgtgaatgccagcaggcagggcattgaagatgcggaggagaccgccacccaaacttgcggaggcaccgattcaaccgaaggactatttaatatggacgaagatgaggagaccgagcacgaaaccaaggccggtcctgaaaggctcgatcaaatggtgcaccctgtggcagagagactggacatcctcatgtccctcgtcctgtcctatatgaaggatgtctgctacgtcgatggaaaagttgataatggcaagacgaaggacttgtacagagacctcataaacatcttcgataagctgctcttgcccacgcatgcttcatgccacgttcagtttttcatgttctatttgtgttcttttaagcttggcttcgccgaggcgtttttggagcacctctggaagaaacttcaagatccatcaaaccccgcaatcattcgccaggcagctggcaactatattggctcatttctggcccgtgctaaatttataccactgatcacagtgaagagctgcctggaccttcttgtcaactggctgcacatttacttgaacaatcaagattctgggactaaagccttttgcgacgtcgcactgcatggtcccttttactccgcctgtcaagccgtcttttataccttcgtgttccggcataagcagttgctgtctgggaacctcaaagagggcttgcaatatctccaaagcctcaactttgaaagaatcgtgatgtctcagttgaaccctctgaagatctgtctgccaagtgttgtgaatttctttgcagccatcaccaataagtaccagctggttttttgttataccatcatcgagcgtaacaatagacaaatgctgccggttattcggtccactgccggtggagatagtgtgcagatctgtacaaatccactagacactttctttccttttgacccttgtgtgcttaagcggagcaaaaaatttatcgaccctatctaccaggtctgggaagacatgtccgctgaggaactgcaggaatttaaaaagcccatgaagaaggacatcgtcgaggacgaagacgacgatttcttaaagggagaggtacctcagaacgacacggtaatcggcattacgccttcctccttcgacacgcacttccgatcaccttcgagctcggtgggctcgcctccagtcttatatatgcaaccctcccccctctag

SEQ ID NO: 239470 - DNA, 1857 bp, Artificial Sequence
  Description of Artificial Sequence: Synthetic coding sequence
atgcgtgctttggagaacgatttcttcaactctcctcccagaaagacagtacgtttcgggggtaccgtgactgaggttctcctcaaatacaagaaaggcgagactaatgatttcgagctgttgaagaaccaactgcttgaccccgacataaaagacgatcagatcatcaactggttactggagttccgatcctccattatgtatctgactaaggactttgaacagctgatctccattatccttcgcctcccctggctcaacagatcacagactgtcgtcgaagaatatctcgccttcttaggaaacttagttagcgcacagactgtttttctgagaccttgcttaagtatgatagcctcccatttcgtcccccctcgcgttattattaaggaaggagacgtcgatgtgtcagatagcgacgatgaggacgataacctaccagccaatttcgacacctgtcatagggcgctgcaaatcatcgcccgatacgtcccttcaactccttggtttctgatgcccatcctggtggagaagttcccttttgttaggaaatcagagcggaccctcgaatgttacgtacacaacctgctacgcatttcagtgtacttccccactctgaggcatgaaattctggagcttatcatcgagaagcttctgaaactggatgtcaatgcttccaggcaagggatagaggacgcagaggagaccgcaactcagacatgcggcggaaccgattctacagagggcctgttcaacatggacgaagacgaagaaactgaacacgagaccaaagcaggtcccgagcggcttgatcaaatggtgcatccggtggccgaaagactggatattttaatgtccctggtgctttcttatatgaaggacgtgtgctatgttgacgggaaagttgacaacgggaagaccaaagacctctacagagatctgataaacatcttcgataagctgttactgcctacccacgcatcctgccatgtacagttcttcatgttctatctttgctcgttcaaactgggctttgctgaagcttttctggagcacctatggaaaaagctacaagatccctcaaatcccgctatcatcagacaggccgcaggaaattacataggaagctttctcgctcgtgctaaattcatcccgctcataacagtaaaatcatgtctagatcttctggtgaactggttacacatttacctaaacaatcaggactccggcaccaaagccttctgtgatgtcgctctgcatgggcctttctattccgcgtgccaagctgttttctacactttcgtgttccggcacaagcaactacttagcggcaacctgaaagagggactccagtatttgcagagtctaaattttgaacgaattgttatgtcccagttgaatcccttgaaaatctgtttgccctccgttgtgaatttctttgccgcaattaccaataaatatcagttagtgttctgttataccatcatcgagagaaacaaccggcagatgttgcccgtcatcagatctaccgctggaggggattccgtccaaatttgtactaatcccctcgacacattctttcccttcgacccatgtgtgctgaagcgaagcaagaaattcattgatcctatttatcaggtgtgggaagatatgagcgccgaagagctccaggaattcaaaaagcctatgaagaaggatatcgtggaggatgaagacgatgactttctcaaaggagaggtcccacaaaatgacacggtgatcgggattaccccctcatccttcgatacccattttagatctccatcctccagcgtcgggagtcccccagtcttgtatatgcagccaagcccactttag

SEQ ID NO: 239471 - DNA, 1866 bp, Artificial Sequence
  Description of Artificial Sequence: Synthetic coding sequence
atggcggcacctcttcttcacacgagacttcccggagacgcagccgcatccagttcggctgtgaaaaagctgggtgcctcccggaccggcattagcaacatgcgggctttggagaacgacttcttcaattcccccccaagaaagactgtgagattcggcggaactgtgacggaggttctgctgaagtataagaaaggagagaccaatgatttcgaactgcttaaaaatcagctgctggaccctgacatcaaacggttgccatggctgaacagaagccagacagtggttgaagagtatctggcattccttggaaacctcgtcagtgcacagacggtgttcctacggccatgtctcagcatgatagcatcacatttcgtacccccaagagtcattataaaagagggcgatgtcgatgtgagcgacagtgatgatgaggacgataatctgccagcaaatttcgatacctgtcatagggcgttacagattatagcgaggtacgtgccaagtacaccttggtttttgatgccaattctggttgaaaagtttccattcgttcgaaagtcagagagaacgttggagtgctacgttcacaacctactgcgaatctccgtgtatttccccacactcaggcatgagatcctcgaactcatcatcgaaaaacttctcaaattggatgtcaacgccagcagacagggaattgaggacgctgaggagactgctacacaaacctgcggaggcacagatagcactgaaggcctgtttaacatggatgaggacgaagagaccgagcatgaaacaaaggcaggccctgagaggctcgaccagatggtgcatcctgtggctgaaagactggacatcctgatgtcattagttctgtcttacatgaaggacgtgtgctacgtggatgggaaggtggacaacggaaaaacaaaagatctatatcgggacctgataaatattttcgataaactgttattacctacccatgcctcatgccatgtgcagttctttatgttctacctgtgtagttttaaattgggcttcgctgaggcttttttggaacatttatggaaaaagttgcaggatccgagcaatcccgctattatccgccaggccgctggtaattacatcggctcgtttctggccagagctaaatttatccctttaattactgtgaagtcttgcctggatctcctcgtgaattggttgcacatctacctgaacaaccaggatagcggtacaaaagcattctgcgatgtggctcttcacggcccattctactcggcctgtcaggctgttttctacaccttcgttttccgacacaagcagctgcttagcggcaacctaaaggaaggtcttcaatatctgcaatctcttaactttgaacggattgtgatgtctcagctcaatccacttaagatttgtttacccagcgttgtcaatttttttgcagccattaccaacaagtaccagctggtcttctgttacaccattatagaacggaacaaccgccagatgctaccggtgattaggtctactgctggaggcgacagtgtccagatttgtaccaatccactggacacattctttcccttcgacccttgtgtgctcaagagatccaagaagtttattgaccccatctatcaggtctgggaggatatgagtgcagaggaattacaggagtttaaaaaacctatgaagaaggacatcgtagaagacgaagacgacgattttctgaaaggcgaagtcccacaaaatgatacagtgattggtatcacaccttcatcatttgacacacacttcaggtctccaagctcgagcgtcggctcccctcctgtgctttatatgcagcctagccccctctag

SEQ ID NO: 239472 - DNA, 1410 bp, Artificial Sequence
  Description of Artificial Sequence: Synthetic coding sequence
atgatcgccagccattttgtgccccctcgggtcattatcaaggagggcgacgtcgacgtatcggattctgatgacgaagatgataacctgcctgccaacttcgacacatgtcatcgtgccttgcagataatcgcacgctacgttccttccactccttggtttctgatgcccattctcgtggagaaatttccattcgtcagaaaaagtgagcggacactcgtaaacgcaagccgccaggggatcgaagatgctgaggagacggcaacgcagacttgcggcggaactgattcaacagagggcttatttaatatggatgaagacgaggagacagagcatgagaccaaagcaggtcctgagagactcgaccagatggtccaccctgtggctgaacgcctcgacattctgatgtccctagtgctgagctatatgaaggacgtgtgttacgtggacggtaaagttgacaacgggaagacgaaggacctctacagagacctgataaatattttcgataaactgctgctgcccactcacgcttcttgccacgtgcagttctttatgttctatctgtgctcatttaagctagggtttgcggaggcctttctcgaacacttatggaagaagctgcaggatccaagtaatccagccattatcagacaggccgcagggaattacattggttctttcttggcacgcgctaaatttatcccactcattacagtgaaaagttgcctggatctcctagtgaactggctgcatatctaccttaacaatcaggacagtgggacaaaggctttctgcgatgtggcgcttcacggccctttttatagtgcctgccaagccgttttttacacctttgtattccggcacaagcaactgcttagtggcaatcttaaggagggactccagtatcttcaatcgctcaactttgagcgcatcgttatgtcccaactcaacccgctgaaaatatgcctccctagtgtagtgaattttttcgcagccatcactaataaataccagcttgtattctgctataccatcattgagagaaacaaccggcagatgttacctgttatcaggtctacagcaggaggtgactctgttcagatatgtacaaacccactggacacgttcttcccctttgacccctgcgtgctcaaaagaagtaaaaagttcatagatccgatctatcaggtgtgggaggacatgtctgccgaggaactgcaagagttcaagaagccaatgaagaaagatatcgttgaagatgaagatgatgactttctcaagggtgaggtgcctcagaatgacaccgtgataggcataaccccgagtagcttcgatactcacttccggagtccatcatcttcggttggcagccctccagtcctgtatatgcaacccagtcccctttag

SEQ ID NO: 239473 - DNA, 792 bp, Artificial Sequence
  Description of Artificial Sequence: Synthetic coding sequence
atgcgactgggcttgtgcgtggttgcgctggtactgtcatggactcatctcacaatcagttccagaggaattaaaggcaaacggcagagacgcattagcgctgaaggcagccaggcatgcgccaagggctgcgaactgtgctcagaagttaatgggtgcctaaagtgtagcccaaaactttttattctgctggaaagaaacgacatacgccaggttggagtttgtcttccgtcatgccctcccggttactttgacgcacggaacccggatatgaataaatgcattaaatgtaagattgaacactgtgaagcctgcttctcccacaatttctgcaccaagtgcaaggaaggtctgtatttacacaagggaagatgttacccagcgtgccccgagggcagttcggcagctaacggcaccatggagtgttcgagtccagcccaatgtgagatgtcagagtggagcccttggggcccatgctccaagaagcagcagttatgcggttttcggagaggctccgaagagcgaacgcgcagagtgttacatgcccctgtgggcgaccatgccgcatgctctgataccaaagagacaaggaggtgcaccgtgcggcgagtaccttgccctgagggccagaagcgcaggaaaggtggccagggcagacgggagaatgcaaatcgaaatttggcacggaaggaaagtaaggaagcaggcgcagggtctcgccgtagaaaaggccaacaacaacagcagcagcagggcacagttggcccattaactagtgccggtcctgcatag

SEQ ID NO: 239474 - DNA, 792 bp, Artificial Sequence
  Description of Artificial Sequence: Synthetic coding sequence
atgcggctggggctttgcgtggtcgctcttgtgctgagctggactcatctgactatctctagtcgtggtatcaaagggaaaaggcagaggcgcatcagtgctgagggatctcaggcctgtgctaagggttgtgagttatgcagtgaagtaaacggatgtttgaagtgtagtccgaagctgttcatcttgttagaacgcaatgatatccggcaggtgggcgtgtgcctacccagctgcccccctggatactttgacgcaaggaatcctgatatgaacaaatgcataaagtgtaagattgagcactgcgaagcctgtttcagccataatttctgcacgaaatgcaaggaaggcttgtacctccacaagggccgttgttaccctgcctgtcccgaagggtcttccgccgctaatggcactatggagtgcagcagtcccgcacagtgcgagatgtcggaatggtcaccgtggggtccatgcagcaaaaaacaacaactctgcgggttcaggagagggagcgaagaacgaaccaggcgggtgttacatgcacctgtcggcgatcacgccgcatgcagtgatacgaaagagaccagaaggtgtaccgtgaggcgcgtgccttgccctgagggacagaagaggaggaagggaggtcagggtcggagggagaacgcgaacagaaatttggctaggaaagaaagcaaagaggctggggcagggtcccgccgaagaaagggtcagcagcagcaacagcagcagggcaccgttggcccattaacctccgcaggacctgcttag

SEQ ID NO: 239475 - DNA, 792 bp, Artificial Sequence
  Description of Artificial Sequence: Synthetic coding sequence
atgagactgggtttgtgcgtagtggctttggttctctcttggacccacctgacaattagcagccgaggtatcaagggaaagcgacagagacgaataagcgcagagggatcacaggcgtgcgcgaagggctgcgagctttgtagcgaagtgaacggctgtcttaagtgcagtcctaagctgtttattctgctggagcgaaacgatattaggcaggtgggcgtctgccttccttcctgtccacccggatatttcgatgcaaggaatcccgatatgaacaaatgcattaaatgcaaaatcgaacactgcgaagcatgctttagccataatttctgcacaaagtgcaaggagggactgtatctacataaagggcgatgctacccggcatgcccagagggctcaagcgccgctaacgggactatggagtgtagcagtcccgctcagtgtgaaatgagcgaatggtcaccttggggcccttgcagcaagaaacaacagctctgcggcttccgcagaggatcagaagaacggaccagacgggtcctgcacgcaccagttggagatcatgcagcttgttctgataccaaagagacccggcgatgtacagttcggagagtgccatgcccagaaggccagaagaggaggaagggtggccagggccgacgagaaaatgccaacaggaatcttgctcgaaaggaaagtaaggaagcaggcgcaggaagcaggcggaggaaaggccagcaacagcagcaacagcaagggactgtgggacccctgacctctgctggacccgcatag

SEQ ID NO: 239476 - DNA, 603 bp, Artificial Sequence
  Description of Artificial Sequence: Synthetic coding sequence
atgagactgggactgtgcgttgtagccctggtgctttcctggacacaccttaccattagcagtagaggcattaaaggtaagagacagcgcagaattagcgctgaaggatcacaggcttgcgcgaaaggctgcgaactttgtagtgaagtaaacgggtgtcttaaatgttcccctaaactctttatcttgttagaacgtaacgatatccgacaggttggcgtatgtctgccaagctgcccaccagggtatttcgacgctaggaaccccgacatgaacaaatgcattaagtgtaagatcgaacactgcgaggcctgttttagccacaacttctgtaccaaatgtaaagaaggtttatacctccacaagggacggtgctacccagcatgcccagaaggcagttccgctgcgaacggtaccatggagtgttctagccctggtcagaaacggagaaaggggggtcagggccgacgagagaacgccaaccggaatctggccagaaaagagtccaaagaggctggagctggatccagaagaagaaaagggcagcagcaacagcaacaacaggggacggtaggccctctgacaagcgccggtcctgcctag

SEQ ID NO: 239477 - DNA, 711 bp, Artificial Sequence
  Description of Artificial Sequence: Synthetic coding sequence
atgatatttcgggtgagtgctgagggcagccaggcatgcgctaaggggtgcgagctttgcagcgaagtgaacggctgcctgaagtgctctcctaagctgttcattctcctggagcgtaacgacatccggcaggtcggtgtctgtttgccgtcctgtccacctggatattttgacgccaggaatccagacatgaataagtgcattaaatgtaagatagagcattgcgaggcttgttttagccataatttctgtactaagtgtaaagagggattgtacctacataaggggagatgttaccctgcgtgtcccgagggctcttccgcagccaatgggactatggagtgttcctcaccagcccagtgtgagatgtctgagtggagtccttggggtccctgcagtaaaaagcagcagctgtgcggattcagaagagggagcgaagaacggactagacgggtgctccacgcccctgttggggatcatgccgcttgctctgacacaaaggaaacacggagatgcacagtacggcgtgtaccatgtccggaaggacagaaaagacgaaagggagggcaaggtagaagagagaacgctaatcgtaatctcgcacggaaagagagtaaggaggctggagccggttctaggaggagaaagggtcagcagcagcagcaacagcagggaacagtcgggcctttgacatcagcaggcccagcctag

SEQ ID NO: 239478 - DNA, 732 bp, Artificial Sequence
  Description of Artificial Sequence: Synthetic coding sequence
atgcagttccgtctcttctctttcgccctcattatcctgaactgtatggactactcccattgtcaggggaatcgatggaggcgcagtaaacgcgcatcttatgtctctaatcctatatgtaagggctgcctgtcatgctccaaggataacgggtgttctcgctgccaacagaagctcttcttttttctgcgccgtgagggcatgcggcaatacggggaatgtctgcacagctgtcccagcggttattacgggcatcgagcccctgacatgaaccggtgcgccaggtgcaggattgagaattgcgacagctgctttagcaaggatttttgtacaaagtgtaaagtcggtttttatctccaccgaggcagatgcttcgacgaatgccccgatgggtttgcacctctggaagagacaatggagtgtgtagaggggtgtgaggtggggcactggtccgagtggggtacctgcagccgcaataatcgcacatgtggattcaaatggggattggagacgaggactaggcaaatcgtgaaaaagcctgttaaggatactatcctctgccccacaatcgctgaatctaggagatgtaaaatgaccatgaggcattgcccagggggtaaacgcactcccaaggcgaaggagaaaaggaacaaaaagaagaagagaaagctgatcgaacgcgcacaagagcagcattccgtctttctggcaactgatcgggctaatcagtag

SEQ ID NO: 239479 - DNA, 540 bp, Artificial Sequence
  Description of Artificial Sequence: Synthetic coding sequence
atgcaattcagactgttcagcttcgcattgattatactaaattgtatggactattctcactgtcagggaaatcgctggcgcaggagcaagcgaggctgtcgcatcgagaattgcgatagttgcttcagcaaagacttctgcacgaaatgcaaggtgggtttttacctgcaccggggtcgatgtttcgacgaatgcccggatggatttgcccctctggaggaaacaatggagtgcgtagggtgtgaggtcggtcattggagtgagtggggcacctgttcccgaaacaatcggacgtgcgggttcaagtggggacttgaaacgcgcacgcggcaaattgttaaaaagcctgttaaagatacaatcctgtgccccactattgcagaatcaaggcgatgcaagatgacgatgcgacattgccccggaggaaagcgcacaccaaaggctaaagagaagaggaataagaaaaaaaaacgaaagttgattgagagagcccaagaacagcactcggtattcttggctactgatcgggctaatcagtag

SEQ ID NO: 239480 - DNA, 540 bp, Artificial Sequence
  Description of Artificial Sequence: Synthetic coding sequence
atgcagtttagactcttctctttcgctcttattattctgaattgtatggattattcccattgtcagggtaacagatggaggcgtagtaagcgtggctgtagaatcgagaattgcgattcatgtttttccaaagatttctgcaccaagtgtaaagtcgggttttacctccaccgcggaagatgttttgatgagtgtcccgatgggttcgcccctctggaagagaccatggaatgcgtaggctgcgaggtgggacactggagcgagtgggggacctgttcccgcaataaccggacatgcggattcaagtgggggctcgaaactcggactagacagattgtgaaaaagccggtgaaagataccattctgtgtccaactatcgccgagagccggagatgtaagatgactatgcgccattgcccaggtggcaagcgcactcccaaagcaaaggagaagcgaaacaaaaaaaagaagcgcaaactcatcgaacgcgctcaggaacagcacagcgtgttccttgcaacagaccgcgctaaccagtag

SEQ ID NO: 239481 - DNA, 531 bp, Artificial Sequence
  Description of Artificial Sequence: Synthetic coding sequence
atgcgccaatacggagagtgcctgcactcttgccccagcgggtactacgggcatcgagccccagacatgaatagatgcgccaggtgtagaatcgagaactgcgattcttgcttctccaaggatttctgtaccaaatgcaaggttggcttctatctacacagggggaggtgttttgacgaatgcccagatggattcgctcctctggaagagacaatggaatgtgtggaaggctgtgaagtgggccactggtcagaatggggaacttgcagcaggaacaacagaacatgcggctttaagtggggcttagagacccggactcggcagattgtgaaaaagcctgtgaaggacactatcttatgtcccacaattgcagagtctcgccgatgtaagatgactatgaggcattgccctgggggtaagagaacacccaaagcaaaggagaaacgcaataagaaaaaaaagagaaagctgattgagcgcgctcaagaacaacacagcgtgtttttggccactgaccgggcaaaccaatag

SEQ ID NO: 239482 - DNA, 507 bp, Artificial Sequence
  Description of Artificial Sequence: Synthetic coding sequence
atgagacagtatggcgagtgtttgcattcatgtccctccggatattacggacacagagctcctgacatgaatagatgtgctcgatgtaggattgaaaattgcgacagctgcttctctaaagatttttgtacaaagtgcaaagtggggttttacttacaccgtggaagatgtttcgacgaatgccccgacggtttcgccccattggaagaaactatggaatgcgtggagggatgcgaagttgggcattggtcagaatggggcacttgcagcagaaacaatagaacatgtgggtttaaatgggggctagagacccgcacccgacaaatcgtcaagaaacccgttaaagacacaatcctctgcccaacgattgccgagtcacgccgatgtaaaatgactatgcgacactgccccggtggcaagcggacccctaaggccaaagaaaagagaaacaagaagaaaaaacggaagctgattgaacgggctcaggaacagcattccgtcttctag

SEQ ID NO: 239483 - DNA, 270 bp, Artificial Sequence
  Description of Artificial Sequence: Synthetic coding sequence
atgcgacagtatggcgagtgtctgcactcgtgcccctcaggctattacgggcatagggcacctgatatgaacagatgcgccaggtgtaggatcgaaaattgtgatagctgtttctccaaggatttctgtactaagtgtaaagtcggtttttacctgcaccggggtcggtgcttcgatgagtgtccagacggatttgcaccccttgaagagaccatggaatgcgtggaaggctgcgaggtcgggcactggagcgaatggggaacatgctag

SEQ ID NO: 239484 - DNA, 366 bp, Artificial Sequence
  Description of Artificial Sequence: Synthetic coding sequence
atgcagtttaggctcttcagcttcgctttaattatactgaactgtatggactatagtcactgtcagggcaataggtggaggagatcgaagagagccagctacgtgtcaaacccaatatgtaagggctgcctcagctgcagcaaggacaatggttgctcaagatgccaacagaagctcttttttttcttgaggcgggaaggcatgagacagtatggagaatgtctgcattcctgcccaagcgggtattatggtcaccgcgctccagacatgaaccggtgcgccagatgtaggatcgagaattgtgatagttgtttcagtaaggacttttgtacaaaatgcaaggttggattctatttgcacaggtag

SEQ ID NO: 239485 - DNA, 234 bp, Artificial Sequence
  Description of Artificial Sequence: Synthetic coding sequence
atgcagttcaggctgttctcattcgccttgattattttgaactgcatggactattctcactgtcaaggcaatcgttggcgacggagcaaaagggccagctatgtatcaaaccccatttgtaaaggatgtttgtcgtgtagtaaggataacggatgctcacgctgtcagcagaaactgtttttcttcctcagacgagaaggcatgcgacagtacggcgagtgtctacatagctag

SEQ ID NO: 239486 - DNA, 1410 bp, Artificial Sequence
  Description of Artificial Sequence: Synthetic coding sequence
atggccttcctcatgcacttgttggtgtgcgtcttcgggatgggaagctgggtgacaatcaacggtctgtgggtcgaacttccactcttggtaatggagctccccgaaggatggtatttacctagttacctcaccgtagtgattcaactggccaacataggaccccttctggtcaccctgctgcatcactttaggcccagttgtctcagcgaggttccgatcatcttcacactcttaggggtggggacagtaacgtgtataatattcgctttcctgtggaatatgacatcatgggtactggacggacatcacagtatagcattcctagtcctcactttctttctggctctagtcgattgtacttctagcgttacgtttcttccattcatgtccaggctaccgacctattatctcacaactttcttcgtgggggaagggctgtcaggactgctgccagccctcgtagcactggcccagggatccgggctcaccacctgtgtgaacgtgactgagatttcagacagcgtgcctagtcctgtcccaactagggagaccgatattgcacagggagttcctcgcgctctcgtttcagccttgccaggaatggaggccccactgagccacctcgagtcgcgctatttgcccgctcatttctcacccctggtgttcttcctactcctcagtatcatgatggcctgctgtctggttgcctttttcgtactgcagcgccagccccgatgctgggaggcctcagtcgaagatttgttgaatgatcaagtgactctgcattcaatccgaccccgagaagaaaatgaccttggcccagcaggcaccgtggattccagccagggccagggctatcttgaagagaaggccgcaccttgttgccctgctcacctcgcgttcatatacacactcgtcgctttcgtgaacgctcttacaaatggcatgttgccctctgtgcagacttacagttgtctctcatacggcccagtggcctatcatctggctgccaccctatcaatcgttgccaaccccctcgcctccttagtttccatgtttctcccgaatcgaagcctgcttttcctgggcgtgctgtccgtgctcggtacttgctttgggggatataacatggccatggccgtgatgtcaccctgtcccctgctgcagggacactggggcggtgaggtactcattgtggcgtcttgggttcttttttctggctgtctgtcatatgttaaggtgatgctgggggtcgttctcagggacctctccagatcagctctcttatggtgcggagcagcggtccaactgggcagtctgctgggagctctcctgatgtttcccctggtgaatgtcctgcgtctgttcagctccgcagatttttgtaatctgcattgtccagcctag

SEQ ID NO: 239487 - DNA, 519 bp, Artificial Sequence
  Description of Artificial Sequence: Synthetic coding sequence
atgcgtgccccactgtgcctcctactcctcgttgctcatgctgtggacatgctggccctgaaccgtagaaagaagcaagtcgggacaggactcgggggtaattgtaccggatgcattatttgcagcgaagagaatggttgtagtacatgtcagcagcgcctcttcttgttcatccgtagggagggcatcaggcagtacgggaagtgtttgcacgattgccccccaggttactttggcattaggggccaagaagtgaaccggtgtaagaaatgcggagctacctgcgaaagctgtttttctcaggatttttgcattaggtgcaaacggcagttttacctttacaagggaaaatgtttgccaacctgcccgcctggcactctcgcacaccagaacactagggagtgtcaggaacgaagtcccggacagaaaaaggggaggaaggataggaggcccaggaaagaccgcaagttggataggcgcttagatgtgcgacccaggcagccaggattgcaaccctag

SEQ ID NO: 239488 - DNA, 2133 bp, Artificial Sequence
  Description of Artificial Sequence: Synthetic coding sequence
atgagaggcaggctgtgtgtgggacgggcagccgcagccgcagccgcagtcgcagttcccctggcaggaggacaagaggggtcaccagggggtggaagaagaggtagccggggaacaaccatggtgaaaaagagaaagggcagagtcgtcatcgactcagatacagaggactcaggctcagacgagaatctcgatcaggagctgctgagcctggccaaacgaaaacgaagcgatagtgaggagaaggaaccccctgtcagccaacctgctgcttcaagcgactccgagacgagcgattctgacgacgaatggaccttcgggagcaataaaaacaaaaagaaggggaaggcgcgaaagatcgaaaagaaggggactatgaagaaacaggctaacaagaccgcctccagtggatcttctgacaaggacagtagcgcagagtcttctgctcccgaagaaggagaagtcagcgactccgacagcaatagttctagttcctcttctgactctgatagctcgtcagaggatgaggaatttcatgacggatatggggaagatctgatgggagacgaggaagaccgagccagactggaacaaatgaccgagaaagagagagagcaagagctcttcaaccggatcgaaaaacgggaggtgcttaagcgcagatttgaaattaaaaaaaaactcaaaaccgccaagaagaaggagaaaaaggagaagaagaaaaagcaggaagaagagcaagagaagaagaaattgacccagattcaggaatcccaggtgacctcccacaataaggagagaagatccaaaagggacgagaagcttgacaaaaagtcccaggctatggaggagcttaaagccgaaagggaaaaacgtaagaatcgcacggctgaattgcttgccaaaaagcagcctctgaaaacctccgaggtgtacagcgacgacgaggaggaagaggaagatgataaatcctcagagaagtcagaccgcagttcgcggacttcatccagcgacgaggaggaagaaaaggaagaaatccctcccaagagtcagccagtttcacttccagaggagctgaatagggtgcgcctcagcagacataaattggaaagatggtgtcatatgcccttctttgctaagacggtcaccggctgcttcgtacgcattggcatcggcaaccacaacagcaagccagtttatcgcgtcgcagaaattacaggagtagtggaaacggccaaggtttaccaactcggtggcacccgtactaataagggactccaactgagacatggaaatgaccaacgagtgtttagactggagtttgtatccaatcaggagttcactgaaagtgaattcatgaaatggaaagaagccatgttcagcgctggaatgcaactgcccacccttgacgaaatcaacaaaaaggaattaagcataaaagaggcacttaattataagttcaacgaccaagacatagaggaaatcgtgaaggagaaggaacgctttcgtaaggcacccccaaactacgcaatgaagaaaacacagctgcttaaagagaaggccatggcagaggatctcggcgatcaagacaaagcaaagcaaatacaggaccaacttaatgaattagaggaaagggctgaggcactggataggcagcggactaagaatatctctgcgatttcatacatcaaccagcgaaacagagaatggaatattgtagagtcagagaaagccctcgtggccgaaagccacaacatgaagaatcaacagatggacccctttacacgtagacagtgcaagccaaccatagtgtccaactccagggatccagccgtgcaagccgcaatactagctcagctgaacgcgaaatatggaagcggagtactccccgacgctcctaaggagatgtcaaagggacagggtaaggataaagacttgaacagtaaatccgcgtctgacctctccgaggacttgtttaaagtacacgacttcgatgtgaaaatagaccttcaagttccgtcgtccgaatcaaaagcactcgccatcacctccaaagctcctcctgctaaggatggcgcacccaggcgatcgttaaacttggaagactataagaagcggaggggtctgatatag

SEQ ID NO: 239489 - DNA, 4551 bp, Artificial Sequence
  Description of Artificial Sequence: Synthetic coding sequence
atggatagcccccctaagctgaccggagaaaccctgattgtgcaccatattcccctggtccactgccaggtacctgatcgacagtgttgtggaggcgcagggggtggagggggaagcacaaggccgaatcctttttgccctccagagctcgggattacacagcctgatcaggatctgggccaggccgacagcctgctatttagtagccttcactccacgcccggaggcacagctagatccatagatagcacaaagtctaggtcccgcgatggtcgaggcccaggagcacctaagaggcacaaccccttcttgttacaggaaggggtgggggagcctggtcttggcgacctgtatgatgatagcatcggggactcagccacccaacaatcctttcatctccacggtacaggacagccaaattttcacctttcaagtttccagctgcccccaagtggacctcgggtaggcagaccctggggtaccactcggtcccgcgctggggtggtggaggggcaggagcaagagccagtgatgacgctggacactcagcagtgcgggacaagccactgttgccgcccagaactggaggctgagaccatggagctcgatgagtgcggcggtcctggcggaagtggcagcggaggaggggcaagcgacacctcagggttttcctttgatcaagagtggaaattgtctagtgatgagtctccacgcaacccaggatgcagtggcagcggagatcagcactgccggtgctcatctacatcctcccagagtgaggccgcagatcagtctatgggttacgtgtccgattctagctgtaactccagcgacggggtgcttgttacgttcagtaccctgtacaacaaaatgcacggaaccccgcgtgcaaatttgaacagcgcgcctcaaagctgctccgattctagcttctgttctcactcagaccccggagcattctacctggacctgcagccaagcccattcgagtctaagatgtcgtacgaatcccatcacccagagagtggtggccgagaggggggttacggctgcccacatgcatcaagtcccgaactggacgcgaactgtaactcctacagaccgcactgtgaaccttgcccagccgtcgcagatctaaccgcctgcttccagtcccaggctagacttgtcgtggcaacccaaaattactacaagctggtgacctgtgatctgtctagccagagctccccctccccagcgggaagttccataacgagctgttcagaagagcacaccaaaataagtcccccaccaggtcctggcccagacccagggcctagccagccctcagaatattatctgtttcagaaaccggaggtgcagccggaggaacaagaggcggtgagctccagcacccaggccgctgcagccgtgggccctactgtgttagaaggacaagtgtacacgaacacctcccccccaaacctcagcacaggacggcagaggagccgatcatacgacaggagtttacagaggtcgccccctgtgaggctcggcagtctggagcggatgctgagctgccccgtcagactgtcagaagggcctgctgccatggccggacccggatcacctcccaggcgggtcacctcgttcgctgagctggcaaagggcagaaagaaaactgggggttctggtagtccccctttgcgcgtttccgtgggggactcatcccaggagttctccccaattcaggaggctcagcaggaccgcggtgcaccactggacgaagggacctgttgctcccactccctgcctccaatgccattgggacccggaatggaccttttggggcctgatccatcccccccttggtctacccaagtgtgtcagggaccacactcctctgaaatgccacctgcaggactgagggcaaccgggcagggccctctcgcccagctaatggaccccggacccgctcttcccggtagccccgctaacagccacactcaacgcgatgcgagggctagggctgatggtggtgggaccgagtccaggcctgtcctcaggtactccaaggaacagaggccaaccacactgcctatccaaccttttgtgttccagcaccactttccaaaacagcttgccaaagcaagagctcttcactccctcagccagctctattccctgtctggttgctccaggactcagcaaccggctcccctagccgctccagccgctcaggtcagtgtacctgctccatcgggggaacctcaggccagcaccccacgggctaccggcaggggcgctcgcaaggctgggagtgagcctgagacatcacggccatccccgttaggcagctattctcctatacgatccgttggaccttttggcccatccactgatagttccgcttctacttcttgctctcctcccccagaacagcccaccgcgaccgagagcttgcccccttggagccactcgtgccctagcgcggtgcgacctgctacttcccagcagcctcaaaaggaggaccagaagattttaaccctaacagaataccgacttcacggaaccggttctctgccccctttgggctcctggcgatcagggctgagtcgggctgaatccctggccaggggaggcggtgagggaagcatggccacaaggcctagcaacgctaaccacctctcaccccaggccctcaaatggcgcgaataccggcgtaagaaccctctgggaccgccaggtctctccggttctctggatcgcagatctcaggaggcccgtctggcgcgacgcaacccaattttcgagtttccaggttccctctctgcagccagccatctgaattgtagactgaatggacaggctgtcaaacctctgccattgacatgcccagacttccaagaccctttcagcctcacagaaaagcctcctgctgagttctgcctgtcaccagatgggtcctccgaagccatctccattgaccttctccaaaaaaaagggctcgtcaaagcggtgaacatcgcagtggatctcatagtggctcacttcggtacctcaagggatccgggagttaaggccaagctaggtaattccagtgttagtcccaacgttggccatctagtgcttaaatacctctgcccagcggtgcgtgctgtcctggaggacggtctaaaagctttcgtgctggatgttataattggccagcgaaagaacatgccgtggtcagtggtagaggcgagtactcagctggggccaagtacaaaagttctgcacggcctgtataataaggtcagtcagttcccagaactcacttcccacacgatgagatttaacgcatttatcctgggtctgcttaacataaggtctctcgaattttggtttaaccacctgtacaaccatgaggacattatccagacccactatcaaccatggggcttcctgagtgcggcacacactgtatgcccgggattatttgaggaattgctactgttgctccagccactggctttgcttcccttctccctggaccttttgtttcagcacaggctgctgcaaagtggccagcaacagaggcagcacaaggagttgctgcgagttagccaggatttactattaagcgcccactccactttgcaactcgcaagagccagaggccaggaagggcctggcgacgtcgatcgcgcagcacaaggagagcgggtaaaaggcgtaggtgcgtcggaagggggtgaagaggaggaggaggaggaagagacggaggaggtagcagaagctgccggtgggtccggcagagcacggtgggctcggggaggccaagccggatggtggtatcagctcatgcagtcatcccaggtgtatatcgacggcagcatagaggggtcaagatttcctcggggatcttccaactcttcatcagagaaaaaaaagggggctggaggtggtggcccaccacaagctccaccccctagagaaggagtagtggagggggcagaagcgtgcccagcatccgaggaagcgttgggaagggaaaggggatggccgttttggatgggaagtccccctgattccgtcttagccgaattacgcagatctcgggaacgtgagggccctgctgcttctccagcagaaaatgaggagggtgcaagtgaaccaagcccaggtggtatcaaatggggacacttgtttggcagccgtaaagctcagcgtgaggcaagacctacaaatcggctgccttccgactggctaagcctcgacaaaagtatgttccagctcgtggcacaaactgtcgggtccaggagggagcccgagcccaaggagagcctgcaggagcctcatagcccagcccttccaagcagccctccctgcgaggtccaggcactgtgccatcacctcgcgacgggacctggccagctgagctttcacaagggggacattctgcgagtgttaggaagagcaggtggcgattggctgagatgtagcaggggacccgacagcggcttggtgcctctcgcctacgtcacactgacgccgactccaagccctacacccggaagcagccagaactag

SEQ ID NO: 239490 - DNA, 4551 bp, Artificial Sequence
  Description of Artificial Sequence: Synthetic coding sequence
atggacagtcctccgaaactcactggtgaaactctgattgtgcaccacataccactcgtgcactgtcaggtgccggaccgtcaatgttgtgggggagccggaggagggggaggttcgactaggccgaaccccttctgcccaccggagttgggtataacccagcctgatcaggatctgggccaagcagacagtttgttgttttcctcattgcattccactcctggcggaactgccagatcgattgactctacaaagagtaggtctagggacgggaggggcccaggggcacctaaaagacataatccgttcctgctgcaggaaggcgtgggcgagcccggtttgggcgatttatacgatgatagtatcggtgacagtgccactcagcaatcgtttcacctccacgggactggccaaccgaattttcaccttagtagcttccagctgccaccttccgggcctcgtgtaggtcgtccatggggcaccacccggtcaagagctggggttgtggaaggccaggaacaggaacccgtgatgacacttgatacacagcagtgtgggactagccactgttgtcgcccagagctggaagccgagacaatggagctcgatgaatgcggaggccctgggggaagtggctctggtggtggcgcaagtgacacttccggattcagcttcgatcaagaatggaagctcagtagcgatgaaagtcctcggaacccaggctgcagtggcagcggggaccagcattgtcgatgcagctcaaccagctctcagagcgaggcagccgatcagagtatgggctacgtgagcgacagtagctgcaattcctccgatggcgtgctggtgacgttctccaccctgtataataagatgcatggaactcccagggccaacctcaattctgccccacagagctgtagcgacagctccttctgttcccacagtgatcctggagccttttacctggacctgcagcccagtcccttcgagtcgaagatgagctatgaatcgcatcaccccgaatccggagggagagagggcggatatgggtgcccacatgcctcctccccggagctagacgccaattgcaattcatatcgcccacattgtgagccgtgccctgccgttgccgatctgacagcttgtttccagtcgcaggccaggctggttgtagctacacaaaattactacaaattggtgacctgtgatctaagtagccaaagctcaccttctccagccggtagctccatcacctcctgctccgaagagcacacgaaaatttcaccacctcccggaccgggacccgaccctgggccaagccagcctagcgagtattacctattccaaaaacctgaagtacagcctgaagaacaagaggctgtgtctagcagcacgcaggcggctgctgcagtgggtcccacagtacttgagggacaggtttatactaatacttctccaccaaacctgagcacgggccgtcagcgaagccggagctacgaccgaagcctgcagcgctcaccccctgtgaggcttgggtcgctcgagaggatgctctcatgtcccgtgaggctgtcagaggggccagcggcaatggccggacccggatcaccccctcggagagtgacgtcgttcgccgagttggctaaaggaaggaagaagacaggtggtagcggctctcctcctttgcgcgtgagcgttggtgattcgagtcaggaattttctcccattcaagaggcacaacaggatagaggggcaccactggatgagggtacatgttgctcccacagcctgccacctatgccactcgggccaggtatggacttgctgggcccagatccatcccctccttggtccactcaggtctgtcagggtccccattccagcgagatgccgcctgcaggtcttcgcgctaccgggcagggccctttggcacagctgatggatcctggccctgcactccccggaagtcctgctaatagtcacacacaaagagacgctagggccagggccgacggagggggaactgagtccaggcctgtgcttcgatattcaaaagagcagcgaccaacaaccctacccatccagcctttcgtgttccagcaccactttcccaaacagttggccaaggccagggctttacatagtctgagtcagctgtactccctgtcgggctgcagtagaactcagcagcccgctcctcttgcggctcccgcagcccaggtaagtgtcccggcaccctcaggcgaaccccaagcatctacacctcgggcaaccggacgaggcgctcgtaaggccggaagcgagcccgaaaccagtcgacctagccccctggggagctacagtcccatccgcagtgtgggcccatttggtccctcaactgactcgagtgcatctacaagctgctccccacccccagagcagccgaccgccaccgaatccttgcccccttggagtcacagttgtcccagcgctgtgagacctgccacctcacagcagccccagaaagaggatcagaaaatcctcacattaaccgagtacagactgcacggaaccgggtccctgcccccactgggaagctggagatcgggactctccagagccgaaagcctggctcgcggaggcggtgagggctcaatggcaaccagaccttcaaacgccaaccaccttagtccacaggccctgaaatggagggagtatcgacggaaaaacccacttggcccacccggtctgagcgggagcctagaccgcaggtcacaggaagcacgcctggccagacgaaatcccatattcgagttccctgggagcttgtcggccgctagtcatctgaactgtagactcaatgggcaggctgtcaaacctctacctctcacttgcccggactttcaggatccgttcagcctgactgaaaagcctccagctgagttttgtctctctcctgacggaagttctgaggcaatctctatcgacctgctgcaaaagaaagggctggtaaaggctgttaatattgcagtggacctgattgtcgcgcactttggaaccagcagagaccctggcgtgaaggctaagttgggtaattcgagcgtgagcccaaatgtggggcacctggtcctgaaatatctctgcccagcggtacgcgctgtactagaagatggattgaaggcctttgtacttgatgtcatcataggccagaggaaaaatatgccgtggtccgttgtggaggcctctacacagttgggccctagcaccaaggttttacacgggctttataataaggtcagtcaatttccagagctgacctcgcacaccatgcgattcaatgctttcatcctcgggctgctcaatatacgcagtctagagttctggttcaatcatctgtataatcacgaagatattattcaaacccactatcagccatgggggtttctgtccgccgcacacaccgtctgtccgggactgttcgaggagctcttgctgctcctccagcctttggctctgctgcctttcagtctggatctcctgtttcaacatcgcttattacaatccggacagcagcagcgacagcacaaagaactgctccgagttagccaggacctgcttctgtccgcacacagcaccttgcagctcgcaagagccaggggccaagagggacctggagacgttgatagggccgcacagggcgaacgagttaagggcgtcggggcttctgaagggggagaggaggaggaagaggaggaggaaaccgaggaggtggcagaagcggcagggggtagcgggcgtgcaaggtgggccagaggcggacaggcaggctggtggtatcagcttatgcagtcgagccaggtatacatcgatggaagtatagagggtagtcggttcccgagaggttcttctaacagcagtagcgagaagaaaaaaggtgctggaggcggagggcctccccaagctccaccaccccgtgaaggggtggttgaaggtgccgaggcatgtcccgcatccgaagaagctctcggccgagaaagagggtggcccttctggatgggatcaccaccagactcagttttggcagagctgagacggtcccgagaaagagaggggcctgctgcgtcaccagcagagaacgaggagggagcctcagagcccagcccagggggtattaagtggggtcacctgttcggatcgagaaaggcccagcgggaggctcgcccaactaatagactgccaagcgactggctgtcccttgataaatctatgtttcagctcgtggctcagaccgttgggagcagacgcgagcctgagccaaaggaaagtctgcaagaaccacattccccggctctgccgagctctccaccctgcgaagtgcaagccctttgtcaccacctggccaccggccctggacagctgtcctttcacaaaggggacattctcagagtcttgggaagggccggtggcgattggctacgctgttctagagggcctgacagtggtttagtgcctttggcttatgtgacactgacacccacaccgagccccaccccaggatcctcccagaattag

SEQ ID NO: 239491 - DNA, 2775 bp, Artificial Sequence
  Description of Artificial Sequence: Synthetic coding sequence
atggactctcctcctaagctgaccggagagactctcatagtgcaccatatacctcttgtgcactgtcaagtgccggatcgccagtgctgcgggggtgctggcggtggtggcggtagcaccaggcctaacccattttgtcctcctgaactcgggattacccagcccgaccaggatctcggtcaagcggattcactgttattctcttcactgcacagtactcccggaggcacagctcgctcaattgatagcactaaatctcgatctcgcgacggcaggggtcccggagctccaaagaggcacaatccattcctactgcaagagggggtaggagaacctggcctcggcgacttgtacgatgactcaattggtgattcggcgacgcagcaatcgtttcacctccacggtacagggcagccaaattttcacctcagcagcttccaactgcctccctccgggccaagagtgggcagaccctggggaacaacccggagcagagcaggagtcgttgaggggcaggagcaggaaccagtgatgacccttgacacacaacagtgcggaacatcacactgctgccgaccggaactggaagccgagacaatggaactggatgaatgcggaggtccgggagggtcaggtagcgggggtggagcctccgatacatccgggttctcttttgatcaagaatggaagctttcttcagacgagtctccaagaaaccctgggtgtagcggttccggagaccagcactgcaggtgtagcagcactagctcacagagcgaggcggctgatcagagcatgggatacgtgtctgattcgagctgcaattcaagcgacggagtgctcgtcacatttagcactctctacaacaaaatgcacggcacccctagggccaatttaaacagtgcccctcaatcatgtagcgattccagtttctgtagccactcagaccctggagccttctacctagacctccagcctagcccgttcgaaagtaagatgtcatacgaatctcaccaccccgagagcgggggtcgagagggcggatatggctgcccgcacgctagttccccggagctagacgccaattgcaatagctatcgaccccactgtgagccatgtcccgctgtggcagatctgaccgcctgtttccaatctcaggctcgtctcgtggttgcaactcagaactactataagctcgtgacctgcgatctgagcagccagtcctcgccctcccctgccggaagttcgatcacatcttgcagtgaagaacacacgaagatttctccccctcctggccctggacctgatccagggccttctcagccctccgagtactatctgtttcagaagccggaggtccaacccgaagagcaggaggcagtgtcatcttctacccaggcggcagccgcagtggggcctactgtgttggaaggacaggtgtatactaacaccagtccgcctaatctgtccactgggcgtcagcggtccagatcttacgataggtccctgcagagaagcccacctgtgagactgggctccctggagcgcatgctctcttgccccgtgcgcctcagcgagggcccagccgctatggccggtccaggcagtcctcccagaagggtaacaagcttcgccgagctggctaagggaaggaagaagactgggggttctggatcaccccctcttcgggtgagcgttggagatagctcccaggaatttagcccgattcaggaggctcagcaggatagaggggctcctctcgacgaaggaacatgttgctcgcattcactcccacccatgccactagggccaggaatggacctgctgggtcccgacccgagccctccatggtccacccaggtatgccagggccctcactcttccgaaatgcctccagctggacttagggccacgggccagggtccgctggcccagctcatggacccaggacctgccctgcccggatcacctgccaactcccatacacagcgcgatgcaagagcccgagccgacggcggaggcactgaatctcggcctgtcctgaggtacagcaaggagcagcggcctacgacactgccaatacaaccttttgtgttccagcatcacttcccaaaacagctcgcaaaagcacgagccctgcattccttgtcccagctttactccctctccggttgctctcggacccagcaaccagccccattggccgctccagcggcacaggtgagtgtgcctgctccgtctggagagccccaggcctctacccccagagctaccggacgtggcgcacgcaaagcagggtcggagcccgaaacttctcgtcctagccctctgggatcatacagccctatccgatcggtcggtccctttggcccaagtaccgactcttcggcaagcacatcttgtagtcccccaccagaacagcccacggcaaccgagtccctccccccatggtcccacagctgccccagcgcagtgcgccctgccacttcacagcagccacaaaaggaagatcagaaaatcttgactctgaccgaatatcggctgcacggtactggaagcctcccacccctgggttcttggcgttctgggctttctcgagccgagtcactggccagagggggaggcgaggggagcatggccacaagaccttccaatgctaatcatctatccccgcaagctctcaaatggagagaatataggaggaagaatccactggggcctccaggcttgtcgggctctctagatcgcagaagccaagaagccagaacaggctag

SEQ ID NO: 239492 - DNA, 591 bp, Artificial Sequence
  Description of Artificial Sequence: Synthetic coding sequence
atgtcgatgctgcgcctccagaagagactcgcctcgtccgttcttcggtgtggcaagaagaaggtttggttggatcctaatgagacaaacgagattgctaacgccaacagccgccagcaaattcgtaaactcattaaggacggactgatcatccgtaagcctgtgacagtccactctagggctaggtgccgcaagaacaccctggccagacgcaaaggaagacatatggggattgggaagaggaaaggaaccgcaaacgcacgcatgccagagaaggttacctggatgagaaggatgcggatactgcggaggcttttaagaaggtatagggagtcaaaaaaaatcgaccggcacatgtaccatagcctgtatctcaaggtgaaaggtaacgtgttcaaaaataagcggatcttgatggagcatattcacaaactaaaggcagataaggctaggaagaaactgctcgccgatcaggcggaagctaggcggagcaaaactaaagaagcaaggaaaagacgcgaggagagattgcaggctaagaaggaggaaatcatcaagaccttgagcaaggaggaggagactaaaaagtag

SEQ ID NO: 239493 - DNA, 1341 bp, Artificial Sequence
  Description of Artificial Sequence: Synthetic coding sequence
atggaagcgtcattcgtccagaccactatggccctcgggctgagtagtaagaaagcgagttcaagaaacgtggccgttgagcggaaaaatctgatcacagtatgcaggttctccgtgaaaacgctgcttgagaagtatacagcagagccaatcgacgattcgtccgaggaattcgttaatttcgcggcaatcctagaacagattctctcccaccgatttaaggcttgtgccccagctggaccagtgtcctggttttcctctgatggtcagcgcggattttgggactatatccgtcttgcctgtagtaaagtaccaaacaattgtgtgtcttccatagaaaatatggaaaacatttcaactgcacgggctaaagggagagcctggattcgtgtggccctcatggaaaaacgcatgtctgagtatatcaccacagccctccgcgacactcgcacgaccagacgattttacgacagcggtgccatcatgctccgagacgaggccaccatcctcaccggtatgttgattggcctctccgccattgattttagcttctgtttgaagggcgaagtccttgatggaaaaacacctgtggtgatagattatactccgtatctgaagttcacacaaagttatgactacctaacggacgaagaagagcgacactctgcagaatcttcaacctcagaggataatagtccggagcatccctacctgccgctagtgaccgatgaggattcctggtacagcaagtggcacaaaatggaacagaaattcagaatcgtttatgcacagaagggctatcttgaggagctcgtgcgcctgcgggagagccagctgaaggacctcgaggccgaaaataggcggttgcaactgcaactggaggaggccgcagctcagaatcagcgcgagaagagggaactggagggggtgattttggagctgcaggagcagctgacagggctcattccaagtgaccacgccccactcgcccaaggtagcaaagaactcaccactcctctcgtgaaccaatggccgagcttggggactcttaacggggcagagggggcatccaacagcaagctctacagaaggcacagcttcatgtccaccgaaccactctccgctgaggcgtccctgtcgtccgactctcaacggctcggcgaggggacccgagacgaggagccctggggcccaatcggcaaagatccaacacctagcatgctgggtctatgcggaagtctggccagcattccctcctgtaagtctctggcatccttcaaatccaacgaatgtcttgtgagtgattcccctgaaggctctcctgccctcagcccctcctag

SEQ ID NO: 239494 - DNA, 1371 bp, Artificial Sequence
  Description of Artificial Sequence: Synthetic coding sequence
atgaaaatcgaagaggttaagtctaccacaaaaacacaaaggatcgcctcccacagccacgtaaaaggattaggtctggacgagtcgggcctggctaagcaagcggcatctgggttggtaggacaagagaacgcacgggaggcatgtggcgtcatcgtcgaactgatcaagtccaaaaagatggctggtagagctgtgctgttggctggccctcctgggacagggaagaccgcactagcactagcaattgcccaggagcttggcagcaaggtccctttctgccctatggtaggctctgaagtctactccacagagatcaagaaaactgaagtgcttatggaaaatttccgcagggcaatcggcctgaggattaaagagaccaaggaagtgtacgagggggaggtcactgagctgacaccctgcgagactgagaatccaatggggggatatgggaagacaatctcccacgtgataatcggactgaagaccgcaaagggtacgaaacaactcaagttagacccgagtatttttgagtcacttcagaaggagcgtgtcgaggctggagacgtgatttacatcgaggccaacagcggagcagtgaagcgccagggcagatgcgatacatacgctacagagttcgatctagaggccgaagagtacgtgccactcccaaagggagacgtgcacaaaaagaaggagatcattcaggacgtgacactacatgatctggacgtagcaaacgctcggcctcagggaggacaagacattctaagtatgatgggccagttaatgaagccaaagaagactgagataacagacaagctgagaggcgagattaacaaggtcgtaaacaagtatatcgatcaagggattgccgagctcgtgccaggcgtgctgttcgtcgatgaagttcacatgcttgacatcgaatgtttcacatacctccaccgggcactggagtcctccatagctccgatcgtgatcttcgcctctaatcgcggtaactgcgtgatccgaggcacagaggatatcacctctccacatggaatccctctggatctattagatcgcgtgatgatcataagaacaatgctgtataccccccaggaaatgaaacaaattattaagatcagggctcagaccgagggtatcaatatctcagaagaggctttgaaccatttaggagaaattgggacaaaaacaaccctgcgctattcagttcaattactgacacctgccaacctgcttgcgaagataaacggcaaggactcaatcgagaaagaacatgtggaggagatttctgaacttttctatgacgccaaaagcagtgccaagatccttgccgaccagcaggataaatatatgaagtag

SEQ ID NO: 239495 - DNA, 1161 bp, Artificial Sequence
  Description of Artificial Sequence: Synthetic coding sequence
atgaaaattgaagaggtgaaaagcaccactaagacacagcggatcgctagtcacagccatgtgaagggattaggcctcgacgagtctggactggcaaaacaggccgcatctggcctcgtgggacaggagaacgccagagaggcctgcggagtcatcgtggagctgattaagagcaaaaagatggccggaagggcagtcctgctggccggaccccctggcaccgggaagacggcactagccctggccattgcccaggaattaggcagtaaggtcccgttctgcccaatggtggggtcagaggtttattccacagagatcaagaaaacggaagtcctaatggaaaatttccgtcgggctattgggctgcgtatcaaagaaactaaggaagtctacgagggagaggttaccgagcttacgccgtgcgagactgagaatcccatgggaggctacggcaagacgatctcacatgtgatcataggattgaaaaccgccaaagggacgaagcagttgaagttagatccatcaatcttcgagtcccttcaaaaggagcgggttgaggccggtgatgttatctatatagaagcgaattctggagcagtgaaacgccaagggagatgtgacacctatgctacagaatttgatttggaggccgaggaatatgtgccacttccaaaaggggacgttcacaaaaaaaaagagatcatccaggacgtgactctgcacgatctagacgttgcaaatgcccgtccccagggaggacaggacattctcagtatgatggggcagctaatgaagccaaagaaaacagaaattaccgacaagctgaggggggaaattaataaggttgtgaacaagtacattgatcaaggcatcgccgaactggtgccaggcgtactttttgttgatgaagtacacatgctggatattgaatgctttacttacctgcatagagcgctcgagtcatcgatcgcgcctatagtgatctttgcaagcaatagagggaactgtgtcatacggggaaccgaagatatcactagcccccacgggattccattggatcttctggaccgcgtgatgattatccggactatgctgtataccccgcaggagatgaagcaggtccttagtgctgcagctgacccaggtcaattagcctgctag

SEQ ID NO: 239496 - DNA, 2502 bp, Artificial Sequence
  Description of Artificial Sequence: Synthetic coding sequence
atggacgtcgtggaccccgacatcttcaatcgggacccacgagaccattacgatctgctccagcgactcggcggaggcacttatggagaagtcttcaaggccagggataaggtatctggcgatcttgtggcgctgaagatggttaagatggaaccagatgatgacgtgtccaccctccagaaggagattctgatcctcaagacttgtaggcatgccaatatcgtcgcgtaccacgggtcttacctgtggttacagaaactgtggatatgcatggagttctgtggcgctggcagcctgcaggacatctatcaggttacaggcagcctgtctgagctgcagatctcatatgtctgcagggaggtacttcagggtcttgcataccttcatagccagaaaaaaattcatagagatattaaaggagccaacatcctcattaacgacgcgggtgaagttcgcctagctgactttggcatctcggcccagatcggggcaacacttgcaagacgcctgagtttcatcggcacaccctattggatggccccagaggtcgccgcagtcgccttgaagggaggctacaacgagctctgcgacatttggagtctgggcatcacagccattgaacttgctgagttgcaaccacctctgttcgacgttcacccactgagagtgctgttcctgatgacaaaatctgggtaccagcctcccaggctgaaggagaaaggaaaatggtcggctgctttccacaattttatcaaggtgacgctcactaaaagtcctaaaaaaagacccagcgcaaccaaaatgctctcacaccagctggtgtcccaacccggactcaaccggggtttgatcctagatttgctggacaagctgaagaaccccggaaagggtccctcaataggtgacattgaagatgaggaacccgaactgccaccggcaatccctcggcgaattcgaagcacacaccgcagcagttccctgggtattccagatgcggattgctgtcggagacacatggagttcaggaaattgcgcggtatggagacccgaccgcctgctaataccgctagattacaacccccacgagacctcagaagctcctcccctcgaaagcagctcagcgagagtagcgacgatgattacgatgatgtggacattcctacaccagccgaggacaccccacccccactgcccccaaagcctaaattccgcagtcctagcgatgagggtcccggtagcatgggtgatgacggccagctgtctcctggtgttttagtacgatgcgcatcgggtccccctcctaactcccctcgacccggaccacctcccagtacgtcctctccccacctgacggctcattcagaaccgagcttgtggaacccccctagccgggagctcgacaagccccctctgctacctcccaaaaaagaaaagatgaagaggaagggctgcgctctgctggtcaagctgtttaatggctgcccacttcggatccattccacagctgcgtggacacatccctcaacaaaagatcagcacctgttactaggggcagaggagggtatcttcatactgaacaggaacgaccaggaggcaacactcgagatgctctttccctcaaggaccacatgggtgtacagtattaataacgtgctgatgtccttgtccggcaagacacctcatctgtactcccactcaatccttggccttttagaacgaaaggaaactcgggctgggaacccaatcgcccacatcagccctcataggctgttggcaaggaaaaacatggtctctactaagatccaggatacaaagggatgccgggcatgttgcgttgcagagggtgcctctagtggcggacctttcctttgcggcgcactggaaacttctgtggttctgctacagtggtaccagccaatgaacaagtttctgctggttcgacaggtactcttcccacttccaactccacttagcgtgttcgccctgttgacaggcccaggtagtgagttgccagccgtctgtatcggcgtgagccctgggcgtcctggtaagtctgtcctgttccacacggtgcggttcggcgcactctcgtgctggcttggggagatgtcaacagaacaccggggtcctgtgcaggtcacccaggtcgaagaagacatggtgatggttctgatggacggtagcgtgaaactggtcacacccgagggctctccagtgcgcggacttaggacacccgagataccaatgactgaggccgtggaagccgtggccatggttggtgggcaactccaagccttctggaaacatggggtccaggtgtgggcactgggtagcgatcaactccttcaggaacttagggacccgacactaacatttcgactgctggggagtccacgcctggagtgctccggaaccatttctccccattgtaatctcctcctgccaggttccagtaattccccagcctccgccagccgcgtcgccggaatcactggactctag

SEQ ID NO: 239497 - DNA, 1257 bp, Artificial Sequence
  Description of Artificial Sequence: Synthetic coding sequence
atggttggacagctcgcggcaaggagagcggcaggggtcgtactggagatgattcgggaagggaagattgccggacgcgcagtcctcatagccggtcagcctggcaccgggaaaaccgctatcgccatgggcatggctcaggctctcgggcctgacacccccttcactgcgatcgccggatccgagattttcagtttggagatgtcaaagactgaagcccttactcaggcgtttagaagaagcatcggagtcagaattaaggaagagactgaaatcatcgagggcgaggtggttgagatccagatcgatcggcctgctacggggaccggttctaaggttggtaagctgacgctcaagaccaccgagatggagacaatctatgacttgggcactaagatgattgaaagtctcacaaaagacaaagtgcaggccggtgatgtgatcactattgacaaggctaccggcaaaatatccaaattgggcagaagctttactcgcgcacgcgattacgatgcgatggggtcccagaccaaatttgttcagtgtcctgacggcgagctgcagaagcgcaaggaagtggtacataccgtgagcctccatgaaatcgacgtcatcaatagccggacccagggcttccttgcactgttttctggcgatacaggcgaaatcaaaagcgaggtgagggaacagattaacgccaaggttgcagagtggcgggaagaaggaaaggccgagatcattccaggggtcctattcatcgatgaagtccacatgctcgatatcgagtccttcagctttttaaacagagcccttgagagcgatatggcccctgtactaatcatggccacaaacaggggcatcacccggattagaggaacaagctatcagtcaccgcacggtattcccattgatcttctcgaccgcttgttgatcgtctccacaacgccctacagcgaaaaggacaccaaacagattttacgtataagatgcgaggaagaggatgtcgagatgtctgaggatgcctacacagtactgacccggatcgggttggaaactagccttcggtatgcgatccagctgattacagctgcttcccttgtatgcaggaaaaggaaagggactgaggtgcaagtagacgacatcaagagagtgtattctctgtttttagacgagtcaaggagcacccaatacatgaaagaatatcaggacgctttcttgtttaacgaactcaagggcgagaccatggatactagctag

SEQ ID NO: 239498 - DNA, 1392 bp, Artificial Sequence
  Description of Artificial Sequence: Synthetic coding sequence
atggctaccgttaccgcgaccactaaggtgcctgaaattcgcgacgtcaccaggattgagcgcattggagcccacagccacatccgtggcttgggcttggacgacgccctcgagcctagacaggcgagtcaaggaatggtgggccaactcgcggcacgcagggccgcaggagtggtgctggagatgatcagagagggcaaaatcgcgggtcgggctgtgcttatcgccggtcagccgggaaccggtaaaacagccatcgcaatgggcatggctcaggctttgggaccagatacaccctttacggctatcgcagggtcagagatattttcactggagatgagcaaaacggaggccttgacacaggcctttcgtcgctccatcggcgtgcggataaaggaagagaccgagatcatcgagggtgaagtggtggaaattcagattgatcggcctgccactggaactggttctaaggtaggaaaactcaccttgaagactaccgaaatggagaccatctatgacctgggcactaaaatgatcgaatcccttaccaaggataaagtacaggctggcgacgtcattaccatagataaggcaaccggtaagatttcgaaactgggacggagttttacacgcgctcgtgattacgatgccatgggctcccagaccaaatttgtgcaatgcccagatggcgaactacagaagaggaaggaggtcgtgcatactgtgtccttacacgagatcgatgtcattaactcccggacccagggcttcctggccctgttttccggtgacactggggaaatcaagtccgaggtgcgagaacagatcaacgccaaggtggcagaatggcgcgaggagggcaaagcagaaatcattcccggagtgctcttcatagatgaagtgcatatgctcgatattgagtctttttccttcttgaacagggccctggagtctgatatggctcccgtcctgatcatggcaaccaatcgcggtataaccagaattcgcggtacatcctatcagtcccctcacgggatcccgattgaccttctagacagactactgatcgtctcaacgacaccttacagtgagaaagatacaaaacaaattcttcgcataagatgtgaggaagaggacgtggagatgtccgaggacgcctacacagttctgactcgcatcggtctggaaactagccttcggtacgctatacagcttataacagctgcttctctggtgtgccgaaagcgcaaaggtacggaagtgcaggttgacgacattaagcgagtctacagtcttttcctcgacgaaagccggtcaacccagtatatgaaagagtatcaagatgcttttttgttcaacgagctgaaaggggagacaatggatacgtcctag

SEQ ID NO: 239499 - DNA, 15102 bp, Artificial Sequence
  Description of Artificial Sequence: Synthetic coding sequence
atgggggacgctgagggcgaggacgaggtccaatttctgaggactgatgacgaggtggtgttgcagtgttccgcaaccgtgttgaaggagcagctcaagttgtgcctggcagcggaaggcttcgggaaccggctgtgctttctggagcccaccagcaacgctcagaacgtgcctccagacctggcaatctgctgtttcgtgctggagcagtctctgtcagtgagggccctccaagagatgttagctaatacggtcgaggcaggcgtggaaagttcccaaggcggtgggcatcgcactctcttgtacgggcacgctatactgctacgacatgcacactcccgaatgtacctgtcctgtttgaccacctccagatcaatgacagataagctggctttcgacgtgggcctgcaagaagatgccacaggcgaagcttgctggtggacaatgcaccctgctagtaaacagcgatccgagggagagaaagttagggtcggcgacgacattattcttgtatcagtatcttcggagcggtatctccatctttctaccgccagcggcgagctccaagtggacgcttccttcatgcagaccctctggaatatgaatccgatctgttcaagatgtgaggaaggttttgtaacaggcggtcatgtgctgcgtctatttcacggccatatggatgagtgcttgaccataagccccgctgattccgatgaccagagaaggctcgtctactatgagggaggtgcagtctgtacccacgctcgcagcctttggcggctagaacctctgcgtataagttggtctggaagtcatctcagatggggacagccactaagagtacgccacgtcaccacaggccagtacctggccctgacagaagaccagggcctcgtggtggtggacgcatctaaggctcacactaaagccacgagtttttgttttaggatctctaaagagaaattagacgtagcacccaagcgcgatgttgagggcatgggcccaccggaaattaaatacggtgaatccctgtgctttgtacagcatgtcgcatccgggctgtggctgacatacgcagcccctgaccctaaagctttgcggttgggcgtcctgaagaaaaaggccatgctgcatcaggaagggcacatggatgacgccctctcactgaccaggtgccagcaggaagagtcacaggccgcacgcatgattcactctacgaacggcttatataaccagttcattaagagcttagactcattcagtggaaagccacgaggatccgggcctcctgctggcaccgccctgcctattgaaggggtgatcctgagcctacaggacctgatcatctactttgagcccccttccgaggacctgcagcacgaggagaagcagagcaaattacggtccctacgcaaccgtcagtctttgtttcaagaggagggaatgctttcaatggtcctcaattgcatcgatcgattaaatgtctatacaactgccgcacacttcgcagagttcgctggagaggaggccgcagagagctggaaggagattgtaaacttgctctatgagcttctggcctccttaatacggggaaatcggtcaaattgtgctttgttcagcacaaacctcgactggctcgttagcaagcttgatagactggaagcatcttccggtatcctggaggtattgtactgtgtgctgatagagagccctgaggtgctgaatattatccaggagaaccacatcaaatctattatttccttgcttgataagcacgggaggaaccataaagtcttggacgtactctgctcactgtgcgtgtgcaatggagtggctgtgcggagtaatcaggaccttatcaccgagaacttgctgcctgggagggagctgctactgcagacaaatttaattaactatgttaccagcattcgcccaaacattttcgtcggaagggctgaaggtaccacccagtacagtaagtggtatttcgaagtcatggttgatgaggtgactcccttcttaactgctcaggcaactcaccttagagttggttgggctctgactgagggatataccccttatccaggggctggggagggttgggggggaaacggagtcggggacgacttatactcgtacggattcgatgggctgcatctctggacgggacatgtggccaggcctgtgacctcccccggtcagcacctgcttgccccagaggatgttatcagttgctgtcttgatctatccgttcccagcataagcttcaggatcaacggatgtccggtgcagggtgtgtttgagagcttcaacctcgatggcctattttttccagtggtatccttcagcgccggtgtgaaggtgcgctttctcctgggaggaagacacggagaattcaagttcttgccaccccctggttacgccccatgccacgaagcagtcctgccaagagaacggctgcacttggagcctattaaggaatatcgccgagaaggccctcgaggtccacacctggtaggtccctctaggtgtctgtcgcacactgattttgtcccatgccccgtggacaccgtgcaaatcgtccttcccccacacctggaacgcattcgcgaaaagcttgcagagaatatccatgagctgtgggccttaaccaggatagaacagggctggacatacggccctgtgagggatgacaataaaagattgcatccatgcctggtggacttccactcccttccagaaccggaacgcaactataacctccaaatgtctggtgagactctgaagaccctcctcgctctaggatgtcacgtggggatggcggatgagaaggcagaggacaacctgaaaaagaccaaacttcctaaaacatatatgatgagcaacggatataaacccgctcccctggatctgtctcacgtgagacttactccagcacaaactacactcgtggacaggcttgccgagaacggccataacgtgtgggccagggatcgggtaggacaagggtggtcttactcggccgtccaagacattcctgccagaaggaatcccagactcgtcccctatcgcctgctggatgaggccactaaacggtcgaacagagattcactgtgtcaggcagtcagaactttgctcggctatgggtacaacatagagcccccagatcaggagccctctcaggtcgagaaccagtcccgctgcgacagagtccgcatctttcgcgcagaaaagagttataccgtgcagtccggccgatggtacttcgaatttgaggcagtcacaacaggagaaatgcgagtcggatgggcgcgtccggagctgaggcctgacgtcgagctgggcgctgatgagcttgcatacgtcttcaatggacatagaggccagcggtggcaccttggctccgaaccgtttgggagaccgtggcagccaggtgatgttgttggctgcatgattgacctgacggagaatacaataatctttaccttaaatggtgaggttctgatgtcagacagcggcagtgagaccgcattccgcgaaatcgagataggcgatggcttccttcctgtatgctccctcggacctggacaggtcgggcatctaaaccttgggcaggacgtgtctagcttacggttctttgccatatgtggcctgcaggagggtttcgaaccatttgctatcaacatgcagaggccggtgacaacctggttctctaaggggttaccccaatttgagcccgtgcctcttgagcatcctcattacgaagtgagcagagtggatggcacggtcgacaccccaccttgcctacgattaacgcaccgcacttggggctctcagaatagcttggtcgaaatgctgtttctgcggctttcactgcctgttcagtttcatcagcacttccggtgtactgctggagctactcccctggccccacccggactgcagcccccagcagaggatgaggcgagggccgctgagccagaccccgactatgaaaaccttcgccgtagcgccggaggctggtctgaggcagaaaacgggaaagagggcacagccaaggagggcgctcctggcggaacacctcaagccggaggcgaggcccagccggctcgagcagaaaacgagaaggatgccaccacagaaaagaataagaaaaggggtttcctttttaaagccaagaaggtcgccatgatgacgcagcctccagcaaccccaaccttgcctcgactgccccatgacgtggttccagccgataatcgggatgatccagagattatactgaataccacaacatactattacagtgttcgggtgtttgcaggacaggagcccagttgcgtgtgggctggctgggtgacacccgattatcaccaacacgatatgtcatttgatctgtccaaggtgcgcgtggtaactgtcacaatgggtgatgaacaaggtaatgtgcacagctccctgaagtgctcaaattgctacatggtttggggaggagacttcgtgagccctgggcagcagggcaggatctcacatacagatctcgtcattggttgccttgtggatttggccaccggcctgatgacctttacagccaacggcaaggaaagcaacacgttcttccaggttgagccaaacaccaaactgttccccgcagtgttcgtgctgccgacccaccagaacgtgatccagttcgagctggggaagcagaagaatataatgcccttgtcagccgcaatgtttcagtccgagagaaaaaatcctgcccctcagtgtccccctagacttgaaatgcaaatgctcatgcctgtgtcctggtcccgaatgccaaaccacttccttcaggtggagactcggagggctggagagaggctgggttgggctgtgcagtgccaagagcctctcaccatgatggccttgcatatacccgaggagaatcgttgcatggacatcttagagctctcagagagactggacctgcagcgtttccattcccacacactgagattataccgggcagtctgcgcacttggcaacaatagggtcgcccacgcactttgtagccatgtagatcaagcccagctgctccacgctctggaggacgcccacctccccggacccctgcgggctggatactacgatttactgatttcaatccatctggaatcagcttgcagaagtcgtcggagcatgttgtctgagtacattgtgcccctcactccagagacacgcgctataacactctttccaccaggcaggtccaccgagaatggacaccccaggcacggtctgcccggtgtaggggtcacaaccagtctccggcctccccaccatttttcacctccatgctttgtggctgcactgccagccgctggggctgcagaagcccctgcgagacttagcccggcaattccactggaggccctgagagacaaagctctccggatgctgggcgaagctgtgcgggacggtggtcaacatgcacgcgatccggttggaggctcagtggaattccagtttgtacctgtcctgaagctcgtgagtactctgcttgtcatgggaatctttggggacgaggacgtgaagcagatcctgaagatgatcgaacccgaggtgtttacagaggaggaagaggaggaagacgaggaggaagaaggcgaggaagaggacgaggaagagaaggaggaagacgaagaggaaactgcccaggagaaggaggacgaagagaaggaggaagaagaggcggctgagggggagaaggaagaagggctggaggaaggtctcctgcaaatgaagcttccagaatccgtcaagctgcagatgtgccacttgctcgaatatttttgcgaccaggagctccagcaccgcgttgagtctctcgcagcattcgccgagaggtacgtggacaaactgcaggccaaccaaaggtcacggtacgggctcctgataaaagctttcagcatgaccgccgctgaaacagctaggaggaccagagagttcagatcccctccccaggagcagatcaatatgctcctccaatttaaggacggaaccgacgaggaggattgtcctctgcccgaggaaattcgacaggatctgctggactttcaccaggatctgctcgcccattgtggaatccagctggacggagaggaagaagagcccgaagaggagactactctgggcagtaggcttatgtctctgctggaaaaagtgaggctggtgaaaaagaaggaggaaaaacccgaggaggagaggtctgctgaggagagcaaacccaggtctttgcaggagctagttagtcacatggttgtgcgctgggcgcaggaggacttcgttcaatctcctgaactcgtccgcgctatgttctccctgctacaccgccagtatgatggcctgggcgagcttcttagggccctcccacgcgcttataccatctccccatcctctgtcgaggacactatgagcctgctggagtgcttagggcagatccgctccctcctgatagttcaaatggggcctcaggaggagaacctgatgatccagtcaatcggaaacataatgaacaataaagtcttttaccagcacccaaacttaatgcgggctctcgggatgcatgaaacagttatggaggtgatggtgaacgttctaggagggggagagtcaaaagaaataagatttccgaagatggtgacttcatgttgtagattcctctgctatttctgccgaatatctcggcagaaccagcggtctatgttcgaccacttatcttaccttcttgaaaactctggaatcgggttggggatgcaagggagtacgcccctagacgtggccgctgcctccgtgatcgataacaatgagctcgcgctggcactgcaagagcaggatttggagaaagtggtctcatatcttgcaggatgcggtctgcagagttgccccatgttggttgcaaagggctacccagatattgggtggaacccttgtgggggagaaaggtatttggactttttgcgcttcgcagtgtttgtaaatggtgagtctgtggaagagaatgcaaacgtcgtagtgaggctgcttattcggaaacctgagtgtttcggaccggcacttcgtggagaaggcggtagtgggctgcttgctgccattgaggaagccattaggatttccgaagaccccgctagagacgggcctggtattcggcgtgatcggagaagggagcatttcggtgaagaaccacctgaagaaaacagggtgcacctgggtcatgcgattatgtccttttacgccgcactcattgatcttttagggaggtgtgcacccgagatgcatcttatccaggctggaaagggggaggcccttcgcatccgcgctattctgcggagtctggtacctctggaggatttagttggcatcatctccctgccgctgcagatccctactcttggcaaagacggagcattagtgcaaccgaagatgtcagccagcttcgtacccgatcataaagcgtctatggtgctgttcctggatcgcgtgtacggcatcgagaaccaggacttcttgctgcacgtactggacgttggattcctgccagacatgagggcagcggcttccttagatacagccacgtttagtacaaccgaaatggcattggcgctaaacaggtatctgtgcttggcagtactgcctctgatcactaaatgcgcccctctgtttgccggaactgaacaccgtgccattatggtggattcgatgttgcacaccgtctatagactgagcaggggacggagcttgaccaaggctcaaagagatgttatcgaggattgcttgatgtcactgtgcagatacatcaggccctcaatgctgcagcacctcctccgcaggctggtgttcgacgttccaattttgaacgaattcgcgaagatgcccctgaagttgttgactaaccattacgaacgctgttggaagtactattgtttaccaacagggtgggctaacttcggcgtgacttccgaagaagagttgcacctcactagaaaactattctggggcatttttgattcattggcccataagaagtacgaccctgaactgtaccgaatggccatgccttgcctgtgtgccattgcaggcgctctacctcctgattatgtcgacgcttcttattcatcaaaagccgagaaaaaagccactgtggatgcagagggtaactttgatcctaggccggttgagacactgaacgtcatcatcccggagaagctcgatagttttattaacaagtttgccgaatacacgcacgagaaatgggcattcgacaagatacagaataattggtcctacggtgagaatatcgacgaggagctcaagacacatccgatgctgcgcccttacaaaaccttctccgaaaaagacaaagagatctaccgatggccgatcaaggagtccctgaaggctatgatcgcatgggagtggaccattgagaaggctcgagagggagaagaagaaaagaccgagaaaaagaagacacgcaagatcagccagtctgctcagacctatgatccgagggaaggatacaacccccagccacctgacctgagcgccgtcacgcttagcagagagttgcaggcgatggctgaacaattggctgagaattaccacaatacatggggcagaaaaaaaaagcaggaactggaagcaaagggaggcggaacccaccccctgctagtcccctacgatactttgacagccaaggagaaagccagggaccgcgaaaaggcccaggagctgctgaaattccttcagatgaacgggtatgctgtgacccggggattgaaagatatggagctggactccagcagcatcgagaagagattcgcatttgggtttttacaacagctgctgcgttggatggatattagccaggagtttatagcccaccttgaagcggttgtttcttccgggcgagtagagaagagccctcacgaacaagagatcaagttttttgccaaaatattactgccattgataaatcagtactttactaaccattgtctgtacttcctttcaaccccggcaaaagtcctgggcagcggcggacacgcctcaaacaaggaaaaggaaatgatcacctccctgttctgcaagcttgcagctcttgtgcggcaccgggtgtccctttttggcacagacgccccagctgtagtgaactgccttcacatccttgctaggagtctggacgccaggacggtgatgaagagtggcccagaaatcgtgaaggctgggttacggagcttctttgagagtgcgtccgaagacatcgaaaagatggtagagaacttgcgattgggcaaggtttcccaggcaagaacccaagtgaaaggggtcggacaaaacctcacatatactaccgtagcactgctgccagtgctcaccactcttttccagcacatcgctcaacatcagttcggagacgacgtcattctagatgacgtacaggtaagttgttaccgaactctttgttctatctactctctgggtaccacaaaaaacacatacgttgagaaattaagaccagcccttggtgagtgtctggcccgtcttgccgcagctatgcccgttgctttcctcgagcctcagctcaacgaatacaacgcttgttcagtctatacgacgaagtccccacgagagcgggcaatcctcggactgccgaacagcgtcgaagagatgtgtccggacatacctgtgctggagcgattgatggcggacatcggcggattggccgagtctggggcacgatacactgaaatgcctcacgtgattgagattacgctgcccatgctctgcagctacctgcccagatggtgggagagaggcccagaagctccgccaagcgccctccctgctggagctcctccaccctgcaccgccgtgacgtccgaccacttgaattccttactcggtaatatcttgcgaattattgtcaataacctcggtatcgacgaggcgtcttggatgaaaaggcttgcagtgttcgctcagccaatcgtcagtcgtgccaggcctgaactcctgcaaagccattttatccctaccatcgggagattgagaaaaagggcgggaaaagtagtgagtgaagaagaacagttgcggctcgaggcaaaagctgaagcccaggaaggcgagttgctcgtcagggatgagttctcagtgctctgcagggacctgtacgcattatatccacttctgatccgttacgtagacaataatagggctcagtggctgacggagcctaacccatctgccgaagagttatttaggatggttggcgagatctttatctattggagcaaatcacacaattttaagcgggaggagcagaatttcgtcgtccaaaatgaaatcaacaacatgtcattccttacggccgacaacaagtctaaaatggcaaaatcagggggatccgatcaggagagaactaaaaaaaagcgcagaggtgatagatattccgtccagacaagtctgatagttgctaccctcaagaaaatgctgccaattgggctaaatatgtgtgcgccaacagaccaggatctcataaccctcgctaagaccagatacgccttaaaggacacagacgaggaggtgagagagttcctacacaacaatctgcacctccagggcaaggttgagggatccccctctctgcgctggcaaatggccctgtatcggggtgtccctgggagagaagaagacgcagacgatcctgagaaaatagttagaagggtccaggaagtgtccgcggtgctttactatttggaccaaaccgaacatccttataaatctaagaaagctgtgtggcacaagctcctgtctaaacagagacgacgggcagtagttgcgtgctttagaatgacacctctgtacaatctccccactcatagggcatgtaacatgttcctggaatcatataaagctgcatggattctgacagaagaccattcatttgaggaccgcatgattgatgatctctctaaggccggagagcaggaggaggaggaagaggaagtcgaggagaaaaaacctgaccccctccaccagcttgtactgcacttctccagaactgcgctgaccgaaaagtccaaattggatgaggactacctctatatggcctatgctgatattatggctaaaagctgtcacctagaggaagggggagagaacggagaggcagaggaagaggtcgaagtgtctttcgaagagaagcagatggaaaaacagcggttattgtatcagcaggctagattacatacacggggtgccgctgaaatggtattacagatgatttcagcctgtaagggggagaccggagccatggtatcatcaacacttaaactgggcatctctattcttaacggtggtaatgccgaggttcaacagaagatgctcgactatctgaaagataagaaggaagtaggatttttccagtcaatccaagcgctgatgcagacatgctctgtgctcgacctcaacgcttttgaacgacagaacaaggcagagggcttaggcatggtgaacgaagacgggaccgtaattaatcgacagaacggagaaaaagtgatggctgacgatgaattcacacaggacctgtttcggtttctacagttattatgcgaggggcacaacaacgattttcagaactacctccgcactcagacaggaaatacgaccaccatcaatatcattatttgcacggtggattacctgcttagattacaggaaagtatatcggacttctattggtactacagcggcaaagacgtcattgaagaacaagggaaacgaaatttttccaaagccatgtctgttgcgaagcaagtgttcaacagcctcactgagtacatccagggcccatgcactggcaaccagcagagcctagctcattctagattgtgggatgctgtggtgggctttctgcatgttttcgcccacatgatgatgaagctcgctcaggattcaagccaaattgaacttctgaaagagttgctggacctgcagaaggatatggtggtgatgttgcttagcctcttggaaggaaatgtggtgaacggtatgatcgctcggcagatggtagacatgctggttgagtcttctagcaacgtggaaatgatccttaaattctttgatatgttcctaaaactgaaggatatagttggctccgaggctttccaggattatgtgacagatcccagaggcttgatatcgaaaaaagattttcagaaggctatggatagccagaagcagttcagcgggccagagatccagtttctgctaagttgttccgaggccgacgagaatgaaatgataaattgcgaggagtttgcaaaccggttccaggagcctgccagggatattggtttcaatgtcgccgttctactgaccaacctgagcgaacatgttcctcatgaccctcggttacacaatttcttagagctggcagaaagtattctcgagtactttaggccctatctgggcagaatcgaaataatgggggcttcacgccgaatcgaacgaatttactttgagatttccgagactaatagagcacagtgggaaatgcctcaggtgaaggagtccaaaagacagttcatttttgacgtcgtcaatgaggggggtgaagcagagaaaatggaactctttgtgagtttctgcgaggacacaattttcgagatgcagatagccgcacagatcagcgaacccgagggggaacctgagaccgatgaagacgaaggagcaggggctgccgaggccggagccgagggtgccgaagaaggagcagccggactggagggcaccgcagcaaccgcagcagctggtgctacagcgagggtggtagccgctgccggtcgcgctctaagaggcctgtcgtaccggagtttacggaggagagtacgcagactgcgacggcttaccgccagagaggccgctacagccgttgcagccttactttgggcagctgtgaccagggccggagcagccggtgctggtgcagccgctggcgctctggggctgctatggggttccctttttggtggaggactagtggagggcgctaaaaaagtaaccgtcaccgaactacttgccggaatgcctgatcctacctcagacgaggtgcacggagagcaacccgctgggccaggcggagatgccgacggcgaaggggcaagtgagggagccggtgatgccgctgagggcgcaggtgacgaagaggaagctgttcacgaggcaggccctggtggtgccgacggcgctgtcgcagtgactgatgggggacccttcaggcccgagggagctggcggactcggagatatgggcgatacgacccccgcagagcctccaacccccgagggcagtcccatcctcaagcgaaagctcggtgtggatggggtggaagaggaactgcccccagagccagagccagagcccgaaccagaactcgaacctgagaaggccgacgcggaaaatggcgagaaggaagaagtaccagaacccacaccggagccgcctaagaagcaggctccccctagcccaccaccaaagaaagaagaggctggaggggaattctggggggaacttgaggtacagcgggttaagttcctcaattatctgagcagaaacttttacacacttcgatttctagctctgtttcttgcatttgccatcaatttcatcctactattctacaaggtgagtgattcgcctcctggcgaagacgacatggaaggctctgctgccggtgatgtgtccggggcaggttctggcggatcgtccggatggggcctgggtgctggcgaagaggctgagggtgacgaggacgaaaatatggtgtactatttccttgaagagtctacaggatacatggaaccagctcttcgctgcctgtccttgctacacacgttggttgccttcctttgtattatcggatacaactgtttgaaggttcccctcgtgatttttaagagagaaaaggagctcgcgcgaaagttagagttcgatggtctgtatattaccgaacaacctgaggacgatgacgtaaagggccagtgggacaggctagtgttgaacactccaagcttccctagcaattattgggacaaattcgtgaaaagaaaggtactcgacaaacatggtgacatatatggccgtgagcgcatagccgagcttctcggcatggacctagccaccctggaaattactgctcataacgagcgaaagcctaacccgcctccgggacttctgacgtggctgatgtcgatcgacgtcaagtaccagatttggaaatttggcgtgatcttcaccgacaattcctttctgtatcttggttggtatatggtcatgagcctccttggacattacaacaatttcttctttgcggcacatcttctggacatcgctatgggtgtgaagaccctgaggaccatattgagttccgtcacgcacaatggcaaacagctggtgatgactgtcggcctgctggcagtggtggtgtatctgtacacagtggtcgcattcaacttctttcgaaaattttataacaaaagtgaggatgaagacgagccggatatgaagtgcgacgatatgatgacttgctatctgttccacatgtatgtcggcgtaagggccggagggggaatcggcgatgagattgaggaccctgccggtgatgaatacgagctctaccgagtggtattcgatatcacattcttcttcttcgtgattgttatcttgctagccatcatccaggggctgattatagatgctttcggcgagctgcgcgatcagcaggagcaggtgaaggaggatatggagacaaaatgcttcatatgcggcattgggtcagattactttgataccacaccccatggcttcgagactcatactctcgaggaacataatctcgctaattatatgttttttctcatgtatcttatcaacaaggatgaaacagagcatacaggccaggagagttacgtgtggaagatgtatcaggagcgctgctgggacttctttcccgctggtgattgcttcaggaaacagtacgaggaccagctgtcataa

SEQ ID NO: 239500 - DNA, 15117 bp, Artificial Sequence
  Description of Artificial Sequence: Synthetic coding sequence
atgggcgatgccgagggagaggacgaggttcagtttctgcggacagacgatgaggttgtgctacaatgcagcgctacagtactcaaggaacagttgaaactctgcctcgccgctgaaggcttcggcaaccggctctgctttctggaaccaacttctaacgctcagaacgtcccgcctgatctggcaatttgctgtttcgtccttgaacagtcactgtctgtccgcgcactgcaggagatgctcgctaacaccgtggaggccggtgtagaaagcagccagggaggtggccacaggactcttttgtacggtcacgccatcctgttgaggcatgcgcattcaagaatgtacctttcttgcttgaccacaagcagatctatgaccgacaagctcgcatttgatgtgggtctgcaagaagatgccactggcgaggcatgttggtggacaatgcacccagcctcaaagcagaggagcgagggagagaaggtacgggtgggagacgacatcatactggtcagcgtctccagcgaacgctacctgcacctgtcaactgctagtggcgaactgcaggtagacgcttccttcatgcagacgttatggaatatgaatcctatttgctccaggtgcgaggaaggttttgtgacaggtgggcacgtcctgcgtctgtttcacggtcacatggatgagtgcctaacaatctcacccgcagattccgatgatcagcgccgactcgtttattatgaagggggagcagtctgtacacatgcacgctcactctggcggctagagcctttgaggatttcctggtcaggatcccatctgaggtggggtcagcctctacgcgtgaggcacgtgacaaccggacagtatctagcactgaccgaggaccaaggactagtcgtcgtggacgcttctaaggcccataccaaagctacatctttctgctttagaatctcaaaagaaaagctggatgtcgcacccaaacgagatgtcgaaggaatggggcctccagaaattaaatacggagaatctctgtgctttgtgcagcatgtcgcaagtggattatggctgacttacgccgcacccgacccaaaagccctccgcctaggagtccttaagaagaaggcgatgctgcaccaagagggccacatggacgatgccctctcgcttactcgctgccaacaggaggagtcccaggctgccaggatgatccattccactaatggcctttacaaccaattcattaagagcctcgattcctttagtggcaagcccaggggttctggacctccagccggaactgcccttcccatcgagggggtaatcctttccctgcaggatctgatcatctattttgaaccaccgtcagaagatctccaacacgaagaaaagcaaagtaagttgagaagtctgcgcaaccgccagtcactattccaggaggaaggcatgctgtcaatggtactcaattgtatcgatcgtttgaacgtgtacactaccgctgcccatttcgctgaatttgcaggagaagaagcagccgaaagctggaaggagatcgtgaacctgctgtacgaactcctcgccagccttattagagggaaccggagcaattgtgcactatttagcacaaaccttgattggctcgtgtctaagctggacaggttggaggcttctagtggcattctggaggtactttactgtgtgttaatcgagtcgccagaagtgctgaatatcattcaagagaaccacattaagagcattattagcttacttgacaagcacggccgaaatcataaagtcttggatgttttatgcagcttgtgtgtttgtaatggagtggcagtcaggtcgaaccaggatttgatcaccgagaacctgcttccaggtcgcgagctactgctacagactaatttaattaactacgtcacttccatcaggcctaacatattcgtcggcagggccgagggaacaacccagtattcgaaatggtactttgaggtcatggtcgacgaggtcaccccgtttctgacagcgcaggccacacatctgcgcgtgggctgggcacttacagaaggctacaccccatatccaggagctggggagggctggggtggaaacggcgttggggatgacctgtatagctatggtttcgatggtctgcatctgtggacaggacatgtggcacggcctgttacttcccctggtcaacacttactagcccctgaggacgtcatttcctgctgccttgacttgtccgttccgagcatcagtttccgcattaacggctgtcctgtgcagggagtgtttgagagcttcaacctggatggcctgttcttcccagtggtgtctttttctgccggtgtcaaggtgcgcttcctcctgggaggccgacatggtgagttcaagttcctaccaccccctggttatgcaccctgtcatgaagcagtcctccctcgtgagcgattacatctggagcctattaaagagtacagaagagaggggcctcggggacctcacctcgtaggaccatcaagatgcctttcccatacagattttgtgccatgcccggtggatactgtgcaaattgtcctccccccacacctggagcgcattcgggagaagctagcagagaatattcacgagctatgggctctaacccgaatagagcagggatggacttacggccctgtacgcgatgataataagcgccttcatccctgcctggtggactttcactcgctgccggagccagagcggaattataatctgcaaatgagcggcgagacgctgaaaaccttgctggcccttggctgccacgtgggcatggctgatgagaaagctgaggacaacttgaagaagacaaaactgccaaaaacctatatgatgagtaacggctacaagccagcccctttagacctctctcacgtgcgcctcactcccgcacagacaacactggtcgataggcttgccgagaatggccacaatgtctgggcgagggatcgtgtgggccagggatggtcatactccgccgtgcaggatatcccagccaggcgtaatccgaggcttgtcccctaccgactccttgatgaggccacaaaaagaagcaacagggattccttgtgtcaggcagtccggacacttttaggatatggctacaacatagagccacccgaccaggaaccctcccaggtggaaaatcaaagccgctgtgacagggtgaggatcttcagggcagaaaagagttacaccgtgcagagtgggagatggtactttgagtttgaggccgttacgaccggcgagatgcgggtgggctgggctagaccagagttgcgacccgacgtcgaactgggagccgacgagctggcatatgtcttcaatggccacaggggccagcgctggcacttggggtcagagccctttgggaggccttggcagcctggcgacgttgttgggtgcatgattgacttaactgagaacaccatcatctttacattgaacggcgaggtgctgatgtcagacagcggtagtgagactgctttccgcgaaattgaaatcggtgatggttttctaccggtgtgcagtctgggaccaggccaggtcggccacctgaacttaggacaggacgtctcctctctcaggttcttcgctatctgcggtctgcaggaagggtttgaaccctttgctataaacatgcagagaccagtcactacatggttcagtaagggcctcccacaatttgagcctgtgcctttggaacaccctcactacgaggtgtctcgggttgatgggactgtcgacacacctccttgtctgcgcctgacccacagaacctggggctcccagaacagtcttgtggagatgctgtttctgagactcagcttgcccgtccagtttcaccagcactttcgctgcaccgccggagccaccccgctagctccacctggcctccagccaccggctgaggacgaggccagagccgctgaacctgatcctgactatgaaaacctgaggcgtagcgctggagggtggtctgaagcagaaaacggaaaggagggcaccgcaaaagaaggggctccaggcggtaccccccaggccggtggggaggcccagcctgctcgggcagagaatgagaaggatgccacaactgagaagaacaagaaacgaggcttcctgtttaaggctaaaaaggtggctatgatgacacagccacccgcaactccaacactcccgagactcccccacgacgtcgtaccggcagataacagagacgatcctgaaattatcctgaatacgaccacctactactattcagtcagagtgttcgctggtcaagagcctagctgcgtctgggctggatgggtgacccctgattaccaccaacatgatatgtcatttgacctctccaaggtcagggtggtgaccgtaaccatgggggatgaacagggaaatgttcacagttccctaaaatgttccaactgttacatggtgtggggaggggactttgtgagccctgggcagcaaggtaggatctcacacaccgatctcgtcatcggatgcctggtggacctggcaactgggctaatgacctttacggccaacggtaaggaatccaatacgttttttcaggtcgaaccgaataccaaattgttccccgctgtcttcgtgcttcctacccatcaaaacgtgattcagttcgagctggggaagcagaagaacatcatgccattatccgctgcaatgttccagtctgaacgcaagaacccagccccacaatgtccccctagattggagatgcagatgctgatgcctgtgtcttggtctaggatgccgaatcacttcctccaggtcgagacccggcgtgcaggtgaaagactcggatgggctgtccaatgccaggaaccgcttaccatgatggcactgcatattccagaagagaatcgttgcatggacatactggagctgtccgagcgtctggacttgcaaagattccactcgcatacactgcggctctatcgcgctgtgtgtgccctggggaacaacagggtcgcacacgctctctgtagccatgtggatcaagcgcagctgcttcacgcgctggaagacgcacatctcccaggacccttgcgtgccggttactacgacctgctcatctctattcacctggagtccgcgtgcagatcgcgtagatcaatgttgtctgagtacatagtaccactaacccctgagacacgagctatcaccctgtttccacccggacgaagtaccgaaaacggccacccacggcacgggctgcctggggtgggcgtgactaccagcctgcgtcctcctcaccacttcagcccaccctgcttcgtggccgcacttccagccgcaggcgctgctgaggcaccagccagattgtctcctgccattcccctagaggctttgagggacaaagccttgagaatgctgggagaggccgtacgggatggaggtcagcatgcaagagatccagttggcggatccgttgaattccagttcgttcccgttctcaagctcgtgagcaccctgctggtgatggggattttcggcgacgaggatgtgaaacagattctcaagatgattgagcccgaggtgtttactgaagaagaggaggaagaggacgaagaggaggagggagaggaagaagatgaagaagagaaggaggaggacgaggaggaaacagctcaggagaaagaggacgaggagaaggaggaggaagaagcagctgagggggaaaaggaggaaggcctagaggagggtctgctgcaaatgaagctgcctgagtctgtgaaacttcagatgtgccaccttctagagtatttctgcgatcaagagctgcagcatcgtgtggagtctctcgccgcatttgctgaaaggtatgtcgataaactccaggctaatcagaggtctcgctatggtctcctgatcaaagctttctccatgaccgcggcagagacagccaggcggacccgagagttccggagcccgcctcaggagcaaatcaacatgctgttgcagttcaaggatggaactgacgaagaggactgtccactacctgaagagatccgccaggacctcctcgactttcatcaagatctgctcgcgcactgcggaattcagctggatggggaggaagaggagcctgaggaagagacgaccctggggagccgtctgatgagcctactggagaaggtccgattagtaaagaagaaggaggagaagcccgaagaggaaagaagtgccgaggaatctaaacccagaagcctacaggaattggtgtcccatatggtggtccgctgggctcaggaggatttcgtacagagtcctgagctggtgagagccatgttttcactgttacatcggcagtacgatggactgggagagctactgcgggctctccctagagcctacaccatctctccttcctccgtcgaagacacaatgtctctcttggagtgtctcggccagattagaagcttgctgatcgttcagatgggccctcaggaggaaaacttaatgattcagtccatcggaaacatcatgaacaacaaagttttttaccagcatcccaacctgatgagagctctggggatgcacgagacggtaatggaagttatggttaatgttctagggggtggggaatcaaaggagatcagatttccaaaaatggtgaccagttgttgtcgctttttatgttacttctgccggatctctcgccagaatcagcggtctatgttcgaccacctatcttatctgctcgagaattccggaattgggctgggtatgcaaggaagtactcccttggatgtggctgcagcaagtgtaatcgacaataacgaactggcactggccttgcaagagcaggatctggagaaggtagtctcctacctcgctgggtgcgggttgcagtcttgtcctatgctcgtcgctaaaggatatccagacattggatggaacccttgcggaggcgaaagatatctggatttccttcgatttgctgtgttcgttaatggggagtctgtcgaggaaaacgccaacgtagtcgtgaggctcctcattcggaagcctgaatgtttcggacctgctctgagaggggaaggcggttccgggctgttggccgcaatcgaggaggctattcggatcagtgaggaccccgcacgggatggccctggtatccggcgtgaccgaagaagggagcactttggcgaggaacctccggaagagaaccgggtccacctcggccatgcaatcatgtcgttttatgccgcacttattgatctgctaggaagatgtgcaccagaaatgcacctcatacaggcaggcaagggggaagctctacggatccgagctattctgagaagcttggtgcctctggaggatctagttggaatcatctctttacccctgcagatcccaaccctgggcaaagatggggctctggtgcagcctaagatgtctgcttcttttgtgcccgatcacaaagccagcatggtgttatttctggaccgcgtttacggcatcgagaaccaggatttccttctgcacgtgctggacgtaggctttctgccggatatgcgcgctgctgcttcccttgatacagccacctttagtactactgagatggccctcgcactgaacaggtatttgtgcctggcggtgctcccactgatcactaaatgtgcacctctattcgcgggaacggagcaccgcgcaatcatggtcgattctatgctgcataccgtctacagactgagtcgcggacggagcctgactaaagcccagcgggacgtgattgaggattgcttgatgtctctatgccggtacattcgcccaagtatgttgcagcatttgttgagacggctggtgttcgatgttccaatcctcaacgagttcgctaagatgccgctgaagttgctgacaaaccactacgaacgatgctggaaatactactgtctgcctacagggtgggcgaatttcggagtcacatcggaggaggaattgcacctcactcgcaaactgttctggggtatcttcgattcacttgctcacaagaagtatgatccagagctgtatcgtatggccatgccatgtttatgtgccattgccggtgccctaccgcctgactacgtggacgcatcctactcaagtaaggctgagaaaaaggctacggtagatgcggaaggtaatttcgaccccagacctgttgaaaccctgaatgtaattattcccgagaaattggactcctttatcaacaagtttgcagagtacacacacgagaagtgggccttcgataagatacaaaataattggagctacggggaaaacatcgatgaagaacttaaaacccacccaatgctacgaccctacaagaccttttccgagaaggataaggaaatctatcggtggcctatcaaggagtcactgaaggccatgattgcctgggaatggacgattgagaaagccagagagggcgaggaagaaaagaccgagaaaaagaaaacgagaaagatttcccagtccgcccagacgtatgaccctagggaaggatataatccccagccacccgacctctcggctgtgaccctgtccagagaactacaggcaatggccgaacagctagctgagaactatcacaacacatggggaaggaaaaagaaacaggaactggaggcaaaggggggtggaacccatcctctgctggtcccgtatgacacactgacggcaaaagaaaaggccagggaccgggaaaaggcccaagaactgctcaaattccttcagatgaatggatatgccgtgacccggggtctgaaagacatggagttagattcaagctccattgaaaagcgctttgcttttggctttctccagcagctgctgcgctggatggatatatcccaggaattcatcgcacatttagaggccgtggtttccagcggcagggttgagaaatcgccccacgaacaagagatcaaattctttgccaaaatcctgcttccactcataaatcagtactttacaaatcactgtctgtatttcttgtcaacccccgctaaggtgctgggttctggaggtcacgcgagcaacaaggagaaagaaatgataacttcgttattttgtaagctggccgcattggtccgtcacagggtgtccttgtttggtaccgacgctccggcagtggtaaattgccttcatattctggctcgatctcttgatgcgaggacggtcatgaagagcgggcctgaaatcgtaaaggcgggtttgcgcagtttcttcgaatcagcatcagaagacatcgagaagatggtggaaaatctgcgtcttggtaaagtatctcaagcccgtacccaggtcaaaggcgtgggacagaacctgacttacaccaccgttgctctactgcctgtgctgactacactttttcagcacattgctcagcatcagttcggggatgacgtgattctggatgatgtgcaggtgagctgttacaggacactgtgctctatatactcgctgggaacgactaaaaatacttatgtcgagaagctgcggccagccttgggggagtgtctcgccaggctggccgctgctatgccagtcgccttcttagagccccagctgaatgagtacaacgcatgctcagtctacacaacaaagagccctcgcgagagggctattctggggctgcccaactcggtggaggagatgtgtccagacatacccgttctggagcggctgatggctgatatcggaggattggccgagtccggcgcacgctacacagagatgccccatgtaattgagataactctccccatgctatgtagctatctgccgcgatggtgggagagaggccctgaagcacccccatccgccctcccagccggagcgccacccccttgtacagcagtgacgagcgaccatcttaattctttactgggaaacattctgcgcatcatcgtgaacaacctgggcatcgatgaagctagttggatgaaaagattagcggtgttcgcacagccaattgtctcaagagcgagacctgaactgctgcagtcacacttcatcccaactatcggccgtctcagaaagagagccggaaaagtggtcagcgaggaggagcagctgagactcgaagctaaggcagaggcacaggagggtgagctgctcgtcagggatgagttttctgttttgtgtcgggatctttacgccttatatcccctgctcatccggtacgttgacaataaccgggcacagtggttgaccgagcctaatcctagcgcggaggagctttttcggatggttggggaaatctttatctactggtctaaaagccataatttcaagcgggaagaacagaactttgtcgtccaaaatgagataaacaatatgtctttcctcacggccgacaataagagtaaaatggcaaaggccggagatatacaaagtgggggaagtgaccaagaaagaacgaaaaaaaaaagacgcggtgaccggtattctgtgcaaactagtcttatcgtcgctacactgaaaaaaatgctgccaatcggattgaacatgtgcgcaccaactgatcaggatctcatcacactggccaaaacccgctacgcgctgaaagataccgacgaagaagttcgcgaatttcttcacaataacctgcatctccagggcaaggtggagggtagcccttccctacgctggcagatggcactgtataggggtgtccccggaagggaagaggatgccgacgacccggaaaaaattgtgcgcagagtgcaagaagtgtccgccgtcctgtattacctagatcaaaccgagcacccatacaagtctaagaaagcagtatggcacaagctgttatcaaagcagcgcaggagggcagtggtggcatgtttccggatgacccccctgtataacttgcccacccaccgtgcttgtaacatgtttctggagtcctacaaagcagcgtggatacttaccgaagaccactcttttgaagacagaatgatcgatgatctctcgaaggccggagaacaggaggaggaagaagaagaagtggaggagaagaagcccgaccctcttcaccagctggtcctgcatttcagcaggactgccttgacagagaaatctaagctggacgaagactacctgtacatggcatatgcagacattatggcaaaatcttgtcacctggaggagggcggagaaaacggcgaagccgaagaagaagtagaagtttccttcgaagaaaaacagatggaaaaacagcgcctcctgtaccagcaggcacgacttcacactagaggagctgcagaaatggtgctccagatgattagtgcatgtaagggcgagactggggctatggtatcctccacactcaaattgggtattagtatactgaatggcggtaacgcggaagtccagcagaaaatgttggattacctgaaagataagaaagaagttggcttctttcagagcattcaagcattaatgcaaacatgcagcgtactggatctgaatgcattcgagagacaaaataaagccgaagggcttggcatggtgaacgaagatggcactgtgattaatcggcagaacggagaaaaggtgatggcagacgacgaattcacccaggacctctttcgtttcctgcagcttctctgtgagggccataacaacgattttcagaattatctgcggactcagacagggaacacaaccactatcaacattatcatttgtacagtggactacttgcttcgcctgcaggagtcgatatcggacttctattggtattattccggtaaagacgtgatcgaggagcagggcaaaagaaacttctcaaaggcaatgagtgtggcaaagcaggttttcaattccctcaccgagtatattcaaggaccatgcactggtaaccaacagtcactggcccactcccgactgtgggacgctgtcgtcggtttcttacacgtgtttgcccatatgatgatgaagcttgcccaggattctagccagatcgagctgttaaaggagttgcttgacctgcaaaaggacatggtggtcatgctgctgtccctcctggaaggcaacgtcgtcaatgggatgatagccaggcagatggttgatatgctcgtagaaagttcatccaatgtcgagatgattctcaagttctttgatatgtttctaaagctgaaagatatcgtgggaagtgaagctttccaagattatgtgacggaccctcgcggtttgatcagcaagaaagatttccagaaggctatggactcccagaagcagttcagcgggcctgagatccagttcctgctgtcatgttctgaagctgatgaaaatgaaatgattaattgcgaagaattcgctaaccgattccaggaacccgcaagagacatcggattcaacgtggccgtccttctgacaaatttgagtgagcatgtgccccacgatccccgactccataattttttagaattggcagaatcgattctggagtatttcagaccttatctgggcaggattgaaattatgggagcctcccgcaggatagagagaatttattttgagatcagtgagacaaacagagctcagtgggagatgcctcaggttaaagagagcaaaagacaattcatttttgatgtcgtaaacgaaggaggcgaagccgagaaaatggaacttttcgtcagcttctgcgaagacaccatctttgagatgcaaatagccgcacaaattagtgaacccgaaggcgaacccgagacagatgaagatgagggagcaggtgctgcagaggcaggggctgaaggagccgaggaaggagctgctgggctagaaggtacagccgctacagccgctgctggggcaacagccagggtggtggcagctgccggtcgggcactccgcggactgagctaccgcagtttaagaaggcgtgtgcggagacttagacgcctgacagcccgtgaagctgccaccgccgttgcagctctgttatgggccgctgtgactcgcgctggcgctgccggagctggcgctgctgctggcgctctcggactcctttggggaagccttttcggaggcggactcgtggagggagccaaaaaggtgaccgtaacggagctcctcgcaggcatgccagacccaactagcgacgaggtgcatggtgagcaaccggctggccctgggggtgacgctgacggtgagggtgcctctgaaggcgctggagatgcagctgagggtgcgggtgatgaagaggaggctgtgcacgaggctgggccagggggagcagacggagcggttgccgtaacagatggtgggccttttaggccagagggggcaggcggtctgggggatatgggcgacactaccccggctgaaccaccaacccctgagggctcccctatcctgaaacgcaagctgggagtagatggcgtggaggaggagctgcccccagaaccagagcccgagccggaacccgagttagagcctgagaaagcggacgcagagaatggcgagaaggaagaggtccctgagcctacccctgaaccacccaagaagcaagcccctccctccccccctccgaaaaaagaagaggccggaggggagttttggggggagttggaagtgcagcgggttaagtttctcaactatctgtcacgaaacttctataccttaagatttttagcgctatttctggcatttgcgattaattttatcctcctgttctacaaagtgtccgactctcctccgggtgaggatgatatggaaggctctgctgctggtgatgtgtctggagctggtagtgggggaagcagcggctggggcttgggagctggggaagaagccgagggggacgaggacgagaatatggtttattacttcctggaggaatcaacaggctacatggaaccagctctgcgctgcctatctctgctgcacacactcgtggccttcctttgcataatcgggtacaattgcctcaaggtccctttggtcattttcaagcgtgagaaggagctagctaggaagctggagttcgacggcctctacatcacagaacagcctgaagatgatgacgtcaagggtcagtgggacagactcgtacttaataccccgtccttcccaagtaattactgggataagttcgtcaagcgcaaagtgcttgacaagcacggcgacatttacggaagagaacgaattgccgagctgctgggaatggatctggctactctggagataaccgcccataatgagagaaaacctaacccaccccctggcctactgacctggctgatgtcaattgacgtgaaataccagatatggaaatttggggtcatatttaccgacaattctttcctttatctggggtggtacatggttatgagtcttctaggacactataataacttcttctttgcagcccacctactggacatcgccatgggagttaagactctgaggactatcctttcaagtgtgactcataacggcaagcagctggttatgacagtgggtctgttggccgtggtggtgtacctgtatacagtggtggccttcaatttttttagaaagttctacaacaagagtgaggatgaggatgaacccgatatgaagtgtgatgatatgatgacttgttacctgttccatatgtacgtgggcgtgcgagcagggggaggcatcggggatgagatagaagatcctgctggcgatgaatacgaactgtaccgcgtcgtttttgatatcacattcttcttttttgtcatcgttatattgctggctattatccagggcctgatcatcgatgccttcggtgagctgagagaccagcaggagcaggtgaaagaggacatggaaaccaaatgctttatttgtggaatcggtagtgactactttgacactacgccccatggcttcgagacccatacactggaagagcacaacctggctaactatatgtttttcttgatgtacctgattaataaggacgaaacagaacacaccggccaggagtcttacgtgtggaaaatgtaccaagaacgctgctgggacttcttcccggctggcgactgcttcaggaagcagtacgaggatcaactctcttaa

SEQ ID NO: 239501 - DNA, 15102 bp, Artificial Sequence
  Description of Artificial Sequence: Synthetic coding sequence
atgggggacgctgagggcgaagatgaagtgcaattccttcgaacagacgacgaggtggttctacagtgttccgccaccgtgctgaaggagcagctgaagctgtgccttgctgccgagggtttcggcaacagattgtgtttcctggagcccacttccaatgcacagaacgtgccccctgatttggccatctgctgctttgtgttggagcagtcccttagtgtgcgggcactgcaggagatgttagctaataccgttgaggccggtgttgagagttcccaaggcggaggacatagaaccttgttgtacgggcatgccattctgttgagacacgcgcactctagaatgtacctatcttgcctgacgacatctcggtcgatgacggataagctggcttttgacgtgggtctgcaggaagatgccacaggcgaagcctgctggtggaccatgcacccggcaagcaagcagagatccgagggtgagaaggttagggtcggagatgacatcatcttggtatccgtgagctcggagaggtacttgcacctgtccaccgcttccggcgagctccaagttgatgcatcatttatgcagacattgtggaacatgaatccaatttgtagtagatgtgaggaggggtttgtcaccggtggccacgtcttgcgtttgttccacgggcatatggacgagtgtctcacaatctcccctgccgactcagatgaccaacgcagactggtgtactatgaaggaggcgctgtatgcacacacgcacgctccctttggaggctggagccactaaggatatcctggtctggatcccatcttcggtggggacaacctctgagagtccggcacgttacgactggccaatatttggccctcaccgaggaccaaggactagtcgtggtcgacgcaagtaaggcccacaccaaggccacttctttttgtttcagaatctcgaaggaaaaactcgacgtggcacctaagcgtgacgtcgaaggcatggggcctccagaaatcaaatatggagaatctctgtgctttgtgcagcacgtggcttccggtctgtggcttacatacgccgcacctgaccccaaagcactgcggctgggcgtactcaagaagaaggcaatgctacaccaggagggtcatatggatgatgcactaagcctgacccgttgccaacaggaagagagccaggctgctcggatgatacacagtaccaatggattatataaccagttcattaaaagcctggacagcttttcaggcaaaccgcgaggtagcggcccacctgcaggaaccgcgctacccattgagggggttatcctgagcttacaggacttaataatctacttcgagcccccaagcgaggacctgcagcatgaagaaaaacaaagcaagcttaggagcctcaggaaccgtcagagcctctttcaggaagaagggatgctgtccatggtgctgaattgtattgaccggttaaacgtctacaccactgctgctcacttcgccgaattcgccggagaggaagctgccgagagctggaaggagatcgtcaaccttctgtacgagctacttgcaagcctcattcggggtaatagatctaattgcgcactgttctcaaccaatctggactggttggtgtcaaagcttgatcgtctcgaagcctctagtggtattctcgaagtattgtattgcgtgctgatcgagtccccagaggtcttgaacatcatccaagaaaaccatatcaagtccataatatcactactggacaagcatggtcgaaaccataaggtgttggacgtgctgtgtagcctgtgtgtgtgtaacggcgtcgcggttcgatcgaatcaggaccttataacagaaaatttgcttccgggtcgcgagctcttattgcagacgaacctcatcaactacgtgacaagcatccggcctaatatcttcgttgggagggccgaggggacaactcagtatagcaagtggtactttgaagtcatggttgacgaggttacccctttcttaacagcacaggccactcatcttcgcgtgggatgggctcttaccgaaggatataccccgtaccccggtgcaggcgaggggtggggcggaaacggagtgggagatgacctttactcctatggcttcgatggcctccacctgtggacaggccacgttgccaggccggtgacaagcccgggtcagcacttgctggcgcctgaggacgtgatctcttgttgtcttgatttatcagtgccctccatctcattccgcatcaatgggtgccccgttcagggagttttcgagtctttcaacttggatggcctgttcttcccagttgtctctttctctgcaggcgttaaagtgaggtttctactgggtggccgacacggcgagttcaagttcctccctccgccagggtatgccccttgccatgaggctgtgctgcctcgcgaaaggcttcacctcgagcccatcaaggagtatagacgggagggccctagagggccacacctagtaggacctagtcgatgcctgagccacaccgatttcgtgccttgtccagtagatacagtgcagatagtactgccaccacatttggaacggatccgggagaaactggctgaaaatattcacgaactgtgggctttaacccggattgagcagggctggacgtatggccctgtgcgggacgataataaacgactgcatccatgtctggttgactttcactcactgcctgagcccgaaaggaactataacttgcagatgagtggcgagaccctcaaaactctgttagccctggggtgtcacgttggcatggctgatgaaaaggccgaagacaatctcaagaagacaaagctccccaagacctacatgatgtccaatggttataaacccgctcccctggacctttcccacgttagactgaccccagctcagacgacgctggtggatcgcctggccgaaaacggccataatgtttgggccagagatcgtgtagggcaggggtggagttacagcgccgttcaggatatcccagctcgtcggaatcccaggctagttccttataggctcctagacgaggcaacaaagaggtccaaccgcgattccttgtgccaagcagtcagaaccctactggggtatgggtataacattgaaccgcctgatcaggaaccatcacaggtcgagaaccaaagcagatgcgacagggttaggatcttcagggccgaaaagtcctacaccgttcagtctggccgatggtattttgagttcgaggccgtcaccacaggcgaaatgcgagtggggtgggccagacccgagctgcggccagacgtagaactcggagctgacgaattagcctacgtcttcaatgggcatcgtggccagcgttggcatttgggcagtgagccttttggcagaccatggcagcctggggatgtcgtgggctgcatgatcgacctgaccgaaaatactatcatcttcacccttaacggagaggttctgatgtcagacagcgggtctgaaaccgctttcagagaaatagagattggcgacggtttcctgcccgtttgtagcctaggcccaggacaggtgggccacctgaacctggggcaggacgtatcatccctcagattctttgccatttgtggcctgcaggagggctttgaaccatttgctatcaacatgcaacggccagtaacaacctggttctctaagggactcccacaattcgaacccgttccactcgagcacccccattacgaggtgagtcgggtggacggtacagtcgatacccccccttgtcttcgcctaacacatcgcacctgggggagccagaacagtctcgtcgaaatgcttttccttcgcctgtccctccccgtgcagttccaccagcatttccgctgtacggccggagccacacccttagccccacccggactgcagcctcccgctgaggacgaggccagagctgctgagccagatcccgattacgaaaaccttcgcagaagcgccggaggatggagtgaggcggaaaacggcaaggaaggaaccgcaaaagagggcgcaccaggcggaacaccgcaggctggcggtgaggcacagccagccagagccgaaaatgaaaaagacgccacgacagaaaagaataagaagcggggattcctgttcaaggctaagaaggtcgcgatgatgacacagcccccagctactcccactctccccagactgccccacgacgtcgtgccagctgacaatagggatgaccctgagatcatcctgaacactaccacctattactacagcgtgagagttttcgcgggtcaggagcccagttgcgtctgggccggttgggtgaccccagactaccatcagcatgatatgagttttgatctctctaaggtgcgcgtagtgaccgtcacaatgggcgatgagcaggggaacgtacattcctctcttaaatgttccaactgctacatggtttgggggggagactttgtgtctccaggacagcaggggaggatctcccacaccgacctcgttatcggatgtctggtggacctcgcaactggcctgatgacattcactgcaaatggcaaggagtctaacacttttttccaggtcgaaccaaacaccaagctgttcccagccgtgtttgttcttccaacccatcagaacgtgattcagtttgaactgggtaagcagaaaaacattatgccccttagtgcagctatgttccaatccgagaggaagaatccggcacctcaatgtccccctcgcttggagatgcagatgctgatgcccgtcagctggtctcggatgcctaatcatttcctgcaggttgagacccggagagcaggagaacgcctaggatgggcagtgcagtgtcaagagccattgactatgatggcactccacatcccagaggagaatcggtgtatggacatactggaactgagcgagcgccttgacctgcagagattccattctcataccctgcgcctctatagggctgtgtgtgccctgggcaacaatagagtcgcacacgcactgtgctcacatgtcgaccaggctcagttgctccacgcgcttgaagatgctcaccttccagggccactgcgggcaggatactacgacttactgatttctatacatctggagtcagcctgcagatcccgacggagcatgctctcggagtacattgttccactcacacccgagactagagctattaccctctttccacccggtaggtccacagaaaacgggcacccccgacatggcctgccgggagttggggtaactactagcctgcggcctccacaccacttttctccgccttgtttcgttgcagccttacctgccgctggcgctgccgaagcacccgctcgcctttctcctgccatccctctggaggccctccgcgacaaagctttgaggatgctcggagaggcagtgcgagatgggggtcagcatgccagggacccagtgggcggatctgtggagtttcagttcgtccccgttctgaagctggtttccacactgctcgttatgggcattttcggggacgaagatgtgaaacaaatcctaaagatgatcgagccagaagtctttaccgaggaagaagaggaggaggatgaagaggaagaaggcgaggaagaagacgaggaagaaaaggaagaagacgaagaggagacagcacaagagaaggaggacgaagaaaaagaagaagaagaggcagcggaaggggagaaggaagagggtttggaagagggtctgctgcagatgaaattgcctgaatccgtgaagttgcagatgtgccatctcttggaatacttctgtgatcaggagctgcaacatcgggtcgagtccttagcagcatttgccgagcggtacgtggataaacttcaggccaaccagcggagtagatatggcttactaattaaggccttctccatgaccgcagctgaaacagctcggcgaactagggaattccgctcgcccccacaagagcagattaacatgctcctgcagtttaaggacggtaccgatgaggaggattgccctttgcctgaagaaataagacaggacctgctcgacttccaccaggatctcctggcacactgtgggatccagttagatggagaggaagaagagcccgaagaagagaccacactagggtcaagactgatgtccctcctcgagaaggtgcgattggtcaaaaagaaggaagaaaaacccgaggaggagagatcagcagaggaaagcaaaccccgaagcctgcaggagctggtgtctcatatggtggtgaggtgggcccaggaggatttcgtgcagtcacccgagctggttcgggcaatgttctctctgctgcatagacagtacgacgggctgggcgagctgctgcgagcacttccaagagcatacactatttcgcccagcagcgtcgaggacaccatgagtttactggagtgtctgggccagatccggagcctgcttatagtgcaaatgggtccccaggaggaaaacctgatgatacaatctattggaaatattatgaacaataaggtcttctaccagcatcccaatctgatgcgtgcacttggcatgcacgagactgtgatggaggtaatggtcaacgtcctgggcggtggcgagtcaaaagaaatccggttccctaagatggtgacgtcctgttgcagattcctttgttatttttgcaggatctctcgtcagaaccagaggtctatgttcgatcatctcagctacttgctagaaaattccgggattggcctgggaatgcagggctctactccattagatgtggccgcagcatccgtgatagacaataatgaacttgcgcttgccttacaggaacaggatctggagaaggtagtgtcgtacctcgccggatgtggcctgcagtcgtgtccaatgctggtcgccaaaggctatcctgacattgggtggaatccctgcgggggtgaaaggtatctcgatttcttgcggtttgccgtgttcgtgaacggtgagagtgtggaagaaaacgctaatgtagtagtgagattgttaatccgaaaaccggaatgtttcgggccagccttgcgaggcgaggggggatcggggctcctcgcagcgattgaggaagcaatcagaattagcgaagatcccgcacgggacggcccaggcatacggagagatcggcgaagagagcacttcggtgaagaacctccagaagagaaccgggtacatttgggacacgccataatgtctttctacgccgcattaatagacctgctcggaagatgtgccccagagatgcacctgattcaggccggtaagggcgaagcacttagaatacgcgctatcctaaggtccttggtccctctcgaagatctcgtgggcattatctcactccccttacagattccaactttggggaaagacggcgcactggttcaacctaagatgtctgcatcttttgtgccggaccacaaggcaagtatggtgctcttcttagatcgagtgtatgggatcgaaaaccaagatttcttgctgcacgtgctggacgtgggttttctacctgacatgagggctgccgctagcctggacaccgctaccttctcaactaccgagatggcattagcacttaatcggtacctgtgtcttgccgtgctccctctaataacaaagtgcgcaccattgttcgccggtaccgaacatagagcaattatggttgactctatgctccacactgtctacagattgtccagaggcaggagcttaactaaagcccagcgggatgtaatcgaggattgcctgatgtccttgtgtcgttacatcagacctagcatgctgcaacacctgcttagaagactggtctttgatgttccaattttaaacgaattcgccaaaatgcctctgaagctccttacaaaccattacgagcggtgttggaaatattattgcctacccacggggtgggctaatttcggcgttacatcagaagaagagttgcacctgacacgcaaactgttttgggggatattcgattctttggcccacaagaaatatgaccccgagctctatagaatggccatgccgtgcttatgtgcgattgcaggtgctctgcccccagattatgtcgatgcctcttacagtagcaaggcagaaaaaaaggccacagtcgatgctgaaggaaattttgacccaaggcctgtcgagaccctcaacgtcattatccccgaaaagttggactctttcataaataaattcgcggagtatacacacgagaaatgggcatttgataagattcaaaataattggagttacggcgagaatatcgatgaagagctcaagacccaccctatgctccgaccttataagaccttttcagagaaggacaaagagatttatcgctggcccatcaaagaatcactgaaggccatgatagcttgggagtggaccatcgaaaaggccagggagggagaggaggaaaagaccgagaaaaagaaaaccaggaaaatttcccagtctgcccagacctacgaccccagagagggctataatcctcaaccaccagacctgagcgccgtgactctgtctcgagagttgcaggccatggccgaacagctcgcagagaattaccataatacatggggtcgaaagaagaagcaggaattagaagccaaaggcggaggaacacatcctctgctggttccatacgacaccttgactgcaaaggagaaagctagggacagagaaaaggcacaggagctcctcaagtttctgcagatgaacggttacgccgtaaccagaggactcaaggatatggagctggactcttcgtccattgaaaagcgctttgctttcggattcctacaacaactgcttcggtggatggatatctcccaggaatttattgcacatctcgaggcggtagtcagctctgggcgtgtcgagaagtcccctcacgagcaagaaatcaagttcttcgccaagatactcttgcctctaatcaaccagtactttactaatcattgcctgtatttcctgtctacccccgctaaggtcctgggctccggcggacatgcttctaacaaagaaaaagagatgattaccagcctgttttgcaagctcgcagccttagtgaggcatagggtctcacttttcgggactgatgcaccagccgtggtgaattgtctccatatcctggcaaggagcctggacgcacgcaccgtaatgaaatctggaccagaaatcgttaaggctggcctgcgtagcttttttgaatccgccagcgaggacatagaaaagatggtagagaacttaagactgggtaaggtgtcacaggcccgaactcaagtaaagggagtcggacagaacttgacctatacaactgttgccctgctgcccgtgctgacaacgctctttcagcacatcgctcaacatcagtttggggacgacgtgatcctggatgacgttcaggtaagttgctataggactctgtgttccatttattctttgggaacgaccaaaaacacctacgtggagaaactgagaccagctctgggagaatgcctggcccgactcgctgccgcaatgccagtagcttttctcgagccgcagctgaatgaatataatgcatgttcagtatacacgactaagagcccgagggagcgcgctatccttggcctgcctaattctgttgaggaaatgtgccctgatatacctgtgctcgaaaggcttatggcagacatagggggtcttgccgagtcaggagccagatataccgaaatgccacacgttattgagattacgttaccgatgctgtgcagctacctccctaggtggtgggagaggggccctgaggctcctccgagtgccctgcctgcgggagctccaccaccctgcactgcggtgacttcggaccaccttaatagcttattggggaatatcctccgcatcattgtgaataacctcggcatcgacgaggcatcctggatgaagagactggctgtgtttgctcagccaatagtaagcagggccagacccgaattattacagagccacttcatacccacaataggtcgactccgcaaacgcgcaggaaaagttgtgagtgaagaagagcagttgcgtttggaagcaaaagctgaggcccaggagggcgagctgctggtaagggatgagttcagtgtgttgtgccgcgatttgtacgcgctctatccactgctgatcagatatgtcgacaataatagggcccagtggctgacggaacccaacccttcagctgaggagctgtttcgcatggtgggcgagatttttatatactggtctaaatctcataacttcaagagggaggaacagaattttgtggtccagaatgaaatcaataatatgtccttcctgaccgctgataataaaagcaagatggcgaaagccggtgatatccagtccggtggcagtgatcaggagagaacaaagaaaaaacgacgaggggacagatatagcgtgcagaccagcctgatagtagccacattaaaaaagatgttgcctatcgggctgaatatgtgtgcacccaccgatcaagatctaatcacccttgccaagacaaggtatgccctcaaagacactgacgaggaggtccgcgaattcttgcataataacttgcacctgcagggtaaagttgaagggtcaccgtcactgagatggcagatggcattgtaccgtggggtgccagggagagaggaggatgctgatgatcctgagaagattgtgcgccgagtgcaggaggtatctgcagtgttgtactacctcgatcagacggagcatccgtataagagtaagaaggcagtctggcataagctgttatctaagcagagacggagggccgttgtcgcgtgttttcgcatgacccctctgtataatctgccgacacaccgcgcttgcaatatgttcctagaatcttacaaagcggcttggattctcaccgaggaccactctttcgaggacaggatgatcgacgatctgtccaaagcaggcgagcaagaagaggaagaggaggaggtggaagaaaagaaacccgaccctctgcaccagctggtcctgcacttcagcaggacagcactgaccgagaaatcgaagcttgacgaggactacctatacatggcctacgctgatatcatggccaagtcatgtcacctggaagagggcggagagaatggcgaagctgaggaggaggtggaggtgtccttcgaggaaaaacagatggagaaacaacggctgttgtatcagcaagcacgtctacacactcgcggagcggctgagatggtgctccagatgatttcggcctgtaaaggcgagaccggggcaatggtgagttcaacactgaaactcggtattagcattctgaacggaggcaacgcggaggtgcagcagaaaatgcttgattacctaaaagacaaaaaagaagtgggtttttttcagagcatccaggccctgatgcagacctgtagcgtgctggaccttaatgccttcgagcgacaaaataaagccgagggcctggggatggtaaatgaggacggaaccgtaggcgaaaaggtgatggctgatgacgaatttacacaagacctgtttcgatttctccagttgctctgtgaaggacacaataacgactttcaaaattatctgagaacccagacgggtaacacaacaacaatcaacattataatttgcactgtcgactatctcctcagactccaggaaagcatcagtgacttctattggtattattccggaaaagatgtgatcgaggaacaagggaaacgtaacttctctaaagctatgtccgttgccaaacaagtgtttaatagcttaactgagtatattcaaggtccctgcacaggaaaccaacagagtctggcgcactcacgcctgtgggatgccgtcgttggatttctgcatgtttttgcccatatgatgatgaagttagctcaggacagttcccagatcgagcttctcaaagaacttcttgacctgcagaaagatatggtggtaatgttgctgtctctcctcgagggaaacgtcgtgaacggaatgattgccagacaaatggtggacatgcttgtggaatccagcagtaacgtggagatgattttaaaattcttcgatatgtttttaaaattaaaagacattgtgggaagcgaagcgttccaagattacgtgactgaccccagaggattaatctcaaagaaagattttcagaaagccatggactcacagaagcagtttagtggccctgagattcagttcttgttgagctgctctgaagcggacgagaacgaaatgatcaattgtgaggagtttgccaatcgctttcaggaacctgcacgagacattggctttaacgttgctgtcctgctcactaacctgtcagaacacgtaccccacgacccaaggctgcacaatttcctggagctcgctgaaagcattcttgagtacttccgcccatatctgggcaggatcgagatcatgggagcttcacggcgtatcgagagaatttattttgaaatctccgagaccaaccgggctcagtgggaaatgccccaggtaaaagagagtaaacggcagtttattttcgatgtcgtcaacgaggggggagaagccgaaaaaatggagctgtttgtaagtttctgtgaggatacaatcttcgaaatgcaaatagcggctcagatcagtgagcccgagggcgaaccggagacagatgaagatgaaggagcgggagcagccgaagccggagccgagggagccgaagaaggggcagcaggacttgagggaacagctgccaccgccgctgccggagctacagcacgagtcgtggctgcggctgggagggccctgcgtggtctgtcctatcggtctctgaggcggcgagttcgtcgcctgcggagactgacggccagagaggcagcaaccgctgtggccgcattactgtgggcggctgttactcgagcaggcgctgccggagccggtgccgctgcaggagcccttggcttgctgtggggttcactgttcggtggcggtctggtggagggcgctaaaaaagtgactgtcacagaactgctcgccggtatgcccgatccaacgtctgatgaggtgcacggcgaacagcctgctggcccaggaggagatgcggacggcgagggcgcttccgagggggctggagacgccgcagagggggctggtgacgaggaggaagctgtccatgaagccggtccaggaggggctgatggtgccgtcgccgtgactgatggcggaccctttcgtcctgaaggggctggcggactcggcgatatgggcgatactaccccagccgaaccacccacccccgaaggatcccctattttaaaaaggaaactgggagtagatggcgtagaagaagagcttcccccagagcccgaaccagagcctgaaccggagctcgagccagaaaaggccgacgcagagaatggggagaaggaggaggtgccagaaccaactccagagcccccaaaaaagcaggcccctccgagtccacctccaaagaaagaggaagctggcggagaattttggggagagctggaagtgcaacgagtgaagtttctaaattacctctcccgcaacttttacacactgcgtttcctggctcttttcctcgcctttgctattaattttatccttctattttataaggtcagcgatagccctcctggggaggacgatatggagggcagtgctgcgggagacgtatcaggcgcaggcagcgggggtagtagcggttgggggttgggcgctggggaggaggcagagggggacgaggacgagaacatggtttattactttctagaggaaagcactggctatatggagcccgcacttaggtgtttgtcccttcttcataccttggtggcctttctgtgtattattgggtataattgcctgaaggtgccactcgtgatctttaagcgggagaaggaactcgcaagaaaactggagtttgacggcctttacatcaccgaacagcccgaagatgacgatgtcaagggccagtgggacaggcttgtgctgaataccccctccttcccaagcaattactgggataagtttgtcaaacgaaaggtcctggacaagcatggtgacatttatggacgggagcgcatagccgaattgcttggcatggacttggccacgctggaaatcacagcccacaatgagcggaaacccaatcctccccctggcttgcttacatggcttatgtcgatcgacgtgaaataccagatttggaagtttggagtgatttttacagataactcttttctctatcttggatggtatatggtgatgtcactactcggacattacaacaatttcttcttcgctgcacacctgctggacattgcaatgggcgtaaagaccctacgaactatcctgtcgtctgtaacccataacgggaagcaacttgtcatgactgtggggctcctggcagtcgtggtctacctatatacagtcgtggccttcaattttttccgcaagttctataataaatctgaggacgaggatgaacccgatatgaaatgtgatgatatgatgacttgttatctgttccatatgtatgtgggagtccgcgcaggcggaggcattggagacgaaattgaggatcccgcaggagatgagtatgaactgtatagagtcgtgttcgatataaccttctttttttttgtgatcgttatcctcttagcaatcatccagggactaatcattgacgcattcggggaattaagagatcagcaggagcaggtcaaggaggatatggaaaccaaatgcttcatatgcggcattgggagcgattacttcgacaccactcctcacgggtttgagacacacactctggaagaacacaatctcgctaactacatgttttttctaatgtacttaatcaacaaagacgagactgagcataccggccaggaatcatatgtttggaagatgtatcaggagaggtgttgggacttcttccctgcaggagactgctttcggaaacagtacgaggaccagctctcatag

SEQ ID NO: 239502 - DNA, 2031 bp, Artificial Sequence
  Description of Artificial Sequence: Synthetic coding sequence
atgaaaagcggccctgaaattgtcaaggcgggtttgcgttccttttttgagtctgcttctgaggacattgaaaaaatggtggaaaatctcaggctcggtaaggtcagtcaggctaggacccaggttaagggtgtgggccagaaccttacatacaccaccgttgcactgctgcctgtacttactaccctgtttcagcacattgcccagcaccaattcggtgacgatgtgatcttggatgatgtgcaggtcagctgctaccggacactgtgttctatttattctcttgggacaacaaaaaatacatatgttgagaaactcaggcctgcccttggagagtgccttgctcgactggcggctgcaatgcctgtggcttttctcgagcctcagctcaacgagtataatgcttgttctgtgtatacaacgaagtctccccgagagcgtgcaatacttggactgcccaacagtgttgaggaaatgtgccctgatattcctgtcttggagcgtctaatggcagacattggcggtctcgctgagagtggggcacgctataccgaaatgccacacgtaatagagataacgctcccgatgctgtgttcctacctccccaggtggtgggaaagaggacctgaagcacctcccagtgccctccccgcaggagcccctcccccttgtacagccgtgaccagtgaccaccttaactccttactgggaaatatactcaggatcatcgtgaataacttgggcattgacgaggcaagctggatgaagagacttgcggtctttgctcagccgatcgtgtctcgcgctcgtcccgaacttcttcaaagccactttataccaacgatcggaaggcttcgtaagcgcgctggtaaagtggtgagtgaggaggaacaactccgactcgaagctaaggccgaggcgcaggagggggagctgctcgtccgggatgagttctcagtgttgtgccgggatctgtacgctctgtacccgcttcttattcgctacgtcgataataaccgcgctcagtggctgaccgaacccaaccccagcgctgaggagctgtttagaatggtgggcgagatttttatctactggtctaaatcccacaactttaagcgggaggaacagaatttcgtggtccagaatgaaataaacaatatgagttttttaactgccgataataagagtaaaatggcgaaagcgggtgatattcagtctggaggctctgatcaggaaagaacaaagaagaagagacgcggagatagatacagtgttcaaacaagcctgatcgtggccactttgaagaaaatgctgccgattgggcttaacatgtgtgcccctactgatcaggatttaattacactggcaaagactaggtatgctctgaaggacaccgatgaggaggtgcgggagttccttcataataacctgcacctgcaagggaaagtcgagggaagcccctccttgcggtggcagatggctctctaccggggagttcccggtcgggaagaagacgctgacgatcccgagaagattgtccggcgagtacaggaggtgagcgcggtattgtactatctcgaccagaccgaacacccgtataaatctaagaaagcggtctggcacaagctgctcagcaagcagcggagaagagctgtggtcgcctgctttcggatgacgcctctttacaacttgcctactcaccgagcctgtaatatgtttctagaatcctataaggcagcctggattctgaccgaggaccactcctttgaggaccggatgatagacgacctatccaaggctggcgagcaggaggaggaggaagaggaggtagaggagaagaagccagatcccctccaccagttggtactccattttagccggacagctctgaccgagaagtccaaactagacgaagattatttgtatatggcatatgccgacatcatggcaaagtcttgtcacctggaagaaggtggggagaatggggaggctgaagaagaagtagaagtttcattcgaggaaaaacagtag

SEQ ID NO: 239503 - DNA, 14922 bp, Artificial Sequence
  Description of Artificial Sequence: Synthetic coding sequence
ctcgggccaagatcctcctctaataaactctcaaacaagaagatgatgaagtggttctgttcagcgccacagccaagtactaaaaacaaccgaagttacgcttggcagcagaaggatctggccacggacttcgtgagttggtcgccactgcctattccacggatgtgcccccaaacaagcccctctgcgccactgtgttggtcaagccctagcctctctgggagatgtcggagatgctggctgacgccgtggcgcaaccagaaaggccagttggatattatcaaatggtccttcggactgaagacagcccaggggggaggccaccggacgcttctgtatggtcacgcaattctgttgcggcattcctatagcgggatgtacctgtgttgcctgtccacatctaggagcagtaccgataaactggccttcgacgtgggactccaagaggacacaacaggtgaagcatgctggtggacgatacatcctgccagtaagcaacggagtgagggggaaaaagttagggtgggggatgatctgatcctcgtctctgtgagtagcgaacgctatctgcacttatcatacggaaacggatcgctgcacgtcgacgcagcctttcagcaaactctctggagcgtggcccctatatcatccggatcagaagccgcacagggttaccttatcggcggtgatgtgctgcggctactgcatggacatatggacgagtgccttaccgttcctagcggcgaacacggagaggaacagaggagaaccgtgcattacgaaggaggtgcagttagcgttcacgcacgctctttatggcgactggaaactttgcgcgtggcatggtccggatctcacattaggtgggggcagccgttccgcctccggcacgtgaccaccggaaaatatctgagcttgatggaggacaaaaacttgctcttgatggacaaagaaaaagccgatgtgaagtcaacagctttcacttttcggagcagcaaagaaaagctcgatgtgggtgtgagaaaggaagtggatgggatggggaccagtgagattaagtacggcgactcagtatgctacatccagcatgtggatacaggactgtggctgacctatcagtcggtggatgtaaagagtgtacggatgggttccattcagcggaaagcaattatgcaccatgaggggcacatggacgacggaattagcttgagccggagtcagcatgaagaaagccggaccgcgcgagttataagatctacagttttcctgttcaatcgattcatccgaggcctcgatgccctgtcgaagaaagcaaaagcttccaccgtagatcttcccatagagtccgttagtttgagtcttcaggacttgattgggtactttcatcctccggatgaacacctggagcatgaggataagcagaataggctgcgagccttgaagaaccggcaaaacttgttccaggaggagggcatgattaaccttgtactggaatgtatagataggctgcatgtctactcatcggcggctcacttcgccgacgtcgctggtcgtgaggcaggcgaatcctggaagtctattctcaattccttatacgagctgctggccgctctgattagaggtaatcgcaaaaattgcgctcagttctctggctctctggattggttgatcagtcggttggagcgattggaggctagttctggcatcctggaggtcctccattgtgtgctagtcgaatccccagaggcattgaacatcataaaggagggccatattaaaagcattattagcctcctggacaaacacgggaggaatcataaagtgctggacgtcctgtgctccctgtgcgtgtgtcacggggttgctgttcgtagcaatcagcatctgatatgcgataatttattgcccggaagagacctgctgctgcaaacccgactggtgaatcacgtttccagcatgcgccctaacattttcttaggcgtgtctgaaggctccgcccaatacaagaagtggtattatgaactgatggtagaccacactgaaccgtttgtgacagccgaggccacacacctgagagttggatgggctagcacagaagggtattctccctatcccggtgggggagaggaatggggtggtaatggtgtaggggacgatctcttttcctacggttttgacggcttgcatctctggagtggatgcattgcaaggactgtctcaagtcctaaccaacatcttctccgcacggacgacgtgatttcctgctgtctggatctgtccgcaccctcaattagttttagaatcaatggtcagcctgtgcagggaatgtttgaaaattttaacatcgatggtctcttctttccggtggtgagcttctccgccggaatcaaggttcggtttctgctcggcggaaggcatggcgaattcaagttcctcccaccgccagggtatgcgccatgctacgaggccgttttaccaaaagagaagctgaaggtcgagcactctcgggagtacaagcaggagcgaacttacacccgggacttactgggaccaaccgtgtctttgacccaggcggctttcaccccaattcctgttgatacgagccaaattgttctgccaccgcacctggaaagaatccgggagaaacttgccgaaaatattcatgagctgtgggtgatgaacaagatcgagctgggctggcagtacggcccagtccgcgacgacaacaaacgccagcacccatgtttagtggaattctccaaactacctgagcaagagcgtaactacaacctgcagatgtctttggagactcttaaaaccctgctggccctcggatgccatgttggaatctcggacgaacatgccgaagacaaggtgaagaaaatgaagctaccgaaaaattaccagctcacttcaggttataagcctgccccaatggacctgagtttcatcaaactgaccccctcccaggaagcgatggttgacaaactagccgagaatgcccataatgtctgggccagagacagaattcgccaggggtggacatatggaatccaacaggacgtcaagaatcgacgaaatcccaggttggtgccttacactctactggatgatcgcacaaagaagtcaaacaaggattctctgagggaagccgtaagaacacttctgggatatggatacaatctggaagctccggatcaggatcacgctgctcgagccgaggtgtgctcagggacaggagagcggtttcgaattttccgagctgaaaagacttatgctgttaaagcaggacggtggtacttcgagttcgagaccgttacagcaggcgatatgcgagttggttggtctcggccaggctgtcagcctgatcaggagttaggctctgatgaaagagcgttcgcctttgacggtttcaaggcacagcggtggcaccagggaaatgaacactacggacggtcatggcaagcaggagacgtggtggggtgtatggtggacatgaacgagcacacgatgatgtttacactcaatggagagattctcctcgatgactcaggctctgagctcgccttcaaggacttcgatgtgggagatggttttatacctgtgtgctcgctgggggttgcgcaggtcggtagaatgaatttcgggaaggacgtatccacattaaagtacttcacgatatgtggattgcaggagggctatgaacctttcgctgtcaacacaaatagggacattaccatgtggctgagcaagcgcctccctcaattcctgcaggtaccatcaaatcatgagcacattgaagtgacccgcatagatggaaccattgactcctcaccctgcctgaaggtgacacagaagtccttcggcagccagaattcaaatactgacatcatgttttaccgcctgtcaatgcctattgagtgcgctgaggtttttagcaaaacagttgccggtggactgcccggagccggactattcggaccaaaaaatgatctcgaggattacgatgccgattccgatttcgaagtgctgatgaagactgcacatggacatttggtcccagatagggtggacaaagacaaagaagccacaaagcccgagttcaataaccacaaagattacgcgcaggagaagccatcccgtttgaagcagcggtttttgttgcggcgtactaaacccgactactcaacgagtcatagtgctcgccttaccgaggatgtgctggccgatgacagagatgactacgattttctgatgcagacctcaacgtactactattccgtgagaattttcccaggacaggaacccgctaatgtctgggtggggtggattacttctgacttccaccaatacgacaccgggtttgatctggacagagtgaggactgtgacggtgacactcggcgatgaaaagggaaaagtgcacgagagtatcaagcgcagcaactgctacatggtctgtgcgggagagtccatgagtcctggacagggcaggaataacaatggacttgaaatcgggtgcgtggttgatgctgcgagtgggctgctgacttttattgccaatggcaaggagttgtcaacgtactaccaggtcgaaccgagcacgaagctgttcccagctgtgttcgctcaagccacgagtcccaatgtctttcaatttgaactcggacgaattaaaaatgtgatgcctctgtcagccggattgtttaaaagcgagcacaagaatcctgtgccacagtgtcctcccagattgcacgtacagtttctctcgcacgtactctggtcccgcatgcccaaccagtttcttaaagttgatgtgagccggatctctgaaagacagggctggctcgtccagtgtcttgatcccttacagttcatgtcactgcatataccagaggaaaaccgctctgttgacattttggaactgaccgagcaggaagagctgctaaaattccactaccatactttaagattatatagcgccgtgtgtgctctgggaaaccatcgggtggctcatgctctttgctcacatgtcgacgaacctcagttgctctatgccattgaaaacaagtacatgccagggttactgcgggcaggatattacgacctcttgatcgacatacacctttctagctatgctacagccagattaatgatgaacaacgaatacatcgttccaatgaccgaggagactaaaagcatcacactatttcctgacgaaaacaaaaagcatggcctccccggtattggactctcaacaagcctgaggccaaggatgcagttctcaagtccgtctttcgtgtccatatccaatgaatgctaccagtactcaccagagtttcctctggatatcctgaagtcaaaaactatccaaatgttaacagaagccgtcaaagagggctccctacatgcaagagacccagtgggcggaactacagagttcttgtttgtccccctaatcaagctgttttacactttgcttattatggggatcttccataacgaggatttgaagcacatcttgcaacttatcgagccgagcgttttcaaggaggctgctacgccagaggaagagtcagacacactggaaaaggagttaagtgtcgatgatgccaaattacagggcgctggggaggaagaggcgaaaggcggtaagagacccaaggaggggctcttgcagatgaaacttcctgagcccgtgaagcttcagatgtgccttttgctccaatatctgtgcgactgccaggtgagacatcggatcgaggccattgtagccttctccgatgactttgtggcgaaactccaggacaaccagaggtttcggtacaacgaagtgatgcaggctctcaatatgagtgcagccctgactgccagaaaaacaaaagagttccgcagtcccccacaggaacagattaacatgctactcaattttaaagacgataagtccgagtgtccctgcccagaggaaattagggaccagctgttggattttcacgaggacctcatgacccactgtgggatcgagctagatgaagatgggtcattggatgggaattccgatctcactatacggggacgtttactctctctggtggaaaaggtgacataccttaaaaagaaacaggccgaaaaacccgtcgagtccgactctaaaaagagcagcacccttcagcaactgatctccgaaacaatggtgaggtgggctcaagaaagcgtgatagaagacccagagttggtgagggccatgtttgtgctcctgcatcggcaatacgacggtattggcggtctggtaagagcgctgccaaagacctacactattaacggagtgtcagttgaggatacaattaatttgcttgcctcactcggccaaattcgttcactactctccgtccggatggggaaggaagaggaaaagttgatgattcgaggtctgggcgacattatgaataacaaagtgttttaccagcatcctaacttaatgcgggcacttggcatgcacgaaacagtgatggaggtgatggtgaatgtgctgggcggaggggaatcaaaggagatcacgtttcctaaaatggttgctaactgctgcagattcctatgttatttctgtaggatatccagacaaaaccaaaaggctatgttcgatcatttgagttacttactggaaaacagttctgtcggcctagctagtcccgcaatgaggggcagcaccccattggatgtggccgcagcctctgtcatggataataacgagctggcacttgccctgcgcgaacctgatctcgaaaaggtggtccggtatctcgccggatgtgggctgcagtcttgtcagatgctggtttcaaaaggatatccggatatcgggtggaatcccgttgagggtgaacggtatctggacttcctccgctttgcagtcttctgtaatggggagagcgttgaagaaaacgctaacgtagtagtccgcctgctgattcgtaggcccgagtgttttggccctgccctcagaggtgaaggaggcaatggcctcctggccgcaatggaggaagcaatcaaaattgcagaagatcccagtcgcgatggcccttctcctaatagcggctcttcaaagacactggacaccgaggaggaagaggacgatacaattcatatgggaaacgccatcatgacattttattcggcgcttattgatttgcttggcagatgtgcaccagagatgcatctcatacacgccggaaagggcgaggccatccgaattaggagcattctgcggtctctgatacccctgggggatctggtgggagttattagcatcgctttccaaatgcctactatcgcaaaggacggaaacgtggtggaacccgacatgtctgcaggtttctgccctgatcacaaggccgcaatggtcctgttcttggaccgggtgtacggcatagaggtgcaggactttcttctgcatctgctagaagttgggttcttgcccgatctgagggcagctgccagcttggacaccgcggctcttagcgccacagatatggcattggcactgaatcgctacttgtgtacggccgtgcttccactgctaactcgttgcgctcctctgtttgctggcacagagcaccatgcaagtcttattgatagcctcctccatacagtctataggctctccaagggatgttctttgactaaggcacaacgggactccatcgaagtgtgcctcctgtccatttgcggtcagttgagaccttcaatgatgcaacaccttctgcgcaggcttgtgttcgatgtgccgttgcttaacgaacatgccaagatgcccctgaagctccttactaaccactatgaaaggtgctggaagtactattgcctgccagggggatggggtaacttcggcgctgcttctgaggaggagctccatctctcacgaaaacttttctggggaattttcgatgctctgtcgcagaagaaatatgaacaggaactatttaaattggctctgccatgcctctcagcagtggctggagccctacctcctgattacatggagtcaaattacgtgagcatgatggagaaacaaagcagtatggacagtgagggtaactttaatcctcagccagtcgatacatcaaatataacaattccggaaaaactggaatactttattaataagtatgccgaacacagccatgacaaatggagtatggataagctggctaacgggtggatatacggcgaaatctactccgacagttctaaggtccaacctctcatgaagccgtacaaactgctgtcggagaaagagaaggagatttacaggtggcccatcaaggaatccctaaagactatgcttgcatgggggtggagaattgagagaacccgcgagggcgacagtatggccctgtataacaggacccgacgcattagccaaacctctcaggtgtcggtcgacgctgctcatggatactcaccgagggcaattgatatgtcaaacgtcacactgtcgcgagacttgcatgcaatggccgagatgatggctgagaattatcacaacatctgggcaaaaaaaaagaagatggagctggagtctaagggcggaggaaaccatcccctgctggttccctacgataccctgacggcaaaagagaaggccaaggacagggagaaagcacaagatattctgaaattcctccagatcaacggctatgcagtgtctcgagggttcaaagaccttgaactagacactccctctatcgagaagaggtttgcttactcatttcttcagcaattgatccgttacgtcgacgaagcccaccagtacattctggaatttgatggaggtagtagaggtaagggagagcacttcccctatgaacaggagatcaaattctttgccaaggtcgtgctgcccctgattgatcagtactttaaaaatcatcggctgtacttcctctccgccgcatcgcgcccactatgcagcgggggtcatgctagtaacaaggaaaaagagatggtgacaagcctgttttgtaaactcggagtccttgtgaggcaccgcatttctctgttcggcaacgacgccacaagcatcgtcaactgcttgcacattttgggacagacgcttgatgccaggaccgtcatgaagacgggcctggaatctgtgaagtctgctctgcgggctttccttgataatgcagcagaagaccttgagaaaactatggagaacttaaagcagggtcagttcacgcacaccaggaaccagcctaagggagtcactcagatcatcaattacactacagttgccctgctgccgatgctaagcagcctcttcgagcacatcgggcagcatcagttcggcgaggacctaattctggaggacgttcaggtgtcctgttatcgaatcctcacttcgttgtacgctttaggtacatcaaagagtatttacgtggaacggcaaagatcagctttaggtgaatgtctggccgcttttgccggagcattcccagttgcttttttggagactcatttggacaaacataatatttatagcatttacaacacaaaaagttccagagaacgtgccgcattgtcgttacctaccaacgttgaggacgtgtgtcccaacattccttcccttgaaaagttgatggaagagatcgtagagttagcagaaagtgggatcagatacacacagatgccacacgtcatggaggtaattttacctatgctgtgctcgtacatgtcccgatggtgggaacatgggccagaaaataaccctgagcgggcagaaatgtgttgcaccgcactaaactctgaacatatgaacactctgctgggcaatatactcaaaatcatatacaataacttgggcatagacgagggagcatggatgaagagactagccgtcttctcccagccaatcatcaacaaagtcaagccacaactcctcaaaacccactttctgccactcatggagaaactgaaaaaaaaggccgcaacagtagtctccgaggaggatcacctgaaagctgaagcccgaggcgacatgtctgaggcggagctgctcatcttggatgagttcaccacactggctcgtgatctttatgccttttacccgttgctgattcggtttgtggactataatcgcgctaaatggctcaaagaaccaaacccagaagctgaagagctcttccgtatggtcgctgaggttttcatctactggtcgaaaagtcacaattttaaaagggaggaacagaattttgttgtgcagaacgaaataaacaacatgtctttccttattacagacactaagtccaaaatgtccaaagccgcagtgtcagatcaggagagaaaaaagatgaaaaggaagggagatagatactctatgcagacttccctcatagttgcagcgctcaagaggctgttacccatcggattgaatatctgcgccccaggcgatcaggaattgatcgctctggcaaagaaccggttctcgcttaaggacactgaagatgaggtacgagacattattcggagcaatattcatcttcagggcaagttagaagaccccgctattagatggcaaatggcactttacaaagatctgcctaataggacagacgatacgtccgacccggagaaaacagtggaaagggtgttggatattgccaacgtcctctttcacctggagcaaaaatctaagcgcgtgggaagaaggcattattgtctagttgaacacccccaacgctccaagaaagctgtatggcataaactgttgtctaaacagaggaaacgcgctgtagtcgcctgcttccgcatggcccctctatataacctgccaaggcatagggccgtgaatctgtttttgcaaggatatgagaagtcctggatcgaaacagaggaacactattttgaggataaactgatcgaggacctggcgaagcccggtgcagagcctccagaggaggacgagggcaccaagcgggttgaccccctgcaccagctgatactgctgttctcgaggacagcactcactgaaaaatgcaaactggaggaagatttcctttatatggcttatgccgacatcatggcaaagtcatgtcatgatgaagaagacgacgatggcgaagaggaggtcaaatcttttgaagtgactggctcacagcggagcaaggagaaagaaatggagaagcagaaacttctgtaccagcaggcaaggttgcacgatcggggagcagcagagatggtattgcagacaatatcggcctcaaagggcgaaactggaccaatggtcgcagccacgctaaagctgggcatagcgatcctcaacgggggaaacagtaccgttcagcaaaagatgctcgactaccttaaggaaaagaaggatgtgggctttttccaatctttggccggtctcatgcagtcctgttcagtcctggacctcaacgcctttgagcgtcaaaacaaagcagaaggcctgggcatggttactgaggaggggtccggagagaaggtgctgcaagatgatgaattcacatgtgatctctttagatttctccaattgctgtgtgagggtcacaacagtgacttccagaattacttacggactcagacaggaaataataccaccgtaaatattatcatatccactgttgattacttacttagggtgcaagaatcaattagcgacttttactggtattacagcggaaaagacgtgattgatgagcagggccagcggaacttctctaaggcaatccaagtggccaaacaggtgttcaatacgctgacagaatatatccaggggccttgcaccggcaaccagcagtcgttggcccatagccggttgtgggacgctgtggttggcttcctccatgtcttcgctcatatgcagatgaaattaagccaggacagctcccagatcgaactgctgaaagaattaatggaccttcagaaggatatggttgtgatgttattgagcatgctcgaggggaacgtggtaaatggcaccatcggcaaacagatggtggacatgctagtggaatcatcgaataatgtggagatgatcctgaagttttttgatatgttcctcaagcttaaagacctgacaagctcagatacattcaaggagtacgaccccgacggaaaaggtgtgatcagtaagcgggatttccacaaagccatggagtcacacaagcactatacacaatctgagacagagttcttgttgtcctgcgctgaaacagacgagaatgaaactctggattatgaagagttcgtcaaacgcttccatgaaccagccaaggatattggatttaatgtcgctgtcctgctcacaaacctgtctgaacacatgcccaatgatacacgcctccagacgttcctggagttggccgagtctgttcttaattacttccagcccttcctgggacgcatagaaatcatggggtctgctaagaggatcgagagggtttacttcgagatatccgagtcgtcccgcacccaatgggagaagccccaagtgaaagaatccaaacggcaattcatctttgacgtggtcaacgagggcggtgaaaaagaaaagatggagctgttcgttaatttttgcgaagacactatcttcgaaatgcagttggccgctcaaatcagcgagtctgacttaaacgagcgtagtgccaataaagaggagagtgagaaggagcgtccagaggaacaggggcctcggatggctttcttctccatcctgactgtgagaagcgcattatttgcccttcgatataatattctgacacttatgcgtatgctgagtcttaaaagcctgaagaagcagatgaaaaaggtcaagaagatgactgtgaaggatatggtgacagctttcttctccagctactggagcatctttatgactctgttgcacttcgttgcttcagtgtttcggggatttttcagaatcatctgttcgctgcttctgggaggctcactcgtggagggggctaagaaaatcaaagtggctgaattactggctaacatgcctgaccccacccaggatgaagtgcgcggagacggcgaggagggagagcggaagcctttggaggcggcactgccttctgaagatctcactgatctcaaagaacttacggaggaatccgaccttctttccgatatcttcgggctggacctgaaacgagaggggggacagtacaaactcattccccataaccctaacgccggactgtccgaccttatgtccaacccggtcccaatgccggaggtgcaggagaagtttcaggagcaaaaagccaaagaagaagaaaaagaggagaaggaagaaaccaagtccgaacctgaaaaggcagaaggtgaggacggagagaaggaagagaaggctaaagaggataaaggaaaacagaagctcaggcagttgcatacacataggtacggagaacccgaggtgcccgagagcgccttttggaagaagatcattgcataccaacagaagctgctaaattacttcgctaggaacttttacaatatgaggatgcttgcactgtttgttgctttcgcaatcaattttatattgctattctacaaggtctcgacatctagtgtcgttgagggtaaagagctcccaacaagaagctcatctgaaaacgccaaagtgacctcacttgattcatccagtcatagaataatagctgttcactatgtactggaggagagcagcggctacatggagccgacactcagaattctcgcaatcctgcacaccgtgattagctttttctgcataatcggatattactgcctgaaggtgcccctggtaatcttcaaaagagaaaaggaagtggcccgaaagctcgagttcgacgggctctatatcacagaacagccatcggaagacgacattaagggacaatgggaccgactggtgattaacacgcagagtttccctaataattactgggacaagtttgtcaagcgcaaggtcatggataagtacggtgaattttatggacgtgacaggatatcagagctgctgggcatggataaggctgctttagacttctctgatgcacgggaaaagaaaaaacctaagaaagactcctccttgtctgccgtactgaattctatagatgtcaaatatcaaatgtggaagctgggagtcgtgtttaccgataatagtttcctgtatctggcttggtacatgacaatgtcagttctgggccattacaacaacttcttctttgctgcgcacctcctcgacatcgccatggggttcaagaccctcagaacaatcctgagtagtgttacacacaacggcaagcagctcgtcctgaccgtcggtctgctcgccgtggtggtgtatctgtatactgtcgtagcttttaacttctttcgaaaattttacaacaagagtgaggacggggacacgcccgatatgaagtgcgacgacatgctaacctgttacatgttccacatgtacgttggcgttcgtgccggaggtggcataggcgatgagattgaggacccggcaggtgatgaatacgagatctaccgcatcatttttgatatcaccttttttttctttgtcatcgttattctgctagctattatccaggggctgataattgatgcatttggagagcttcgcgaccagcaggagcaggtgaaggaggacatggaaactaagtgctttatctgcggaattggcaatgactacttcgatactgtgccgcatgggtttgaaactcataccctccaggaacataatctggctaactatctgtttttcctgatgtatttaatcaacaaggatgagacggagcacaccggccaggagagttacgtgtggaaaatgtatcaggagcggtgctgggagttcttcccagccggagattgcttccggaagcagtacgaagaccagcttaactac

SEQ ID NO: 239504 - DNA, 14904 bp, Artificial Sequence
  Description of Artificial Sequence: Synthetic coding sequence
atggctgatggaggcgagggtgaagatgaaatccagttcttgcgtaccgacgacgaggtggtgctccagtgcacagcaacgattcataaggaacagcaaaaactctgcctggctgcagaaggattcggaaatcgactctgtttcttggaatctaccagcaactccaaaaacgtgcctccagacctcagcatttgcactttcgtgcttgagcagagcctcagcgtgcgcgctctccaggagatgctggcgaacaccgtagaaaaaagcgaagggcaggtcgacgttgaaaagtggaagtttatgatgaaaactgcacagggcggaggccaccggacccttttgtacggccacgccattctactgcgccattcgtatagcggaatgtacctgtgttgcctgagcaccagccgttcttccactgataaactggcctttgacgtcggcttgcaggaggatactaccggcgaagcctgttggtggacaattcaccccgcatctaaacagcgatcagagggggagaaagtcagagtcggggatgatcttatcttggtgagcgtgagtagcgagaggtatttgcacctttcttatggaaatggctccctgcatgtggatgctgccttccagcagaccctctggtcggtcgctccaatatctagcggatccgaggctgcgcagggctacctgattggcggagacgtcctgcgattactgcatggtcacatggatgagtgtctcactgtgccaagcggggagcatggcgaggagcaaagacgaactgtccactatgaggggggagctgtttccgttcacgctaggagcctctggcggctggaaacactccgggtcgcctggtccggcagtcatatacggtggggtcagcctttccgcctgcgccacgttaccaccgggaagtacctgagcctgatggaagacaagaatctcctcctgatggacaaggaaaaggctgatgtcaagtctacggcattcacatttagatcttccaaagaaaagctcgatgttggggtccggaaggaggtggatgggatggggactagtgagatcaagtacggggatagcgtttgttacatccagcatgtggatactgggctgtggctcacttatcagtcagttgatgtcaaatcagtgaggatgggatctattcagcggaaagccattatgcatcacgagggccacatggacgacggaatctctctctcgcgttcccagcacgaggagagtagaaccgccagagttatccgctcgacagtgttcctgtttaatagattcattagaggtctggacgccctttctaaaaaagcaaaagccagcaccgtggacttacccatagagtctgtttccctctctctgcaggatctgatcggctactttcaccccccagacgagcatttggaacacgaagacaagcaaaaccggctgagagccctgaagaaccgacaaaacctgttccaggaggagggaatgataaatcttgtgctcgagtgcattgaccggctgcacgtctattccagcgccgcacacttcgctgacgtcgccggtcgagaagccggtgagtcttggaagtcgattttaaactccctctatgagctacttgctgcactgatccgcggaaacagaaaaaactgcgcccagttttcgggcagtttagactggctcatctcccggcttgagaggctggaggctagcagtggcatcttagaagtgctgcattgcgttcttgtggagagtcccgaggcattgaatattataaaagaagggcacatcaaatccattatcagtcttctggataagcacggcaggaaccacaaggtgttggacgtgttatgttccctttgcgtctgccatggggtggcagttcgatcaaaccagcacttaatttgcgacaacctgttgcctggtagggatctcctcctgcagactagactagttaaccacgtgagctccatgcggccaaacatcttcctcggcgtgtccgaggggtcggcacagtacaagaagtggtactacgaattaatggtagatcacactgagccgttcgtgacggccgaggctacgcatctgagagtaggctgggccagtacagagggctattcgccctatcccggaggtggagaagaatggggcggtaatggagtcggcgacgatttattcagctacgggttcgatggtcttcatctttggagtgggtgcattgctcgcacggtgagctcacccaaccagcatctccttcggacggacgatgtcattagctgttgcttagacctgtcagcccctagcatctcattcaggatcaacggccagccagtgcagggtatgttcgaaaactttaacattgacggcctgtttttccctgtggtctctttttccgctggaattaaagtaagatttctgctaggaggcaggcacggggaattcaagtttcttccacccccaggctatgcaccctgttacgaggccgtgctgcctaaggaaaagctcaaggtggagcattcacgcgagtataagcaggagcggacttacaccagagatctgttggggccaacggtctctctgacccaggccgcattcacacccatccccgttgacactagtcagattgttctgccccctcacttagagcggatccgggaaaagctggcagagaatatccacgagctgtgggtgatgaacaaaatcgaactgggatggcagtacgggccagtcagagacgacaataaacggcagcacccatgcctagtcgaattttctaagcttcctgagcaagagcgcaactacaacctacagatgtcgttggagacattgaagaccctgctcgccctgggatgtcatgtgggaatttcggatgagcacgcggaggacaaagtgaagaagatgaagctccctaaaaattatcagctgactagtgggtacaaaccggcaccaatggacttaagttttataaagttgaccccctcacaagaggcaatggtcgataaacttgctgaaaacgcacacaatgtctgggcacgagatcgcatccgccaggggtggacctacgggatccagcaggatgtcaagaatagacggaacccaagattagtaccatacacgctcctggatgatcgtaccaagaaatcaaataaggattcgctgcgtgaagctgtgcgcaccctgctcggctatggctataacctggaggccccagatcaggaccatgccgctcgagcagaagtgtgcagtggtactggggaaaggttccgaatctttcgggcagaaaaaacttacgcagtgaaggctgggcgatggtacttcgagttcgaaacggttaccgctggggatatgcgggtggggtggagcaggccagggtgccaacccgatcaggagttgggttcagacgagcgcgctttcgcctttgacgggttcaaggcgcagaggtggcaccagggcaatgagcactatggccgatcttggcaggcaggagacgtggtggggtgtatggtggatatgaacgaacacactatgatgtttacattgaatggagaaattttattggatgatagcgggtctgagttggcatttaaggacttcgacgtcggggacgggttcatccctgtttgcagtctcggtgttgcccaggtcggacgaatgaatttcggtaaagatgtatcgactttgaagtactttacaatttgcgggctacaggagggctatgaacccttcgcagtgaacaccaatcgagatatcacgatgtggttgtcaaagcgtctgccccaatttctgcaagtgccatctaaccacgaacacattgaggtaaccagaattgatggtacgatcgattcttctccatgtctcaaggttactcagaagagtttcggctcccaaaatagcaatacagatatcatgttctacaggctcagcatgcccatcgaatgcgctgaagtgttctctaagacggtcgctggcggacttcccggtgcgggtctcttcggcccaaaaaacgacctcgaggactacgatgccgattctgacttcgaggtattgatgaaaactgcacacggccacctggtcccagatcgcgtcgataaggacaaagaagccacaaagcctgaatttaataatcacaaggattacgctcaagaaaagccaagcagactgaaacagaggtttttgttacgtcgcactaagcccgattacagcacaagtcattcggcgagactcacagaagacgtgttggctgacgaccgtgatgactatgatttcctgatgcagacttcgacatattattatagcgtgcgcatattccctggccaggaacctgccaacgtctgggtcggttggattacaagcgactttcatcagtacgatacgggatttgatcttgatagggtgcgaacagttaccgtaaccctaggcgacgaaaaggggaaagttcacgaaagtatcaaacgttctaactgttacatggtttgtgctggggagagcatgtcacccggacaagggagaaataataacggcctcgagatcggttgcgtggtggatgcagcaagtggcctgcttacgttcattgcaaacggtaaagagctcagtacttactatcaggtggaaccctccacaaagctgttccctgccgtgttcgcgcaggcaacaagcccaaatgtgttccagtttgaactggggaggatcaagaacgtgatgcccctgtctgctggcttattcaaatctgaacacaagaaccccgttccccagtgtcctccacgactacatgttcagtttctttctcatgtgctgtggtcccgcatgcccaaccagtttctaaaggtcgacgtgagtcggatttctgagaggcagggttggttagtccaatgcctggacccgctgcagtttatgtcactccatattcccgaagagaatcgatccgttgacatcctcgagctgacagaacaggaggaattgctaaagttccattatcacactcttcgcctttacagcgccgtgtgcgctctgggtaatcacagggttgcccacgccctgtgctcccacgtggacgaaccccagctgttgtacgcaatagaaaataagtatatgcctggcctccttagagcaggctactacgaccttctgattgacatccatctgagcagttatgccacagcacgattaatgatgaataatgaatacatagttcccatgaccgaggaaacaaagtctatcactctgtttcctgatgagaacaaaaagcatggcttgccaggtatcggtttgtctacatccctccggccacgcatgcagtttagttcccccagctttgtgtctattagcaatgaatgctaccagtactcccctgaatttccactcgacatacttaagtctaagaccattcagatgctgacggaggccgtcaaggaaggatcacttcacgccagggatcctgtgggcggaaccactgagtttctgtttgtccctttgatcaaattattctataccttactaattatgggtatcttccacaatgaagatcttaaacacatattgcagttaatagagccctccgttttcaaggaggcagctacccctgaggaagaatctgatacacttgaaaaagagctctccgttgacgacgccaagctccaaggcgctggcgaggaggaggctaaagggggaaaacggccaaaggagggcttgctgcagatgaaactgccagaacccgttaaattgcaaatgtgccttctgctccagtatctatgcgattgtcaagtcagacatagaatcgaagcaattgtagcattttccgacgatttcgttgcgaagctccaggacaatcagaggtttcgttataacgaggtaatgcaggcactgaatatgagcgcggctttaacggcaaggaaaacaaaagaattcagatctcctccacaggaacaaatcaacatgctgctaaattttaaggatgataaatcagagtgcccatgcccagaagagatccgggatcaattattggatttccacgaggacctgatgacccactgtggcattgaactcgacgaggacggctccttggatggtaactcagaccttactatccggggtcgcctattgtcgctggtggaaaaggtgacataccttaagaagaaacaagcggaaaagccagtggagtctgactcgaagaagtctagcactctgcagcagctaatcagcgaaacaatggtacgctgggcccaagaatctgtaatcgaagatccagagttggtgcgagcgatgttcgtgttgttgcatcgtcagtatgatggaatcgggggactcgttcgtgcccttcctaaaacctacactattaacggtgtgtccgtggaggacacgatcaatctgcttgctagcctcggacaaatacgttccctactaagcgtcaggatgggaaaggaagaagaaaaactgatgatcaggggtctgggtgacatcatgaataacaaggtgttctatcaacaccccaatctcatgcgggcattgggcatgcatgaaacagtcatggaggtgatggtcaatgtgcttggcggaggagaatctaaagagatcactttcccaaagatggtcgctaattgttgccgcttcctttgctatttctgtcggatctcgaggcagaatcagaaggctatgtttgatcatctctcgtatctgctcgaaaattcttcagtcggcctcgcttcacccgctatgcgtgggtccacgcctttagacgtcgcagcggctagcgtgatggataataacgagttagcactcgctttaagagagccagatcttgagaaggtggttcggtacctagccggatgcggactacaatcttgtcagatgctcgttagtaaaggctaccctgacattggttggaatcccgtggagggagaacggtacctggacttcctccgctttgccgtattctgcaatggagagagtgttgaagaaaacgcaaatgtagtggtgcggctactgattagaaggccagaatgtttcgggcctgccctgcgcggagaagggggtaacggactgttggcggcaatggaagaggccattaagattgctgaagatccctctcgcgacggcccttcccccaattccggttcatccaagaccttagacacagaggaggaggaggatgacacaatccatatgggcaacgccataatgacattctactccgcacttatagatcttctgggcagatgtgcgccagaaatgcacttaattcacgcaggaaaaggtgaggctatccgcatacgaagtatcctacgatcattgatcccgctgggagacttggtcggggtgatcagcattgcgtttcagatgccaacaattgcaaaagacgggaatgtggtagagcctgacatgtccgcaggcttctgcccagaccacaaagcggcaatggtgctcttcctggaccgggtttacggcattgaagtgcaagactttctgttgcatctcctggaggtggggtttctccctgacttaagagccgctgcgtccctggacaccgctgcgctgtcagccacagacatggctttagcccttaaccggtatctttgcaccgcagtgctgcccctcctgacccgatgtgcccctttattcgccggtactgaacaccacgcgagcctcatcgattctctgctccacaccgtctacagactgtccaaggggtgcagtctaactaaggcacaacgtgattccatcgaggtgtgcctgctgagcatatgcggtcaattgcgcccttcaatgatgcagcacttactgagacgacttgtattcgatgtcccactgctaaatgagcacgctaagatgcctctgaagctcttgactaaccattacgagagatgctggaagtactattgtcttcctggcggatgggggaactttggagctgcttccgaggaagaattgcacttgtcacggaagttgttctggggaatttttgatgcactgagccaaaaaaagtatgaacaagagttgtttaagcttgctctgccctgcttgagcgcggtagccggtgctctccctcctgactacatggaatcgaactatgtttcaatgatggagaaacaaagcagcatggactctgaagggaatttcaacccccagcctgtcgacacctcaaacattaccattcctgagaagcttgagtattttatcaataaatatgctgagcactcccacgacaagtggagcatggataagttggccaacgggtggatatatggcgagatctattcagactcatcaaaagtccagccccttatgaagccatacaagctgctgagcgagaaagagaaagaaatctaccgctggccaataaaggaatcactgaaaactatgctggcctggggatggcgcattgagagaacacgggagggcgacagtatggccctgtataatcgcacccgcaggattagtcagacaagtcaggtgagcgtggacgccgctcacggctattcccccagagctattgacatgtcgaatgtgacgctgagtcgcgatctccacgctatggctgagatgatggctgaaaattaccacaacatctgggccaagaagaagaagatggagctcgagtcaaaagggggagggaaccaccccttgttggtgccttacgatacgctcacagccaaagagaaggctaaggacagagaaaaagctcaggatatcttaaagttcctccagataaatggctatgccgtgagcagaggcttcaaagatctagagttggatactccaagcatcgagaagcgatttgcctattcatttttacagcagttaattaggtacgtggacgaagcacatcagtacatcctcgagtttgatggtggcagtcgtgggaaaggcgagcacttcccttatgaacaggagattaaattttttgctaaggtggtgctgcctctaatcgatcaatatttcaaaaatcataggctctattttttgtcagctgcctccaggcccctctgtagtggtggccacgcctcaaataaggagaaggagatggtcacatctcttttctgtaagctcggtgtgcttgttcggcaccgcatctctctgtttggaaatgacgccacgtccatcgtaaactgcctgcacattttgggacaaaccttagacgcgagaacggtaatgaaaactggcctggaaagcgtcaagagcgccctaagggcatttctggacaacgcagcagaagatctggagaaaacgatggagaatctcaagcaggggcaatttacccatacccgcaaccagcccaagggggtaacccagattattaattacaccaccgtggctttacttccaatgctgagcagcttatttgagcatattggacagcaccagttcggtgaggacctcattctggaggacgtgcaagtcagctgctatcgaatattaacatccctgtatgcattgggcacaagcaagtctatatacgttgaaaggcaacgctcagccttgggggagtgcctcgccgctttcgctggggcattccccgtcgcttttctcgaaacccacctggataagcacaatatatattccatctacaatacaaagtctagccgggagagagcagccctaagtttaccaacaaatgttgaggacgtgtgcccgaatattccctccctggagaagctgatggaagaaattgttgaactggccgagagtggtatccggtacacccaaatgccacacgtaatggaagtcatcttgccaatgttgtgctcctatatgtctagatggtgggagcacggccctgagaacaacccagaaagggcagagatgtgttgcactgccttgaacagcgagcatatgaatactctgctcggaaatatcctcaaaatcatttacaacaacctgggtatcgacgagggcgcttggatgaaacgcctcgctgtgttctctcagccgatcattaataaagtgaaaccccagttgctgaagacgcactttctgccgctaatggagaaattgaagaagaaggctgctacggtagtgtctgaagaggatcacttaaaagctgaggctaggggagatatgagcgaggccgaactgctgatattggatgagttcactactctggctcgagacctgtacgcattctatccactcctgatccggttcgtggattataaccgcgcaaaatggctgaaagagccaaatccggaggctgaggagctttttcgtatggtcgccgaggtgttcatttattggtccaagtcacacaactttaaacgtgaagagcaaaacttcgtggtacagaacgagataaacaacatgagtttcctgattacggatactaagagcaaaatgagcaaagcagccgtgtctgatcaggagaggaagaaaatgaagcgtaaaggcgaccgctacagtatgcagacatctctgatcgttgctgccctgaagagactcctgcccatcggattgaacatttgcgcacccggagatcaggagctgattgcacttgcgaaaaatagattcagtctcaaggacacagaggacgaggtaagagatattattcgcagtaacatacacctgcagggaaagctagaagaccccgcaattcgatggcagatggcactgtacaaggatctgccaaacagaacggatgacacgagtgaccccgaaaagaccgtagaacgtgttctcgacattgctaacgtcctgtttcacctcgaacaaaaaagcaagagggtagggcgaaggcactattgccttgtggaacacccacagaggtctaaaaaggctgtctggcacaagttgctgtctaagcagcgcaagagagctgtggtggcatgctttagaatggccccactctacaatctcccacgacatcgcgcagttaaccttttcctgcagggctatgaaaaaagttggattgagacagaggagcattactttgaggacaagctgatcgaagatctggctaagccaggcgctgaaccacccgaagaggatgagggcactaaaagggtcgacccgctgcaccagttgatcttactgttttcccgtacagcactgacggagaagtgtaagctcgaggaggacttcctgtatatggcctatgccgacataatggccaaaagctgccatgatgaagaggatgatgatggggaggaagaagtaaagtctttcgaagaaaaggagatggaaaagcagaagctgttgtaccagcaggccaggctccacgatcgtggtgcagccgaaatggtcctccaaaccatttccgctagtaagggcgaaacaggaccaatggtggcagccacgctaaagcttggcatagccatcttgaatggcggaaattccaccgtgcagcagaaaatgctcgactacctgaaagaaaaaaaggacgtcggattcttccagtccctcgctggcctgatgcagtcatgcagcgttctggacctgaacgccttcgaaagacagaacaaagcagaaggcctcggtatggtcacggaggagggatccggcgaaaaagttctccaggatgatgagtttacatgcgacttgttcaggtttctgcagctgctgtgtgaaggtcacaatagcgatttccaaaactacctgcgaacccagacagggaacaacacaaccgtgaacatcatcatctcaaccgtcgactacctgttaagagtgcaggagtccatttctgatttctactggtattactccgggaaagatgtgatcgatgagcaaggccagcgtaattttagcaaagctatccaggtggcaaagcaagtttttaataccttgacggagtatattcagggaccgtgcacaggtaaccagcaaagtttggctcatagccgattatgggacgcagtggtcggcttccttcatgttttcgcccacatgcagatgaagctgtcccaagatagtagccagatcgagttactcaaagagctcatggatctgcaaaaggacatggtggttatgctactgagcatgctggaaggaaacgtagtcaatgggaccattggcaagcagatggtggacatgctggtcgagtccagtaataatgtggagatgattcttaaattcttcgacatgttccttaagctaaaagacttgacctccagtgatacctttaaagagtatgatcccgacggcaagggagtcatatcaaagcgagactttcataaagccatggaatcgcacaaacattacacacaatcggaaaccgagtttctcctgagttgtgctgagacggacgagaacgagacactagactatgaggagtttgtaaaacggtttcacgagccagcaaaagatatcggatttaacgtcgctgtgctactcactaacctgtccgagcatatgcccaacgacactcgactgcagacatttctcgagctggccgagagtgtgctcaattacttccagccatttctggggaggattgagatcatgggaagtgccaaacggattgaacgcgtttactttgagatttccgaaagttcaaggacacagtgggagaaaccacaggtgaaagagtcaaaaaggcaattcatctttgacgttgtgaatgagggcggagagaaagaaaagatggaactcttcgtgaacttctgtgaggacaccatcttcgagatgcagctggctgcccagatctcagagagtgacctgaatgaacgcagtgctaacaaagaagaaagcgagaaggaacgcccagaagagcagggacctcgcatggcctttttcagtatcttgacggttaggagcgctctgtttgcccttcgttacaacatcctgaccctgatgcgaatgctgagtcttaagagccttaagaagcaaatgaaaaaggtcaagaagatgaccgtcaaggatatggtgactgcctttttttcatcctattggtccattttcatgacgttactgcactttgtcgcctctgtcttcagaggtttctttcgaattatttgcagtctcctcttgggaggaagcctcgtggagggggctaaaaagattaaggtggccgagctcctggccaatatgcccgaccctacccaggatgaggtacggggagacggggaggaaggcgaaaggaagcctctcgaggccgctcttccctcggaggacttgactgacctgaaggagttgaccgaagagagcgacctactctcggacatcttcggactggacctgaagcgcgaaggcggtcagtataaacttattccacacaatccaaacgcaggactatcagacttgatgtccaatcccgtgcctatgcccgaagtgcaagaaaaattccaggagcaaaaggcgaaagaagaggagaaggaggagaaagaggagacaaagtctgagcccgagaaagccgaaggggaagacggtgagaaagaggaaaaagccaaggaggataagggcaagcagaagctccgacagctccatacacaccgctacggggaacctgaagtccctgagtcagctttttggaaaaaaattattgcgtatcaacaaaaattgcttaattacttcgctcggaatttttacaacatgaggatgctcgcactgttcgtagcctttgccataaattttattctgctgttttataaagttagcactagtagcgtggtggagggcaaagagctgccaacccgatcatccagtgaaaacgccaaagtcacatccctggactccagcagccaccgcattattgctgttcactatgttctggaggagtcatctgggtacatggaacctacactcagaattctggctatcctgcacactgtgatcagctttttttgcatcatcggctactattgcctgaaggtgcctctggtgatattcaagagagagaaagaagtagcaaggaagttggaatttgacggactgtacattaccgaacagccctccgaagatgatatcaaaggccagtgggacaggctcgttatcaatacccagtccttccctaataattattgggataaatttgttaaaagaaaagtgatggacaaatacggtgaattctacggtcgtgatcgaatctccgaattgttaggcatggacaaagctgcactggatttctctgatgccagagagaagaagaagcctaaaaaagattcctctctttccgctgtgcttaatagtatcgacgtcaagtaccagatgtggaagctgggggtggtttttactgataatagcttcttatatttggcttggtacatgactatgtccgtccttggacattataataattttttttttgcagctcacctcctggatattgctatgggctttaaaaccctgcggactatactgtcgtccgtgacacacaacggtaagcagcttgttctgacagtcggcctacttgccgtcgtggtttatctctatacagtcgtggcctttaatttcttccgaaagttttacaataagtcggaagacggtgatactcccgacatgaagtgtgacgacatgctgacctgctacatgttccacatgtacgtcggtgtgcgggctggcggaggaattggagacgagattgaggatcctgccggagatgagtatgaaatttacaggatcatctttgacataacgtttttctttttcgtcatagtgatattgttggcaattatccagggcctgatcatcgatgcatttggtgagctgcgagaccagcaagaacaggtcaaggaagatatggaaacaaaatgcttcatttgcggtatcggtaatgattacttcgataccgttccacatgggtttgaaactcataccttacaggagcacaatttagccaattacctctttttcctcatgtaccttatcaacaaagacgaaacagaacacaccggccaagagagttacgtttggaaaatgtaccaggagaggtgttgggagttcttccccgcaggagactgttttcgcaagcaatatgaggaccagctgaattaa

SEQ ID NO: 239505 - DNA, 987 bp, Artificial Sequence
  Description of Artificial Sequence: Synthetic coding sequence
atggagcctaccctaaggatactggccattttgcatactgtaatttcgttcttttgcatcattgggtactactgtttaaaagtgccccttgtgatctttaagcgcgagaaggaagtcgcacggaaactggagtttgatggcctctacattactgagcagccttcagaggatgatattaagggacagtgggatcggctggtgattaacacccagtcctttcctaataattattgggataagttcgtgaagagaaaagttatggataagtacggtgagttttacggacgcgatcgcatctctgaactcctgggtatggataaggccgctctggactttagtgacgccagggagaaaaaaaaaccaaaaaaagactcctctctgtccgccgtgctaaattctattgacgtgaaatatcagatgtggaagctgggggtggtgtttactgacaattcattcctgtacttggcctggtacatgactatgtctgtccttgggcactataacaacttctttttcgcagcccatttgttagacatcgccatgggcttcaagaccttgagaaccattttgagcagcgtgacacataacggcaagcagttggtgctcactgtgggattgttggcagtggtggtgtacctctatacggtagtcgcttttaacttcttcagaaaattttataacaagtctgaggatggggataccccagacatgaagtgcgatgatatgcttacttgttacatgttccacatgtacgtaggggttagggcaggtggtggaattggagatgagatagaggaccccgcaggtgacgaatacgagatttaccggattatctttgacattaccttcttctttttcgtcatcgtgatcctactggcaataattcaaggcctgatcattgacgccttcggagaactgagggaccagcaagagcaagtaaaggaagacatggaggtcttctcggatgtgtcttacaagcagcgctag

SEQ ID NO: 239506 - DNA, 645 bp, Artificial Sequence
  Description of Artificial Sequence: Synthetic coding sequence
tcattattttgcaagcttggtgtgctggtgcggcataggatatcacttttcggaaacgatgccacctccattgtcaattgcctgcatatccttggccaaactcttgatgctcgcactgttatgaagaccggtcttgaatctgtgaagagcgcacttcgggcattcttggataatgcagcggaagatctggagaagactatggaaaacctgaagcagggtcaatttacacatactagaaatcagccaaaaggcgtgacccaaattattaactataccaccgtggccctcttacccatgctttcaagtcttttcgaacacatcggacagcatcagtttggcgaagatctgatcctagaggatgtccaagtctcttgctatagaattctgacaagcctctatgccttgggcactagcaaaagcatctatgtcgagcgccaaaggagcgccttgggcgaatgcttagcagcctttgctggggcatttcccgtagcctttcttgaaacccacctggataagcacaacatttacagcatctataataccaagtcttccagggagcgtgcggctctgtccctccccactaatgttgaagacgtgtgtcctaacatccctagcctggagaagctaatggaggagattgtgtag

SEQ ID NO: 239507 - DNA, 4266 bp, Artificial Sequence
  Description of Artificial Sequence: Synthetic coding sequence
atgaagactggtttggagagcgtgaagtccgcgctcagagccttcctagacaacgctgccgaagacttggagaaaacaatggagaatctcaaacaaggtcaattcacccacaccaggaatcagccaaagggcgtgacccagatcattaattacactactgttgctctgctgcctatgcttagttcactcttcgagcacatcgggcagcaccagtttggcgaggaccttatactggaggacgtccaggttagctgttacaggatcctgacctccctatacgccttaggcacatcaaagagtatttacgtagagagacagcggtccgccctgggcgaatgcttggccgcattcgcgggtgcctttcccgtcgcttttttggaaacccatctggacaaacacaacatatacagtatttacaacacaaaaagcagcagagaaagagccgctctgtctctgcctactaatgtagaggacgtctgtcccaacattccgtcactggagaagctgatggaggaaatagtggaactggctgaatccggcatcaggtatacacaaatgccccacgtaatggaagtcattctacctatgctgtgctcttatatgagtaggtggtgggagcacgggcctgaaaataaccccgaacgagccgagatgtgctgtacagccttaaattctgagcatatgaacaccctcctgggcaacattcttaagataatctacaataatctcggcatcgatgagggtgcatggatgaaaaggcttgccgtcttctcccaaccgatcattaataaggttaagcctcaacttctcaagacacactttttgccgctcatggagaaactgaaaaaaaaagccgctactgtagtgtcagaggaggaccaccttaaggcagaagcaagaggagacatgtccgaggcagagcttctcatcctggacgagttcacaacactagccagggatctgtatgctttctatccccttttgatcaggtttgtcgattacaatcgcgcaaagtggctcaaagagcccaacccagaggctgaggagctttttaggatggtggccgaggtgttcatctactggagtaaatcccataactttaagagagaggaacaaaatttcgtcgtgcaaaatgaaattaacaatatgtcgtttctgatcaccgacactaaatctaagatgtccaaggctgcagtgtcagatcaggaacggaagaaaatgaagcgtaagggcgaccgctactctatgcagaccagcctcattgtggctgctctgaagaggctactgccgattggcttaaatatatgcgctcccggagatcaggaacttatagcactagctaaaaataggttttcgcttaaagacacagaggatgaagtgcgtgatattattcgcagcaacatccatcttcaagggaaacttgaggaccccgcaattagatggcaaatggccctgtataaagatctccctaatcgcactgatgatacatctgacccggaaaagactgttgagcgggtcctggacattgccaatgtgctgttccatcttgagcagaaatcgaaacgagttgggcgtagacattattgtctggtggaacatccacaacgaagcaagaaggctgtgtggcataagcttttatctaagcagcgcaaaagggcagttgtggcttgctttagaatggcgccactgtataatctgcctagacatcgagccgttaacttattcttacagggttacgagaagtcctggattgaaactgaggagcactacttcgaggataagctcatcgaggacctagctaagcctggcgcagagccaccagaagaggatgaggggacaaagcgggtggatcctttgcatcaactaattctgctgtttagcagaaccgcgctgacggaaaaatgcaaattggaggaggattttctgtacatggcttatgcagacatcatggccaagagctgtcacgatgaggaagacgacgacggtgaggaagaggtgaagtcctttgagcatgacatcataaaggatttgcgcaataagtttgcttctctgggcgagaactcgctggaaaaagagatggagaagcagaagctgctctatcaacaggcacgcctgcacgaccggggtgccgcagaaatggtgttgcagacgataagtgcttctaagggggaaaccggacctatggtggcagccacgttgaaattggggattgccattctgaatggcggaaatagcaccgtgcagcagaagatgctggattatctaaaggaaaagaaggatgtggggttcttccagtccctggcaggccttatgcagtcttgcagcgtgttggatctgaacgcattcgagcgacagaataaagcagaaggcctcgggatggtgactgaggagggctctggagagaaggtgttgcaggacgatgaattcacatgcgatcttttccgattcctccaattactatgcgagggtcataacagtgactttcagaactacctgaggactcaaacggggaataataccacggttaatattatcataagtaccgtggattatttgctgcgcgtgcaggagtcaatctcagatttctactggtactattccggcaaggatgttatagatgagcagggccaacggaacttcagcaaggccatccaagtggctaagcaagtatttaacacccttaccgagtacatccaggggccatgcaccggcaaccaacagtccctggcacattcacgactatgggacgccgtggtcgggtttctgcatgtcttcgctcatatgcagatgaagctgtcacaggactcaagccagatcgagctgcttaaggaacttatggacttacagaaagatatggtggtcatgctgctgtctatgctcgaagggaacgtggtaaatggtaccatcggtaaacagatggttgatatgctcgtggagtcaagcaacaatgttgaaatgattctgaagtttttcgacatgtttcttaagctgaaggatctcacatcaagcgatacattcaaggagtacgaccctgatggcaaaggagtgatctctaagcgggactttcacaaagccatggaatctcataaacattatacccagtcagagacagagttccttctgtcttgtgccgaaactgacgagaatgagacacttgactacgaagagtttgtaaagagattccacgagcctgccaaggatatcggttttaatgtggcagtgctgctgactaatctgagtgagcatatgcccaacgataccagactccagacattcctcgagctggccgaatctgtattaaattactttcagcccttcctggggaggatagaaataatgggttccgcaaagcgcatcgaaagggtgtacttcgagatcagcgaatcctctcggacgcaatgggagaagccacaggttaaagaaagcaagcggcagttcatattcgacgttgtgaacgagggaggagaaaaggagaaaatggagctcttcgtaaatttctgcgaggatacaatctttgagatgcaactggctgcgcagatcagcgagagcgacctgaatgaacgatccgccaacaaggaagaaagcgagaaggaaagacccgaagagcaggggcctcgaatggcattcttcagcatactaacagtgcggagcgccctttttgctttacgctacaacattctgaccctaatgcgtatgctgagcctgaaaagcctcaagaagcaaatgaagaaggtgaaaaaaatgacagtaaaggatatggtcaccgcattcttctcgtcctactggtctattttcatgaccttattacattttgtggcttctgtgtttagggggttctttaggattatttgctctctcctgcttggaggctcacttgtcgaaggagccaagaagattaaagtagctgagctgctggcaaatatgcctgaccctacccaggacgaagtcaggggcgacggggaagaaggcgaacgcaaacctctggaagcagcacttccctctgaagaccttacagacctgaaagagcttaccgaggaatccgacctcctttccgatatcttcgggctcgatttgaaacgcgaagggggacagtacaaactgatccctcacaatccaaacgctggcctgagtgacttgatgtcgaaccctgtgcctatgcccgaggtgcaagaaaaatttcaagaacagaaagccaaagaggaggaaaaagaagagaaggaggaaactaaatccgagcccgagaaagcagaaggagaggacgggtag

SEQ ID NO: 239508 - DNA, 14856 bp, Artificial Sequence
  Description of Artificial Sequence: Synthetic coding sequence
gatgacgaagtggtcctgcaatgcaccgcgaccattcacaaggaacagcagaagctgtgcctcgccgcagaaggcttcggtaatcgtctgtgctttctagagtccaccagcaattcaaagaacgttccacctgacctcagcatttgcacatttgtactggaacagtccctgagcgtgcgagctctacaggaaatgctggccaataccgttgagaagtccgagggacaggttgatgtggaaaagtggaaatttatgatgaaaactgcccagggtggcggacacaggacactgctctatggtcacgcaatcctgttaaggcactcctattctgggatgtatttgtgctgtctcagcacctcaagatcttcaaccgacaagctggcttttgacgtagggttgcaggaggataccacaggcgaggcatgttggtggaccatccacccagcatccaaacagcggagcgagggcgagaaggttcgggtcggcgacgacttgattctggttagtgtcagtagtgaaaggtatctgcacctgtcctatgggaatggcagtcttcacgtggacgctgcttttcaacaaaccttatggagcgtcgcacctatctcttccggatctgaggctgcccaagggtacctaatagggggagacgttcttagactcctgcatggccacatggacgagtgtctgactgtcccttctggcgagcacggcgaggaacaacggagaacagtgcattacgaaggcggtgcggtaagcgtgcacgcaagatccctttggaggttggagaccctccgcgtggcatggtccggtagccacatacgctggggtcagccatttagactgaggcatgtcactacgggaaaatatctctcattaatggaagacaagaatctgcttctgatggacaaggaaaaagctgacgtaaaatctactgcatttacatttaggagcagcaaggaaaaactggacgtgggagtgcggaaggaagttgatggcatggggacatccgagatcaaatatggggatagtgtgtgctatatccagcatgttgataccggactttggctgacttaccaaagcgtcgacgttaagtccgttcgaatgggcagtatacagcggaaagcaatcatgcaccatgaaggccatatggatgacggaatctccttgagccgtagccagcacgaagaatcccgcacagctagggttattagaagtacagttttcctgtttaataggtttattcggggattggacgcactgtcgaaaaaagcaaaggcttcaaccgtggatctccccatcgaaagcgtaagtctgagcctgcaggatctgatcggttattttcacccacccgacgagcatcttgagcacgaggacaagcagaacaggcttagggctttaaagaacagacagaaccttttccaggaagagggtatgatcaacctggtgcttgaatgcatcgatcggctgcacgtctatagttctgctgcccacttcgcagacgtcgccggacgagaggccggagagagttggaaatctattttgaacagtctatacgagttgctcgcggcacttatcagaggtaatagaaaaaattgtgcccagttttccggaagtttggattggttaatttcaaggttagaacgcttggaagccagctccggaatactggaagtgcttcactgtgtgctggtggagtcacctgaagcgctcaacatcattaaagaggggcacatcaaatcgataatttctctgcttgacaaacatggacgtaaccacaaagttcttgatgtgctgtgctccctttgtgtgtgccacggcgtcgcagtccgaagcaaccagcatcttatctgcgataatctccttccgggtagggatcttttgctacagactcggcttgtgaaccacgtgtcctcgatgcgccctaatatttttcttggggtgagcgaaggatctgcacaatacaagaagtggtattatgagctgatggtggaccacaccgagcctttcgtcaccgcggaggcaacccatttgagggtggggtgggcaagcaccgagggctacagcccttatcccggtggcggagaggaatgggggggaaacggcgtcggtgatgatctcttctcctatggcttcgatgggttgcacctgtggtctggctgcatcgcccgtactgtatccagtcccaaccagcatctgctgcgtactgacgatgtgatcagctgctgcctggatttaagtgccccatcaatcagtttccgtatcaatgggcagcccgtccagggaatgttcgagaattttaacattgatgggctgttcttcccagtggtgagtttttccgcgggtataaaagtgcgcttcctcctcgggggaaggcatggggagttcaaatttctcccaccaccgggatacgccccttgttacgaggccgtcctgcctaaggagaagcttaaagtggaacattcacgggagtataaacaggagcgcacatataccagagacctactgggaccgactgtgtccttaacacaggccgcattcactcccattcctgtggacacgtctcaaattgtcctgcccccacacctggaaagaattcgcgagaaattggcagagaacatccatgagttatgggtgatgaacaagatagaacttgggtggcagtacggacccgtaagggacgacaacaaaagacagcatccctgcctggtggagtttagcaaactgcccgagcaggagcggaattacaacctgcagatgtctctcgaaacgttgaaaactttattagccctggggtgccacgtcggaatttctgatgaacacgcggaggataaagtgaagaagatgaagttacctaagaactaccagctcactagtggatacaaacccgcacccatggatttgtcgtttattaagctcactccctcgcaggaggccatggtggacaagttagcagagaacgctcacaatgtgtgggccagagacagaatccgccagggctggacatacgggatccagcaggatgttaaaaatcgtcgcaacccacgactggtgccctacaccctactggacgaccggacgaagaaaagcaataaggacagccttagagaagctgtccggactctcctgggatacggatataatctggaggcccctgaccaagatcatgctgcccgtgccgaggtatgctccggaaccggagagcgctttcgaatcttccgggcagaaaagacctacgctgtgaaggccggaagatggtacttcgagttcgagaccgtgacagcgggagacatgcgggtgggctggtctcgacctgggtgccagcccgaccaagaactggggagcgacgagcgcgctttcgcctttgacggcttcaaggcacagcgctggcaccaaggtaacgaacactatggccgaagctggcaggccggtgatgtagtaggctgcatggtcgacatgaatgagcacacaatgatgttcaccctcaacggtgaaatcttacttgacgattcaggatctgagctggcctttaaggattttgacgtgggagatggattcatcccggtgtgcagccttggtgttgcccaggtaggcaggatgaactttgggaaagatgtgtcaacactgaagtactttacaatttgcgggctgcaggagggatacgagccattcgccgtgaatacaaatcgggacattacaatgtggctgagcaaacggttgccacagtttctgcaggttccctccaatcatgaacatattgaggtgacgagaatcgacgggacaatcgattcctcaccctgcctgaaggtgacccagaaatccttcggctctcagaattccaatacggacatcatgttctaccggttgagtatgcctatagagtgtgccgaagtgttctctaagaccgtcgccggtggcttgcctggtgccggactttttgggcctaaaaacgatctggaagactatgatgccgacagcgactttgaggtgctgatgaaaacagcacatggacatcttgttccagatcgtgtagacaaagataaagaagctacaaagccagagttcaacaatcacaaggactacgctcaggagaaaccctcccgccttaaacagaggtttcttctgcgcagaaccaaacctgattattcaacctcccacagtgccaggctgaccgaagatgtgcttgccgatgacagagacgactacgactttctgatgcagacgagtacctactactacagcgtacgcatttttccaggccaggaaccagccaatgtttgggtgggatggattaccagcgattttcatcaatacgatactggcttcgatctggatagagttagaactgtgaccgttaccctaggcgatgagaaagggaaagtgcatgagtccattaagaggtccaattgctacatggtgtgtgctggcgaatccatgtcccctggacaaggacgtaataacaacgggttagagattgggtgtgtggtggacgctgctagcggcctgctgacgtttattgccaacgggaaagagctctccacatattatcaagtggaacctagcaccaaattattccccgcagtgttcgcccaggccacgtctcccaacgtgttccagttcgagctcgggaggattaaaaatgtgatgccactgtctgctggtctttttaagtctgagcacaagaaccccgtgcctcagtgtccccctcggctccacgttcaattccttagtcatgtgctctggagtcggatgccaaatcagtttctcaaggtggatgtttccagaatatccgagagacagggctggctggtgcagtgcctggacccactccagttcatgtccctgcacatcccggaggaaaacaggtcagtggatatcttggagctgactgagcaggaggagttacttaagtttcattatcacacactccggctgtactccgccgtctgtgctttaggaaatcacagagtggctcatgctctctgctcccacgtcgatgagccccaactgctgtacgctattgaaaacaagtacatgcccggactgcttagagccggttattacgatctactcatcgacatccacttatcttcatacgcaaccgcgaggctaatgatgaacaatgaatatatagttccaatgacagaagagactaagagtattaccctcttcccagatgagaacaagaaacatggactccccggaatcggactttctacaagtttgcggcctagaatgcagttttcatcgccctcatttgtgtcaatcagcaatgagtgttaccaatatagtcctgaatttcccctggacatattaaagagtaaaaccatacaaatgctcacagaggcagtaaaagagggcagtctccacgccagagaccccgtggggggaaccaccgaattcctgttcgttcccctcattaaactgttctacacactcttaatcatggggatcttccacaatgaggatttgaaacatatcctgcagctaatcgagccatctgtatttaaggaggccgcaaccccagaagaggagtctgacactctcgaaaaggaattgtccgtggacgacgcaaagctccagggagcaggagaagaggaggcaaaggggggtaagcgccctaaagagggcttactccagatgaagttgcccgagccagtaaagctccagatgtgtctgttactgcagtacctctgtgattgtcaagtgagacaccggatcgaagctattgttgctttctctgatgattttgtggctaaactccaggacaaccagagattccgctataacgaggtgatgcaagcgctgaatatgtctgctgctctcaccgcccgaaaaaccaaggagtttagaagccccccacaagagcaaatcaacatgctgctcaacttcaaagacgataagtcagagtgtccttgccccgaggaaattcgcgatcagcttctggatttccacgaggatttgatgacccattgcggaatcgaacttgacgaggacggctccctcgatggcaattccgacctgacaatccgtggcagactgttatccctggtcgagaaggtgacgtacttgaagaagaagcaagccgagaagcctgtcgagagcgatagcaagaagtcctctaccctgcagcagttgatatcagaaaccatggttcgctgggctcaagagtccgtcatcgaggaccctgagcttgtcagagctatgtttgtgctgctgcatagacagtacgatggcatcgggggacttgtgcgggcactccctaagacgtatacaatcaacggcgtgagcgtggaagacactatcaacctattagcctcactcgggcaaatccggtcgctgctgtctgtccgaatgggtaaggaggaagagaagttgatgattaggggccttggggatatcatgaacaataaagttttttatcaacacccaaacctgatgagagcattgggcatgcacgaaacagttatggaggttatggtcaacgtcctgggtgggggagagtccaaggaaatcacgtttcctaaaatggtggctaactgctgtaggttcctgtgttacttctgtaggatttcccggcagaatcagaaagcaatgtttgatcacttgagctacctgctggagaactcctccgtaggactggcaagtccagccatgagaggaagcacccccctggatgtggctgcagcttctgtgatggacaataacgagctcgcccttgccttgcgggaacccgacctggagaaagtggtgcgctaccttgcagggtgtggactgcaatcttgtcaaatgttggtgtcaaaaggatatccagatatcggctggaacccagtggaaggggaacggtacctggacttcctgagattcgccgtgttctgtaacggcgagagcgttgaggagaatgctaatgtcgtggttagattgctgattaggcgtcccgagtgcttcgggcctgctttgagaggtgaaggcggtaacggcctgctcgccgcaatggaggaggcgataaaaatcgccgaggacccctcacgtgacgggccaagccccaattctggtagcagtaaaactctggatactgaggaagaagaggacgacacaattcatatgggcaatgctatcatgaccttttacagtgcgctgatcgatctgctcggtagatgtgcccctgaaatgcatcttatccacgctggcaagggcgaagccatacggatacgctccattttacgatctctgattccacttggggacctggtgggcgtcatttcaattgccttccagatgcccaccattgccaaggatggcaatgtggttgagcctgacatgtctgctgggttctgtccagaccacaaagcggctatggtgctttttctggacagggtgtacggtatcgaagtgcaggacttcttgctacacttgctagaggttggatttcttccagacctccgtgccgctgcctctctcgatacggctgctctgagtgccactgatatggcgttagccctcaaccgatacctgtgtacagctgtcttacctctcctgactaggtgtgctccattgtttgcagggacagagcaccacgcatccttgatcgactctcttctgcatacagtgtacagattatccaagggttgtagtctgaccaaagcccagcgagattccattgaggtgtgtctgttgtcgatttgcggtcagcttaggccctctatgatgcagcacctcctccgcaggctcgtgtttgatgtccctctgctgaacgagcacgccaagatgccgcttaagctcctcaccaatcactatgaacggtgctggaagtactactgtttaccaggagggtggggcaattttggagccgcatctgaagaggaattacacctctctcgcaagcttttttggggcatatttgacgctctatctcagaagaaatacgaacaggagctgttcaaactggccctgccttgcctgagtgctgttgctggcgcacttcccccagattacatggagtctaactatgtgagtatgatggagaagcagtcttccatggattctgaaggtaattttaacccacaaccagttgacacatccaatataaccatcccagaaaaattagagtacttcattaataaatacgccgagcactcacacgacaaatggagcatggacaagcttgccaacggctggatatacggggaaatctattcagactccagtaaagtccagccactgatgaagccatacaaactcctcagcgagaaagagaaggagatctacaggtggcctataaaagagtccctaaagacaatgcttgcatggggatggagaattgaacgaacccgggaaggggattctatggctctctacaatagaacgagacgaatcagccagaccagtcaggtttcggttgatgcagcacatggatattctccacgggctattgacatgtcaaacgtcaccttgagcagggatctgcatgcaatggccgaaatgatggccgaaaactatcataacatctgggccaaaaaaaagaagatggagctcgaatccaaaggtggaggcaaccacccattgcttgtcccgtacgatacactcacagctaaggagaaggcaaaggaccgcgagaaggcacaagacatcctgaagttcctgcagatcaacgggtacgcagtgagcagagggttcaaggatttagagttagatacaccgtctatcgagaagcggtttgcatactccttcttgcagcagttgatccgatacgtggatgaggcccatcagtacatcctggagtttgacgggggtagccgcggaaagggcgagcacttcccctatgagcaggagatcaagtttttcgctaaagttgtactgcctctcattgatcagtactttaagaaccatcggctctattttctatctgcggcatcccgtcctctgtgttcagggggtcacgcctctaacaaagaaaaagagatggttacctcactgttctgcaaacttggggtgctcgtgcgccaccgcattagtctgttcggaaacgatgcaaccagcattgtgaactgccttcacattctcggacagacccttgacgcaaggactgttatgaaaactggccttgagtctgtgaaatcagcccttcgcgcttttctggataacgcagcagaggatctggagaagacaatggaaaacttaaagcagggccagttcacccacactagaaatcagccaaagggggtcacccagatcatcaactatacaacagtggcgctgctgccaatgctgagtagcttatttgagcatatagggcaacaccaattcggagaggacctgatcctcgaggacgtccaggtcagttgctatcgcatactgactagcttatatgcactgggaacaagcaaatctatttatgtagagcgccagaggtcagccttaggcgaatgcctggccgcttttgcaggggctttccccgtggcatttcttgaaacacatctcgacaagcataatatatattctatttataacacgaaatcttctcgcgagagggccgcactgtctctgcccactaacgtggaggatgtttgtcccaacatcccatcattggagaagcttatggaggagattgtggagctcgcagagagtggtattcggtatacccaaatgccgcatgtgatggaggtgattctgcctatgctttgctcctacatgagccgctggtgggagcatggtccagaaaacaaccctgagcgggctgagatgtgttgcacggctctgaactccgagcacatgaacaccctcctggggaacatcctgaagatcatttataataatctaggcatcgatgagggggcatggatgaagcgcctggcggtattctctcaacccatcatcaataaagtgaaaccacagctgctcaaaactcactttctccccctaatggaaaagcttaaaaagaaagcagcaaccgtggtgtctgaagaagatcatcttaaagcagaggctagaggagacatgtctgaagccgaactcctgatactcgacgagttcactacactggctcgcgatctctatgccttttacccactgctcatcagattcgtggactacaaccgtgctaagtggttgaaggaaccaaatcctgaagcagaagaactctttcggatggtagccgaggtctttatctactggtcgaagagtcacaacttcaagagagaggagcagaactttgtagtgcagaacgaaatcaataacatgtcattcctgataaccgacaccaaaagtaaaatgagcaaagctgccgtgtctgaccaggagcgcaagaagatgaagcgcaagggcgaccgttacagtatgcagacttcccttatcgtcgccgcattaaagagactgttacctatcggtcttaacatttgcgcaccgggagaccaagagctgattgcccttgcaaagaaccgcttctctcttaaagatacagaagacgaggtgagggatattattcgttccaatattcacctccaaggaaagttggaagatcccgcaattagatggcagatggcattgtacaaggatctcccaaaccgcacagatgatacgagcgatcctgaaaagacagtggaaagagtgctggatattgccaatgtgttgttccacttagaacagaaatctaagcgcgtggggagaaggcattattgccttgtcgagcacccacagcgaagtaagaaagccgtgtggcataagctgctaagcaagcaacgcaaacgcgctgtagttgcctgctttaggatggcccctctttataacctcccccgacatcgcgcagtaaacttgttccttcaaggatacgagaagtcctggatcgagactgaagaacactacttcgaggataagttgattgaggaccttgctaaacccggtgccgagcctcctgaggaggatgagggcacaaagcgagtggacccactgcaccagcttatcctgcttttcagcagaaccgctctcaccgaaaagtgcaagttagaagaggatttcctgtatatggcttatgcagacatcatggcaaaatcttgccacgatgaggaggatgatgatggtgaggaagaagtgaagtcctttgaagaaaaagagatggagaaacagaagctgctataccaacaggcaagactccacgatagaggcgctgctgaaatggtgttacagactattagtgcgagcaaaggagaaacaggacccatggttgccgctacattgaaattaggcatagcgatattgaatggcggtaatagcacggtgcagcagaagatgctagactacttgaaggagaagaaagatgtgggattttttcaaagcttagccggtctgatgcagtcatgctccgtgctagacctaaatgcctttgagcgacagaacaaagctgaaggcctgggcatggtgactgaagaaggtagtggagagaaggtcttgcaggacgacgagtttacctgcgaccttttccgctttttgcagctcctttgtgagggacataactccgattttcaaaattacctgagaacccagactggcaataataccaccgtgaacattattatatcaactgttgactatttgctccgggttcaggagtccatcagcgatttctattggtattacagcggaaaagacgtgatcgacgaacaaggtcagaggaatttttccaaagcaatccaagtggcgaaacaggtgttcaacacgctgactgagtacattcagggaccttgtaccggaaaccagcagtcactggcccactctcgattatgggacgccgtagtgggctttttgcatgtatttgcccatatgcagatgaaactgtcgcaggatagttcacaaattgaactcctgaaggagctgatggacttacagaaggacatggttgtgatgttactgagcatgttagaaggcaatgtggtgaacggcacaatcgggaaacaaatggttgacatgctggttgaatctagtaataacgtcgaaatgatcctgaagttttttgacatgttcctgaaattgaaggacttgacgagttccgacacattcaaggaatatgatcccgacggcaagggggtaatatctaaaagggatttccataaagctatggagagtcataagcactacacccagtccgagacagaatttcttctgagctgtgctgagacagacgaaaacgagacactggactacgaggaatttgtgaaacggtttcatgaaccggcaaaagacatcgggttcaatgtggccgtcttgttgaccaatttgtcagagcacatgccgaacgatactaggctccagacattcctggagctggcagaaagtgtgctgaattattttcagcctttcctgggccgaattgaaattatggggtcagccaaaagaatcgagcgcgtttactttgagattagtgaaagctccagaacacagtgggagaaacctcaggtaaaggagagcaaacgacagtttatcttcgacgttgtcaatgaaggtggagaaaaggaaaagatggagctcttcgttaatttctgcgaggataccattttcgaaatgcagctagctgcacagataagtgaatctgatctcaacgagcggagtgccaacaaagaagagagcgagaaagagcgccctgaagaacagggcccaaggatggcttttttttctattctgacagtccggtcggcactgttcgccctcaggtataatattctgacgcttatgcgcatgctatcgctcaagagtctgaagaagcaaatgaaaaaggtaaaaaaaatgaccgtgaaggatatggtgacagcgtttttcagttcctattggagcatcttcatgacgttgctgcattttgtagcttcagtttttaggggctttttcaggattatctgctccctcctgttaggaggtagtctggtagagggcgcaaaaaaaataaaggtagcagaactattggcaaatatgcctgatcccacacaggatgaggttcggggtgacggagaagaaggtgagcgaaagccactcgaggccgcactgccgtccgaggatctgacggatctgaaagagttgacagaggaatccgaccttctgtcagatatcttcggcctcgaccttaagcgggaaggaggtcagtataaacttataccacataatcccaatgccggactatcggatctgatgtccaacccagtgcctatgcccgaggtgcaggaaaaattccaggaacagaaggcaaaggaggaggagaaggaagaaaaagaggagaccaagtcagaaccggaaaaagccgaaggggaagatggcgaaaaagaagaaaaggcaaaggaagataagggtaaacagaagcttcgccagttacacacacaccgctatggagagcccgaggtccctgagtcagcattttggaagaaaatcattgcgtaccagcagaaactgctgaattactttgcgcgtaacttttacaacatgcggatgttggcactttttgttgcctttgcaatcaacttcattcttctgttctacaaggtgtctacgtcgtccgtggtggaagggaaagagctgcctactagaagttctagtgagaacgccaaagtaacctccctggattcctctagccaccgaataattgccgtccattacgtgcttgaggagagcagtggttatatggagcccactctcaggatactggccatcttgcataccgtgatctcttttttttgcatcattgggtactattgtctgaaggtgcccttggtgattttcaagcgggaaaaggaggtggcaagaaaactcgaattcgatggtctgtatatcaccgaacagccctcagaggatgacattaagggccagtgggacagactggtgatcaacacccagagcttcccgaacaattactgggataagtttgtgaagcgtaaggtgatggacaagtacggagaattctacggtcgggatcgcatcagtgagttactgggcatggataaagccgcactggatttctccgacgcgcgtgagaaaaagaaacccaaaaaggactcctctctgtcagctgtgcttaactccatagacgtcaagtaccagatgtggaaactgggtgtggtgtttaccgacaacagctttctgtatttagcatggtatatgaccatgagtgtgctgggacactataataacttctttttcgccgctcacttactggatatagccatgggctttaagacacttcgcacaatcctctcttcggtaacccataacgggaaacagctcgtacttacagtgggtctgctggccgtggtggtttacctatatacagtagttgcgtttaatttttttcgaaaattctacaacaaatccgaagacggagacacaccagacatgaaatgcgacgatatgctcacctgttacatgttccacatgtacgtgggtgttcgcgcaggcggaggtatcggtgacgaaattgaagatcccgctggggacgagtacgagatctacaggattatatttgacataacctttttttttttcgtcatcgtaatactactcgccatcatccagggcttgatcatcgatgctttcggcgagttgcgggaccagcaggaacaggtgaaagaagacatggagacaaaatgcttcatctgtggtatcgggaatgattatttcgacaccgtgccccacgggtttgagacccataccctgcaggaacataacctcgcaaactacttattcttccttatgtaccttataaacaaagatgaaacggaacacaccggccaggaatcctacgtctggaaaatgtaccaagaaaggtgttgggagtttttccccgctggcgattgtttccggaagcagtatgaggaccagcttaattag

SEQ ID NO: 239509 - DNA, 14601 bp, Artificial Sequence
  Description of Artificial Sequence: Synthetic coding sequence
atggcagaactcggagggggtggagaagaagatgccaggtggtaccggaaggaagacgaggttgtgttacagtgcatcgctaccatccacaaggagcagcgcaaattctgtctagcggctgagggacttggcaatcgactctgctttcttgagcccacgagcgaggcgaagtacattcctcctgatttgtgtgtgtgcaatttcgtcctcgagcagtctctctcggtgcgcgctctgcaagagatgctcgccaatacaggcgagaacgggggagaaggcgcagcacagggagggggacaccgcactttactgtacgggcacgccgtgctgttgagacacagcttctccggaatgtatttgacttgtctgactactagtcggagccagaccgataaactggccttcgacgtcggactccgggaacacgctactggggaggcttgctggtggaccatccatcctgcttctaaacagagatccgagggcgagaaggtaaggatcggggatgacctgatcttagttagcgtttcttccgagcggtaccttcacctgtcagtgagcaatggaaacatccaggtcgatgctagctttatgcagacactgtggaacgtgcatcccacttgtagcggctcttcgattgaagaggggtatctgttaggtggacatgtcgtgcggcttttccatggtcacgacgaatgtctgactatcccatccaccgaccagaatgactcccagcatcggagaattttctatgaggcaggaggtgctggaactagagcacggagcctatggcgagtagagccactgcggatttcctggagcgggagcaacattcgctgggggcaggcattcaggctgcgacacctgactaccggccattacctggctctcacagaagatcaaggcctcatcctgcaggacagggccaaatctgacacgaaatccacagcgttttcatttcgcgcaagcaaggaattaaaggagaaattggacagttctcataagagagacatcgaaggcatgggtgtccctgagatcaaatatggcgacagcgtgtgctttgttcagcacattgcctctgggctttgggttacatataaagcccaggatgctaagacatcacgcctcggcccactgaaacggaaggtgatcctgcatcaggaaggacatatggacgacggtctgacccttcaaaggtgtcagcgggaggagtcccaagccgctaggatcattcggaatacgactgccctcttctcacaattcgtgtctggaaacaataggaccgcagccccaatcaccctacctatcgaggaagttttgcagacgttacaggacctgatagcatacttccagcctcccgaagaagagatgcgccacgaggacaaacagaataaattgaggagtctcaaaaacaggcagaacctttttaaggaggagggtatgttggccctcgtcctgaattgcatcgaccgactcaatgtttataatagtgtcgcacatttcgccggaattgcgagggaggaaagcggcatggcttggaaagagatcctcaatctgctttacaagcttctcgcagcattaatccggggtaataggaacaactgcgcccagttttctaataacctcgactggctcatttcaaagttggataggcttgaaagctcttcagggatactcgaagtcctacactgcattctaactgagagtcctgaggctttgaatctgatagccgagggtcacattaaaagcattatatcactgctagacaaacatggtcgcaatcataaagtactggacattctgtgcagcctctgtctgtgcaatggggtggcagtgcgtgccaatcagaacctgatttgcgacaacctgttgcctcgacggaaccttttattgcagacgaggttgattaacgacgtgacgagcattcgccctaacatttttctgggggttgcagagggtagtgctcagtacaaaaagtggtactttgagctaatcattgaccaagtagatccctttctcactgccgaaccaacacacctgcgagtcggttgggccagctctagtggttacgctccataccctggtggcggagaggggtggggaggaaatggcgtaggggacgatctgtattcttacggtttcgatggcctgcatctgtggtctggaagaattccccgtgccgtcgcctctattaatcaacacctactccgcagtgatgatgtcgtgtcctgttgcctagacttgggggtccctagcatttctttccgtattaacggtcagccggtgcagggaatgtttgagaatttcaatacggatggtctctttttccctgtgatgtccttttcagcaggcgtgaaagtccgcttcctgatggggggtcggcacggagaattcaaattcctgcccccaagtggttacgcaccctgctatgaggctctactacccaaggagaagatgagacttgaacccgttaaagaatacaagagagacgccgacggtatcagggatctattggggaccacacagtttctttcacaggccagcttcattccgtgtccagtcgatacatcccaggtgatcctgccaccccacttggagaagatcagagacaggttggccgaaaatatacacgaattgtggggaatgaataagattgaactgggatggacattcggcaagattagggacgacaataaacgacaacatccgtgccttgtggagttctccaagctgcctgaaaccgaaaagaattacaacctacagatgagtactgaaactttgaagactctcttagccttagggtgccacatcgctcacgtcaatcccgcagcggaagaggatctcaagaaggtgaaactgcccaagaattatatgatgtccaacggatataagccagcccctctggacctgagcgatgtaaaactcctccccccacaggagattctggtcgataaactggcggaaaacgctcacaacgtgtgggccaaagaccgtatcaaacagggttggacctatggaattcaacaggacttgaaaaataaacgtaatcccagactcgtcccctatgccctcctcgatgagaggacaaaaaagagcaaccgggacagcctgagggaagccgtccggaccttcgtgggatatggctacaatatagagccatcagatcaggagcttgccgattctgcagtggagaaggttagcatcgacaagatacgcttttttcgggttgagagatcttacgccgtccggtccgggaagtggtactttgagtttgaggttgtgacaggaggggatatgcgcgtggggtgggcccgaccgggatgtcgaccagatgtcgaactaggcgctgacgaccaagcattcgtgtttgaagggaaccgcggtcagagatggcatcagggttctggttacttcgggcgaacttggcagcctggagacgtggtggggtgtatgattaacttagatgacgcaagtatgatttttaccctgaacggagagctgctaataactaataaaggcagcgaactcgcgttcgcagactacgaaatcgagaacggattcgtgcctatctgttgcctcgggctgtcccagatcggtcgcatgaacctcggtacggacgcgtctacatttaaattttatactatgtgtggactacaggaggggttcgagccgttcgcggtgaacatgaaccgcgatgtagcaatgtggtttagtaagcggctacccaccttcgtgaacgtccctaaagaccaccctcatatcgaagtcatgcggattgacggcactatggatagccccccatgtctgaaagtgacgcataaaacattcggaacacagaattccaatgcagatatgatatattgtagattgtctatgcccgtggagtgccactcttcctttagccacagcccctgtcttgacagtgaagctttccaaaagagaaagcagatgcaggaaatcctgtcccatacgactacccagtgctactatgcaatccggattttcgccggacaggaccccagctgtgtgtgggttggatgggtaactcccgactatcatttatactccgaaaaatttgatctaaacaagaactgtactgttacagtgaccctcggggatgaacgcggacgggtgcatgagagcgtgaagcgcagcaattgttacatggtatgggggggtgacatcgtcgcgtcttcacaacggtcaaacaggagtaacgtggacctggagatcggatgcctggtggatctcgccatgggaatgctgagcttcagtgccaatggtaaagagctgggcacatgctaccaggttgagcccaacactaaagtgttcccagcagtgttcctacaacccacctccacctcactctttcaattcgaattagggaagctaaaaaacgcgatgccactatctgccgctatctttagatctgaggagaagaatccagtcccacagtgtccgcctaggcttgacgtgcagactatccagcccgtcttatggagcaggatgccaaatagcttcctgaaggtggagacagaacgtgtaagtgagagacatggttgggttgtccagtgtctggagcccttgcagatgatggcgctccacatcccagaggagaacaggtgtgtcgatatattagagctgtgtgaacaagaggacttgatgagattccactaccacactttacgactatatagtgctgtatgtgccctgggtaattcgagagtcgcttatgctttgtgctctcatgtagacctctcccagctattctacgccattgacaacaagtatctgccaggtctcctgcgctccggattttacgatctgctgatcagcatacacttggcgagcgctaaggagcggaagctgatgatgaagaatgagtatattataccaatcacttctactacaagaaatatcaggttgttccctgatgaaagtaaaagacacggcctgccaggcgtcgggctgcgcacctgcttaaagccaggtttccgcttttctactccttgtttcgtcgtaacaggtgaagatcatcagaaacaatctcctgagattcccctggaaagcctgaggaccaaggctctgtctatgcttacagaggccgtgcagtgcagtggggcacatatccgcgaccccgtgggcggttccgtggaattccagtttgttcctgtcctgaaacttattgggacattgttggtgatgggggtgttcgatgatgatgatgtaaggcagattctgctgctgatcgatcctagcgtgttcggggaacatagtgccggtactgaagagggggctgaaaaggaagaggtgacccaggttgaagaaaaggcagtggaggctggcgaaaaggccggaaaggaggcgcctgtcaaaggtttgctccagaccagattgcctgaaagcgtgaaactgcagatgtgtgagctgctttcttacctttgcgactgcgagctgcaacacagggttgaggccatcgtggcctttggggacatctacgtatctaaactgcaagccaaccagaagttcaggtacaacgagctcatgcaggctctgaatatgagtgcggctctgactgctcgaaagacgaaggagtttcggtctccaccccaggaacagatcaatatgctgcttaacttccagttaggcgagaattgtccatgccccgaagaaattcgggaggagctgtatgattttcacgaagacctccttttgcattgtggagtcccactagaagaagaggaggaagaagaggaggatacttcgtggactgggaagctctgcgcactggtatataagatcaaaggcccaccgaagccggaaaaagaacagcctaccgaggaggaggagcgttgccccacaactctgaaagaactcattagtcagaccatgatttgctgggctcaggaagatcagattcaggactccgaattggtacgaatgatgtttaatcttctgcgtcggcagtacgattccattggtgagctcctgcaggcactgcggaaaacttacaccatctcccacacatccgtttcggacaccataaatttgctggctgcattggggcagatccggtcactgctctcagttcgcatgggtaaggaggaagaactccttatgataaacggcctgggagacatcatgaacaataaggtcttttaccagcatcccaatctaatgcgggtacttggcatgcatgagacagtgatggaggtgatggtgaacgtcctgggcaccgagaaatcccaaattgccttcccaaagatggttgcttcctgctgccggtttctgtgctatttttgcagaatttcgagacaaaatcagaaggcaatgtttgagcatctctcataccttctagaaaatagttccgtgggcctagctagcccctcaatgagggggagtacccccttggatgtggccgcttcctcggtgatggacaataacgagctcgccttgagcctggaagagcccgatctggaaaaagtcgtgacttatctggcaggatgtgggttacaaagttgccctatgctgctggctaaaggctaccccgacgtcggttggaacccaatagagggagagcgatacctgagcttcctgaggtttgccgttttcgtcaactcagaatccgtggaagagaacgccagcgtagtcgttaagcttctgatcaggcggccagaatgtttcggacctgcactcagaggagaaggagggaacgggctgctggcagctatgcagggcgctatcaaaatctcggagaatcctgccctggatcttccctcacagggttataaaagggaggtcagtactggagacgatgaggaggaggaggaaatcgtgcatatggggaacgccataatgagcttttactcagcccttatcgacttgctgggccgatgtgccccagagatgcaccttattcagacaggaaaaggtgaagcaatccgtatcaggtcaattttacggagcctcgtgcctactgaagaccttgtgggcattatctctatccctctaaagctgccatccttgaataaagatggctccgtgtctgagcccgacatggctgctaacttttgcccagatcacaaggctcctatggtactgtttctggaccgcgtgtatggaattaaagaccagactttcctgttgcatcttttggaagtgggatttcttccagacctgcgcgcaagcgctagtctggatactgtgtccttaagtacaacagaggcagcactggcactgaaccggtacatctgctctgccgtgctcccactgcttaccaggtgtgcgcctctgttcgctggcacagaacactgcaccagtctgatcgacagtaccttgcagactatttacagactcagtaaggggaggtcgttgacaaaggcccagagggacaccatcgaagaatgcttattagctatttgcaatcatctgcggccatccatgctgcagcagttacttcggagattagtctttgacgtccctcagctcaatgagtactgcaagatgcctttgaagctgttgactaatcattatgaacagtgttggaagtactattgtctgccttctgggtggggttcatacggactagcagtagaggaagagctgcacctgaccgaaaagctgttctggggcatctttgactcactgtcacataaaaaatatgatcccgacctgttccgcatggcactcccttgtctgtccgcaatcgctggggcactgccgccagattatttggatacgaggattaccgcaactttagaaaagcagatatcggtcgatgcagacggcaactttgaccctaagccaattaataccatgaacttctcccttcccgagaaactggagtacatcgtgaccaaatacgctgaacacagccacgataagtgggcttgcgataaatcacagagcggttggaagtacgggatctcacttgatgaaaatgtgaaaacccatcccctcattaggccctttaaaactctgaccgaaaaagaaaaggaaatttataggtggcccgcacgtgaaagcctcaagaccatgctcgctgtcgggtggaccgttgagcgcacgaaggagggagaagcacttgtgcaacaacgagaaaatgaaaaactgagatcagtctcccaggcaaatcaaggtaattcctacagtcccgcacctctcgatctgagcaatgttgtactgagccgcgaactgcagggcatggttgaagtggtggcagaaaactatcataatatctgggctaagaagaagaagctcgaactggagagtaagggcggagggagtcaccccttactggtgccttacgatacacttacagctaaggagaaattcaaggacagggagaaggctcaggacctcttcaagtttctgcaggtgaacggcatcatcgtgtctcgcggaatgaaagacatggagctggatgcatccagcatggagaagcggtttgcctataaattcctgaagaaaatactgaagtacgtggactctgctcaggagtttattgctcacttggaagccatcgtgagttctggaaaaaccgagaagagcccaagggaccaggaaatcaaattctttgccaaggtgttgctgccactggtggaccaatactttacttctcactgtctgtactttctgagctcacccctgaaacctctgagttcctccggctacgcaagtcataaagaaaaagagatggtggccggactgttttgcaagctagccgcactcgtgagacatcgcattagcctctttggttctgactcaacgactatggtctcgtgcctgcacattctggctcagactctggatacccggactgtgatgaaatcggggtcagaattagtaaaggccggtctcagagcattttttgaaaacgccgcagaggatctggagaaaaccagcgaaaaccttaagcttggaaagttcacgcattcacggacccagatcaagggggtgtcccaaaacattaactacactacagttgcactgttacccatcttaacttccatattcgagcatgttacccaacaccaattcggaatggacttactgctcggcgacgtacagatttcctgttaccatattctctgctccctgtacagcctcggtaccggtaaaaatatctatgtggagcgtcagaggcccgctctgggggaatgccttgcatctctggccgctgcgattcctgtcgctttcttggagcctaccctcaacagatacaaccctcttagcgtttttaacacaaaaacgccacgcgagaggtcaatactcggcatgcccgatacagtcgaggatatgtgtcctgacattccacagctagaagggctgatgaaagagataaatgatctggctgagtctggcgcacgctatacagaaatgcctcacgtgatcgaggtgattcttccaatgctctgtaactatctgagctactggtgggaacggggacctgagaatttgcctcccagtaccggcccttgttgtacaaaggtaacctctgagcacctttccctgatcctgggaaacattctcaagatcatcaacaacaacctcgggattgatgaagctagttggatgaagcggatcgctgtgtatgcccaacctatcattagcaaagcacgccctgacctgctgagatcgcactttatcccgaccctcgagaagctgaagaagaaggccgtcaaaacagtgcaggaggaggaacagcttaaagccgatggaaaaggcgatactcaagaggctgagctcctgatactcgatgaattcgcagttctctgtcgagacctgtacgctttctatcctatgctgatcaggtatgtggacaataacagatctaattggctcaagagccctgacgcagactccgatcagctgttccgcatggtggcagaagttttcatcctatggtgcaagtcccataactttaaacgggaggagcagaacttcgtgatccagaacgagattaacaatctcgcatttctgacaggcgacagcaaatctaaaatgtctaaatcggggggacaagatcaagagcgcaaaaagaccaaacgacgtggagacctctacagcatacaaacctcccttatagtggccgcactgaaaaaaatgctaccaatcggcttgaacatgtgtacgcctggagatcaggaattaatctccctagcaaagtctaggtatagccatagagatacggacgaggaagtgcgcgaacatcttcgcaacaacttgcacctccaggagaagtcggacgatccagcggtgaaatggcagctgaatctatataaggacgtgcttaagagcgaagaacccttcaacccagaaaaaactgttgagcgggtgcagcgcattagcgctgccgtctttcacctggagcaggtggagcagccccttaggagcaagaaggctgtatggcacaaacttcttagtaagcagcgcaagcgcgctgtggtggcctgttttcgtatggccccactatacaacctgcctaggcacaggtctataaatctcttcttgcatggttatcagagattttggatagagaccgaggagtacagctttgaagaaaaactggtacaggatctggccaaatcccccaaagtcgaagaggaggaagaggaggagacagaaaaacagcccgacccccttcatcagatcatcctctacttctctcgaaatgccttgacagagcgaagcaaactcgaggacgatccgctgtacacgtcctattcctcgatgatggctaagagttgccagtcaggggaagacgaggaagaagatgaagataaagaaaaaacattcgaggaaaaggagatggaaaagcagaagacactgtaccaacaggccaggctccacgagaggggcgctgctgaaatggtactccagatgattagtgcgagcaagggagagatgtcaccgatggtggtggaaaccttaaagttagggatagccatcctgaacgggggtaacgcgggagtccagcagaagatgctggactatttgaaagaaaaaaaagatgcaggattttttcagagtctgtcaggactgatgcaaagctgcagaagcgtgttggatcttaatgcctttgagaggcagaataaggccgagggattaggaatggtcaccgaagagggaaccctgatcgtgcgcgaaagaggagaaaaggtcctgcagaacgatgaatttactcgagacctgttcagattcctacaacttctgtgcgagggccataatagcgattttcagaacttcctccggacacagatgggtaacaccacgacggttaacgttatcattagtaccgtcgactacctgctcagactccaggagtcaatctcggatttttactggtactacagtggtaaagacattattgatgagtccggacagcacaatttcagcaaagctctggccgtaaccaagcagattttcaatagcttgactgaatacatccaaggcccttgcattgggaaccaacagagcctggctcatagtcggttatgggacgcagtggtgggcttcctccacgttttcgctaatatgcaaatgaagctaagtcaggactcttcacagatagagctcctcaaagaactgcttgatctgctccaggatatggttgtaatgttgttgagcctgcttgagggaaatgtcgtaaatgggactataggcaaacagatggtggacacacttgtcgaatcgtccaccaatgtggagatgattctgaaatttttcgacatgttcctgaagctgaaagatctgaccagctcagatacattcaaggagtatgaccccgacggcaaaggcattatttccaagaaagagttccaaaaggctatggaaggacagaaacaatatacacagtccgagatagatttccttctctcctgtgcggaggccgatgagaacgatatgttcaactatgtggattttgtcgatcgcttccatgagccggctaaggatataggtttcaatgtcgccgtgttgctgacgaatctgtccgagcacatgccgaatgatagtcgcctgaagtgtttactggacccagccgaaagtgttctgaactacttcgaaccatacctggggagaatagagatcatgggaggcgcaaaaaagatcgaaagagtttacttcgagataagcgaaagttcaagaacacagtgggaaaaaccacaggttaaggagtccaagagacaattcatcttcgatgtggtaaatgagggaggggaacaggagaagatggaactgttcgtgaatttctgtgaggatactatcttcgagatgcagttggctagtcagatttctgagtcggattcagccgacaggccagaagaggaggaggaagatgaggattcaagttacgtgctcgaaattgccggtgaagaagaggaggatggttctcttgagcccgcatccgcgtttgcaatggcttgcgctagtgtaaagaggaacgtgacagactttcttaagcgggcaacactgaagaacctgaggaaacaataccgaaatgtaaaaaaaatgaccgccaaggagctcgtgaaagtactgtttagtttcttctggatgctgtttgtgggcttgttccagttgctgtttacaatcctggggggaatctttcaaattttgtggtcaaccgtttttggtggtgggctggtggaaggggcaaagaacattcgcgtgaccaaaattctgggtgacatgcctgaccccacccagtttggcatacatgacgataccatggaggcagagcgtgccgaggtcatggagccaggaatcactaccgaactcgttcacttcatcaaaggggaaaaaggtgacacagacattatgtcagacctcttcggactacatcctaagaaagagggtagcctaaagcatggcccagaggtggggttaggcgatctttctgaaataatcgggaaagatgaaccacctacgctagagagcaccgtacagaagaaacggaaggcccaggcagcggaaatgaaagccgctaacgaggctgaaggcaaagtcgagagtgaaaaagccgatatggaggatggtgaaaaggaggataaggataaagaggaggagcaggcagagtatttgtggaccgaagtgactaaaaagaagaaaagaagatgcgggcaaaaagtggagaagcccgaggcatttaccgcaaatttctttaagggcctggagatttaccaaacaaagctcctgcactacctggcgcgtaatttttataacctcagatttctcgccctgtttgtggccttcgccataaattttattctcctgttctacaaagtcactgaggaacccctggaagaggagactgaggacgtggctaatctttggaactcttttaacgacgaagaggaggaggaagccatggtgttttttgtccttcaagagtctacaggctacatggctcccacacttcgggctctggccatcatccacacaatcatatccctggtctgtgtagtggggtactattgcctgaaggtgcctttggttgtgtttaaaagggaaaaagaaatcgccagaaagttggagtttgacgggctatatatcactgaacagccttcagaagacgacataaagggacaatgggaccgacttgtgataaacactcccagctttcctaacaactattgggataaatttgtgaaaaggaaggtaatcaacaagtatggtgatctctacggggcagagaggatcgcagaactgttggggctcgataagaatgcccttgacttcagtcccgtcgaggagacaaaggccgaggctgccagcctcgtttcctggctatcctccattgatatgaagtatcacatttggaagctaggggtggtcttcactgataacagtttcctctatctggcctggtacaccaccatgtcggtgctaggacactacaataatttctttttcgcagcccacctgttagatatcgccatgggtttcaagaccctccgtacaatccttagctctgttacccataatggaaagcagctggttctcacggtggggcttctggctgtggtcgtgtacttatacactgtggttgcctttaacttttttcggaagttttacaacaagtccgaagatgatgacgagcccgatatgaagtgcgacgacatgatgacctgctacttgttccacatgtatgttggcgtccgggctggaggtggcattggggatgaaatcgaggaccctgccggagacccttatgaaatgtataggatcgtgttcgacatcacctttttcttctttgtcatagtgattcttttggcgatcattcaaggactgatcattgatgcatttggtgagctacgggaccaacaggaacaggttcgggaggatatggagacaaaatgcttcatttgtggtatcgggaatgactattttgacaccaccccgcacgggtttgagacacatactcttcaggaacataacctggcaaactatctgttttttctgatgtacctgatcaataaagacgagactgagcacaccggacaagagagttacgtgtggaagatgtatcaggagcgatgctgggacttctttccagctggcgactgctttcgcaagcaatacgaggaccagctcgggtaa

SEQ ID NO: 239510 - DNA, 14613 bp, Artificial Sequence
  Description of Artificial Sequence: Synthetic coding sequence
atggccgaggggggagagggtggtgaagatgagatacagtttctgaggactgaggatgaggtcgtgctgcagtgtatcgccacaatccataaggaacagcggaagttttgtctggccgcagagggcttgggcaaccgtctgtgcttcttagagccaacatccgaagctaagtacataccacctgatctttgcgtatgcaacttcgtgctggagcaaagcctgagtgtgagggctttacaagaaatgctagccaacacaggtgaaaatggtggggagggggcagcacaaggcggaggccacaggaccctgttgtatggtcatgctgttttgcttcggcactccttctcaggaatgtacctgacctgcttaacaacttcacgttcacaaaccgacaaactggcattcgatgtcggactgagagaacatgccaccggtgaggcatgttggtggactatccaccctgcttcaaagcagcggtccgagggcgagaaggtacgaatcggtgacgacctcatcctggtatcagtcagttccgagcgctacctgcacttatccgtgtcaaatggaaacatccaagttgatgcaagcttcatgcagaccctgtggaatgtgcaccctacctgttcggggagtagcatcgaggaaggttacctgctgggaggacatgtcgtacggctatttcatggccatgacgagtgcctcactattccttcaacagaccaaaacgattcccaacatcgacgcatcttctacgaagctggcggtgcgggaaccagggcgagatctctctggagggttgaacccctgagaatttcctggtccgggtccaacattcgctggggacaagcttttagactcaggcatctcaccacgggccattatctggctttgaccgaggaccagggcttaatcctgcaagaccgggcaaaatcagacaccaagtcaaccgcattcagctttcgggcaagtaaagagctgaaggagaaactagatagcagccataaacgggacattgaggggatgggagtacccgagatcaagtatggggattctgtctgcttcgtgcagcacatcgcttcagggctgtgggtgacgtataaggcccaggacgctaaaacatcaagactgggacctctgaaaaggaaggtaatacttcaccaggaggggcacatggatgatggacttacactccaaaggtgtcaaagagaagaatcccaggcggcaagaattatccgtaacacgaccgcactcttttctcagtttgtgtctggaaataaccggacagccgcacccatcacactgcctatcgaggaagtcttgcagacgcttcaggatcttatcgcctactttcagcctcctgaagaagagatgcgacacgaagataagcagaacaaactgagatctttgaaaaataggcaaaacttgttcaaggaggaaggcatgctcgcactggtactcaattgcattgaccgactaaatgtctacaactccgtggcacacttcgctggcatcgctagggaggagtccgggatggcatggaaggagattctgaacctgctatataaactgcttgcagctctcattcggggaaatcgtaacaactgcgcacagttcagtaacaacttagattggctgatcagcaagctcgataggttggaatcttcgtctgggatcctggaagtacttcactgtattctgaccgagtcgccagaagccctcaacctgatagccgaggggcacattaagtccatcatttcactcctcgataaacacgggagaaatcacaaagtgctggacattctctgcagtctctgtctctgtaatggagtggcggtccgggctaaccaaaacctgatctgtgacaatttgttgccccgtaggaacctgctgctacaaaccaggctcattaacgatgtgacatcgatccggcctaatattttccttggagtggccgaaggttctgcccagtacaagaagtggtacttcgagctgatcatagaccaggtggatcccttcctgaccgcagaacccacccacctccgcgtgggatgggcgtccagtagtggatacgccccttacccaggaggaggagagggatggggcggaaatggcgtcggagacgatctgtattcctatggatttgatggcctacacctttggtcaggtaggatccctagggctgtggcctctatcaatcaacacttgctgaggagcgacgatgtagtttcctgctgcctcgacctgggagtcccgagcatatcttttagaatcaacggccaaccggtgcagggaatgtttgaaaactttaacaccgatggtctgttctttcctgtgatgtcatttagcgcaggggtcaaggtccgctttctgatgggagggcgtcacggggagttcaaattcctgcctccctccggatatgccccatgctatgaagccctcctccctaaagagaaaatgcgcctcgagcccgtgaaagaatataagcgcgacgcagatgggataagagacctcctgggcacaacgcagtttctgagccaggcctcctttattccttgtccagttgatacttcacaggtaatccttccccctcaccttgagaagattcgagacaggctggcggaaaacatacacgagctctggggcatgaacaagattgaactgggttggaccttcggcaagattcgcgacgacaacaagcggcagcacccttgtctggtcgagttcagtaaactgccagagacggagaaaaattataatctccaaatgtcaacagaaacactgaaaactctcttggctctgggctgccacattgctcacgtcaaccccgctgcggaggaggatctgaagaaagtcaagcttccaaagaattacatgatgtccaatgggtacaagcccgcaccactggacctgtcagacgtcaaactgttgcctcctcaggaaatccttgttgataagctggccgagaacgcacacaacgtttgggctaaagaccgtattaaacaaggctggacctatgggattcagcaggatctaaagaataagagaaatcccagactagttccgtacgccttgctcgatgaacgcacgaaaaaaagcaaccgggacagtctcagggaagccgtcaggacttttgtgggatatggctataacattgagcccagcgatcaggagttggccgattctgcagtcgaaaaagtttccatcgataaaattcggttctttcgcgtggaaagaagctatgccgtgagatctggaaaatggtacttcgagtttgaggttgttacagggggtgatatgagggtcgggtgggcacggccaggttgtagacccgacgtggaattgggcgctgacgatcaagccttcgtctttgagggaaatcggggtcagcgatggcaccaggggagtggttatttcggtagaacatggcagcctggagatgtcgtggggtgcatgatcaacctggatgacgcctcaatgatcttcacactgaatggagaacttcttatcacaaataagggctctgagctggctttcgcagattacgagatcgagaacggttttgtgcccatttgttgtttaggacttagtcagatagggagaatgaacttgggcacagacgcttccacatttaagttctacacaatgtgcggtctccaggagggttttgaacctttcgccgttaacatgaacagagacgtagctatgtggtttagtaaacggttgccgactttcgtaaacgtgcctaaggatcacccacatatcgaggtgatgcgcatagatggtactatggactctcctccatgtttgaaagtaacccacaagaccttcgggacccagaatagcaacgcggacatgatctactgcaggctttcaatgcctgttgagtgtcactcctcattttctcacagtccctgcctggattcggaggcctttcaaaaacgaaaacaaatgcaggagattctctcgcatactactactcagtgctactacgcaatccgtatattcgcgggtcaggatccttcctgcgtgtgggttggatgggtgactcccgattaccacctctacagtgagaaatttgatctgaataagaattgcactgtgaccgtgacattaggcgacgaaagggggagagttcatgagtctgtcaaaagaagcaactgctatatggtatggggaggagacatcgtcgctagcagccaaaggtccaatagatcaaacgtggacttagagatcggctgccttgtggacctcgcaatgggcatgctgtccttctctgccaacggaaaggaactgggcacttgctaccaggtagagccgaataccaaggtgttccctgccgtctttctccagccaacttccacctctctctttcagttcgagctgggcaagcttaaaaatgccatgcccctgtccgccgcaatttttaggtccgaagagaaaaacccagtcccccagtgcccacccaggttggatgtacagactatccagcctgtgctgtggagtcggatgcctaattctttcttgaaggtggaaaccgaaagagtgagtgaaagacacggctgggtggtgcagtgtctggagccattgcaaatgatggctctgcacatccctgaggagaatcgatgtgttgacatccttgaactatgcgaacaggaggacttgatgcggttccattaccacacactccgcctgtatagcgcagtttgcgctctgggcaattctagggtggcctatgccctgtgcagccacgtagatttaagccagttgttctatgctatcgataacaaatatctgcctggcctcttgaggagcgggttttatgacctgcttatctccatacatctggcaagcgcaaaagagcggaagcttatgatgaagaacgagtatattattccaatcacatcgaccacgagaaatatcagactgttcccagatgagagtaagcgacacgggttaccaggtgtaggcctgcggacatgtctgaagcctggattccggtttagcacaccgtgtttcgtcgtgacaggtgaggaccaccagaagcagtccccggagatccccctcgagtcattgaggactaaggccctgagcatgctgacagaagctgtgcagtgctccggtgctcacataagagaccccgttggtgggtctgtcgaattccagttcgtgcccgtgctgaaattgattggcaccctcctggtgatgggcgtgtttgatgacgacgacgtacgacagatcttgctgcttattgatcctagcgttttcggtgagcactccgccggtacagaagagggcgcagagaaggaagaagtaacccaggtggaagagaaagccgtggaggccggtgagaaagccggtaaggaagctcccgtgaaaggactcctgcagacacggttgcctgagagtgtgaagttgcaaatgtgcgagctgcttagctatctatgtgattgcgaactccagcacagagtggaggctatagtcgccttcggcgatatctacgtatccaagctgcaagctaatcaaaagtttcggtataacgaactgatgcaggccctgaacatgagcgcagccctcactgcgagaaagacaaaagaattccggtcccccccacaggaacagataaatatgctactcaattttcagcttggtgaaaactgcccttgccccgaagaaattagagaggaactctacgacttccatgaagatctcttactacattgcggagtgcccctggaggaagaggaggaagaagaggaagacacctcttggacagggaaactttgtgcgttagtctataagatcaaagggcctccgaagcccgaaaaggaacaaccaactgaagaggaggaaaggtgtccaaccacactgaaagaactgatctctcaaaccatgatttgctgggctcaggaggaccagattcaagacagcgagctggtccggatgatgttcaaccttttgcgtagacaatacgattcaattggagaattgctacaggcgctcagaaaaacgtacactatctcccacacctctgtgagcgacacaatcaacctgctcgctgccttggggcagatcagatcactcttgtccgtcaggatgggcaaggaagaggagttattaatgatcaatggccttggcgatattatgaacaacaaagtattctatcagcacccgaatctcatgagggtgctcggaatgcatgaaacagttatggaggtgatggttaatgtgcttggaactgagaaatctcaaatcgccttccctaaaatggtggcaagctgttgtaggttcctttgttacttctgtaggatctctagacagaaccagaaagctatgtttgagcacctcagttatttgctggaaaattccagcgtgggcctggcttcccctagcatgaggggctctacccccctagacgtcgctgcatcttccgttatggacaacaacgaactggccttatcactggaggagccagatttggagaaagtggtgacctacctggccggttgcggcctgcaatcctgtccgatgctccttgccaagggctaccccgacgtgggatggaacccgatcgagggcgaacgctacctttcctttctgcgattcgctgtcttcgtaaacagcgaaagcgtggaagagaatgcatccgtcgtcgttaaactgcttataaggcgccctgaatgctttggcccagcactacgcggagaggggggaaacggattgctggctgctatgcagggcgctatcaaaatctctgaaaatcccgctttggatctgccaagtcagggatataagcgtgaagtatcaaccggggatgatgaagaggaagaagagattgtacatatgggtaatgccatcatgagcttctattcagctttgatcgacttgttgggaagatgtgcaccggagatgcacctgatccagacgggcaagggggaggcaatccgaattcggtctattctcagaagcctcgtgccaacagaggacctggtgggcattatttctatccctctgaaactacccagcctgaataaggatggcagcgtaagcgagccagatatggccgcaaatttttgtcctgaccataaggccccaatggtactctttctcgatcgcgtttacggaatcaaggaccagacttttctgcttcaccttctggaagtgggctttcttcctgacctcagagcttctgcctccctagacacagtctcgctgagtacgaccgaagcagcactggccctgaaccgttacatttgttctgctgtgctgccactcttgactaggtgtgcgccactgtttgccggtactgaacactgtactagtcttattgatagtactctccaaaccatatataggctgtccaagggcaggtcattgaccaaagcccagagagacacaatcgaagagtgtctgttggcaatctgcaatcatctacgcccttccatgctccagcagctgctgaggagactcgtgtttgatgttccacagctgaatgagtactgcaagatgccattgaagctcctaacgaaccactatgagcagtgctggaaatattactgcctgccgtcagggtgggggtcatacggattggccgtggaagaggagcttcatctcactgaaaaattgttttggggtatttttgactcactctcccataaaaaatacgatcctgacctgttccgcatggccctgccctgtctgagcgcaattgccggagcccttcccccagattaccttgatacgcgtatcaccgccaccctcgaaaaacagataagcgtagacgccgatggaaattttgatcccaaacccataaacacgatgaatttctcgttgcctgagaagcttgagtatatcgttacaaaatacgcagagcattcacatgacaaatgggcttgcgataagtctcagtctggctggaagtacggcattagcctggacgagaatgttaagactcaccctcttattagaccattcaagactctgactgagaaggagaaggagatataccggtggccagctcgagagtctctgaagactatgttggcagtgggatggaccgttgagcggaccaaggaaggggaggccttggttcagcagagggaaaacgaaaagctccgcagtgtctcccaagccaatcaaggaaactcttacagcccggcaccattggatctttccaatgtcgtactatctcgggaactccagggtatggtcgaggtagtcgcagagaactatcataatatatgggcaaagaaaaaaaagctggaacttgagtccaagggtggtggttctcatcctctcctggttccatatgatacattaaccgccaaggaaaaattcaaagaccgggaaaaggcacaggatctttttaaatttctgcaggtgaacggcatcattgtttcccgagggatgaaggacatggagctggacgcctccagcatggagaagcggtttgcctacaagtttctcaagaaaatcctgaaatacgtggattccgcccaggaatttattgcacacctcgaggccatcgtctcctccggtaagaccgagaagtcccccagagaccaagagatcaagttctttgcaaaagtgctgttgccattggtggatcagtacttcacatcccattgtctgtacttcttgagttcacccctcaaaccactgtcctcctccggctatgcgagccataaggaaaaggagatggtggccggactattctgcaagctcgccgcattggtgcggcatcgcatttctctgttcggctccgactctaccacaatggtgagctgtttgcacatccttgcacagacactggataccaggacagtgatgaaatcaggcagcgaactggtgaaggcaggattgcgcgctttcttcgagaatgccgctgaagatctggagaagacttctgaaaacctgaaattgggaaagttcacccattcccgtactcagattaaaggagtcagtcagaacatcaattacacaacagtagcactactccctattctgacttccatctttgagcacgtgactcagcatcagtttggcatggacctactgctgggagacgtgcagatctcgtgttatcatatcctctgtagtctgtactccctgggaaccggtaagaatatatacgttgaaaggcagcgccctgccctaggcgagtgcctggccagtcttgctgccgcaatcccagtagccttcctagagcccacattaaacagatacaaccctctaagcgtgtttaataccaaaaccccgcgtgagagatccatactgggcatgcccgacactgtggaggacatgtgccccgatatcccacaactggagggtctgatgaaggaaatcaacgacttggccgagtccggcgctagatatactgagatgccacacgtcatcgaggtaatcttgcccatgttatgtaactatcttagctactggtgggagagaggtccagagaacctgccaccttctacaggaccctgttgcaccaaggtgacatctgagcatctctccctcattctgggcaacatcctgaaaattatcaataacaacctggggatcgatgaagcatcctggatgaaacgaatcgccgtgtacgcccagcccatcatctctaaagcaaggcctgatctgctacgaagtcacttcatccctaccctggaaaagctaaaaaagaaagccgtgaagaccgtgcaagaggaagaacagttgaaagccgacgggaaaggcgacacgcaggaggctgaattactgatcctcgatgagttcgccgtgttatgtagggacctttatgcgttctacccaatgttaatccggtatgtggacaacaacagatccaattggctgaaatcacctgatgccgattccgatcagctgtttcggatggtggccgaggtcttcatcctctggtgtaagtcacataactttaaaagagaggagcagaattttgtcatccagaatgagatcaacaatcttgcctttcttacaggagattccaagagcaaaatgtcaaaggccatgcaagttaagtctggtggtcaagaccaagaaaggaaaaaaacgaagagaagaggcgacttgtattccatccagaccagtctaattgtggctgctctcaagaaaatgttgccaatcggcctcaacatgtgtacaccaggtgatcaagagctcatctctctggcgaagagtcgatattctcatcgggacaccgatgaggaagtgagggagcacttgagaaacaatttacatctccaagagaaatctgatgaccctgctgtgaaatggcagcttaatctgtacaaggacgttctaaagtccgaggagccctttaaccccgaaaagacagtcgagcgtgtgcagaggatatctgcagccgtatttcacttggaacaggtggagcagcctctccgctcaaagaaagcagtgtggcacaaactgttgtccaagcagcgcaagcgggcagtggttgcatgttttaggatggctccactgtataatttgccaaggcacaggtccataaacctctttcttcacggctaccagaggttctggattgagacggaggagtactcttttgaggagaagctggtgcaagatctggctaagtcacctaaggttgaagaggaagaagaggaagagactgaaaaacagccagatcctcttcaccagattattctgtatttctcaagaaacgctttgactgagcgaagcaagctggaggatgacccattatacacctcctatagttccatgatggctaaatcctgccagtcaggagaggacgaggaggaggatgaggacaaagagaaaaccttcgaagagaaggagatggagaagcaaaaaaccctctatcagcaggctcggctccacgagaggggcgctgccgagatggtcctgcagatgatcagcgctagcaaaggagagatgtcacccatggtcgttgaaaccctgaagctcggcatcgccatattgaatgggggaaacgctggcgttcagcaaaaaatgctagattacctgaaagaaaagaaagacgctggtttcttccaaagcttgtccggtttaatgcaaagttgttcagtgctcgacctcaatgcctttgaaaggcagaataaggcggaggggctggggatggtgaccgaagagggtaccctgattgtgagggagagaggcgagaaggtgctccagaatgatgagttcaccagagatctatttcgatttttgcaattgctctgcgaaggccacaactccgatttccaaaactttctaagaacacagatgggcaacacaaccactgtgaacgtcataatttcgactgtcgattatttgctgcgcctgcaggagtcaatttcagatttttattggtactactccggcaaggacataatcgatgagtcgggccagcataacttcagtaaggctctggctgtgactaaacagattttcaattcactcaccgagtacattcaaggaccctgtataggcaaccaacagagtctcgctcactctcgcctgtgggatgccgtggtgggctttctgcacgtgtttgcaaacatgcagatgaagctatcacaggacagctctcagattgagctcctgaaggagctcttggacttgctgcaagatatggtcgtgatgctgctcagcctcctcgagggcaacgtcgtaaatgggactatcggcaagcagatggtcgacaccctggtggaaagcagtactaacgtagagatgatcctcaagttcttcgatatgttcctgaagctgaaagatctaacaagctcagatacctttaaagaatacgaccccgacgggaaaggcatcattagtaaaaaagagttccagaaggctatggagggccagaaacaatatacgcagagtgagatcgactttttgctgtcttgtgccgaagccgacgaaaacgatatgtttaattatgtggattttgtcgaccgcttccacgaacctgctaaggatatcggttttaatgtcgctgtgcttctgacaaacctgagtgagcacatgcccaatgacagcaggctcaaatgcttactagatcctgctgagtcggtgctgaattatttcgagccttacttaggcagaatcgaaatcatgggcggtgctaaaaagatcgaacgggtttatttcgaaatctctgagagtagtcgtacccaatgggaaaagcctcaggtgaaggagagtaagaggcagtttatcttcgatgtcgttaacgaaggcggagagcaggagaaaatggagcttttcgtgaacttttgtgaagacactatattcgagatgcagctggccagccagatcagtgagtccgatagtgccgaccggccagaggaggaagaggaagatgaagacagttcctatgtacttgaaatcgccggtgaagaagaagaagatggtagcttggagccggcaagtgccttcgccatggcctgtgccagcgtcaaacggaacgtgaccgatttcctcaagcgcgcaacactgaagaatctgaggaagcagtatcgtaatgtgaaaaaaatgactgcaaaggagttggtgaaggttctgttttccttcttttggatgctcttcgtaggtttgtttcagttgctctttaccatcctgggtggaatttttcagatcttgtggagtaccgtgttcgggggtggactcgttgaaggcgctaagaatatccgagttaccaagatcctgggagacatgccagacccaacccagttcggcattcatgatgacaccatggaggctgagcgagctgaggtcatggaacctgggataacaaccgagctggtgcattttatcaagggcgagaagggggacaccgacatcatgagcgatctgttcggcctgcacccaaaaaaggaggggagtctgaaacacggccctgaggtcggactaggagatttgagcgagatcatcgggaaggacgagccccctacactagaatcgaccgtgcagaagaagagaaaggcacaggctgcagagatgaaggccgcaaatgaggcggagggtaaggtggagagcgagaaagctgacatggaagacggggagaaagaggacaaagacaaagaggaagagcaggctgagtacctttggaccgaagtcactaagaaaaagaaaaggaggtgcggccaaaaagtggagaagccagaggcttttacagccaatttcttcaagggtttggagatttaccagaccaagctgctgcattatttggcacgcaacttctacaatctgcggtttctggccctgtttgtcgccttcgcaatcaatttcattttgctattttacaaagtcaccgaagagcccctggaggaggagaccgaagacgtggctaacctatggaactcctttaatgacgaggaagaagaggaagctatggtgttcttcgtgttacaggagtctaccgggtacatggcacccactcttagggccctggccataatccacactatcatcagcctggtttgcgtagtcgggtactattgcctgaaggtgccgctcgtggtgtttaaacgcgagaaggagattgcgcgtaagctggaattcgatggactctacatcaccgagcagccgagtgaggatgacataaaaggacagtgggacaggctggttattaatacaccctccttcccaaataattactgggataagttcgtgaaacggaaagtgatcaacaagtatggtgacctgtatggcgctgaacggatcgcagagctgcttggcctggacaagaatgcgcttgatttttcccccgtagaggagacaaaagccgaggctgcctctctggtgagctggctgagctctatagatatgaagtaccacatctggaagctcggcgtcgtgttcacggacaattcctttctgtatctggcttggtacactactatgagtgtgctgggacactataataacttcttctttgccgctcacctgctggatattgcaatgggtttcaagactttgcggacaatactgagctccgtaactcataatggaaagcagctcgtgctgacggtggggctgttggccgtagtggtgtatctctacactgttgtggcattcaacttcttccggaagttctacaataagagtgaggatgacgacgaaccagacatgaagtgcgacgatatgatgacgtgttatcttttccatatgtatgtaggtgtgcgcgcaggtgggggtatcggagacgaaatcgaggaccctgcaggcgatccatatgaaatgtacaggattgtttttgatattactttcttcttcttcgttatcgtgattctgttggcaataatccaagggctgatcattgacgctttcggggaactgagagaccagcaggagcaggtgagagaagatatggaaactaagtgtttcatctgtggtattggtaacgactatttcgataccaccccgcacggctttgagactcataccctgcaggagcacaacctggccaattacctgttttttctgatgtacctcataaataaagatgagacagagcacactggccaagagtcgtacgtgtggaagatgtaccaagagagatgttgggacttttttcctgccggtgactgcttcagaaaacaatatgaagatcagctgggctaa

SEQ ID NO: 239511 - DNA, 14598 bp, Artificial Sequence
  Description of Artificial Sequence: Synthetic coding sequence
atggctgagggcggagagggaggagaagatgagatccaattccttcggacggaggatgaagtcgtgctgcagtgtatcgctacaatccataaggagcagaggaaattctgcttagctgcagaaggcttgggaaatcgactgtgctttctggagccaactagtgaggcaaagtatataccgccagatttgtgcgtctgcaattttgtcctggagcagtctctcagcgtcagggccttacaggaaatgctggcgaacactggtgagaacggaggggaaggagctgcacagggtggtggtcatagaacactgttgtacggccacgctgtgctcctgcgacatagctttagtggtatgtatttaacctgcctgactacttcccgcagccagaccgacaaattggcctttgacgtgggactacgggagcacgctacaggcgaggcctgctggtggaccatccaccctgcctccaaacaaaggtccgagggggagaaagtgcggatcggggatgaccttattctcgtctccgtttcctctgaacggtatctgcacctatctgtctctaatggaaatatccaggtggacgcatcattcatgcaaacactgtggaatgtgcaccctacgtgcagcggttcctccatcgaggagggctacctattgggcggacatgtagtacggctcttccacggtcatgatgagtgcctgactattccaagcaccgatcagaatgactctcaacacagaaggattttttacgaggccggtggcgcaggcacgcgcgctagatcactgtggagggtagaacccttgcgaattagctggagcggatccaatatcaggtggggccaggccttcagattgcgacacctcacgactgggcactaccttgcactcacagaagatcagggcctgatactgcaagatcgggctaagagcgatacgaaaagcactgccttttcctttcgcgctagcaaggagctcaaagaaaagctggattcaagccacaagcgagatattgaagggatgggcgtccccgagattaaatacggtgattccgtatgctttgtccagcatatcgcatctggcctctgggttacatacaaagcgcaagacgctaaaaccagccggctcggtccactcaaacgtaaagttatactgcaccaggagggccacatggacgatggactgaccctgcagcggtgccagcgtgaggaaagccaggctgccagaataattcgcaatacaactgcattgttcagtcagtttgtgagcggtaacaaccgcaccgcggcaccaattaccctcccgatcgaggaagttctgcagacactccaggacctcatagcatatttccagcctccagaggaagagatgaggcatgaggataaacagaacaagttgcggagtctcaaaaatcgacagaacctttttaaagaggaggggatgttggctctggttcttaactgcatcgataggctgaacgtatacaactcggtcgcccattttgcaggaattgcacgggaagagtctggaatggcctggaaggagatcctgaatctcttatacaagctgctggccgctctcattaggggtaatcggaacaattgcgcacagttcagcaacaacttagactggttaatttcaaagttggaccgcttggaaagcagttcaggaattctcgaggtcttgcattgcatactgacggagagtccagaggccttgaatctaattgctgaaggccatattaagtcgattataagtttactggacaagcatggccgaaatcataaggtcctggacatattgtgctcactgtgcctgtgtaatggcgtggccgttcgggcaaatcaaaacctaatttgtgacaacttgctgcctagaagaaatctgttgctgcagactcgtctcatcaacgatgtaaccagtatcagacccaatatctttctcggggtggcagaaggtagcgctcagtataagaagtggtattttgagcttatcatagatcaggttgacccttttcttactgcagagcctactcacctgcgggttggatgggccagctctagtgggtacgccccataccctggaggaggcgagggttggggcggaaatggtgtgggggacgacttatacagctacggttttgatggtttgcacttgtggtccggcagaatcccgagggccgtcgcctcgattaaccagcatctccttcgaagtgacgacgtggtcagttgttgtctggatctaggagtgcccagcatcagcttcaggatcaacggccagccggtacagggcatgtttgagaattttaacaccgatggcctgttttttccggtgatgagtttctccgcaggagtgaaggttaggttcctgatgggaggtagacacggtgagtttaagtttctgcccccttccggttacgcgccatgttatgaagcccttctgcccaaggagaagatgagactcgaacccgtcaaagagtacaagcgggatgcggacgggatccgcgacttgttgggaaccactcagttcctctcccaggcctcctttatcccttgtccagtggacacaagtcaggtgattctaccgccacatctggagaagattagggatagattggctgaaaatatccacgagctgtggggtatgaacaaaattgaactcggttggacctttggaaagatccgggacgataacaagaggcagcacccgtgcctagtggaattttccaagttgcctgagacagagaagaactacaatctccaaatgagcacggaaacactgaagactcttctcgccctagggtgtcacattgcccacgttaacccggcagccgaggaggacctcaagaaagtcaaattgcctaagaactatatgatgtcgaacggctacaaacctgctcctcttgatctgagcgatgttaagctcctgcctcctcaggaaattcttgttgacaaattagcagagaacgcccacaatgtctgggctaaagatagaataaagcaaggctggacctacggtatccagcaggacctgaagaataaacggaatccacgactggtgccctatgccctcctcgatgagaggacaaaaaaatctaatcgggattcactccgtgaagcagtgagaacgtttgtgggctatggctacaacatcgagccctccgatcaggaactggccgacagcgcagtcgagaaagtatcaattgataagatacggttcttcagggtcgagcgttcttacgccgtaagatctggaaaatggtacttcgagtttgaggtcgtcaccgggggagacatgagagtgggttgggccaggcctgggtgccgtcccgatgtcgaacttggagccgatgatcaggcatttgtgtttgagggcaaccgcggtcagaggtggcatcagggtagtggctattttggtaggacctggcaacccggagatgtggtcggctgtatgataaacttagatgatgcatctatgatatttaccctgaatggcgagctgctgatcaccaataagggatctgagctggctttcgctgactacgaaatagaaaatgggttcgttcccatctgctgccttggtctgagccagattggtcgaatgaatctgggcactgacgcatctaccttcaaattctatactatgtgtggacttcaggaagggtttgagccctttgccgttaatatgaatagagacgttgccatgtggttctccaagaggttgcccaccttcgttaacgtgccgaaagaccatccacacatcgaggtgatgaggattgatggcaccatggactctcctccttgcctgaaagtgacccacaaaacattcggaactcaaaattctaatgccgatatgatttactgcagactgagtatgccagtcgagtgccactctagcttttcccattcaccctgtttggatagcgaggcattccaaaaacggaaacaaatgcaggagattctcagccacaccaccacccagtgctactatgccatcaggatttttgccggacaggacccttcatgtgtgtgggtgggctgggtgactcccgattaccacttgtactcggagaaatttgatctcaacaagaattgcacagtgactgtgactttaggagacgaacgcggaagggtacatgagtccgtcaagcgatccaactgctatatggtctggggcggtgacatcgtcgcatcttctcagcgttctaatcgttctaacgtcgatctggaaatcggatgcctggtggatcttgccatgggaatgctgagctttagcgctaacggaaaagagctgggcacctgttaccaggtggaacctaacacaaaggtttttccggctgtgtttctgcagcccacatcaacgtcactgtttcagttcgagttgggcaagctgaagaacgcgatgcccctgtctgctgcaattttcaggtccgaggagaagaacccagtcccccagtgtccaccaagactagatgtccaaacgattcagccagtcctgtggtcccgaatgcccaacagtttcctcaaggtcgaaacagagagagtcagcgagaggcacggttgggtggttcagtgtctagaacctctgcaaatgatggccctgcatattccagaagagaatcgctgtgtggatatactggagctgtgtgaacaagaggatcttatgaggttccattaccatacgctgagactatactcagccgtgtgcgcccttgggaacagtagggtggcatacgctctgtgtagccatgtcgatctctctcagctattctacgccattgacaataaatatctccctggactgctcaggagtggattctacgatctgctgattagcatccatctcgccagcgcgaaggaacggaaactgatgatgaagaatgaatacataatccccatcacctcaacaacaagaaacattcgtctcttcccagatgaatctaagagacacggtctgcctggggtgggacttcgaacctgcctgaaacctgggttccgcttctcaactccttgcttcgtggttaccggtgaggatcaccagaaacaaagccctgaaattcccctggagtctttacgcacaaaagcgctcagcatgctcactgaagccgtccagtgctctggggctcacatcagggaccccgtcggcggatctgtggagttccagtttgtgccagtgctgaagcttatcggcaccttacttgtgatgggcgtatttgacgatgacgacgttagacagatactgttgctgatcgaccctagcgtcttcggagagcactcagctggtactgaggagggagccgaaaaggaggaggttacgcaagtggaagagaaagccgtggaggccggagagaaggccggaaaagaagccccagtaaaaggtctgctccagacacgactgccagaatctgtaaagctccagatgtgtgaacttcttagctacctgtgtgattgtgaactccagcatagggtcgaggctattgtggcatttggtgacatctacgtgagtaagcttcaagcaaatcaaaagttcaggtataatgagctgatgcaggctctgaacatgtccgctgccttgactgcacgtaaaaccaaggagttcagatcccctcctcaggaacagatcaacatgttacttaatttccagctgggcgaaaattgtccttgtcccgaggagattcgggaagaattatacgacttccacgaggatttgctgctacactgcggtgtgcccctggaggaggaagaggaagaagaggaagatacctcttggacaggtaagctctgtgcccttgtgtataaaatcaaggggcctccaaagcccgagaaagaacaaccaacggaagaggaggagagatgccccactaccctgaaagagttaatatcgcagacaatgatctgttgggctcaggaggatcaaattcaggacagtgagctggtgcgaatgatgttcaatctcctaagacgccagtatgattccattggtgagctcctgcaagcgctaagaaagacctacacaataagccacaccagcgtcagtgatacaatcaatctgctggccgcattgggacagatccgctctctgttatctgtgcgaatgggcaaggaagaggaacttcttatgattaacggcctgggggacattatgaacaataaagtattttatcagcacccgaacttaatgcgggtcctgggaatgcatgagaccgttatggaggtcatggtcaacgtactgggcacagaaaaatctcagatcgcttttcccaaaatggtcgcttcatgctgcagattcctgtgttacttctgccgaatttcacgccaaaaccagaaggctatgttcgaacacctgagttatctgttagagaacagttctgtggggttggcaagccctagcatgagaggcagtacacctctggatgtggcagcatcaagtgtaatggataacaacgaactggccctgtctctcgaggaacccgatttagaaaaagtggtcacttacctggccggatgtggcctgcaatcatgcccgatgctcttagcgaaaggatatcctgacgtcggctggaaccccattgaaggggagaggtacctgagctttcttcgtttcgctgtatttgtgaactctgaatcagttgaggagaacgccagcgtggtagttaaactgcttattaggcggcctgaatgctttggaccagctttaagaggcgaagggggaaacgggcttttggcggcaatgcagggagccataaaaatcagcgagaaccctgcgctcgacctgccctcgcaaggatataagcgggaggtctctaccggggacgatgaggaggaagaggaaatagtgcacatgggtaacgctataatgtccttctactccgcgctgatcgacctgctgggcaggtgcgctcccgaaatgcacttaattcaaacaggtaaaggggaagctattcgtataagaagcattttgcggagcctggtgccgacagaggatttggtgggaattatcagcattccactcaagttaccctctctcaataaggacggaagcgtcagcgaacctgatatggccgctaacttttgcccagaccataaggcaccgatggtgctctttttggatagggtttatggaatcaaagaccaaacttttctgctgcatttgctggaggttgggtttttgccagacctcagagcttccgcgtccctggacaccgtcagtctaagtaccaccgaggctgccctcgcactgaaccgctatatttgttccgccgtcctgccgctactgaccaggtgcgcccctctatttgctggcacagaacactgcacatccctcatcgatagtactttacagaccatttataggctgtccaagggacggagtctgacaaaagcccagcgagacaccattgaagaatgtctgcttgctatctgcaaccatctcagaccatcgatgttgcagcagttgctgcgaagactggtgtttgatgtaccccaactgaacgagtattgtaaaatgccgctgaaacttcttacaaatcattacgaacagtgttggaagtattattgcctgccttccggttggggatcatacggactggctgtggaagaagagctgcacctgacagagaaactgttttgggggatcttcgactccctgtcccacaagaagtacgatccagacctgttccgcatggctttgccttgcctgtcggcaattgctggagctttgcctcctgactacctggacacccgtatcaccgcgaccctagaaaaacaaatctcagtggacgctgacggaaactttgacccaaagcccattaataccatgaacttctcccttccagagaagttggaatatattgtgacgaagtatgctgagcatagtcacgacaaatgggcgtgtgataagagtcagagcgggtggaagtacggcatctctttggatgagaatgtgaaaacgcaccctctcattcgcccattcaagacactcaccgaaaaggaaaaagagatataccggtggcctgccagggagagcttgaagacaatgctagccgtgggctggactgtcgaaagaactaaggagggggaggctctggtgcagcaacgcgaaaacgaaaaactaagatctgtgagtcaggctaatcaaggaaattcgtactcgcctgcaccgcttgatttgtctaacgtggtacttagtcgagaactgcagggtatggtggaagtggtggcagaaaattaccataacatatgggcgaagaagaagaagttagagttagaaagcaaaggagggggatcccatcctttgctggtcccgtacgacacactgactgccaaagaaaaattcaaagatagagaaaaggcccaggacctcttcaaattcctccaagtgaatggcattatcgtaagtcgcggaatgaaggacatggagctggacgcaagcagtatggagaaacggtttgcctacaagttcctgaaaaaaattttgaagtatgtggactcagctcaggagtttatcgcacacctggaggccatcgtgagcagtggtaaaaccgagaaaagtcccagagatcaagaaatcaagttctttgccaaagtcttactgcccctcgttgatcagtattttacaagtcactgcctgtactttctgagcagccccctcaagccgctgtcatcctctgggtatgcgtcacacaaagaaaaagagatggtcgctgggttgttttgcaaactcgcagctcttgtgcggcaccgcatatctcttttcggctcagattccacaacaatggtgagctgtctgcatatcctggcgcagactttggatactaggactgtgatgaagtctggaagtgagctggttaaggccggtctgcgagcatttttcgagaacgctgctgaggacctggagaagacctcagagaacttgaagctgggaaaatttacacacagccgaacgcagatcaaaggtgtatcccagaacatcaattacacgaccgtggcccttctgcccatcctgaccagtatcttcgagcatgtgacccagcaccaatttgggatggacctgctactgggcgatgtccagatctcctgttaccatatcctttgtagtctctactctcttgggaccggtaaaaacatttacgtggaaagacagagaccagctctgggggaatgtttggcatccctcgccgcagcaatcccagttgcgttccttgaacctacactcaacagatataatccactgagcgtgttcaacaccaaaacccctcgtgagaggtccatcctggggatgcctgacacggtcgaggatatgtgtccagatatcccccaactggaggggctgatgaaagagattaacgacctggccgaatcaggggctcgctataccgagatgccccacgtaattgaagtgatcctgccgatgctttgtaactatctgtcctactggtgggagaggggtcccgagaatctgcctccctctacagggccatgttgcactaaagtcacctccgaacacctaagcctgattctaggaaatattctcaaaatcatcaataataacctgggcattgatgaggcaagctggatgaagaggattgctgtgtacgctcaacccattatcagtaaagctcgccctgatctgctccgatcccatttcatccccacactcgaaaagctcaaaaagaaagcagtgaagacagtgcaagaggaagaacagctcaaggcggacggcaaaggtgacacacaggaggcagagcttctgattttggacgagttcgcggtactttgcagagatctgtacgccttctatcctatgctcattaggtacgttgataataaccgcagtaattggctgaagtcccccgacgcggatagcgatcagctgttcaggatggtcgccgaggtgtttatactctggtgcaaaagtcataacttcaagcgggaggaacagaatttcgttattcagaacgaaattaacaacttagcattcttgacaggggattcaaagtccaagatgtctaagagcggcggacaggatcaggaaaggaagaaaactaaacgaaggggcgatctctactcaatacagacctccctgattgtggccgcactgaagaagatgctgccaattgggctcaatatgtgcacacctggcgaccaggagctgattagcctggcaaaatcaaggtatagtcaccgagacactgatgaggaggtgcgagagcacttgcgtaacaatcttcatcttcaagagaagtcggacgacccagcggtgaagtggcagctgaacctctataaagatgtattgaaatctgaggaaccgttcaaccctgagaagactgtcgagagagtgcagcgtataagtgccgctgtttttcacctggagcaggtggagcagccactaaggtcaaagaaggccgtgtggcataagttactgtccaagcagcgcaaaagggcagtggttgcctgctttcgaatggcgccactgtacaacttgcccaggcatagatctataaatctgtttttgcacgggtatcagcgattttggatagagactgaggagtacagtttcgaggaaaagctcgtgcaggatctagcaaaatcccctaaggtcgaagaggaggaggaggaggagacagagaagcaacctgacccactccaccagattattctatatttttcgcgtaacgccttaacagagcggagcaagcttgaagacgatcctctgtatacaagctattcaagcatgatggccaaatcctgccagagcggcgaagacgaggaagaggacgaagacaaggagaagactttcgaggagaaggaaatggagaaacagaagacactctaccagcaagccaggctgcacgaaagaggcgctgccgagatggtcctccagatgatttcggccagcaagggggaaatgtctccgatggttgtagagaccctaaagttggggattgctatactaaatggaggtaacgccggagtccagcagaaaatgctcgactatctgaaggagaagaaagatgccggtttcttccagtcgttgagcggccttatgcaatcttgttccgtgttagacctcaacgcgttcgaaaggcagaacaaggccgagggcctaggaatggtgaccgaagagggaaccttaattgtgcgggaacgtggtgagaaggttctgcagaacgatgagttcacccgagatctgtttaggtttttacagctcctgtgtgaaggacataactccgactttcagaatttcctgcggacccagatgggaaatacgaccacagtgaacgtaatcatctcaactgttgactaccttctaaggttacaggagagtatctcagacttctactggtattactcagggaaagatataatagacgagtctgggcagcacaatttctccaaggctctggctgtcactaagcagatcttcaatagcctgaccgagtacatacaggggccatgtattggaaatcaacagagcctggcgcactccagactgtgggacgccgtagtgggcttcctgcacgtgtttgctaatatgcagatgaaacttagtcaggacagcagtcagatcgagctgctgaaggaactgctggatttgttgcaagatatggtcgttatgctgctgtccctgttggaaggcaacgtggtcaatggaacaatcgggaagcagatggtagatacactggtcgaatccagtaccaatgttgagatgatcctgaagttttttgatatgttcctgaaactgaaagacttgacctcctccgacacttttaaggagtatgaccccgacggcaaggggattattagcaagaaagaattccagaaagctatggagggacagaaacagtatacgcaatctgaaattgactttcttctgtcttgcgctgaagcagacgaaaatgacatgttcaattacgtcgatttcgtggaccgctttcacgagccggctaaggatatcggattcaatgtggccgtactgctgaccaatctcagcgaacacatgcccaacgacagtagactgaagtgtttactcgatcccgctgaatctgtccttaactacttcgaaccctacctgggtagaatcgaaattatgggcggagctaaaaagatcgaacgtgtgtatttcgagatcagtgaatcctcccgcacccaatgggaaaaaccacaggtgaaagagtcgaagagacagttcattttcgacgttgtgaatgaaggcggagagcaggagaagatggagctgttcgtgaacttttgcgaggatactatctttgaaatgcagttggcttcacagatctctgaaagcgacagtgcggacagaccggaggaagaggaggaggatgaagacagctcatatgtactcgagatcgccggtgaggaggaggaagacggtagtctggagccagcttcagcattcgctatggcctgtgcgtctgtgaagaggaacgtgactgattttctgaagcgggctacgctgaaaaacctccgcaaacagtacaggaatgttaaaaaaatgaccgccaaggaactggtgaaagtcctgttcagctttttctggatgctcttcgtcggcctgtttcaactgctctttactatccttggcggaatcttccagatcctctggtccactgtatttgggggtggattggttgagggtgccaagaacataagagtcactaagatcctgggagacatgcccgatccaacacagttcgggatccatgatgacaccatggaagcagaacgggcagaagtaatggagccaggaatcactaccgagctcgtacattttatcaagggcgagaagggagatacggacattatgtctgacctattcggcctgcaccccaagaaagaagggagtcttaaacacggacctgaagtcggcttgggggatctaagtgaaattattggtaaggatgaaccaccaaccttagagagcaccgttcagaaaaagcgaaaggctcaggccgctgaaatgaaggctgccaacgaagccgaggggaaagtggaaagcgaaaaggcggatatggaggacggggagaaggaagataaagataaggaagaggagcaagccgagtatctgtggactgaagtcactaagaaaaaaaaaagacgatgtggccagaaagtggagaaacctgaagcctttacagctaatttctttaaaggccttgaaatctatcagactaagttattacattatctggcgaggaacttctacaacctccgctttctagccctcttcgtagcgttcgctatcaactttatcctcctcttctataaggtaaccgaagaacccctagaggaggagactgaggacgtagccaacctatggaactctttcaacgacgaggaggaggaggaagctatggtgtttttcgtgctccaggaaagcacgggctacatggcacccacgctcagggcacttgccatcatacatactatcatcagcctcgtgtgcgtggtgggatactattgcttgaaagtaccgcttgtggtctttaaaagggagaaggaaattgcacggaagttggagttcgatggcctgtatataaccgaacaaccctctgaagatgacattaagggccagtgggaccgactggtaatcaataccccgtcttttccgaataactattgggataagtttgtgaagaggaaggtgattaacaaatatggcgatctgtacggcgctgaaaggattgccgaactcctggggctggacaagaacgccctggacttcagtccagtggaggagaccaaagctgaggctgcatctcttgtttcctggctgagctccatcgacatgaaataccacatatggaaacttggcgttgtctttacagataactcgttcctgtatctggcctggtataccaccatgtccgtgcttggccactacaataactttttctttgccgctcacctgctcgacattgcgatggggttcaaaaccctcaggacaatcctgtcatctgtgactcacaatggaaaacagctggtgcttactgtcggtctgcttgcagtggtggtgtatctctacacagtggtcgcattcaacttttttcgtaagttctacaataagtcagaggatgatgacgaaccggatatgaagtgtgacgacatgatgacctgttatttgttccatatgtacgtgggcgtgagggccggaggaggaattggggacgagattgaggacccagcaggcgacccttacgagatgtatagaatcgtttttgatatcaccttcttcttttttgttattgtgatactgctggcaataatccaaggcctgattatcgacgcgtttggagaactccgtgatcagcaggagcaggttcgtgaggacatggagactaaatgtttcatctgtggaatcggcaacgactactttgatacaacaccacacggatttgagacacataccttgcaagagcataacctggcaaattatctttttttcttgatgtatcttataaataaggacgaaacagaacataccggccaggagagctacgtttggaagatgtaccaggaacgatgttgggacttcttcccagccggagactgcttccgtaaacagtatgaagatcagctgggctat

SEQ ID NO: 239512 - DNA, 285 bp, Artificial Sequence
  Description of Artificial Sequence: Synthetic coding sequence
atgggcagtgagctggaaacagcaatggagactctgattaatgtatttcacgcccatagtggtaaggaaggagacaagtacaagttgagtaaaaaggagcttaaggaattgcttcagacagaacttagcggcttcctcgacgcacagaaggacgttgatgccgtggataaggtaatgaaggagctggacgaaaatggtgatggtgaggttgacttccaggagtacgtcgtcctggtcgccgctctcaccgtcgcatgtaataatttcttctgggagaattcctag

SEQ ID NO: 239513 - DNA, 162 bp, Artificial Sequence
  Description of Artificial Sequence: Synthetic coding sequence
atggggtccgagctggagactgccatggaaaccctgatcaacgtgttccatgcccatagtggcaaggaaggagataagtacaagctcagcaagaaagagttgaaggagctgctgcagaccgagctgtctggtttcctcgatgtgaaggagctcatgctgtag

SEQ ID NO: 239514 - DNA, 444 bp, Artificial Sequence
  Description of Artificial Sequence: Synthetic coding sequence
atggaggaacctcagactaaaactccttcagccgagttccctccgtaccgagctcagccggctcaaccagcgacggcccctgcagcgacctttgccaccctggcaatctgtccagaacccgctcccaccagtggcccagggcagccctgtactgctgcaatggggagcgaactggagacagccatggaaacactcatcaacgttttccatgctcactccggaaaagagggcgacaaatacaagttaagcaaaaaggaactgaaggagctgctgcagactgagcttagcggtttcctggacgcccagaaggatgtggatgctgtagacaaggtgatgaaggaactggatgaaaacggggatggtgaggtcgactttcaggaatatgtggtcttagtggctgcgttgactgttgcttgcaacaacttcttttgggaaaattcctag

SEQ ID NO: 239515 - DNA, 105 bp, Artificial Sequence
  Description of Artificial Sequence: Synthetic coding sequence
atggggagtgagctggaaacagccatggagaccctcattaatgtatttcatgcccactctgggaaagagggcgacaagtacaagctcagtaagaaggagctctag

SEQ ID NO: 239516 - DNA, 294 bp, Artificial Sequence
  Description of Artificial Sequence: Synthetic coding sequence
atgccctcacagatggagcatgccatggaaacaatgatgtttaccttccacaaattcgccggtgacaagggctacctgaccaaagaagatctgcgagtcctcatggagaaagagtttcccggattcctagagaaccagaaggaccctcttgccgttgacaaaatcatgaaggatcttgaccagtgcagggacggtaaagttggttttcagtcctttttttctctgatcgctggcttaaccatcgcttgcaacgactattttgtggtccacatgaaacaaaaaggtaagaagtag

SEQ ID NO: 239517 - DNA, 294 bp, Artificial Sequence
  Description of Artificial Sequence: Synthetic coding sequence
atgccatctcagatggaacacgcaatggaaactatgatgttcacttttcacaagttcgccggagataagggatacctcactaaggaggacctgcgcgtcttgatggagaaggagttccctggttttctcgaaaatcagaaggatcctttagccgtggacaagataatgaaggacctggatcagtgtagagacggcaaagtggggttccagtcatttttcagtctgatagccggattaactattgcctgtaatgattatttcgtggtgcacatgaagcagaaaggtaaaaagtag

SEQ ID NO: 239518 - DNA, 318 bp, Artificial Sequence
  Description of Artificial Sequence: Synthetic coding sequence
atggcaaagatctccagccccacggagacggaaaggtgcatagagtctcttatcgcggtctttcagaaatacgctggtaaagatggatacaattatacgctatcgaaaaccgagttcttaagttttatgaatacagagctggctgctttcaccaagaatcagaaagatcccggtgtacttgacaggatgatgaaaaagttggatactaacagcgatgggcagctcgacttctccgagttcctgaatctaatagggggactcgctatggcttgccacgactcgtttttaaaagccgtcccatcccagaagcgaacatag

SEQ ID NO: 239519 - DNA, 252 bp, Artificial Sequence
  Description of Artificial Sequence: Synthetic coding sequence
gcgggtaaaatgaccaagctggaggagcatctggaagggatcgtgaatatcttccaccaatattccgtcagaaaaggtcattttgacacactaagtaaaggggaattgaaacaactgttgacaaaagagctggctaacactattaagagacccaagaaaggatcatctgtgattgacgagatcttccagggtctggatgcgaaccaggacgagcaggtggattttcaggagtttatctctctcgtcgcatag

SEQ ID NO: 239520 - DNA, 279 bp, Artificial Sequence
  Description of Artificial Sequence: Synthetic coding sequence
atgacaaagttggaagaacatttggagggcatcgtgaacatctttcatcaatactctgtgagaaaggggcactttgatacactgagtaagggcgagctgaaacagttgctgacaaaagagctggccaacaccattaaaaacataaaggacaaagccgtgatagacgagatattccagggactggacgccaatcaagacgaacaggtggattttcaggaattcatctctctggttgccatcgccctgaaagccgctcactaccacactcacaaggagtag

SEQ ID NO: 239521 - DNA, 297 bp, Artificial Sequence
  Description of Artificial Sequence: Synthetic coding sequence
atggccgctgagcctctcaccgagctggaagagtcaatcgagaccgtagtcacaaccttctttaccttcgcgcgtcaagaagggcgaaaggactccctgtcagtgaatgagtttaaagagttagtgacccaacagcttccacacctgctgaaagatgtgggctccctggatgaaaagatgaagtccttggatgtgaatcaggacagtgaactcaagtttaatgaatactggaggctcatcggggaactcgcgaaagaaattcgcaagaaaaaggatcttaagatccgtaaaaaatag

SEQ ID NO: 239522 - DNA, 297 bp, Artificial Sequence
  Description of Artificial Sequence: Synthetic coding sequence
atggccgcagagccgcttacagagctagaggagtcaatcgagaccgtggtcaccaccttcttcacctttgccaggcaggaaggccgtaaagatagcctgagcgtgaacgagtttaaggagctggtcacccagcagctcccgcacctgctcaaggacgtcgggagtctggatgagaagatgaagagccttgatgttaaccaggacagtgagctgaagtttaatgagtactggagactgattggcgagcttgcaaaggagatcaggaagaaaaaagacctcaaaatcagaaaaaagtag

SEQ ID NO: 239523 - DNA, 297 bp, Artificial Sequence
  Description of Artificial Sequence: Synthetic coding sequence
atggccgcagaaccactaactgaactcgaggaatcgattgaaaccgtcgttaccaccttttttacgtttgcaagacaggaaggccgtaaggattccctttccgtgaatgagttcaaagaacttgtcacacagcagttacctcatctgctgaaagatgttggttcacttgatgagaaaatgaagagccttgatgtaaatcaggactccgaactgaaattcaacgaatactggagattgattggtgagctggccaaagagatccggaagaaaaaagacctaaagattagaaagaaatag

SEQ ID NO: 239524 - DNA, 297 bp, Artificial Sequence
  Description of Artificial Sequence: Synthetic coding sequence
atggccgcagagccccttacggaactggaggaatccatcgaaaccgtcgtcaccaccttcttcacctttgcacgtcaggaagggaggaaggattcgcttagtgtgaacgaattcaaagagcttgtgacccagcagctgccgcacttactcaaggatgtcggttccctggatgaaaagatgaaatctctggatgtcaaccaggattctgaactgaagttcaatgaatactggaggcttattggagaactggccaaggagataaggaagaaaaaggatctgaaaattagaaaaaaatag

SEQ ID NO: 239525 - DNA, 297 bp, Artificial Sequence
  Description of Artificial Sequence: Synthetic coding sequence
atggccgctgaacccctgactgagctcgaagaatccattgagactgtggttactaccttcttcaccttcgcgagacaggaaggcagaaaagatagcctctctgtgaatgaatttaaggaattagtgacccaacagctgcctcacctactcaaggacgtcggtagcctggacgaaaagatgaaatccctggatgtgaaccaggactccgaacttaagttcaatgagtattggcggcttataggcgaactcgccaaggagattagaaaaaaaaaggatctcaagatccgcaagaaatag

SEQ ID NO: 239526 - DNA, 315 bp, Artificial Sequence
  Description of Artificial Sequence: Synthetic coding sequence
atgggacagtgccgttcagctaacgcagaagatgctcaggagttttcagacgtggaacgcgctatcgaaactctcatcaagaacttccatcagtatagcgttgagggaggtaaggaaaccctgacacctagtgagttgagagacctggtcactcaacagcttccacatctgatgcctagtaactgtgggctggaggagaagatcgccaacctaggatcttgtaacgactctaagttagagtttcgcagtttttgggagctgatcggcgaagctgccaaatccgtgaaactggagaggccagtccgcggtcactag

SEQ ID NO: 239527 - DNA, 315 bp, Artificial Sequence
  Description of Artificial Sequence: Synthetic coding sequence
atggggcaatgccgctcagccaacgccgaagacgcccaggagtttagtgacgtggagcgcgcaatcgaaactctcatcaaaaatttccatcaatattcggtcgaaggcggaaaagagaccctcacaccctccgagcttagggacttggttacgcaacagctgcctcatctgatgccatcaaactgtgggctggaggaaaagattgcgaacctgggctcctgtaatgacagcaaacttgaatttaggagcttttgggagctcataggggaagccgctaagagcgtcaagctcgagcgcccagtccgaggacactag

SEQ ID NO: 239528 - DNA, 315 bp, Artificial Sequence
  Description of Artificial Sequence: Synthetic coding sequence
atggggcagtgccgtagcgccaatgctgaggatgctcaggagttttctgacgtagaaagggccatcgagaccctcatcaagaatttccatcaatattcagtcgaaggaggtaaggagacactgactccctctgagcttcgtgacctggtaacacagcagctcccccacttgatgccgtctaactgtggtctggaggagaaaatagctaatctgggatcatgtaacgacagcaaactcgaattccgctccttttgggagcttataggcgaggcagccaagagcgtaaagcttgagaggccagttcggggtcactag

SEQ ID NO: 239529 - DNA, 315 bp, Artificial Sequence
  Description of Artificial Sequence: Synthetic coding sequence
atgggccagtgccgcagcgcaaacgccgaagacgctcaggaattctcggatgttgagagagccatcgaaactctcattaagaatttccatcagtacagtgtggagggtgggaaggagaccctcacaccttcggagctgcgggacttggtgacccagcagctgcctcatctgatgccaagcaattgcggcctcgaggagaagatcgccaacctgggcagttgtaacgattcaaaacttgaattccgctccttctgggagctgattggggaggccgctaaaagcgttaaattggagcgaccggtgcggggacactag

SEQ ID NO: 239530 - DNA, 417 bp, Artificial Sequence
  Description of Artificial Sequence: Synthetic coding sequence
atgtgtagctcactcgagcaggctctagctgttctggtgactacttttcacaagtatagttgtcaggaaggcgataagttcaaattgagcaaaggggagatgaaggagttgctgcacaaggagttaccgagctttgtgggtcactcaagagagccctgtgcagtccgggctttcagggtccatctgtttaacccagtcatcggcgacctgcgcaaccagagcccagagggcaagtccgactgcccaaagattacccagcactgggagaaggttgacgaggaaggtctgaagaagctcatggggtccttagacgagaattccgaccagcaggtggatttccaggagtatgcagtgtttctggcgctgatcacagtgatgtgcaacgattttttccagggctgccctgaccggccatag

SEQ ID NO: 239531 - DNA, 294 bp, Artificial Sequence
  Description of Artificial Sequence: Synthetic coding sequence
atgtgtagcagtctggagcaggcgttggcagtgctggtgacaacttttcataagtattcctgtcaagagggagataagttcaagctttcaaagggcgagatgaaagagttactacataaggaattgccttcttttgtgggcgagaaagttgatgaggaaggccttaagaagctgatgggatctcttgacgagaacagtgatcaacaggttgacttccaggagtacgcagtgttcctggcactgatcacagtcatgtgtaacgacttcttccagggatgccccgacaggccttag

SEQ ID NO: 239532 - DNA, 294 bp, Artificial Sequence
  Description of Artificial Sequence: Synthetic coding sequence
atgtgtagctctctggaacaggctctggccgtactggtcacaacatttcataaatatagctgccaggagggagataaattcaagctctccaagggggagatgaaagagttactgcacaaggaactgccttcttttgtcggagagaaggtagatgaagaagggctgaagaaactgatgggatctctggacgaaaattctgatcagcaagtggacttccaggaatacgctgtgtttctggcgcttatcacggtgatgtgcaacgatttcttccagggttgtcccgaccgcccatag

SEQ ID NO: 239533 - DNA, 294 bp, Artificial Sequence
  Description of Artificial Sequence: Synthetic coding sequence
atgtgctcctcactggaacaggccctcgcagttcttgtcaccacatttcacaagtattcctgtcaggagggcgacaagttcaaactcagtaagggagaaatgaaagaactgctgcacaaggagttaccaagcttcgtgggggagaaagttgacgaggaggggcttaagaagttaatgggcagcctcgatgaaaattccgatcaacaggtggactttcaggaatatgcagtgtttcttgcactgatcaccgttatgtgcaatgatttttttcagggatgtccggaccggccttag

SEQ ID NO: 239534 - DNA, 306 bp, Artificial Sequence
  Description of Artificial Sequence: Synthetic coding sequence
atggcgcgtcccttggaacaggctgtcgctgctatcgtgtgtaccttccaggaatatgcaggacggtgtggggacaaatataaattgtgtcaagccgaactgaaagagcttctgcaaaaagagcttgcaacctggacacccactgagtttcgtgagtgtgactataacaagttcatgtccgttctggatactaacaaagactgcgaggtcgacttcgtagaatatgtcagatcgctggcctgtctgtgcttgtattgtcatgaatactttaaagattgcccgtctgagccaccctgtagccagtag

SEQ ID NO: 239535 - DNA, 306 bp, Artificial Sequence
  Description of Artificial Sequence: Synthetic coding sequence
atggctaggccccttgagcaggccgtggcagcgatcgtatgtacctttcaggaatatgctggtagatgcggagacaaatataagctgtgccaagccgagttaaaagaactactgcagaaggagttggctacctggactcccaccgagttccgtgaatgcgactataacaaatttatgagtgttctggacacaaacaaagattgtgaggtagatttcgttgagtacgtgagatctctcgcttgtctttgcctgtactgtcacgagtattttaaggattgtcctagcgagcctccatgctcacagtag

SEQ ID NO: 239536 - DNA, 306 bp, Artificial Sequence
  Description of Artificial Sequence: Synthetic coding sequence
atggcctgcccacttgagaaggccctggatgtgatggtgtcaactttccataaatacagcgggaaggaaggcgataagtttaagctgaataagtcagaacttaaagagctcctcacccgggagctgcccagtttcctgggtaaaaggactgatgaggcggctttccaaaagctgatgtccaacctggattctaatcgtgacaacgaggtggacttccaggagtactgcgtgttcctaagctgcattgcaatgatgtgcaacgaattttttgaaggtttccctgacaagcagcccagaaagaagtag

SEQ ID NO: 239537 - DNA, 306 bp, Artificial Sequence
  Description of Artificial Sequence: Synthetic coding sequence
atggcatgcccactggaaaaagcactggatgtgatggtgtccacctttcacaaatatagcggaaaggagggtgataagtttaagctaaacaaatcagagctgaaggagttgttaactagggaacttccctcctttctcggcaaacgaacagatgaggctgcattccagaagcttatgagtaatctggattccaaccgtgataacgaagtggattttcaagagtactgtgtattcctctcatgtattgctatgatgtgcaacgagttctttgagggatttccggataaacaaccaaggaaaaagtag

SEQ ID NO: 239538 - DNA, 306 bp, Artificial Sequence
  Description of Artificial Sequence: Synthetic coding sequence
atggcatgccctttggagaaagcacttgatgtcatggtgtctaccttccataagtattccgggaaggagggggacaaatttaagctgaataagagcgaactcaaagagctgcttaccagagagctgcccagtttcctgggtaaaagaactgatgaggccgcattccaaaaacttatgtcaaaccttgactcaaaccgcgacaacgaagtggatttccaggagtactgcgttttcctgtcatgtattgctatgatgtgtaatgagttctttgagggcttccctgacaaacagcccaggaaaaaatag

SEQ ID NO: 239539 - DNA, 306 bp, Artificial Sequence
  Description of Artificial Sequence: Synthetic coding sequence
atggcttgcccgctggagaaggccctggacgtgatggtttccacattccacaaatactcaggcaaggagggggataagttcaagctcaacaagtctgagctaaaggagcttctgacacgagaactcccctcttttctcggtaaaaggaccgacgaggctgcctttcagaagctgatgagtaacctggactctaatcgcgacaacgaggtcgatttccaggagtactgtgtgttcctttcctgcatagccatgatgtgcaacgaattctttgaaggatttccagacaagcagccaagaaagaagtag

SEQ ID NO: 239540 - DNA, 273 bp, Artificial Sequence
  Description of Artificial Sequence: Synthetic coding sequence
atggttagtacttttcacaaatatagtgggaaggaaggcgacaagttcaagctaaacaagtctgagcttaaagagttgcttacacgcgagttaccatcgtttctgggaaagcgtacagacgaagcagcattccagaaactcatgagtaatttggattccaaccgggataacgaggtcgactttcaggaatactgcgtatttctctcatgtatcgcaatgatgtgtaacgagttctttgaggggtttcctgataagcagccacgaaaaaagtag

SEQ ID NO: 239541 - DNA, 333 bp, Artificial Sequence
  Description of Artificial Sequence: Synthetic coding sequence
atgcctgccgcatggatactgtgggcccatagccatagcgagctgcataccgttatggaaacccctcttgagaaggcattgacaacaatggtgaccacctttcataaatacagcggtagagagggtagcaagttaaccctgtcacggaaagagctgaaggaactcattaagaaggagttgtgcctgggagagatgaaggagagtagcatcgacgatttgatgaaatcacttgataagaattcagaccaggagatcgactttaaggagtactcagtctttctcactatgctttgcatggcctacaatgatttctttctggaggacaacaagtag

SEQ ID NO: 239542 - DNA, 279 bp, Artificial Sequence
  Description of Artificial Sequence: Synthetic coding sequence
atggagacgccactggaaaaagctttaacgaccatggttacaacattccataaatattcagggagagaaggaagcaaactgacgctaagccggaaggagctgaaagaactcattaagaaggagctctgcctcggcgaaatgaaagaatccagcatagatgaccttatgaaatcactggacaagaattcggaccaagaaattgatttcaaggagtacagcgtgttcctcacaatgttgtgtatggcctataatgattttttcttagaagacaataagtag

SEQ ID NO: 239543 - DNA, 279 bp, Artificial Sequence
  Description of Artificial Sequence: Synthetic coding sequence
atggagacacccctcgaaaaagctctgaccacaatggtcaccacattccacaaatactccgggcgtgaaggatccaagctgacactttctcgaaaagagttgaaagagttgattaagaaagagttgtgccttggagaaatgaaggaaagtagcattgacgacctcatgaaaagtctcgacaagaattctgaccaagaaatcgattttaaagagtactccgtgttcttgacgatgctgtgcatggcttataacgatttcttcctggaggataacaaatag

SEQ ID NO: 239544 - DNA, 273 bp, Artificial Sequence
  Description of Artificial Sequence: Synthetic coding sequence
atggcctgcccgttggaccaggctatcggcctgctggtggctatcttccacaaatactccggccgagagggggacaaacatacattatccaaaaaggagttaaaagagctcattcagaaagagctgacaatcgggtctaaactgcaggatgcagaaatcgcgagattaatggaagatctcgatagaaacaaggatcaggaagtgaactttcaggagtacgtgacattcctcggggctttggccctaatctacaacgaggcactgaaaggttag

SEQ ID NO: 239545 - DNA, 273 bp, Artificial Sequence
  Description of Artificial Sequence: Synthetic coding sequence
atggcatgccccctggaccaagctattggtttgttggtggctatcttccacaagtattcaggacgcgaaggagacaaacataccctgtccaagaaggaactgaaggaactgatccagaaagagcttaccattggatccaagctgcaggacgctgaaattgccaggctgatggaggacctcgatcggaacaaagaccaggaggtgaactttcaggagtacgtgacctttctgggcgcactggcactcatctataatgaagctcttaaaggatag

SEQ ID NO: 239546 - DNA, 306 bp, Artificial Sequence
  Description of Artificial Sequence: Synthetic coding sequence
atgtcaaacacccaggccgaaagatctatcatcggcatgatcgacatgtttcacaagtacacaaggagggacgataaaatcgaaaagcctagtttacttactatgatgaaagagaattttcctaattttctcagcgcctgtgacaagaagggcaccaactacttggcagatgtattcgaaaaaaaggacaaaaatgaagacaagaagattgatttttccgaatttctgagtcttctaggagatattgcgacggattatcataaacagtcccacggggctgcaccatgcagcgggggtagtcagtag

SEQ ID NO: 239547 - DNA, 306 bp, Artificial Sequence
  Description of Artificial Sequence: Synthetic coding sequence
atgagcaacacacaggcggagcgatcaatcatagggatgatagatatgtttcacaagtatacgcgcagggatgataagattgagaaaccctcactgctcacaatgatgaaggaaaatttccccaacttcctgtcagcctgtgacaaaaagggtactaattatctcgctgacgtctttgagaaaaaagataagaatgaggacaaaaaaatcgacttctccgaattcttatccttattaggcgatatagctacagactaccacaaacaaagccatggagccgctccttgctccggcggatcacaatag

SEQ ID NO: 239548 - DNA, 282 bp, Artificial Sequence
  Description of Artificial Sequence: Synthetic coding sequence
atgctcaccgaactggagaaagcattaaacagtatcatcgatgtgtaccacaaatactctctgattaagggcaattttcacgccgtgtaccgggacgacctgaagaaactgctggagactgagtgcccacagtatataaggaagaagggggctgatgtgtggtttaaggagctggacatcaacactgacggtgccgtcaatttccaggagtttttgatcctggtaattaaaatgggagtcgctgctcataaaaaaagtcatgaagaatcgcataaagaatag

SEQ ID NO: 239549 - DNA, 282 bp, Artificial Sequence
  Description of Artificial Sequence: Synthetic coding sequence
atgctcacagagcttgagaaggccctgaattcgattatcgacgtgtaccacaagtattctttaattaaagggaatttccacgccgtgtacagagacgatcttaagaagttgcttgaaactgaatgcccacagtacattaggaagaagggagctgatgtgtggttcaaagagttggatattaatacagacggcgcagtaaacttccaggaattcctcattcttgtgatcaagatgggcgtggcagcccacaaaaagtcccacgaagagtctcacaaagagtag

SEQ ID NO: 239550 - DNA, 345 bp, Artificial Sequence
  Description of Artificial Sequence: Synthetic coding sequence
atgacgtgtaagatgtcccagttggagaggaatatagagacaattattaatacattccaccaatacagcgttaagctggggcacccagatacactaaatcagggcgagtttaaggagctggtcaggaaagatttgcagaattttttgaaaaaggagaataagaacgagaaagtgatagaacacatcatggaggatctggacacaaatgctgataagcagctcagtttcgaagagttcattatgctgatggcacgcctgacatgggcctcgcatgagaaaatgcatgagggggacgaaggtccagggcaccatcacaagcccggtctcggcgaagggaccccgtag

SEQ ID NO: 239551 - DNA, 279 bp, Artificial Sequence
  Description of Artificial Sequence: Synthetic coding sequence
atgagcgagctggagaaggcaatggttgccctaatcgacgtgttccaccagtactcggggagagagggagacaaacacaagttaaaaaagagcgaactgaaagagctcataaataacgaactctcgcactttctggaagagattaaagagcaagaagttgtcgacaaggttatggagactctggataatgatggcgatggcgagtgcgactttcaggagttcatggcttttgtcgctatggtgaccaccgcctgccatgagtttttcgagcacgagtag

SEQ ID NO: 239552 - DNA, 279 bp, Artificial Sequence
  Description of Artificial Sequence: Synthetic coding sequence
atgagcgaattggagaaggccatggtcgctctcatcgatgttttccaccagtactccgggagagagggcgacaagcataagctaaaaaaatccgagcttaaagaattaatcaataatgagttgtcgcattttctggaagagatcaaggagcaggaggtggtggataaggtgatggagaccctcgataatgacggagatggcgaatgcgatttccaggaatttatggccttcgtggcaatggtgacaacagcatgtcacgagtttttcgaacacgagtag

SEQ ID NO: 239553 - DNA, 288 bp, Artificial Sequence
  Description of Artificial Sequence: Synthetic coding sequence
atgacagagctggaaactgctatgggaatgatcatagatgtgttcagcagatattcgggatctgagggctccactcaaacactaacgaaaggtgaactgaaggtcctgatggagaaggaactccccggattcctgcagtccggcaaggacaaagacgctgtagacaagctgctgaaagacctagacgccaatggggacgctcaggtggatttctctgagttcatagtgtttgtggctgctattacctccgcctgccataagtacttcgagaaagctgggttaaaatag

SEQ ID NO: 239554 - DNA, 300 bp, Artificial Sequence
  Description of Artificial Sequence: Synthetic coding sequence
atgccgacacagctggagatggctatggacactatgatccggatctttcatcggtattccggcaaggagcggaagaggttcaagctttccaagggggagctcaagctgttgctccagcgcgagctcaccgagttcctctcctgtcagaaagagactcagcttgtggacaagatcgtgcaggacctcgatgcgaacaaggataatgaggttgacttcaatgaattcgttgtgatggtagccgcactgaccgttgcgtgcaacgattacttcgttgagcagctaaaaaagaagggaaagtag

SEQ ID NO: 239555 - DNA, 300 bp, Artificial Sequence
  Description of Artificial Sequence: Synthetic coding sequence
atgccgacacaactggaaatggctatggatactatgattcgaattttccataggtatagtggtaaggagcggaagagatttaagctgagcaaaggagaactgaaactcttgctgcagagagagctgaccgagttcttgtcatgccagaaggagactcaactggtcgataagattgtgcaggatcttgatgcaaacaaagacaatgaagtcgacttcaatgaattcgtggtgatggtggccgctctgacagtagcttgtaacgactattttgtagaacagctcaagaaaaaaggaaagtag

SEQ ID NO: 239556 - DNA, 1029 bp, Artificial Sequence
  Description of Artificial Sequence: Synthetic coding sequence
atgatgtgtagtcgcgtcccaagtgaacagtcatccggtacctctctgctgccaaaagatggagctccattttcctgggactcccttgacgaggatggtttagatgactccctgctggagttatccgagggggaagaagacgatggggacgtgaattataccgaagaggagattgacgcactgctgaaagaggacgatccctcttatgagcagtcttccggggaagacgacggaggccatgtcgaaaagggagaacgtgggagccagatcctgctggacacaccaagggaaaagaactcctcctacagcttgggccctgttgccgagaccccggacttgttcaaattacctcagctgtccacctctagtgggcacgggcctgcgcatactaagcccctgaacagacggtccgtcctcgagaagaaccttattaaggtgactgttgcacccttcaatcccacggtgtgcgacgccctgctcgacaaggacgagactgacagctcaaaggatacagaaaagctttccagcttaggcgaggagatgcgtgaggacggcctgtccccaaatgagagcaagctgtgcacagaaagcgaaggcatttccccaaacaacagcgcatggaacggccctcagcttagctcatccaataacaatttccagcaaaccgttagtgataaaaacatgcctgactctgagaatcctaccagtgttttcagcaggatctcggaccactcggaaacgcctaacatggaactgtcgtgccgcaacggaggatcccacaaaagttcctgtgaaatgcggtccttggtcgtgtcaacgagctctaacaaacaagacgttctgaataaggatagtggaaagatgaagggccacgaaagaaggttgggcaaagtgatcccagtgctgcagaccaagacacggacaaatgttcctacgttttcgcaaagcaatctggagcaacagaaacagctgtatcttagatccgtcatagctcacattgaagaccccgaggacacaaaccaaggctag

SEQ ID NO: 239557 - DNA, 1227 bp, Artificial Sequence
  Description of Artificial Sequence: Synthetic coding sequence
atgatgtgcagcagagtgcccagcgagcagagttctggcactagcttactaccgaaggatggcgcacccttttcctgggacagcctggatgaggacgggctcgatgacagcctgctggaactcagcgagggcgaggaggatgacggggacgtgaactataccgaggaagagatagacgccctgctcaaagaagacgacccctcatatgagcagagctcaggtgaagacgatggcggacacgtggagaagggggagagagggagccaaatcctgctggacacgcccagagaaaaaaacagttcgtactcgctgggccctgtagcagagacacctgatctttttaagctgccgcagctgtccacatctagcggtcatggaccagcccacaccaagccactaaacagacgcagcgtgttggaaaagaacctgataaaagtgaccgttgccccatttaaccctacagtttgcgacgcactcctcgataaggacgaaacagattctagtaaggataccgagaagctcagctcattgggagaagagatgcgtgaagatggactctctcctaatgaatccaagctttgcaccgaatcagagggaatctcacctaataactcggcctggaatgggccacagctcagcagcagcaataataatttccagcaaactgtttccgacaaaaatatgcccgattctgaaaacccaacgagcgtgttctctcgaattagtgaccatagcgagactcctaatatggagctttcatgtcggaatgggggatcccataaatctagctgtgagatgaggtccctagttgtttccacctcctcgaacaagcaagatgtgctgaacaaggattcagggaagatgaagggacacgagcgaagactgggtaaggtgatacccgttctgcagacaaagacacggactaacgttccgacctttagtcaatccaatcttgaacagcaaaaacaactatatctgaggtctgtaatcgcacacatcgaagatccagaggacactaatcagggtatttctggcgagctctgtgcattgatggaccaagtgcaccatatgcagcattcaaagtggcagcatccttctgatctcacaactcggaactacgctagaaggcaaaagcacctccagaggtactccttgacccagtgggttgatcggaatatgcgctcccatcataggttccagaggttgcctgatttcagctacagctag

SEQ ID NO: 239558 - DNA, 1227 bp, Artificial Sequence
  Description of Artificial Sequence: Synthetic coding sequence
atgatgtgtagcagggtgccctcagagcagagctccggcactagtctgctacccaaggacggggcacccttctcatgggactcactggatgaggatgggctggacgatagccttctggaactgagcgagggggaggaggatgatggggacgtgaattacaccgaggaagaaatcgacgccctgctgaaggaggatgatccgtcatacgaacagtctagcggtgaggacgacggaggccacgtggaaaaaggcgagcggggaagccagatcctcctggacactccccgagaaaagaacagttcatatagtttagggcctgtcgctgagacccccgacctttttaaactgcctcagcttagcacctcttcaggacatgggccagcacacaccaagccattaaaccggcgtagcgtacttgagaagaacctgataaaggtcacagtggctccatttaatcctacagtgtgtgatgctctgcttgacaaggatgaaactgatagcagcaaggataccgagaagctgtccagtttgggcgaggagatgcgcgaggacggacttagccccaacgaatctaaactttgcacagagtcggaaggtatttccccaaacaactcagcatggaacggtccacagttgtcatcaagtaataataacttccagcagaccgtgagtgataagaacatgcccgattctgaaaatccaactagcgtgttttctagaatatcagaccacagtgagacaccgaacatggagctgtcatgtagaaacggtggctcccataagagctcgtgcgagatgcgctccctcgtggtctccactagctccaataagcaggatgtgttgaataaagattctggcaagatgaaaggccatgagagaaggctgggtaaagtcatccccgtcctccagacaaaaacccggacgaatgtgcctacctttagtcagtcgaacctcgagcagcagaaacagctgtacctgcggagcgtgattgctcacatcgaggatcccgaagacacaaaccagggcatctccggcgaactctgtgccctgatggatcaggtccatcatatgcagcacagtaaatggcaacatcctagcgatctgacaacccggaactacgcaaggaggcagaaacacctgcagagatactccctgacccagtgggtcgacagaaatatgagatctcaccatagattccagaggttgcctgacttcagctactcctag

SEQ ID NO: 239559 - DNA, 1026 bp, Artificial Sequence
  Description of Artificial Sequence: Synthetic coding sequence
atgatgtgcagtcgggtgcctagcgaacagtctagcggaactagcctcttacccaaggatggagctccgttttcatgggactctctggatgaagacggcctcgacgactcgttgcttgagctgtcggagggggaggaggatgatggcgacgtgaattacaccgaagaggaaatcgatgccttgctgaaggaagatgatccaagttacgagcaaagctctggggaagacgacggcggacatgtggagaagggagagcggggatcccaaattctgcttgacacacctagggaaaaaaactcttcatatagccttgggcctgtggccgaaacccctgacttattcaaacttcctcagctctctactagttcaggccatggcccagcacatacaaagcccctcaaccggagatccgttctggagaagaatctgattaaagtaaccgtcgcaccctttaacccaacagtctgcgacgcgctgctggataaggatgaaacagactcctccaaggatactgagaagctcagttcattgggcgaggaaatgagagaagacggcctgtcccccaatgagagtaagctgtgcactgaatctgaggggatctcacccaacaatagcgcttggaacggaccacagttatctagttccaataacaactttcagcagaccgtttctgataaaaatatgcccgactccgaaaacccgacctccgtcttttctagaatcagcgaccatagcgagacaccaaacatggagctgtcttgcagaaacggtgggagtcacaagtctagctgcgagatgaggagcctggtggtgtcaacttcttctaacaaggacgtgctaaacaaggactctggcaaaatgaagggccacgaacgccgacttggcaaggtcatcccagtgttgcagaccaaaacccgcaccaacgtcccaacgttttcccaatcaaatttggagcagcagaaacagctttacttgagaagcgtcatcgcacatattgaggacccagaggacacaaaccaaggatag

SEQ ID NO: 239560 - DNA, 441 bp, Artificial Sequence
  Description of Artificial Sequence: Synthetic coding sequence
atgatgtgttctcgggtgcccagcgagcagtcttctggcacttctttgctgccaaaagacggagctccgttcagctgggacagtctggacgaggacgggcttgacgacagcctgctcgagctgtctgagggggaagaagatgatggtgacgtaaactacaccgaggaagaaatagatgcccttctcaaggaggacgatccgagctacgagcaaagctccggagaagacgatggagggcatgtagaaaagggcgagcggggatctcagattttactggacacgccgagagagaagaattccagttacagtcttggaccggtagctgaaacacctgacttgtttaaactaccgcagctctctacatctagtggccacggtccagctcataccaaaccccttaatagacgctcagtgttggaaaaaaacctgattaaagtctag

SEQ ID NO: 239561 - DNA, 363 bp, Artificial Sequence
  Description of Artificial Sequence: Synthetic coding sequence
atgatgtgttctagagtcccctctgagcagtccagcggtacatccttactgccaaaggacggcgctcccttctcttgggacagccttgatgaagacggactcgacgactcattactggagctaagcgagggggaagaggacgacggagacgtaaattacaccgaagaggaaatagacgctcttctcaaagaggatgacccaagttacgagcagtcctccggtgaggatgatggcggacacgtggaaaaaggcgaacgcggatcccagattttgttggacaccccacgcgagaaaaactcttcctatagtcttggtcccgttgctgagacacctgatcttttcaaactcccacagctgtcttag

SEQ ID NO: 239562 - DNA, 126 bp, Artificial Sequence
  Description of Artificial Sequence: Synthetic coding sequence
atgatgtgttcccgcgtgcccagtgaacagagttctggcacaagtctgctccccaaggacggggctccattcagctgggattctctcgacgaggatggactcgacgactctctactggaattgtag

SEQ ID NO: 239563 - DNA, 18 bp, Artificial Sequence
  Description of Artificial Sequence: Synthetic coding sequence
atgatgtgttcaaggtag

SEQ ID NO: 239564 - DNA, 393 bp, Artificial Sequence
  Description of Artificial Sequence: Synthetic coding sequence
atgatgtgctcccgcgtgccgagcgagcagtccagtgggacgagcctcctcccgaaagacggcgctcctttttcctgggactccctcgacgaggacggtctcgatgatagccttctggaactcagtgagggggaggaggacgacggcgatgtcaattacaccgaggaagagattgatgcattgcttaaagaggacgacccatcatatgaacagtcctccggggaagacgatggtggacatgtggagaagggagaacgcggatctcaaatcctgttggataccccaagagaaaagaacagcagctattctctgggacctgtagccgaaacgcccgacctctttaagctgccacaactgtctacctccagcgggcatggccctgctcatacttag

SEQ ID NO: 239565 - DNA, 1026 bp, Artificial Sequence
  Description of Artificial Sequence: Synthetic coding sequence
atgatgtgctcacgggtacctagcgaacagagtagcggtacaagcctgctcccaaaggacggggcaccattcagctgggatagtctcgatgaggacgggctcgatgattctttacttgagttgagcgagggtgaggaggatgatggcgacgtgaattataccgaagaagaaattgacgctctcctaaaggaagatgatccttcttatgaacagtcttcaggcgaggatgacggtggacacgtggagaaaggggaaagaggaagccagattctgctcgacacccccagagagaagaattcgtcttactccctgggccctgtggctgaaacaccagatttatttaagcttccacagttgtcaacgtcctctggacacgggccagcccacaccaagccacttaatagacgcagtgtcctcgagaagaacttaattaaggttactgtcgccccttttaatccgacggtgtgcgatgcattgctagacaaggatgaaactgacagctctaaagatactgaaaagctctcctcccttggggaggaaatgagggaggatggcctaagtcctaacgagtcaaagctttgtaccgagagcgaaggtattagccctaacaattccgcgtggaacggccctcagctgagctcctctaacaacaattttcagcagacagtgtctgacaaaaacatgcctgattctgagaacccaacaagcgtgttctcacgcatttccgatcattccgagactcccaacatggaacttagctgtaggaacgggggttcccataagtcgagctgcgaaatgaggagtctggttgtgagtacttcctctaacaaggatgttctaaacaaggactcaggaaagatgaagggacacgagcgacgcttagggaaggttatccccgtcctgcaaacaaaaacgaggactaatgtacctacgttcagccaatccaatctggagcagcagaagcaactttatctgcgttctgtgattgcccacatagaagaccccgaagacactaaccagggctag

SEQ ID NO: 239566 - DNA, 516 bp, Artificial Sequence
  Description of Artificial Sequence: Synthetic coding sequence
atgatgtgttcacgggttccaagcgaacagtctagcggcacctcactgttgcctaaagatggggctcccttttcgtgggacagcctcgacgaggacggtttggacgattctttactggaattgagtgagggagaggaagacgacggtgacgtgaattacaccgaagaagagatcgacgcgttactcaaggaggacgatccctcgtatgaacagagttcgggggaagacgatggcggtcatgtggaaaagggagaaaggggaagtcagattttgctcgatacccctagggaaaagaacagttcctatagcctcgggccagtggctgagactcccgatctctttaagttacctcaactcagtacaagcagtggccatggacctgcacatacgaaacccctcaatcggaggagcgtgctggaaaagaacctcatcaaagtcaccgttgcacccttcaatccaaccgtctgtgatgccctgctcgataaggatgaaaccgattccagcaaggatacgtag

SEQ ID NO: 239567 - DNA, 1764 bp, Artificial Sequence
  Description of Artificial Sequence: Synthetic coding sequence
atggccacagccgcttacgagcagctaaagctccatattactcctgagaaattctacgtcgaagcgtgtgatgacggcgctgatgatgtgctgacaatcgatcgcgtctccaccgaagtcaccctggctgtgaagaaggacgttcctccctccgccgttacccgccctattttcggtattctgggaactatccacctggtggcgggtaattacctaatcgttatcacaaaaaagatcaaagtgggggagtttttctctcacgtcgtctggaaagccaccgatttcgacgttcttagttataaaaagacaatgttgcatcttactgatatacagcttcaagacaataagacatttctggcaatgcttaatcatgtgctgaacgtggacggcttctatttctccaccacgtacgatcttacccatactctgcaaagactgagcaatacatccccggagttccaggaaatgagtctgttagaacgagcagaccagaggtttgtctggaacgggcacttactacgcgaactctctgcacagcccgaagtgcatcgattcgcactgccggtcctgcacgggtttatcactatgcacagttgtagcattaatggaaaatattttgactggattcttatttccagaaggagctgctttagggcaggagttaggtattatgttagagggattgattccgagggacacgccgctaatttcgtagaaacagagcagatagttcattataatggctccaaagcctcatttgtgcagacacgcggaagcatacccgtgttctggtctcagagacctaacctaaagtataagccccttccacagatcagcaaggtggccaatcatatggacggatttcagagacattttgatagtcaggtgattatctatggaaagcaggtcattatcaacttgatcaatcagaagggtagcgaaaagcccctggagcagacatttgccaccatggtaagcagtctgggctccggaatgatgcgctatatcgcattcgacttccacaaagaatgtaagaatatgaggtgggatcgtctatctatcctgttggatcaggtagctgaaatgcaggacgaattatcatacttcctagtggactcggccggacaggtagttgcaaatcaggaaggcgtgttcagatctaattgtatggattgtctggaccgtaccaacgtgatacaatctcttctggcccgtagaagcctgcaggcacaactgcagcgactcggcgttttgcatgtggggcaaaaacttgaagagcaggacgaatttgaaaaaatctataagaatgcatgggccgataacgcaaacgcctgcgcaaagcagtacgctggcacaggcgcactaaagacagatttcacacgcactggcaaaagaacacatctggggctgataatggatggatggaattccatgattcgatactacaagaataatttctctgatggttttcgccaggactcgatcgacttattcttgggaaattatagcgtggatgagctcgagtcccactctccgctgagcgttcccagggactggaagtttctcgctttgccgatcatcatggtggtcgctttctctatgtgtattatttgtctattaatggctggagacacatggaccgagacacttgcctacgtccttttttggggagtggcctccattgggactttctttatcatactatacaacggtaaggattttgtggatgctcctaggctggtgcagaaggagaaaatcgactag

SEQ ID NO: 239568 - DNA, 1581 bp, Artificial Sequence
  Description of Artificial Sequence: Synthetic coding sequence
atgtggaaattggttatgatggagcagatgacgtacttacccctgactgtctgcccccagcgactcccactacagagccggaaaatgttcctgttacagttaagtcaagatcagtacctcgtatattgggcccaatccatctggtggcagctgcaagacaataaaacctttctcgccatgctaaaccatgtactgaatgtcgatggattctatttttctactacctacgatctgacccatacgctgcagaggctgtctaatacctcgcctgaattccaggagatgagtttgttggaaagagctgaccagcggtttgtatggaacggacacctcctgcgcgagttgagtgctcaacccgaggtgcacagatttgccttgcctgtgctccacggatttattaccatgcactcatgttctatcaacggcaagtacttcgactggatactaatttcccgacgtagctgtttccgtgctggcgtccgctactacgtgcgaggaatcgacagtgaaggccacgctgccaattttgtggaaaccgaacagatagtccactataacggcagtaaagcttcctttgtgcagacccggggatccatccctgtgttctggagtcagcgccctaacttgaagtacaagccacttccacagatcagcaaagtggccaaccacatggatggtttccagcgacatttcgactcccaggtgattatctatggaaagcaggttatcatcaatctgataaaccagaaaggctctgagaagccactggagcagacatttgcaacaatggtctcatctctgggtagcggaatgatgaggtatatagctttcgatttccacaaagagtgcaagaatatgagatgggataggctgtcaatactactcgaccaggttgccgagatgcaggacgaactgagttactttcttgttgacagcgctggacaagtggtggccaaccaagagggagtgttcaggtctaactgtatggattgtcttgaccggaccaatgtgattcagtcattactagcgaggcgctctctgcaggctcagctgcagaggcttggggtgctgcatgtaggccagaagttagaagaacaggacgaattcgagaagatctataagaacgcctgggccgataacgcaaatgcttgcgcaaagcagtacgctgggacaggcgctcttaagacagactttaccagaacagggaagcgaacccaccttgggctgattatggatggatggaactctatgatccgttattataagaacaatttctccgatggtttcaggcaggactcaattgacctgttcctgggcaactacagtgtggacgaactcgagtcccattcccctctatcggtaccacgagactggaaattcctggcactgcccatcattatggtcgtagccttcagtatgtgtattatttgcctcctcatggcaggagatacgtggaccgaaacactggcatacgttcttttttggggagtcgcctccatcggaactttctttataattctctacaatggcaaggactttgtcgatgcacctcgtctggtgcagaaggaaaagatcgactag

SEQ ID NO: 239569 - DNA, 2901 bp, Artificial Sequence
  Description of Artificial Sequence: Synthetic coding sequence
atgttctggaagttcgacctgaataccactagtcacgttgataagctactagacaaagaacacgtgacccttcaggagctcatggacgaggacgacattctacaggagtgcaaagcccagaatcagaaattgctggacttcctctgtagacaacaatgtatggaagagcttgtatccctgattactcaggaccctccgctggatatggaagagaaagttcggtttaagtatccaaacaccgcctgcgagttgctcacatgcgacgtgcctcagatttccgacagactcggaggggacgagagtttactttctctgctttacgactttttggaccacgaaccacccctaaaccccctgctggcgagctttttctcgaagaccataggtaatcttattgccaggaagaccgagcaggttataaccttcttaaagaaaaaggataaatttatctctctggtgctcaagcacatagggacatccgcattgatggacctgttgttgcgtctggtgagctgcgtagaacctgccggattgcggcaggacgtgctgcactggcttaatgaggagaaggtgatccagaggctggtcgaactgattcacccttcgcaggatgaggataggcaaagtaatgcatctcaaacactgtgcgacatagtgcgcctaggccgagaccagggctcgcagcttcaggaggcactggagccggaccccctcctcacggctctggagtcacaggattgcgtggaacaactcctgaagaatatgttcgatggagacaggacggagtcctgcttagttagcggcactcaggttctactaacactgctcgaaacccgtcgtgttgggacggagggccttgtagattctttctcacaggggctggagcgctcatacgccgtcagcagttctgtgctgcatggaattgaacctagattgaaagattttcaccagctgctgctcaatcccccaaaaaagaaggcaattctgactacaattggcgtacttgaagaacccttgggaaatgctcggctgcatggggcacgccttatggccgcacttttgcataccaacactccaagcataaaccaggagctctgtcgcttgaacaccatggatctattgctggacctgtttttcaagtatacttggaataacttccttcactttcaggtggaactgtgtattgcagcgattctttcacacgccgcacgcgaagagagaactgaggctagtgggagtgagagccgggtggaacctccacatgaaaacggtaaccggagcctggagaccccacaacccgcagcaagcctacccgataacaccatggtgacccatctgtttcaaaagtgctgtctggtacaacgcattctggaggcttgggaggccaacgaccatacacaggctgccggtgggatgaggcggggaaacatggggcatctgacacgtatcgccaacgctgtggtgcaaaatctggaaaggggcccagtacagacgcacatttcagaggttatcaggggactcccggcagattgccgcggaaggtgggagtctttcgtcgaggagacactgacagaaactaatcgtcggaacactgtggacctcgtttctacacaccacctgcactcctcgagcgaagacgaggacatagaaggcgcattcccaaacgaactcagtctgcagcaggccttcagcgactaccagatccaacagatgactgcgaacttcgtagatcagtttggctttaacgatgaagagtttgctgatcaggacgacaatattaatgcgccattcgaccggatcgcagaaattaatttcaacatagatgcagacgaggactctccctccgcagccctgttcgaagcttgctgctctgatcgcatccagcctttcgacgatgatgaggatgaggatatttgggaggactccgataccagatgtgcagcaagggtcatggctcgccctcgttttggagctcctcacgccagtgaaagctgcagcaagaatggacccgagagagggggtcaggatggaaaggcgagcctcgaagcgcatagggacgcccctggtgccggagctccccctgccccagggaagaaagaagcgccacccgtggaaggtgattccgagggtgccatgtggaccgccgtcttcgatgagccagccaacagcacacccaccgcccctggtgtcgtgagagacgttggctcatctgtctgggcagcaggcaccagtgctccagaggaaaaggggtgggcaaagttcacagatttccagccattctgctgcagcgagtctggaccccgatgcagttcccccgtggataccgagtgtagccacgccgagggatctaggtctcagggacccgaaaaggcttcccaggcctcttatttcgctgtctcccccgctagcccctgtgcatggaacgtttgtgtcacccggaaggctcccctgttagcatcggattcatctagcagcggtgggagccattctgaagacggggaccagaaggcggctagcgccatggatgccgtgtccaggggtccaggaagagaagctccacctctgccaaccgttgcaagaaccgaggaagctgtgggtcgagtaggctgcgctgactcaagacttctgtcccctgcttgtccggctccaaaagaggtgacagcagcgccagccgtagcagtacctcccgaggccacagtcgccatcacgacagcactgagcaaagccggacctgccatacctacaccggcagtgtcttccgccctcgcagtagcagttccgctgggaccgatcatggctgtgacagctgccccagccatggtggccactctcggtactgtgacaaaggatggcaaaactgacgctcccccagaaggagcagctctgaatggccctgtgtag

SEQ ID NO: 239570 - DNA, 2217 bp, Artificial Sequence
  Description of Artificial Sequence: Synthetic coding sequence
atgtccagaagatcgcagagactaacaaggtactctcagggagacgatgatggcagcagcagttctggcggttctagcgtggctggtagccagagtactctgtttaaggacagcccattgagaacattgaagcgaaagtcaagcaatatgaagcggctcagccctgccccacagttgggcccaagcagcgacgcgcacaccagctactatagcgagagcttggtccacgagagttggtttcctcccagatcctcactagaagagcttcacggcgatgcgaattggggggaggatttgagagtaaggcgcagacgaggcactggcggaagcgagtcgtcacgggcatctgggctagttggcagaaaggcgacagaagattttctcgggagctcttctggttattcgtctgaagatgattacgttgaagattccgagggacgcggaagcaaagtgaccgagacagagcccgtgagctcatttcccgctggttatagcgacgtggatcaacagagcagctcatcaaggttacgctcagccgtatctcgcgctggctcgcttctttggatggttgcaacatctcccggtagactcttcagactcctgtattggtgggccggtactacctggtatagactcactaccgctgcaagcctactggatgtgtttgttctcacaagacggttcagctcactgaagacttttttgtggtttctgcttcctctcttgctactgacatgcctcacatatggagcctggtacttttacccttacggcctccagacgttccacccggctctggtaagctggtgggccgctaaggatagccggcgacctgatgaaggctgggaagcacgcgactcatcgccacattttcaggctgaacaaagggtgatgtccagggtccatagccttgaaaggcgtctggaggctctggccgctgagttttcctccaactggcaaaaagaggccatgaggctggaaagactggaactcagacagggagctccaggccaaggtgggggaggagggttgagccatgaagacacactggctctcctcgaaggcttggtatccaggagagaagcggctttgaaggaggatttcaggcgggaaactgcagcgaggatacaggaagagctgtccgccctgagggcagagcatcagcaggactcagaagatctgtttaaaaagattgtacgcgcttcgcaggaatcagaggccagaattcagcagttgaaatccgagtggcaatcaatgacccaggagtcctttcaggaatcaagcgtgaaagagctaaggaggcttgaggatcaacttgccggtctgcagcaggagttggctgcactcgcactcaagcagagtagcgttgcagaagaagtggggctcctaccccagcagattcaggccgtgcgagatgacgttgagtcccagttcccagcgtggatttcacagttcttagctcgcggaggaggcggaagagtgggactattgcagcgggaggagatgcaagctcagctccgggaactggagtcaaaaatcctgacgcacgtggccgaaatgcagggtaaatcagctcgtgaggctgctgcgtcgttgagcctgactttacaaaaagaaggggttattggcgtaaccgaagagcaggtgcatcacatcgtgaaacaggctctgcagcggtacagcgaagatcgcatcggcctagccgactacgccctggagtcagggggagcttccgttatttctactcgatgtagtgagacatacgagacaaagacagccctcctatctctttttggcatccccctgtggtaccactcccaaagtcctagggtaattttgcaacctgacgtgcatcctggcaactgctgggcctttcaaggtccacagggtttcgcggttgtcagactatcggcgcgaatccgcccaaccgcagtgacacttgagcatgttcccaaggcactgtcgcctaactctacaatatcctccgcccctaaagactttgcgatcttcggcttcgacgaagatttacagcaggagggaacacttctggggaagttcacgtacgatcaggatggcgagcctatccagacctttcactttcaagcgccaaccatggccacctatcaagtggtggaattacggatcctcactaattggggccacccagagtatacatgtatctatcgctttcgggttcatggcgaaccagcacactag

SEQ ID NO: 239571 - DNA, 2154 bp, Artificial Sequence
  Description of Artificial Sequence: Synthetic coding sequence
atgtcccgacgatctcagagactgacacggtattcccagggcgacgacgatggctccagtagtagtgggggtagctcagtggccggatctcagtccaccctctttaaagactccccgttgcgcactctgaaaagaaagtcctccaacatgaagcgtctcagccctgcaccacagctgggccctagctcggacgcccacacatcatactatagtgaaagcttggtgcacgagagctggttccctcctaggtctagtctcgaagaactccacggggacgctaactggggagaagatctcagagtgaggcggaggagagggactggaggatccgagagttctcgcgcatctggattagtgggcaggaaagcaactgaagacttcctagggagctcgtccggatactctagtgaagacgattatgtgggatactcagacgtggaccagcagagctcctcatctagattgcgctcagccgtcagtcgggcaggttcgctgctgtggatggtcgcgaccagccccggaagactgttccggctgctctattggtgggccggaactacttggtatcgcctcacgacggcagcgagtctgctggacgtttttgtcttgacacgcagattctcgtccctcaaaacattcctctggttcctgctgcccttattgctactcacatgcctgacgtacggggcttggtatttctatccgtacggactgcagaccttccaccccgcactcgttagttggtgggcagcaaaagattcaagacgtcccgatgaaggttgggaggccagggattccagtccacacttccaggcggaacagcgggtgatgtccagagttcactcgctggagaggcgactggaggctctcgctgctgagttcagcagcaattggcagaaggaagccatgcgcctggagcgcctcgaattgcgccagggcgctcccggtcagggaggcggagggggactgagccatgaggatacactggctcttctggaaggcctagtcagccggagagaggctgccttgaaagaagactttaggagagaaaccgctgcaaggattcaggaggagctgtcagcgcttcgcgcagagcaccagcaggacagcgaagatctattcaagaagatcgtgcgggctagccaggagtccgaggcacggatccagcagctgaaatcagagtggcagtccatgacacaggagagctttcaggaatcctccgtgaaggagctgcgcaggctcgaggaccaacttgctggactgcagcaggaactggccgcacttgcccttaaacaatctagtgttgcagaggaggtcggcttgctgccccaacagatccaggcagtgcgggatgatgtggaatcacagttcccagcttggatctcccagttcctagctcgcggaggcggagggagagtcggattactgcagcgggaggaaatgcaggcgcagctgcgggagctggagtcaaaaatcctgacccacgtggcggagatgcaaggtaagagcgcacgcgaagccgctgcctcccttagtctgacgttgcagaaggaaggagtgatcggcgttaccgaggagcaagtccatcatatcgtcaagcaggccctgcaacggtacagcgaggatagaataggtttagcagactatgccctagaatcaggtggcgcatcagtgattagcactaggtgctctgagacatatgagaccaagacagccttgttatcccttttcggcattcccctgtggtaccattcacagtcgccacgcgttattctccagcccgatgtgcatcccggaaactgctgggcattccaaggccctcaggggtttgcagtggtaagacttagtgcacgcattaggcccacagctgtgacgttagaacatgtaccaaaggccctctctccaaactcgacgatctccagcgcccctaaggactttgcaatcttcgggtttgacgaagaccttcagcaggaggggacgttactgggaaaatttacatacgaccaggatggcgaaccgatccagacgtttcatttccaggcacccacaatggccacataccaggtggtggaacttcggattctgacgaactggggccacccagaatacacgtgcatataccgatttcgggtgcatggagagccggctcactag

SEQ ID NO: 239572 - DNA, 2154 bp, Artificial Sequence
  Description of Artificial Sequence: Synthetic coding sequence
atgagcaggaggtcacagcgcctgactcggtattcccagggagacgacgacgggtcttcatccagtgggggtagcagtgtcgcgggaagccagtcaactttgttcaaagactccccgctgaggacccttaagcgcaaatctagcaatatgaaaagactcagtccagcccctcagctgggaccgagctctgatgctcatacctcatattactctgagtctctggtccacgagagctggttccctcctcgctccagcctggaggagctgcacggggacgccaattggggcgaggatctcagggttcggaggcgcagagggacgggtggctccgagtcttcccgagcatctggtctcgtcggtcggaaagcaacagaggacttccttggaagcagcagcgggtatagctcagaggacgactacgtcggctactctgatgtggaccagcagtcttcctcgagccgtctgcgaagcgcagtctctcgcgcaggcagcctgctgtggatggtggccaccagccccggtaggttattccgcttgctgtactggtgggccggaactacatggtaccggctgacaacagcagcatcactcctggatgtgttcgttctaaccaggcggtttagttccttaaagacttttttgtggttcctgctgccattgttattgctgacatgcctcacttatggtgcctggtacttttatccatacggtttgcagaccttccaccctgctcttgttagctggtgggccgctaaggacagcaggaggcccgacgagggttgggaggcccgagacagttctccacattttcaggctgaacaacgggttatgtcccgcgtccattcccttgagaggcgcctggaggcgttagcagccgagtttagcagcaactggcagaaggaagctatgcgcctagagcggctcgagctgagacagggcgctccgggtcaggggggtgggggtggcttgtcccacgaagacacacttgcattgctagagggactggtctcccggcgagaagcagcactcaaagaggactttagacgtgagaccgcagcgagaatccaagaggaattaagtgcccttcgcgctgagcaccagcaggacagtgaagacttgttcaagaaaattgtacgggcatcccaggaatcagaggctaggatccaacagcttaaatccgagtggcagtccatgacccaggaatcattccaggagagctccgtcaaagagttacgtagactcgaagaccagctcgccggactccagcaagagctcgccgctctagcactgaagcaatcatccgtcgcagaagaggtgggcctgctgccccaacaaatacaagccgttcgggatgatgtcgagtcgcagttccccgcatggattagccaattccttgctaggggcggaggtgggcgtgtgggactgctgcagcgagaagaaatgcaggcacagcttcgcgaacttgaatccaaaatcctgacccatgttgccgagatgcaaggaaagtctgccagggaagctgccgctagcctgtcactgacactgcaaaaggagggcgtgatcggagtgaccgaagagcaggtacaccatatagtgaagcaagctctccagagatatagcgaggatcgtattggcctcgccgattatgccctcgaatccggtggagcctccgttatatctactcgctgtagcgaaacatacgagaccaagactgccttgctttcactattcggaattcccctgtggtaccacagccagtccccacgagtgatcctgcaaccagacgtgcatcccggaaactgctgggccttccaagggcctcagggtttcgccgtcgtgcgcctaagcgctcgtatacgtccgacggctgtgacattggagcatgtgcccaaggcgctcagtccaaacagcacaatttccagcgcccctaaggacttcgctatcttcggtttcgatgaggacctccagcaggagggaaccttgttggggaagttcacttatgaccaggacggagagccaattcaaacctttcactttcaagctcctacaatggccacctatcaggtcgtggaactccggatattgaccaactggggtcatccagagtatacttgtatatataggtttagggtgcatggggagccagctcactag

SEQ ID NO: 239573 - DNA, 2121 bp, Artificial Sequence
  Description of Artificial Sequence: Synthetic coding sequence
atggtgagccccccttccgctggacaacgattgcgcggagtccctgtctgggcggctggggctttccggttctcttcaggagaagaatccacaagtcacctgattatgtcaaggcgctcccagcgcctgactcgatactcccagggagatgatgacggctcttcatcttcgggtggaagcagtgtggcgggttctcaaagtaccctatttaaggattcgcccctgagaacacttaagcgaaaatcgagcaatatgaagcgtctatcacctgcaccccagctgggcccttccagtgatgcacatacatcatactattctgagtcgcttgtccacgagagctggttccctccacgctctagcctggaagaactccatggcgatgctaactgggggtactccgatgtagatcagcagtccagttccagtagactccggtctgccgtcagtagggcaggaagcctcctgtggatggtcgctacctcgccgggaagactttttcggttgctgtactggtgggctggcactacctggtaccgcttgaccaccgctgcatccctgctggatgtgttcgttttgactaggcgcttctcttcgttgaaaacttttttatggttcctgctgcctcttttgttattgacatgccttacttatggggcttggtacttctatccgtacggactacagacgttccaccctgccctggtgtcctggtgggctgctaaagactctcgtaggcccgatgaaggatgggaggcgagggattcctccccccactttcaggccgagcagagagttatgtcccgggtgcacagcctggaacggagactcgaagctctggctgctgagttcagttccaattggcagaaggaagcgatgagactcgaaagacttgagctgcggcaaggggcacctggacagggagggggtggcggtctgtcacacgaggataccttagctttgttagaggggcttgtgagccgcagggaggccgctttgaaagaagatttcaggagggaaaccgcagcccgtatccaagaagagctgtccgccctgcgggctgaacaccagcaagactctgaggacctgttcaaaaagatcgtgcgtgcttcccaggagagtgaggcacgaattcagcagctgaagagtgagtggcagagtatgacccaggagtcatttcaagagagtagtgttaaggaacttcgcagactggaggaccagctggcaggactccagcaggagttagccgctctagctctgaaacagagctccgtggccgaagaggtaggtctgttgcctcagcagatacaggccgtaagggacgatgtagagagccagttcccagcctggatttctcaatttctggctcgaggtggtggaggcagagtcggattgctacaacgagaagagatgcaggctcagctacgggagctggagtccaaaatattgacccatgtcgccgagatgcaaggaaagtcagctcgtgaagccgcagcttccctgagcttgactttgcagaaggagggggttattggcgtgacagaagaacaagtgcatcatatcgttaaacaggccctgcagaggtacagcgaagaccgtattggtctggccgactacgcactcgagagcggcggtgctagtgtcatttctactagatgcagtgaaacatacgagaccaaaacagctcttctcagtctgttcgggatcccactctggtatcacagccagagcccaagagtgattctccagcccgacgtgcaccccggaaattgctgggctttccaggggccacagggtttcgcggtggtgcggctgtccgcacgtataaggcctacagcggtgaccctggaacatgtgccgaaggctctcagtcctaacagcactatttcctccgccccaaaagactttgcaatcttcggtttcgatgaagacctgcagcaggagggcacacttctggggaaatttacatacgatcaagacggcgagccaatccaaactttccattttcaggctcctactatggctacgtaccaggtggttgagttgcgcatacttacaaactggggtcatccggaatacacctgcatttacagatttcgagtgcacggagagccagcccattag

SEQ ID NO: 239574 - DNA, 375 bp, Artificial Sequence
  Description of Artificial Sequence: Synthetic coding sequence
atgtctagaagatctcagagactcactaggtattcacagggtgatgatgacggctcctccagctctggagggagcagcgtggcagggtcacagagcactttgtttaaggattctcccctgagaacgctcaagcgaaagtcatctaatatgaaaagactctctcccgcaccacagctgggtcccagcagtgacgcccatactagctattatagtgaaagcttagtgcacgaatcttggtttccacccaggtcttccctggaggaacttcatggcgacgcaaattgggaccctacctttcagaagctcctggaggcccagaaaagcccatggttctttcccgcacaggtccgaacctgcgggtgcggcggtggctag

SEQ ID NO: 239575 - DNA, 384 bp, Artificial Sequence
  Description of Artificial Sequence: Synthetic coding sequence
atgagcaggagatcccagagactaacgaggtactcccaaggcgatgacgacggctcatcttcaagcggcggttcttccgtggcaggaagtcagtctacactcttcaaagattctccccttaggacactcaagcgaaaatcaagcaatatgaagcgcttgtctcctgcccctcagctcggaccttcatccgacgcacacacatcctattactctgagagtctggttcacgagagctggtttcctccaagaagctccctagaagagctgcatggcgatgcgaattggggctactcagacgttgatcaacagtcctcttcttcacgattaaggtctgcagtgagcagggctggcagcctgctgtggatggttgctacttccccttag

SEQ ID NO: 239576 - DNA, 333 bp, Artificial Sequence
  Description of Artificial Sequence: Synthetic coding sequence
atgagtcgcaggagccagcgcctcactaggtacagtcaaggggatgacgatggctctagttcgtctggaggctcctcggtggcgggttcccaaagcacactattcaaggatagtcccctgaggacactgaaaaggaagtcaagcaatatgaagagactcagcccagctcctcagttgggcccatctagtgatgcgcacactagttattattccgaatcactcgtccacgagtcctggtttcccccacgctccagcttagaggagcttcacggggacgccaattggggtgaagatttgcgagtcagaaggaggcgtggtaccggaggttcttag

SEQ ID NO: 239577 - DNA, 675 bp, Artificial Sequence
  Description of Artificial Sequence: Synthetic coding sequence
atgtcccgacgtagccaacgtctgactcggtacagccagggggacgacgatggttcaagcagtagcggtggctcttctgttgccggatcccagagcactctcttcaaagacagccccctgagaaccttaaaacgcaagtcttcaaatatgaaacgcctctctccagctccccagctgggaccttcttctgacgcacatacatcttactactctgagagcctcgttcatgaatcttggttccctcctagatctagccttgaagagctacacggggacgccaattggggatattcagacgttgaccagcagagctcaagtagcagactgaggtctgctgtgtcacgggctggttccttgttatggatggtggccactagccccggacgtctgttccggttgctctactggtgggcaggaaccacatggtaccggctgactaccgccgcatcacttcttgatgttttcgtgttaaccaggcgcttctcatccctgaagacttttctctggtttctccttcctcttctcctccttacatgcctgacctacggggcttggtacttctacccctatggactgcagactttccatccagcactcgtgtcctggtgggcagcaaaagattcaaggcggcctgatgaaggttgggaggccagggactccagccctcacttctag

SEQ ID NO: 239578 - DNA, 306 bp, Artificial Sequence
  Description of Artificial Sequence: Synthetic coding sequence
atgagcagacgttcacagcggctaacgagatattcacagggcgacgacgatggatctagctctagtggcggttcatctgtggcagggagtcagtccacactcttcaaagatagtccactccgcacccttaagagaaagagtagcaatatgaaacggcttagtccagctccacaattaggtccatcctcagatgcccatacatcctactactctgagagcctagtccacgagtcctggttccccccaaggtcatcacttgaggaactgcacggcgacgctaactggggcgaggatctgcgcgtatag

SEQ ID NO: 239579 - DNA, 435 bp, Artificial Sequence
  Description of Artificial Sequence: Synthetic coding sequence
atgtcgcgacggtcccagagacttacacgctatagccagggtgatgacgacggctcttccagttcgggtgggagcagtgtggccggtagccaatcaacattgtttaaggactcacccctcagaacactgaagaggaagtcctccaacatgaagagactttcacccgcacctcagctagggcctagctcggatgcccacaccagctactactctgaatcactggtacacgaatcatggtttcctcctagaagctccttggaggagctgcatggcgatgccaactggggcgaggatttgcgtgtgaggcggagacggggaaccggcggatcagaatcatcccgggcttcaggcttggtgggacggaaggccaccgaagattttctcggctcaagcagtgggtacagtagtgaagacgattacgtgggtagacggtag

SEQ ID NO: 239580 - DNA, 618 bp, Artificial Sequence
  Description of Artificial Sequence: Synthetic coding sequence
atgagccgtcgatctcagcggcttacacgctatagtcagggcgatgatgacggttcaagcagcagcggagggagttcagttgcaggtagccaatccacactctttaaggattctcccctgcggactctaaagcggaagtctagtaacatgaaaagactcagtcccgcaccgcagctgggccctagctccgatgcacacacctcctattactccgagtccctggtgcacgaatcttggttcccacccagaagcagcctggaggagctccatggcgatgccaactggggggaagatctgagggtccgcagaagaaggggaaccggcggaagcgagtcttctcgggcaagtggactggttggcagaaaggctaccgaagatttccttggcagcagctccggatactcctcagaagatgactacgtcgggtattctgacgtggatcagcagtctagcagttctcgccttaggagtgccgtgagccgagctggctccctcctatggatggtagctactagcccgggacgcctgttccgcctactctactggtgggctgggactacatggtaccgattaactaccgccgcttcactcctggatgttttcgttctcacccgttag

SEQ ID NO: 239581 - DNA, 1140 bp, Artificial Sequence
  Description of Artificial Sequence: Synthetic coding sequence
atgccaaggtctagccgttcccccggagaccccggtgctctcctggaagatgtcgcccataatccgagaccccgaaggatcgcccaacgaggccgtaatacatcccgcatggcagaggacacatctcccaacatgaatgacaacatcctgctgcctgtgcggaataacgaccaggcacttggcctgactcaatgtatgctgggctgtgtgagctggttcacgtgtttcgcctgcagtctccgaacccaagcacagcaagtgctgttcaatacgtgtcggtgcaagttgctttgtcaaaaactgatggaaaagacaggcatcctgctcctttgcgcttttgggttttggatgtttagcattcacttaccatctaagatgaaagtgtggcaagacgattcaataaacggccctcttcaatccctcagactgtaccaagagaaagtccggcaccacagcggcgagatccaggacctgagaggaagcatgaaccagctgatcgcgaaacttcaggaaatggaggcaatgagcgacgagcagaagatggcccaaaagattatgaaaatgatccatggcgactatatcgaaaagcccgacttcgcactgaaaagtataggagcttcaatcgattttgagcacacatctgtgacctataatcatgagaaggcccacagctattggaactggatccagctgtggaattatgctcaacctccagatgttatcctggagccaaacgttacccctggcaattgctgggcatttgagggcgacagagggcaagttactattcagcttgcccagaaagtgtacttgtccaacctcactcttcaacacattcccaagaccatctctttgtccggatccctcgatactgcgcctaaggatttcgtgatttatgggatggaggggagcccaaaggaagaggtattcctgggtgcctttcagttccagcccgagaatattatccagatgttcccactacagaaccaacctgccagagcattttccgcagtgaaagttaaaataagcagtaactggggcaatcccggattcacctgcctatacagggtaagagtgcatgggagtgtagctccacctagagagcaacctcaccagaacccatatccaaagcgagattag

SEQ ID NO: 239582 - DNA, 369 bp, Artificial Sequence
  Description of Artificial Sequence: Synthetic coding sequence
atgcccaggtcttcaagatcacccggagaccccggagccctgttagaagacgtggcccacaaccctcgccctcgtagaatagctcagcgaggtcggaacacaagccgcatggccgaagatactagtcccaatatgaacgacaatattcttttacctgtccgaaacaacgaccaggctctggggctaacgcagtgtatgcttggatgcgtctatgcctcatgttgtgccaggtcgtcatggagaaggcaggctttctgtagcagcgtactgtcggtgtgtcctagagccctccccagtccaaggtggcgatatccttgggcacttgccctgatcatcggccactgggcgcgtcattgcactgcgacctag

SEQ ID NO: 239583 - DNA, 1065 bp, Artificial Sequence
  Description of Artificial Sequence: Synthetic coding sequence
atgcctcgaagttctagatccccgggagatccaggcgcactcctcgaggacgtggcacacaacccacgcccacgacgcatcgcccaaagagggaggaacacctccaggatggcggaagatactagtcctaatatgacttggtttacatgctttgcatgctccctaagaacccaggcgcagcaggtgttgttcaatacatgtaggtgtaagcttttgtgccagaagttgatggagaagactggaatactcctactgtgtgcctttggattctggatgttttctatacatctgccctccaaaatgaaagtgtggcaggacgactccatcaacggccctctgcagtcgttgcgactataccaagagaaggttcgccatcatagtggcgaaatccaggatcttcgagggtccatgaatcagttaattgcaaaattgcaggaaatggaggcaatgtcagatgagcagaaaatggcgcagaagattatgaagatgatccacggggactatattgaaaaacccgacttcgccctgaaatctatcggcgcttctatcgacttcgaacacacaagcgtgacgtataatcacgagaaagcacactcctactggaactggattcaactctggaattacgctcaacccccagacgtcattctggagccgaatgtgactccaggaaattgttgggcttttgaaggtgacagaggacaggtaaccattcaactcgctcagaaagtgtatctttccaatctgacgctgcaacatatcccaaagacaatttccctctcaggaagccttgacaccgccccaaaagacttcgtcatttacgggatggaaggctcccccaaggaggaagtctttctcggcgcatttcagttccagccggagaacatcatccagatgttccccctgcagaaccagcctgctcgcgcttttagtgctgtgaaggtcaagatttcttccaactggggtaaccccggatttacatgcttgtacagggtcagagtacatgggtctgtggcaccgccaagggagcagccgcaccagaatccataccccaagcgagactag

SEQ ID NO: 239584 - DNA, 459 bp, Artificial Sequence
  Description of Artificial Sequence: Synthetic coding sequence
ggggctctgttagaggatgtcgcacacaatccccgtcccaggcggatcgcccagagaggcagaaacaccagccgaatggctgaagatacctcccccaacatgaatgacaacatcctgcttcctgtgagaaacaatgatcaggcattaggcctcacacagtgtatgcttggctgtgtgagctggtttacatgcttcgcctgttctctgcggacccaggcccaacaggtcctctttaatacttgccgctgtaagttgctttgccaaaagctgatggaaaaaacagggatcctgcttctctgcgccttcggggtgagccagggacccgctcagtctcaggtggaggtgtcactcggtcccggaaccgactacagaactctggggaagaccttgcattgccatgttacccagttcccccatctgcccgatgggtgttgctgtgagaattatgagatgaagtag

SEQ ID NO: 239585 - DNA, 387 bp, Artificial Sequence
  Description of Artificial Sequence: Synthetic coding sequence
atgtccgagggcggtggccaggttagctgcatcttcgcagccccaacccggctttgccgctggcccgctttaatagaatgtggtgtcaacctcacacagcctttgtgtgaatggatgattcaagtcgcacgcgatcgaacactctctctagcctgggaggtagcctccctgctcacactgtcttccagtgaggtcggcttagagggagtcggcactatctggccttcatcctattcgtcagaagagtcttctaggaacggagccgagcaggggagacaactttctattgagggacctttccagggacagaactgtcccagccatccagcagcagccttgccccttcctatgaggggagaatctcaggccacttcttgtcaggtatag

SEQ ID NO: 239586 - DNA, 3975 bp, Artificial Sequence
  Description of Artificial Sequence: Synthetic coding sequence
atgtccagacggaagcaggcaaaacctcagcacttccagagcgatcctgaggtggcttctctgcccagaagagacggggacacggaaaaagggcagccgtccaggccgacaaagagcaaggacgctcacgtgtgtggccgttgttgcgccgaattttttgagctctcagatctcctcctgcataagaaaaactgtacgaagaatcagctcgttctgatcgttaacgagaacccagcatcaccaccagagaccttctctccatctcccccaccggataaccctgacgagcaaatgaatgacacagttaacaagaccgaccaggtggattgttctgatctgagcgagcataacgggctggatcgcgaggaatctatggaagtggaggctccggtggctaacaagagcggctccggcactagttcagggtctcactcctccaccgcgccaagtagttcctcaagctcttctagctcatccgggggaggtgggtctagctcaaccggaacttctgccatcactacatcactgccacagctgggcgacttaaccactctggggaacttctccgtcataaactctaacgtaatcattgagaacttacagagcacgaaggtggcagttgcccagtttagtcaggaggcccgttgcggcggagcctcggggggtaagctcgctgtccctgcgctgatggagcagcttctggcgctgcaacagcaacagattcatcagctgcaactcatcgagcagattcgacaccaaatcttactattggcttctcagaatgccgatctccccacgtccagttctccctcccagggtacactccgtacctctgccaatcctctgtccacgctgagttcccacctttcccaacagttggcagctgcagccggattagcgcagtcattagcatcccaatctgcctcaatatcaggggttaaacagctgcccccaattcagctcccccagagtagcagcggtaatacgatcatcccatcaaactccggttccagtccgaacatgaacattctcgccgcagcagtaactactccttcctctgaaaaagttgcatctagcgcgggtgcttctcacgttagcaatcctgctgtttcctcctcctcgtcgcctgcatttgccatatcaagtcttcttagccccgcatcaaacccgctgcttcctcagcaggcaagcgccaattctgtgttccctagtccgctgccaaatatcggtacaacagccgaggacctgaatagcctaagtgccctggcacagcagcgaaaaagtaagccacctaatgtgactgcctttgaggctaaatccacctccgatgaagccttctttaagcataagtgcaggttttgcgctaaagttttcgggagtgattcagccttgcagattcacttgaggagtcacacaggagaacgaccctttaaatgcaatatctgcggcaatcggttttctacaaagggaaacctcaaggtccacttccagcggcataaagaaaagtatccgcatattcagatgaacccctaccctgtgcctgagcacctggacaatatacccaccagcacagggataccctatggaatgtctatcccccctgagaagcctgtgacgtcttggttggacactaaaccagtgctgccaacgttgacaacatctgtaggccttcccctcccgccaaccctgccgagcttgatccccttcatcaagacagaggagcctgctcctatacctataagtcactccgccacgtctcctcctgggagcgtgaagtctgactcaggcggacctgagtccgccacacgcaacttgggtgggctacccgaagaagcagagggcagcaccctccccccaagtggagggaagagcgaagagagtggtatggtcacaaactcagtacctacagcctccagtagtgtcctgtccagcccggctgccgactgcggccctgccggttccgcaaccacctttactaatcctctgttgccacttatgtcggaacagttcaaagcgaagtttcctttcggcggactgttggatagtgcacaggcctccgaaacaagcaagctgcagcaattggtggagaatattgataaaaaagcaaccgatcctaatgagtgcattatttgccaccgtgtactgtcctgtcagtcggcactcaagatgcattaccggactcataccggcgagcggcctttcaagtgcaaaatttgcggcagagctttcacgacaaaaggaaacctcaaaacacattactctgtgcaccgcgctatgccacctctgagagtacaacactcttgtcccatttgtcagaagaagtttacaaatgccgttgtactccaacaacacatcaggatgcatatgggcggacaaatccctaatactcccgtaccggattcatattctgagagcatggagtctgacactggctcattcgacgagaagaacttcgacgatctggataactttagtgacgagaacatggaggattgccctgaggggagtatccccgacactccaaaatctgccgacgcttctcaggactccctgtcttcaagccctttacctctggagatgtcctctatcgccgcacttgaaaatcagatgaagatgattaacgccggtcttgctgagcagttgcaggcaagtctgaagtccgtggaaaatggaagcatagagggggatgtactgaccaatgactcatcttccgtcggcggagatatggagtcccagtccgccggttcccctgctatatcagagtcaacttcttcgatgcaggccctatctccatccaactctacgcaggagttccacaagagtccatctatcgaggaaaagccacagcgggcagtgccaagtgagtttgctaatggcctgtcccctactccagtgaatggaggagccctcgacctaacatcctctcacgccgaaaagatcatcaaagaagacagtctgggcatcttgttcccttttcgcgatcggggtaagttcaagaacaccgcttgcgacatttgtggcaaaacgttcgcctgccagagtgccctggacattcattaccgatcgcataccaaggagagaccgttcatctgtacggtgtgcaaccgcggattctccactaagggaaatctgaaacagcacatgctgactcaccaaatgcgggatctcccatcccagctttttgagccatccagcaacctggggccaaaccaaaatagcgctgttatacctgcaaactccctcagctccctcataaagacagaggtgaacggcttcgtgcatgtttctcctcaggactccaaggacacaccaacaagtcacgtgccgagcggtccactctcttcgagcgccacttctccagtgctgctgcccgcactgccacgccgaactcctaagcaacattactgcaacacttgtgggaagaccttctccagcagctctgccctgcaaatccatgagcgtactcacaccggggagaaaccattcgcatgtaccatctgtggaagggcatttacaactaaggggaacctgaaggtacacatggggacacatatgtggaatagcacgccagccaggcggggtcggcgtctgtcagtagatgggcctatgacgtttctcgggggtaaccctgtgaaattccccgagatgtttcagaaagacctcgctgctaggagcgggtcaggtgatccgagttccttctggaaccagtatgctgccgctctgagcaacggtctcgccatgaaagcgaatgaaatctcagttattcagaatggaggaattccacctattcccggatctctgggcagcggcaacagttctcctgtctccgggctgaccgggaaccttgagcggctacagaactccgaacctaatgcaccgctggctggcttggagaaaatggcctccagtgagaacggcacaaacttcagatttactagattcgtggaagacagtaaagagatagtgaccagctag

SEQ ID NO: 239587 - DNA, 3684 bp, Artificial Sequence
  Description of Artificial Sequence: Synthetic coding sequence
atgaacgacaccgttaataaaacggaccaggtggactgcagcgacctttcagaacacaacggactggaccgagaggaaagtatggaagtggaggccccagtcgctaataaatctggctctggcacttctagtgggtcgcattctagcaccgccccttcatcgagctcctcatcctcgtcatcttctgggggaggtgggtcatccagcactgggaccagcgcaattactacaagtcttccccagctcggggatctgacaaccttgggcaacttctcagtgattaacagcaacgtgataattgagaacctgcagtccaccaaagtggctgtggcccagttcagtcaggaggctcgctgtggtggtgctagtggaggtaagctggctgtgcccgcactgatggagcagctccttgcattgcagcagcaacagattcaccaactgcaactgatcgaacaaatccgacaccagatcctgctcctggcgtcacaaaacgcagatctgccaacatccagctcaccatcccaaggaaccctaagaacttcagccaatccactgtccacgctatcctcacacctgtctcaacagcttgcggcagcagctggcctggcacagtccctggcctctcagtctgccagcattagcggtgtcaagcaattaccaccaatccagctaccccagagtagtagcggcaacacaattattccatccaacagtgggagttcaccgaacatgaatatcctggcggctgctgttacaacaccaagctccgaaaaggtggcaagtagcgcaggtgccagtcacgtgagcaatcccgctgtttctagctcctcctctcccgcattcgctatctctagccttctgagcccggcatccaacccactgctcccccagcaggcatctgctaactctgtatttccatcccccttgcccaatatagggacaaccgccgaagacctgaatagtctgagcgccctggctcagcaaaggaagtctaagcctccgaacgttactgcttttgaagcgaaaagcaccagcgatgaagcattcttcaaacacaagtgccgattttgtgctaaggtgtttggttctgatagcgccttacagattcatttgaggagccacaccggtgaacgtcccttcaagtgtaatatttgcgggaacaggttctccaccaaggggaatcttaaggtgcactttcaaagacataaagaaaaatatccacacatacaaatgaatccttaccctgttcccgagcatctggacaatatacctacctctacaggcattccttatggcatgtctattccgcctgaaaaaccggtgacatcttggctggacactaagcctgtcctaccaaccctgactacctccgtggggctgccactcccgccaacactaccgagtctgatccctttcattaaaaccgaggaaccggctccaattcccatttctcattctgctacttctcctcccggatccgtaaagagcgactccggagggcctgaatctgctaccaggaacctaggaggcctgcccgaggaagcggaaggaagtactctgcctccaagtggtggcaaaagcgaggaatctggaatggttacgaattctgtccccactgcaagtagctcagttctgtctagccctgctgctgattgcggaccagcgggatcagctactactttcacaaaccctctactgcctcttatgtccgagcagttcaaggccaagttcccatttggaggactgctcgacagcgcccaggcatcagaaacctccaagctgcagcagctggtagaaaatatcgacaagaaagccaccgaccctaacgagtgtatcatttgtcaccgcgtgttgagctgccagagcgccctgaagatgcactaccgaacgcacactggggagcgaccatttaaatgtaaaatctgtggaagggcattcaccactaaaggcaacttgaagacccactacagtgtgcatcgcgctatgcccccactccgggtgcagcacagctgtcctatttgtcagaaaaagttcaccaatgcagtggtccttcagcaacacataagaatgcacatgggtgggcagattccaaacaccccggttccggattcctattctgagagcatggagtccgataccggttcgttcgatgagaagaattttgacgatctggacaatttctcagacgaaaacatggaggactgcccagagggctccatccctgatacgcccaaatccgcagacgcttcacaagactcattatcctcaagtcccctccctcttgagatgtcctctattgctgctttggaaaatcagatgaaaatgatcaacgccggacttgccgaacaactgcaggcttccctgaaaagcgtggaaaacggaagtatagaaggagatgtactgactaacgacagttcttctgtcgggggagatatggaatctcagtctgccggttctccagccatttcagagagcactagcagcatgcaagcgctttctcccagtaacagcacccaggagttccacaaatctccaagcatcgaggagaagccacagcgggctgttccgtcagagttcgccaatggcctatctcctacacccgtgaatgggggagctctcgacctcacatccagtcacgctgagaaaatcattaaggaagatagtcttggaatcctttttccctttcgcgaccgaggaaaatttaaaaacactgcttgtgatatctgcggaaagacctttgcctgtcagagcgcgctagacattcactacaggagtcacaccaaagagcggccattcatttgcaccgtttgcaacagaggcttctcgacaaaaggcaacttaaagcaacatatgctcactcaccagatgagggatctaccatctcagctatttgaaccctcttccaatctaggcccaaaccagaattcagctgtgatcccagccaacagtctgtcttccttgataaagactgaagtgaacggattcgttcacgtctctccccaggatagcaaagacactccgacatcacatgtaccttccggacctctgtctagcagtgcaacatcccccgttctcctccctgcactaccgcgaagaacaccgaagcaacattactgtaacacttgtggaaagacgtttagctcgagttctgctctccagatccatgagcgcactcataccggagaaaaaccctttgcctgcacaatctgcggcagggccttcacgacaaagggaaatttgaaggtccacatgggtacccacatgtggaattccaccccagcgagacgaggacgcagactctctgtggacggtccaatgacatttctcggcggaaaccccgtaaagtttccagaaatgtttcaaaaggatctggctgcacgaagcggctccggggacccgtcgtctttctggaaccagtacgccgcagctctgtcgaacggcctggccatgaaggctaacgaaatcagtgtcatccagaatggaggaatacctcctatccctggatctctgggcagcggtaattcttcccctgttagtggactcaccggaaatctggaacggctccagaattccgaacctaacgctccgctcgcgggtttggaaaaaatggcttcctccgagaatggaaccaattttcgtttcaccaggttcgtggaggatagtaaagagatagttacttcctag

SEQ ID NO: 239588 - DNA, 3867 bp, Artificial Sequence
  Description of Artificial Sequence: Synthetic coding sequence
atgtcccggaggaagcaggcgaagccacagcacttccagagcgatccagaggtagcctcgttaccccgtagagacggagatacagagaagggacagcctagccgacctaccaagagcaaagacgctcacgtgtgcgggcgttgctgtgccgaattttttgagttatctgatctgctactgcacaaaaagaactgtacaaaaaaccagcttgtgctgattgttaatgagaaccccgcaagtccccctgagacgttctctccctccccaccccctgataatcccgatgagcagatgaatgacaccgtcaataagacgggttcccactcatctaccgcccctagcagttcctctagttcaagcagcagttccggcggtggcggaagttcctcaactgggacgtctgctatcaccacctcccttccccaacttggtgatctaacgactctgggcaacttttcagtaatcaactcgaacgtcatcattgaaaatcttcagtccactaaggtcgctgtggctcaattttcccaggaggccagatgtggaggagcctctggcggtaaactcgcagtacccgcactgatggagcagctgcttgctctacagcagcagcagatccatcagttgcagctgattgagcagatcagacaccagatcttgcttctggcaagccagaacgccgacctccccacctctagctccccctcacagggtaccctacgaacatcagctaatcccttatccaccctgtcaagccatctgagccagcagctcgcggctgccgcaggtctggcccagtctttggcatctcagtctgcctctatatctggcgttaaacagctgcccccaattcagctacctcagtcgtcctctgggaacacaatcattcctagcaatagcggtagctccccaaatatgaatattctcgcggcagctgtgactaccccgtcatctgaaaaagtcgccagtagcgccggagcaagccatgtctccaatccagcagtgtcatcttcctcaagtccagcgttcgctattagcagtttgctgagtccggcttccaacccgctgctacctcaacaggccagcgctaacagcgtgttcccttccccattgccgaacatcggcaccactgcagaagacctgaacagtctgtccgccctggcacagcagcggaagagcaaacctccaaacgtcacagcattcgaagcgaaatcgacgtctgatgaagccttcttcaagcacaaatgcagattctgtgccaaggtctttggtagcgactcagccctgcagatccacctgcgcagccacaccggcgaaaggccttttaagtgcaacatttgtggtaaccgctttagtaccaaaggcaatctcaaagtgcatttccagagacataaagaaaagtatccccacattcagatgaatccgtaccccgtacccgaacaccttgacaatatcccaacatctactgggatcccctatgggatgtctatccccccagagaagcccgtgacttcttggcttgatacgaagcccgtcctgcccaccctgaccacctctgttggactgcctctgccgccaactcttcctagcttaatcccttttataaagaccgaagagcctgcccctattcccatcagccactccgccacaagcccacccggatctgtgaaatctgattcaggaggaccagagagcgcgacacggaacctgggaggcctgcccgaagaagcagagggaagtaccctgcccccaagcggcggaaagagcgaggagtcaggtatggtgacaaacagcgtgcccaccgcatcgtcctccgtgcttagtagtcccgctgccgactgcggtccagccggtagcgctactacgttcaccaaccctctcctgcccctgatgtctgaacagttcaaggcgaagttcccattcggaggactcttggattcagctcaggcgtctgaaacctcaaagctgcagcagcttgttgagaatatagacaagaaggccacagatcctaatgagtgcatcatttgtcatagggtcctctcttgccaatccgccttgaagatgcactacagaacacataccggtgaacgcccatttaagtgcaaaatctgtggacgggcttttactaccaagggcaatctcaagactcactactccgtgcacagggcaatgccacccctcagagtgcagcatagttgtcctatctgtcagaagaaatttaccaatgctgtggtcttacaacaacacattcgaatgcatatggggggtcaaattcccaatactcccgtccccgactcctactcagaatcgatggagtccgatactgggagcttcgatgaaaagaattttgatgacctggataacttcagcgacgagaacatggaagactgtcccgagggctcaattcctgacacacccaaatctgcggacgctagtcaggatagcttgtcctcctcccccctgccactcgaaatgtcaagtatcgcagctctggagaaccaaatgaagatgattaacgctggccttgcagaacagctacaggctagcctcaagagtgtggagaacgggtccattgaaggtgatgtcctgacaaacgactcttcttccgttgggggagatatggaatctcagtccgctgggtcacccgctatcagcgaaagtaccagcagtatgcaagcactcagccctagtaacagcacgcaagagttccacaaatctccgagcattgaagagaagccccagcgcgctgtgccgagtgaattcgcaaatggcctgagcccgaccccggtgaatggtggtgccttggacctgaccagctctcatgctgagaagataatcaaagaggattcacttgggatactatttccttttagggacagaggaaaatttaagaatacagcctgcgacatctgtggaaagactttcgcgtgtcaaagcgccctggatattcactatcggtcccatactaaggagagaccttttatatgtactgtatgcaatcggggattttcgacaaaaggcaatctgaaacagcacatgctgacccatcagatgagagatctccccagtcagctgtttgaaccgagtagcaatctgggacctaatcagaatagcgcagttatccctgcaaattcactgtcctctctgatcaagaccgaagtcaatggatttgtgcatgtgtcgccccaggattccaaagatactccaacatctcacgtaccctcaggcccattgtcttcttctgcaactagccccgttctcctgccggcactaccaaggagaacacccaagcaacattactgcaacacctgcggtaaaacctttagctcctcctctgctcttcagatccacgaacgtactcacactggtgaaaagcctttcgcatgtaccatctgcggcagggcattcacaacaaaaggcaatctcaaagtgcacatgggcacgcatatgtggaatagtacccccgctaggagaggtaggagattgtctgtagacggcccaatgacgtttttgggcggaaatccagtgaaattccccgagatgtttcaaaaggacctagccgctcgaagtggctccggggacccttcatctttttggaaccaatatgctgcagccctcagtaatggcctggccatgaaggcgaatgagatctcagtcattcagaacgggggaattcctccgattcccggatctctggggtcaggtaactcctcccctgtctctggcttgactgggaatctcgaacgcctgcagaattcggagccaaacgccccactcgcaggacttgagaagatggcttcttccgagaatggaactaattttcgttttactagattcgtggaggactccaaggaaattgttacctcctag

SEQ ID NO: 239589 - DNA, 444 bp, Artificial Sequence
  Description of Artificial Sequence: Synthetic coding sequence
atggttcacatgggcacgcacatgtggaacagtacccctgccaggagaggccgaagactgtccgtagatggaccaatgacattcttgggcggtaatccggttaagtttccagagatgttccagaaagacctggccgcacgaagtggcagcggggatcctagttcattttggaaccagtatgccgctgccttaagtaatggtttggccatgaaagcaaatgaaataagcgtcatacagaatgggggaattcccccaatacctggctctctcggatcaggcaacagtagtcccgtatcaggcctaactggcaatctggaacggctccaaaattcggagcccaacgcgccattggccggtcttgaaaagatggcctccagcgagaatggcaccaactttaggtttacgagatttgtcgaggacagcaaagagatagtgacttcatag

SEQ ID NO: 239590 - DNA, 3024 bp, Artificial Sequence
  Description of Artificial Sequence: Synthetic coding sequence
atgagtcggcgtaaacagcgaaagcctcagcagctcatctcagactgcgagggaccttcagccagcgagaatggcgacgcttccgaagaagaccatccacaggtgtgcgcaaagtgttgtgctcagtttaccgaccctaccgaatttctggcgcatcagaacgcctgctcaaccgaccctccggtcatggtgatcattggaggacaggagaacccgaacaactccagtgcctcaagtgagccccgaccggagggccacaataatcctcaggttatggacaccgaacacagcaatcccccagacagtggcagctctgtgcctactgacccaacttggggccctgagagaaggggcgaggaatccccgggacactttctggtggccgctaccgggacagctgccggaggcggagggggattaatactggcaagtcctaagctcggggctactcccctgccccctgaatctaccccagctccacctccacccccacctcctccccctccaccgggagtgggcagcggccacctgaatattcccctaatcctagaggagctgagggtattacagcagagacagatccaccagatgcagatgactgaacagatttgccgccaagtactgcttctgggcagtctcggccaaacggttggcgcacctgcttccccatcggaactccccggtaccggcactgcatcgagcacaaaaccactgttgcccctcttttcaccgatcaagcccgttcagacctctaaaacactcgcatcatcctcttccagttccagctcctcttctggcgctgaaacccccaaacaggctttctttcacctgtatcatcccctaggatcccaacacccattctccgctggaggtgttggcagatcccacaaacccactcccgcaccatccccagccctacccggtagcactgaccagctcatcgcgagcccacacctcgcttttcccagtactacggggctcctggccgctcaatgtctgggggctgcacggggtctggaggctaccgccagccccggactcctcaaaccaaaaaacggttcaggcgaattgtcatacggggaagttatgggccctctggaaaagccaggcggacgccacaagtgccggttttgtgctaaagtctttgggtctgatagtgctctgcagatacatctgcgctctcacaccggcgaacggccttataaatgtaatgtatgcggcaaccgatttactacccgaggtaatcttaaagtgcattttcaccggcaccgagagaagtacccacatgtgcagatgaatccccatcccgtgccagagcacctggattacgtgattacaagtagtggtctcccctacggcatgtctgtgcccccagaaaaggcagaagaggaggcggcaaccccaggaggtggagttgagcgaaagcccctcgtggccagcactacggccctgagcgccactgagtctctgactctgttatcaacctcggccggaacagctaccgcccctggtctcccagcttttaataaatttgttcttatgaaagccgtggagcctaaaaataaagccgacgagaacacacccccagggtcagagggttctgctatttctggagtggctgagtctagcacagcgaccaggatgcaactgtcgaaactggtaacatctttgccttcgtgggccctactcactaatcattttaagtccacaggaagcttcccctttccttatgtcctggagcctctaggagccagcccttctgagacctcaaaactacagcaactcgtagagaaaatcgacagacagggggcagtggccgtgacctccgccgcatctggcgcaccaaccactagcgccccagcacctagcagcagcgccagctcaggaccaaatcagtgcgtgatctgcctccgcgtactgtcatgtccgagagcgttgcgacttcactatggccaacacggcggagagagacctttcaaatgtaaagtatgtgggcgtgcgtttagtactaggggcaatctgcgtgcccacttcgtgggtcataaggccagccctgccgcacgtgcgcagaactcctgccccatatgccagaagaaattcaccaatgcagtcacattgcagcaacacgtgcgaatgcacctgggcggtcagattccgaatgggggaactgctctgccagaagggggaggagcagctcaggagaatggaagcgaacagagtacggtttcaggcgctggaagcttccctcagcaacagagtcagcagccgtctcccgaggaagaactctctgaagaagaggaagaggaagatgaagaagaagaagaggatgtcactgatgaagactccctcgctggcaggggtagcgagtcaggaggcgaaaaggccatctcggtgcgtggggacagcgaggaggcatctggggcagaggaagaagtagggaccgtggccgcagctgccaccgcaggtaaggagatggactctaatgaaaagaccacgcagcaatcttcgctgcctccaccccctccaccagattccctagatcagccccaaccaatggagcagggtagctcaggagtgctcggcggaaaggaagaaggcggaaaaccagagcggtcaagcagtccggcaagcgctctaacacccgagggggaagctacttccgttactctggtggaagaactatctttacaggaggcaatgcgaaaggaaccaggcgagtcaagctctaggaaagcttgtgaagtgtgtggccaggcgttcccctctcaggctgccttggaggagcaccagaagacacacccaaaggaggggccactgttcacatgtgttttctgccgacaagggttcttagaacgggctactctgaagaagcatatgctccttgcccatcaccaagtgcaaccttttgccccacatggccctcagaacattgccgctctgagcctcgtgcccggatgtagccctagcatcacctccactggtttgtctccatttcctaggaaagatgatcccactattccatag

SEQ ID NO: 239591 - DNA, 1827 bp, Artificial Sequence
  Description of Artificial Sequence: Synthetic coding sequence
atgagccgccgtaaacagcggaagccacagcagctgatctcggattgtgaagggccatcagcttccgaaaatggggatgccagtgaagaggatcacccgcaggtttgcgccaagtgttgcgcccagttcacggacccaaccgagtttctggcccaccagaatgcctgtagtaccgatcctcctgtaatggttatcatcgggggacaagagaaccccaacaattcctccgctagttcagagcctcggcctgagggccacaataaccctcaggtgatggataccgaacacagtaacccccctgattcaggctcctccgtgcccacagacccgacatggggccctgaaaggcggggtgaagaatctcccggacacttcttagtggccgctaccggaacagccgctgggggaggcggaggactgatactagcctctcccaagctcggcgctacaccactgccgccagagtccaccccggctccaccacctcctccgcctcccccaccaccacccggagtgggctctgggcacctgaatattccgttgatcctcgaagaactgagagtgctgcaacagcgccagattcaccagatgcagatgacagagcaaatctgcaggcaggttcttctactgggttctctgggccagaccgtgggcgctcccgcaagcccttcggaattgcccggaactggaacagcttcttcaactaagcctctgctgcccctattctcacctatcaaacctgttcagacctctaagactctcgccagcagttccagctcaagcagttcctctagtggtgcagagacacccaagcaggcctttttccatctttatcatcctctcgggtcccagcatccgttttccgcaggaggcgtggggagatctcataagcccactccagccccaagtcctgcattgccgggttctaccgaccagctaatcgccagcccccatctcgcgttccccagtaccactggactcctagcagctcagtgtctgggagcagccagaggtctcgaggccactgctagtcccggtcttctaaaaccaaaaaatggaagtggtgaactgtcttatggcgaggtgatgggaccactcgagaaacccggaggccgtcataagtgccggttctgtgcgaaggtgtttggttccgattctgccctccagatccacctgcggtctcacaccggggagaggccctacaagtgcaacgtctgtggtaatcgattcaccacacgtggcaatttaaaggtgcacttccacaggcatagggaaaaatacccacacgtgcagatgaacccacaccccgtgcctgaacacctggattacgtgataacgtcctctgggctcccatacggcatgtctgttcccccagaaaaggcggaggaagaggctgctacccccggaggcggtgtcgagcggaagcctttagtggcgtccaccactgccctttccgctacagagtccctcacccttctctccacaagtgctggcacagccaccgccccaggcctgcctgctttcaataaatttgtactgatgaaagccgttgagcctaaaaataaggccgatgaaaatactccaccaggaagcgagggatcggcaatttccggggtcgccgagtccagcacggctaccagaatgcaactttccaaactggttaccagcctgccttcctgggccctgctgaccaaccactttaagtccacgggcagtttcccatttccttacgtccccgaagaagttcatcagtgttgtcactctgccgctgcttgtccagacgcgcctggcggaccagacccgcaacggtggtactgcacaccatag

SEQ ID NO: 239592 - DNA, 3687 bp, Artificial Sequence
  Description of Artificial Sequence: Synthetic coding sequence
atgtcacgaaggaagcaggctaagccgcaacacctgaagagcgacgaggagctgctaccacccgatggcgcacctgagcacgccgctcctggagaaggagccgaggacgcagacagtgggccagagtccaggtcaggcggtgaagagactagcgtttgtgaaaaatgttgtgcagaattctttaaatgggcagacttcttggaacatcagagaagttgcactaagctgcctcccgtgctgatcgttcatgaggatgctcccgctcctcccccagaggactttcccgaacctagtccagccagttcacccagtgaacgcgctgaaagcgaagccgcagaggaggctggcgctgagggagcagaaggtgaggctaggccggtggaaaaagaggctgagccaatggacgcagaaccagctggggacactcgggctccgaggccgccacctgcagcccctgctccgccaacaccagcctatggggcaccatccactaacgtcacactggaagccctgttatccaccaaggttgcagtggcccaatttagccagggagcacgcgcagcaggaggttcaggtgccggaggtggcgttgcagccgcagcggttccactgatccttgaacagctgatggctctgcaacaacagcagatccatcagctacagctgatagaacaaatccgctcgcaggtagctttaatgcaaagacctccgcctagaccttcgctgtctccagccgcagccccttccgcgccaggtccggctccctctcaattacccggactagccgcactcccgttgtctgccggagcacctgcggctgccatcgcgggttccggtccagcagctcctgccgcattcgagggagcccagcccctgtctcggccagagtcaggagcgtcaactccgggagggcctgcagagcctagcgcgcctgccgcaccatccgccgctcctgctcctgccgcacccgcacctgccccagctcctcagtcggccgcttctagtcagccacaatccgccagcacaccacccgcactcgctccaggcagccttttaggcgctgcccctggtctgccaagtccactgttaccccagacctctgctagcggagttatcttcccaaatccactagtcagcattgcagctacggcaaatgccctcgatcccctgtctgcactgatgaaacaccggaagggcaagcctcccaacgtcagcgtgtttgagcccaaagcttcggcggaagacccattcttcaagcacaagtgtaggttctgtgctaaggtgtttggaagcgattctgcgcttcaaattcacctcaggagccatactggggaaagaccctttaagtgtaatatatgcgggaaccgcttttcgaccaaagggaacttaaaggtacatttccaacgacataaggaaaagtatccccacattcagatgaatccctatccggtacccgaatatctggacaatgtccctacctgtagtggcatcccctacggcatgagccttccgccagaaaagcccgtgacgacttggctggactccaagccagttctgccaaccgtgccgaccagtgtcggactgcagttgcccccaactgtcccaggtgcccacgggtacgcagattcaccatctgccactccagcctcaaggtccccccaaaggccatctcctgccagctcggaatgcgcttccctttcaccgggattaaatcatgtcgaatcaggtgtgtcagcaaccgcggaaagcccccagagtctgctggggggacccccactgaccaaggccgagccagtgagcctgccttgtacaaacgcaagagccggtgacgccccagtgggagcacaggcctcagcggctccgacaagcgtggacggcgcaccaacttctctgggaagcccgggattgccagctgtctccgagcagtttaaagcccagttcccttttggtggtcttttggattcgatgcagacatctgagacttccaaactccagcagctcgtggaaaatatagacaaaaaaatgaccgaccccaatcagtgcgtgatctgccatcgggtactgagctgccagagcgctctaaaaatgcactaccgcactcacacaggcgaaaggcccttcaagtgtaagatatgcggccgagcctttactactaaagggaacctaaaaacacacttcggagtacatcgcgctaaaccgcctcttcgggtgcagcactcttgtccgatttgtcagaagaagttcaccaacgctgttgtgcttcagcagcacattaggatgcacatggggggtcagataccaaacactcctcttccagagggattccaggatgcaatggatagcgaactggcgtatgacgataagaatgccgagactctatcatcctatgatgacgatatggacgaaaactccatggaggacgatgccgaactgaaggatgctgccaccgaccctgccaagccccttctcagctatgccggttcttgtcctccctctcccccttcagttatctcctctatagccgctctcgaaaatcagatgaaaatgatcgattctgtgatgagctgtcagcagctgactgggctgaagtctgtggagaatgggagcggcgagagtgaccgcttgtccaatgattctagttccgccgtcggtgacctcgaatctcgttctgctggctcaccagctttgagtgaatcctcttcatcacaagcactgagcccagcaccttcgaatggcgaaagtttccgctctaaatctcccggtttaggtgcacccgaagagcctcaggagatcccactgaaaacagagcggccagatagccctgctgctgcaccaggcagtggcggagccccaggcagggccggaatcaaggaagaggcccctttttccttactgtttttgtccagagaaagaggcccttcacagagcacaccatctcttatttcgagcgccgcacctactatgatcaagatggaagttaacggccatggtaaagctatggcacttggggagggccctcccctcccagcaggggtacaagtaccagccggaccacagacagtgatgggacccggtcttgccccaatgctagctccaccacctcgcaggactcctaaacagcacaattgtcagtcctgcggaaagaccttctcctcagcatcagcactccagatacacgagcgaacacacacaggcgagaagccttttggctgtaccatctgcggccgagcttttacaaccaagggtaatctgaaggtgcacatgggcacccacatgtggaataatgccccagcccgtcgcggaaggaggctgagcgtcgaaaaccctatggctttactgggcggtgacgccctgaaattttctgagatgttccaaaaggatctggccgctagagctatgaatgtggatccgtcattctggaatcagtacgccgctgcaatcaccaatggcctagcaatgaagaacaatgaaatctcggtgatccagaacggaggcattcctcagctgcctgtttcgttaggcggtagtgccctcccaccactggggagtatggcctccggcatggacaaggctcgtaccggaagttctccaccaatcgtgtccctggataaagcgtcaagtgagactgccgcttccaggccattcacccgattcattgaagacaataaagagattggcatcaattag

SEQ ID NO: 239593 - DNA, 3903 bp, Artificial Sequence
  Description of Artificial Sequence: Synthetic coding sequence
atgtcacgccgtaagcaggccaaaccacagcaccttaaatccgatgaggagttattaccaccagatggagcgccagagcatgcagctccgggtgagggggcagaggacgctgactctggacccgagtcccggtctggcggtgaagagacctccgtttgcgagaaatgttgcgctgaattcttcaaatgggcagacttcttggaacaccaaaggagctgtacgaagctgccccctgtccttatagtgcatgaagatgccccagctccccctcccgaagacttcccagagccctctcccgcttcttctcctagcgagagagcagaaagcgaggcggcagaggaagccggtgctgagggcgctgaaggcgaggcacgcccagttgagaaggaggcagaacctatggacgcagagccagctggcgacacaagagcacctaggcctcccccagcggcacccgctcccccaacacccgcatatggtgccccatccaccaacgtcaccctggaggccttactgagcacaaaagtggcggtcgcccaattttcccagggggctagagccgctggcggttctggcgctgggggaggcgtggccgctgccgcagtgccattgatactggagcaactcatggccctacagcagcagcaaattcatcagttgcagcttattgagcagatccggtcacaggtggccctgatgcagagaccaccaccaaggccatcactgtcaccggctgccgctccttcggcacctggtccagcaccaagtcagcttccaggattggccgctcttcccctaagtgctggcgctccagccgcagctatcgcgggatcaggcccagccgctccagccgctttcgagggagctcagcctttatcacgccctgagtcgggtgctagcacacctgggggacctgccgagccctccgcacctgctgccccatcagctgcccctgcccctgccgctcccgctcctgctccagcaccacaatcagctgctagcagccaaccacagagcgcctctacccccccagccttagcacctggttccctcctcggagccgcaccgggtttgccgtcgccacttttgccccaaacatctgcatccggggtgatcttccctaatccacttgtttcgattgcagccacagcgaatgctttagacccgctgtctgccctgatgaagcacagaaagggtaaacccccaaacgttagcgtgttcgaacccaaggcatctgccgaagatccttttttcaaacacaagtgtcgtttttgcgcaaaagtattcggatctgactccgctttgcagatccacctcagaagccataccggggagcggccatttaaatgtaatatctgcggaaaccgcttttcaacaaagggcaatcttaaagtgcatttccagcggcacaaggagaagtatccacatatacagatgaacccttatcctgtgccagaatatctcgataacgtgccaacctgtagtggtatcccctatggaatgtcactgcccccagagaagcctgttaccacgtggctggatagcaagccagtactgccaactgtcccaacatccgttgggctacagcttccaccaactgtcccaggggcacatggatatgcggactcacccagtgccacacctgcctcccgtagccctcaacgacctagcccggcttcaagtgaatgtgcttcactgagcccgggacttaaccacgtggaatccggggtgagcgccacggcggaatcccctcagtctctgttgggtggacctcccctgaccaaagccgaaccagtgtcccttccttgcactaacgccagagccggtgatgccccagtaggagcccaagcgtcagccgcaccgacttccgtggacggagcccctacctcgttaggcagccctggcctgcccgcagtgtcagaacagtttaaagcccagttccccttcggcggtcttctggacagcatgcagaccagtgaaacatctaagctacaacagcttgttgagaatattgataagaaaatgaccgacccaaatcagtgcgtgatctgccatcgagtcttgtcttgtcaatctgccctcaagatgcattaccgcacacatacaggcgaaagaccctttaaatgcaagatctgtgggagggcttttactaccaaagggaatttgaagacccacttcggagtgcacagagcgaagccacctctcagagttcagcactcctgtcccatatgccagaagaaatttactaatgctgtggtgttacagcagcacatccggatgcacatgggtgggcagattcccaacaccccattacccgaggggttccaagatgctatggatagcgaactcgcgtacgatgataaaaatgccgagacgctctcttcgtatgacgacgacatggatgagaacagcatggaggacgacgctgagctgaaggacgccgctaccgaccctgctaaacccctgctctcttacgccggttcatgtcccccttctccgcctagtgtgatctcgagcattgcggctctggaaaatcaaatgaagatgatcgacagtgtgatgagctgccaacagttaacagggctgaaatccgtggagaacggatctggcgagtccgacagattgagcaatgacagttccagcgcagtgggtgatctggaatctcgttccgctgggagcccagcactgtcggagtcaagtagcagccaagccctcagccctgctccttccaatggggagtcttttcgctctaaatctcccggactgggtgcaccagaggaaccccaggagattcctctaaagacagagcggcctgactcccccgcagcggcacctggctcggggggtgcccctggacgggcaggcattaaggaagaggccccatttagcctactattcctatcacgcgagcgaggcaagtgcccgtctactgtctgtggagtctgcgggaagccgtttgcttgtaaatcagcgcttgagatccattacagatctcacaccaaggagcggcctttcgtgtgtgcgctgtgcagacgcggatgctcaacaatgggcaatctcaaacaacacctcctgacccaccgtctaaaggagctgccgagccagctctttgacccgaacttcgccctgggtccatctcaatctaccccatccctcatcagcagtgccgctcctacgatgatcaagatggaagttaatggtcatggcaaggccatggcactgggcgagggtcctcccctccctgcgggtgttcaggtacctgccggtccccaaactgttatgggacccggtctagccccaatgttggcccctcctcccaggcggacccctaaacagcataattgtcagtcctgtgggaaaacattttcttctgctagcgcattgcagattcacgagagaacacacactggggaaaaaccattcggatgcacaatctgtggcagggcttttactactaaggggaacctgaaggtgcatatggggacacatatgtggaataacgccccagccaggagaggcagacggctgagcgtggaaaatcccatggcgcttctgggcggtgacgccctaaagttctcggaaatgtttcaaaaagacctggccgctagagcgatgaatgtcgatccgtcattttggaatcagtacgcagctgccatcactaacgggctggcaatgaaaaacaacgagatctcagtaattcagaatggcggtataccacaactgcctgtttccttggggggttcagcactcccaccactagggtccatggcttctgggatggataaggcacgtactggctcaagccccccaattgtatcgctggacaaggccagcagcgagacagccgctagtaggccgtttacgagattcatagaggataacaaggagattggtataaactag

SEQ ID NO: 239594 - DNA, 2883 bp, Artificial Sequence
  Description of Artificial Sequence: Synthetic coding sequence
atgtcccgtcggaaacaggcaaaaccacagcatctcaagtcggacgaggagctgctccccccagatggtgcccctgagcacgccgctcctggtgaaggggctgaggacgccgattctggcccagagtcacgctcagggggagaggaaactagtgtatgcgaaaagtgttgcgccgagttttttaaatgggcggatttcctggaacaccaacgctcctgtaccaaactgccacctgtactgattgtgcacgaggatgccccacctggtttgccatcaccactgctcccgcagacaagcgcgagtggcgtgatttttcctaaccctctggtttctatcgctgcgaccgcaaacgctttagatcctctctctgccttgatgaagcacagaaagggaaagccgcctaacgtcagtgtgtttgagccaaaagcgagcgccgaggaccccttcttcaagcataaatgtagattttgtgctaaagtgtttggctccgattctgccctgcagatccacctgcgcagtcacaccggagagcggcctttcaaatgcaacatctgtggaaatcgattctcaacgaaaggcaatctcaaagtgcattttcagaggcacaaagaaaaatatcctcatatacagatgaacccatatccggtccctgagtacctggacaacgtcccaacttgctccggcattccatacggtatgtcccttccacctgagaagccagtgacaacgtggctggattcgaaacctgtgctgcccaccgttcctacgtccgtcggcctccagctcccaccgactgtgcctggagcacacgggtacgctgactccccatccgcaacgccagccagccggtcccctcagaggccctctcccgcttccagcgaatgcgccagtttatccccaggactcaaccatgtcgagtccggagtcagcgccactgcagagtcacctcagagtctgctcggcggacccccactgaccaaggcggaacccgtaagtttaccttgtacgaacgccagggccggagatgccccagtcggcgctcaggcttccgctgctcctacctcagtggatggcgctcctacctctctgggcagccccggtctgcccgctgtgtccgagcagttcaaagcccagtttcccttcgggggtctgctcgattccatgcagacgtctgaaactagtaaacttcagcaattggtcgaaaacatagataaaaaaatgacggatcctaaccagtgcgtaatctgccacagggtgctgtcttgtcaaagtgctctgaagatgcactaccggacccatacaggcgagagaccgtttaagtgtaagatttgtggtagagcctttactacaaaggggaacctaaaaacgcatttcggagtacacagagctaagccacccctgcgagtgcagcacagttgccccatttgccagaagaagttcacaaatgccgtggttctgcagcaacacatacgcatgcacatgggcggacagattccaaacacccccctacccgaagggtttcaggacgcgatggatagtgagctcgcctacgacgacaagaacgccgaaacactctcctcctatgatgacgatatggacgagaattctatggaggatgacgccgaattgaaagacgctgccaccgatcctgccaagccattactcagctacgctgggagttgtcctccgtccccaccaagtgtcatctcctcgatcgcagctctggagaaccagatgaagatgatcgacagtgtgatgtcttgtcaacagctgaccggcctgaaaagcgtggagaatggaagtggcgagtctgacaggctgagtaatgactcttcatcagcggtgggggacctagaatcaaggtcggccggaagccctgccttatccgagagctccagtagtcaagctttgtccccagccccaagcaatggcgagagcttccggagtaagtcccccggactaggagcgcctgaagagccccaggagataccgctgaagacagaacggccagacagccctgccgcagctcctggttcaggtggagcgcctggacgtgctgggatcaaagaggaggcacctttcagtctgctcttcttgagcagagagagaggaccctctcagtctaccccctcactgatttcaagcgccgcaccgactatgatcaagatggaggtaaatggccatggtaaggccatggccttgggcgaggggccaccactgcctgctggggttcaggtacccgctggaccgcagaccgtgatgggacctgggctagcgcctatgctcgcccctccccctcgtcgaactccaaaacagcacaactgtcagtcctgtggtaaaacattctcctccgcgtccgccttgcagattcacgagcggacacatacgggcgagaagccatttggctgtacgatctgcgggcgtgcctttacgacaaagggtaacttaaaagtccatatgggcacacacatgtggaataacgctcctgcacgacgcggacggcgactttcagtggaaaatcccatggcgttacttggaggagatgctctcaaattttctgaaatgttccagaaggacctggcagccagggcaatgaacgtggacccatctttctggaatcagtatgccgcagctattaccaacgggttagctatgaagaataatgagatttcggtcatccagaacggaggtatccctcaattacctgttagcctagggggatctgcccttccaccattaggctctatggcctcaggaatggacaaagcccgaaccggcagctcacctccaattgtgtctctagataaagcctcatccgagacggctgctagccggccattcacgaggttcattgaggataataaggaaattggcatcaactag

SEQ ID NO: 239595 - DNA, 516 bp, Artificial Sequence
  Description of Artificial Sequence: Synthetic coding sequence
atggtgagacctcccgttgtccccaggagaccaccggcacacatctcttctgtccgtcaggcctctacccaggtcccacggaccgtgccccatacccaacgggttgcaaacataggaacgcagactaccggcccttctggcgtaggctgttgcacccctggacgtcccctattgccatgcaaatgcagttcagcagcacactccacttaccgggtgcaggagcctgctgtgcacatcccaggccaggaaccgctgacagccagcatgctcgctgcggcaccactgcatgagcaaaaacagatgatcggcgagcggctttaccccctgatccacgatgtgcatacacagctggccggaaagataacaggcatgctcctagagatcgataattccgagttgctgcttatgctcgagtctcccgagtccctgcatgctaagaagcgcaagagctcacttccctggctgccgaagggtcagtgtttctggctgtctgccctgaggccgtgcaaactgtag

SEQ ID NO: 239596 - DNA, 831 bp, Artificial Sequence
  Description of Artificial Sequence: Synthetic coding sequence
atgagccgccgtaagcaggccaaacctcaacacatcaactctgaggaggatcagggtgaacaacaaccccagcagcagacaccagagttcgccgatgctgcacctgccgcaccagccgctggagagctgggccgtagtagcttgccatctacatttatccgggctccaccaacctatgtgaaagttgaagtgcctgggacattcgtgggcccaagcacactgtctcccggaatgaccccattattggccgctcagcccagaagacaggctaagcagcatggctgtactagatgtggcaagaattttagctccgcctctgctctacagattcacgaaagaactcatacaggcgagaagccttttgtctgcaatatctgtggcagagcatttacaactaaggggaatctgaaggtacactatatgacgcacggggcaaataataactctgccaggcggggacgcaagctcgccatagagaataccatggcgctgctcgggacagacggtaaaagagtatctgagattttccctaaggaaatcttggcgccttccgtgaacgtagaccccgtcgtctggaaccaatacactagcatgttaaacggcggtttagctgtgaaaactaatgaaattagcgtcatacagtccggaggcgtgccgacgctgccggtgagcctcggcgctaccagtgttgtgaataatgctacagttagtaagatggacggctcacagtctggtatctctgccgacgtggaaaagccgtcagccacagacggcgtacccaagcaccaattcccacatttcctcgaagagaacaagatcgcagtgagctag

SEQ ID NO: 239597 - DNA, 1851 bp, Artificial Sequence
  Description of Artificial Sequence: Synthetic coding sequence
atgagcagaaggaagcaggcgaaaccccaacacataaactcggaggaggaccagggggagcagcaacctcagcagcagacccccgaatttgccgacgctgccccagcagctccagccgctggcgaactgggcgctcccgttaatcaccccggtaacgacgaggtggcatccgaggatgaagcaactgtcaagcgcctgcggcgtgaggagacacacgtttgtgaaaaatgctgcgcggaatttttttcaatttctgagttcctcgagcataaaaagaattgcaccaagaatccgcctgtgctgatcatgaacgactccgaggggcctgttccctccgaggatttctcaggcgcagtgctctctcaccaaccgaccagccctggatcaaaggactgccatagggagaacggcggtagcagtgaggatatgaaggaaaagccagatgcagagtcagtggtctacctcaaaaccgagaccgctctacctccaaccccccaagatatctcgtatttagcaaaaggcaaggtggcaaacacgaacgttacattgcaggctctccgcggtacaaaggtggccgtaaaccagcggagcgcagacgccttaccagccccagttcctggagctaactctatcccttgggtgctcgaacagatcctgtgtctacagcaacaacagttgcagcagatccagcttacggaacagatccggatacaggtgaacatgtgggccagccacgctttgcattcatcaggcgctggcgcagatacactcaagaccctggggtcacacatgagccagcaggtgagcgcggctgtggcgttgttgtctcaaaaggctggatctcaaggactgagcctagacgcccttaagcaggccaagctgcctcatgctaacattccaagcgccacctcatctctaagccctggactagcgccttttactctgaaacctgacggcacgagggtgcttcccaacgttatgtccagactgccttcagccctgcttcctcaggcccctgggagcgtactcttccaaagtccctttagcactgtggccctcgatacctccaagaagggaaagggcaagccccctaacatctctgccgtggacgtgaagcccaaggacgaggcggctctatataagcacaagtgtaggagcagcttaccatcaacgtttatcagagctccaccaacatatgttaaggttgaggtcccgggtacctttgtgggtccctctacattaagcccaggtatgactcccctgctggccgcacagcctagacggcaggctaaacagcacgggtgtactcgctgcggaaaaaacttctccagcgcctcggcgctgcaaattcatgagcggactcacaccggtgagaaacctttcgtgtgtaatatatgcggcagagcatttactacaaagggcaatctgaaggtgcattatatgacccatggcgctaacaacaactcggctcggaggggtcggaagctggctattgagaacaccatggccctcctgggaaccgacggcaagcgagtatctgaaatctttccaaaggaaatccttgccccttccgttaatgtagaccccgtggtctggaatcagtacacatctatgctaaatgggggtttggccgtgaagaccaatgagattagtgtcattcagtctgggggtgtgccaactctaccagtctctctaggggcaacatcggtggtgaataacgcaacagtgagcaaaatggacggcagccaaagcggaatttccgcagatgttgagaagccatccgcaaccgacggcgtccctaaacatcagtttccccacttcctggaagagaataagatagccgtgtcatag

SEQ ID NO: 239598 - DNA, 2781 bp, Artificial Sequence
  Description of Artificial Sequence: Synthetic coding sequence
atggtgatggcagacgggcctaggcaccttcaacgcggaccagtgagagtgggcttttacgacatcgaaggtacactggggaaggggaactttgctgtagtaaagcttggcaggcatagaataacaaaaacagaggtcgccattaagatcatagataaatcgcagctggacgctgttaatttggagaaaatttatagagaagtccagatcatgaagatgctggaccatccacatatcattaagctctatcaggtaatggaaacaaagtccatgctgtaccttgtgaccgagtatgcaaaaaacggcgagatcttcgattatctggcaaaccacggcaggttaaacgagagtgaagctcgccgtaaattctggcagattctcagcgccgttgactactgtcacgggagaaagatcgtgcatcgagatctgaaagctgagaatttgctcctcgacaataacatgaacattaagatcgcggacttcggattcggcaacttttttaagtctggcgaactgctggcaacctggtgcgggagcccaccttatgcagcaccggaggtgttcgaagggcaacagtacgagggtccccagctggatatctggtccatgggcgttgtgttatatgtgctcgtctgtggggcactcccgttcgatggccctaccctccccatactccgccagagggttcttgaaggcaggttcaggatcccctatttcatgagcgaagactgcgagcatctgatccgccgaatgctggttctggatccatctaaacgcttgaccatcgcccaaataaaagaacataagtggatgctgatcgaagtgcctgtgcagcgccctgtgctgtacccgcaagagcaggagaacgagccgtccatcggagagttcaacgagcaggtgctgcgcctgatgcacagtttgggaatcgaccagcagaaaacgattgagtcattacagaataagagctacaaccattttgccgcaatctactttctgttagtcgagagacttaaatctcatcggagttcctttccagtcgagcagagactcgacgggaggcaacgtcgtccgtctactattgcggaacaaacagtggctaaagcccagaccgtcggcctgccagtgactatgcatagccctaacatgcgattgttgcgcagcgccctgctaccacaggccagcaatgtggaggccttttcttttccggcatctggttgccaggccgaggccgcttttatggaggaggagtgcgttgatacccctaaggttaacgggtgcctgttggatcccgtgcccccagtgctagtaagaaagggctgtcaatcactcccttccaacatgatggagacaagtatcgacgaggggctagaaaccgagggggaggctgaagaagaccccgcacatgcgtttgaggccttccagtccacacgcagcggtcagcggcgtcatacactgagcgaggtcacgaatcaactggtggtcatgccaggtgccggaaaaattttctcaatgaatgacagtccctcactggactcagttgatagcgagtatgatatgggttccgtgcagcgagatttgaattttctcgaggacaacccaagcctcaaagacatcatgctagctaatcaaccatcacctagaatgacctccccgtttatatccctcagaccaacaaatccagcaatgcaggctttgagcagccagaagcgtgaggtccacaacaggtctcccgtgtccttccgcgaaggacgccgtgctagcgacactagccttacgcagggtatagtcgcctttcggcagcacctgcagaacctggccaggaccaaagggattcttgaactcaataaagtgcaattgctgtacgagcaaatcggtcctgaggctgatcccaatttagcccctgccgctccccaactacaggatttggcctcatcttgcccgcaggaagaagtcagccaacagcaggagtcagtgagtacgctgcctgcctccgttcatccccagctgagccctaggcagagtctggagactcagtacttacaacatcgactgcaaaagccctcacttttgagcaaggcccagaatacctgccaactatactgcaaggagccaccccgaagcctcgaacagcagctgcaggaacatagactgcagcagaagcgactttttctccagaagcagagtcaactccaggcctatttcaaccagatgcaaattgctgaatccagctacccacagcctagccagcaactcccgctgccgaggcaagagacgccgcctccttcccaacaagcccctcctttttccctgacacagccattgagccccgtgctcgagccatcatctgagcagatgcagtacagtccatttctatcccagtatcaggagatgcaactgcagcccctgccttccactagcggacccagggctgcgccacctctgcctacacagttgcagcagcagcagccaccaccgcctccaccaccccctcctcctaggcaaccaggcgcagcacccgctcccctgcagtttagttatcaaacgtgcgaactccctagtgcagcaagcccagcacctgactacccgacgccttgccagtatccagtcgatggtgctcagcagagtgacctcacgggaccagattgtcctcgctcacccggactgcaagaggcgccttcctcttacgatcctttagctctctctgagcttccaggcttattcgattgcgaaatgctcgacgcagtggacccgcagcacaatggttacgttttagtgaattag

SEQ ID NO: 239599 - DNA, 1881 bp, Artificial Sequence
  Description of Artificial Sequence: Synthetic coding sequence
atgcaacgggctgacagtgagcaaccttcaaaacgcccacgctgtgacgatagccctagaacaccaagtaatactccatcagccgaagcagattggtcccctggattagaactccaccctgattataagacctggggccctgaacaagtttgtagttttttgaggcgaggcggatttgaggaaccggtgttgcttaagaacattagggagaatgagatcacaggagctctgctgccgtgtctagacgaatcccgcttcgaaaatcttggggtctcaagtctcggagaacgaaaaaaactcctgtcctatattcagcggctcgtccagatccatgtggataccatgaaggtgataaacgaccctatacatggccacatagaattgcaccctctactagtcaggatcatagacacaccacagtttcaacgactgcgctacatcaaacagttgggcggagggtattatgtgtttcctggcgcttcacataacagatttgaacatagtttgggggtcggttacctcgctgggtgcctggtgcacgctctcggggaaaaacaaccggagctgcagatcagcgagagagatgtgctctgtgtccagattgcgggactttgccacgatcttgggcatggccctttcagccatatgttcgacggccgatttattccactcgctcgtcctgaagttaaatggacccacgagcaaggctcagtgatgatgtttgaacacctgatcaattctaacgggattaagcccgtgatggaacagtatggccttattcctgaggaagatatatgctttataaaagaacagattgtgggccctcttgaatccccagtcgaagattcgctctggccctataagggtcgccctgagaacaagagttttctatacgagattgtgtccaataagcgcaatggtatcgacgttgataaatgggactatttcgccagagattgtcaccatctaggaatccagaacaacttcgactacaaacgcttcattaaattcgccagggtgtgcgaggtggacaatgagcttcggatttgtgctcgggacaaggaggtcggtaatctgtatgatatgttccacacacggaactctcttcaccggagggcgtatcaacataaggtgggcaatattatcgacaccatgataacagatgctttcctaaaggctgatgactatatcgagatcacaggcgcaggcggaaaaaaatacaggattagcacagcaatcgacgacatggaagcgtataccaaacttacagacaatatctttttagaaatcctctactccaccgatcctaaactcaaggacgctcgggagattttgaagcaaatcgaatatagaaacctgttcaagtacgtcggcgaaacgcagcctaccggtcagatcaagatcaaacgtgaggactacgaaagtttaccgaaagaggtggcctctgctaaaccaaaggtgctgctggatgtgaaactgaaggccgaagacttcatcgtggatgtgatcaacatggactatggcatgcaagagaagaatccaatcgatcatgtgagcttttattgcaagactgccccaaatagggccatccgcattaccaagaaccaggtgtctcagctgctgcccgaaaagtttgcagaacagcttatccgagtgtactgtaagaaggtggatagaaaatctctgtatgccgctagacaatacttcgttcaatggtgcgccgataggaacttcacaaagccacaggatggagatgtcatcgcaccactcattacccctcagaagaaggagtggaatgacagcactagtgtccagaaccccacacgtctgagagaggcctccaagagtagagtgcagttgtttaaggatgatcccatgtag

SEQ ID NO: 239600 - DNA, 513 bp, Artificial Sequence
  Description of Artificial Sequence: Synthetic coding sequence
atgtttgacggcaggttcattcctctcgctcggcctgaggtaaagtggacacatgaacagggttccgtcatgatgttcgagcacctgataaattctaacggcataaaacccgtgatggagcagtacgggctgatccccgaggaggatatttgctttatcaaggaacagattgtcggtccactcgagagccctgtggaagactctctatggccttacaaagggcgacccgagaacaagagcttcctctatgagattgtatctaacaaaagaaatggtatagacgtggataagtgggactacttcgcacgcgactgtcaccacctggggatacagaacaacttcgactataaacggtttatcaagtttgcccgtgtgtgtgaagtagataacgaactaagaatctgtgccagagataaggaggtgggtaatctttatgacatgtttcatacccgcaactcgttgcatcggcgagcctatcagcataaagtaggtaatattatcgacaccatgtag

SEQ ID NO: 239601 - DNA, 1326 bp, Artificial Sequence
  Description of Artificial Sequence: Synthetic coding sequence
atggagatacgcctggacacactgagcgcctcattaggaaggagctctaccctgaataattgcaatctggaagataaattggcgtggtacgagggggaggcatatatgtggcatcactggaaaccatttccagagaaccccctttggacatgtctggattttcagattgcccaggtgggcccatgggaccactgctctagctgtatccggcacactcgacttaagagctcttgtagcgacatggatctccttcacagctggagatcatcatcctttgggaactttgatcggttcagaaataattctctatccaaacctgatgactctacggaagcccatgagggagacccaacaaatggaagtggagagcagagtaagacatccaacaacggcggtggtctgggcaaaaagatgagggctatctcatggactatgaaaaaaaaggtgggcaaaaaatatattaaggctctgtccgaagaaaaagacgaagaagacggggaaaacgcccatccatatagaaattcagatcccgtcatcgggactcacacagagaaagtgtcactgaaggcttctgacagcatggacagcctttattccggccagagttcttcttccggcatcactagctgctcagacggtacgtccaatcgcgactcattccgccttgacgacgacggtccgtattctgggcctttctgtgggagagctcgcgtgcatacagactttactcctagcccctacgacacagattcactcaagataaagaaaggggacattatagacattatttgcaaaactcccatgggcatgtggaccgggatgctaaacaataaagtgggcaactttaaatttatatatgtagatgtcatcagtgaggaggaggcagcccctaagaaaatcaaagctaacagaaggagtaattcaaagaagtccaaaaccctgcaggaattcctggagcggattcatttgcaggagtacacgagcacattattactgaatggttacgaaaccctcgaagatctgaaggacataaaagagtcccatttgattgagttaaatattgagaacccggatgaccggcgtagattgctgtctgccgcagaaaatttcctggaagaggagatcattcaggagcaggaaaatgagcccgagccactctccctgagttcggatataagcctcaataaatcccagctggacgactgtccgcgagatagcggatgttacatcagtagtgggaactccgacaacggtaaggaggatttggagtccgaaaacctgtctgacatggtccataagataataataacagaaccctccgactag

SEQ ID NO: 239602 - DNA, 618 bp, Artificial Sequence
  Description of Artificial Sequence: Synthetic coding sequence
atgttaaagagaaaaccttctaatgtgagcgagaaagagaaacaccagaagcccaagaaaggagatattatcgacattatttgcaagacccccatgggaatgtggaccgggatgctgaataataaagtggggaacttcaagttcatctatgtggacgttatctccgaagaggaggcggctcccaaaaagattaaggctaatagacggtctaacagcaagaagagcaaaaccctgcaggaattcctggagcggattcaccttcaagaatacaccagtactctccttctgaacggctacgaaactctggaagatttgaaagatattaaagaaagtcatctcatcgaactgaacattgagaacccagatgatcgcaggagactcctttccgccgcagagaatttcctcgaggaagagatcatccaggagcaggaaaatgagcctgagccactcagtctcagctctgacatctccctgaacaaatcccaactcgatgactgtcccagggacagtgggtgctacattagcagtgggaattcagataacggaaaagaagacctggaatccgagaatttatccgatatggtccacaaaattatcattactgagccctcagattag

SEQ ID NO: 239603 - DNA, 1122 bp, Artificial Sequence
  Description of Artificial Sequence: Synthetic coding sequence
atgctaaagcgaaaaccatcgaacgtgagcgagaaggagaaacaccagaaacctaaacggtccagtagtttcggcaactttgacagattcaggaataatagcttatctaaaccagatgacagcacagaggcccacgagggcgaccctaccaacggctctggcgagcagtctaagacttcaaacaatggtgggggtctggggaaaaagatgagagccatcagttggaccatgaagaaaaaggtcggcaaaaaatatataaaagccctgtccgaggagaaagatgaggaggacggcgaaaatgcccacccataccgtaacagtgaccccgtgataggtacacacaccgagaaggtgtcgctcaaggcaagtgactccatggactcactctactccgggcagtcctctagctccggtatcacctcatgctcagatggaacatctaatcgtgattcttttcggctggatgacgacggaccatattccgggccattttgtggacgagctagggttcatactgactttacacctagtccttatgataccgacagcctgaaaatcaaaaagggcgatattattgacatcatctgtaaaaccccaatggggatgtggaccgggatgctaaacaataaggtcgggaatttcaagttcatctatgttgacgtcatcagcgaggaagaagcagctcctaaaaagataaaggccaataggcggtctaatagtaagaaaagcaagactcttcaggagttcctggaaagaatccacctgcaggagtacacatctactctgcttctgaatggctatgaaactctggaagacctcaaggatataaaagagtcacacctcattgagctgaacatcgaaaatcccgatgatagaagacgtttactctcggctgcggaaaatttcctggaagaggaaattatccaggagcaagaaaacgaacctgaacccctcagcttgagcagtgacatctctctgaataagagccagctggatgattgcccacgtgactctggctgctacattagctctggaaactcggacaacggtaaggaggatctcgagtcagaaaatctcagcgacatggttcacaagatcattattaccgaaccgtctgactag

SEQ ID NO: 239604 - DNA, 1008 bp, Artificial Sequence
  Description of Artificial Sequence: Synthetic coding sequence
atgggctcagccagtcctggattatcctcagtgagtccttcccacttactgctcccaccagatacggtgagcaggactggcttggagaaggccgcagcgggagcagtgggcctggagcggagggactggagcccatcacccccagcaacacccgagcagggtcttagcgccttctatctttcgtacttcgacatgctttatcccgaagacagctcttgggccgcaaaggccccaggtgcaagcagccgcgaggagccgccagaggaacctgagcagtgcccagtgatcgacagtcaggctcccgcaggctcactggatctggtgcctggaggtctcacactcgaggaacattcactcgagcaggttcagtccatggttgtgggtgaagtcctcaaagacatagagaccgcatgcaaactactaaatattactgccgaccccatggactggagtccatcaaatgtgcagaaatggctcctatggacagagcatcaatacagactgcctcctatgggaaaagcattccaggagttagcaggaaaagagctctgtgctatgagtgaagaacagtttagacagcgaagtcccctgggcggagatgtgcttcacgcccacctggacatttggaaatccgcggcatggatgaaagagagaacatctcccggtgccattcattattgcgctagtacttcggaagagtcatggactgattccgaagtagattcctcatgtagcgggcagcccatccacctgtggcagttcttgaaggaattgctgcttaaaccacacagctatgggcgatttattagatggctaaataaggagaagggcatattcaagatcgaagacagcgcacaagtggccaggctctggggaattaggaagaatcgacccgctatgaattacgataaattgagccgctcaatccggcagtactacaaaaaaggaatcattaggaaacctgacattagccaacggttggtgtaccagttcgtgcacccaatctag

SEQ ID NO: 239605 - DNA, 960 bp, Artificial Sequence
  Description of Artificial Sequence: Synthetic coding sequence
atgggttccgcctcaccaggcctctcttctgtatcgccctcccacctactgctcccaccagatacagtctcacggacagggctggagaaggctgctgccggtgccgtgggcttagagcgacgcgactggtccccctcgcccccagccaccccagaacaaggactgtctgccttctatctgtcctatttcgacatgctgtaccccgaggatagcagttgggcagctaaggctcccggagcaagttctcgcgaggaaccacccgaggagccagagcaatgccccgtgatagactcgcaggctccggcagggagcctggacctcgtccccggtggccttacactcgaagagcactctttagagcaagtccaaagcatggtagtgggagaagtcctgaaagacatcgaaacagcgtgtaaactgcttaacattacagccgatcccatggactggagcccaagtaatgtgcaaaaatggctcctgtggaccgagcaccagtaccgcttaccccctatgggaaaagcattccaagagctggccggtaaagagctctgcgccatgtccgaggaacagttcagacagcggagccctctaggcggagatgtgctacatgcacatctggacatttggaagagtgcttccacctctgaggagagctggacagattccgaggtcgactcttcctgtagtggccagcctattcatttgtggcagttcctcaaggagctcctgctgaagccccatagctatgggaggtttattcgatggttgaacaaggagaaaggaatatttaagattgaggattccgctcaagtggcccgactgtgggggattagaaagaatagacccgcaatgaattatgacaaactgagtaggagcattaggcaatattacaagaaaggtattatcaggaaaccagacattagccagagactggtttaccagttcgtgcatcctatatag

SEQ ID NO: 239606 - DNA, 1218 bp, Artificial Sequence
  Description of Artificial Sequence: Synthetic coding sequence
atggccgcatcaggtaaaacatcaaagagcgagcccaatcacgttatctttaaaaagatttccagggacaaatctgtgaccatttacctgggcaatagggattatattgatcacgtgagtcaggtccagcccgtcgatggtgtggtgctggtggaccctgacttggtaaaaggcaagaaggtgtatgtgaccctgacttgcgctttccggtatggacaggaggatatcgatgtgatagggctaacctttcgcagggatctgtactttagccgagttcaagtgtatccacccgtgggggcagcaagcacaccaaccaagctccaggagtccttgctcaaaaaattgggctcaaatacctatccttttttactgacttttcccgactatctcccgtgttccgtgatgctccagcctgcccctcaggattcgggaaagtcttgtggagtggatttcgaagtgaaagccttcgcaacagacagcaccgacgctgaagaggacaaaatacctaagaaatcttcagttcgcctgctgatcagaaaggtgcagcacgccccactggaaatggggccacagcccagggctgaggcggcatggcagttcttcatgagcgacaaacctcttcacttagccgtgtctttgaacaaggaaatatacttccatggcgagccaatcccagttactgtcactgtgaccaataacactgagaaaacagttaaaaaaataaaggcctttgtggagcaggtggccaatgtcgtgctgtattcatctgactactatgtaaaacccgtagctatggaagaggcccaggaaaaagtgcccccaaacagcacgctaacgaaaacactgactctgctcccattgctcgccaacaaccgggagcgacgcggaattgccctggatggcaaaattaaacacgaagataccaacctcgcctcgtccacgatcatcaaagagggtattgacaggacggtacttgggatcctggtgagctaccagattaaagtgaagctgacagtgagcggaatgaccggacgccaaaaggctagcgaggttgccaccgaggtccccttcagactgatgcaccctcagcctgaggaccctggtcagttttcctaccaggacgccaacctggttttcgaggaattcgctagacacaacctgaaggatgcaggcgaggctgaagaaggaaaaagggataagaatgatgtcgacgaatag

SEQ ID NO: 239607 - DNA, 1218 bp, Artificial Sequence
  Description of Artificial Sequence: Synthetic coding sequence
atggctgcttctggcaagactagtaaatctgagcccaaccacgtgattttcaaaaaaatctcacgggataagtctgtgactatttacctcgggaacagggactatatcgatcatgtgagtcaagtacagcccgtggatggcgttgtgctggttgacccagatcttgtgaaaggcaagaaggtgtatgtgaccctgacctgtgccttccgctacggtcaagaggacattgatgtgatcggactgacattccggagggacctgtacttcagccgggtacaggtgtaccctcctgtgggcgcagcctccacacccacaaaactgcaagagtcattgttaaagaaacttggctcgaacacttaccctttcctgctgaccttccctgactatctgccatgcagtgttatgttgcagcccgcaccccaagattctggtaagtcttgcggggtggatttcgaggtcaaggcatttgctacagacagcactgatgcagaagaggataagataccaaaaaagtcttccgtccgcctcctcatccggaaagtgcagcatgcccctttagagatgggccctcagcctcgcgcagaggctgcgtggcagtttttcatgagtgataaacccctgcatctggccgtctcgctgaataaggagatctattttcacggcgagccgattccggtcactgtgactgtcacaaataacactgagaaaaccgtgaaaaaaatcaaagccttcgtcgagcaggtcgccaacgtcgtcctatacagctctgactattatgtaaagcccgtcgcgatggaggaagctcaggagaaagtgcccccaaactccacgttgaccaagacgctgacactgctgccgctgctggccaataacagagaacggagggggatcgcactcgacggtaaaattaagcacgaggacaccaatctggcatcttccactattatcaaggaaggaatagataggacagtcctcggaatcctcgtgtcgtatcagatcaaggtcaaactgacagtaagcggattcctgggtgagttgacaagctccgaagtggcaaccgaggtgccttttcgtctcatgcatccccagccagaggaccctgcaaaagaaagttaccaagacgcgaacctcgtgttcgaagagtttgccagacacaacttgaaagatgccggagaggccgaagaaggcaagcgggataagaatgatgtagacgagtag

SEQ ID NO: 239608 - DNA, 510 bp, Artificial Sequence
  Description of Artificial Sequence: Synthetic coding sequence
atggcagcttctggcaagacatcaaaatccgaaccaaaccacgtcattttcaaaaagatttcgcgcgataaatccgtgacaatctatcttggaaaccgcgattacatcgatcatgtctcccaggtgcagccggtggatggagtcgtattggtcgacccagatttggtgaaaggcaagaaagtgtacgtgacactcacgtgtgcttttcgttatggacaggaggacattgacgtaatcgggctcacattcagacgggatctctacttctcccgggtgcaggtctacccacctgtcggagctgcttctacgcccactaagctgcaggaatccctccttaaaaagcttggatccaacacgtatccatttctgctcacattccccgattatctcccttgtagtgtcatgctccagccagcccctcaggacagtggaaaaagctgcggagtcgactttgaagtgaaagcgtttgctaccgactctacagacgctgaagaggataagattccctag

SEQ ID NO: 239609 - DNA, 708 bp, Artificial Sequence
  Description of Artificial Sequence: Synthetic coding sequence
atgttacagcccgcaccccaggattctggtaagtcctgcggtgtcgacttcgaggtgaaggcctttgccacagacagtacagacgccgaagaggataagatacctaaaaaatcatccgtgcggcttctcatccgaaaggtgcaacatgcccctttagaaatgggaccccagccccgtgctgaggcagcttggcagtttttcatgtccgacaaaccgctgcacctagccgtgtcgttgaacaaggagatatacttccatggcgagcctattcccgtcacagtaaccgttaccaataacacagaaaagactgtaaagaagattaaggccttcgtggagcaagtcgccaatgtggtcctctattcatctgattactacgtgaaacccgtggcaatggaggaagcccaggaaaaggtccccccaaactctactctcaccaaaaccctcactcttctgcctctccttgcaaacaaccgcgaaagacgtggcattgcccttgatgggaagataaaacatgaagacactaacttagcctcaagtaccattatcaaagaagggatcgataggacagtcttgggcattctcgtttcctatcagataaaagtgaaattgaccgtaagcgggtttctgggtgagctgacctcgtctgaggtcgccacagaggtgcccttcaggctgatgcacccccaacctgaggaccctggaaaatag

SEQ ID NO: 239610 - DNA, 204 bp, Artificial Sequence
  Description of Artificial Sequence: Synthetic coding sequence
atggcagcctctgggaagacctctaagagcgagcctaatcatgtgattttcaagaaaatttcgcgggataaatccgtgtccggagctcaagtaactatctacctaggaaacagagactacatcgaccacgtgagccaggtgcagcctgtggatggtgtggtcctggtcgaccctgacctggtgaagggcaaaaaggtttcctag

SEQ ID NO: 239611 - DNA, 633 bp, Artificial Sequence
  Description of Artificial Sequence: Synthetic coding sequence
atggcaacagagactgtcgaactacacaagttgaagctagcagagctcaaacaagagtgtctggcacgcggactggagacaaagggaatcaaacaggatctgatccacagactgcaggcatacctggaagagcatgccgaggaggaagcaaatgaggaggacgtcttgggcgacgagaccgaggaggaagagaccaaacccatcgaactacccgtaaaagaggaggagcccccagagaaaaccgtggacgtggcggcagagaagaaggtggttaagattaccagcgagattccccaaactgagcggatgcagaagcgcgcagaaagattcaacgttcccgtttctctcgagagcaagaaggccgctcgagccgcacggtttggtatatctagcgttcctacgaaagggctaagtagcgacaataaaccgatggtgaaccttgataagcttaaagaacgggcacagcgatttgggctgaacgtttccagcatttctaggaaatctgaggatgatgaaaagctgaaaaagcggaaggaacgattcggaatcgttacgtctagtgccggtactggcacaactgaggacactgaagctaagaagcgaaaacgcgcagagagatttggaatcgcttag

SEQ ID NO: 239612 - DNA, 453 bp, Artificial Sequence
  Description of Artificial Sequence: Synthetic coding sequence
atggaagaagagaccaaacctatcgagctgcctgttaaggaagaagagccacctgaaaaaaccgtggatgtggctgccgaaaagaaggtcgtgaaaatcacgtcagaaattccccagaccgaacgtatgcaaaaacgagctgagcgcttcaacgtaccagtgtcacttgagtccaaaaaagccgcacgcgctgccaggttcggtatttcgtccgtgcccacaaaaggactgtctagcgacaacaaaccaatggtgaatctggataagctgaaggagagggcacaacgctttgggttgaatgtttcgtccatttcccgtaagtcagaggacgacgaaaaactgaaaaagaggaaagaaagattcggaatcgtaaccagttctgccggaacaggaaccacggaggacactgaggctaagaagcgaaagcgtgcagagcggttcgggatcgcctag

SEQ ID NO: 239613 - DNA, 633 bp, Artificial Sequence
  Description of Artificial Sequence: Synthetic coding sequence
atggcaactgagactgttgaactccataagctcaagctagccgaactcaaacaagagtgtttggccaggggcctagagacgaaagggatcaagcaggaccttattcataggctgcaggcttaccttgaagagcatgccgaggaggaagccaacgaggaagatgtactcggagacgagactgaggaggaagagactaagccaattgagctcccagtgaaggaggaggagcccccagaaaaaactgtcgatgtagctgctgaaaagaaagtggtgaaaattacttccgagatacctcaaaccgagaggatgcagaaacgggcagagcgatttaacgttcctgtatcactcgagagcaagaaggcagctcgtgccgctaggttcgggatcagctcagttcctacaaaaggcttgagctccgataacaagcccatggtcaacttagacaaactgaaggaaagagcccagagattcggactcaatgtgagctccatcagtaggaaatccgaggatgacgaaaaactcaaaaaaaggaaagaaagattcggtatagtgacctcttcggctggaacaggaacaacagaggatacagaggcaaaaaaacgcaagagggccgagcgttttggcattgcctag

SEQ ID NO: 239614 - DNA, 879 bp, Artificial Sequence
  Description of Artificial Sequence: Synthetic coding sequence
atggccggaaaaaagaacgtgctgtcttctttggccgtatacgctgaggactctgaacccgaaagtgatggtgaggccggtatagaagctgtgggctcggctgcagaggagaaggggggtctggtgagtgatgcctatggcgaagatgacttcagccgcctggggggagatgaggacggctacgaagaagaagaagacgagaattcgcgccagtcggacaacactgaggcagagaagcgtgatccacaggaactggtggcctcattcagtgagcgagttcgaaacatgtcacctgatgaaataaaaatccctccagagcctccgggtcgctgttctaaccatctgcaagacaagatacagaagctgtatgagagaaagatcaaagaagggatggatatgaattacattattcagaggaaaaaagagtttaggaatccatctatttatgagaagctcatacagttttgcgcaattgatgaactggggactaactaccctaaagacatgtttgacccccatgggtggtcagaagattcatattatgaggcattggccaaggcacagaagattgaaatggataaattggagaaggcaaagaaggagagaacgaaaatagagttcgtgactgggaccaagaagggaacaactaccaacgcgacctcaactaccaccactacagcctcaacggctgtcgcggacgcgcaaaagaggaagtcaaagtgggactccgccatccctgtaacgaccatcgcccagccgaccattcttaccaccactgctacactgcctgcagtcgtgaccgtgacaacctccgctagcgggagcaagacaactgtgatcagcgcagtgggtaccatcgttaagaaggccaaacagtag

SEQ ID NO: 239615 - DNA, 927 bp, Artificial Sequence
  Description of Artificial Sequence: Synthetic coding sequence
atggccggaaaaaaaaacgtcctctcctccctagctgtgtatgccgaggactctgaacccgagagcgatggggaggccggaattgaggccgttggctcagcggcagaagagaagggtggcctggtttcagacgcttatggtgaggacgacttctctagattggggggagacgaggatggatatgaggaggaggaagatgagaacagcagacaatcagaagatgacgacagcgagacggaaaaacctgaggccgatgatccaaaggacaacacagaagccgagaagcgagacccccaagagctcgtcgcaagcttttctgagcgggtgcgcaacatgagccccgatgaaattaagattccccctgagcctccaggtcgctgttccaatcacctgcaggacaagatccagaagctttacgaacggaagataaaggagggcatggatatgaattacattatccagagaaaaaaagagttccgcaatcccagcatttatgaaaaactgatacagttttgcgcaattgacgagctggggaccaattatccgaaggacatgttcgacccccacggctggtccgaagacagttattacgaagctctggcaaaagctcagaagatcgaaatggacaagctagagaaagccaaaaaggaacggacaaaaatagagtttgtgaccggcaccaaaaaggggaccacaacaaacgccacatccaccactactacaactgcctcgactgcagtggccgacgcacagaaacgcaaatccaagtgggactcggccattcccgtgactacaattgctcaacccacaatcttgactacaaccgccacactgcccgctgtagtcacagtgaccacttccgcatccggctccaaaaccacggtcataagcgctgtcggaaccatcgtgaagaaggccaaacagtag

SEQ ID NO: 239616 - DNA, 507 bp, Artificial Sequence
  Description of Artificial Sequence: Synthetic coding sequence
atggccggaaagaagaatgttctcagttcacttgcagtgtacgcagaagattcagagccggaatctgatggggaagcgggtattgaggctgtgggatctgccgctgaggagaagggaggcctggtaagcgacgcctatggtgaagacgacttttctaggttgggcggagatgaagatggttacgaggaagaggaggacgaaaactccaggcagagcgaggacgatgattccgaaacagaaaaacccgaggctgacgatccgaaggacaacacggaggctgaaaagagggaccctcaggaattggtggcatcttttagcgaacgtgtgcgaaatatgtcacctgacgagatcaaaatacctcccgagccccctggtcggtgctccaaccacctgcaggacaaaatccaaaagctttatgagcggaagattaaagaaggaatggacatgaactacatcattcagagaaaaaaagagtttcggaacccgtcccaggggccagagaactag

SEQ ID NO: 239617 - DNA, 927 bp, Artificial Sequence
  Description of Artificial Sequence: Synthetic coding sequence
atggccggaaagaagaatgttctcagcagcctcgcggtgtacgcagaggactccgagccggagtctgatggggaagccggaatagaggctgtcggctctgcagccgaagaaaagggtggactggtatctgatgcttatggcgaagacgatttctctaggttgggcggagatgaggatggttatgaagaggaagaagatgaaaactcgcggcagtccgaggacgacgattccgagactgaaaagccggaggccgatgaccctaaggacaatactgaagccgaaaagagagacccccaggaactggttgcctcgttcagtgaaagagtacgtaacatgtcccccgacgaaatcaaaattccccctgagcccccagggcgatgtagcaaccacctgcaggacaagatccagaagctttacgagcggaaaattaaggaagggatggacatgaattacatcatccagcgtaagaaggagttccgaaatccctcgatttatgaaaagcttattcaattctgtgcgattgatgagcttggtactaactatccaaaagatatgtttgacccccatggttggagtgaagactcatattatgaggctctggcgaaagcacagaagatagaaatggacaagctggaaaaggccaaaaaggagagaacaaaaatcgaatttgtaactggcactaagaagggcaccactaccaacgccactagcactacaactacaaccgcgagtacggctgtggccgacgctcagaagcggaagtctaaatgggactcggcgatccccgtaacaacaatcgctcagccgaccatattaacaactacggccaccctgcctgcggtagtgaccgtgactacatccgcatcgggatctaaaacaaccgtaatttccgcggtcggaacaatcgtgaaaaaggccaagcagtag

SEQ ID NO: 239618 - DNA, 366 bp, Artificial Sequence
  Description of Artificial Sequence: Synthetic coding sequence
atgtcctttatctttgaatggatttataacggcttctctagcgtgctccagttcctggggctgtacaaaaaaagcggaaaactggtctttctgggactggacaacgcaggcaaaactaccctgctgcacatgctgaaggatgatcggctgggccaacatgtgcctacccttcacccaacctcagaagaactgaccattgcaggtatgacattcacgactttcgatctcggtggccacgaacaagcaaggagagtttggaaaaattacctgcccgcaatcaacgggatcgtgtttctagtcgactgtgctgatcacagcagactagtggagagcaaggtcgaacttaacgtctgctttgtcctttag

SEQ ID NO: 239619 - DNA, 597 bp, Artificial Sequence
  Description of Artificial Sequence: Synthetic coding sequence
atgtcattcattttcgagtggatctataacggttttagctccgtattgcaattcctgggcttgtacaagaaatcgggcaagctggtgttcctgggactggataatgctgggaagaccacgttgcttcacatgcttaaggatgaccgtcttggacagcatgtacccacgctccacccgacctccgaggagcttaccatcgcgggtatgactttcactaccttcgatctcggcggacacgaacaggctcgcagggtctggaaaaattatctccctgcaattaacggaattgtattccttgtagactgtgccgaccacagtagactggttgagagtaaagtggaactcaacgccctcatgactgacgaaacaatctcaaacgtgccaatccttatactggggaataagatcgataggacagacgcaatttcagaagaaaaacttagggaaatcttcggactgtacggacagacaaccggcaaaggaaacgttacactgaaggagctgaatgcacgcccaatggaggtgtttatgtgcagcgtcctcaagcgtcagggatacggcgaagggtttaggtggttgagccagtatattgactag

SEQ ID NO: 239620 - DNA, 597 bp, Artificial Sequence
  Description of Artificial Sequence: Synthetic coding sequence
atgtccttcatttttgaatggatctataatggtttttctagcgttcttcagttcctgggcctgtacaagaaaagcggcaagctggtgtttctcggtctggacaatgcagggaaaactaccctgctgcatatgctaaaggacgaccgtctaggccagcacgtgcctaccctacaccccacaagtgaagagctcacaatcgctgggatgaccttcactacctttgatctcggtggtcatgaacaggcgaggagggtctggaagaattatctgccggcaatcaacgggatcgtcttccttgtggattgcgccgatcatagtcgcttggtggagtcaaaagtggagctcaacgccctcatgaccgacgagactatttctaatgtacccatcctgatattgggcaataagatcgacaggaccgacgccatttctgaagagaaactgcgcgaaatctttgggctttacgggcagacaaccgggaagggcaatgtcactttgaaagaactgaatgcccgtcctatggaagttttcatgtgcagtgttctgaagcggcaggggtatggcgaaggcttcaggtggctgagccaatatattgactag

SEQ ID NO: 239621 - DNA, 597 bp, Artificial Sequence
  Description of Artificial Sequence: Synthetic coding sequence
atgagcttcatcttcgagtggatttataacggcttctcatccgttctgcagttcctcggcctgtataagaagtctggaaaattagtttttctggggcttgataacgctggtaaaacgacactgctccacatgctgaaggatgaccgattgggccagcacgtgcctactcttcacccaacaagtgaggaacttactatcgcaggaatgaccttcacgacgtttgacctgggcggtcacgaacaggcgaggagggtatggaaaaattacctccctgctattaacgggatagtgtttctggtagattgtgccgatcacagtcgcctcgtggagtccaaggttgagctgaatgctttgatgacggatgagaccattagcaacgttccgattctgatcttgggaaacaagattgataggactgacgctatctcagaggaaaagctcagagaaatttttggcctgtatggccagacaacaggaaagggaaatgtaacccttaaggagctgaacgcccgacctatggaggtcttcatgtgctccgtgctgaagcgccagggctacggcgagggcttccgatggctctcccagtacatcgactag

SEQ ID NO: 239622 - DNA, 597 bp, Artificial Sequence
  Description of Artificial Sequence: Synthetic coding sequence
atgagttttatcttcgaatggatatacaatgggttcagttctgtattgcagtttttgggcctgtacaagaagagtggcaagctcgtgttcttaggcctcgacaacgctgggaagactacactccttcacatgctcaaagatgatcgcttgggacagcatgtgccaacactgcaccccacctcagaggaactgactatcgccggaatgacgtttactacatttgacttgggtgggcacgagcaggctcgtcgcgtttggaaaaattacttgcctgccatcaatggtattgtgtttctggtggactgtgccgatcactcccgactggttgagtcaaaagtggagttaaacgccctaatgactgatgagactatctccaatgttccaatcctgatcctcggaaacaagattgaccggacggacgctatctccgaggaaaaactgcgcgagattttcgggctatacggccaaactaccggaaagggcaacgtgaccctaaaggagctaaacgcccgtcctatggaggtttttatgtgttcagttctcaagagacaaggctacggggaaggctttaggtggctgtcacaatatatcgactag

SEQ ID NO: 239623 - DNA, 354 bp, Artificial Sequence
  Description of Artificial Sequence: Synthetic coding sequence
atgggcctttctttctggtggaccgtacagatcattctcgcctcatggaaccccaaactcagtttgatgatctactgcagcagcctgctgacactcgcgccaaacgccctgatgacagacgaaaccatatcaaatgtgccaattctgatccttggcaacaaaattgacagaactgatgcaatttctgaggagaaactgcgcgagattttcggcctatatggccagacaacgggaaaaggaaatgttaccctcaaggaactcaatgccagaccaatggaagtattcatgtgctccgtgctgaagaggcaaggatatggtgaagggtttaggtggctgagccaatacatagattag

SEQ ID NO: 239624 - DNA, 597 bp, Artificial Sequence
  Description of Artificial Sequence: Synthetic coding sequence
atgagttttatatttgagtggatttataacggattcagctcggttcttcagtttcttggcctttataagaagtctgggaagctggtatttctcggactcgacaacgccggtaagaccaccctcctgcatatgctaaaggacgaccggctaggacagcatgtgcccactctgcatcccacctcagaagagctgaccattgctggcatgaccttcaccaccttcgatctgggtggccacgagcaggcgagacgtgtttggaagaattacctaccagccatcaatgggatcgtgtttcttgtcgattgcgctgatcactcacgactcgttgagtcaaaagttgaactgaatgcactcatgaccgacgaaaccattagcaacgtccccattctcatactggggaacaagatagatcgtaccgacgcgatcagtgaggagaaactgcgtgaaatcttcggcctgtatggtcaaactacaggaaaggggaacgtgacactgaaagaactgaatgcccgacccatggaagtcttcatgtgcagcgttctgaagcgtcaaggttacggggaaggctttagatggttatcacagtacattgattag

SEQ ID NO: 239625 - DNA, 348 bp, Artificial Sequence
  Description of Artificial Sequence: Synthetic coding sequence
tgatccttctggtggactgttcagataattctcgctagctggaatcctaagctgtctcttatgatctactgctctagccttttaactttggcacctaacgcacttatgaccgatgagaccatcagcaatgtgcctattctgatcttgggtaacaagatcgaccggaccgacgcaataagcgaagaaaagttacgtgagatttttgggttgtacggtcagacaacagggaagggcaatgtgacactgaaagagcttaacgcccgaccaatggaagtcttcatgtgctctgtattaaaacgccaaggctacggagaagggtttcggtggctatcccagtatattgattag

SEQ ID NO: 239626 - DNA, 468 bp, Artificial Sequence
  Description of Artificial Sequence: Synthetic coding sequence
atgctaaaggatgacaggctggggcagcacgtccccaccctgcaccccacttcagaagaattgactattgccggaatgacgtttacaacgtttgatctgggcggacatgagcaagccagacgagtgtggaagaactaccttcctgccatcaacggtattgtttttttggtggattgtgccgatcacagtagattagtggaaagcaaggtggagctgaacgcacttatgacggatgaaaccatatcaaacgtgcctatcctaattttagggaacaagattgatcgcacagacgccattagcgaggagaagcttagggagatattcggactctacggccagaccacagggaagggcaatgtcaccctgaaggagcttaacgctcgccctatggaagtgtttatgtgcagtgtcctgaaaagacagggctacggggaaggattccgctggctttcccagtacatcgactag

SEQ ID NO: 239627 - DNA, 393 bp, Artificial Sequence
  Description of Artificial Sequence: Synthetic coding sequence
atgacattcaccactttcgacttgggaggtcatgtgcaagctcggcgtgtatggaaaaattacttacccgctattaatggaatagtgttcctcgtggactgtgccgatcacgagcgactgctcgaatccaaagaagaactggacagcctcatgacagatgaaacaatcgccaatgtacctatcctgatcctgggtaacaagatcgaccgtcccgaggctattagcgaggagaggctccgagagatgttcggcctctacggccagacaacaggcaaagggagcatcagtctgaaagagctgaatgccagacccctggaggtcttcatgtgtagcgtactgaagaggcagggatacggtgagggtttccgatggatggcccagtacattgattag

SEQ ID NO: 239628 - DNA, 597 bp, Artificial Sequence
  Description of Artificial Sequence: Synthetic coding sequence
atgagctttatttttgattggatttacagcggctttagctccgtgctccagtttttaggtctgtacaagaagacagggaagctagtgttcctgggtttagacaacgccggtaaaacgaccctgctgcacatgctaaaggatgaccggctgggtcagcatgtgcccactctccacccgacttccgaggagttgaccatcgctgggatgacatttaccacttttgacctaggcggacatgtgcaggccaggcgggtgtggaagaactatctgcccgcaataaacgggatagtgtttttggtagactgcgcagaccatgaacggctcttagagtccaaagaagagttggattccctgatgaccgacgaaacaatcgcaaatgtgcctattctcattctcggcaacaagatcgaccgcccagaagctattagtgaggaacgcttacgggagatgttcgggttgtacggacagacaaccggcaagggatccatttctctgaaagagttgaacgcaaggccattggaggtgttcatgtgctcagtgctgaaacgtcagggatatggtgagggcttccgctggatggcgcagtatatcgactag

SEQ ID NO: 239629 - DNA, 597 bp, Artificial Sequence
  Description of Artificial Sequence: Synthetic coding sequence
atgagttttattttcgactggatctactccgggtttagctctgtgctgcagtttctcgggctctacaagaaaactgggaaactggtattcctcggtttggataacgcgggtaaaacaaccctgttacacatgctgaaggatgatcggctgggacagcacgtgccaaccctgcacccaacctcagaggagctcaccattgcgggaatgactttcaccacattcgatctggggggacacgttcaggcaaggcgtgtgtggaaaaattacctaccagccatcaacggcatcgtgtttctcgtggactgtgctgaccacgaacggctactggaaagcaaggaagagctggactcactaatgacggacgagacgatagctaacgtccctattcttatccttggcaataagatagaccgcccagaagccattagcgaagagagactccgggaaatgttcggcctctacggccagacaactggtaaaggctctatttcactcaaggaactgaacgccagacccctggaagtctttatgtgctctgtgcttaaaagacagggctacggggaaggctttcggtggatggctcagtacatagactag

SEQ ID NO: 239630 - DNA, 312 bp, Artificial Sequence
  Description of Artificial Sequence: Synthetic coding sequence
atgtctttcattttcgactggatctactcaggcttctcatccgtgctgcagtttctgggactctataagaagaccggaaaattggtttttctgggtttggataacgcgggtaaaacaaccctgctgcacatgctcaaggatgaccgtcttggacagcacgtccctaccctccaccctacatctgaagagctcactatcgctggcatgaccttcactacattcgatcttgggggacatgtccaggcccgtcgggtctggaagaactatctgcccgctatcaacgggatcgtctttctagtggattgtgcctag

SEQ ID NO: 239631 - DNA, 393 bp, Artificial Sequence
  Description of Artificial Sequence: Synthetic coding sequence
atgacatttaccacgttcgacctggggggtcatgtgcaggcacgacgagtctggaaaaattaccttccggctattaacgggattgtgttcttggtggattgcgcggaccacgaaagattgctggagagtaaagaagagttagacagcctcatgacagatgagactatcgcaaacgtgccaatactaattctgggaaacaaaatcgataggcctgaggcaattagtgaggaaagattacgagaaatgtttggattgtacggccaaacaacgggcaaaggctcaatatcactgaaggaattgaatgccagacctctggaggtcttcatgtgctctgttctaaagcgccaaggatacggagaaggatttagatggatggcccagtacatagactag

SEQ ID NO: 239632 - DNA, 513 bp, Artificial Sequence
  Description of Artificial Sequence: Synthetic coding sequence
atgagcttcatttttgattggatctactcgggcttctcatctgtcctgcagttcctcgggctgtacaagaagacaggcaaactagtattcctaggcctcgacaacgccggtaaaactacactcctgcatatgctcaaggatgaccggctaggtcagcacgtgccaacactccacccaactagcgaagagttgaccatcgcaggcatgacattcacaaccttcgatcttggaggccacgttcaggctcgccgtgtgtggaagaattaccttcccgctatcaatgggattgtcttcctggtcgactgtgccgatcacgagaggctgctggagtccaaggaggaactggacagcttaatgactgatgaaaccattgcgaatgtgccaatcctcatactgggaaataagatagatagacctgaagctattagtgaagaacggctacgagaaatgtttggcctctatgggcagactaccggcaaaggtagcattagtctgaaggagctgaatgcctag

SEQ ID NO: 239633 - DNA, 393 bp, Artificial Sequence
  Description of Artificial Sequence: Synthetic coding sequence
atgacctttactacttttgacctgggaggccacgtccaggcaagacgagtctggaagaattatctgcctgccattaacggtatcgtgttcctcgtcgactgcgcagatcatgagcggctgctggagtccaaagaggaactagactcgctgatgacagacgagacaattgccaacgtacctatcctgattctcggcaacaaaatagatagacctgaggcaattagcgaggagagactcagggaaatgtttggattatacgggcagactactggcaagggttcgatcagcctgaaagagctcaatgcacgcccactggaagtctttatgtgcagcgtactcaaaaggcaaggatatggtgaggggttcaggtggatggctcagtacatcgactag

SEQ ID NO: 239634 - DNA, 393 bp, Artificial Sequence
  Description of Artificial Sequence: Synthetic coding sequence
atgacattcacaaccttcgatctgggtggccacgttcaagctcggagggtttggaaaaattacttgccagccataaacggaatcgtgttccttgtggactgtgcggatcacgagaggctcctggaaagtaaagaggaactggatagtctgatgaccgatgaaacgatcgccaacgtacctattctcatcctgggtaataaaattgataggcccgaagctatatcggaggaacgcctgagagaaatgtttggcctttacggccaaacaaccggcaagggctcaatttccctaaaagagttaaacgcgaggccgctcgaagtgttcatgtgttcggtactgaagaggcagggatatggggagggcttcaggtggatggcccagtatattgactag

SEQ ID NO: 239635 - DNA, 2796 bp, Artificial Sequence
  Description of Artificial Sequence: Synthetic coding sequence
atgcgggctcttgtgttgctgggatgccttctggcatctttactgttttccggtcaggccgaactgcaggtctcagcatccggtggaactgaggacgtcgggaaccttctggagaatcactttagcgccggagatgcttctctcgaggagaaggagcgtgcactgtatgctgacacagcccctcaagataaaaagcttcttttgcattatcccgatggacgcgaggctgagtccccaaagaaaactccagccagcgctgctagcgccggacccgatccagaggcttcactctccaacgcatcggctactgagtcaccccctcctggagaacgagacgatcgagatgccgctgggcctggggaggagaaaaatggcccacctgtggcaagcgctctcccaccaggaggcgctaaagggccagtggaggaagagtggcccgaaccttcaagtggagaggggcagggtgaggaagagacagggtttggactgcccacagagggaaccgcctctggggaggcgggaggccaggccggaggtcacgagcttccagaagaggtgcaggaggtgcagggcgatagtttggtccagggcgcagtggcaggtacggctgagcctaaggctgaaggcgcatctccgcactccgaaggagacggtgttggacctttaaacgccgaagccgaaggctcaccaggaccaggagaggaacccgctgtgccggagggcgctcctgatgtggctgcggtaggcggagagtctgagccggacatcgatacacaagcctctgaggggacggaagatcaaggtgagccaggccctgctgcagaggcatctgccgagcccggaggggcacaaagcgtgaaagccggagacaccgaagagaatcagtcgccagaaatgacagaggaggacgcggatgaagcttccagtgaggaggagtccggggacggctccggatctgaagaagagggaggcgtcccatccgaggaggaatctgaggaggactccggggatggagcgtcttccgaggaagctgaaggcgcaagcgaggaagcgacggagcctcaggaggctggcgaacctcaagaggcaagagaaccacaggaaggaggcgacctacaggaggctgaggaaagccaggaggggggagacccacaggaagcggaggagccccaggaggggggtgcccctcaagagggtggagagccccaggaagggggagatccacaggaagctagagaaccccaggaggctcgggaaccacaggagggcgcagagctgcccgaggcaaccgggacgacctcccacagggaccgtggcgctcagcctggtcccgaagagctaaacacagagagcatgggttcagagacgctggacatgaaggccgaagagcccgaagagggacatcagagagagagcccaatcatagtggcacaagaggaaaccgaagatgcgaatgaggaagcaccgctgagggacagatctcacatcgagaaaaccctgatgctaaacgaggacaaacccagcgatgactactccgcagtactacagaggcttcggaaaatctatcactccagcatcaaaccactcgagcagtcatataaatataacgaattacgccagcatgaaatcacagacggagagataacttccaaacctatggtgttgtttcttgggccttggtccgtgggaaaatctacaatgatcaattacctgctcggattggaaaatactcgctaccagctttatactggagctgaacccacaacctcggagttcaccgtactgatgcacggcccaaagctgaaaacgattgagggtattgtgatggcagcggattcagcccgaagtttcagtccactggagaaatttggccagaacttcctggagaagctgatcggtatcgaagttccccataaattactcgagagagtcaccttcgtcgatacccccggtattatcgagaataggaagcagcaagaaagaggatatccgtttaatgatgtttgccagtggtttatcgaccgcgctgatctgatttttgtggtgttcgatcccaccaagctcgatgttggcctagaactcgagatgctttttaggcagctcaagggaagggagtctcagatcagaattattctgaataaggccgacaacctagcaacccagatgctgatgcgggtctatggagcattgttctggtccctggcccctctgataaatgtcaccgagcccccacgagtgtacgtgagcagcttctggcctcaggagtacaaaccggacactcatcaggagttattcctccaggaagagatcagcctactggaggaccttaaccaggtgattgagaaccggctggaaaacaagatcgcctttatcagacaacatgcaattagggtacgtatccacgccctcctggttgataggtatttacagacatataaagacaaaatgactttttttagcgatggcgaactggtgttcaaagacatagtagaagacccggataagttttacatttttaagacgatacttgccaaaactaacgtgtcaaaattcgatctgcctaatcgcgaagcgtataaagatttttttggtattaatcccatctcatctttcaagctgctctctcagcaatgctcatatatgggcggttgctttttggagaaaatagaaagagcaattacccaggagctgcccggactccttggaagcctggggttgggcaaaaatccaggagccttgaattgcgacaaaaccggctgtagcgagactcccaagaatcgctaccggaagcactag

SEQ ID NO: 239636 - DNA, 1422 bp, Artificial Sequence
  Description of Artificial Sequence: Synthetic coding sequence
atgagagctttggtgctactgggatgcctcctggccagccttctgttctcgggacaggcggaagagactgaggacgccaacgaagaggcacccctgcgagaccggtctcatatcgagaaaaccctaatgctcaacgaggacaaaccttccgacgactatagtgccgtgctgcagaggctgcggaaaatttatcatagtagcatcaagccccttgaacagtcctataagtacaatgagctgcgtcagcacgaaattacagacggcgagattacctctaagcccatggtgctctttctggggccttggagtgtgggtaaatctaccatgatcaactaccttctgggactcgagaatacaaggtaccagctctatacaggcgctgagcccaccacctccgaattcaccgtgctgatgcacggtccaaagttaaagaccatcgagggaatcgttatggccgctgacagtgccagatccttcagtcctttggagaagtttggtcagaactttctggagaaactgataggaattgaggtgcctcacaaattgctggagcgggtgacctttgtggacacccctggcattatagaaaatcgcaagcaacaggagcgaggctacccatttaacgacgtatgtcaatggttcatcgaccgtgcggatctgatttttgtggtgtttgacccgactaagttagacgtcgggcttgagctcgagatgttattcagacaactgaaaggaagagagagtcagattaggatcatattaaacaaggccgataacctcgccactcagatgctaatgagggtttatggggctctgttttggagcctggcacccttaatcaatgtgactgagccgccacgagtttacgtaagttccttttggccgcaggaatataagcctgacacccaccaagagctgttcctgcaggaagaaatctccctactggaggacctcaatcaggtgatcgagaaccggctcgaaaataagattgcgttcattaggcagcacgctatccgcgtgagaattcacgccctgctggtggatcggtatctgcagacctacaaagataagatgacatttttctccgacggcgaactcgtatttaaggatatcgtagaggatcccgataagttctacatttttaagacaatactggccaaaaccaacgtgagtaaatttgacctaccaaatcgggaagcgtataaggactttttcgggataaaccctattagttctttcaaattactttcccaacaatgctcttacatgggaggctgcttcttagagaagattgaaagagccattacacaagagctccctggcttgctggggtccctgggtctgggcaaaaaccctggggcattgaattgtgataagaccggctgttccgagacgcccaaaaacagatacaggaagcactag

SEQ ID NO: 239637 - DNA, 1296 bp, Artificial Sequence
  Description of Artificial Sequence: Synthetic coding sequence
atgctcaatgaggacaagccctccgacgactactccgccgtgctccaaagattgagaaaaatctaccacagctcgatcaagccactggagcagtcgtacaaatacaacgaacttaggcaacacgagatcactgatggtgagatcacctccaagccaatggtgctttttttggggccatggtcagtaggtaagagtaccatgattaactacctgctgggcttagagaatacaaggtaccagctgtatacaggagccgaacccaccacttccgaattcactgtgctcatgcatggcccaaagctgaaaacaattgaagggattgttatggcagccgacagcgctcgatcttttagccctctggaaaaatttggtcaaaattttcttgaaaaactgatcggtatcgaggtcccacacaaactgttagaacgggtgactttcgtagacactccaggaattattgagaataggaagcagcaggaaaggggataccccttcaatgacgtgtgtcaatggttcatcgaccgcgctgatcttattttcgtggtttttgatcctacaaaactggatgtgggcctggagctggaaatgcttttcaggcagctgaagggacgagagtcccagataagaataatacttaacaaggcagacaatttagctacacagatgctgatgcgagtgtacggcgcattgttttggagcttggcacccctcattaatgttactgagcctcctcgcgtctatgtctcctcattctggccacaggaatacaagcccgacactcaccaggaactctttttgcaggaagaaatcagcctgcttgaggatctgaaccaggtaatagaaaatagactggagaataaaatcgcttttatccgacaacacgccataagagtccgaatccatgctctgttggtggacagatatctgcagacttataaggacaagatgacgtttttttctgatggagagctggtctttaaagatattgtagaggaccccgataaattctatatatttaagacaatactggctaagaccaatgtgtctaagttcgatctacccaacagggaggcgtataaagattttttcgggatcaatccgattagtagtttcaaactgttatctcaacagtgctcctacatggggggatgtttcctggaaaagattgagcgcgcaatcacacaagagctccccggtctgctgggatcactagggttaggcaaaaatcccggagctttgaattgtgataaaacaggctgtagtgaaactcctaaaaatcggtaccgaaagcactag

SEQ ID NO: 239638 - DNA, 1164 bp, Artificial Sequence
  Description of Artificial Sequence: Synthetic coding sequence
atggccgaaaccttgttctggacacccctattagtggtactgctcgctggactgggcgataccgaagcgcaacagacgactttacatccactggtgggcagggtctttgttcatacactcgatcatgaaacattcttgtccctacccgaacacgtggctgtccctccagcagtgcatattacgtaccatgctcacctgcagggtcaccccgacctccctcgctggctcagatatacccaacgatccccccaccatccgggtttcctgtatggatcagcgacccccgaggatcggggattacaagtgatcgaggtgaccgcctacaaccgggattcattcgacacaacacgccaacggctggtcctggagattggtgatccagaaggaccactgctgccgtatcaggctgaattccttgtacgaagtcacgatgcggaagaagtcctgccaagtactccagcgagcaggttcctgtcagcgctcggtggactgtgggagcccggagaactgcaactactcaacgtcacatccgcgctggatcgaggaggacgagtgcccctgccaatcgagggcaggaaggagggagtgtatatcaaagtgggatctgcttcacccttcagtacctgtcttaagatggtagcttcccctgattcccacgcacgctgtgcgcagggacagccacccctactatcttgttacgatacgctggccccacattttcgcgtggactggtgtaatgtgactcttgtggacaagtcggtgcctgagcccgctgatgaagtccctacccctggggacggcatcctggagcacgatccctttttttgcccgccaacggaggcgccagatagagactttctggtggacgctttggtgacgctcctggtccccttgctggttgcccttcttctgacacttctgttagcctacgtgatgtgctgtagacgggagggtcgtctcaagcgggacctggccacctcggatatccagatggtccaccactgcacaattcatggcaacaccgaggaactccggcagatggcggctagtcgagaggtgcccaggcccttgtctactcttcccatgttcaatgttcacactggcgagcggctgcctcccagagtggacagtgcacaggttccactgatcctggatcaacattag

SEQ ID NO: 239639 - DNA, 792 bp, Artificial Sequence
  Description of Artificial Sequence: Synthetic coding sequence
atggccgagacgctgttctggacgccgcttcttgtggttctgctcgccggactgggggatactgaagctcagcagaccacgctacacccgctggtcggcagagtcttcgtgcacactcttgaccatgagaccttcctttccttgcccgagcacgtcgcggtccctcccgcagtgcatatcacctatcacgcccatctgcagggccatcctgatttacccagatggctgcgctacacacagcggagcccacaccaccccggattcctgtacggcagcgccactccagaggatagaggtttgcaggtcatcgaagtcactgcctataacagggattcgttcgacaccaccagacagcggcttgtgctggagattggcgaccccgaaggaccactcctaccatatcaggctgaatttctggtgcgatcccacgacgcagaggaagtcctgcctagcacacccgcaagccggttcctcagcgccctcgggggactgtgggaaccaggcgagcttcagctgttgaacgtcacctccgctttggatcgcggtggccgtgtccccttaccaattgagggaagaaaagagggtttaaagcgcgatctcgccaccagtgacattcagatggtgcaccactgcactatacacggcaataccgaggagctgaggcaaatggcggcttcacgggaggttcctaggcctcttagcacccttcctatgttcaacgtgcataccggcgagaggctgcctcctcgagtggattccgctcaggtgcctctaatactggaccagcattag

SEQ ID NO: 239640 - DNA, 537 bp, Artificial Sequence
  Description of Artificial Sequence: Synthetic coding sequence
atgagcgtaacagcttataacagagacagttttgataccacaagacagagactcgtgctagagatcggcgaccctgagggcccactgctcccttaccaggccgagttcctggtacgcagccacgacgccgaggaagtgttgccctccactcccgcaagccgttttttgtctgcactgggaggactgtgggaaccaggcgaactgcagttgcttaacgtgacatcggcgctcgatagagggggacgggtccctctgcccatcgagggacgaaaagaaggggtatatataaaagttggcagcgcctcgccattctctacatgtctcaaaatggtagcaagcccagatagccatgcaagatgtgcccaggggcagccaccgctcctgtcttgctacgacaccctcgcacctcatttcagagtggactggtgcaatgtaacactggttcgccgagacccaggatccgggggtggggtaggccacgggccacatccctcaccgccaagcctgccctgctgcttcctgtcccccagcttgtag

SEQ ID NO: 239641 - DNA, 792 bp, Artificial Sequence
  Description of Artificial Sequence: Synthetic coding sequence
atggcagagacgctcttctggacgccactgctggtcgtgctgctggctggcctgggggacactgaggcccaacaaacaacacttcacccactggtgggaagggtgttcgtccatactctggatcacgaaacgtttctcagtttgccagagcacgtggcagtgccaccagccgtgcatatcacttaccatgctcacttacagggacaccctgacttaccaaggtggctcagatatacccagcggtcaccacaccaccccggattcctgtatggaagtgcaactccagaggatagaggactgcaggtgattgaggtcactgcatacaaccgagatagctttgacactacccgtcagagactagtcctcgagattggggaccctgaaggaccactgctgccctaccaagccgaattcctcgtccgaagccatgatgccgaggaggtgttgccatccactcccgcatcccgttttctgagtgctctgggcggtctctgggagcccggagaactgcagctgctcaacgtgacgagcgcacttgatcgcggtggtagggtcccactgcctatagaggggagaaaagaggttttgttgcgccacttaggaacaccgctcattcagatggttcaccactgtaccatacatggcaacactgaggagctccgtcagatggcggctagtcgcgaagttccccgacctctatccaccctgcccatgttcaacgttcacacaggagaaaggctgccaccaagagttgactctgcgcaggtccctctcatattagatcagcactag

SEQ ID NO: 239642 - DNA, 957 bp, Artificial Sequence
  Description of Artificial Sequence: Synthetic coding sequence
atggccgctgccgcagccgctgcagccgagcagcaatctagcaacggtcctgtgaaaaaaagcatgagggagaaggcggtcgaaaggcgctccgttaataaggagcacaactcaaacttcaaagcgggatatattccgattgatgaagataggctacataaaacaggtctgcggggacgtaaaggcaatctggctatttgcgtgattattctgctctttattctggcggttataaacctgatcataaccctggtgatatgggccgttattaggattgggcctaacggctgtgacagcatggagtttcacgagtccggcttgcttcgcttcaagcaggtgagtgatatgggtgtcatccaccctttgtataaaagtacagtagggggtaggaggaatgagaatttggtcataaccggaaataatcagcccatcgtgttccagcagggaacaaccaagctgagcgtcgagaataacaagacctccatcacctccgacatcggcatgcagtttttcgatcctcgcacccagaatattttgttttcaaccgactacgaaacacacgagtttcacctgccttccggcgttaagtcactgaacgtgcaaaaggcttcaactgagcggatcacatccaacgcaaccagcgatttaaatattaaggtggacggaagagcaattgtgcgtggaaatgagggcgtctttatcatgggcaaaactattgaatttcacatgggaggcaacatggaactcaaggccgagaattctatcatcttaaatgggagcgtgatggtatcgacgacacgcctgccatcaagctctagtggtgaccaactcgggagcggggattgggtgaggtacaagctgtgcatgtgcgccgacgggacactgtttaaggttcaggtaacctcgcaaaatatgggctgccagatcagcgacaatccgtgtggcaacacgcactag

SEQ ID NO: 239643 - DNA, 747 bp, Artificial Sequence
  Description of Artificial Sequence: Synthetic coding sequence
atggcagcagctgcagcagccgctgccgagcaaatcaccctggtaatctgggctgtcataaggattgggccaaacggatgtgattctatggagtttcatgagtctgggttgctacgtttcaaacaagtttcggacatgggtgtaatccatccactttacaaatccacagtcgggggacgtcgtaacgaaaacctcgtcatcactgggaacaatcagcctatcgtgttccagcaagggactacaaaattaagtgtggaaaataacaaaaccagcatcacgtccgacattggaatgcaattctttgatcccagaactcagaatattctattctcaactgactatgagacccatgagttccacttgcctagtggggtgaaatcattgaatgtgcagaaagcttccactgaacgtataacgtctaacgcaaccagtgacctgaatattaaagtggatggccgagccatcgttcggggtaacgaaggcgtatttataatgggcaagaccatagaattccatatggggggaaacatggaactcaaagcagaaaattccatcatcctgaatggtagtgtgatggtgtctacaacccgtttgccctcctccagcagcggagaccagttaggttccggggactgggtcaggtacaagctgtgtatgtgcgcagacggcaccctgtttaaggtccaggtgacctcacagaatatgggctgccaaatttctgataacccctgtggcaacacccactag

SEQ ID NO: 239644 - DNA, 873 bp, Artificial Sequence
  Description of Artificial Sequence: Synthetic coding sequence
atgatgccgcaggaacagtatacacatcataggtccactatgcctggaagtgttggaccgcaggtctataaggtgggaatttacggttggcgcaagaggtgcctctacttctttgtgcttctcttgatgattctcatccttgtaaaccttgccatgaccatctggatcttgaaggtgatgaactttacaatagatggcatgggaaacctgcgaataacagagaagggtctgaagcttgaaggagactctgaatttctgcagcccctgtacgcaaaagagattcaatcacgtccaggtaatgccctgtactttaagagtgcgcgaaacgtcacagtcaacattcttaatgatcagaccaaagtcctcacacagctgattacaggtccgaaggccgttgaggcctacgggaagaaattcgaggttaagactgtgtctgggaaactcctgttctccgccgacaacaacgaagttgtggtgggcgcagagcggctgcgggttcttggtgctgaggggacagtgttccccaagtcgattgagaccccaaacgtgagggctgacccttttaaggaactcagattggaatcaccaactagatcattggtgatggaggctcccaagggagttgaaatcaatgcagaagctggaaatatggaagcgacgtgtcgcactgagttacggctggaaagtaaggacggcgagatcaagctggacgctgccaaaattaggctgccgagactgcctcacggatcttacaccccaactgggaccagacaaaaggtgtttgagatctgcgtatgcgcaaatggcagactcttcctcagccaagcgggagccggttcgacatgccaaatcaatacatccgtgtgtttatag

SEQ ID NO: 239645 - DNA, 870 bp, Artificial Sequence
  Description of Artificial Sequence: Synthetic coding sequence
atgccccaagagcagtacactcaccacagatccaccatgccaggtagtgtcggtcctcaagtgtacaaggtgggcatctacgggtggagaaaaaggtgtctgtatttctttgtgctgctgctgatgatcttgatcctggtcaacctcgcaatgacaatctggattctaaaggtgatgaacttcactatagatgggatgggcaatctcagaatcacagagaagggccttaagctagaaggagattcagagtttcttcagccactatacgccaaagagattcagtcgaggcccggaaacgccctatacttcaagtctgcacggaacgtgacagtgaacattctcaacgatcagactaaagtccttacccagctgatcacagggcctaaggcagtggaagcgtatggcaaaaagttcgaggtaaagacagtgtcaggcaagttgcttttttcagctgacaataatgaggtggtggtaggcgcagagagattgcgagttttaggcgcagagggcactgtgttccctaaatccatcgagactcctaatgtcagagccgacccgtttaaagagttgagactcgagagccctacgcgcagcctggttatggaagcgccaaagggagtggagatcaatgccgaggcgggaaatatggaagcgacttgcagaaccgaactacgtttggagagtaaagacggcgaaattaagctcgacgctgccaaaatccgcttacctagattaccccatggctcctacacaccaactggcacccggcagaaggtgtttgaaatttgcgtgtgcgccaacggtcgcttatttttgagtcaggctggggctggatcaacatgtcagataaatacatcggtttgcctctag

SEQ ID NO: 239646 - DNA, 771 bp, Artificial Sequence
  Description of Artificial Sequence: Synthetic coding sequence
atgatgccccaagagcagtatacacaccacagaagcacgatgccaggcagcgtgggccctcaagtgtacaaggttggcatttatggatggcgcaagaggtgtctgtattttttcgtccttcttttgatgatcctaattctcgtgaatctcgctatgaccatctggatactgaaggtaatgaattttactattgacggaatggggaatctgcggatcactgagaaaggcttgaagctggaaggtgacagcgagtttctccaaccactttacgctaaggaaatccagagcaggccaggcaatgctttgtactttaagtcagcacgcaacgtcacagtgaatattctaaatgatcagacaaaggtactcacccagctgatcactggtcccaaagccgtagaggcatatggcaagaagttcgaagtgaaaaccgtgtctggtaagctcctgtttagcgcggacaataatgaagttgtggtcggtgccgagaggttgcgcgtactcggtgcggagggtactgtgttcccaaagagcattgagacccccaatgtgagggccgacccatttaaggagcttcgcttagagtcccccacacggtcgttggttatggaggcacctaaaggagtcgaaatcaatgccgaggccggtaacatggaagccacgtgtcgtactgagctgcgcttggagtccaaggatggggaagtgcgagatgagaaggacaggtcatccaaatcctattctttcaaccgccctaccctgccaattaccggatag

SEQ ID NO: 239647 - DNA, 771 bp, Artificial Sequence
  Description of Artificial Sequence: Synthetic coding sequence
atgatgccacaggaacagtacactcaccataggtctaccatgcccggaagcgtcggtcctcaggtctataaggttggaatatacggttggcgcaaaaggtgcttatacttcttcgttctgctgcttatgattctcatcctggtgaatctggcgatgacaatatggatcctcaaagtcatgaattttactattgacggtatgggaaacctaaggatcaccgagaaaggactgaaactcgagggcgactcggaatttctccagcctctgtacgccaaggagatccagagcagacctggtaatgccttgtacttcaagtccgccagaaatgtgactgtgaatatactgaacgatcagaccaaagttctcacacagctgataaccggccctaaggctgttgaggcttatggcaagaaattcgaagtcaagactgtgagcgggaagctgttattctccgcagataacaatgaggttgtggtaggcgctgaaaggctgagagttttgggtgctgaaggaacagtatttcccaaaagcatcgagacccccaatgtgcgggctgatcctttcaaggagctccggttagaatcacccacgcgcagtctggtgatggaagctcctaagggagtggaaattaacgctgaggcagggaatatggaggctacctgcaggacagaactgaggctcgagtcaaaagacggcgaggtgagggatgaaaaggataggagtagcaagagttactccttcaatcgccctaccttgcccatcactggatag

SEQ ID NO: 239648 - DNA, 1314 bp, Artificial Sequence
  Description of Artificial Sequence: Synthetic coding sequence
atgcaactgcctcgctggtgggaactgggtgacccttgtgcatggacggggcagggtaggggcacaagacgcatgtccccagccacgaccggaactttcttgctgactgtgtactccattttctcaaaggttcacagcgaccggaatgtgtatcctagcgctggagttttatttgtgcacgtgcttgaaagggagtacttcaagggagaatttccgccttaccctaaaccgggagagatttctaatgacccaataacctttaacaccaacctcatggggtaccccgatcggccaggctggcttcgctatatccagagaactccctactctgacggagtcctgtacggctcgcctacggctgaaaatgtcgggaaacctaccatcatcgaaattactgcatacaaccgcagaaccttcgagacagctagacacaatttgataattaacatcatgtctgccgaagattttcccttgccctatcaagcggagttcttcattaaaaacatgaatgtggaggagatgctagcatcggaggtactcggtgatttcttaggggcagtgaaaaacgtgtggcagccagagaggctgaacgcgattaatattacctccgcactcgacaggggaggaagagttcccttgcccattaacgacttgaaagagggagtgtacgtgatggtcggagcagacgtgccattttcatcgtgcttacgggaggtggagaatccacagaaccagctcaggtgtagtcaggagatggagcctgtcatcacttgcgacaaaaagttccgaacccaattttacatcgattggtgtaagattagtctggtagacaagacgaaacaagtgagtacatatcaggaagtgatccgtggtgaaggcatactcccggacggtggagagtacaaaccgccaagcgacagtctgaagtcaagagattactatacagacttcctcatcaccctggctgtcccatctgccgtggcactggtgctcttccttatactagcctacataatgtgttgcaggcgcgagggcgtggagaaacggaacatgcaaactcctgacattcagttggtgcaccatagtgctattcagaagagcactaaagaactgcgagatatgtcgaaaaacagggagatcgcctggccacttagtacgctgccagtattccaccccgtgacaggggagatcatccccccactgcacacagataattacgactcgactaacatgcctctgatgcagacccagcagaacctcccgcatcagacgcagatcccacagcagcagaccacagggaaatggtatccatag

SEQ ID NO: 239649 - DNA, 1416 bp, Artificial Sequence
  Description of Artificial Sequence: Synthetic coding sequence
atgcagctgcctcgttggtgggagcttggcgacccttgcgcttggaccggtcagggaagaggcacacggaggatgtcccctgctaccactggcaccttcctcctcacggcctttttgttatcgtgcgcagacggaattaacgggactgtgaactggaaaactcggcaggctaacaactttatcattagtcgcaaaatggcagccggaatgaaggacgtctactccatcttcagcaaagtccactctgacaggaatgtttacccgtctgctggcgtgttgttcgtgcatgttttggaaagagagtattttaaaggagaattcccaccatacccgaaacctggagagatttccaatgatccgatcacattcaatacaaacctgatgggttacccagaccgccctggatggctaagatacatccaacgtacaccatacagcgatggagttctatacggatctccaacagccgaaaacgtgggcaagcctactatcatagaaataaccgcatataaccgcaggaccttcgagaccgctcgtcacaatctgattattaatataatgtctgctgaggattttccacttccttatcaggccgagtttttcatcaagaatatgaacgttgaggaaatgctggctagcgaggtgctgggagatttcttgggagccgttaaaaatgtctggcagccagaaagactgaacgcaatcaatattacatcagccttggaccggggaggacgggttcctctgcccatcaatgatctcaaggagggggtatatgtgatggttggtgccgacgtgcctttctcgtcctgtctgagggaggtggagaatccacagaatcaactgagatgtagccaggagatggagcccgtgataacgtgtgataaaaagttcaggacccagttctacatcgattggtgcaaaatttctttagtggataaaaccaagcaggtgtcaacgtaccaggaggtgattcgaggggaaggtattctgccagacggaggagagtacaagcctccttcagactcattgaagtcccgtgactattatactgacttcctaatcactctcgccgtcccctctgccgtcgcattagtgctttttctgatcctggcctacatcatgtgttgtcgtcgggaaggagtcgagaaacggaatatgcaaacacccgatatccaactggtccatcactctgccatccaaaaatcaaccaaggagctacgcgacatgagcaagaatagagaaatcgcctggcccctgtcgaccctcccggtttttcaccctgtgacgggagaaatcatccccccactccacaccgataactacgacagcacaaatatgcctctgatgcagacgcagcagaatctgccccaccaaacccaaataccacagcaacagaccaccggcgaatgctag

SEQ ID NO: 239650 - DNA, 1356 bp, Artificial Sequence
  Description of Artificial Sequence: Synthetic coding sequence
atgcagttgcctcgctggtgggagctgggcgatccgtgcgcttggaccggccagggacgcggaacaagacggatgtcccccgcaactaccggcacgtttctgctgaccgtgtactccattttcagcaaggtacactccgaccgtaacgtctacccgtccgcaggtgtgctgtttgtgcacgtgctggagagagagtacttcaagggagagtttccaccgtaccctaaacccggtgaaatttccaacgaccctatcaccttcaacacaaatctgatggggtatccggatcgaccagggtggttgcgatacatccagaggacgccctactccgacggcgtgctgtacggttctcccactgcagaaaatgtgggaaagcctacaattatcgaaatcacagcttacaatagaagaactttcgagaccgcaagacacaacttgatcatcaatattatgagcgccgaagatttccccctcccttatcaggcagaattctttatcaagaacatgaacgttgaggagatgctagcatccgaggtcttgggcgattttttgggagcagtgaagaatgtttggcagcccgagcggttgaatgcaataaatatcacctccgcactggaccgcggtggaagggttccactccctataaacgaccttaaggaaggcgtttacgtgatggttggcgcagatgtacctttttctagttgtctgcgggaggtggagaatcctcagaaccaattgagatgctcccaggagatggagcccgttattacatgtgataagaagtttcggacccagttctacattgattggtgcaaaatttccctggtggataagactaagcaagtatccacttaccaggaagtgattaggggagaaggcatcctcccagatggcggagagtacaagcctcccagtgacagtctcaagagccgcgactactatactgatttcctcataaccctggcagtgccaagcgcagtggccctggtactgttcctcattcttgcatatatcatgtgttgtcgccgagaaggagtcatacaactggtgcatcactcagctatccagaaaagcactaaggagctgagggatatgtctaaaaaccgcgaaatcgcttggcccctgtcaactctccctgtctttcatccagtaactggcgagatcataccccctctccacaccgacaactacgactccaccaacatgcctttgatgcagacccaacagaacctgccacaccagactcagattcctcaacagcaaaccaccggggactttcgactcacaacctttcagagatttgaagtcaacggcatccctgaggaacgtaaactgaccgaagccatgaacctttag

SEQ ID NO: 239651 - DNA, 1389 bp, Artificial Sequence
  Description of Artificial Sequence: Synthetic coding sequence
atgcaattgccccgttggtgggaactgggcgacccatgtgcctggactggacaaggcagaggaactagacgaatgtcccccgctacaactggaacgtttctgctgacagtgtattccattttttccaaggtgcattccgacagaaacgtgtatccatccgccggagtcttgtttgtgcacgttctggaacgagaatatttcaaaggcgaatttccaccgtatccaaaacccggagaaatcagcaatgatcctataacatttaatacgaatcttatgggttatccagatcgaccaggatggctgcggtacattcagcgaactccttacagcgacggagtgctctacgggtcaccaactgctgagaacgttgggaagccaaccatcatagagattacagcctacaacaggcgaaccttcgagacggccagacataatcttatcattaatatcatgagcgcagaggattttccgctcccctaccaggctgagttttttataaaaaacatgaatgtcgaagagatgctagcgagcgaagtattgggtgactttctgggggcagtaaagaacgtttggcagccggaacgcctgaacgcaataaacatcacatctgccctcgacagagggggacgcgtgccactccccatcaacgacttaaaagaaggagtgtatgtcatggttggagctgacgttccgttttcatcttgcctccgagaagtcgaaaatccacagaaccagctccgctgcagccaagagatggaaccggtaattacttgcgacaagaaattccggactcagttctacatcgactggtgtaaaatttccctcgttgacaagactaagcaagtgagcacctaccaagaggtgataaggggcgaaggtatcctgcccgatggaggggaatacaaaccacccagtgattctctgaagtctcgggattactacaccgattttctaataactctggctgtgcccagcgcagtggccctggtgcttttccttatcctcgcctatattatgtgctgtcgacgggaaggtgtggaaaagcgcaatatgcagacaccagacatacaactcgtgcaccattcggcgatccagaagtccacgaaggagctacgggatatgagtaaaaatcgggagatcgcctggcctctttctacattacccgtttttcaccctgtgaccggggaaatcattccacccctccacacagacaactatgactcgactaatatgccgctgatgcagacccagcaatggtcctttgccccagttgctcaggccggagttcagtggtccgaccttggttccctgcaacccccaccacctagaaatcttcctcaccagactcagatcccacagcagcagacaacaggcaagtggtacccgtag

SEQ ID NO: 239652 - DNA, 2118 bp, Artificial Sequence
  Description of Artificial Sequence: Synthetic coding sequence
atgaccgataacagcaacaaccagttagtggtgagggccaagttcaacttccaacaaaccaatgaggacgaactgtcattctcaaagggtgacgtcatacatgtgacaagagttgaggagggcggatggtgggagggaacattgaacgggagaaccggttggttcccatcaaactacgttagagaggttaaagcaagtgaaaagcctgtttctccaaagtccgggaccctaaagtccccacccaaaggcttcgatacaactgcaattaacaagtcttactataatgtggtgttgcaaaacatcctcgagactgaaaacgaatactccaaagaattacagaccgttttgagcacttacctgcgaccgcttcagactagcgaaaagttatctagcgcaaatatttcctacctgatgggcaaccttgaagagatttgcagcttccagcagatgcttgtccaatcccttgaggagtgcacgaaactccccgaggctcagcaaagagtgggtgggtgcttcctgaatttgatgccacagatgaaaaccctctacctgacttactgtgccaaccacccgtccgccgtcaacgttctgaccgagcactccgaggagcttggggaattcatggaaacaaaaggtgcatcctctcccggaatccttgtgctgacgacaggactctcaaagccattcatgcgcctggataaatatcccacattgttaaaggagctggagcgacacatggaagactatcacacagacaggcaggacattcagaaatccatggcagccttcaagaacctcagcgcccagtgtcaggaggtgaggaaacggaaagagctagaattgcagatcctgaccgaagctatcaggaattgggagggcgacgacataaagacgttgggtaatgtcacctacatgagccaagtcctgatccagtgcgccggttccgaggagaaaaacgagcgatacttattactgttccccaacgtgttactcatgctaagcgcctcacccagaatgtccgggttcatataccaagggaagttgcccaccactggaatgaccataaccaaactcgaagattccgaaaaccacagaaatgcatttgagatctctggctcaatgatcgagaggatcttggttagctgcaacaaccaacaggacctgcaggagtgggtggagcatctccaaaaacagacaaaagttacttctgtggggaatcctaccatcaaaccacattcagttccatcccacactctcccttcacaccccgttactcctagtagcaagcatgcagactcaaaacccgctccgctgacccccgcatatcacaccctgcctcacccttcccaccacggcacaccccacactacaataaactggggcccactcgagcccccaaaaacgcctaaaccctggagtctcagctgtttgaggccggctccgccactgcgcccaagtgccgctttatgttacaaagaagatctgtcaaaaagtcccaagactatgaaaaaactcctgcctaaacgaaaacccgagagaaagccctcggatgaggaattcgcatctcgcaagagcaccgctgctctggaagaggatgctcagattctgaaagtgatcgaggcgtactgtacaagcgctaagacccgacagactctcaacagtacatggcaggggacagacctcatgcacaaccatgtcttagccgacgacgaccaaccttcactggatagcctcgggaggcgttccagcctatctcgtctggagccatccgacctttcagaagatagtgactatgacagcatttggacagctcatagctatcgcatgggtagcacaagccgttcaagaaaagaatctgctcctcaggttcttctgccggaggaggaaaagatcatcgttgaggagactaaaagcaacggtcagactgtgatagaggaaaaaagcctggtagatacagtgtacgccctgaaagacgaggtgcaggagcttcgacaggataataaaaagatgaaaaagtctctggaggaggagcaacgcgctcgcaaagatctggagaagctagtgaggaaggtgctcaaaaacatgaacgaccccgcttgggacgaaaccaatctgtag

SEQ ID NO: 239653 - DNA, 876 bp, Artificial Sequence
  Description of Artificial Sequence: Synthetic coding sequence
atggttcgcgagcagtacactaccgccaccgaaggcatttgtattgagcggcctgagaaccagtacgtttataagatcgggatctacgggtggcggaagcgatgtctttacctttttgtccttttattacttatcattctggtcgtgaatcttgccttaacaatctggattttaaaagtcatgtggttttcacccgctggcatgggccatctatgcgtgacaaaggatggcttaaggctggaaggggagtccgagttcctgttccccctgtacgctaaagagatacactcaagggtagacagttccctgctcctccaatcaacccagaacgtgaccgttaacgccagaaactcggagggcgaggtgaccggacgactgaaggttgggccaaagatggtcgaggtgcaaaatcagcaattccagattaattcaaacgatggcaagcctttgtttacagtggacgagaaagaagttgtcgtaggaactgataagctccgcgtcacaggaccggagggcgcactctttgagcacagcgtggaaacaccgctggttcgagcagacccgtttcaggaccttcgactcgagtcccccacaaggtctctgagcatggacgccccacggggtgtgcatatccaagcacatgccggtaaaatcgaggccctctctcagatggacatcctcttccacagctccgacggcatgctagtgctggacgctgagaccgtctgcctgccaaaactggtgcagggcacgtggggtccctcagggtcctcccagagtctgtacgagatttgcgtttgcccggacggtaagttgtatctcagtgtggcgggagttagcacaacctgtcaggagcacaatcatatatgcctgtag

SEQ ID NO: 239654 - DNA, 876 bp, Artificial Sequence
  Description of Artificial Sequence: Synthetic coding sequence
atggtgcgggagcaatatactacggctactgagggtatttgcatagaacgccctgagaatcagtacgtttataagatcggtatctacgggtggcgcaaacgatgtctatatttattcgtgctgctcctcctaattatattggtggttaacctggctttgactatttggattctcaaggttatgtggttctcccctgccggaatgggccatctatgcgttacaaaagacggacttcgtctcgagggtgagtcagagttcctgttccccctgtacgccaaggaaatccatagcagggtggatagtagtctgctgctgcaatccacacagaacgtgacagttaacgctcgcaacagcgaaggtgaggtaacaggccgactcaaggtgggccctaagatggtggaagtccaaaatcagcaattccagattaattccaacgacgggaagcctttattcaccgtggatgaaaaagaagtcgtcgttggcaccgacaaactacgggtgaccgggcctgaaggcgcactgttcgagcatagcgtagagacccctcttgtcagggccgacccctttcaggacctcaggcttgaatctccgactaggagtctcagcatggacgctcctaggggagttcatatccaggcgcatgccggtaaaatcgaagcccttagccaaatggatattctgttccattcttcggatgggatgctggttctcgacgcggaaactgtgtgccttcctaagttggtgcaggggacctgggggcctagtggctcttctcaaagcctctacgaaatttgcgtgtgtccagacggcaagctttacttatccgtggccggtgtgtccacaacatgtcaagaacacaatcatatttgcctatag

SEQ ID NO: 239655 - DNA, 96 bp, Artificial Sequence
  Description of Artificial Sequence: Synthetic coding sequence
atgggtatcaacacaagggagttgtttctgaacttcactattgtgttgatcacagtgatcttgatgtggcttcttgtcagaagttatcaatactag

SEQ ID NO: 239656 - DNA, 96 bp, Artificial Sequence
  Description of Artificial Sequence: Synthetic coding sequence
atgggtatcaacactagagaactgttcctgaattttaccattgtgctgatcacagttattctgatgtggctcctggtgcgctcctaccagtattag

SEQ ID NO: 239657 - DNA, 96 bp, Artificial Sequence
  Description of Artificial Sequence: Synthetic coding sequence
atgggtatcaacactagggagctcttcttaaattttaccatcgtgttgatcaccgtgatactgatgtggcttttagtgcgatcttaccaatattag

SEQ ID NO: 239658 - DNA, 732 bp, Artificial Sequence
  Description of Artificial Sequence: Synthetic coding sequence
atgggcaaaaataaacagcctagaggtcagcagcggcaaggtggacccccagcggcagatgctgccggaccagatgatatggaaccaaagaagggcacaggagcccctaaagaatgcggggaggaagagccacgcacctgctgcggatgcaggtttccactgctgctggccttgcttcagctggcccttgggatcgctgtgaccgttgttggattcttgatggcctctatatctagctccctcctggtgagggacacacctttttgggccggtatcatcgtctgccttgttgcatacctgggcctgttcatgctgtgcgtgagctaccaggtcgatgaacggacatgtatacagttctctatgaagctgttgtattttttgctgagcgctttgggactaactgtctgcgtgctagcggttgccttcgccgctcaccactactcccagctaacccagtttacttgtgaaactactctggatagttgccagtgtaagcttccctctagtgagcctctgtcacgaacatttgtctatagggatgtcaccgactgcacctctgtaaccggaaccttcaagctgtttctcctgattcagatgatacttaatctcgtatgcggcctcgtgtgtttactggcttgttttgtaatgtggaagcaccgctaccaggttttctatgttggcgttcggatttgcagcctaactgcttctgagggtcctcaacaaaagatctag

SEQ ID NO: 239659 - DNA, 423 bp, Artificial Sequence
  Description of Artificial Sequence: Synthetic coding sequence
atgctgtgcgtatcttatcaagttgacgagcgcacctgtatacaattctcgatgaaactgctttattttttattaagtgccctggggctgacagtgtgcgtgctggcggttgcctttgcagcgcaccactattcccaattaacccagttcacatgtgagaccacacttgattcctgtcagtgcaagcttccatcctcggagcctctgtctcgcacttttgtgtacagagacgtgactgattgtaccagcgtcaccggaacattcaaactgtttctgctgatccagatgattttgaacttggtctgtgggcttgtgtgtctgctcgcttgttttgttatgtggaaacatcgttaccaagtgttctacgtgggagtgagaatttgtagtttaacggctagtgaaggaccccagcaaaagatttag

SEQ ID NO: 239660 - DNA, 654 bp, Artificial Sequence
  Description of Artificial Sequence: Synthetic coding sequence
atggagccaaagaaaggcacgggggcacccaaggagtgtggcgaggaggaacccagaacatgctgtgggtgtcgcttcccattgctcctggccctactgcagctagctctgggcatagccgtgacagtggttggctttcttatggcatccataagctctagcctcctggttcgggatacgccattttgggccggaatcattgtgtgcctggtggcataccttggtctgtttatgctctgtgttagttatcaggtagatgagcgtacgtgtatccagttttcaatgaagttactgtatttcttgctatccgctctaggtcttaccgtgtgtgtcctggccgtggcatttgctgcacatcactactctcagctgactcaatttacgtgtgagacgacccttgatagttgccagtgtaaattaccctcctcagagcctctgtctcgcacatttgtttatagagacgtaacggactgtacctcagtcaccggcacgtttaagctttttctccttatccagatgattctcaacctagtttgcggtctggtttgcctacttgcctgcttcgttatgtggaagcatcggtatcaagtgttctacgtcggcgttcgcatatgtagcctcactgcctccgagggaccgcaacagaagatttag

SEQ ID NO: 239661 - DNA, 387 bp, Artificial Sequence
  Description of Artificial Sequence: Synthetic coding sequence
atggggaagaataagcagccccgaggtcagcagaggcaggggggaccgccagcagccgacgccgctggacccgatgatatggagcccaagaagggcaccggcgcacccaaggagtgcggggaggaggagccccgaacttgctgtggctgtaggtttccacttcttttagccctcctccagctggctcttggaatcgcagtaacggtcgttggcttcctgatggcaagcatcagctcaagcttgctggtgagggatacgcccttttgggccggaatcatagtctgtctcgtggcgtacctcgggttgttcatgctgtgtgtcagctaccaggttgacgagaggacatgtatccagttcagcatgaaaatccattgccatgatttttag

SEQ ID NO: 239662 - DNA, 363 bp, Artificial Sequence
  Description of Artificial Sequence: Synthetic coding sequence
atgctgtgcgtatcataccaggtcgatgagagaacatgtatccaattttccatgaaattactgtactttttactgagcgccctgggccttacggtatgcgtgttggctgtggctttcgcagcacaccactacagccagctgacgcagttcacttgcgaaacaaccctggatagttgccagtgtaagctgcctagctcagaaccgcttagccgtaccttcgtgtaccgggatgttacagattgcacctccgtcactggaacttttaaattgttcctattaattcagatgatcttgaacttggtttgcggtctcgtctgtctcctggcatgtttcgttatgtggaaacatcgctaccaggtttag

SEQ ID NO: 239663 - DNA, 423 bp, Artificial Sequence
  Description of Artificial Sequence: Synthetic coding sequence
atgctctgcgtaagctaccaagtggacgaaagaacatgcatacaatttagtatgaagctgttgtactttttactcagcgccctgggtctgacagtctgcgtacttgccgtggcgttcgcagcccatcactattctcagcttacacagtttacctgcgagacgaccctggattcatgtcagtgtaagctgcccagttcagagcctctgtccaggacattcgtttaccgagatgtgaccgactgcacctcggtgactggcacatttaagttgtttctattaattcagatgatcctcaatctggtgtgcggcctggtctgtctgttggcctgcttcgtgatgtggaagcacaggtaccaggtcttttacgttggggttcggatctgctctctcacagcatcagaaggcccacaacagaagatctag

SEQ ID NO: 239664 - DNA, 2292 bp, Artificial Sequence
  Description of Artificial Sequence: Synthetic coding sequence
atggaccacctcaacgaggcaacccaaggaaaggagcacagtgagatgagcaacaacgtctccgaccctaaggggccaccagccaaaatcgccaggcttgaacagaatgggagccccctcggcagggggaggctaggctcaactggggcaaagatgcagggagtaccgctaaagcacagcgggcaccttatgaaaaccaatctgcgcaagggcaccatgcttcccgtgttctgtgtcgtggaacactatgaaaatgccattgagtatgattgcaaggaggaacatgcagaattcgttctggtacgtaaggatatgttgttcaatcagctcatagaaatggccctgctgtcgctgggctacagccactcatccgccgcacaggcaaaaggtctgatccaggtcgggaagtggaatcctgtgcctcttagctacgtgactgatgcaccggatgcaacagtcgcagatatgctccaggacgtgtaccacgtggtaactctcaaaatacaattgcactcttgcccgaaactggaagacctgcccccagagcagtggagccacaccacagtgcgaaatgcacttaaggacctcctgaaggacatgaatcagtcatcgcttgccaaagagtgtcccctcagccagtccatgatctcctccattgtcaattccacctactacgccaacgtatcagccgcaaagtgccaggagtttggaaggtggtacaaacacttcaagaagacaaaggatatgatggttgagatggacagtctgagtgagttatcccagcagggcgctaaccacgtaaatttcgggcagcagccggttcctggaaacaccgcagagcagcctccttcaccagctcagctttctcacggaagccagccatctgtgcgcacccccttgcccaacctgcatcctggattagtgtccacaccgatctctccccagctagtcaaccagcaactggttatggcacagttattgaaccagcagtatgctgtgaacagactgctcgctcagcagagtctgaatcagcagtacctgaatcaccccccacctgtgagcagaagtatgaataaacctttggaacaacaggtcagcacaaacactgaagtctcttccgaaatttatcagtgggttcgcgacgaattgaagcgggctggaatctcccaggcggtgttcgcacgggtcgcgttcaaccggacccaggggctgttgagtgaaatcttgcgtaaggaagaggatcccaagaccgcatcccagtcactgttggtgaacctgagagctatgcagaactttctacagctgcccgaggccgagcgcgacaggatttaccaagacgagcgggaaaggagccttaatgctgcatctgctatggggcctgctcctctgatctccacccccccatctcgaccaccccaggtgaaaacagccacgattgctaccgaaaggaacgggaagcccgagaacaatactatgaacattaatgcatccatttatgatgagattcagcaagagatgaaaagggctaaggtttcacaggctttattcgctaaagtcgccgctactaaatcacagggctggttgtgtgaattactgcgctggaaggaagaccccagtcctgagaaccgaacattatgggagaacctgtccatgataagacgctttctgagtcttccacagcctgagcgtgacgccatctatgagcaggaatccaacgcagttcatcaccacggcgataggcctcctcacataattcacgtcccagcagagcagatacaacagcaacagcagcagcagcagcagcagcaacagcagcagcaagcccctccacctccacaacctcagcaacagccccagacagggccacgactccctccacggcagcctaccgtcgcttcccccgctgaatctgatgaggagaacagacagaaaactcggccaagaactaaaatatcagtcgaggccctcgggatactgcagtcctttattcaggatgtgggcttataccctgatgaggaagccattcagacgctctctgctcagctcgatctgccaaaatataccatcatcaagttttttcagaatcagcgctattacctgaagcatcatggcaagttgaaagacaatagcggcttggaagttgacgtggccgaatacaaagaggaagagcttctgaaagatctggaagaatccgttcaggacaagaacacaaatactcttttttcggttaaattggaggaagaactgagtgtggaaggaaacacggatataaacacagatctcaaggactag

SEQ ID NO: 239665 - DNA, 351 bp, Artificial Sequence
  Description of Artificial Sequence: Synthetic coding sequence
atggatcacctgaacgaagcaactcagggcaaggaacatagtgaaatgagtaataacgtcagtgatcccaagggccctccagcgaaaattgcccgactcgagcagaatggctcccctctcgggaggggcaggctaggctctacaggtgcaaagatgcagggggtgcccttgaagcacagcggtcacctgatgaagacaaacttgcgtaagggtacaatgttgcccgtcttctgcgtggtggagcattatgagaacgccattgagtacgactgcaaagaggagcacgctgaattcgttctcgtccgaaaagacatgctgttcaaccagctcatcgagatggcacttctttag

SEQ ID NO: 239666 - DNA, 675 bp, Artificial Sequence
  Description of Artificial Sequence: Synthetic coding sequence
atggatcacttgaatgaagccacccaagggaaagaacacagcgaaatgagtaacaacgtgagtgatcccaaaggcccacccgctaagatagcgcgtctggagcagaatggcagccctctgggcaggggaaggctgggatcaactggcgctaagatgcagggggtccctctcaaacactcgggccatttgatgaaaacaaatttgaggaaggggaccatgctacccgtgttctgtgtggtggagcattatgagaacgctatcgagtacgactgcaaagaggagcatgctgagttcgtcctggtccggaaggacatgctgttcaatcagcttatcgaaatggccctcttgtcactcgggtattctcactcttccgctgcccaggctaagggcctcatccaggttgggaagtggaatcctgttccgctgtcatatgtgactgatgcccctgacgccaccgttgccgacatgctgcaggacgtctaccacgtggtgacgttaaagattcagctgcactcatgcccgaagctggaggacttacccccagagcagtggagtcacacaaccgtgcgcaacgctttgaaagacttgcttaaagacatgaaccagagttctcttgccaaagagtgccctctatcacagtcaatgattagctcaatcgttaacagcacctactag

SEQ ID NO: 239667 - DNA, 216 bp, Artificial Sequence
  Description of Artificial Sequence: Synthetic coding sequence
atggaccatctgaacgaagcaacacaggggaaggagcactctgaaatgtcaaataacgtgtcagatccaaagggcccaccagccaagattgcccgactggagcaaaatggatcaccattaggtaggggcaggctgggatctaccggcgcaaagatgcagggcgtccccctcaagcactccggccatctgatgaagacaaatctgcgcaaagggtag

SEQ ID NO: 239668 - DNA, 27 bp, Artificial Sequence
  Description of Artificial Sequence: Synthetic coding sequence
atggaccacctgaatgaagctacctag

SEQ ID NO: 239669 - DNA, 519 bp, Artificial Sequence
  Description of Artificial Sequence: Synthetic coding sequence
atggatcacctcaatgaagcgacccaggggaaagaacattctgagatgtcaaacaatgtctccgaccccaagggtccacctgccaagatagcgagactggagcagaatggatcgcctctaggcagaggacgtctgggctccaccggtgccaaaatgcagggagtgcctctgaagcactcgggacatctgatgaaaaccaacttgcgcaagggaactatgctgccggtgttttgcgtggtggaacactatgaaaatgccatcgagtatgattgcaaagaagagcatgccgagtttgtgctggttcggaaggacatgctgttcaatcaactgatagagatggctttgctgagcttggggtactctcactcaagtgccgcacaagcaaaaggcctgatccaggtggggaagtggaatcctgtacctctgtcctacgtcacagacgcccctgatgccaccgtcgcagatatgctccaggacgtgtatcacgttgtaacgctgaaaatccagttacacagatag

SEQ ID NO: 239670 - DNA, 2292 bp, Artificial Sequence
  Description of Artificial Sequence: Synthetic coding sequence
atggatcaccttaatgaggctacccagggaaaagaacattctgagatgtcaaataacgtaagtgaccctaaggggcctcctgctaagattgcgaggctggagcagaatggctcgcccctggggagggggaggctgggctctaccggggctaaaatgcagggggtcccactcaaacattctggacatctcatgaaaacgaacctgaggaagggaactatgctgcctgtattctgcgttgtggaacactacgaaaacgcaattgagtacgattgcaaggaagagcacgcggagttcgttttggtgagaaaagacatgctgtttaaccagctcatagaaatggcattgcttagcctggggtattcgcattcgtctgcagcacaggccaaaggcctgatccaagtgggcaagtggaatcctgtgccgcttagctacgttacagatgcaccagacgcaaccgtagccgacatgctgcaggatgtgtatcacgtggtgaccctgaagatccagctccattcctgtcccaagttagaggacctccctccagagcaatggtctcacactactgtcaggaacgcccttaaagatttgttaaaggatatgaatcagagcagcctagctaaggagtgcccattgtcacagagtatgataagtagcatagtgaacagcacttattacgctaatgtgtccgctgctaagtgccaagaatttggacggtggtacaagcacttcaagaagacgaaggatatgatggtcgaaatggactcattgagcgagctcagtcagcagggcgcaaatcacgtgaacttcggccagcaacctgtgcccggtaacaccgctgaacaacccccatctcctgcccagctgtcacacgggagccagccctccgtgcggacacctctacccaatttgcatcccggactcgtaagcacccccatttctccccagctggtgaaccagcagctggtaatggcccagcttctgaaccagcaatatgctgtgaaccggctgttagctcagcagagtctaaatcaacagtatcttaaccaccctccacccgtgtctcgctccatgaataagcctctggaacagcaggtcagcacaaatactgaggtgtcttcagaaatctatcaatgggtgagggatgagctgaagagggctggtatttctcaagctgtgttcgcacgcgtcgccttcaatagaacccagggactgctctctgagatcctcagaaaggaggaagatccaaaaaccgcaagccagagcctactggttaatctgagggctatgcagaattttctacagctgcccgaagcagagcgggatcgcatttaccaggatgaacgggagagaagtcttaacgcggcaagcgcaatgggtccagcgcctcttatttccacacccccatctcgtcctccccaggtgaagaccgcaaccatcgccaccgaacgcaatgggaaaccagaaaataatactatgaacattaacgcctcgatatatgacgaaattcaacaagagatgaagagagcaaaggtcagccaggccctgtttgctaaggtggccgctactaagagccagggttggttatgcgagttgctccggtggaaagaagacccaagtcccgaaaaccgaaccctgtgggagaacctgagtatgatccgcagatttcttagtcttccacaaccagagcgcgacgctatttacgaacaggagagtaatgctgtgcatcatcatggtgaccggccaccccacattattcacgtgccagctgagcaaatccaacagcagcaacagcagcaacagcagcaacaacagcagcaacaggcacctcccccacctcaaccgcagcagcagccccagacgggtccaaggctccctcctcgccaacccacagtagcatcaccggcagagtctgatgaggaaaaccggcagaaaacccgccctcgcaccaaaattagcgtggaggccctggggatactgcagagctttatacaggatgtaggactgtatccggatgaagaggctattcagactctcagcgcgcagctcgatctgcccaagtacaccatcatcaaattcttccagaaccaacgctattacctgaaacatcacggcaagctcaaggacaactccggtctagaggtggacgtagccgaatacaaggaggaggaactactcaaggatttggaggaatccgtacaggataagaacacgaatactctgttcagtgtgaagctagaggaagaattgagcgttgagggtaacacggacatcaacacggacctgaaagattag

SEQ ID NO: 239671 - DNA, 393 bp, Artificial Sequence
  Description of Artificial Sequence: Synthetic coding sequence
atggaccacctgaacgaggctacccaaggcaaggaacacagcgaaatgagcaataacgtttccgatcccaaaggccctcccgctaaaatcgcacggcttgaacaaaatgggtccccactgggtcgcggaagactggggagtactggggctaagatgcaaggtgtgcccttaaagcacagtgggcatctgatgaaaactaaccttagaaaaggtacgatgttgcccgttttctgcgtagttgagcactacgagaacgctatagagtacgactgtaaggaggagcacgctgaattcgtgttagtccgaaaggatatgctgtttaatcagctaattgagatggctctactgagccttgggtactcccattcttcggccgcacaggccaaaggttag

SEQ ID NO: 239672 - DNA, 2388 bp, Artificial Sequence
  Description of Artificial Sequence: Synthetic coding sequence
atggaccacctcaatgaggctacacagggcaaagagcactctgaaatgtcaaataacgtctccgaccctaagggacctccggctaaaattgcccgtcttgagcagaacggttcccccctcgggaggggtagactgggctccactggcgctaagatgcagggcgtcccccttaagcatagtgggcatctgatgaagacgaacttgcggaagggaacaatgttacctgtgttttgcgtggtggaacactacgagaatgcaatagaatatgattgcaaagaggagcacgcagaatttgtgctagtgcgcaaagatatgctctttaaccagctcatcgaaatggctctgttgagccttggatattcccattccagcgccgctcaggccaagggactcatccaggtgggcaagtggaatcctgttcccctgagctacgtgaccgatgcccctgacgcgacagtagcagacatgctccaggacgtataccacgttgtcaccctcaaaatccagctgcactcctgtcccaaattggaggacctgcctcccgagcaatggtctcacaccacggttcgaaacgcgctcaaggacctcctgaaagacatgaatcaatcaagtttggctaaggagtgtcctctgtcccagagcatgatctcttctattgttaacagcacatattacgcaaacgtgtctgccgctaaatgtcaggaattcggtcgctggtacaagcacttcaagaagactaaagacatgatggtagagatggattcactgtcagaactgagccagcagggggcaaaccacgtgaatttcggccagcagccggtgcccggaaatactgccgagcaacctccttctcccgcacagctgtctcatggcagccagccatctgtccggacccctctccccaacttgcatcccggtctggtgtctacccccatttcaccccagttagtgaaccaacaactagttatggcgcagcttttaaatcaacaatatgcagttaaccgtctgttagcacaacaaagcctaaatcagcagtaccttaaccacccaccgcctgtgagtagatctatgaataagcccctggagcagcaggtttccaccaatactgaggtctcttccgagatctaccagtgggtgagggatgagctgaaaagagccggaatctctcaggccgtcttcgcacgggtggctttcaacagaacacaaggattattatccgagatcttgcggaaggaagaggaccccaagactgcaagccagtcgcttcttgttaatctcagggcaatgcaaaactttctgcagctcccagaagctgaacgcgacaggatctatcaggatgagagagaacgcagtctgaatgctgcatctgctatggggccagctccactgattagtacaccaccaagcaggcctcctcaggttaagacagccaccatcgctaccgaacgtaacggcaagccagaaaacaatactatgaatataaatgcctctatctatgatgagatccagcaagaaatgaagagggccaaggtcagtcaggcgttatttgcgaaagtggcagccaccaaatctcagggatggctgtgcgagttgttgcgttggaaagaggacccttctcccgagaatagaacactatgggagaacctttccatgattcggagattcctaagcctccctcagccagaaagagatgctatctatgaacaggagtccaatgccgtccaccaccacggtgatcgacctcctcacataatccatgttcccgctgagcagattcagtcccctagcccgacaaccctggggaagggcgagtctcgcggagtctttctgccaggcttacctactcctgccccatggctgggggctgcgcctcagcaacagcagcaacagcaacagcagcagcagcagcaacagcaggccccacctccgcctcaaccccaacagcagccccagactggccctaggctgccccctaggcagccaacagtggcatcgcctgcggaatcggatgaagagaaccggcaaaagacaagaccccgaaccaagattagtgttgaggcactgggaattttgcaatccttcatccaggatgtgggattgtacccagacgaggaggcaatccagacgctgagtgcccagctggacctgccgaagtatacaatcatcaaattctttcagaatcagcgctattacctgaagcaccacggcaaacttaaggataattccggattggaagtggacgtcgcagagtataaggaggaagaactgctcaaagacctcgaagaatctgtgcaggataaaaacaccaatacattgtttagcgtaaaacttgaagaggaactgtccgtggagggaaatacagacattaatacggacctgaaagattag

SEQ ID NO: 239673 - DNA, 2202 bp, Artificial Sequence
  Description of Artificial Sequence: Synthetic coding sequence
atggagcgcaggagcgaatctccctgtctgagggatagtcccgatcgtcgctctgggtcgcccgacgtcaaaggaccgccacctgtcaaagtcgctagattggagcaaaatggaagtcccatgggggctcgaggcagaccaaacggggctgttgccaaagctgttggaggtctcatgattcccgtgttttgcgtggtggagcagttagatgggagtctggaatacgacaatcgagaggaacacgccgagtttgttctggtacgtaaggacgtcctcttttcgcagctcgtagagacggccttacttgcacttggatactcccactcgtctgcagctcaagcccaaggtattatcaaattggggaggtggaacccactgccactgagctatgtgaccgatgcacctgacgccactgttgcagacatgttgcaggatgtctaccatgtggtgacactgaagatccagctgcagagctgcagcaaactcgaggaccttcctgctgagcaatggaaccatgcaacagtcagaaatgcactgaaggaacttttgaaagaaatgaatcaatccaccctggcaaaagagtgccctctctcgcagagcatgatatcaagcatcgtgaactccacctattacgcaaatgtcagcgcaacaaaatgccaggaattcgggcgttggtataaaaaatacaagaagatcaaggtagagagggtggaacgcgagaacctgagcgactattgtgtgctgggccaaaggcctatgcatcttcccaatatgaatcagttggcaagcctgggaaaaaccaatgagcagtccccccacagtcagattcaccacagtacacctataaggaatcaggtgcctgcactccaacctatcatgtccccaggcctcctcagcccccaactgtccccgcagctggtgcgccagcagattgccatggcccacctcattaaccaacagattgccgtgtcccgcctgcttgcacaccagcatcctcaggcaatcaaccagcagttcctcaatcacccccctatccctagggccgttaagccggagcccaccaatagctctgtagaagtttcgcccgacatataccagcaagtgagggacgagctcaagcgcgcttcagtttcacaggctgtttttgctagagtcgccttcaacagaacgcagggtctgctctccgaaattctccgcaaagaagaggaccctaggacagcctctcaatccctgctcgtgaatctccgcgcaatgcagaacttcctgaatctaccagaggtagagcgtgatagaatctatcaagatgaacgcgaaaggagcatgaatccgaacgtttcaatggtcagctccgcatcctcctccccatccagctctcggacacctcaggcgaaaacatctacccccactacagacctccccataaaggtggatggggctaatatcaacattacggcagctatttacgatgaaatacagcaggaaatgaagagggccaaggtgtcacaggctctctttgcgaaagtcgcagccaacaaaagccaaggttggctctgcgagctgcttaggtggaaagagaacccctctccagagaataggactctttgggaaaatctctgtacaataagacggttcctgaacttgccccagcatgaacgggatgtcatctacgaggaggaatcccgccatcaccattcagagagaatgcagcacgtggtgcagctgccccctgagccggtgcaagtgctgcacagacaacagtcacagcctgccaaggaatcaagccctccacgcgaggaagcgccacctccccctcctcccaccgaggacagctgcgctaaaaagcccaggagcaggactaagataagccttgaagcgttgggcattctgcaatcctttatccatgacgttggactctaccctgatcaggaagcaatccatacactatctgcccagctcgacctgccgaagcatacgatcataaagttctttcagaaccagaggtaccatgtgaaacatcacggcaaactcaaggagcacctcgggtccgccgtggacgtggcagagtacaaagacgaagaactgcttacggagtcagaggaaaacgactcagaggaaggcagcgaggaaatgtataaggtagaagcagaggaagaaaacgcggacaagagtaaggcagctccggctgagatagaccagcggtag

SEQ ID NO: 239674 - DNA, 2202 bp, Artificial Sequence
  Description of Artificial Sequence: Synthetic coding sequence
atggagcggaggtccgagagtccttgcttgcgagattcccctgatcgcagatcaggttcacccgatgtgaaggggcctcccccagtaaaggtcgcccgtctggaacagaacggctccccgatgggcgcaagaggtaggcccaatggggctgttgcgaaggcagtaggaggactgatgattccagtattctgcgtggtggagcagttagacgggagtctggagtatgataaccgcgaggaacacgctgagttcgtgctcgtgcgtaaagacgtactcttctcccagctggtcgaaactgccctcctagcactgggatactctcattccagcgccgctcaagcccaaggtatcatcaaacttggcaggtggaatccactcccattatcatacgtgacagatgcccctgatgctacagtcgcggatatgttacaggatgtgtatcatgtcgtcaccctgaagatccaattgcaatcttgttctaaactcgaggatctcccggcagagcagtggaatcatgctactgtcagaaatgccctaaaagaactgttgaaggagatgaatcagtcaacactcgccaaggagtgccccctttcacagtcaatgatcagctcaattgtaaactcgacttactacgcaaatgtgtctgccacaaaatgtcaggaattcggcaggtggtacaaaaagtacaaaaagataaaggttgaacgtgtagaacgtgaaaatctgtctgactactgtgtgctgggtcagcggcctatgcacctgcccaatatgaaccagttagcatctttaggcaaaaccaatgaacagtctccacatagtcaaatccatcattccacacccataaggaaccaggtgcctgcccttcagcctatcatgtctcccggtcttctctctccacagctaagtccccagctggtcagacagcagatcgctatggctcacctgataaatcagcaaattgcagtgtctcgtctgctggcccatcagcatccacaagcgataaatcagcagttcttgaatcaccctcccattccaagagctgttaagccagaaccaaccaattcctctgtggaggtcagtccagatatataccaacaggtccgcgacgagctgaagcgtgccagcgtgagccaggcagtatttgccagagtggcctttaaccggactcaaggcttgctttctgaaatcctcagaaaagaggaggacccacgaaccgccagccagtctctcctggtcaacttacgcgctatgcagaattttttaaacctgcctgaggttgaaagagacagaatttatcaggatgagcgggagaggtctatgaatcctaatgtcagcatggtgtcctctgcttcctcttcacccagcagcagccggaccccccaagcaaaaaccagcacccctactacggacctgccaattaaggtggatggtgccaatatcaacatcactgctgctatatatgatgaaattcagcaggagatgaagagagcaaaggtgagtcaggcccttttcgcaaaggtggccgctaataagtcgcagggatggctgtgcgagcttcttagatggaaagagaatccatcccccgagaaccgcacactctgggaaaatctttgcacaatccgtcgctttcttaatctccctcagcatgagcgcgatgtcatatatgaggaggagtcccgacatcaccattcggagcggatgcagcatgtcgtgcagttaccccctgaacccgtgcaggtattgcacaggcagcagagccaaccagcaaaggaaagtagtcctcccagggaggaggcaccacccccaccaccaccgactgaagactcatgtgcgaaaaaacctagaagtcgcactaaaattagtttagaagccctgggcatccttcagtcttttatccatgatgtgggtctctaccccgaccaggaggcaattcacaccttaagcgcacagttggacctgccgaagcacacaatcatcaaatttttccagaaccagaggtaccacgttaaacaccacggaaaactgaaagagcatctgggtagcgccgtggacgtggctgagtataaagacgaagagctgctaactgaaagcgaagaaaatgatagcgaagagggctccgaagagatgtacaaagtcgaagctgaggaggagaatgccgacaaaagcaaggctgcccctgccgagattgaccaaagatag

SEQ ID NO: 239675 - DNA, 1848 bp, Artificial Sequence
  Description of Artificial Sequence: Synthetic coding sequence
atggaacgacgctcagagagcccctgcctcagagatagccccgacaggagaagtggctctcctgacgttaaaggcccacctcccgtgaaggtggccagactcgaacagaatggatccccgatgggagcacgcggaaggcctaatggagcggttgcaaaggccgtcggaggcctgatgatcccagtcttttgtgtcgtggagcagttagacggctcgcttgaatatgacaatagagaagagcacgccgaatttgttctggtgagaaaggacgttcttttctctcagctcgttgaaaccgccctcctggccctcggttattcccattcaagtgctgctcaggctcaggttgagcgtgtggaacgcgaaaatttgtccgattactgcgtgctgggacagcgccctatgcacctgccaaacatgaatcagctggcctctctcgggaagacaaatgaacaaagtccccacagccagatacaccacagcacgcccatccggaaccaagtcccggctctacagccaatcatgtcccccggattactgagccctcaacttagtcctcagcttgtcaggcagcaaatagctatggctcacctaatcaatcagcagatagccgtttcccgcttactggcacaccagcacccccaggccattaaccaacagttcttaaatcacccacctattcccagagcagtgaagccagagccgaccaattcatcggtcgaggttagcccagacatctatcaacaagttcgcgatgagctgaagagggcaagcgtgagccaggctgttttcgctcgcgttgcctttaatcgaacacagggacttctcagcgaaattctcaggaaggaggaggatcctagaaccgctagtcagtccctcctggtaaatctgagggccatgcagaatttcctcaatctgcctgaagtcgagagagataggatctaccaagacgaaagagagcggagtatgaatcctaatgtttccatggtctcctcagcttcgtcttcaccttcctccagcaggactccccaggctaaaacaagcaccccgacaacggatctgcctatcaaggttgatggtgccaatatcaatatcaccgcagccatctatgatgagattcagcaggagatgaaaagggcaaaagtgagccaggcattgttcgctaaggtggctgccaacaaatcgcaaggttggctctgcgaattactgaggtggaaagagaatccctcacctgagaaccgcacgttatgggagaacttgtgtactattcggcgatttctcaatctgccccagcatgaacgcgacgtcatttacgaggaggaatcccggcatcatcacagcgaacgcatgcagcacgtcgtgcagctgccaccggagcccgtgcaggttctgcaccggcagcagtcccagccagccaaggaaagttccccaccgagggaggaagctcctcctccaccaccgccaacagaagattcttgcgctaaaaaacctcgatccaggactaagatatccctcgaagctctgggaatccttcaatcttttattcacgatgttgggctgtatccggaccaggaagcaattcacacactatctgcacaactggacctgccgaagcatacaattattaaatttttccagaatcagcggtaccacgttaaacatcatggaaagttgaaggaacacctgggcagcgcggtggacgtggctgagtataaagacgaggaactgctcacagagagcgaggagaacgattcagaggaaggctccgaggagatgtacaaagttgaggccgaagaagagaatgcggataagagcaaagcggcacctgctgagattgatcaaaggtag

SEQ ID NO: 239676 - DNA, 2202 bp, Artificial Sequence
  Description of Artificial Sequence: Synthetic coding sequence
atggagcgccgaagcgagtcaccgtgcctgcgcgatagtcccgaccgcagatcagggagccccgatgtaaaaggacccccacccgtcaaggtagccaggcttgagcaaaatggctcccccatgggggctcgagggaggcctaatggggctgttgccaaggctgtggggggtctcatgataccagttttttgtgttgtggagcagcttgacggctccctggagtacgacaaccgtgaggagcatgccgagttcgttctcgtgcgcaaggacgtgttgtttagtcagttggtagagactgccctgctggcattggggtactcccattcatctgcagctcaagcccaggggattatcaagctgggacgctggaatcctcttcctcttagctatgtcaccgacgctcctgacgctacagtagcagacatgcttcaggatgtgtaccacgtggttactctgaagattcaattacaatcatgtagcaaactggaggatcttcccgcagagcagtggaatcacgccaccgtgcggaacgcccttaaggagctcctgaaagagatgaaccagagcacgctcgccaaggaatgccccctgtcacagtcaatgatttcttcgatagtgaactctacttactatgccaacgtaagtgctacgaaatgccaggagtttggtaggtggtacaaaaaatacaagaagatcaaagtggagagggttgaacgcgagaacctgtcagactactgcgtgctgggccagcggccaatgcatttgccaaacatgaatcagctggcgagccttggtaagaccaacgaacagagcccccatagtcaaattcatcactcaacgcctattcgcaaccaggttcccgctctgcaacctatcatgagccccggattgctaagccctcaactcagccctcagctggtccggcagcaaatcgcgatggcgcacctgatcaaccagcagatcgcggttagtcgtctcctcgcgcatcagcacccccaggccataaatcagcagtttctgaatcacccgcctatccccagggcagtaaaaccagaacctacgaacagttctgttgaagtcagcccagacatttatcaacaggtgcgcgatgagctaaaaagagcttccgtctcacaggctgtgtttgccagagtggcatttaacagaacacagggcttgctaagcgagatcctgagaaaagaggaggatccacgaacggcctcccaatccctcctggtgaatcttagggcaatgcaaaatttcctgaatcttccagaggtggagagggatcgaatatatcaggacgagcgtgagagatcgatgaaccccaacgtcagcatggtgtcgtctgcaagctcctctccctccagcagcagaacgccacaggctaaaacatcaacgcctaccaccgacttacccatcaaagtggatggcgcaaacatcaacattaccgccgctatatacgacgagatccagcaagagatgaaaagagctaaagtctctcaagctctcttcgctaaagttgccgcaaacaaatcccagggttggctttgcgagctgttgcgctggaaagagaatccatccccagagaacaggacactctgggagaacctgtgtacgatcagacggttcttgaaccttccccagcacgagcgcgatgtgatctacgaagaggagtcacggcatcatcacagtgaacgcatgcagcacgtcgtccagctgccacccgagccagttcaggtcctccatagacagcagtctcagcctgcgaaggagtctagccctcctagagaggaagccccaccaccacctcctccaactgaagactcctgcgctaagaagccaagatctcggacaaaaatctccctggaggccctcggaatactacagtcctttattcacgacgtggggctgtatcccgaccaggaggcaattcataccttgtctgcccagctagatctccctaagcacacaatcattaagttcttccaaaatcagcgttaccatgtgaaacaccacggcaaactcaaggagcacctcgggtccgcagtggacgtggccgagtacaaagatgaagagctgcttactgagtctgaggaaaatgattcagaagaagggagtgaagagatgtataaggtcgaagctgaggaagagaatgcagacaaatccaaggctgcaccagccgagattgaccagagatag

SEQ ID NO: 239677 - DNA, 2748 bp, Artificial Sequence
  Description of Artificial Sequence: Synthetic coding sequence
atggcggaaacactgtccggcctgggagacagcggtgctgctggcgctgccgctttatcaagtgcttctagtgagactggtacccggagattatctgacctcagagtcatcgacttgcgcgcagagcttaggaaaaggaatgtggatagcagcgggaataagtccgtgctgatggagagactgaagaaagcaatcgaagacgagggaggcaacccggatgagatcgagattacctctgaggggaataagaagacttctaagcgtagttctaagggcaggaagcccgaggaggaaggggtagaggacaatggccttgaagagaattccggcgacggacaggaagacgtggagactagccttgagaacttacaggacatcgatatcatggacatcagtgtcctggatgaagcggagattgacaacgggtctgtggccgactgcgtcgaggacgacgatgcggacaacctccaagagagcctttctgacagccgggaacttgtcgagggagaaatgaaggagttgccagagcagctccaggaacacgcgatcgaggataaggaaactatcaacaacctggatacaagttccagcgattttacgatcctccaggagatcgaagagccctccctcgagcctgaaaacgaaaagatcctggacatcctgggcgagacttgcaagtcagagccagtgaaggaagagagcagcgaacttgaacagccgtttgcccaggacacgagctccgtggggccagatcgtaaactggcagaggaggaggatctcttcgactctgcgcaccccgaggaaggtgacctcgacctggcctcagagagtacagctcacgcccaatctagcaaagcagactcactgctagcagtggtgaaacgcgagccagccgagcaaccaggcgatggagagcgcactgattgtgagcccgtcggtttagagcctgctgtcgagcagtcaagtgctgctagtgagctagcagaggcctctagtgaggagctggcggaagcaccgaccgaggctccttccccagaggcacgagattctaaagaagacggcagaaaattcgacttcgatgcatgtaatgaggtgcctcccgcaccaaaggaatcatccacaagcgaaggcgctgaccaaaaaatgtcaagccccgaagacgatagtgacactaaacggctgtcaaaagaagagaagggcagaagcagttgcgggcgaaacttctgggtaagtggactgtccagtaccaccagggccactgacctgaagaacctgttcagcaagtacggaaaagtggtgggtgctaaagtggtcacaaatgccagaagcccaggcgctaggtgctatggcttcgtgacaatgagtaccgcagaagaagcaactaagtgcataaatcaccttcataagaccgagctgcacggaaagatgatatccgtggagaaggcgaagaacgaacctgtagggaagaagaccagcgacaagagagactccgatgggaagaaggaaaaaagcagtaatagcgatcgcagcacgaaccttaagagggatgataaatgtgacaggaaagatgatgcaaagaagggggacgatgggtccggtgagaaaagcaaggatcaggatgaccaaaaaccaggaccatccgaacggtctcgtgctaccaagtcaggctctagaggtacagaaaggaccgtggttatggacaagagcaaaggagtacctgtgatcagcgtcaagacctcagggagcaaggagcgcgcttctaagtctcaggacagaaaatctgctagcagagagaagaggtctgtggtcagttttgacaaagtgaaagaaccacgaaagtctcgggactccgagtctcactcacgcgtacgcgagcggtctgaaagagagcagcgcatgcaggcgcagtgggaacgggaggaacgcgagaggctggaaattgctagggaacgcctggccttccagcggcagagattagagcgcgagcgcatggaacgagaacgcctggaacgggagcgaatgcatgttgagcatgagcggaggcgcgagcaggagcggatacaccgagagcgtgaggagctgcggagacagcaagaactgcggtacgagcaggaaaggaggccagcagtgcggcgaccttacgacctggaccgcagggatgatgcctactggccagaagcgaagcgagcagcgctggacgaacgctaccactctgacttcaatcgtcaggatagatttcacgactttgaccaccgagatagagggcgttaccctgatcattccgtcgacagaagagagggatctcgttccatgatgggcgagagagaagggcagcattatcccgagcgacacgggggaccggagcgccatggcagagactcgcgcgatgggtgggggggttacggatccgataagcgcatgtccgaaggaagaggtttgcctcccccacccagaagggactggggagatcacggccgtagagaggacgacagatcctggcagggaacagctgatgggggaatgatggaccgggatcataagcgttggcagggcggagaacggtccatgtcaggtcactcgggacctggtcacatgatgaacaggggcggtatgtcagggcgaggatcctttgccccaggcggagcaagcaggggtcaccctattccccacggaggaatgcagggtggctttggaggacaatcaagggggagcagacctagcgatgccagatttacacggaggtactag

SEQ ID NO: 239678 - DNA, 2244 bp, Artificial Sequence
  Description of Artificial Sequence: Synthetic coding sequence
atgaaagaactgcctgaacagctccaggaacatgcaatagaagacaaagagacgatcaacaatttagatacatcaagtagtgacttcaccatcctgcaggagatcgaggagccctctcttgagcccgaaaacgaaaagattctggatattctgggagagacatgtaaatcagaacccgtgaaagaagagagcagcgaacttgagcaaccgtttgctcaagatacatcatcagtagggccagatcgaaaattggctgaggaggaagacttgtttgactcggcccatccagaagaaggggacctcgacttggcatctgagagtactgcacatgcccagagttcgaaggccgactccctgctggccgtggtgaagcgcgagcccgctgagcagcccggtgacggtgagcgcactgactgcgagcccgtcggtctcgaaccggctgtggagcagtcctcagccgcatctgagcttgccgaagcttcaagcgaggagctggctgaggcacctaccgaggcacctagcccggaagccagggactccaaagaggatggcagaaaatttgacttcgacgcctgcaacgaagttccacctgctcctaaggagtcaagtaccagcgagggtgcggaccagaagatgtcaagtcctgaggacgactcagacaccaagagattgtccaaagaagagaagggaaggtctagttgcgggagaaatttttgggtctcaggcctgtcttccaccactagggccacagatcttaagaacctgttttccaagtatggaaaagtcgttggtgccaaggtcgtgacaaatgctcggagccctggtgccagatgctatgggtttgtaaccatgtcaactgccgaggaggccaccaagtgcatcaatcatttacacaagactgagctacatggaaagatgattagcgtggaaaaagctaagaatgaaccggttggcaaaaaaacctccgacaagcgagacagcgatggcaaaaaggaaaagtcctccaactctgaccggagtaccaaccttaagcgagatgataagtgcgacagaaaagatgacgctaaaaaaggggatgacggcagcggtgaaaagtcaaaggatcaggatgatcagaagcctgggccatccgagagatcccgggctaccaaatccggctcgcgcggaaccgagcgaactgttgtgatggataaaagcaaaggagtgccggtgatctctgttaaaacttcagggtcaaaagagagagcttctaaatcgcaggacagaaaatccgcatcacgtgagaagcgatccgtggtaagcttcgataaggttaaagagcctaggaaatctcgtgacagcgagtctcatagccgcgtgcgggagcggagcgaaagggaacagaggatgcaggcccagtgggagagggaagaacgcgagaggctcgaaatcgctagagaaaggttggcttttcagagacagcggctggaacgtgaacggatggagagagagaggttggagcgggaacgcatgcatgtggagcacgaacgcagacgggagcaggagaggattcaccgggagagagaggaactgaggaggcagcaggaactgaggtacgaacaggaacgcagaccagccgtgcgccgaccttacgacctagaccgacgcgatgacgcatactggccagaggccaaacgggctgcacttgatgagaggtatcactccgattttaaccgccaagatagattccacgattttgatcaccgcgaccgcggaagataccccgaccacagcgtcgaccggagggaaggctcgcgtagcatgatgggcgagcgggaaggacagcattaccccgaaaggcacggcggtcctgagcgacacggccgtgactcaagagatgggtggggagggtatggatctgacaaacggatgtccgaaggaagagggctgcctccacctccaagagggcgacgggattggggcgatcatggtcgacgcgaggacgatcgtagctggcaggggacggctgatggaggtatgatggacagagatcataaaagatggcagggaggggaacgtagcatgtctggccacagcggccctggtcacatgatgaatcgcggtgggatgagcgggcgaggctctttcgcaccaggaggggcttcaagggggcatcccataccacacggtggcatgcagggcggatttggaggacaaagtagggggtcccggccaagtgatgccaggttcacgagaagatattag

SEQ ID NO: 239679 - DNA, 2547 bp, Artificial Sequence
  Description of Artificial Sequence: Synthetic coding sequence
atggcagagaccctgagcggccttggtgacagtggcgcagccggtgccgctgctctttcttcagcctcctcagagacgggtacacgtcggcttagcgatctgcgtgtaatagacctgcgcgctgagctgcgcaagaggaacgtggattcttctgggaataagtccgtgctcatggaaagactaaagaaagcaattgaggatgagggtggcaatccagatgagattgagataacctcggaaggcaataagaagacctctaagcgatcaagtaagggcaggaagccagaggaggagggcgtggaagacaacggcctggaggaaaacagcggagacgggcaaattgaggacaaagagactatcaataacttggatacgtccagttccgacttcacaattctccaggaaatcgaagaaccctccctggagccagagaacgaaaagatcctggatatcctcggtgaaacctgcaagtcggaacctgtaaaggaagaaagctctgagttggagcaacccttcgcccaggacacttcttcggtgggccctgatcgcaagttagccgaggaggaagatctctttgattctgcccatcctgaggagggcgatttagacctggcaagcgagtctacagcacacgcccagagcagtaaggcagatagtctcctcgccgttgtaaaacgtgaacccgcagaacagcccggagatggagaacgcactgattgcgaaccagtggggctcgaacctgcggttgagcagtccagtgctgcttctgaactggccgaagccagttctgaggaacttgctgaagcaccaaccgaagctccaagccctgaggcaagagactccaaagaggatggtcggaagtttgatttcgacgcctgtaacgaagttccgccagccccaaaagagtcttccaccagcgagggcgctgatcagaaaatgagctcgcctgaggatgatagtgataccaaaaggctctccaaggaagaaaagggcagatctagctgtggaagaaacttttgggtctccggcctatcttcaactacccgggcaacagaccttaagaatctgtttagcaagtatggcaaagttgtaggagcaaaggttgttacaaacgcgagatccccgggtgctaggtgttacggattcgttaccatgtctaccgcggaggaggcaactaaatgtatcaaccaccttcataagactgaactacacggaaaaatgataagcgtcgaaaaagcaaagaatgaaccagttggtaaaaagacctcggacaaacgggacagtgacggtaagaaggagaagagcagtaacagtgataggagcacaaaccttaaacgggacgacaagtgcgacaggaaagacgacgcaaaaaaaggtgacgatggctcaggggaaaaatctaaagaccaggacgaccagaaacccggtccatccgaaaggtcgagagctacaaaatctggcagtagaggcaccgagcggactgtggtgatggataaatctaagggagtcccagttatttcggtgaaaactagcggatcaaaggaacgagctagcaagtctcaagaccgcaaaagtgcaagcagggaaaaacgctctgtggtttcctttgacaaggtcaaagagccaagaaagagcagggatagcgagagccactcaagggttagagaacgttctgagcgcgagcagaggatgcaagcccagtgggaacgtgaagagcgggagcggctcgaaatcgctcgtgaacgactggcctttcaaagacagcggctggagcgagagcggatggaacgagagagacttgaacgagagaggatgcatgtggagcacgagagaagaagggagcaagagcgcatacatagagaaagggaggaactgcggaggcagcaagagcttagatacgaacaagagagaagaccggctgtgcgaaggccctatgacctcgacagacgcgatgatgcgtactggccagaagcaaaacgggctgcgctggacgagaggtatcacagcgactttaaccggcaggataggttccacgattttgatcatagggatcgcggaaggtacccagaccattcagtggataggagggagggctctcgttctatgatgggtgaaagggaaggacagcattacccagagcgacatgggggaccagaacgacatggccgtgattcccgagatggatggggaggatatgggtcagacaaaagaatgtctgaaggtcgtggcctaccacccccacctagaggcagaagggactggggagatcatggtaggagggaggacgatcggagctggcaaggaacggccgacggcggtatgatggacagagaccacaaacggtggcaggggggagagaggtcgatgtcagggcactcaggcccaggacacatgatgaacagggggggaatgtctgggcgaggatccttcgcaccaggaggcgcatcacgaggacaccccattcctcacggtggcatgcaaggtgggttcgggggtcaaagtcggggatcaagaccatccgacgctcggttcacgcgaagatactag

SEQ ID NO: 239680 - DNA, 2280 bp, Artificial Sequence
  Description of Artificial Sequence: Synthetic coding sequence
atgaaggtagtaattctcaccaagttgaaacttcccccacgggagacccgaaaacatcagagggggctggccaagattgaggacaaagagacaattaataatctggacacatcgagtagcgatttcactatactccaggaaatcgaggagccatcactggagcctgagaatgagaagatcttggatatactaggggagacgtgcaaatccgaaccggtaaaggaagaatcaagcgagctggaacagccatttgcccaagatacttctagcgtgggacctgatcgaaagctggctgaagaggaggacctgtttgattcagctcatccagaggaaggggacttggacctggccagcgaaagtacggcccacgctcagtcatctaaggctgattccctgctcgctgttgtcaagagggaacccgctgagcagccgggtgatggtgagcgaaccgactgtgagcccgtcgggctcgaaccagcagttgagcaatccagcgcagcaagcgaattggctgaggcatcatctgaagaactggcagaggctcccactgaggccccatcaccagaggctagagattcgaaagaggatgggagaaaattcgatttcgacgcttgcaacgaagtgcctcccgctcccaaggagagctcgacctctgagggtgcagaccagaagatgtcatctcccgaagacgactctgacactaagcgactctctaaagaagagaagggccgttctagctgcggacggaacttttgggtctcgggactgtcatccaccacccgggcaaccgacctcaagaacctctttagcaagtacggcaaggtcgtgggggcaaaggtcgtgacaaacgcacgctccccaggggctcgatgctacggttttgtaactatgagcacagcagaggaagcgactaagtgtataaaccaccttcacaagacggagctgcacggaaaaatgatttcagtcgaaaaagccaagaacgaacctgtcggtaagaagaccagcgacaaacgcgattccgatggtaaaaaagagaagagtagcaattcagaccgctcaaccaacctgaagcgagacgacaagtgcgatcggaaagatgacgcaaaaaagggagacgacggaagcggggagaaaagtaaggatcaggatgaccagaagcccggaccctcagaacggtcccgcgctaccaagagtgggtctagaggcaccgagcggaccgtggtcatggataaaagcaaaggggtcccggtgatcagcgtaaagacttctgggagtaaagaacgggcaagtaaatcacaagaccgcaagagcgcttctcgcgaaaaaaggagtgtagttagcttcgataaggttaaagagccaaggaaaagccgggacagcgaaagccatcgggtacgtgagcgctctgagagagaacagcgtatgcaggcccaatgggagcgcgaggaaagggaaaggctggaaatcgcacgtgagcgtctggccttccagagacagcgtctagagcgggaacgaatggagagggagaggctcgaaagagaacgtatgcacgtcgaacatgagcgccgacgagagcaggaacggattcatcgcgagagggaggaacttcgacgccagcaagaactgagatacgagcaggagcggaggcctgcagtgcgccgaccttatgaccttgatcgtagggatgacgcctattggcccgaagctaaaagagcggctctggacgagcgatatcactctgacttcaatcgacaggacaggttccacgatttcgaccatcgtgacagaggcagatacccagatcatagtgtggatagacgggaaggctcacgctccatgatgggtgaaagagaggggcagcactatccagaaaggcatggaggcccagagcgacacggtcgagattcacgagacggctgggggggatatggctctgataaacgaatgagcgaggggagggggctgccgccaccaccgagggggagaagagattggggcgatcatggtaggcgcgaggacgatagaagctggcagggcacggcagatggtggtatgatggacagagatcacaaacggtggcagggtggagaacggagcatgtcaggacacagcggcccaggtcatatgatgaatcggggaggcatgtcaggcagaggatcattcgccccaggcggtgccagtcgcggacatcccatcccccacggcggaatgcagggcggatttggaggtcagtctagaggaagccggcctagcgatgctagattcactcgtagatattag

SEQ ID NO: 239681 - DNA, 2439 bp, Artificial Sequence
  Description of Artificial Sequence: Synthetic coding sequence
atggccgagacacttagcggtctaggtgacagtggagcagctggagctgcggctctgtctagcgcctcctccgaaaccggtactaggaggctctcagacctgagggtgatcgatctgcgggcagaattgcgcaaaaggaacgtcgattcctcaggtaacaagtccgttctgatggagcggcttaaaaaagctatcgaagacgagggagggaatcctgacgagatcgaaattacctccgagggtaacaagaaaactagcaagagaagcagcaagggacgaaagcctgaggaggagggagtagaagataacggtcttgagcccgagaatgagaaaattttagacattctgggcgaaacctgtaaatctgagccagtcaaagaagaatcaagcgagctcgaacagccattcgcacaggatactagtagcgttggcccagatcggaagcttgctgaggaggaagatttgtttgactccgcacatcccgaggaaggggatttagatctggcctccgagtctaccgcccacgcccaatcttctaaagccgattcactactggccgtagtaaagcgtgaaccagcggagcaacctggcgacggcgagagaaccgattgtgaacccgtggggctcgagcctgcggttgaacagtcttcggccgctagtgagctggcagaagccagtagtgaagaattggccgaggctcctacagaagctccttcacccgaagccagagactccaaggaagatggtaggaagttcgatttcgacgcttgcaatgaggtgcccccagctcctaaggaaagctctaccagcgagggggcagaccagaaaatgtctagccctgaggacgatagtgacacgaagcgccttagtaaggaagaaaagggaaggtcatcctgcggtcgcaatttctgggttagcggactaagttcgactaccagagccactgatttaaagaacttattcagtaagtacggcaaagtagtgggtgctaaggtggttactaatgctagatcacccggagccagatgctatggctttgttaccatgtcgaccgccgaggaggccacaaagtgcattaaccaccttcacaaaactgagctccacggaaaaatgatttcggtggaaaaagctaaaaatgaacctgtcggtaaaaagacttccgacaaacgcgatagcgatggcaaaaaagaaaaatcttcaaattccgaccgcagcactaatctgaagagagacgacaagtgcgaccgtaaagatgacgcaaagaaaggtgacgacggaagcggcgagaaatccaaggaccaagacgaccagaagcctgggcctagtgagagaagtagggccaccaaatccggatctcgcggtactgaaaggaccgtggtcatggataagtctaagggcgtgccagtaatttcggtcaagacctccggaagcaaggagcgggcttctaaatcccaggatcggaagtccgcgtctcgagagaagcggtcagtagtaagtttcgataaagtgaaggagcccagaaaatccagagattcagagtcccatagccgggtccgtgagaggagcgaacgagaacagcgcatgcaggctcaatgggaaagggaagagcgtgagcgattggagattgctcgtgagcgtctggcattccaacgccagagactggagagagagagaatggagcgcgaacgtcttgaacgggaacgtatgcacgtagagcacgagagaaggagggaacaggagcgcattcacagggagagagaagagctgcgccgacagcaggagctgagatatgaacaggagcggcgacctgcggttcgcaggccgtatgatttggaccgcagagacgatgcatactggccagaagccaaaagagccgctctggacgagaggtatcactctgactttaaccgacaagaccgcttccacgatttcgaccacagggatcgcggacgctatcccgaccacagtgtggatcgacgcgagggcagtagatctatgatgggggaacgcgagggccaacattatccagagagacacggaggtccagaaaggcacggcagagactctagagacggctgggggggttatggatctgataagcggatgtctgagggcagggggctccccccaccccctcgcggacgccgtgactggggtgaccatggcagaagggaggatgatcgtagctggcagggcacagccgatgggggtatgatggacagggaccacaagaggtggcagggtggggagcgaagcatgtcggggcacagcgggccaggacacatgatgaaccggggagggatgagcggccgtggatcttttgctccgggaggggcttcgagaggacatcccatccctcatggcggaatgcagggtgggttcggaggccagtccaggggatcccgcccatctgacgctagatttacccgccgatactag

SEQ ID NO: 239682 - DNA, 2862 bp, Artificial Sequence
  Description of Artificial Sequence: Synthetic coding sequence
atggccgaaacactgccaggaagcggcgatagcggccctggtacagcatccttgggcccaggagtggccgagaccgggacgcggcgactgtctgaactgagggtcatcgatctcagagcggaattgaagaagaggaacctggataccgggggaaataaaagcgttctgatggaaaggctgaaaaaagccgtgaaagaggaaggacaagatcccgacgaaattggcatcgaattagaggctactagcaagaagtccgcaaaaagatgcgtgaaaggccttaaaatggaggaggaaggcacggaagacaatggtctggaggatgatagtcgggatggtcaagaggacatggaagcatcactggaaaacttgcagaatatgggtatgatggatatgagcgttctcgatgaaacagaagtcgccaatagctcagctccagatttcggggaagacggcacagacggcctgctggatagcttttgcgacagcaaagagtatgtggccgcacagctgaggcagctgccagcccagccacctgagcacgcagtggacggggagggctttaaaaataccttggagacctcaagtctgaactttaaggtgactcctgatattgaggagagcttgctcgagccagagaacgaaaaaattctggacatcctgggggagacctgtaagtccgaacctgttaaagaggagtcctccgaattggaacagccctttgctcaggataccagctcagtgggtccggaccgcaagctggccgaagaggaagatctctttgatagcgcccacccagaggagggggacctggatttggctagcgagagtactgctcacgctcagtcttcaaaagccgactctctcctcgctgtagtgaaaagggaacctgcggagcagccaggtgacggcgagagaaccgattgtgaaccggtagggttggagcccgcagttgagcagtccagcgccgcatccgaactcgcagaggcatcttccgaagagctggcagaggcacccaccgaggctccatctcccgaggctcgcgattctaaagaagatggccgaaaattcgattttgacgcctgtaacgaggttccacccgctccaaaggagagctccaccagcgagggcgcagatcagaagatgtccagctttaaagaggagaaggacataaagcccatcattaaagacgaaaagggtagggtcgggtctggttcagggaggaatctgtgggtgagcgggctgtcctccacaactagggccacagacttgaaaaacttgttctctaagtatggcaaggtagtgggggcaaaagtggttaccaacgctcgctcacctggcgctagatgctatggtttcgtgactatgtctacatctgacgaagccaccaaatgcatctctcacctgcaccgcactgagctccatggtagaatgatttccgtggagaaagcaaaaaacgagcccgcaggaaaaaagctgagtgacagaaaagaatgcgaggtgaagaaggagaagctatcttccgtcgatagacatcacagcgttgagattaaaatcgagaaaaccgtgatcaagaaggaggagaagattgagaaaaaggaagaaaagaagcccgaagacatcaaaaaggaagaaaaggaccaggacgaattaaagcctggcccaacgaaccgcagccgggtgaccaaaagcggttctcgaggtatggagcgaaccgttgtgatggacaagagcaagggcgaacccgtcatctccgtcaagaccaccagccggagtaaggaaaggtcctcgaagagccaggacaggaagtctgagtccaaggaaaagcgggacattctaagttttgataagatcaaggagcagagagagcgcgaacgccaacggcaacgcgagagggaaatccgagagactgaacgccgacgcgaacgcgaacagagggaacgagagcaaaggcttgaagcattccacgagaggaaagagaaagctcgattgcagcgcgagcggctgcagcttgaatgccagagacagagacttgagcgggaaagaatggaacgcgaacgtcttgagagagaaaggatgagggtagaacgcgagcggcgaaaagaacaggagcggatccacagggagcgcgaggagctcagaagacagcaggagcagctgagatatgagcaggaacgacggccaggccgaaggccctatgatctcgatcgcagagacgacgcctactggccagagggcaagagggtagccatggaggacaggtatagagcggactttccacggccagaccaccgctttcacgatttcgatcaccgggatcggggacagtaccaggaccacgctatcgatcgcagggaggggtctagacccatgatgggcgatcacagagatgggcaacactatggggatgaccggcatggacatggcggtcctccagagcgacatggacgcgacagtagagatggatggggagggtacggctccgataaaagactttcagaaggacgcggactccctccaccacccaggggcggaagagactggggtgagcataatcagaggttggaagagcatcaggccagagcatggcaaggggcaatggacgccggtgccgctagtagagaacatgctcggtggcagggcggagagcggggtttgtccgggccatcgggacccggtcacatggctagccgcggaggcgtggcagggagggggggatttgcccagggcggtcactctcaggggcatgtggtgcctggcggaggcttggagggcggtggggttgcttcacaggaccgcggaagccgagtgccacatccacatccccatcctcctccgtatccacattttactagaaggtattag

SEQ ID NO: 239683 - DNA, 1533 bp, Artificial Sequence
  Description of Artificial Sequence: Synthetic coding sequence
atggccgagactcttcctggttccggagatagtgggcctggcactgcctctctgggccctggagtcgctgagaccggcacacggagattgagtgagctcagagttatcgacctacgcgctgagctgaagaagagaaatctggataccggcggaaataagtccgtgttgatggaacgactgaaaaaagctgtgaaggaggagggccaggatcccgatgagatagggatcgagctggaggctacgagcaagaagtccgcgaagaggtgtgtgaagggcctgaagatggaggaggaaggaaccgaggataatggcctggaggatgactcacgcgatggccaggaagatatggaagcaagcctggagaacctgcagaacatgggcatgatggatatgagcgtgctggatgagacggaagtcgctaactccagtgcccctgactttggcgaggatggcacggacgggctcctcgattcattttgtgacagtaaagagtacgtggcagctcagcttcggcaactccccgctcagccacccgaacatgccgtaggcaatctagaaacccggcaggacgtgccaaccagctcaagtttgagggtttccgtggcagcggtgcctgttccgcatctatctgtcgaaaacgaaaaaatccttgatattctgggtgaaacgtgcaagtctgagccagtaaaggaggagtccagcgaactagaacaacccttcgcccaggatacttcctcagtaggtcctgatagaaagcttgctgaagaggaggaccttttcgacagtgcccatcctgaggagggagatctagacttagccagtgagagcactgcacatgctcagtccagcaaagccgacagcttactagccgtcgtaaaacgggaaccagccgaacaacctggagacggcgaacggacagactgcgaacccgtcggtctggaacccgctgttgaacagtcctcagctgccagtgagctcgctgaggccagctcggaagaactggctgaggctcctactgaggccccttcaccagaagctcgcgatagtaaggaggatgggagaaagtttgactttgatgcgtgcaacgaggtacctccagccccaaaggagtccagcacatcagaaggcgctgaccagaaaatgtcttcattcaaagaagagaaagacatcaaacccattatcaaggatgaaaaggggcgagtaggctctgggtctgggaggaacttgtgggtttctggcctatcttccactactcgggctaccgaccttaagaacctctttagtaaatacggcaaggtcgttggagcgaaggtggttaccaatgctcggtcccccggtgctagatgttacggctttgttaccatgtccactagcgacgaggctaccaagtgtattagtcatttgcatcgcacggaactacatggaaggatgatttcagttgaaaaggccaaaaacgaacccgcaggcaagaagttgtctgacagaaaggaatgtgaggtaaagaaggaaaaactctcttcagtcgatcgttag

SEQ ID NO: 239684 - DNA, 786 bp, Artificial Sequence
  Description of Artificial Sequence: Synthetic coding sequence
atggccgagactcttcccggttcaggcgacagtggacctggaaccgctagcctgggtcctggcgtcgcagagactgggactcgccgactctccgaattgcgggtcatcgacctacgggcagaattaaaaaagcgcaatctggacaccggtggaaacaaaagtgtgttaatggaacgtctgaagaaggcagtcaaagaagagggacaggatccggacgagattggtattgagctagaggccacgtccaaaaagtcggctaagcgatgtgtcaaagcccctagccctgaggcacgagactctaaggaagacggtcgaaaattcgacttcgatgcctgcaatgaggtaccgcctgctcccaaggagtcaagtacctccgagggcgctgaccagaaaatgtccagttttaaagaggaaaaagatattaagcccatcatcaaggatgagaaggggagggtgggcagcggttccgggcgaaacttgtgggtctctgggttgagttctactactcgggcaactgacttgaaaaatctattctcaaaatacggaaaagtcgtcggtgccaaggttgtaactaatgccaggtcacctggggcacgctgctacgggttcgttacaatgtccaccagtgacgaagccaccaaatgcatctcccatctgcacaggacggagctgcatggacgcatgattagcgttgaaaaggctaaaaacgaacctgcgggtaagaagttgtccgatcgcaaggaatgcgaagttaaaaaggagaagctctcttccgtggacagatag

SEQ ID NO: 239685 - DNA, 1221 bp, Artificial Sequence
  Description of Artificial Sequence: Synthetic coding sequence
atggccgagacgttgcccggtagcggcgattctgggcctggcaccgcttctcttgggccaggagtggctgagaccggaacccgtagactctcagagctcagagttattgacctgcgggcagaattaaagaaaagaaatttagacaccggtggcaataaatcagtcctgatggagcggttgaaaaaagccgtgaaggaggaggggcaagaccctgacgagattgggatcgagctggaagccacttccaaaaaatcagccaagagatgtgtgaagggcctgaagatggaagaggagggtacagaagacaacggcctggaggtggagaatgaaaaaattttggatattttaggcgaaacatgtaaatccgagccagtgaaagaagagtcaagcgaactggagcagcccttcgctcaggatacttccagcgtgggccctgaccgaaagctagcagaggaggaagatctcttcgacagcgcccaccctgaagagggggatctcgatctagcatctgagtctaccgctcacgcccagagcagtaaggccgactcacttctggcagtggtaaagcgcgaacccgctgaacagcccggtgatggagagcgcacggactgcgaaccagtgggactagaaccggctgttgaacaatcctctgccgctagcgaactggccgaggccagtagtgaagagctcgccgaagcaccaaccgaggcaccttctcccgaggcccgtgattcaaaggaagatgggagaaaatttgacttcgatgcctgtaacgaggtaccgccagccccaaaggagtcgtcaactagcgagggggcagaccagaaaatgtcgagtttcaaggaggagaaggatatcaagccaataattaaagacgaaaaggggagggtgggctctggttcaggccgtaacctatgggtatccggattatcctctacaaccagggccaccgacttgaagaatttattttcaaagtacgggaaggttgtcggcgcaaaggtcgtgactaacgcaaggtcccctggagctcgctgttatggtttcgtgaccatgagtacttcagacgaggctacaaagtgtatcagccaccttcatagaacagaactgcatggacggatgatctctgtagaaaaagctaagaatgaaccagccggaaagaaattaagtgataggaaggagtgtgaagttaaaaaggaaaagttgtcatccgtcgacagatag

SEQ ID NO: 239686 - DNA, 606 bp, Artificial Sequence
  Description of Artificial Sequence: Synthetic coding sequence
atggctgagactggaaccaggcggctcagcgagctgcgcgtcattgacctgcgcgcagagttaaagaaacgaaatctggataccggaggcaacaaaagtgttctgatggagcgcctgaaaaaggcagtgaaagaggaagggcaggacccagatgagattggtatcgaactggaagccacaagtaaaaaaagtgccaagaggtgcgtaaaggggctgaaaatggaggaggaggggacagaggacaacggccttgaggatgattctcgggatggccaggaagacatggaggctagcctggaaaatctgcagaatatgggaatgatggacatgtcagtgctcgacgaaaccgaggtggcaaacagcagcgcacccgacttcggcgaggacggcacggacggcctcctcgacagcttctgtgacagcaaagagtacgtggccgctcagctgaggcagctcccagctcagcctccagagcacgccgtagacggagagggcttcaagaacacccttgaaacatcttccctgaactttaaggtcactcccgatattgaagaatccctgctggagcctggcacagacaagcgaaataccaccgtaatggtctag

SEQ ID NO: 239687 - DNA, 1821 bp, Artificial Sequence
  Description of Artificial Sequence: Synthetic coding sequence
atgaaagtgaggtccgccggtggagacggagacgcgctctgcgtgaccgaagaagatttagcaggggacgatgaggacatgcccacatttccctgtacccagaaagggcgtccagggccacggtgctctcgctgccagaaaaacctttcattgcatacctctgtgcgcatcctttacctgtttctggccttgctgctggtcgccgtcgccgtgttggcaagcctggtttttagaaaagtggacagtctctcagaggatatctccttaacgcagagtatttatgacaaaaaattggtgctgatgcagaagaatctgcagggcctagatcctaaagccttgaataactgctccttttgccatgaagccggacagctgggacccgagattcgtaagctgcaagaagagctggagggcatccaaaaattattgctggcccaggaggttcaactggaccagactctgcaggctcaggaggtcctctccacgacctcgagacagatcagccaggagatgggcagctgcagcttctcgattcaccaagtgaaccaatctcttgggcttttccttgcccaggtgaggggatggcaagccacgacggcaggcctggacctatcattgaaggacctgacgcaggagtgttatgacgttaaggccgcagttcaccagattaacttcaccgttgggcagaccagcgagtggattcatgggattcaacgcaagaccgacgaggaaacactgaccctgcaaaagattgtcaccgactggcagaactacactaggttattcagcgggcttagaaccacaagcactaagacgggagaggccgtgaaaaacatccaggctaccctgggtgcaagctctcagcggatatctcagaattctgagtcaatgcatgatctcgtcctgcaggtgatgggactgcagctgcaactggataacatctcaagctttctggatgatcacgaggagaatatgcatgatctccagtaccatactcactatgcacagaaccggaccgtggaaaggttcgaatccttggaaggcaggatggcgtcgcatgagatcgaaatcggcaccatttttaccaacatcaacgccacggacaaccacgtacacagcatgctaaagtatctagacgatgtgcgccttagctgtactctggggtttcacacacatgcggaggagctgtattatcttaacaaaagcgttagcattatgctaggaaccaccgatctgctgcgagaaagattcagtctgctgtccgccaggctcgacttaaatgtgcgaaacttgtcaatgatagtggaggagatgaaagctgtcgacacacaacacggcgagattcttcgaaacgtaaccatcctgaggggggctccgggaccacccggtcccaggggattcaagggagatatgggggtgaaagggccagtgggcggacgcggtccgaagggagaccccggatcacttggtccgctcggaccccaggggcctcaggggcagcctggcgaggctggaccggttggcgagagaggccctgtggggcctcgtggattccccggattaaagggaagtaagggttcctttgggaccgggggtccccgaggccagccaggccctaaaggcgatattggcccacctggccctgaaggaccacccggatcaccaggaccctccgggccacagggaaagccagggatagcaggaaaaaccggatcccccggtcagaggggtgctatgggacctaagggggaaccaggtattcaaggcccaccaggcctgccagggccacctggtcctcctggcagccagtcattctattag

SEQ ID NO: 239688 - DNA, 1401 bp, Artificial Sequence
  Description of Artificial Sequence: Synthetic coding sequence
atgaaagtccgctcggctggaggagacggagatgcattatgcgtgaccgaggaagacttagcaggcgatgatgaggatatgcctacctttccttgcacgcagaagggacgtcccggaccacgctgtagtcgctgtcagaaaaacttatctctgcacacctcagtgcgtatattgtatctatttctcgcgctgttgcttgtcgctgtggccgtcttggcttctttggtgtttcgcaaagtagactccctgagtgaggacatcagtctaacccagtctatatacgacaagaagttggtcttgatgcaaaaaaacttacagggactggaccccaaggctctcaataactgttcattttgccatgaagccggacagctcggacctgaaattcgaaagctccaagaggagttagaggggattcagaaactgctccttgcccaggaagtacagctggatcagaccctgcaggcgcaggaggtcctgagcacaacgagtcgccaaatcagccaggaaatgggatcctgcagcttttccatccatcaggtgaatcaatctctgggcctgttcctcgcacaggtccgtggatggcaggctacgaccgcagggttggatctttccctgaaagacctgacacaagaatgctatgacgtgaaagctgccgtacatcaaataaattttaccgtgggccaaacgtctgaatggatacatggaatccagagaaaaactgatgaggagactctgactcttcagaagattgtgactgattggcagaactacacaagactgtttagtgggctccgaacgaccagcacgaaaactggtgaagccgtcaagaatatccaggcaaccctgggcgcttctagccagcgaatttcccagaacagcgagagcatgcacgaccttgttctgcaagtgatgggcttgcagctgcagctggacaacatttcttcttttctcgatgatcatgaggaaaatatgcatgacctgcagtatcacacacactacgcacagaataggactgttgaaagattcgagagtctggagggcagaatggccagccacgagattgagatcgggactatcttcacaaatataaatgctacagataaccatgtgcattcaatgctgaagtatcttgacgacgtgcgcctgagttgcaccctgggattccatactcatgcagaagagctgtattacctcaataagagcgtctcaattatgctcggcactacggatcttctgcgtgaacgattcagcctgctcagcgcaaggctggacctgaacgtaagaaacctgtctatgattgtggaggaaatgaaagccgttgacacacagcatggagagattctaagaaacgtgaccattctgcgagggcacacactgttttctcataaccgcatttag

SEQ ID NO: 239689 - DNA, 1008 bp, Artificial Sequence
  Description of Artificial Sequence: Synthetic coding sequence
atgggtcgctgctgcttttacacagccggaacactctcgctgctgctgctggtgaccagtgtcactctcctcgtagccagagtgtttcagaaagcggtggatcagagcatcgagaaaaaaatcgtgctacggaatggcacagaagcgttcgattcttgggagaaacctccgctacccgtttacacccaattctacttctttaacgtgacaaaccccgaagagattctgaggggggagaccccaagagtcgaagaggtgggcccttacacgtatcggagcctcgattggtggatcactgacaaatgtaacatgattaacggcaccgatggcgactcattccacccattgatcactaaggacgaagttctctacgtgtttcctagtgacttttgcaggagcgtgtacatcacattctcagactacgaaagtgtgcaagggctacccgcatttagatataaggtgcccgctgaaatcctggccaatacatctgataatgccggattctgtatacctgaaggcaattgtctgggtagcggcgtccttaacgtatctatatgcaaaaacggggcacccatcatcatgagctttcctcatttctaccaggccgacgaacgtttcgtcagtgcgatagaaggcatgcatcctaatcaagaggatcacgaaacatttgtggacattaatcctttgaccggtatcatcttaaaggcagccaagcgattccaaataaacatttatgttaagaagctcgacgatttcgtagagaccggagacatcagaactatggtgtttcctgtgatgtatctgaacgagtccgtgcatatcgacaaagagacagccagccggctgaaaagcatgatcaatactaccttgattatcacgaacatcccttatatcatcatggctctaggcgtgttttttgggctggtttttacttggcttgcatgcaagggacaggggtcaatggatgaaggcacggcagacgagagagcacctctgatacgcacatag

SEQ ID NO: 239690 - DNA, 1530 bp, Artificial Sequence
  Description of Artificial Sequence: Synthetic coding sequence
atgggctgttccgccaaagccagatgggcagccggagctctcggcgtggccggactcctctgtgctgtgctgggcgcagttatgatcgtaatggtcccgtccctgattaagcaacaagttctgaaaaacgttcgcatcgacccatctagcctaagctttaatatgtggaaagagattccaatccccttttacttgagcgtgtattttttcgacgttatgaatccctccgaaattctaaagggcgaaaaacctcaagtgagggaaagggggccttatgtgtaccgcgaatttcggcacaaatctaacattacgtttaacaacaatgacacagtgtcgttcttggagtatcggacttttcagtttcagcctagcaaatctcatggctccgagtcagactacatcgtcatgccgaacatacttgtgctgggggcagcagtaatgatggagaataaacctatgactctcaagctgatcatgaccctggcttttactactctaggagagagagccttcatgaacagaactgtcggtgaaatcatgtggggctataaggacccccttgtgaacctgataaataaatatttccccggaatgtttccgtttaaggataaatttggcctgttcgctgaactcaacaactcagattctggtctgtttactgtgtttacaggggtgcaaaatatttctcgcatccatttggtcgacaaatggaatggtctgagtaaggtcgacttctggcattccgatcagtgtaatatgatcaatggcaccagcggtcagatgtggcccccttttatgacacccgagagtagcctggagttttactcacctgaggcctgcaggtcgatgaagctcatgtataaggagtctggagtctttgagggcatccctacctatcgcttcgtggcgccaaagactctattcgccaatgggagcatctacccccctaacgaaggcttctgcccttgcctggagagtgggattcagaatgtcagtacatgccgctttagcgctccactgttcttatcacacccccacttcctgaatgccgaccctgtgctcgccgaagcagtgacgggactgcacccgaaccaagaggctcatagtctgttcttggacatccaccctgtgacaggcatccccatgaattgttcggtgaagctgcaattgtccctgtacatgaaaagtgtggcaggtatcggacaaaccggaaagatcgaaccagtggtgttacctctgctatggtttgcagaatctggcgctatggagggagagacattgcacacattctacacacagctagttcttatgccaaaggtcatgcattacgcacagtatgttctcctggccctgggctgcgtccttctactcgtacctgtgatatgccaaatacgttcacaagagaagtgttatcttttctggagctctagcaaaaaaggctctaaagataaggaggccattcaagcatattctgaaagtttaatgacttctgccccaaaggggagcgtgctgcaggaagctaagttatag

SEQ ID NO: 239691 - DNA, 1521 bp, Artificial Sequence
  Description of Artificial Sequence: Synthetic coding sequence
atggggtgctctgcaaaggcgaggtgggctgcaggtgctctgggcgtcgctgggttattatgtgctgtgctgggtgcggtgatgatcgtgatggtgcctagtttgatcaagcagcaggtgcttaaaaacgttaggatcgatccgagctccctgagcttcaacatgtggaaggagattcctattcctttctatctaagcgtatatttctttgacgtcatgaacccttctgaaatactgaagggagagaaacctcaagttcgcgaaaggggaccctacgtttaccgggagtttcgccacaagtctaacataacattcaataacaacgatacagtctcatttttggagtaccgaaccttccagttccagccaagcaaaagccacggatcggagagcgactatattgtgatgcctaacattctggttttgggcgctgccgtaatgatggagaacaagcccatgactctaaagctcattatgaccctcgcattcacaacattaggggaaagagcatttatgaaccggaccgtcggggagatcatgtggggatacaaggatcccctggttaatctcattaataaatatttccccggaatgttcccttttaaagataaatttgggctattcgctgagttgaacaattcagacagtggactgttcacagtcttcacaggagtgcagaacattagcaggatacatctggtggataagtggaatggtctctctaaggtcgatttctggcacagcgatcaatgtaacatgatcaacgggacgtccggacagatgtggcccccttttatgactccagagtccagcctcgagttttatagcccggaggcatgtaggtctatgaaactcatgtacaaagagtccggcgtattcgaggggatccccacatacaggttcgtggcacccaagacgctgtttgccaacgggtcaatttatccaccgaacgagggcttttgtccttgtttggagagtggcatccagaacgtgtccacatgtaggtttagtgctcccttgttcctgagccacccacactttctaaacgcagatcctgttttggccgaggccgtgactgggctgcatcctaatcaggaggcccactccctgtttctggacatccaccccgtgactgggattccgatgaactgcagcgtgaaactgcagctgtctctttacatgaaatccgtggcgggaattgggcagactgggaagattgagccagtggtgttaccattgttatggttcgctgagagcggggcaatggagggagagaccctccacacgttttacacccagctggtgctcatgcctaaagtgatgcactatgctcagtatgtcctgctggccctcggctgtgttctgctgctggtgcctgttatctgtcagattagatcacaaggtcccgaagacaccgtttcgcagcccggtctcgctgctggaccggaccgtcccccttctccctataccccgttactgcccgattctccctccgggcagcccccatctcccaccgcttag

SEQ ID NO: 239692 - DNA, 1230 bp, Artificial Sequence
  Description of Artificial Sequence: Synthetic coding sequence
atggggtgctcagccaaggccaggtgggccgcaggggctctgggcgttgctgggctgctttgcgcagtcctgggagctgtcatgatcgttatggttcccagcctgatcaagcagcaggtactgaaaggcgcagctgtgatgatggaaaacaaacccatgacccttaagctcatcatgaccctggctttcacaaccctgggagagcgcgcattcatgaaccggactgtgggggagattatgtggggctacaaggatccgctggtgaatctcataaataaatacttcccgggaatgtttccgttcaaagataagttcgggctgtttgctgagctcaacaacagcgacagcggcctctttacagtttttaccggtgtgcagaatatctccagaattcacttagtggataagtggaacggactttcaaaggtggacttctggcacagtgaccagtgtaacatgatcaacggcacatccggtcagatgtggcccccattcatgactcctgaaagctccctggagttctacagccccgaagcatgcagaagtatgaagttgatgtataaggaaagcggggtattcgagggaatccctacctaccgtttcgttgcgcctaaaacgcttttcgccaatgggagcatttatccccctaacgaaggcttctgcccttgtctagaaagcgggattcagaacgtttctacttgtcgattcagtgcccctttatttttgtcccacccacactttttgaacgctgaccctgtgctggccgaggctgtgaccggcttgcatccaaaccaggaggctcattccctcttcctggatattcaccctgtcaccggtatcccaatgaattgctctgtgaaattacaattgtccctctatatgaagtccgtcgccggaatcgggcagactggaaaaattgagccagtggtgctgcctttgctctggttcgccgagtctggggctatggagggagagactctgcacaccttctacacgcagttggtcctgatgcccaaggtgatgcactatgctcagtatgtgctcttggccctgggatgcgttttgctcctcgttcctgtcatttgccagatcaggagccaggagaagtgttacctgttctggtcaagcagcaagaagggaagcaaagataaagaagccattcaagcgtatagcgaatccctcatgacctcagccccaaaggggagtgtgctgcaggaagccaaactgtag

SEQ ID NO: 239693 - DNA, 1659 bp, Artificial Sequence
  Description of Artificial Sequence: Synthetic coding sequence
atgggatgttctgctaaggcccgatgggccgcaggtgcactaggtgtggccggactgctctgtgccgtcctgggggctgtgatgattgtcatggtgccgtccttgattaaacagcaagtcctgaagaatgtgaggatcgaccccagctccttatctttcaacatgtggaaggagattcccattccattttacttgagcgtctactttttcgacgtaatgaacccctcagagatccttaagggcgagaagccgcaagttcgggaaagagggccatatgtgtatagggaattccgtcataaatcaaacatcacctttaataacaatgatactgtaagttttctggaatacagaaccttccagtttcaaccctcaaagtcacacggatctgaatcagattatattgtgatgccaaacattctggtcctgggggctgccgtgatgatggaaaacaaaccaatgactctgaagttgattatgactctggctttcacaacactcggagagcgggcatttatgaatcggactgtgggcgagataatgtggggttacaaggacccccttgtgaatttgattaacaagtatttccccggaatgtttccattcaaagacaaattcgggctgttcgctgaattgaacaactccgatagtggccttttcaccgtgttcacaggggtgcaaaatattagcaggatccatctggtcgataagtggaacgggctgtccaaagttgacttctggcacagcgatcagtgcaatatgataaatgggacatccggccagatgtggccccctttcatgacaccagaatccagcctggagttttacagcccggaagcatgcagaagcatgaaactcatgtacaaggagagcggagtgttcgagggcatacccacgtatcgtttcgtcgctccaaaaacgctgtttgccaacggatctatctatccacccaatgaggggttttgtccttgcttggaaagtgggattcagaatgtttcgacctgccggtttagcgccccactcttcttgtctcatccacactttctgaacgcggatccagtccttgccgaggccgtcaccggattgcatcccaatcaggaggctcactcactgttcctagatatccatccagtgaccggtatccctatgaactgctcagtcaagctgcagctaagcctgtacatgaaatctgtcgccggtatcggccagactggcaagatagaacccgtggtactgcctctcctgtggttcgcggaatctggcgcaatggagggcgaaacccttcacactttctatacacagttggtgttgatgccaaaggtcatgcattatgcccagtatgtgctgctggcacttggctgtgtactgctcttggtaccggtaatttgccagatccgcagtcaggtgggtgccggtcagcgggctgcgcgagccgacagccatagcctggcctgctggggaaagggcgcatccgacaggacgctgtggccgacagccgcttggtcaccaccgcctgccgcagtccttcgtctctgccggagtggctccggacactgttggggtctcaggtctacgctggcatcttttgcttgccgggtggcaactacgttacctgtcctggaagggctgggacccagccttggcggaggaaccggcagctag

SEQ ID NO: 239694 - DNA, 1551 bp, Artificial Sequence
  Description of Artificial Sequence: Synthetic coding sequence
atgtgcgcagtaggaaacgtcagaattgatccgtcgtccctgtcttttaatatgtggaaggagatccctattcccttctacctcagcgtgtactttttcgacgtcatgaacccctccgaaatcctcaaaggggagaagccacaggtcagagaacggggtccctacgtttaccgagaatttcgtcataagagcaatattacatttaacaataacgacaccgtttcattcctggagtaccgcacctttcagttccagccgagtaagtctcacgggtccgaaagcgattatatcgtgatgcccaatattctcgttctcggcgcagcggtgatgatggagaataaaccaatgactctaaaactgataatgacacttgcattcaccacccttggtgaacgcgctttcatgaatcgtactgtgggtgagatcatgtggggctataaggatccactggtgaatctcatcaataagtatttccctggtatgttcccattcaaggataagttcggcctgtttgctgaactgaataatagcgattcagggctctttacagtgttcactggggtacagaacatttccagaatccatttggtagacaagtggaacggtctgtcaaaagtggacttttggcactcagatcaatgcaacatgattaatggcacaagtgggcaaatgtggcccccattcatgactcctgaaagctcactcgaattttattccccagaagcgtgccggagcatgaagctcatgtataaggaaagcggcgtcttcgagggaatcccaacctaccgttttgttgcaccaaaaacgttgtttgcaaatggctcgatttatccccctaacgagggattttgtccttgcttggaaagtggcattcagaatgtgtctacttgccgcttttctgcccctctcttcctgtcccacccacacttcctgaatgcagaccccgtactggccgaagcagtcacgggtctgcaccccaatcaggaagcccatagcctctttttggacattcaccctgtgacgggcattccaatgaactgctccgtcaagcttcagctctcgctttacatgaagtccgtggctggtattggccagaccggcaagattgagcctgtggtgctcccacttctctggttcgcagagagcggtgctatggaaggcgagaccctgcataccttctacactcagttagtactgatgcctaaagtcatgcactatgcccagtatgtcctgctggctctgggctgcgtgctgctgctggtgccagtcatttgccagatcaggagtcaggtgggggcagggcagcgtgccgctagggccgactcccattctttagcttgctggggtaagggagccagcgatcgtacattatggccaaccgctgcatggtccccaccccctgccgcagtccttaggctgtgtcggtcaggttctggacactgttggggtctgagaagtacgcttgcttccttcgcctgcagggtggccaccacactgccagtgctcgaggggctgggcccttcgcttggtggcggtaccggcggactatag

SEQ ID NO: 239695 - DNA, 1539 bp, Artificial Sequence
  Description of Artificial Sequence: Synthetic coding sequence
atgaacgtgcggattgatccatcttcactatcttttaacatgtggaaggaaattcccatcccattttacctgtctgtctactttttcgatgtgatgaacccgagtgagattctaaagggcgagaagccacaagtgagagagcgcggtccatacgtgtacagagaatttagacataagtcaaacatcacattcaataacaacgacaccgttagtttcctagaataccgtactttccagtttcagccgagtaaaagccacggatccgagagtgactatatcgtcatgcctaacatattggtccttggtgcagccgtgatgatggagaacaaacccatgacactaaaactcattatgacattggccttcacaacactgggcgagcgggcttttatgaatcggacggtcggggaaatcatgtggggttacaaggaccccctcgtcaatctgatcaataaatacttccccggaatgtttccttttaaagataaattcgggttattcgcagaactcaataatagtgactccggcttattcacggtttttaccggcgttcaaaacatctcaaggattcatctggtggacaaatggaacggactgtctaaggtggacttctggcatagcgaccaatgcaacatgataaatgggactagcggacagatgtggcctcctttcatgacacctgaaagcagtttggagttctattcaccggaggcctgcaggtcaatgaaactgatgtacaaggagagtggagtttttgaggggattcctacctacagattcgtggccccaaagactctcttcgcaaatgggtcaatttaccctcctaacgagggcttttgtccttgtttggagtctggcatccaaaacgtaagtacgtgccgtttttctgcgcctctttttctgagccatccgcatttcctgaatgccgaccctgttctggccgaagccgtgactggcttacaccctaaccaggaggcccacagcctcttcctcgacattcaccccgtgacgggaatccctatgaactgcagtgtaaagctacaactgtccttgtatatgaaatccgtagcaggaattggacagacgggtaagattgagcccgtggtgcttcctttgctttggtttgccgaaagcggtgctatggaaggtgaaacattgcacacattttacacccagttggtactaatgcctaaggtcatgcactacgcccagtacgtcctcttggccttaggctgcgtcctgctgctggtcccagtcatctgccaaattcgatctcaggttggcgctggccagcgtgcggctcgcgctgactcccactcactggcatgttggggcaaaggagcatctgataggaccctctggccaaccgctgcatggtcccccccacccgcagctgtgttgaggctgtgccggtccggtagcggtcattgctgggggctgcggtcaaccctggcatcctttgcttgcagagtcgccaccactctcccggtgctcgaaggcctgggcccatcactgggcggtggtacaggtggcctgtag

SEQ ID NO: 239696 - DNA, 441 bp, Artificial Sequence
  Description of Artificial Sequence: Synthetic coding sequence
atgggttgttcggccaaagcccgatgggcggctggtgcccttggggtggcgggactgctttgtgctgtactgggggcagtgatgatcgttatggtgccctcgctaattaaacaacaagttttaaagaatgttcgcatcgatccaagctctctcagtttcaatatgtggaaagagatccccattccgttctatctcagcgtgtacttttttgacgtgatgaaccctagcgaaattctaaagggggagaagccccaagtgagagaaagaggcccatacgtgtacagagagtttcggcacaaatcaaacatcacttttaacaacaatgacacggtgtcattcttggaatataggaccttccaattccaaccatcaaaatcccacggcagtgaaagtgactatattgtgatgccaaacattcttgttctggttcgcctcccttag

SEQ ID NO: 239697 - DNA, 1446 bp, Artificial Sequence
  Description of Artificial Sequence: Synthetic coding sequence
atggggtgttctgccaaggctaggtgggcagccggagctttgggagtggctggcttgttgtgcgccgtgctgggcgctgttatgatagtcatggtaccctctttgatcaaacagcaggttcttaagaacgttcgcattgatccctcttccctgtcattcaatatgtggaaggagatccccataccgttctatctgtctgtgtatttctttgatgttatgaacccgtctgaaattctgaaaggtgaaaagccccaggtgcgagagaggggaccctatgtttacagagaatttcggcacaaatctaacataacctttaataacaacgacaccgtgtcctttctcgagtacagaacatttcagttccagccatccaaaagccacggctccgaaagcgattacatagtaatgccaaatattctcgtgctgggggcagccgtgatgatggagaataagcccatgactttgaagttaatcatgaccctcgcctttacaaccctgggcgaacgagcattcatgaacagaaccgtgggggaaatcatgtggggctataaggacccattggttaacctaattaataagtatttccccggtatgtttccatttaaggataagttcggtctttttgctgaactgaacaactcagactcaggactgttcacagtcttcactggtgtgcaaaatatttcccgcattcacctggtggataaatggaacggcctgagcaaggtagatttctggcattccgatcagtgcaacatgatcaacggaactagcggccagatgtggccccctttcatgacgccggaaagttctctggagttctatagccctgaagcctgcaggtctatgaaattaatgtacaaagaatctggcgtgttcgagggaatccccacctatcgattcgtcgcacccaagaccctcttcgccaatggaagtatctaccctcctaatgaggggttttgtccctgcctggagtcagggattcagaatgttagtacctgtcgtttctctgctcctctgtttctgtcccatcctcacttcttgaacgcagacccagtgctggcggaagccgtgacaggtctgcatccaaaccaagaggctcattccctgttcttagacatccacccagtgacaggaatccccatgaattgtagcgtaaagctgcagttgtcactatatatgaagagcgtcgcaggcataggccagaccgggaaaattgaacctgtcgttttacctcttctgtggtttgccgagagcggggctatggaaggtgaaacgctccacactttttacacacagttggttcttatgccgaaggagaagtgttatctgttttggtcctcaagcaaaaaggggtctaaggacaaggaagctatccaggcctactctgagtcactcatgacatctgctcctaaaggctccgtcctgcaggaagcaaaattgtag

SEQ ID NO: 239698 - DNA, 1437 bp, Artificial Sequence
  Description of Artificial Sequence: Synthetic coding sequence
atgggtcggtgttgcttctatacagccggtactctcagtctgctccttctggttacctccgtaacgttactggtcgcacgcgtgttccagaaagcagtcgaccagtctatcgagaaaaagatagtcctaagaaatggtaccgaggcatttgactcctgggagaaaccccctcttccggtctatacccagttctatttcttcaatgtgactaatccggaggaaattttgcggggtgagacaccccgagttgaagaggtgggcccatatacatatagagagctacgcaacaaggcaaacatccaatttggggacaatgggacaaccattagtgcagtctcaaataaagcatatgtgttcgagagagaccagtccgttggcgaccctaaaatcgatctcatcaggaccttaaatataccggttctaactgttattgagtggagtcaagtgcatttcttgcgagagatcatcgaagccatgttaaaagcttaccaacagaagctattcgttacacacaccgttgacgaacttctgtggggatacaaggatgagatcttgtctcttatacacgtctttaggcccgacatctccccctactttggcctgttttacgagaagaacggaaccaacgacggagactatgtttttctcactggagaggactcatacttaaactttactaaaatcgtggaatggaatggtaaaacaagcctggattggtggatcaccgacaagtgtaacatgatcaacggaaccgacggggactccttccaccctttgatcacaaaggacgaggtgctctatgtgttcccctctgatttttgtcggtctgtgtacattaccttttctgactacgagtccgtacagggcctgcccgcattccgatacaaggttcctgctgagattctggctaacacttctgataacgccggattttgtatccccgaaggtaattgcttgggatccggcgtcctcaacgtcagcatctgtaaaaatggggcacccatcattatgtccttcccgcacttttatcaggctgacgaaaggtttgtatccgcgattgaaggcatgcatcccaaccaggaagatcatgagaccttcgtcgatattaatcctctgactgggatcattttgaaggccgctaagcgctttcagataaacatatatgtgaagaagcttgatgacttcgtggagacgggggatatccggactatggtgtttcctgtgatgtacttaaacgaaagtgtccacattgacaaagagaccgcctctcggctgaagagtatgatcaataccacactgattattaccaacatcccctacattattatggccctcggcgttttcttcgggctggtgtttacatggttagcgtgcaagggacaaggaagtatggatgagggcactgcagacgagcgtgcacctctgatcagaacctag

SEQ ID NO: 239699 - DNA, 1710 bp, Artificial Sequence
  Description of Artificial Sequence: Synthetic coding sequence
atgggcttgggcctcttgcttcctcttctcttgctatggactaggggcacccaaggttccgagctggatcctaaagggcagcatgtctgcgttgcgtcctcgccctctgctgagcttcaatgttgtgccggatggcgacagaaagaccaggagtgtacaataccaatttgcgaggggcctgatgcttgccagaaggatgaagtgtgtgtgaagccaggcttatgtagatgtaagcccggtttctttggagcccactgcagtagccgctgtcccggacagtattggggtcccgactgccgggagtcctgcccatgtcatccccacggtcagtgtgagcctgccaccggggcatgccagtgtcaggctgacaggtggggggctcggtgcgagtttccatgtgcatgtggtccccatggaagatgcgaccccgctactggcgtctgccactgcgaacccggttggtggagcagtacctgtagaaggccctgtcagtgcaatactgccgctgctcgttgcgagcaagccaccggagcctgcgtgtgcaaacccggatggtggggaagacgatgcagctttaggtgtaactgccacggttccccttgcgaacaggattcagggcgttgcgcttgtcgcccaggatggtggggtccagagtgccaacagcagtgcgagtgcgtgaggggccgatgctccgctgcaagcggagaatgcacctgccctcccggatttcgaggcgcacgatgcgaactgccctgtccagccggtagccacggcgtccagtgtgcccactcctgtggacggtgcaaacacaatgagccgtgtagccctgacacgggatcctgcgaatcttgtgaaccgggatggaatggtactcagtgccagcagccctgtctccccggtactttcggcgagtcctgtgaacagcagtgcccccattgccggcatggggaagcttgcgagcccgatacgggccactgccagaggtgtgacccaggctggctggggccacggtgtgaagacccctgtcccactggaacattcggcgaggattgtgggtcaacgtgcccgacttgcgtgcaaggcagttgtgataccgtgacaggcgattgcgtatgcagcgcagggtactgggggccatcctgtaatgccagttgtcccgctgggtttcatggtaacaattgtagcgtgccctgcgaatgccctgaaggactgtgtcatcctgtgtcaggaagctgtcagcccggatcaggatcccgggacacagccctgatcgctggatctctggttcctctcctgctgttattcttagggctggcctgctgtgcctgttgttgttgggccccaagatcagacctgaaggatcggcctgctcgagacggggcaacagtgtcacgtatgaaactgcaggtttggggcactctgaccagcctgggctctacacttccttgtcggtccctcagtagtcataagctcccatgggtcaccgcatcgtcctctcgaccactgcccgcagggcctctcatgactccaagtcaccctattctttctcttgagcgtcaaatgaggttcttgccgactgtatgccatcccaaaaaaggatggagcctatggcctcgacaggggcgtcagaggccagcctggctgcaggtactcagtaggcctttgcggacacctcctcggcatagtccgagcagggccccaccggcatag

SEQ ID NO: 239700 - DNA, 2613 bp, Artificial Sequence
  Description of Artificial Sequence: Synthetic coding sequence
atggagggagccggacctcggggagcgggtcccgctcgcagacgaggagcgggtggcccaccctccccactcctgcctagtctgctgttattgctgctcctgtggatgctgcctgacactgtggcaccccaagaactgaatccgagaggcagaaacgtttgcagggcccctggctcccaagttcccacctgttgcgccggatggcggcaacagggggacgagtgtggcatagcggtgtgtgaggggaacagcacttgcagtgagaatgaagtttgcgttagacccggtgaatgcaggtgtcggcatggctattttggcgctaattgcgatacaaagtgtccgagacagttttggggcccagattgtaaggaactgtgcagctgtcacccacatggacagtgtgaggatgtgactgggcaatgtacttgccacgcgagaaggtggggggcacgatgtgaacatgcctgccagtgccagcacgggacatgccatccccgtagtggcgcttgcaggtgcgagccaggatggtggggagcgcagtgtgcaagcgcctgctactgttccgcgacatcacggtgtgatccccagacaggcgcatgtctctgccatgcgggatggtggggccgtagctgcaataatcaatgcgcctgcaactcgagtccctgtgaacagcagagtggacgatgtcagtgtagagaacgaacttttggcgcacgatgcgaccgatattgccagtgcttcagaggcagatgccacccagtagatggaacctgtgcatgtgagcctgggtacaggggtaagtactgtcgtgaaccatgtcctgcaggcttttacggacttggttgtaggaggagatgcggccagtgtaaaggccagcagccatgcactgttgccgagggacgctgtctgacttgcgagcctgggtggaacgggaccaagtgcgaccagccttgcgccaccggcttttacggagagggctgcagccatcgatgcccaccttgtcgcgatgggcacgcctgtaaccacgtaacaggcaaatgcacgaggtgtaacgcaggctggataggtgatcgctgcgaaaccaagtgctccaacgggacctacggcgaggactgtgccttcgtgtgcgccgattgcggttctgggcattgtgacttccagtccggaagatgtctttgctccccaggcgttcacgggccacattgtaacgttacctgcccccctgggttgcatggggcagattgcgcacaggcgtgcagttgtcacgaggacacttgcgacccagtcaccggggcttgccacctggagacaaatcagaggaaaggtgtgatgggcgctggcgctctcctcgtcctgctggtgtgcttgttactgtccttactcgggtgctgttgcgcctgcagaggaaaagatccaaccaggagacccaggcccaggagggagctcagcttgggtagaaaaaaggcccctcaccggctgtgcggacgcttttcccgtataagtatgaaactccccagaatacccctgcggagacagaaacttcccaaagtcgtcgtggcacatcatgacctggacaacacgctcaattgttcctttctcgaacctccttccggcctcgagcagcccagtccttcatggtcatcccgggctagcttctcttccttcgatactactgacgaaggccctgtatattgtgtacctcacgaggaagcccctgccgagagtagggatcccgaagtccctacagtgccggcagaggcgcctgcgccatcccccgtccctctcacaacgcccgcttccgccgaagaagcaattccccttcccgctagcagcgacagtgagaggtctgcctcctccgtcgaagggccaggcggagcactgtatgcaagggtcgccagacgggaggccaggcccgctagagcgagaggcgaaatcggcggactctctctgtcaccgtcacctgagcgtcgtaagcctcctcccccagacccagcgactaagccaaaggtgtcttggatccatggcaaacactccgccgctgctgctggcagggcaccatctcctccccctcccggaagcgaggctgcgcctagcccaagcaaaagaaagcgcacacccagcgacaagtccgctcatacggtggaacatgggagccccaggacccgggatcccacaccacgtcctccaggtctgcccgaggaggccaccgcccttgctgctccatcacctcctcgcgcacgtgcacgggcagcacctagacccctaggcgctcatggcagacgcaggagccctgctaaacgggcagaggccgctagcatgctggccgcagatgtaagggggaaaacacgatctttgggccgtgccgaggtcgctctgggagctcagggacccagggagaagcctgctcctccacaaaaggccaagaggtcagtgccacccgctagtcccgctcgagcgccaccagccacagagacccctgggcctgagaaagctgcaactgacctgcccgctccagagacacctcggaaaaaaaccccgatccaaaaacctcctcgcaagaagtcacgggaagcggcaggagaactgggaagggccggtgctccgactctttag

SEQ ID NO: 239701 - DNA, 2493 bp, Artificial Sequence
  Description of Artificial Sequence: Synthetic coding sequence
atggggcttggcctgttactgcccctcttgctcctctggactcgcggaactcaaggtagtgaactggatcccaagggacagcacgtatgcgtggcctcatccccttccgcagagctacagtgctgtgctggttggcggcagaaggatcaggagtgtacaatcccaatctgcgagggcccagacgcctgtcagaaggatgaagtgtgcgtcaagccaggtctgtgtcgatgtaagcccggattcttcggcgcacactgttcctcgcggtgccctggacagtactgggggcctgactgccgcgagagctgtccatgccatcctcacggacagtgcgaacccgctactggagcctgtcaatgccaagctgatcggtggggtgctagatgcgagtttccgtgcgcatgtggcccacatggtcgttgtgatccggctacgggcgtctgtcactgcgagcctggatggtggagcagtacttgccggcgtccctgccagtgcaacactgctgcggctaggtgtgagcaggccaccggggcatgtgtttgtaaaccaggttggtggggtcgtagatgtagctttcgctgcaactgccatggatccccatgtgaacaggattcgggcaggtgtgcctgtcggccaggctggtggggccctgaatgccaacagcaatgcgaatgtgtgcgcggtaggtgtagcgctgcatcaggagagtgcacctgtcctccaggattcaggggtgcacgatgcgagctcccctgccctgccggatcacacggggtccaatgcgctcactcctgcggtaggtgtaagcataatgagccgtgcagtccagatacaggatcctgtgagtcctgcgaacccggatggaatggaacacagtgccaacagccctgtctgccagggaccttcggagagtcctgtgagcagcagtgtccccactgtcgtcacggcgaggcctgtgagccggatactggtcactgccagagatgtgatcccggatggttaggccctcgctgtgaggacccctgccccactggtacatttggggaggactgtggttcaacctgccccacatgcgtgcagggctcctgcgatacagtcaccggcgactgcgtgtgcagtgccggatactggggcccttcctgcaatgcttcctgtcctgctgggtttcacggcaacaactgctcagtaccttgcgaatgccctgaagggctgtgccaccctgtgtccggctcatgccagcctggtagcggttcacgtgacacagctttgattgctggaagtctcgtgccactattattacttttcttgggcctggcttgttgtgcctgttgttgctgggcacccagatctgatctcaaagaccggccagcccgtgacggcgctaccgttagccgcatgaaactacaagtgtgggggactctcacaagcctgggctcaactttaccttgtcgctctttgtcctcacacaagctgccctgggtaaccgtcagccaccacgatcctgaggttccgtttaatcacagtttcattgagcctcccagcgcgggatgggccaccgatgatagcttctccagcgatccggagtctggcgaagcggacgaggttccagcctactgtgtgccccctcaagagggcatggtgccggtggcccaggccggaagcagcgaggcctctctggcggcaggtgcatttcctccgcctgaagacgcgtcgaccccatttgctattccacggacttcttctctggcacgggcaaaacggcctagcgtgagtttcgcggaaggcactaagtttgccccacagagtcgcagatccagcggcgaactgtccagccccctgcgcaagccaaagcggctgtcccgtggcgctcaaagtggtccagaggggagggaggccgaagaatcaactggacccgaggaggccgaggccccagagtcctttcccgctgctgccagccccggtgactcggccacagggcatcgccgacccccactggggggtcgaaccgtcgctgaacatgtggaggccattgaaggttctgtgcaggaaagcagcggccctgtaacaaccatctatatgctggcaggaaagccccgtgggtctgaggggcctgttcgcagcgtgtttcgccacttcgggtcctttcagaaggggcaggccgaagcaaaagtgaaacgcgcaatccctaagccaccccgacaggccttgaaccgaaaaaagggttctcccggactcgcaagtggatccgttggtcaatcccccaattcagcccctaaagcgggtttgccaggtgccactggacctatggcagtccggcctgaggaagccgttaggggtctcggcgctggtacagagtcgagccgccgagctcaggaacctgtatccggttgcgggtctccggagcaggacccgcaaaaacaggcagaagaagagaggcaagaggagcctgagtacgagaacgtggtgcctatttcccgccctccggaaccatag

SEQ ID NO: 239702 - DNA, 2235 bp, Artificial Sequence
  Description of Artificial Sequence: Synthetic coding sequence
atgggccttggcctactcttacctctgctgctgttgtggacgcgtggaacccagggttcagaactcgaccccaagggtcaacatgtttgtgttgcaagttccccctctgccgaactccagtgttgcgctggttggcgccagaaagatcaagaatgtactattccaatatgcgaaggccctgatgcctgccaaaaggacgaggtgtgcgtgaaaccaggcctgtgtcggtgtaagccaggcttcttcggagcacattgttcttcacgttgcccgggacagtactgggggccagattgtagggagagctgcccctgccaccctcatggtcagtgtgaaccagcaacaggcgcatgccagtgccaggcggatcggtggggcgctagatgcgagtttccctgtgcctgtggaccacacggcagatgtgaccccgctacaggcgtttgccactgtgaaccaggatggtggtctagtacttgtcggcgtccctgccagtgtaatactgcggctgcacggtgtgaacaggctacaggagcttgcgtgtgcaagcctggttggtggggcaggagatgctcttttcggtgcaattgtcacggcagcccatgtgagcaagactccggcagatgcgcctgtcggccaggctggtggggtccagagtgccagcagcagtgtgaatgtgtgcgtggaagatgttcagccgcaagcggagaatgtacatgcccgccaggattcaggggagcccgatgtgagctgccatgtcctgctgggagccacggtgttcagtgtgcacacagttgcggacgatgtaaacataatgagccttgcagcccagacacagggagttgtgagtcttgtgaaccaggatggaacggtacccagtgtcagcaaccttgcctcccaggcacatttggagagagttgcgagcagcaatgtcctcactgtcgacacggtgaggcttgcgaacctgacactggccactgtcagcgctgctcggggagtcgggacacagccctaatcgcagggagtctagtccctctcctcctactcttcctcgggctggcatgttgcgcatgttgctgttgggccccaaggtctgatctcaaggaccgcccagcgagggacggagcaaccgtgagtcgtatgaaacttcaagtgtgggggactctgacatcccttggcagtaccctgccatgcagaagtctcagcagtcataagctcccttgggtgactgtcagccaccatgaccctgaagttccattcaaccacagctttatcgaacccccatctgctgggtgggccacagacgatagcttttcatcagatccggaatcaggagaggcggatgaagtgccggcttactgcgtcccgccacaggaggggatggtccctgtcgcccaggccggaagctcagaagccagtcttgccgctggtgctttcccaccacccgaagatgcgtcgacaccattcgctatccctaggactagtagcctggccagggccaagcgcccttctgtgagtttcgccgaaggcactaagtttgcccctcaatcaagacgctccagtggggagttgtcaagccccctgcggaaacctaagcggctgagcaggggagcacaaagcggtccagaaggacgggaagctgaggagtccacaggtcctgaggaggctgaggccccagagtcctttcctgcagctgcaagtccaggggactctgccaccggacaccgaagacctccactggggggtaggactgtggcagagcacgtggaggcaatcgaggggagcgtccaagagagctctgggcctgtcactaccatttatatgctggccggaaagcctcggggttcagagggccctgtaaggagcgtatttagacattttgggagttttcagaaaggccaggccgaggcgaaagttaagagggcaatccctaagccgcctcgccaggctctcaaccggaaaaagggctccccaggactggccagcggttcagtgggccagtcccccaactctgcccctaaagccggtttgcctggggctactgggccaatggcggtgcgcccagaggaagccgtgagggggctgggggcaggcaccgaatcatctagacgcgctcaggaaccagtatctggatgcgggtcgcccgagcaggatccccagaaacaggctgaggaagaacgccaagaggaacccgaatacgagaatgtagtcccgatttccagaccgcctgaaccctag

SEQ ID NO: 239703 - DNA, 1710 bp, Artificial Sequence
  Description of Artificial Sequence: Synthetic coding sequence
atgggattgggtctgctcttgcccctcctgctgctgtggacaaggggaactcagggatctgagctggaccctaagggacagcacgtgtgtgttgcctcttccccctctgccgaactgcagtgttgcgctggctggcggcaaaaggaccaggaatgcacaattcctatttgtgaaggtcctgatgcttgccaaaaagacgaggtttgtgtgaagccgggtctctgtaggtgtaagcccggtttctttggtgcccattgctcgagccgctgccccggacaatattggggaccagactgcagggaatcttgcccatgtcacccgcatggtcagtgcgagcctgccaccggcgcttgccagtgtcaggcagacaggtggggcgctcggtgcgagttcccctgcgcctgcggccctcacggcaggtgtgacccggctactggagtgtgtcattgcgaaccaggatggtggagttctacttgccggagaccctgccaatgtaacactgcagccgcaagatgcgaacaggcaaccggggcttgtgtctgcaagcctggttggtggggcaggcggtgcagtttcaggtgcaattgccatgggagcccatgcgaacaggattctggacggtgcgcctgtaggccaggctggtggggtcctgagtgccagcagcaatgcgagtgtgtccgcggtagatgtagcgccgcatcaggcgagtgtacttgtcctccgggttttcgaggggctagatgcgaacttccatgtccagctgggtcgcatggcgtgcaatgtgcacactcctgtggacgctgtaaacataatgaaccatgtagcccagacaccggaagctgtgagagctgcgaacccggttggaatggcacccagtgtcaacagccgtgtctgccaggaacgttcggggagtcttgcgagcaacagtgtccccactgtagacacggcgaggcatgtgagccagatacgggacactgtcagaggtgtgatcccggttggcttgggccacgctgcgaggacccttgtcctaccggcacctttggtgaagattgtgggagcacatgtccaacctgcgtacagggaagctgtgatacagtcaccggggactgtgtgtgttctgcaggttactggggcccaagctgtaatgctagctgtcctgccggattccacggaaataactgctccgtgccgtgtgagtgtccagaaggcctgtgccatcccgtatccggatcatgccagcccggaagcggctctagggatactgctctcattgcaggtagtttagttccgctattgcttctcttcctcggcttagcatgttgtgcctgctgttgttgggctccacggtctgaccttaaagatagacctgctagagacggtgcaacagtgtccaggatgaagctgcaagtctgggggacgctcacatcactcggcagcacactgccctgtagatctctctcaagccacaaattaccctgggtgaccgcctcttccagtcgcccactccctgccggacctctcatgacgccctcgcaccctatactgagccttgagaggcagatgcggttcttgcctactgtgtgccaccctaagaagggatggagcctttggccccgacagggacggcagagaccagcatggctgcaggttcttagccgcccactccggactcctccacgccactcaccgtcacgcgcaccgccagcgtag

SEQ ID NO: 239704 - DNA, 2595 bp, Artificial Sequence
  Description of Artificial Sequence: Synthetic coding sequence
atggaaggcgctggtcctcgcggagctggcccagccagacgtagaggcgcaggcggtcctccaagccccctgttgccgagtctgttactcctgctcctgttgtggatgttgccagacacagtggcaccccaagagctcaacccacgcggacgaaacgtgtgcagggctcctggatctcaagttcctacatgctgtgcagggtggagacagcaaggtgacgagtgcggaattgcagtttgcgagggtaatagcacctgtagtgagaatgaagtgtgcgtcaggcctggagagtgccgctgccggcacggttatttcggtgctaactgcgataccaagtgcccgagacagttctggggccctgactgcaaagaattgtgctcatgccacccacacggccagtgtgaggacgttacagggcagtgtacgtgccacgcacggcgatggggcgcaaggtgtgagcacgcttgccagtgccagcacggtacttgccacccaagaagcggcgcttgtcggtgtgagccagggtggtggggtgcccagtgtgcatccgcatgttactgctccgccacctcgaggtgtgatcctcagacaggcgcatgtctgtgtcatgcgggttggtggggtcggtcatgtaacaaccagtgcgcctgtaatagttctccgtgtgagcagcaaagtggcaggtgccagtgtcgcgagcgaacatttggtgccagatgtgataggtattgtcaatgcttcagagggagatgccaccccgtagatgggacctgcgcgtgtgagcccggatacaggggtaaatactgtcgcgagccatgtcctgcgggattttacggtttggggtgtcgcagacgctgcggacagtgcaaaggccagcagccttgcacagttgccgagggcaggtgtctcacatgcgagcctggatggaatggcaccaagtgcgatcagccctgcgcgaccggattctacggcgaggggtgcagccatcggtgtcccccatgtagggatggacatgcatgcaaccatgtaaccggaaaatgcacccggtgcaatgccggatggatcggagaccgctgtgagaccaagtgctcaaatggaacttacggggaggattgcgcctttgtctgtgcggactgtgggagcggccattgcgacttccaatctgggcgatgtctgtgttccccaggggtgcatggtcctcactgcaacgtgacgtgccctcccggtttgcacggagctgattgtgcacaagcatgctcctgtcacgaggacacatgcgacccagttactggcgcttgtcacctcgaaacaaatcagagaaaaggggtcatgggggctggcgctttgctcgtgctgctggtctgcttactcttatcgctgctcggctgctgttgtgcctgcagggggaaagatcctacccggcgagagctcagcctgggccgaaagaaggctcctcatcggctttgtggccgattttccagaatctcaatgaagcttcctagaatcccacttcggagacagaaacttcctaaggtcgtcgttgctcatcacgatcttgacaacaccttgaactgctcatttctcgagcctccgtcaggcctggagcagccttcccctagttggagctctcgggcaagtttcagctcttttgacacaacagatgaggggccagtctattgcgtacctcacgaggaagccccagccgaaagtagggaccctgaggtgcctacagtgcctgctgaagccccagcgcctagtccagtgccactgacaacaccagccagcgccgaggaagctattcctctgcccgcaagttctgatagcgagagaagcgcatcgagtgtcgagggacctggcggagctttatatgcacgggtggctagaagagaagcacgacccgctagagcacgaggcgaaatcggaggtctatccctctccccaagtcccgaacggaggaagccccctcccccagacccagcaacaaaacccaaggtgagctggattcacggaaagcatagcgccgcagcagctgggcgagctccatcccccccacctccgggaagcgaagcagccccaagtcccagcaaacgcaaaaggactccctccgataagtcagcacacacggtggagcacggttccccaaggacgcgtgatcccaccccacgaccaccgggtcttccagaggaggctacagccttagccgcacccagcccaccacgtgccagggcccgtgctagacctggcctgctggagccaactgatgctggcggaccgccaagatcagctccggctgcatccatgctcgctgcagacgttcgcggtaagactcggagcctgggcagagccgaagtagcattgggtgcccagggaccccgagagaagcccgcaccccctcagaaagctaaacgctcagtcccacccgctagtccagctcgtgctccacctgcaaccgaaacacctggtccggagaaagctgccacagatctgcccgctccagagacaccgcgtaaaaaaacgcccatacagaaaccccctaggaagaagagtagagaggccgcaggagaattaggaagggccggtgcacctacactgtag

SEQ ID NO: 239705 - DNA, 2598 bp, Artificial Sequence
  Description of Artificial Sequence: Synthetic coding sequence
atggagggcgcaggacctaggggtgcgggaccagcacgccgtcggggagcaggcggaccgccatctccgctgctgccatcacttctactgcttctcctgctgtggatgctccccgacaccgttgcccctcaagaattaaaccccagaggcagaaatgtgtgcagggcgcctggaagccaagtccccacttgctgcgctggctggaggcaacagggtgatgagtgcggcatcgctgtctgcgagggcaactcaacctgctctgaaaatgaggtctgtgtacgcccaggggaatgccggtgtcggcacgggtatttcggggcaaactgcgataccaaatgcccacgccagttttggggcccagactgcaaggagctgtgctcatgccacccccacggacagtgcgaagacgtgaccgggcaatgcacctgtcacgcccgtaggtggggagccaggtgtgaacatgcttgccagtgccaacacggaacttgccacccaaggtccggggcatgcaggtgtgaacccggatggtggggcgcacagtgtgcatcagcctgttattgcagcgccacaagccgctgtgatccacaaacaggagcatgtttgtgtcacgcagggtggtggggcagaagctgcaataatcaatgcgcctgtaattctagcccctgcgagcaacagtcaggacgctgccaatgccgggaacgtacctttggtgccagatgtgatagatattgtcagtgcttccgaggccgatgtcatccagtggatggcacttgtgcgtgcgagccgggttaccgcggtaaatattgtagagagccttgtcctgccggattttacggcctcggctgcagacgtagatgtggccaatgcaaagggcagcagccatgtaccgtggctgaagggcgttgtctgacttgcgaacccggatggaacggcaccaagtgcgatcagccatgtgccacaggtttttatggagaaggctgtagtcacagatgcccaccgtgccgcgatggacatgcatgtaatcacgttacagggaagtgtacccggtgtaatgcgggatggatcggcgaccggtgtgagacaaaatgctctaatgggacatacggagaggattgcgcttttgtgtgtgccgactgtggatcgggccattgcgattttcagagtgggcgttgtctgtgtagccccggtgttcacgggccacactgcaatgtgacctgtccccctggcctccacggggctgattgcgcgcaggcatgttcatgccatgaagatacttgcgatcccgtgactggcgcttgtcatctagaaactaaccagcgtaaaggcgttatgggggctggagcactgctggtcctgctggtttgcttgcttcttagcttgcttggctgctgctgcgcctgccgcggaaaggaccctacacgacgagagcttagcctgggtcggaagaaggcaccccataggctgtgtgggcgtttctcccggatttctatgaaattaccccgaatccctcttcggaggcaaaaattgccaaaagtcgttgtggcacaccacgacttggataacaccctcaactgttcttttctggagcccccatccggcctggagcaaccttccccatcctggtccagcagggcttctttctcgtcctttgacaccaccgatgaaggtcccgtgtactgcgttccacacgaggaagccccagccgaaagccgcgaccctgaggtgcctacagtgcctgccgaagcccctgctccctcacccgtgccgctgaccacccccgctagcgccgaggaagcaattcccctgccggcaagcagtgacagcgagcgatccgcttccagcgttgaaggaccagggggagccctgtacgccagagtcgcccgacgggaagctcggcctgctcgggctcgtggcgaaatcgggggtttgtccctctcaccaagtcctgagcggaggaagccgcctccccctgatcctgccaccaaaccaaaagtctcttggatccatggaaagcattccgctgcagctgccggtcgcgctcccagtcccccacccccaggctcagaggctgccccttcccctagcaaacggaagcggacgccgagtgataaatcggctcatacagtcgagcatggatcccctcggacccgagatcccactccgcgaccaccagggttgcctgaggaagccacagccctggccgctcctagccccccacgggcacgcgcacgagccgctccgaggccacttggagctcacggccgtcgtcgtagccctgccaagagggctgaagccgcttctatgctggcagccgacgtaaggggaaagacacggtctctcgggagagctgaggtggcgctcggggcacaaggtccccgagagaagcccgcaccccctcagaaggcgaaaaggtccgtgcctcctgctagcccagcccgtgcaccaccagccaccgaaacaccaggaccagagaaggcagccaccgacctcccagctcccgagactcctcgaaaaaagacccctattcagaagccaccacgtaagaagtcgcgcgaggccgctggcgagctcggaagagccggtgctccaacgctatag

SEQ ID NO: 239706 - DNA, 1728 bp, Artificial Sequence
  Description of Artificial Sequence: Synthetic coding sequence
atgcacaaggaagcggagatgctcattggccctcagctcgatgaaaaaagatgggggtggcggttgggcgacggttctgcggctcctcctttcttgccccaggcgctttcttttttactgttgctcccactggcttcggcccttcagcctactccactgcccttccaggaactgcgcctggttggcggaccatcccgttgcaggggtagattggaagttatgcatggcggatcttggggatcggtgtgcgatgatgactgggatgtggtagatgccaacgtagtatgccgtcagctggggtgcggtctagcgctgcctgtcccgaggcctttggccttcggccaaggcaggggcccaatactgttggacaatgtcgagtgccggggacaagaagctgctcttagcgaatgtggctcccgtggatggggggtccacaactgcttccactacgaagacgtagccgtcctgtgcgacgagtttctgcccacccagccgcctactcgcaagatgcttacaagtagagcacctccaactaccctgccgaatggaaaaagtgagggctcagtgagactcgtaggcggagctaacctgtgccaagggagggtggaaattttgcactctggattgtgggggacagtttgcgacgacgactggggtctgcccgacgcggctgtcgtgtgccgacagttgggctgtggcgctgcaatggccgctacgactaacgcctttttcggctacggcacaggtcatatccttctggacaacgtgcattgcgaaggtggcgagccccgtctcgccgcatgccagagcctcggctggggggtgcataactgcgggcatcatgaggatgccggagcgttgtgcgccggtcttgggcctccaacgctcaccgctcttccatccagtgccacccgggaagactgggcatggcaaacggacccctccgcgaccggcgtggggcctcaacctagcagggaaactgcgctgctaacaaccgctgcatgggcagcagggaaaaagagcggcaggctgagactggtgggcggacccggaccctgtcgcggacgggtggaggtcttgcatgcaggcggatggggaactgtgtgtgatgatgactgggacttcgcagatgccagggttgcctgccgcgaggcagggtgcggcccagcattgggcgctactgggctgggccacttcggctacggaagaggcccagtcctcttagataatgtgggatgtgccggtaccgaggcccgactgtcggattgcttccatctggggtgggggcagcataattgcggtcaccacgaggatgccggagcactttgtgcgggtcctgaagagctcgggctgcaggtccagcaggacggcagtgaaaccaccagagtccctacacccagaccccgtgatggacacctcaggctggtcaatggcgcacaccgctgcgaggggagagtggaactgtatttaggccagcggtggggcaccgtgtgtgatgacgcctgggacctgcgggcagcaggcgtgctctgccggcagctcggatgcgggcaggcccttgcggctcctggcgaggcccatttcggcccaggcaggggcccaattctccttgacaatgtcaaatgtcgtggcgaagagagcgcccttctcctgtgctcccacatccgctgggatgcccataactgtgaccatagcgaggacgcatccgtgctttgtcagcccagttag

SEQ ID NO: 239707 - DNA, 849 bp, Artificial Sequence
  Description of Artificial Sequence: Synthetic coding sequence
atgtccaacgtgactctgaggaaaatgtcaccaaccggcaatgagatgaaatcgaccacacaggggacaaccaggaagcagcaggactttcatgaggtgaataagcggcgaacattcttgcaggacaattcctggatcaagaaaagaccagaggaggagaaggacgaaaactacggccgagtcgttctaaatcgccacaatagccatgacgcccttgatagaaaggtgaatgagagggatgtacctaaggccaccatctctcggtactcaagcgatgataccctggataggtccatgtccatgtttagatccctcgaagtcaccaagctccaaccagggggtagccttaacgcgaacacctctaatacaatcgcttctactagcgcaacaactcccgtgaagaagaaacggcagtcctggttcccccctccccctcctggatacaatgcctccagctcaacaggcacaagaagaagggaacccggtgtgcaccccccaattcccccaaagccttcatctcctgtttcatctccaaatcagctgagacaagacaatcgccagattcatccacccaaaccgggtgtctacacagaaacaaatcggagtgctgaaaggaacattagcgaggagctcgataacttaataaagatgaacaaaagtctgaataggaaccaaggactggattcactcttcagagcgaatcccaaagtggaagaacgcgaaaagcgggctaaatccctggagagtttgatctacatgtccactaggacagataaggacggaaaaggcatccagtcattgggttccccaatcaaagtcaaccagagaaccgataaaaacgaaaagtag

SEQ ID NO: 239708 - DNA, 2067 bp, Artificial Sequence
  Description of Artificial Sequence: Synthetic coding sequence
atgagtaacgtgaccttgcgaaagatgagcccaactggcaacgagatgaaatccactactcagggcacgaccagaaagcagcaggattttcacgaggtgaataaacgcaggacctttctgcaagataatagctggatcaagaaaagacctgaagaggaaaaagacgagaattacggaagggttgtgctgaataggcacaatagtcatgatgcactggacagaaaggtcaatgagagagacgtgccaaaagcaaccatttcgagatactcttccgatgacaccctggataggatctcggatcgcaacgacgctgccaagacatacaaagctaataccctggataatcaactgacaaatagatctatgtccatgtttaggtcacttgaggtaacgaagctccagccgggtggctcacttaacgcaaacacgagcaacaccatcgcatccacatccgcaacaacgcctgtcaaaaagaagaggcaaagctggtttcctccaccccctcctggctataatgcttcgagttcaacgggaaccagacgccgtgagccaggcgtccacccccctattccgccaaagccttcatcaccagtgagtagtcccaatcaacttagacaggacaatagacagattcatccgcctaagcctggcgtgtacactgagaccaatagatctgccgagaggaatattcgcagccaagatttggataatatcgtgaaagtggctacctcactgcagagatccgacaagggcgaagagctggacaacttgatcaaaatgaacaaatcccttaataggaaccaaggactggactcactgttccgggctaaccccaaggtggaagaacgcgaaaaaagagctaaatctctagagtcacttatttatatgtccacacggaccgacaaggacggaaaggggatacagtctctgggaagcccgatcaaggtgaaccagaggaccgataaaaacgagaaaggcagacagaatctcgagtcggttgctaaggttaacgcccgtatgaataagacgagcaggagatcagaggatttagataatgcaaccgaggtgaatcctaaaggtcacgagaatactaccggaaaaaaggacctcgacggtctaatcaaggtagatcctgagactaacaaaaacattacccggggacagtctctggacaacctgatcaaggtgacgccggaagtgaagagatcaaaccaggggtcgaaggacctgaataattttatcaaagtgtatcccggaaccgagaagtcaaccgaagggggacaaagcctcgactccctcatcaaggttactccagaaagaaaccggactaaccagggtaaccaggacctcgaaaatctgatcaaggtgattccttcggccaacaaatcttctgagcagggtctggatgagcatatcaacgtgtcccccaaggccgtgaagaacactgacggcaagcaagacctggacaaattgatcaaagtgaatcccgagatttttacaaacaaccaaagaaaccaagatcttgccaatttaatcaaagtgaaccctgctgtgattcggaacaaccagagtcaggacctggacaacctgatcaaagtgaagccgtcggcccttcggaacactaatcgagatcagaacctcgaaaacctaatcgaagttaacagccacgtgagcgaaaacaaaaatggctcaagtaacacaggtgctaagcaagcaggccctcaagatactgtggtgtatacgcgcacctacgtcgagaactcaaaatcacctaaggacggataccaggaaaacatctctgggaaatatattcagactgtgtactctacatctgatagatccgtcattgaaagagacatgtgcacatattgcaggaagccactgggcgtggagacgaagatgattctggacgaacttcaaatttgctgccactccacatgcttcaagtgtgaaatttgcaaacagcctctggaaaacctgcaagccggagattccatatggatctaccgccagaccattcactgcgaaccgtgttactcaaagatcatggcaaagtggataccttag

SEQ ID NO: 239709 - DNA, 2007 bp, Artificial Sequence
  Description of Artificial Sequence: Synthetic coding sequence
atgtcgaacgtgactctgcgtaaaatgtctcccacgggtaacgaaatgaagagtaccacacaggggactactcgcaagcaacaagacttccatgaagtgaacaagagaaggacattcctgcaggataactcttggatcaaaaaacgtccagaagaggagaaagatgaaaactacggacgagtcgtgttgaatcggcacaacagtcatgatgccctagatcggaaggtgaatgagagagacgtcccgaaggccacaatcagtagatattcttccgacgataccctggatagaattagcgaccgcaacgacgccgcaaaaacttacaaagccaacactctagataatcaactgaccaatcgctctatgagcatgtttcgcagcctggaagtgactaagctgcaacccggaggttccctgaacgctaacacgagtaatactattgccagcacctcagcaactactcccgttaagaagaaacggcagtcctggttccctcctcccccaccagggtataatgcctcatcctctaccggaacacggaggagggagcccggagttcatcctcctattcctccaaagccgagctcccccgtttcatcaccaaaccagcttaggcaggataatcgccagattcaccctccaaagccaggagtgtatacagaaaccaataggtccgctgagcgcaatatctcagaagagttggacaatctaattaaaatgaataaatctctgaataggaaccagggtctggattcacttttccgggctaatcctaaggttgaggaaagggagaaaagggcgaaatccctggagagcttgatctatatgtccacacgcacagacaaggatggtaaaggtatccagtccctgggtagcccaattaaagtcaaccagcgcacagacaagaatgaaaagggcagacagaacctggagagtgtggccaaagtcaatgccagaatgaacaaaaccagtcgcaggagcgaagacttggacaacgccacagaggtgaacccaaaagggcatgagaatacaacgggtaagaaggatctagatggcctcattaaggtcgaccctgagacaaacaagaacatcacaagaggtcaatccctagacaaccttatcaaggtcactcctgaagttaagcgtagcaatcagggatctaaagacctgaataacttcatcaaagtttacccaggcactgagaaaagcacagagggagggcaatctctagattctcttataaaggttacacccgagagaaatcggactaaccagggcaatcaggacctcgagaatctcattaaagtgatacccagtgccaataaaagctcagaacagggccttgatgaacacattaatgtgagcccgaaggccgtcaagaacacagatggtaagcaggacctggataagttgatcaaagtgaatccagaaatatttaccaacaatcagcggaatcaagacctggccaatctgatcaaggtaaatccagcagtgattcgcaataaccagtcccaggacctggacaatctgataaaagttaaaccttctgccctgcgcaatacaaatcgggaccaaaatcttgaaaacctcatcgaggtaaactcccacgtctccgagaacaagaatgggagcagcaataccggtgcaaagcaggctggccctcaggataccgtcgtgtataccagaacttatgtggagaatagtaagtcacctaaagacggctaccaggagaacatttccggtaaatatattcagacagtctatagcactagcgacaggtccgtaatcgagcgagatatgtgtacttattgtaggaagcctttgggcgtggaaacaaaaatgatcttggacgagctgcagatttgctgtcactctacctgttttaagtgcgaaatttgcaagcagcctctagagaacttgcaggccggtgacagtatctggatataccggcaaaccatacattgcgagccctgttattctaagattatggccaaatggatcccctag

SEQ ID NO: 239710 - DNA, 1941 bp, Artificial Sequence
  Description of Artificial Sequence: Synthetic coding sequence
atgtccaacgtcaccctccgtaagatgtccccgactgggaacgaaatgaagtctacaactcaggggactacgaggaagcagcaggactttcacgaagtgaataagcgtcggacattcctccaggataattcttggatcaagaaacggcctgaggaagagaaggatgagaactatggacgggttgttctcaatcggcataattctcatgacgctctggatagaaaagtcaacgagcgggatgtgccaaaggctactatctccagatactcttctgacgacaccctggatcgtatctctgatcggaacgacgcggcaaagacatacaaagcaaatactctcgataaccagctcaccaaccggagcatgagcatgttcagaagcctggaggtgactaaactgcagcctggtggatccctgaatgctaatacatccaacactatcgcttccacaagcgctactacgccagtcaagaagaaaagagagcccggtgtccatccacccataccacctaagcctagttctcctgtgagctctccaaaccagctgagacaggataatcggcaaatccatccaccaaagcctggagtctacaccgagacaaataggtcagctgaacggaatatacggagtcaggatttagataatattgtcaaagtggccacatccctccagagatcagacaaaggcgaagagctagataatctgataaaaatgaataaatcgttaaatcggaatcaaggtttggactctctgttccgagccaatccaaaggtggaagagagagaaaagagagccaaaagcttggagtccctgatctacatgtccacccgaacagataaggatggaaagggcatacagtcgttaggatcacctatcaaagtgaaccagagaacagacaagaatgaaaagggacggcagaatctggaatccgtcgctaaagtgaacgccaggatgaataagacctccagacggtcagaggacttagataatgcgactgaggttaaccctaaggggcacgaaaacacgaccgggggtcagtccctggacaacctgataaaggtgacacctgaggtgaagcgaagtaatcagggctctaaggatctgaataacttcatcaaggtgtaccccggtactgaaaagagtacagagggcggacagtctttggatagtctgatcaaggtgacacccgaacgaaacaggaccaaccagggaaaccaggatctggagaatcttattaaagtgatcccgtctgccaacaagtcaagtgagcagggcctggatgagcacatcaacgttagtcctaaggccgtgaagaacactgacggcaagcaggatttggataagctgattaaagtgaaccccgaaattttcaccaacaaccagagaaaccaggatttggctaatttgatcaaagtcaatcctgctgtcatccgaaacaatcagtcccaagacctggacaaccttatcaaggtgaagccctctgccctgagaaacaccaacagagaccagaacctggaaaacctgattgaggtgaattcccacgtgagtgaaaataagaatgggagcagcaatactggtgctaagcaggccggaccccaggacacggtagtctacactcggacctatgtggaaaattctaaaagtcccaaggatggataccaggaaaacatctccggcaaatacattcagacggtgtattctactagcgacagaagcgtgattgaacgcgacatgtgtacctactgtagaaagcctctgggcgtcgaaactaaaatgatcctggatgagcttcagatatgctgtcactccacctgcttcaaatgcgaaatatgtaaacagcctttggagaacctgcaggcaggcgatagcatctggatttaccgccagactatccactgtgagccctgttattccaagattatggctaaatggatcccttag

SEQ ID NO: 239711 - DNA, 2148 bp, Artificial Sequence
  Description of Artificial Sequence: Synthetic coding sequence
atggctcgggaattataccacgaagaattcgctcgtgctgggaagcaggcaggactgcaggtttggaggatcgagaagctggaactggttcccgtccctcaatcagcccacggtgacttttacgtgggagatgcctacttggtccttcataccgccaaaaccagccgcggatttacgtaccatctccatttttggctgggtaaggagtgtagtcaggacgaaagcacagccgcagccatttttacagtgcagatggacgattatctaggagggaagccagttcaaaacagagaacttcagggctacgaatctaacgactttgtaagttatttcaagggcggtctgaagtacaaggctggaggggtggcaagtggattgaaccatgtgttaacgaatgatctcactgctaaaagacttctgcacgttaaggggaggagagtcgttcgcgctacagaagtgcctctgtcttgggacagcttcaataaaggagattgctttataatcgatctggggaccgagatctaccagtggtgcggaagctcttgtaataagtacgagcgactaaaagcaaatcaggtcgcgaccggaattcgatataacgaaaggaagggccgtagcgagttgatcgtagttgaggaagggagtgagcctagcgagctgattaaggttctcggagaaaaacccgagctgccagatgggggagacgacgacgacataatcgcggacatctcaaatagaaaaatggcgaagctgtacatggtgagtgacgcttccggatcgatgagggtcacggtggttgctgaggagaacccctttagcatggccatgttactgtccgaagagtgcttcattctcgatcatggggcagccaaacagattttcgtgtggaagggcaaagatgccaatccccaggagaggaaggccgctatgaagaccgcggaggaattcctccagcagatgaattatagcaagaacacgcaaattcaggtgcttccggagggcggtgaaactccgatcttcaaacagtttttcaaggattggagggacaaggaccagagtgacggatttggcaaggtttacgtaactgagaaggtcgcccagatcaagcagattccattcgacgcaagtaaacttcactcatccccccagatggcagctcagcataatatggtcgatgatggatccggcaaggtggaaatctggcgggtggagaataacgggagaattcaggtcgaccagaattcttacggagagttctatggcggtgattgctacattatcttgtacacttatccgcgaggacagattatttatacctggcagggcgctaatgccacccgcgatgaactcacaacctctgcattcttgacggtgcaattagacagatctctgggcggacaagctgtccaaataagggtatcccagggtaaagagccagtgcatctcctttctctgttcaaggacaaaccgttgattatctataaaaacggcacttccaaaaagggtggccaggccccagcgccacccacccgcctgttccaggtcagacgtaatctcgcatctatcactcggatcgtggaagtggatgtcgacgccaatagcctcaactcaaatgacgtgttcgtgctgaagttaccccaaaattctggctatatctgggtgggcaagggtgcatctcaggaggaagagaagggagctgagtacgttgcctccgtactgaagtgcaagaccttgagaatccaggaaggggaggaacccgaggagttttggaatagtcttggtggaaagaaggattatcaaacatccccactcctcgagactcaggcagaagatcacccccctagactgtacggatgtagcaataaaactggtcggttcgtgatagaggaaatcccaggcgaatttacacaggatgaccttgccgaagatgatgttatgctcctcgacgcctgggaacagatttttatttggattggaaaagatgccaacgaggtcgagaaaaaggagtcactcaaatccgccaagatgtatttggagacggatccttccggtagggataaacgcactcccattgtaatcattaaacagggccatgagcctccaacttttacaggatggttccttgggtgggacagctccaaatggtag

SEQ ID NO: 239712 - DNA, 1407 bp, Artificial Sequence
  Description of Artificial Sequence: Synthetic coding sequence
atggctaagctgtatatggtcagcgacgccagcggctccatgagggtgacagtggtagccgaagagaatcccttcagtatggccatgctcctgtcggaggagtgcttcattcttgatcatggtgctgctaaacagatatttgtgtggaaaggtaaggacgcaaatccacaggagcggaaagctgccatgaaaacggctgaagagtttctgcagcagatgaattatagcaagaatacccaaatccaagtcctgccagagggtggagagacacctatcttcaaacagtttttcaaagactggagggacaaggatcagagtgatggtttcggcaaagtctacgtcacggaaaaggtggctcaaataaagcaaatccccttcgatgctagcaaactgcacagcagcccacagatggccgctcagcataacatggtggatgacggatctgggaaggttgaaatatggcgggtcgaaaataatggacggatacaggtggaccagaacagctatggggagttttacgggggagattgctatataattctttacacatatcctaggggccaaatcatatacacctggcaaggcgcaaacgctactagggacgagctaactacctccgcattcttgactgttcagctcgatagatctttgggcggacaggctgtgcagatcagagtgtcccagggtaaggagcctgtacatttactgtccctgtttaaggataaaccattgatcatttacaagaatggtacatcaaaaaagggtggtcaggcaccagcacctcctacaaggctgtttcaagtgagacgtaatttagcatcaataactcgaatcgttgaggtagacgtggatgcgaactctctgaatagcaatgatgtgttcgtactgaaactgcctcagaattccggctacatctgggtcggcaagggcgcatctcaggaggaagagaaaggagccgagtatgtcgctagcgtactcaagtgcaaaacccttcggatccaagaaggtgaggagccagaagagttctggaattcactgggtggaaagaaagactatcagacgagtcctctactcgagacccaggccgaggaccacccccctcgactttatgggtgctcaaacaagaccggcagattcgtaattgaggagataccaggtgaattcacccaggatgatctggcagaggatgacgttatgctgctggatgcatgggagcagatcttcatttggattggcaaggacgcaaacgaggtggaaaaaaaagaaagtctcaaaagcgcaaagatgtatctggagaccgacccaagtggtcgggacaaacggacccctattgttatcatcaaacagggccatgaacccccaacatttaccggatggttccttggttgggactctagcaaatggtag

SEQ ID NO: 239713 - DNA, 1407 bp, Artificial Sequence
  Description of Artificial Sequence: Synthetic coding sequence
atggccaagctgtatatggtgtcagatgcgtctggttcaatgagggttaccgttgttgcagaggagaatccgttttccatggcaatgctgctgagcgaggaatgctttatactggatcatggggcagctaagcagatattcgtgtggaagggaaaagacgccaatccccaagaacgaaaggctgcgatgaaaaccgcggaggagtttctgcaacagatgaattattcaaaaaacacccagatccaggttcttccggaaggaggagaaacccccatctttaagcagtttttcaaggattggcgggacaaagaccagagcgacggctttggcaaggtttacgtaaccgagaaagtagcccagatcaaacagatccccttcgacgcgagcaaactacatagcagcccgcagatggccgcacagcacaatatggtggatgatggttctggaaaggtagaaatctggcgcgtcgagaataatgggagaatccaggtcgaccaaaattcatatggagaattctacggcggagactgctatatcattctgtacacctaccccaggggacagattatctacacatggcagggtgcgaacgccaccagggacgagctcacaaccagcgcattcctgacggtgcagctggaccggagtctcggcggtcaggcggtgcagataagagtgtcccaggggaaagagcctgtgcacctgcttagcctgtttaaggataagccactgattatatataaaaacggtacttccaagaaaggcggacaggctcccgctcctcccactaggctgttccaggtccgcagaaatctggccagtattactcgtatcgtggaagtcgacgtggacgcgaacagtctcaatagtaatgatgtcttcgtcttgaaacttccgcagaactcaggatacatctgggtcggaaaaggcgcatctcaggaagaggagaaaggggctgaatacgtcgccagtgtccttaaatgtaagaccttgcggatccaggaaggagaagagcctgaagagttctggaactctctgggaggaaagaaagattatcaaacgtctcctcttctagaaactcaggcggaagaccatccacctcgcctctacgggtgtagtaataagacaggtaggttcgtgattgaagagattccaggagagttcacccaagatgatttggctgaggacgatgtgatgctactggatgcatgggaacagatcttcatctggatcgggaaggacgcgaatgaggttgagaagaaggaatccctgaagtctgcaaaaatgtatctagagacagatccatcagggagggacaaaagaaccccaatcgtcatcataaagcagggtcatgagccaccaaccttcactggttggtttctgggatgggattctagtaaatggtag

SEQ ID NO: 239714 - DNA, 3864 bp, Artificial Sequence
  Description of Artificial Sequence: Synthetic coding sequence
atggaacccatctatcccttcgctcgccctcaaatgaataccagattcccttcatccagaatggtgccttttcactttcccccttccaagtgtgccctgtggaatccaacacccacaggggatttcatatacctgcacttgtcttattacaggaaccccaaacttgttgtaacggagaagaccatcaggctggcctatcgacacgccaaacagaataaaaagaatagcagttgcttccttcttggttctctgactgccgatgaagacgaggagggggttacactcacggttgacaggtttgatcccggtagggaggttcccgagtgcctagagataacgcctaccgccagcctgccaggagatttcctgataccatgtaaagtccacactcaggaactgtgttcccgggaaatgatcgtgcactcggttgacgacttttcgagcgcactgaaggctttgcagtgtcacatctgtagcaaggacagccttgactgtggaaagcttctgtcccttagggtgcacatcacctcccgcgagtcgctggattctgtggaatttgatctgcactgggccgctgtcacgctcgcgaataacttcaagtgtacccccgtgaaaccaatcccaattattcccactgccttagcccgaaacttgtctagcaatctgaatatttcacaggtacagggtacttacaaatacggctaccttactatggatgagacccggaaattattactattactggaaagtgatccaaaggtctattctttgccccttgttggaatctggctcagtgggatcacccatatttacagcccccaggtttgggcgtgctgcctgaggtatatcttcaattcctctgtgcaagaacgggtctttagtgaaagtggtaacttcatcattgttctttattccatgacccataaagagcccgagttctacgaatgcttcccatgtgatggtaagatccctgacttcagatttcagcttttgacctctaaggagacgctgcatctttttaagaacgtggagccccctgataaaaatcccatcagatgtgagctgtccgctgagtcccagaacgccgagaccgagtttttcagcaaagcgagtaaaaatttctctatcaagcggagcagccagaaactgagttctggaaagatgcccattcatgaccacgattccggtgtggaggacgaggacttcagcccacgaccaatcccctcgcctcacccggtgagtcagaagatttccaaaattcaaccaagtgtgcccgagttgtctctcgtgcttgacggaaactttatcgaaagcaacccattgccaacacctctggagatggtgaataacgagaacccaccactcattaaccatctcgagcacctgaaacccctacagccgcaattatatgacgaaaaacactccccggaagtcgaggccggtgagccaagtttgcgcggaatccccaaccagttgaatcaagacaagccagccctgctccgccattgtaaggtgagacagccccctgcctacaaaaaggggaacccacacacaagaaattctattaagccatcctcgcataacggccctagtcatgatatctttgagaagctccagactgtgagcgctggaaacgtccagaacgaagaataccccataagaccaagtacactaaacagtaggcagtccagtctcgccccacagtcccagcctcacgacttcgtcttttcgcctcacaatagcggacgtccaatggagctacagattcctacccctcccctgcccagctactgcagcaccaacgtgtgcagatgttgtcagcatcactcccacatacagtattcccccctgaactcttggcagggagccaacaccgtgggatccatccaggatgtgcagagcgaagccctccagaaacatagtctgttccacccaagcggctgtccggcactatactgcaacgcattttgtagctcctcctcacctatcgctctgcgaccccagggagacatgggctcatgctcaccacatagcaacatcgagcctagcccagtggccagaccgccaagtcacatggacctctgtaatccccagccttgtactgtgtgtatgcacacacccaaaaccgagtcggataatgggatgatgggcctttccccagacgcctatcgcttccttacggagcaggaccggcaactccgccttctgcaagctcaaatccagcgacttctcgaagcacaaagcctgatgccctgctcccccaaaactaccgccgtggaagatacggtgcaagctggacggcaaatggagctggtgagcgtagaggcgcagagtagccctggcctgcatatgcgcaaaggcgtcagcatagccgtctcaactggcgcatctctgttctggaacgcagctggagaggatcaagagcctgattcacaaatgaagcaagatgatacaaagatctccagcgaagatatgaacttctctgtggacattaataacgaggtgacatctctgccaggatcagcctccagtttaaaagccgtggatataccatctttcgaagagagcaacatagccgtcgaagaggagttcaatcagcccctgagtgtgagcaattcctctctagttgtccgcaaagagcccgacgtcccagttttcttcccgagcgggcagctagccgaatccgtctcaatgtgtcttcaaacagggcctactggaggagcatctaataatagcgagacgtcagaggaacctaagattgagcatgttatgcagcctttgttgcaccagcctagtgacaatcagaagatataccaagacctgctcggacaggtgaatcatctactcaattcaagtagcaaagaaaccgagcagcccagcacaaaggcagtgattataagccatgaatgcacccgcacccagaatgtgtaccataccaaaaaaaagacccaccattccagattggtggataaagattgtgtgctcaatgcaaccctgaagcagctgaggagcctgggcgtgaaaattgactctcccacaaaggtcaagaagaacgcacataacgtggaccatgccagcgtgctggcatgcatttcgcccgaagccgtgatttctggcctaaattgtatgtcgtttgcgaacgtgggtatgtccggtctgtctccgaacggggttgacctcagcatggaggctaacgctattgccttaaagtacctgaacgagaaccagctctcccagttgtctgtgacgcgaagcaatcaaaacaactgcgatccttttagccttttgcatattaacactgaccgaagcaccgtaggactaagcttaatctcacctaacaatatgagtttcgcaacaaaaaagtatatgaaacgttatggtctactccagtcttccgacaattctgaagacgaggaagagcctccagacaacgccgatagtaagtcagagtaccttctcaatcaaaacttaagaagcatccccgagcaactggggggacaaaaggaacccagcaagaacgatcatgagattatcaactgctcaaactgtgaatccgtgggaacaaatgcagatactccagtgctacggaatataaccaatgaagtgcttcaaactaaagctaaacaacaacttaccgagaagcctgccttcctggttaagaatctgaagccctcccctgctgtgaacttgaggactgggaaggccgagtttacacagcaccccgagaaagaaaatgagggtgatatcacaatcttccccgaatctttgcaaccatccgagaccctgaagcagatgaacagcatgaactctgttggtacattccttgatgtgaagcggctcaggcagctgcccaagctcttttag

SEQ ID NO: 239715 - DNA, 3864 bp, Artificial Sequence
  Description of Artificial Sequence: Synthetic coding sequence
atggagcccatctaccctttcgccagacctcagatgaatacccggttcccaagctccaggatggtcccgtttcatttcccaccctcaaagtgtgctctttggaaccccacaccgactggcgattttatctatcttcacctctcctactaccggaaccccaaacttgtagttacagagaaaacaatcaggctcgcctatagacatgccaagcaaaacaagaagaattcctcttgcttcctacttgggtccctgaccgctgacgaagatgaggaaggcgtaactctgactgtggatcgctttgatcccggacgggaggtcccagagtgcctggagatcacacctactgcgtccctgcccggtgacttcctgatcccctgtaaggtacacacacaagagctgtgttcgcgagaaatgatagtccattctgttgacgacttctccagcgcgttaaaagcactacagtgtcatatctgttcaaaggactctctagattgtggcaaacttttgagccttagggttcacatcaccagtcgagaatccctggactcagtggaattcgacctccactgggctgcagtgaccctggcaaataacttcaaatgcacccctgtgaaacccatcccaataatcccaactgcactcgcccgaaatttgagctctaatcttaacatttcccaagtacaaggtacatacaaatatggatatttgaccatggacgagaccagaaagttgctgctgctccttgaatccgatccgaaagtctattctctccctttggtcggaatctggttatcgggaattacacacatttacagcccccaagtgtgggcatgctgtctgcggtatatcttcaattcgagcgtccaggaacgagtcttcagtgaaagcgggaactttatcatcgtgttgtactccatgacccataaggaaccggaattctacgagtgcttcccgtgtgatggtaaaatcccagatttccgcttccagctactgaccagcaaagagacactccatctgttcaaaaacgtggagccccctgacaaaaaccctattaggtgcgagctgtcagccgaaagtcaaaacgctgaaaccgaatttttcagcaaagcatctaaaaatttttcaattaagaggtcatcacagaaactgtcctctggcaagatgcctatccacgaccacgatagtggcgtggaggacgaggatttctcccccagaccaattccctcaccgcaccctgttagccagaagatttccaagatccagccctccgtacctgagttaagcctcgtgctcgatgggaatttcatcgaatccaatcccctgcctacccctttggagatggtgaataacgagaaccccccactcataaaccacctggagcacttgaagcctctgcagccccaattatatgatgaaaagcattctcctgaggttgaggcaggcgagcctagcctgaggggtatccctaatcagcttaatcaggacaagcccgcattgttgcgacattgcaaggtcagacagcctcccgcatacaagaaggggaatccccacacccgcaacagtattaaaccgtccagccataacggtccatcccacgatatttttgagaaattgcagacagtctctgccggtaatgtgcaaaacgaggagtaccctatccggccttctactctgaactctcggcaaagcagtctcgctccacagagtcagccccatgatttcgtttttagcccacacaacagcggcaggccaatggagctccagatccccacacccccacttccatcgtactgttctacaaatgtgtgtcgctgctgccagcatcactctcacatccagtattcccctttaaacagctggcagggtgccaacacagtggggtccattcaggatgttcagtccgaagccttgcagaagcattctctgttccatccatccgggtgccctgctctttactgcaatgctttctgttcaagcagctcgcccattgctctccgccctcagggtgacatgggaagctgctctccccactctaacatcgaaccttctccagtggccagaccgccttcccatatggacttgtgtaaccctcagccttgtacagtttgcatgcacacaccgaaaacagagtctgataatgggatgatgggtctgtccccagatgcttacagattcctgaccgagcaggaccggcaacttcggctactccaggcccagatccaaaggctcttggaggcacagtcccttatgccctgttctccaaagacgactgctgtggaagatacagtgcaggccggtcgccagatggaactggtgagcgtggaggctcagtcctcaccaggactgcacatgagaaaaggggtgtccattgccgtgagcacgggggctagtctcttttggaacgcagccggtgaggaccaggagccagactcccagatgaaacaggacgacactaaaatcagttctgaagacatgaacttttctgttgatatcaacaatgaagtgacgtctctacccggatccgcatcttcactaaaagccgtggacattccttctttcgaagagtctaacattgccgtggaggaggagttcaaccaaccgctcagtgtctcaaacagttctctagtggtgcggaaggaaccagacgttcccgtgttcttccccagcgggcagctggccgaatctgtcagcatgtgtcttcaaaccggcccaactggaggggcttcaaataactccgaaacctcagaggagccgaaaatcgagcacgtgatgcagcctctgctccaccagccctccgataaccagaagatctaccaagaccttctcgggcaggtgaatcacctgctcaacagcagctcaaaggagacagagcaacctagcactaaagcagtgattatctcccatgagtgtacccggacacaaaacgtgtaccatacgaaaaagaagacacatcactcaagactcgttgacaaagactgtgtcctaaacgctactcttaagcagctcagatccctgggtgtgaagattgattctcctacaaaggtgaagaagaatgctcacaatgtggaccacgcttccgtgctggcgtgtatctcacccgaggccgttatctccggcctgaattgcatgagctttgctaacgtggggatgagcggcctaagccctaacggagtggatctgtctatggaagctaatgccattgctctgaaatatcttaatgaaaatcagctctcacagctgtcggtgacccgctccaatcagaacaactgtgaccccttttctctgctgcatatcaatactgacaggtccacagttgggctgtccctgatcagcccaaataacatgagcttcgcgacgaagaaatacatgaagcgttatggactgttgcagagttctgacaatagcgaggatgaggaggaacccccagacaacgcagacagcaagagcgagtacctcctgaaccaaaatctcagaagtattcccgaacaattgggcggacaaaaggagccaagtaagaatgatcatgaaataatcaattgttctaattgtgagtcagtgggaactaacgcagacactcccgtgctgagaaatatcacaaacgaagtgcttcagactaaagccaagcagcagctgaccgagaaacctgcctttttagtcaaaaatctgaagccatcacctgctgtaaatctgagaactggtaaggctgaattcacacagcacccagagaaggaaaacgagggagatatcacaatttttccggagtctttgcagccaagcgaaaccctgaagcagatgaacagcatgaattcagtgggcacctttcttgatgtgaaacgtttgagacagctgccaaaattgttctag

SEQ ID NO: 239716 - DNA, 3864 bp, Artificial Sequence
  Description of Artificial Sequence: Synthetic coding sequence
atggagcccatttatccctttgccaggccacagatgaatacccgattccctagctcaaggatggtgcctttccatttcccacccagcaagtgtgccctctggaaccccactccgactggggacttcatatatctccacctgtcctattatcgaaaccctaaactggtagtcactgagaaaacgatcagactggcttatcgccacgccaagcagaataagaaaaacagcagctgcttcctgctggggtcactcactgccgatgaggacgaggagggcgtgacactgaccgtagataggttcgaccctgggagggaagttcccgagtgcctggaaattactcccaccgcatccctgcctggggactttctgattccatgcaaggtacacacacaagagctgtgtagcagggaaatgatcgtgcattccgtggatgattttagttccgcactcaaagcattgcagtgtcatatatgtagcaaagatagcttggactgtggcaaacttcttagtcttagagtacatattacatctcgcgagtctctggactcagttgaattcgacttacattgggcagccgtgactctggcgaacaatttcaagtgtaccccggtgaagcccatccctattatcccaaccgcactggcacgcaatctgtcctcgaacctgaatatctctcaggtgcaagggacatataaatatggctacctgaccatggatgagacccgtaagctgcttctgctgctggagtcggatcctaaggtgtatagcctgccccttgtgggcatatggctcagcggtattacccacatctattccccccaggtctgggcttgttgccttcggtacattttcaactcttcagtgcaggaaagggtcttctccgagagcggcaattttataatcgtgctttacagcatgacgcataaggagcctgaattctatgaatgtttcccttgcgatgggaagatacctgacttcaggttccagttgttgacaagtaaggagactttgcacctttttaaaaacgttgagccacccgataaaaatccaattcgttgcgaactgagcgccgagtctcagaatgctgaaacagaattttttagtaaagcttcaaaaaacttctccatcaaaagatcatctcaaaagctcagttctggtaagatgccaatccatgatcacgactctggggtggaagatgaggatttcagcccacgcccaattccgagccctcaccccgtgtctcagaaaatctccaaaattcagcccagtgttccagagcttagcttagtgttggatggtaacttcatagaatctaatcctttgccgacccccctagaaatggttaacaatgaaaatcctcccctcatcaatcatctggagcatctcaaacctctgcagccgcagctgtatgatgaaaagcattcacctgaggtggaggccggtgagccaagcctgcgtggtattcccaaccagctgaatcaggataagcccgcattgcttcggcattgcaaggtgaggcagccgccagcatacaagaaggggaatccccatactcgcaattctatcaagccatcatcccataatggaccttcacacgacatctttgagaagttgcagaccgtatctgcaggaaacgttcagaacgaggagtaccctatacggcctagcaccttaaattcacgtcaaagcagtctggcaccacagagccagccgcacgactttgtgttcagtccacacaactccggcagacctatggagcttcagattcctaccccgccactcccttcctattgtagtacaaacgtgtgcagatgttgccagcatcactcccacatacagtattcgcctttgaacagctggcagggggctaatacagtggggagcatacaggacgtacaatccgaagctttgcagaagcattcgctgtttcacccgtcggggtgtccggctctgtattgtaatgcattctgttcctcatcttcaccaatcgcacttagacctcagggtgacatgggcagctgctcaccacactccaacatcgagccctcacccgttgcacgacccccatcacacatggacctatgcaacccccagccctgcacagtgtgcatgcataccccaaaaacagaaagtgataacggaatgatgggcctgagtccagacgcttaccgtttcctaacggagcaagaccgccagctgaggctcctgcaggcacagatccagcgtctgcttgaagcccaatccctgatgccttgtagtcctaaaaccacggcagttgaggatactgtccaggccggacggcaaatggagctggtgagtgtcgaggcccaatctagccccggactccacatgcgcaagggcgtgagtatcgcagtgagcacaggagccagtctgttctggaacgcggcaggagaagaccaggagccagacagtcagatgaaacaggacgacacaaagatatcctcggaagatatgaacttctccgtagatatcaacaatgaggtgaccagcctgccagggagtgcatcatccctgaaagctgtggacatcccatccttcgaggagagtaatatcgctgtcgaggaagaattcaatcagcccctgtctgtgtctaactctagccttgtggtacggaaagaaccggacgtaccggtgtttttcccttctggccagctggccgaaagcgtctcaatgtgtctgcaaaccggccctactgggggagctagcaacaactccgaaacttcggaggaacctaagattgaacacgtgatgcagcccctcctccatcagccgtcagacaaccagaaaatttaccaggacctgctggggcaggtgaaccatttactcaactcttcatcaaaagagactgagcaaccttccactaaggccgtaatcatttctcatgaatgcactcgcacccaaaatgtgtaccatacaaagaagaaaacacaccattccagactggtcgacaaggattgcgtgcttaacgccacattgaaacagcttcgtagtctcggcgttaaaatagactctcctaccaaggttaagaaaaatgctcataatgtggaccatgcaagcgtgctagcatgtattagtcctgaggctgtcatctcagggttaaattgtatgtcctttgcaaacgtggggatgagcggcctctcacccaacggtgtggacctgtcaatggaggcaaatgccattgcgcttaaatatctgaacgagaaccagctgtcgcagttgagtgtgacacgaagcaaccagaacaactgcgaccctttcagcctgctgcacatcaacacagataggtctactgtcggactgtcgctgatttccccaaataatatgtcatttgcaacgaagaaatatatgaagcgctatggcctcctgcagtcatcagataattcagaggacgaggaggaaccacccgataatgctgacagcaagtctgagtatttgctcaatcagaacctgcgttcaatccctgaacagctgggaggccagaaagagccgagcaaaaatgaccacgagattatcaattgctccaactgtgagagcgtaggcacaaatgcagacaccccagtgctgcgcaacatcactaatgaggttctacagactaaggcgaaacaacagctgaccgaaaagcctgccttcctagttaagaatctcaagccgagtcctgcagtaaatctcaggaccggaaaggccgagtttacccagcaccccgaaaaggaaaatgaaggcgacatcactatctttcctgaatcgctccagccgtctgagacgctcaagcagatgaactctatgaacagtgtgggcacattcctggatgttaagcgacttagacagctgcccaagcttttctag

SEQ ID NO: 239717 - DNA, 633 bp, Artificial Sequence
  Description of Artificial Sequence: Synthetic coding sequence
cagttgtacgacgagaagcattcccctgaagtggaggcgggagaaccctcgctgcgcggtatcccaaaccagttgaatcaggacaagcctgctctgctgcgtcactgtaagccctgtaccgtctgcatgcatacccctaagaccgagtccgataatgggatgatggggttgagcccagacgcatatcggttcctgactgagcaagatagacagctgagactactgcaggcacagatacagagactccttgaggcccagagtcttatgccttgctcccccaagaccaccgccgttgaagacacggtgcaggcaggtcggcagatggagctcgtgtccgtggaagcccagagcagcccgggactgcacatgcgcaagggagtgagcatagcagtgagtactggagccagtttattttggaacgccgctggggaagaccaagaaccagattcacagatgaaacaggatgacactaagatctcctccgaagacatgaatttctccgtggatattaataacgaagtcacctcgctcccgggtagcgcctcgtctctgaaagccgtcgacatcccgagctttgaagaatctaatatcgcagttgaggaggagttcaatcaaccccttagtgtatcctag

SEQ ID NO: 239718 - DNA, 3867 bp, Artificial Sequence
  Description of Artificial Sequence: Synthetic coding sequence
atggagcccatatacccctttgccaggccacagatgaatacacggttcccgtcgtcccgtatggtcccgtttcatttccccccttccaagtgcgcgctatggaaccccactccaactggggactttatctacctccacctgagttactatagaaatcctaaactggtggttacagagaaaaccatcaggctcgcctaccggcacgcaaagcagaataagaaaaattcaagctgttttctgctgggcagtttaacggccgatgaggatgaagagggtgtgacccttaccgtggacagatttgatcccggaagagaggtccccgagtgcctagagatcaccccaaccgccagcttacccggtgatttcttgatcccatgcaaggtccacactcaagagctatgttccagagagatgatcgtgcactcagtagacgacttcagttcggccctaaaggctcttcaatgtcacatatgcagcaaagatagcctggactgtggtaagctgctgagccttagagtgcacataacctcacgcgaaagcctcgattctgtggagtttgacctgcactgggcggcagtgaccttggctaataactttaaatgtactcctgtgaaacctatcccaataatccccaccgccttagccagaaatctgtcttccaatctgaacatttcacaggtgcagggaacgtataaatatggatatcttaccatggacgaaacccgtaaactgctcctcctgcttgagagcgatcctaaagtgtattcgctgcctctggtgggcatttggctgtcaggaattacgcatatttactctccgcaggtctgggcctgctgtttgaggtacattttcaactccagcgttcaggagcgagtattcagcgaatccggcaattttattattgtgctgtatagtatgacacataaggaaccagaattctacgagtgtttcccctgcgacggcaaaatcccagactttcggttccagctgctgacatccaaggaaaccctgcatcttttcaagaatgtggagccgccagacaaaaatcccattcggtgcgaactttctgcagagagccagaatgccgaaaccgagtttttctcaaaagccagcaaaaacttcagtataaagaggtcaagtcagaagctttcatccggcaagatgcctattcacgaccatgattctggcgtcgaggatgaggattttagccccagacccatcccaagcccccaccccgtttctcagaagatcagcaagattcagcctagtgtgcctgagctttccctggtcctagatggcaacttcatagaatccaaccccttgcccaccccactggagatggtgaataacgaaaacccaccacttatcaatcacttggaacacctgaagcctctccagccccagctttacgacgaaaagcattctcccgaggtcgaagcaggagaacctagtctaagaggaatccccaaccagttgaaccaagataaaccagcccttttgcggcactgtaaggtgcggcagcccccagcctataaaaagggcaacccacatacccgtaacagtatcaaaccttcctctcacaacggcccatctcatgatatcttcgaaaaactgcagaccgtatctgctggtaacgtgcagaatgaggagtaccctatacggccatcaactttgaactcgcggcaatcctccctcgcccctcagagtcagccccacgatttcgtatttagtccccataatagtgggaggcccatggaattgcagatccctaccccaccattgcctagctattgcagtaccaatgtctgccgctgctgccagcaccacagtcacatacagtacagcccattaaattcatggcaaggcgcaaataccgtcggctctatacaggatgtgcagtccgaggccctccagaagcactcgctttttcaccccagtggatgtcccgcattatactgcaacgccttctgcagctcgtctagccctatcgcattgcgcccacagggggacatgggaagttgctctccccacagcaacatcgagccaagtcccgtcgcaagaccgccatcccacatggacctttgtaaccctcagccgtgcacggtctgcatgcacacgccaaaaacagagtcagacaatggtatgatgggactcagccccgatgcctaccggtttctcactgaacaggatcggcaactgcggctgctccaggcacagatccagagattactcgaggcccagtcattgatgccttgctccccaaagacaacagctgtagaagatactgtgcaggccggacgccagatggaactcgtgagtgttgaggcccagagttctcccggactgcacatgcgtaaaggcgtctccatcgctgtcagtaccggcgctagtctattctggaacgcggctggagaggaccaagagccggatagccaaatgaagcaggatgatacgaaaatttcctccgaggacatgaactttagtgtggatatcaataatgaagtgaccagcctccccggatctgcctccagtctgaaagccgtcgatattccctcattcgaagagagcaatatcgccgtggaggaggagttcaaccagcccctatccgtgagcaattcatcgtcactagttgtgcggaaagagccagacgtgcccgtcttcttcccttccggccaactcgccgaatccgttagcatgtgtttgcagactgggccaacaggaggagcaagcaacaacagcgagacatcagaagagcccaagatagaacacgtgatgcaaccattgttgcaccagcctagcgacaatcaaaaaatttatcaggacctgctgggacaggtaaaccatctgctgaactccagttcaaaggagactgagcagccaagtacaaaggcagtcatcatcagtcatgaatgtacgaggacccaaaacgtgtaccatacgaagaaaaagacccaccattcccggctcgttgataaagactgtgtccttaacgccacccttaaacagctgcgttccttgggcgtgaagatagatagcccaacaaaggtgaagaaaaatgcccacaatgtagatcatgctagtgtcctggcctgtatttctccagaagctgtcatcagcggcctcaattgtatgtctttcgctaacgtgggaatgtcaggtctgagtcccaacggcgtcgacctttcaatggaagccaacgctattgccctgaagtacttaaacgaaaaccagctgtcacaactatctgtaacgcgtagcaatcaaaataactgtgatcctttctctctgcttcacataaacaccgaccgttctacagtgggcctatccctcataagccctaataacatgtcgttcgccacgaaaaaatacatgaaacgttatggcctcctgcagtcctctgacaattcggaagatgaggaggaacccccagataatgcagattccaaatcggagtacctgctgaatcagaacctgcgaagtattccagagcagctggggggacagaaagagccatctaagaacgaccacgaaataatcaactgctctaactgtgagagcgtgggcactaatgcggatactcccgtgctgcgcaatattactaatgaagtcctgcaaaccaaagccaagcagcagctcacagaaaagcccgcttttctggttaagaacctcaaaccaagtcctgcagtaaaccttaggaccggaaaagctgagtttacacagcacccagagaaagaaaatgagggggatattaccatattccctgagtccctgcaaccgagcgagacactgaagcaaatgaactccatgaacagtgtgggcacttttctggacgtgaagagacttcggcagctccccaaacttttttag

SEQ ID NO: 239719 - DNA, 606 bp, Artificial Sequence
  Description of Artificial Sequence: Synthetic coding sequence
atgagtttcgccaccctcaggccggcacccccaggaagatacctgtacccagaggtcagccccctgtctgaggatgaggacagaggaagcgacagctccggcagcgacgaaaaaccttgtagagttcatgctgcccgatgtgggttgcaaggggctaggcggagagctggcggtaggcgggctggtggaggaggtcccggtggcagaccgggtagagagccacggcagcgacacaccgctaatgcccgtgaacgagatagaactaatagcgtcaacaccgcattcaccgcactgcgcaccctcatccccaccgagcccgctgacagaaaacttagtaagattgagacactgcgcctcgctagtagctatatcagtcacctgggtaacgtgctgttagccggagaggcatgtggggatgggcagccttgtcacagcgggcctgcattttttcacgccgctagagcgggtagtcctccgcctcctccccctccgcctcctgccagagacggggagaatacccaaccgaaacagatatgcaccttctgtctttctaatcagcgcaagctcagtaaagaccgcgaccggaaaacagctatccggagctag

SEQ ID NO: 239720 - DNA, 642 bp, Artificial Sequence
  Description of Artificial Sequence: Synthetic coding sequence
atgcaactgccactggctctgtgtttggtatgtctgctggtgcacacagcatttagggtggtggagggccagggttggcaggcctttaaaaatgatgccaccgaaatcatccctgagttgggagaataccccgaacctcctcctgagctggagaataacaagactatgaatagagctgagaacggcggtaggcctccacaccatccctttgaaactaaggatgtcagcgagtattcctgtcgggagcttcatttcacccgttacgtgacggatggcccatgtagatccgctaagccagtgaccgaacttgtatgcagtggccagtgcgggcctgcgcgactcctcccgaacgccattggaaggggaaagtggtggaggccatccggacccgacttcaggtgcatccccgacaggtacagagcccagcgcgtacaattattatgccccggaggcgaggccccaagagcccgaaaggtcagactggtggccagctgtaaatgcaaaaggctgacacggttccacaatcaaagtgaactgaaggacttcggaactgaggcagcccgaccccaaaaaggacgcaagccaagaccaagggcccgaagtgccaaagccaatcaggcagaactagagaacgcctattag

SEQ ID NO: 239721 - DNA, 906 bp, Artificial Sequence
  Description of Artificial Sequence: Synthetic coding sequence
atggcaatgctggtgctagtgcctggacgagttatgcggccactgggcggacaactgtggaggttcttgcccagggggttagaattttggggcccagctgaggggaccgcaagagtgctgctgaggcaattttgtgcgaggcaagccgaagcgtggagagcaagcggacgcccaggctactgtctgggtacacgtcccctttctactgcacgaccaccaccaccttggagtcagaagggtcccggagacagcactcggccatccaaaccgggaccggtcagctggaaatccctcgccattaccttcgctatcggcggagctctgcttgctggcatgaaacatgtcaagaaagagaaggctgagaagctcgagaaggagaggcagcgacatatagggaagcccctgctggggggacccttctctctcaccacgcacacaggagaacgcaagacggacaaagactatctgggccaatggttgctgatttatttcgggtttacacattgcccggatgtatgccctgaggaattggaaaagatgattcaggtggtcgatgagattgactcaattacgaccctgcccgatctgactccactgtttatatccatcgatcctgaaagagacaccaaagaagctatcgccaactatgtcaaagaatttagccctaaacttgtggggcttactggaactagagaagaggtggaccaagtggccagggcttacagggtctactactccccaggcccaaaggatgaagatgaggactatatcgttgaccacactatcatcatgtatctcatcggtccagacggggagtttctggattatttcgggcaaaacaagcgaaaaggagaaatcgcggcatccatcgctactcacatgcgcccatatagaaaaaagtcttag

SEQ ID NO: 239722 - DNA, 813 bp, Artificial Sequence
  Description of Artificial Sequence: Synthetic coding sequence
atggcaatgctggtgctggttccaggccgagttatgcgcccactaggaggacagctgtggcggttcctgccacgcggactagaattttggggacccgctgagggcaccgcacgtgtgctgttgcggcaattctgtgctaggcaggccgaagcatggcgggcttcggggcgaccaggctactgtctaggaactcgccctctgtccacggccaggccgcctcctccttggagccagaagggaccaggcgactccacacgcccttcaaagcccggtcctgtatcatggaagtctctggccattacgttcgctatcggcggagccctcctcgccggaatgaaacacgtgaagaaagaaaaggcggagaaattggaaaaagagcggcagcggcacatcggcaagcccctactagggggacctttctctctgacaacgcatactggtgagcggaaaacagataaagattacttagacagcatcaccaccttaccagacctcacccctttgtttatctctattgatccggagcgcgacacaaaggaagccatcgccaattacgtcaaggagtttagccccaaattggtcggactgacaggaacacgggaagaagtcgatcaggtggcaagggcttatcgggtttactacagtccaggcccaaaagatgaggatgaggattacattgtggaccacaccatcattatgtacctaatcggtcctgacggagagttcctggactacttcgggcagaataagcgcaaaggagagattgcggcttccattgcaacccacatgcgtccctaccgtaagaaaagctag

SEQ ID NO: 239723 - DNA, 801 bp, Artificial Sequence
  Description of Artificial Sequence: Synthetic coding sequence
atgttgctcctcaccagatccccgactgcttggcacagactgtcacagctgaaaccaagagtccttccgggaaccctggggggacaggccctccatctgcggtcctggctgctgtcaagacaaggacccgctgagacggggggacagggacagccgcaaggacccggactgcgcacaaggctgctgattacgggccttttcggcgctggactcggaggggcttggttagccctgagggcagaaaaggagagacttcagcagcagaagagaaccgaagccctcagacaggcagcggtgggccagggtgacttccaccttctcgaccatcggggacgcgcaaggtgcaaagcagattttagaggacaatgggtcctcatgtattttggcttcacccattgccctgacatctgcccagacgagctggagaaactggtccaggtcgtgaggcagctggaggctgaaccaggacttccaccagtgcagcccgtgtttataacggtagatccagagagggacgacgtggaagcaatggccaggtacgttcaggattttcaccccaggctgctgggactgaccggcagtactaaacaggtcgcccaggcctcacactcctaccgtgtctactacaacgccggtccgaaagacgaggaccaggattacatcgtagaccattcaattgcaatctatctgctgaatccagacggattgtttactgattattatggcaggagcaggtccgctgaacaaatttccgacagcgtcagacggcatatggccgcttttcgcagtgttctgtcatag

SEQ ID NO: 239724 - DNA, 801 bp, Artificial Sequence
  Description of Artificial Sequence: Synthetic coding sequence
atgctgctgcttacacggagcccaacagcatggcatcggctgagccagctgaaacctagagttttgcctgggaccctggggggacaggccctgcatcttagaagttggctcctgtctaggcagggtccagccgagacaggtggccagggccagccacaggggcctggccttcgtacgagactcctgataactgggttgtttggcgcagggcttgggggagcttggctcgccctgcgcgctgagaaagagcggttacagcaacaaaagaggacagaggcactgcggcaggctgccgtggggcagggcgactttcatcttcttgaccacagggggagagccaggtgcaaagctgactttcgaggacagtgggtgctcatgtattttggttttacacactgtccagatatctgcccggacgagctcgagaagttggtccaagtagtgaggcagctggaagcggaacctgggctgccacccgtccaacccgtgttcatcacggtggaccctgagagggatgatgtggaggccatggccagatatgttcaggattttcaccctcgacttcttggcctgactgggagtacaaaacaggtagctcaggcctctcactcatatcgggtgtactataacgccggacctaaggacgaggaccaggactacatagtggaccattctattgccatatacctcctcaatcctgacgggctgtttactgattattacggacgcagccggagcgcggagcagatctctgacagcgtacggaggcatatggcagctttcagatcagtgctgagttag

SEQ ID NO: 239725 - DNA, 411 bp, Artificial Sequence
  Description of Artificial Sequence: Synthetic coding sequence
atgctgctgttgaccagatccccaactgcgtggcatagactgagccagctgaagccccgagtgctccctggtacgctcggcggacaggccctccacctgcgctcttggcttctgtcgagacagggtccggctgaaactggcggacaagggcaaccgcagggcccaggtctgagaaccagattgttgattaccggcctgttcggggctggcctcggtggggcatggctcgccctccgcgctgagaaagagagattgcagcaacagaaacgaaccgaagctctgaggcaggctgcggtggggcaaggtgactttcatttacttgatcatcgtggtagggccagatgcaaagctgacttcagggggcagtgggtgttgatgtactttggctttactcactgccctgacatctag

SEQ ID NO: 239726 - DNA, 411 bp, Artificial Sequence
  Description of Artificial Sequence: Synthetic coding sequence
atgttgctcctaacccgcagcccaacggcttggcatcggttgagccagttgaaaccacgggtcctcccagggacactggggggacaggctctccatctgcggagctggcttctgtctcggcagggcccagccgagaccggaggccagggacaaccacagggacctggtcttagaacccgtctgcttattacaggcttattcggtgccggacttggaggagcttggctcgcattgcgcgctgagaaggagcgcctgcagcagcagaagaggaccgaggctctgagacaggccgcagtcgggcagggcgatttccacttgttagaccataggggtcgcgctagatgcaaggcggacttccgcggacagtgggtcctgatgtatttcggattcacccactgtccggatatatag

SEQ ID NO: 239727 - DNA, 801 bp, Artificial Sequence
  Description of Artificial Sequence: Synthetic coding sequence
atgttgctgctgacaagatcacccactgcgtggcaccgtctgagccaactaaagccccgtgtgctgcctggcacgctcggcggacaggctttgcatctcagatcttggttgctttctcggcagggtccagcggaaacaggaggtcagggtcagcctcagggcccaggattacgaacgcggctcctgatcaccgggcttttcggtgcgggactgggtggcgcatggctggcattgagagcagagaaggaaaggctccagcagcagaagcgaacagaagccctccggcaggctgctgtcggacagggcgactttcacctcttagaccatcgtggacgtgctcgctgcaaagcggacttcagaggacaatgggtgctcatgtattttgggttcacccattgtcctgatatttgcccggatgagctggaaaaactcgtgcaggtggtgcgtcagctagaggccgaacccggactaccacctgttcagcctgtgtttatcactgttgacccagagagagacgatgtggaggcaatggcacgctatgtgcaggatttccacccccgactcttgggcttgacaggcagtaccaagcaagtcgctcaagcttcacattcgtaccgggtatattataatgcaggcccaaaagatgaggaccaggactatatagtggaccactcaatagcaatctatcttctgaaccccgatggactctttacagattactatgggaggtctcggagtgccgaacagatatctgacagcgtcaggcgacatatggcggctttccggagcgtgttgtcttag

SEQ ID NO: 239728 - DNA, 801 bp, Artificial Sequence
  Description of Artificial Sequence: Synthetic coding sequence
atgctgctcctcacacgcagccctaccgcttggcaccggttgtctcagctgaaacccagggttcttccgggaacattgggtggacaggcactgcacttgagatcgtggctcctctcaagacaggggccagccgagactggcggtcagggacagccccaagggcctgggctccgcacccggctgttgatcacgggcctattcggcgcagggctgggcggagcctggttggccttgcgtgcggaaaaggaacgcttgcagcaacagaagcgcaccgaagccctgcggcaggccgctgtcgggcagggagactttcacctgttggatcacagggggagagctagatgtaaagccgattttagaggccagtgggtgctgatgtactttggctttacccactgtcccgatatctgtccagatgagctggaaaaattggtgcaagtggtgcggcagctggaagccgaacccggattaccgcctgtccagcccgtgttcataaccgtagaccccgaacgggacgatgtggaagccatggcaaggtacgtacaggattttcaccctagacttctggggctgacaggctccactaagcaggtggctcaggcctcccacagttacagggtctactacaatgcaggacctaaagacgaagaccaggattacatcgtcgaccatagcatagccatctaccttctcaatcctgatggactctttactgattattatggcaggagtcggagcgccgaacagatcagtgatagtgtccgaagacacatggccgcttttcggtccgtgctgagttag

SEQ ID NO: 239729 - DNA, 1047 bp, Artificial Sequence
  Description of Artificial Sequence: Synthetic coding sequence
atgccgaggtcattcctggtgaaaaaagtgaaattggatgccttctctagcgcggatttggaatccgcatacggacgagcaaggtccgacttaggtgcacccctgcacgacaaaggctacctgtctgattatgtgggccctagctctgtctacgatggggatgcagaagcagctctcctcaaagggccttcccccgaacccatgtatgcggcagcggtacgaggcgagttaggtcccgctgcggctggcagcgcaccgccacctacaccccgacccgagctggcaaccgcagcgggaggatatatcaacggtgacgctgctgtgagcgaggggtatgctgctgacgcatttttcatcacggatggcagatcaagacggaaggcaagtaatgctgggtccgcagcagccccttctactgcgagcgcggctgccccagatggtgacgcaggcggtggaggcggtgctggtggtaggagcctcggttccggcccaggaggccgaggcggtaccagggctggcgcagggaccgaggcgagggcagggcctggagccgctggcgctggcggacgccacgcctgcggggagtgcggcaagacctatgctacatcttcgaacctgtcccgacacaaacagacacacagaagtttggactcacagctggcaaggagatgtcccacatgcggaaaagtctacgtttccatgccggcaatggcaatgcatctgctgactcacgatttacgccacaaatgtggggtgtgcggtaaagcttttagtaggccctggctcttacaaggccacatgcgatctcacaccggggagaagccgtttggctgtgcacactgcgggaaggcctttgcagacagatctaatctgcgggcacacatgcagactcacagcgccttcaaacactttcaatgcaaacgctgtaaaaagagctttgctctgaagtcatacctgaataagcactacgagagtgcatgttttaagggaggcgcaggcggacccgcagctcccgctcccccacagctgtctcccgttcaggcctag

SEQ ID NO: 239730 - DNA, 4893 bp, Artificial Sequence
  Description of Artificial Sequence: Synthetic coding sequence
atgctgaagtgcatcccactgtggaggtgcaacagacatgtggagagtgtcgacaaaagacattgctccctgcaggctgttcccgaggaaatttaccgatattcacgctcactcgaagagctgctacttgatgctaaccagctcagggaactgccaaagccattcttcaggctgttgaatctgaggaagcttggacttagtgacaatgagatccagcgactgcccccagaggtcgccaacttcatgcagctcgttgagctagatgtgagtcgcaacgacattcctgaaataccagaatcaataaaattctgcaaagccctggaaatcgccgatttcagcgggaaccctctgtctaggttgcccgatggctttactcaactgcggtccctcgcccacctggcattgaatgacgtgagtctacaggctcttccaggagacgtcggcaacctggccaatcttgtgaccttggagctgagggaaaacttgcttaaatcccttcctgcctctctctctttcctcgttaagctggaacagctggatctcggcggtaacgaccttgaggttctgcctgacacccttggtgcgctgccaaacctaagagaactgtggctggaccggaaccagttgagtgccttgccacccgaactggggaacctacgccgactggtgtgtttagatgtgagtgaaaatcgtctggaggaattgcccgcagaactgggcggacttgttctgctgacggacttgcttttgagccagaacctcctccgtcgtctccctgatgggataggccaattgaaacagctgagtatactgaaggtggatcagaacagactatgtgaagtgaccgaagccatcggagattgtgagaatctgtctgaactgatactcaccgaaaatctactcatggccctacctcgtagccttggtaagctgactaagttgacgaaccttaacgtggatcgaaaccatctggaagcactcccaccagagataggaggatgtgttgccctgagcgttctgagccttagagataatcggctggccgtccttccacccgagctggctcatactacggagctgcatgttcttgacgttgctggtaaccgcttgcagtccctgccttttgcgctgacccacctgaacctgaaagccctatggctggctgaaaatcaggctcaacctatgcttcggtttcagactgaagatgatgcacggactggggaaaaagtactcacctgctatctgcttccccagcagccacccccaagcctggaggacgccggacaacagggctccctcagtgagacgtggagtgatgccccaccctcaagagtctctgtcatccagttcttggaagccccaattggagacgaggatgccgaggaagcggcagccgagaagcgcggacttcagaggcgcgctacgccacacccttcagaacttaaagtcatgaagcggagtattgagggaagaaggtcagaagcttgcccatgtcagcccgactcaggctctcccctcccggcagaagaagagaaacgtctgtccgcagagagtgggctgagcgaagattcccggccttctgcctccactgtctctgaggccgagcccgagggcccatctgccgaagcgcagggaggttcgcagcaagaagctacgacagccggtggggaggaagatgctgaagaagactaccaggagcccacagtgcacttcgccgaggatgccttgctgccaggggacgacagagagattgaggaaggacagcctgaggccccatggacactaccagggggacgccagcgccttatacggaaggatactccacattataagaaacatttcaagatcagcaagcttccccagcctgaagcagtggtggctctgctgcaggggatgcaacccgacggcgaaggccctgtagctccagggggttggcataatggccctcacgccccatgggccccaagggcccagaaagaggaggaggaggaagaagaaggctccccccaggaggaggaagtggaggaagaggaagagaaccgcgctgaggaggaggaggcctctaccgaggaagaggataaggaaggcgctgtcgtctccgctcctagtgtgaagggggtgagctttgaccaggcaaataacctcttgatcgagcccgctagaatagaagaagaggaactcactctgaccattctgcggcagacaggaggattggggatatctatcgctggtggaaaaggatccaccccatataagggggacgatgaggggatctttatctctagggtcagcgaagagggcccagccgctcgcgcaggcgtgcgggtgggagacaagctgctggaggtcaacggggtggccctacagggagccgagcaccacgaagctgtcgaagctctgcgaggcgcaggaactgccgtgcagatgagagtgtggcgcgaacgtatggtggaacctgaaaacgcggtcacaatcacccccctccggccagaggacgattattctccgagggagcgcagggggggaggcctgcggctgccgctgctgcctcctgaatctccgggacccctcagacagaggcacgtagcatgcctcgcgaggtcagaacggggtctgggcttttcgatcgcaggtgggaagggtagcacaccgtacagagccggagacgccggaatttttgtcagtcggattgctgaaggtggtgcagcacatagagcgggaacacttcaagttggcgatagagtactgagcattaatggcgtcgacgtaacggaggctcggcacgaccacgctgtctctctcttaacagccgcatctcccacaattgcccttctccttgagcgtgaagcaggcggacccttgcccccttcaccactcccccacagctcacctcccactgctgctgtggcaacaacctcaatcactacagcaacacccggtgtccccggacttccttctctggccccaagtctccttgcggctgcattagaggggccataccccgtggaggaaataaggctgcccagagccggaggccctttgggcctgtcaatcgttggcggaagcgaccactcctctcatcctttcggcgtacaagagcctggggttttcatctctaaagttttacctcggggactggccgcacggtcgggccttcgcgtaggtgaccgcattcttgctgtgaacggccaggatgtccgtgacgccacccatcaggaggccgtctctgctctgctgaggccttgcttagagctctctctcttggtgaggagagatcccgctcccccaggcttgcgcgaactgtgtattcagaaagccccaggggagaggttgggaatcagcattaggggaggcgcaagaggccatgctggcaatcctcgggatcccactgatgagggcatctttatttcgaaagtgtcacccactggggctgcagggagagacggacgattgagggtcgggcttaggctcttggaggtgaaccagcagtccttactgggcctcacccacggggaagccgtccagctgttacgctccgtaggagacaccctcacagtcttagtgtgcgacgggtttgaggcgtctactgacgcagccctggaagtgtcccccggagtgattgccaacccattcgccgctggtatcggacacaggaacagcctcgaaagtatctctagcatcgatagggagttatctcccgagggtccaggcaaagaaaaagagctgccaggacagacactccactggggaccagaggcaacagaggctgctggacgtgggcttcagccgctgaaacttgactacagagctctagccgctgtaccttccgcgggaagtgtccagagagtgcctagtggcgcagctggcggaaagatggccgagtccccatgcagtcctagcgggcagcagcctcccagcccaccctcgccggacgagctccccgctaatgtcaagcaagcatatcgcgcatttgctgccgttcccacctctcacccacctgaagacgcccctgcacagcctcccacaccaggcccagcggcttctcccgaacaactgagctttagggaacgacagaagtactttgaactggaagtgcgtgtgccacaggcagagggaccgcctaaacgagtgtctcttgttggagctgacgacctgaggaagatgcaggaagaggaagctagaaagctgcagcaaaagagggcacagatgctaagggaagccgctgaggccggagccgaagcccgtcttgcccttgatggggagaccctaggtgaagaggagcaagaggacgaacagcctccatgggcgtccccttcccctacaagcaggcagtcacctgcttcacccccacccctggggggtggtgcgcctgttcgcaccgcgaaagccgaacgtcgccaccaagaaaggcttagagtgcagtcacctgagccccctgcccctgaaagggcattaagccctgccgagctgagagctctggaagccgaaaaacgggcactctggcgagcagctagaatgaagagcttggagcaggatgccctccgggctcagatggtgctgtcccggtctcaggagggacgaggcactcgtgggccactggaaagacttgccgaagcgccatcccctgccccaactcccagccctacaccagtggaggatctggggcctcagaccagtacatctcccggacgcctctccccggattttgcagaggagctccgatccctggaaccatcaccatcaccaggcccacaggaagaagatggggaagtggccctggtgctacttggcagaccttcacccggagccgtcggccctgaggatgtcgccctgtgctcctccagacggcctgttaggcctggcagacggggtcttgggcctgtgccgagctag

SEQ ID NO: 239731 - DNA, 4650 bp, Artificial Sequence
  Description of Artificial Sequence: Synthetic coding sequence
atgcagctcgtggaattagacgtcagtcggaacgacattcccgaaatccccgagtccatcaaattttgtaaagcactggaaatcgctgactttagtggcaatcctctgtccagactgcctgatggtttcacccagcttaggagcttagctcacttggctctcaatgacgtttctctgcaggccctccctggagatgtgggaaatctggccaatctggtgacactggagctgcgcgagaatctgctcaaaagcctgccagcttctttatcttttctggttaaactggagcagctggatctcggtggaaatgacttggaggtcctgcctgataccctgggagccctgcctaacttgcgagaactgtggttggatcgtaatcaactaagcgccctgccacctgaactgggcaatctgcgcaggttagtgtgcctggacgtgtcagagaataggctcgaggagctgcccgcagagttgggcggtctggtcctcttgacggatctactgttgtctcagaacctattaaggcgtctgccggatgggatcggacagctcaaacagttatctattcttaaggtagatcagaacaggctttgcgaggtgaccgaagccattggcgattgtgaaaacctctccgagctcattcttactgagaatctgctgatggctctgccccgatctctgggcaagttaactaaacttaccaacctcaatgtcgatcgaaaccaccttgaggccctgccccctgagatcgggggttgtgtggccctgtccgtcctaagtctccgagacaaccgtctggccgttctgcctccagagttggcacacacgactgagttgcatgtgctggacgtggccggaaatagactccaatcgttgccgttcgcgttgacccacctgaatcttaaagcactgtggctggccgagaaccaggctcaaccaatgttaagatttcaaacagaagatgacgccagaacaggcgaaaaagtgctcacctgctatttattgccgcagcagcccccaccctccttggaggatgctgggcagcagggctcactgtctgagacatggagcgacgccccaccatccagagtgagcgtcatccagttcctcgaagctcctatcggtgacgaagacgctgaggaggccgcagcggagaaacgaggcctgcagaggagagctaccccccatccaagcgagcttaaagtgatgaaaagatcaattgagggcagaaggtcagaggcctgtccctgccagcccgattctgggagcccactgcccgcagaggaggaaaaacgactgtccgccgaaagtggcctctccgaggattcgcgtccgagcgcaagtactgtctctgaagcggagcctgaagggccatccgcagaggctcagggcggaagtcaacaggaggcaactaccgctggcggagaagaagatgccgaagaagactatcaggaacccacagttcatttcgctgaggacgccctgctgcccggagacgatcgcgagattgaggaagggcagcccgaggcaccctggacgttgcccggtggaaggcaaagactgattaggaaggataccccacactataaaaagcatttcaagataagtaaactccctcagcccgaggctgtggtggctcttctccagggaatgcagcccgacggggaaggccctgtggcacccggagggtggcacaacggtcctcacgccccatgggctcccagagcccagaaagaagaagaggaagaagaagaaggcagccctcaggaagaggaggttgaagaagaggaagaaaatagggcggaggaggaggaggcctcaactgaggaggaggacaaggagggggcagtcgtgtccgcccctagcgtcaagggagtaagctttgaccaggcgaacaacctgttgatagagcccgcaagaatcgaagaggaagagcttactcttacaatcctgaggcagacgggagggcttggaatcagtatcgcgggtggaaaaggtagcacgccatacaagggggatgatgaggggatcttcatatctagagtgagtgaagaagggcctgctgccagagcaggcgtgcgggtcggagataaactgcttgaggtgaatggagttgctcttcagggcgctgagcaccacgaagccgtggaggctctccgaggcgctggcaccgccgtgcagatgcgagtttggagggagaggatggtggagcctgaaaatgcagtgactatcacaccccttagacctgaggacgattactctcctagggaacgtagaggcggtggtctgagactccctctgctgcctcctgaatcacctggaccactacggcagcgccacgtcgcctgtctggcaagaagcgaaagggggctgggtttctctatcgccggaggcaaagggagcactccttaccgggcaggcgacgcaggaatcttcgtgtcgcgtatcgctgaaggcggagcagcccaccgggctggaaccctccaggttggggacagggtcctgtcaataaatggagtggacgtcacagaggcgcgtcacgaccatgccgtgtccctgttgacagctgcatctcccacaattgcccttttactcgagagagaggcgggtgggcctctgccaccctccccacttccccactcctcccctcctaccgccgctgttgcaactaccagcattacgacagcaacgcccggtgtcccaggcctgccaagtcttgccccatccctcctggccgctgctctcgaaggtccttaccctgtcgaggaaattcgtctacctcgcgctggagggccactaggcttgagcatcgtgggaggcagcgatcactcatctcaccctttcggagtacaagaacctggagtatttatttctaaggtgcttcccaggggcctcgcagccaggagtgggctgcgggtgggggatcggatattggcagtgaatggacaggacgtccgcgatgctacgcatcaggaagcagtgtccgccctactaagaccctgtttggagctgtcccttttagtgcgaagagatcctgctcctccaggtctccgggagctgtgcatccagaaagctcctggcgaacgactcgggatctctataagagggggagctaggggccacgcgggtaatcccagggatcctaccgatgagggtattttcatctccaaggtttctcccactggcgcagctgggagggatgggcgactgcgagtggggttgagactcctggaggtgaatcagcaaagtctcctagggctgacacatggagaagcagtccagctgctccggtcggtcggggacaccctaactgtcctggtttgtgacgggtttgaggcttccacagatgccgctctagaagtgtcgcctggggtgatcgcaaatcccttcgcagcgggaatcggccaccgcaattccctagaaagtatttcatctatcgatcgcgagctttctcctgaggggccaggtaaagaaaaggaactaccaggccaaaccttgcactggggaccagaggcaacagaggccgcaggaaggggactgcaaccgctgaaattagactatcgcgcactggctgcagtcccatccgctggttcagtacaacgcgtgccctccggagccgcaggaggcaaaatggctgagtcaccctgttctccatccggtcagcagccaccatccccacccagccctgatgagttgcccgctaatgtgaaacaggcatacagagccttcgccgctgtccctacttctcacccgcctgaagatgccccagcacaaccacccacgcctggcccagccgcaagtccggagcaattgagtttcagagagagacagaagtatttcgaacttgaggtgcgggtgcctcaggctgaaggaccccctaagagagtatctcttgtgggggctgatgacctgagaaagatgcaggaggaggaggcgagaaaactccagcaaaaacgcgctcagatgctccgcgaagctgccgaagccggagctgaagcgaggctggcattggatggtgagacactcggggaagaggaacaagaagatgagcagccaccctgggcctcccccagccccaccagccggcaatctccggcatcgcctccaccgctcgggggaggcgcacccgtccggacagctaaggcagaaaggagacatcaagagaggttacgtgtacaatcccccgagcccccagccccagagcgggctctctctccagccgaattgagggcccttgaggccgagaagcgtgcactgtggcgcgcagctcggatgaagagcctggagcaagacgccctgcgggcacagatggtgctctctcgaagtcaggagggtagaggtacgcgcggtcctctggaaagattggctgaagctccctctccagcccctactccatctccaacgccagtggaggacttgggcccacagaccagcaccagccccggacggctcagcccagactttgccgaggagctcaggagtctggaacctagccccagtcctggtccacaagaggaggacggagaagtagccctcgtgctgttgggtcggccttcaccaggtgccgtgggtcccgaagacgtagcactgtgtagtagtaggcgcccagtacgacccggtaggcgcggactgggacctgtacctagctag

SEQ ID NO: 239732 - DNA, 2268 bp, Artificial Sequence
  Description of Artificial Sequence: Synthetic coding sequence
atgcagcctgacggggaggggcctgtggctcccggagggtggcacaatggacctcacgccccttgggcccctcgagcccagaaggaagaggaggaagaagaagaaggcagcccacaagaagaggaggtggaggaggaagaagagaatagagcggaggaggaagaggcatctacagaggaagaggataaagaaggggctgtcgtgagtgctccatcagtgaagggcgtgtcctttgaccaggccaacaacctgctgatcgagccagcccgaattgaggaggaagaacttacattgaccattcttagacagaccggtggactcggaattagtatcgcaggtgggaaaggctctaccccttataagggggacgacgagggaatctttatttcacgcgttagcgaagaagggccagcggcacgagccggtgtgcgtgtgggggacaagctgttggaagtcaacggcgtagcgctccagggagccgagcatcacgaggccgttgaggcccttcggggagccggaacggctgtccagatgcgggtatggcgggaaagaatggtggaaccagaaaatgctgttacaatcacccccctgcggcctgaggacgattattccccaagagaacgtaggggagggggactcaggctcccactgttgcccccagaatctccaggtcccttaagacagaggcacgtggcttgcctggccaggtcggaacgtggcctcggcttcagtatcgccggtggaaaaggttctactccataccgcgctggcgacgctggaattttcgtaagtcggattgcagagggtggggctgctcacagagcaggcactctgcaggtcggggaccgggttctctcaatcaacggagtagatgtgaccgaggccagacacgaccatgcggtgtcgttgcttacagcagcgagtcccaccattgcgctgctgctggagcgcgaggctgggggacccctgcccccatctccacttccccactctagtcctccaacagccgcagtagcaacaaccagcataactactgctactcctggcgttcccggtctgccctcactggcgccttcactgctggctgccgcactagagggaccatatccagttgaggagatcagactgccaagagctgggggacctctgggcctcagcatcgtgggtggctcagaccacagcagccatccttttggggtgcaagaaccaggcgtgttcatttccaaagtgctacccagaggactcgccgcacgcagcggcttaagagtaggggatagaatccttgcagttaatggccaggatgttcgagacgccacgcaccaggaagctgtatctgcattactacggccatgtctcgagctttcgcttttagtacggagggaccccgcaccgccaggattgcgggagctgtgtatccaaaaagcacctggtgaaagactggggatctctatccgaggtggagctaggggacacgccggaaatccgcgagaccccactgacgagggtatcttcatcagcaaagtaagtccaactggggcagccggtcgcgatgggcgtcttcgggtcggtttacggctactcgaggtgaatcagcagtcactcttaggcctcacacacggcgaggctgtccagttgctgagatctgttggggatactcttactgtactggtgtgcgacggcttcgaggcaagcaccgacgccgcactagaagtgtctcccggagtgatagctaatccgtttgctgctgggattggccatagaaactctctcgagtctatatcctcgatcgatcgagaacttagtcccgaaggccctggcaaagaaaaggagctcccaggccagacgcttcactggggcccagaggctactgaggccgcaggacgtgggctgcagccactgaagctagactatagagccttggccgctgttccctccgccggttcagttcagcgtgttccttcaggggcagcaggtggcaagatggctgaatctccatgtagtccgagcgggcagcaacctccatccccccctagcccagacgagctgcccgctaatgttaagcaggcctaccgggcttttgccgcagtgcccacctctcatcctccagaggacgcccctgcacagccccctacacccggtccagctgcttctcctgagcagctcagtttcagagaaagacagaaatacttcgaattggaagtccgagtgccgcaggccgagggacctctgcgcccaggcaggcggggtctgggccctgtaccgtcgtag

SEQ ID NO: 239733 - DNA, 4968 bp, Artificial Sequence
  Description of Artificial Sequence: Synthetic coding sequence
atgctaaaatgtattccactctggcgttgcaatcgccatgttgagtccgtcgacaagcggcattgttccctgcaggcggttccagaggagatctacaggtattccaggtccctcgaggaacttctgctggacgctaatcagttacgcgagctgcctaagcctttcttccggttgttaaatctgagaaagctgggattgagtgataatgagattcaacggctcccccctgaggtggccaattttatgcagctcgtggagctggacgtgtctcggaatgacatcccagagattcccgaatcaatcaaattctgcaaggcattggaaatcgccgacttctcaggcaaccccctaagccgcctcccagatggctttactcagttgagatctctcgcacacctagctctgaatgatgtatccttgcaggccctccccggagatgtgggtaatctcgctaatctcgtcaccctggagctccgggagaacctgttgaagtcactgcctgccagcctcagtttcctagttaagctcgaacagctggatcttggcggaaacgaccttgaagttctccccgacactcttggtgctctaccaaatctgcgagagttgtggctcgatcgtaaccagctgtcagccctacctccagagctcggaaacctacgtagactggtctgtctcgatgtgtccgagaaccggctggaagagttgcccgcagagcttgggggacttgtcctactgaccgatctgttactgtctcagaatttgctgagaagattgcctgatggtattggacagctcaagcagctgtcaatacttaaggttgatcaaaacagactctgcgaagtaaccgaagcaatcggcgattgcgaaaacctgagtgaactgattctgacagagaatcttctgatggcgctgccgcgaagtctcggtaagctcacaaagctcacaaaccttaatgtagataggaaccatctcgaggctctgccgcctgaaatcgggggttgcgtggctttgtcagtcctctctctaagagataatagactggctgttttgcccccagagctggcccacaccactgagctccacgttctggatgttgccggtaaccgtcttcagtccctgccctttgcgctgactcacctaaacctgaaggccctgtggctagcggaaaaccaggcccaaccaatgctccggttccagactgaagatgacgctaggactggagagaaggtactaacttgttatctgcttccgcagcagcccccacctagccttgaggatgccggacagcagggaagcctttccgaaacctggagcgacgcccctccgtctcgggtgagtgtcatccaatttctggaggctcctatcggcgatgaagacgccgaggaagcggctgccgaaaagaggggcctgcagcggagagctaccccacatccctctgagctgaaggtgatgaagcgaagcatcgaagggaggaggagcgaggcctgtccctgccagcccgattcaggctcaccattgccagctgaggaggagaagcgcctgtctgcagagtctgggctgtccgaggatagtcgcccaagcgcatcaacagtttccgaggctgagcccgagggcccttctgcagaagctcagggaggttctcagcaggaggctaccacagctggcggagaggaagatgctgaggaagattaccaggagcctaccgtgcactttgcagaagatgccttgctgccgggagacgaccgagaaattgaggagggtcagccagaggcgccatggacattgcccggtggccgtcagcgactgattagaaaagatactcctcactataaaaaacacttcaaaatctccaagctcccacagccagaggccgttgtggcgctgctacaaggcatgcaacccgatggcgaaggacctgttgcaccgggaggttggcataatgggcctcacgccccttgggcccctcgggcacagaaggaggaagaggaggaagaagaaggatctccacaggaggaggaggtagaggaagaggaggaaaatagggccgaggaagaggaagcttctaccgaagaggaagacaaggaaggtgcggtggtcagtgcaccatccgtcaagggagtaagtttcgatcaagctaataacctgctgattgagcctgctcgcatcgaagaagaagagctcactctgaccatcttaaggcaaactggcggattgggtataagcattgcgggtgggaagggttcaacaccctacaagggagacgacgagggcatttttatcagtcgggtgagtgaagaggggcctgcagccagagctggtgtccgggttggagacaaacttctggaagtaaacggcgtcgctctacaaggcgctgaacatcatgaggcagtggaagcactgagaggcgcaggtaccgctgtgcagatgagggtctggcgggagcgcatggtggaaccagaaaacgctgtgactatcacgcccctcaggccggaagatgactattctccaagagaaagacgaggcggagggctgaggctgccactgctgccaccagagtctcccggtccgctccgtcagaggcatgtggcctgcttggctagaagcgagagaggcctgggcttttctattgctggaggtaaaggatccacaccatatagggccggagacgctggaattttcgttagcaggattgcagaaggtggggctgcccaccgggctgggactctccaggtgggagatagagtcctgagcatcaacggggtggatgtcaccgaagctcggcacgatcatgccgtcagtttgctgaccgccgcatctcccacaattgcgttactgcttgagagggaagctggcggtccgttgccaccttctcccctccctcattctagccctccgaccgcagccgtagccactaccagcatcactacggctacccccggtgtccccggattgccttctttagcgccaagcttgctggcagccgcactagagggtccatatcctgtggaggagatacgactgccgcgagccggtggtcccctgggactgtcgatcgtgggtggcagtgatcactcaagccatccgttcggcgtccaggaacccggagtatttatcagtaaagtgctgccacgcggtctggcagccaggtctggcctgagggtgggcgacagaatcctcgccgtgaatggacaggacgtcagagatgcaacccaccaggaggcagtttcagctctgctgaggccttgcctggagttgagccttttagtccgcagagacccagcgcctcccggactcagggaattgtgtattcagaaggctcccggagaacgccttggtattagcattaggggaggggcaagaggacatgccggtaatccccgagaccccacagacgaaggcattttcatttcgaaagtctctcctaccggggcagctgggagggatgggagattgagggtggggctgcgcctccttgaggtgaaccagcagtctctgcttgggttgacacacggggaagcggtccagctcctgaggtccgtgggcgacactctgaccgtgcttgtttgtgatggtttcgaggccagcaccgatgcggcactggaagtgagtccaggtgtcattgccaatccattcgccgctgggattggccacaggaactcactcgagtccatcagttctatagatcgtgagctgtctccggaaggaccgggaaaggaaaaagaactgcctggccaaacgctgcattgggggccagaggctaccgaggctgcaggacgtggactacagccgctgaagttagactatagagccctggccgcagtgccaagcgcaggaagtgtgcaacgagtaccttccggcgcagctggcggtaagatggccgaatccccatgctcacctagtggccagcaaccccctagccccccaagccctgacgagctgcccgcaaacgtgaaacaggcttatcgggcattcgcagcagtccctacgtcccatccgccagaggacgcacccgctcagccaccaactccaggcccagcagctagtcccgagcagctgtcattccgcgaacgtcagaaatactttgagctggaggtccgggttcctcaggccgaaggtcctcctaaaagggtgagcttggtgggagccgacgaccttcggaagatgcaggaggaagaggcaaggaaactgcagcaaaaaagggcacagatgctgagggaggcggctgaggctggtgctgaggccagactcgcactagacggcgagaccctgggagaggaggaacaggaagacgaacagccgccttgggcctctccttctcctacatctaggcaaagcccagcttcccctcccccacttggaggtggtgcccctgtcaggacagcgaaggccgagcgcagacaccaggaacgccttcgggttcagtcccctgaacctccagccccagagcgcgctttatcacccgctgagctgagggccctggaagcagaaaagagggccctgtggagggctgcacggatgaaaagcctggaacaggacgcgctcagagcccaaatggtgctttcaagatcccaggaaggacggggaaccaggggacctttggaacgcctagccgaggcaccatccccggcacccaccccttcccccacgccggtggaagacctaggtccccagacaagcacgtcgccgggtaggcttcccctgtctggtaagaagtttgattacagagcattcgcagccctgccctccagccgccctgtttacgatatccagtcgcctgattttgcagaggagctacggtctctagaaccctcaccgagccctgggcctcaggaggaggacggcgaggttgctttagtgctcctgggacgtccctcacctggtgctgtgggccctgaggatgtggccttgtgttcatctcgtcgtccggtgcgccctggtcgcagagggcttgggccagtaccctcgtag

SEQ ID NO: 239734 - DNA, 2427 bp, Artificial Sequence
  Description of Artificial Sequence: Synthetic coding sequence
atgtggtttttcgctagggaccctgtacgagacttcccctttgagctgattcccgagcctccggagggcggtctcccaggaccatgggctctgcaccgcggaagaaagaaagctactgggagccctgtgtcaatctttgtgtatgacgttaagcccggagccgaagaacagacacaggtcgctaaggcagccttcaaaaggttcaagaccttgcggcatcctaacatactggcctacattgatgggctggaaaccgagaaatgtttgcatgtagtgaccgaggcggtcacgcccttaggaatctacttgaaggctcgtgtagaggcaggagggctgaaagaactggaaatttcttggggccttcaccagattgtgaaggcgctttcttttttggtaaatgattgtagtttaattcacaacaacgtgtgcatggctgccgtgtttgttgatcgggcaggcgaatggaagctcggagggctggattatatgtattcagcgcaggggaacgggggaggcccaccacgcaaggggatccccgagctggagcaatatgacccccctgaattggccgacagttccggccgagtggtcagggagaagtggagcgccgatatgtggagactgggatgcctcatttgggaggtattcaatgggccactgccgagggcggcagcactgagaaaccccggaaaaataccaaagactctggtgccccattactgtgaactggtgggcgctaaccctaaggtgaggcccaatccagcccgattcctgcaaaactgtagagcacccggaggatttatgagcaaccgctttgtggaaacaaatttgttcctcgaagagatccagattaaggagcctgctgaaaaacagaagttttttcaggaactttcaaaaagtctcgacgcatttcctgaagatttttgccggcacaaggtgctcccccagctgctgacagctttcgagtttggaaacgctggcgctgtagtcctaacccctttattcaaagttgggaagtttctctcagccgaagagtatcaacagaaaatcatcccagtcgtagtgaagatgtttagttcaacagaccgcgcaatgagaattcgattgctgcagcagatggagcagttcatccagtatctcgacgagcctactgtgaatactcagatctttccacacgtggtgcacgggttcctggacacaaacccagccatcagggagcagacagtgaaatctatgctgctgctggctccgaagttaaacgaggcaaatctgaacgttgagctgatgaagcacttcgctcggctccaggctaaagatgagcaggggccaataagatgtaacaccactgtgtgcctggggaaaattggctcttacctttctgcctctacccgtcatcgcgtccttacctccgcttttagcagggctacaagagatcctttcgctccttctagagtggcaggggtcctgggtttcgccgctactcacaacctgtactcaatgaatgattgcgcacaaaaaatccttccggttctgtgtggcctgactgtagacccagaaaagagcgtgcgcgaccaagcatttaaagcaattcgcagctttctgtcaaagttagagtctgtttcggaggatcccacacaactagaagaagtggaaaaagatgtacatgctgcatcatcaccaggaatgggcggtgcggctgcgtcctgggcgggttgggctgttacaggtgtgtccagtttgaccagcaaactcattcgctctcaccccactacggctcccacagaaaccaacatcccccagcggccaacccccgaaggcgtgcctgctcccgcacccacccctgtccccgctacccccactacaagcggacactgggaaactcaggaagaggacaaagatacagcagaagactcgagcacagctgatagatgggatgacgaggattggggctcactggaacaagaagcagagtcagtgctcgcccaacaagatgactggagcaccgggggtcaagtgagccgggctagccaggtgtctaatagcgaccataaatcctccaagtcacctgagtcagactggtcttcctgggaggctgagggttcttgggagcaggggtggcaggaaccttcttcccaagaacccccaccggacggtacgcgtttggccagtgagtacaactgggggggtcccgaaagtagcgacaagggggacccgttcgctacactgtcagcaagaccaagtacccagcccagaccagatagttggggcgaagataattgggaaggcctggagaccgattctcgacaggtcaaagcggagttggcacgcaagaaacgggaggagcggaggagggagatggaggcaaaaagagccgagcggaaagtggccaaaggacctatgaagcttggtgccagaaaactggactag

SEQ ID NO: 239735 - DNA, 2346 bp, Artificial Sequence
  Description of Artificial Sequence: Synthetic coding sequence
atgtggttcttcgccagggaccccgtacgcgatttcccattcgaactgatacccgaacctcctgagggaggcctgcctggtccctgggccctacatagagggagaaagaaggcaactggcagtccagtgagcatttttgtttatgacgtgaagcctggggctgaagaacagactcaggtcgccaaagcagcttttaaaagattcaaaacattgaggcatcctaatatcctagcatacatcgatggtctggagactgagaagtgcctgcatgttgtgaccgaggcagtgactccacttgggatatatcttaaggcccgagtcgaagctggcggattgaaggagctggagatttcatgggggctgcaccaaatcgtgaaggcactcagctttttggtgaatgattgctccctgatccacaataatgtgtgtatggcggctgtgtttgtcgatagggcaggtgaatggaaactcggagggttggattacatgtatagcgctcaaggcaacgggggtggaccaccaaggaagggcattcctgaactggagcagtacgacccgccagagctcgccgatagtagtggtcgagtggttcgtgaaaagtggagcgccgatatgtggcgtcttggatgtctgatctgggaagttttcaacgggcctctgcctcgcgcagctgccctcagaaatccaggtaagattcccaaaacgctcgttcctcattattgtgaattggttggggctaatcccaaagtgcgaccaaacccagccaggttcctgcagaattgccgcgctcccggtgggttcatgagcaacaggtttgtggagacaaacctcttcctggaggagatccaaattaaggaacccgcagaaaagcagaaattttttcaggagctaagtaagtcccttgatgctttcccagaagatttctgtcgtcataaggtgctgccgcagttactgaccgcctttgaatttgggaatgcaggcgctgtcgtcctaactccactcttcaaagtaggtaagtttctgagtgccgaagaatatcagcagaaaatcatcccagttgttgtgaaaatgttcagcagcactgatcgggctatgcgcatcagattactgcagcagatggagcagtttatccagtacctagacgagcctaccgtgaacactcaaatcttcccacacgttgtgcacggctttctcgatacaaacccagccattcgtgagcagaccgtgaagagcatgcttcttctggcccctaagctgaacgaagcgaatctgaacgttgagcttatgaagcatttcgcccgactgcaggccaaggacgaacaaggcccaattcgctgtaatactactgtctgtctagggaaaatcggcagctatttgagtgcatcaacaagacatagagtactgacaagcgccttcagccgggcaactcgggatccgtttgccccaagccgcgtggccggagttttgggattcgcagccacacacaatctgtatagtatgaacgactgtgcacagaagattcttcccgtcctgtgcggcctgacagtggaccctgagaagagcgtacgagatcaggccttcaaagccatccggtcatttctgagcaagctggaatccgtgtctgaggatcctactcagttggaagaggtcgaaaaggatgtccacgccgcttctagccccggtatgggcggagccgctgcaagctgggcaggatgggcggtgacaggggtttcttccctgacaagcaaactcataagatcccacccaacaaccgcccctactgagacgaatattccccaacggcctacacctgaaggagtacctgctcccgctccgactcccgttccagctacaccaactacaagcggtcactgggagacccaagaggaggacaaggataccgctgaggatagctctaccgcagaccggtgggacgatgaggattggggctcgctcgaacaagaggctgagtcagtcctcgcacagcaggatgactggagcacaggcggacaggtctcccgcgcatctcaggtaagtaactctgaccacaagtcaagcaaaagcccagagagtgactggagtagctgggaagctgaaggaagctgggagcagggctggcaggagcccagtagccaggagcctccaccagacgggacccgtcttgccagtgaatataactgggggggaccagagagtagcgacaaaggtgacccatttgcaacgctgagtgccagaccatccacgcaggatagatcccgtttgagctggcctggcaggtctgctcggagcggaggaggccgttggcgacccaacgcccctcgcggaaggtggcctcgagctccctag

SEQ ID NO: 239736 - DNA, 2124 bp, Artificial Sequence
  Description of Artificial Sequence: Synthetic coding sequence
atgtggttctttgcccgagacccagtgcgtgatttcccattcgaactcatcccggagccacctgaggggggactgcctggcccttgggctttacaccggggtcgcaaaaaagccacagggtcccctgtgagtatctttgtatacgatgtaaagcctggtgcagaagagcagacacaggtggctaaagctgccttcaaaaggttcaagactctgcggcacccaaacattctggcgtacattgacggactcgaaactgagaagtgtctacacgttgtgaccgaggccgttactcccctcggcatttacctaaaagcaagagtggaggccggagggttaaaggagctagagatctcctggggcctgcatcagatcgtcaaagcactttcattcttagtcaatgattgctccctgatccacaataacgtatgtatggccgctgtttttgttgatcgcgcaggcgagtggaagctggggggtctcgattatatgtatagcgctcaggggaatggtggcggtcccccaagaaagggcatccccgaactggaacagtatgacccgcctgagttagccgattctagtggaagagttgtaagagaaaaatggtccgccgacatgtggcggcttggctgcctgatttgggaggtattcaatggtcccctgcctcgcgctgcagccctgcgcaacccaggtaaaattcctaagactctggttcctcattattgtgaactggtcggtgcaaaccccaaggttcgacccaatcccgctaggtttctccaaaattgtagagcacccggaggatttatgagtaaccggttcgtggagaccaacctctttctcgaggagattcaaattaaggaacctgcggagaagcagaaatttttccaggaactgtccaaaagcctggacgcttttcctgaggatttctgtaggcacaaggtcctgcctcaattacttactgcattcgaattcgggaacgccggagccgttgtcctgacgccgctctttaaagtcggcaagtttctgtccgcagaagaatatcagcagaaaataattcccgtcgtggtcaagatgttctcaagtaccgacagagctatgagaattaggctcctgcagcagatggaacaattcatccagtatcttgacgaaccaacggtgaacactcaaatttttccccacgtcgttcatggattcttggacacaaaccctgccatcagagagcaaaccgtcaaatctatgttactgctggccccaaagctcaatgaggctaacttgaacgtcgagctgatgaaacacttcgctagactgcaggccaaagacgagcagggtccgatcagatgcaacacaacggtgtgcctgggcaaaattgggagctacctctccgcatcaactcggcacagagtgctcaccagcgcgttcagtagggccacccgggaccctttcgccccaagtcgggtggccggtgtgttggggtttgccgcaacacataacctgtacagcatgaatgactgtgcccagaaaatcctgcccgtgctctgtggcttgactgtggatcccgaaaaaagtgtcagagatcaggccttcaaagccatcaggagcttcctgagcaagcttgagagtgtttccgaggatcctacgcagctggaagaggtcgagaaagatgtccatgcagcatcttcccctgggatgggaggggctgctgcgtcttgggcagggtgggctgtaaccggcgtgtcctctttgacgtctaagctgatcaggtcacacccaaccacggctccgaccgagacaaacatccctcaacgccctactccagaaggacattgggagacccaagaacccccaccagacggaacaaggctggcgtccgaatacaactggggcggtcccgagagctctgacaaaggcgacccgttcgcaacactgagcgcgcgaccctctacgcaacccaggcccgacagttggggtgaggacaactgggaggggctagaaaccgactcccgccaagtgaaggctgagttggcaagaaagaagagagaggagcgtcgtagggagatggaagccaaaagggcagaacgcaaggtggccaagggccctatgaagttgggggcacgcaaattggattag

SEQ ID NO: 239737 - DNA, 1071 bp, Artificial Sequence
  Description of Artificial Sequence: Synthetic coding sequence
atgtggttttttgcccgtgatccagtccgcgacttcccttttgaattaatccccgaaccgcctgagggcggactgcctgggccatgggccctccaccgagggcgaaaaaaggcaactgggagccctgtgtccatcttcgtctacgatgtcaagccaggcgctgaggaacaaactcaagtcgccaaagcagctttcaagagatttaagacccttcgccatccgaatatacttgcctatattgatggcctggaaaccgagaaatgcctgcacgtggtgaccgaggcagtcacgccactgggcatttatttaaaggccagggtcgaagcaggtggactgaaagagttagaaatctcctggggcctgcaccaaatcgtcaaagctttgagcttcttggtgaacgattgcagccttatccacaataacgtttgcatggctgcagtatttgtggatcgagccggagaatggaaactcggcggactcgattatatgtacagcgcgcaggggaatggtggtggacccccaaggaagggcattccggaactggagcagtacgacccccctgaactagcggactcaagcgggagggtggtacgagagaaatggtccgcagatatgtggcggctaggttgcttgatttgggaggttttcaatggccctcttccaagagcggctgctctgcgcaaccctggtaagattccaaagaccctggtcccgcattattgtgaattagtaggcgctaaccccaaagtgcggccaaatcccgcacgtttcctgcaaaactgtagagcacccggtgggttcatgagtaacaggttcgttgaaaccaaccttttcctggaggagatacagcccaaggaccccagactgaaagaattcctgccacagcctccaccactgttcctgccccctctgcagccccaggctacaggcagaagaaggcggcgtacccgaacacagcagcggacagccgcactgcttactgacgggaccacaaagacgggagccgcatggtcaagacgtccatctttgtgttggcctagcagaaccacaggtgccccaggggcaaagtag

SEQ ID NO: 239738 - DNA, 2376 bp, Artificial Sequence
  Description of Artificial Sequence: Synthetic coding sequence
atgtggttttttgccagagacccagtgagagattttccatttgagcttattcccgagcccccagagggcggacttcccggaccttgggcactgcatagaggacggaaaaaggccacggggtcccctgtgagcatttttgtctacgacgttaagccaggtgccgaagagcagacacaggtggccaaagctgcgtttaagcgttttaagacactcagacatcctaacatcctcgcttacatcgatgggcttgagacggaaaaatgcttgcacgtggtgacagaagccgtcaccccgctggggatctatctgaaggctcgggtggaggccggaggtctgaaggagctcgagatcagctggggactgcatcagatcgtcaaggccctgagttttttggttaatgactgcagcctgatccataacaacgtgtgcatggctgctgtctttgttgatcgcgctggggagtggaaattaggcggtctcgactatatgtacagtgcgcaggggaacgggggaggtcccccaaggaaggggattccagagcttgaacagtatgacccacccgaactcgccgactcatcaggacgtgtcgttcgagagaaatggtccgcggacatgtggcgacttggctgtctgatttgggaagtgttcaatggcccacttccaagagcagccgctctgcgcaatcctggtaaaattcccaaaacgctggtgcctcactattgcgaactcgtaggcgctaatccgaaggtgagacctaatcctgcaagattcctgcaaaattgtcgcgcacctggcggttttatgtcaaaccggtttgtggagaccaatttgttcctggaagagattcaaattaaggagccagccgaaaagcagaaattttttcaggagctgtcaaagtcattggacgccttcccagaggacttttgcaggcacaaggtgctgccacagttactgaccgccttcgagttcggcaatgcaggggcagtcgttctaactcctttatttaaagtcgggaagttcttgtctgccgaagagtaccaacagaagatcatccctgtggtcgttaaaatgtttagtagtaccgacagagctatgaggatcagactgctgcagcagatggagcagttcatccagtacttggatgagccaaccgtgaacacgcagatctttccacacgtcgtgcacggctttctggacacgaacccggctattcgggagcagaccgtgaaatccatgctcttattagcgccaaagctaaacgaagctaacctgaatgtggagctcatgaaacactttgctcggctgcaagcaaaggatgagcagggcccaattcgctgcaacactactgtttgccttggcaagatcgggtcctacttatctgccagcactcgacaccgcgtgctcacatctgccttctcccgggctactcgggatccatttgcaccttctcgggtggctggcgttctggggttcgcagcaactcataatttgtattctatgaacgattgcgcgcagaagattttaccggttctctgcggactcactgtcgacccagagaaatcagttcgggaccaggccttcaaagcaatcagatcatttctcagcaaacttgaatcagtaagtgaggacccaacccagttagaggaggtagagaaagatgtgcacgccgcatctagccccggaatgggaggtgcagcggcttcttgggccggatgggccgtgacaggcgtgtcctcactgactagtaaacttataagatcgcaccccacaacggccccaactgagacgaacatcccacagcgacctacaccagagggtcattgggagacacaagaggaggacaaggacacagccgaagacagctcgacggccgaccgctgggatgacgaagactggggctccctcgaacaggaggccgagtctgtgctggcacagcaagacgattggtcgacgggaggccaggtatcccgggcaagccaggtaagcaactcagatcataaaagttccaaatcgcccgagtccgattggagtagttgggaggctgaaggcagctgggagcagggctggcaggaaccaagctcccaggagccccctcctgatggtactcgtctggccagtgaatacaattgggggggacccgagtcctccgacaagggggatccattcgcaacattgtcagcacggccttctacccaacctagaccagattcctggggcgaggacaattgggagggattagaaaccgatagtcgacaggttaaggccgaactggcgcgaaaaaagagggaagagcgcaggagggaaatggaagccaagagagccgaacgaaaggtggccaagggcccaatgaaactaggagctcgaaaactagattag

SEQ ID NO: 239739 - DNA, 2343 bp, Artificial Sequence
  Description of Artificial Sequence: Synthetic coding sequence
atgtggttttttgctcgggatcccgtgcgtgactttcctttcgaacttataccagagccgccagaaggagggctgcccggtccgtgggccttgcacagaggacggaagaaggctactggatcacccgtctctatcttcgtctatgatgtcaagcctggcgcagaggagcagacgcaggtggctaaagcagctttcaaacgtttcaaaactctgaggcacccaaacatcctcgcttatatagacggcctagagacagaaaagtgtctgcacgtcgtgacagaggctgttactcctctgggcatttatctcaaggcaagagtggaggctggcggactgaaggagctggaaattagttggggcctgcaccagattgtgaaagccctgagctttctggtgaatgattgcagtctgatccataataatgtgtgcatggctgctgtgtttgtggatcgcgcaggggaatggaagttgggcggtttagactacatgtacagcgctcagggcaacggcggaggcccaccccgaaagggaatcccagaacttgaacaatatgatcctcccgagctggccgatagctctggacgggtagtaagagagaaatggagcgctgatatgtggcgcctgggatgtctcatttgggaagtctttaatggccctttgcccagagccgcagcacttagaaatcctggaaaaatcccgaaaacgctcgttccacattattgcgaacttgtcggagcgaatcccaaggttagacctaaccctgcaagattcctccagaattgccgggctcctgggggttttatgagcaaccggtttgtggagacgaacctcttcctggaagaaattcagatcaaagagccagctgaaaagcaaaaatttttccaggaactcagcaagtcactcgacgccttccctgaagatttttgtcgccacaaggtccttccccagctattgaccgcattcgagttcgggaacgcgggagcagttgtgttgacacccctgttcaaggtcgggaagtttctatcagcagaggagtaccaacagaagattattcctgtggttgtcaaaatgttcagttcaacagatcgcgctatgcgaatccgtctgctgcagcagatggagcagttcattcagtatctcgatgaacctacagtcaacacacagatctttccgcacgtggtgcacggtttcctggacaccaaccctgccatcagggaacaaaccgtgaagagcatgctgttgctggccccaaagctgaacgaagcaaatctcaatgtcgagctgatgaaacatttcgcacgcctgcaggcgaaggacgaacaaggaccgatcagatgtaacacaaccgtatgcctgggcaagattggctcctacctgtctgcatccaccaggcatagagtgttaaccagtgccttctcaagggccacccgtgacccattcgcaccctctcgcgttgcaggggtgctggggtttgcggcaacccataatctgtatagcatgaacgattgcgcccaaaaaattctgcccgtgctgtgcggactgacggtggatccagaaaaaagtgtcagagatcaggcttttaaagccattcggtctttcctgtctaaactcgagagtgtctctgaggaccccacgcagctcgaagaggtggagaaggacgtgcatgcagcctctagccccggaatgggcggagctgccgcttcctgggccggatgggccgtaaccggtgtgagcagcctgaccagcaagcttatacgcagccatcctacaacagcaccaacagagaccaacatccctcagaggccaactccagagggagtaccggctcctgccccaacccctgtgcctgcgacgccaaccacttctggccattgggagactcaagaagaggataaagacaccgccgaggattcctcaactgccgataggtgggacgatgaggactgggggagcttggaagaggcagagagcgtgcttgcccagcaggacgactggagcaccggcggacaagtgtctcgggcaagccaggtgagtaactcagatcataaatcgagtaaatctccagaatctgattggtcaagctgggaagcggagggctcctgggagcagggatggcaggagcctagttcccaggaacctccccctgacggaactagactcgccagcgagtacaactgggggggaccagagtctagcgacaaaggcgacccattcgccactttgtcagctcgcccaagcacccaggacaggtcgcgcctctcctggccaggccgatccgccagatcgggcggagggcgatggcggccaaacgcaccacgcggacgatggccccgagcgccttag

SEQ ID NO: 239740 - DNA, 2124 bp, Artificial Sequence
  Description of Artificial Sequence: Synthetic coding sequence
atgtggttctttgccagagacccagtacgcgatttccctttcgagcttattcctgagcctccagaagggggactgccgggaccttgggcccttcatagaggaaggaaaaaagcaacgggcagccccgtgagcatctttgtttacgatgtcaaacccggagccgaagagcagacccaagtcgccaaggctgcctttaaacgattcaagacactacgacacccgaatatattggcctacatcgacggtttagaaaccgaaaaatgtctccacgtcgttaccgaggcagtgactccgttaggcatttatcttaaggccagggtagaagctggcggtctgaaggagctcgagattagctggggcttgcaccagatcgtgaaggcactctccttcctggtcaacgactgcagcttaatacacaataacgtttgcatggcagccgtgttcgtggaccgcgctggtgaatggaagctcgggggtctcgattatatgtattcggctcagggcaacgggggtggcccaccgagaaaaggtatacccgagctggagcagtacgacccccctgaactggcagacagctccggccgagtcgtgagggaaaaatggtcagcagatatgtggaggctcggctgcttgatttgggaagtgttcaatggacctctcccaagagcagcagcactcaggaatcctggcaagattccaaaaacactggtgccacattattgcgaactggtgggagctaatcccaaggtccgccctaaccccgcacgcttcttgcagaattgcagagctcccggtggattcatgtccaatcggtttgtcgaaacgaacctgtttctggaggaaattcagattaaggagcctgctgaaaagcagaaattcttccaagaactaagcaagtcactagatgctttcccagaggacttctgtaggcacaaagtccttccccagctgctgactgcattcgaattcgggaacgctggagccgtggtgttgacaccactgttcaaggtgggaaagttcctcagcgctgaggaatatcagcagaagataatacctgtggtggtgaagatgttttcttctaccgacagagctatgagaattagacttcttcaacaaatggagcagttcattcagtatcttgacgagcctactgtgaacactcagatcttcccgcatgttgtgcacggcttcctggacacaaatcccgcaatcagggaacagacggtcaaaagcatgctgctcctcgcccctaaactgaacgaagccaacctgaatgtggagctcatgaagcacttcgccagactccaggccaaagatgagcagggtcctatacggtgcaacaccaccgtgtgcctcgggaaaatagggtcatatctgagtgcaagcacccgacatcgggtgttgacctcagccttttcgcgtgccacccgagaccctttcgcaccatctcgcgttgccggagtgttgggcttcgccgctacacataatctttactccatgaatgactgtgctcagaagattctgccagtgctgtgcgggcttacagtggaccccgagaagtcagtacgcgatcaggcctttaaggctatacggtcctttttatcaaagttggaatcggtgtccgaagatcccactcaacttgaggaagtggagaaggatgtgcatgcagccagttcccctggaatgggcggtgctgctgcttcatgggctggctgggcagtcacaggggtgagctcccttacatcgaagctaatccggagtcacccaaccaccgcccctactgagaccaacatcccccagcggcctaccccagaaggtcattgggagacccaggaaccgcctccagacggtacccgcttggcatcagagtacaactggggcggtccagaaagcagcgataaaggcgatccattcgcgacgttgtccgcgagacctagcactcagcccaggccagacagctggggcgaagataattgggagggtctggagaccgattctaggcaagtaaaagccgagctggcccgaaaaaaaagagaagaaagaaggcgagagatggaggccaaaagggccgagaggaaggtcgccaagggcccaatgaaactgggcgctaggaaactcgattag

SEQ ID NO: 239741 - DNA, 2364 bp, Artificial Sequence
  Description of Artificial Sequence: Synthetic coding sequence
atgtggtttttcgcacgtgatcctgttcgcgactttccttttgagctaatccccgagccgccagagggcggtttgccagggccttgggcactgcacaggggcaggaagaaggctaccggatctcccgtatcaatctttgtgtacgatgttaagccgggtgcggaggaacagacccaggtggctaaggccgctttcaagcgcttcaagactcttaggcaccccaatatacttgcatacattgatggcctggaaaccgagaagtgcttacacgtggtgaccgaggcagttaccccccttggaatatacctgaaggcccgagtagaggccggtggcctgaaagaactcgaaatatcctggggcctgcatcagattgtcaaggctctgagcttcctggtcaatgattgtagcctaattcataacaatgtatgtatggccgctgtgttcgtcgacagagcaggtgaatggaagttaggtggtctggattacatgtattccgctcaggggaacggcggaggaccgcctagaaaaggtattcccgagctggagcagtatgacccacccgaactcgctgactcttctgggagggtggttagagaaaaatggtctgctgacatgtggagactcggctgcctgatatgggaggtctttaacggtccactcccacgggctgctgctctgaggaaccccggaaaaatcccaaaaactctggtgccgcactactgcgagctcgtcggcgctaaccccaaggtcagaccgaacccggctaggtttctgcagaattgtcgggctcctgggggatttatgtccaatagatttgtcgagacaaatttatttctcgaagagattcagataaaggagcccgcagaaaagcagaaatttttccaagagctcagtaagtcgctggacgctttcccggaagacttctgtagacacaaggtgttaccccagctgctaaccgcttttgaattcggaaatgctggcgctgtcgtcctgaccccactcttcaaagtcggaaagtttctgagtgctgaggaatatcagcagaagatcatccccgtcgtggtgaagatgttctccagcactgaccgcgcaatgcggatcaggctgctgcagcagatggagcaatttattcagtatctcgatgaaccaaccgttaatactcagatctttcctcatgtcgtacacggattcctggacacaaatcccgctatcagagaacagacggttaagtctatgctgctgctcgcccctaagctgaacgaagctaatctcaatgtggagctgatgaagcattttgccaggttgcaagcaaaagatgagcaggggcctatccggtgcaatactacagtgtgtctgggaaaaataggctcctacttatcagcaagcaccaggcacagggtactaacaagcgctttcagccgcgcaacaagggacccctttgctccaagcagagtagctggggtccttggctttgctgccactcataacctgtactcaatgaatgattgtgcccaaaaaatcctccccgtgctgtgtgggctaactgtagaccccgagaaatcagttcgagatcaggcctttaaggcaattcggtctttcctctcaaagttagaatctgtgtccgaggatcctactcagctcgaggaagtcgaaaaggatgtccatgctgccagcagcccaggaatgggcggagctgcagcaagctgggcaggctgggctgttactggggtgagcagtctgacctcaaagctcattaggtctcatccaacaaccgctccaaccgagaccaacattcctcaaaggcccaccccggaaggggtaccagcaccggcacccacccccgtgcccgcaactccgacaacttctgggcattgggaaactcaggaggaggataaagacaccgccgaagattcaagcaccgccgaccgatgggatgacgaagattggggctcgctcgagcaggaagccgaatccgtcctggctcagcaggacgattggagcaccggcggtcaagtgtcccgcgcatcacagtcccccacgggagccgcaggaaagctgcgtgcccctggcaaccgggctgggaggagccaagcgccacggtctcatttgctaacagtacacggatggccagccagtatcaccggcgtggcacaaagccccgctaccagagctactccgtccctgccctgcctccacgtgccagccccttcaagggggcagacgttgggtgtgcggaccaccggtagggcctcaagactcacggtggatcgaagcaggctgtcttggcccggtaggagcgctagaagcggcggtggccgttggcgaccaaacgccccaagaggtaggtggcctcgagcaccatag

SEQ ID NO: 239742 - DNA, 663 bp, Artificial Sequence
  Description of Artificial Sequence: Synthetic coding sequence
atgattaaacccaaatggggaggcttggtgtgggcccagtggcacggaccactggctcggccttccgggacacttccatttgctagtagcatgccgagcccagtggacgccagcagtgcagatgggggaagcggcctgggaagccacaggcgaaaacggactacgttctcgaaggggcagttactagagctcgagcgcgcattcgcagcctggccatatcctaacatttctacgcacgaacatctggcctgggtcacatgcctccccgaagctaaagtccaggtctggttccaaaagcggtgggcgaaaattattaagaatcggaagtcggggatactctctcccggttcggagtgtcctcagagcagttgttcattgcccgacaccctccagcaaccctgggacccccaaatgccaggacagccgccaccctccagtggaactccacaacggacctcggtgtgtcgccactcaagttgcccagcacccggactgtctcccagacagggctgggaaggggctaaggcagtcgccccatgggggtcggcgggtgcatctgaggtgcatccatcactggaacgcgcaactcctcaaacttcccttgggtcgctttcggatttgatctacgccctagcaatcgtggtgaatgtagaccactcatag

SEQ ID NO: 239743 - DNA, 651 bp, Artificial Sequence
  Description of Artificial Sequence: Synthetic coding sequence
atggggggatctggcgtggggacagcttggcacggccctttggcacgcccttccgggaccttgccattcgcttccagtatgccaagccccgtcgatgcatcatcagcagatggcggttccggcctgggctcccaccgacgtaagaggacgaccttcagcaagggtcaattactggagctggagagggcctttgctgcatggccataccctaatatcagcacccatgaacatctggcttgggtaacgtgtttacctgaagctaaagtgcaggtctggtttcaaaaacgctgggccaaaatcattaaaaatcggaaatctggcatcctcagccccggttccgagtgcccacagtcctcctgttctctgcccgacactttgcagcagccatgggatccccagatgccgggacagccgcctccttcatccgggaccccacaacggacttcagtgtgtcgacactcctcatgccccgcacccggtctttctcccagacagggctgggagggggctaaagccgtggccccttggggaagcgccggtgccagcgaggtgcacccatcactcgagcgcgctacccctcagaccagtttggggtctctgtccgacctgatctacgcgctggcaattgtcgtgaacgtagaccacagctag

SEQ ID NO: 239744 - DNA, 648 bp, Artificial Sequence
  Description of Artificial Sequence: Synthetic coding sequence
atgatgactactggatggactggactgtgccttccgccagtaaaccctagccgggtgtcttcgagttctctcgaaacctcaaccacggagtccatttttgcacacgacggcggatcaggtctcggctcccatcgaaggaagagaaccaccttcagtaaggggcaactgcttgaactcgaaagggccttcgccgcttggccatatcctaatatctctacccacgagcatctcgcctgggtgacctgtcttcctgaggctaaggttcaagtgtggtttcagaagcggtgggcgaagattatcaagaatcgcaagagtggaatcctctcccctgggtctgagtgccctcagagctcttgcagtctccccgacacactgcagcagccatgggatccgcagatgcctgggcagccccctccctctagcggcactccccaacgcactagcgtgtgcaggcacagtagctgtcccgctccagggttaagcccacggcaggggtgggaaggagctaaggccgtggccccatggggatccgccggagcctctgaggtccacccaagtctcgagcgggctactccacagacatcactggggtctttgtcagacctgatttatgcactcgctattgtcgtcaatgtggaccattcttag

SEQ ID NO: 239745 - DNA, 648 bp, Artificial Sequence
  Description of Artificial Sequence: Synthetic coding sequence
atgatgaccacgggatggacaggactgtgtcttcctccagtcaacccaagccgggtatcaagttcatccttggagacttctaccaccgagtcaattttcgctcatgatgggggaagcggtcttgggtcccatagacgcaaacgcactactttctccaaaggtcagctactcgagctcgaaagagcttttgcggcttggccttacccgaacattagtacccacgaacacctcgcgtgggtgacttgtttgcctgaagccaaggtccaggtctggttccagaagcgctgggcgaaaataattaagaataggaaatccggaatcctgagccccggaagcgagtgtccacagtcctcctgttccctccctgatacccttcagcagccatgggacccccagatgccaggccagcctcccccaagcagtggtaccccgcagcgcacctccgtttgtaggcactcctcctgtcccgctccgggtctgtcacctcgccaaggatgggagggcgcaaaagccgttgccccttggggctcagctggtgcatctgaggtccaccccagcctggaaagggctactcctcagacctctctcggctcactgagtgatctgatatacgcacttgcaatcgtagtcaatgtggatcacagctag

SEQ ID NO: 239746 - DNA, 1212 bp, Artificial Sequence
  Description of Artificial Sequence: Synthetic coding sequence
atgtcgggacgggtgggagaccttagtcccagacagaaagaagcactggcgaagtttagggagaatgtacaggacgtccttcccgctcttcctaacccggacgactactttctcctaaggtggcttagagcccgtagtttcgatctgcaaaaatctgaagccatgttacgcaagcacgtggaattccggaaacagaaagatatcgacaacataatctcctggcagcctccggaagtcatacaacagtatcttagcggtgggatgtgcgggtatgacctggacggatgcccggtttggtatgatattataggacccctggacgcaaaaggattgctgtttagcgcatccaagcaggatctcctccgtacaaaaatgagagagtgtgagttactcctgcaggagtgcgctcatcaaacgaccaaactgggcaggaaggtggagaccatcaccattatttacgattgcgagggcctagggctgaagcacctctggaaacccgctgttgaagcctatggtgaatttctgtgtatgtttgaggaaaactatcctgaaacgttaaagcggctattcgttgttaaggccccaaagttgtttcccgtggcttacaaccttatcaaaccctttttgtctgaggacacacgcaaaaagatcatggtgctgggcgcaaattggaaggaagtcctgctgaaacatatctcccccgatcaggttccagttgagtatggagggacaatgaccgatccagatgggaatcctaaatgtaagtccaagatcaattatggcggtgacatcccgaggaagtactatgtgcgggaccaagtcaagcagcagtacgaacacagtgtccaaatttcaagagggtcttcacaccaagtcgaatatgagattctgttcccaggttgtgtattacgatggcagtttatgagtgatggagccgatgtggggttcggcattttcctgaagactaagatgggagagagacagcgagcaggcgagatgacagaggtcttgccaaatcagaggtacaactcacatcttgtccccgaggatggcactctcacatgttccgatcccggaatttacgtgctcaggttcgataatacatacagcttcattcacgctaaaaaggtgaactttacagtggaggtgctcctcccagataaagcttcagaggaaaaaatgaaacaattgggtgctggcacgccaaaatag

SEQ ID NO: 239747 - DNA, 963 bp, Artificial Sequence
  Description of Artificial Sequence: Synthetic coding sequence
atgagcggaagagtcggagatctgagccctcgtcaaaaggaagccttagcaaaattccgagagaatgtgcaggatgtcttgcccgctctgccaaacccggacgattatttcctgctgaggtggctgcgcgcaaggtccttcgatttgcaaaagtctgaagctatgttgaggaagctgggccgtaaggtggaaacaattaccattatctatgactgtgaagggctgggcttaaagcatctgtggaagccggctgtcgaggcatacggtgagttcctgtgcatgttcgaagaaaattaccccgagacactgaagcgactctttgtggtaaaagctcccaaattgtttccggtggcatataatctcataaaaccctttctctcagaagataccagaaaaaagattatggtgctgggggcaaattggaaagaggtccttttgaaacacatcagcccggatcaggtgcctgtggaatatgggggtacgatgacggaccccgatgggaatcccaaatgcaagtctaagattaattatggtggggacattcccagaaagtactatgtacgagatcaggtgaaacagcagtatgaacattctgtgcagatctctcgtggaagcagccaccaggtggagtacgagatactgttcccgggttgtgtgcttcgctggcagtttatgtccgacggcgcagacgtggggttcggcatattcctgaagactaaaatgggcgagcggcagagagcgggtgagatgaccgaagtcctcccgaaccaacgctataactcacatttggtcccggaagacggcacccttacatgttccgatcctggcatctacgtgttgaggtttgacaacacatactccttcatacatgcaaaaaaagttaatttcacagtggaggtactgctgccagataaagcttccgaggagaagatgaagcaactgggcgcaggaacaccaaaatag

SEQ ID NO: 239748 - DNA, 990 bp, Artificial Sequence
  Description of Artificial Sequence: Synthetic coding sequence
atgctgcgaaaagtgatacagcagtacttgtcaggcggaatgtgcggttacgatctggacgggtgccctgtgtggtacgatattatcggtcctctggatgcaaagggcctcctgttttctgcttcaaaacaagatctgctgcggactaagatgcgagagtgcgaactgcttctgcaggagtgcgcacaccagaccaccaagttgggacgtaaagtggagactattacaataatctacgattgcgaggggctgggcctgaaacacttgtggaagcctgctgtggaggcctacggtgagtttctgtgcatgttcgaggaaaattatcccgagactttgaaaaggctattcgtcgtcaaagcgccaaagctcttcccagtcgcctataacttgatcaagcctttcttgagcgaggacacccgcaagaagataatggtgttaggagctaattggaaggaggtgttgctgaaacatatatcgccggatcaggtccctgtggaatatggagggaccatgacagatcccgacggaaaccctaagtgcaagtcaaagatcaactacggaggggatatccctcgaaaatattacgtgagggaccaggttaaacagcaatatgaacacagcgtgcagatttcaagaggcagctcccaccaagttgagtacgagatcttatttccgggatgtgttctcagatggcagtttatgagtgatggggcagacgtgggctttggcatttttctgaagaccaaaatgggcgagcgtcagcgcgctggggagatgactgaggttttgcccaaccagcgttataatagtcatctcgttcctgaggatggtacactcacatgcagcgatcccggaatctacgttctcaggtttgataacacctacagcttcatacacgcaaagaaagtgaacttcacagtcgaggtgcttctcccggataaggcgtccgaggagaagatgaagcagctcggggcaggaacgcccaagtag

SEQ ID NO: 239749 - DNA, 1179 bp, Artificial Sequence
  Description of Artificial Sequence: Synthetic coding sequence
atgtcaggccgagtgggcgacttatcgccaaggcaaaaagaggccctggctaaattccgagaaaatgtacaggacgttttgcccgctctgccaaacccagacgattactttctgttgcgctggcttagggctagatcctttgacttacaaaagtctgaggccatgttgcggaagcatgtggagttcagaaagcaaaaagacatcgacaacatcattagttggcagccccctgaggtgattcagcagtatctgtctggagggatgtgcggatatgatctagacggatgcccagtgtggtatgacattattggaccgctcgacgctaaagggttgctatttagcgcgtccaagcaggatctgctccgaacgaaaatgcgcgagtgcgagctattattgcaggagtgtgctcaccagactactaaactgggcagaaaagtcgagactataaccattatctatgattgcgagggcctgggactgaaacacctgtggaagcctgcagttgaggcctacggcgaatttctttgcatgtttgaagagaattacccagaaacactgaagcggttgtttgtggtaaaagcccctaaactctttcctgtggcttataacttgatcaagccctttctgtcagaggataccagaaagaaaatcatggtgttaggggctaattggaaggaagtcctgttgaaacacatcagccctgaccaagtgcccgttgagtatgggggtactatgaccgacccagatggtaatcctaagtgcaagtccaaaatcaattacggcggagacattcccagaaaatattatgtacgcgaccaagttaagcagcagtatgagcattcggtgcagatatccaggggaagttcgcatcaggtggaatacgaaattctttttccgggatgcgttctgcgctggcagttcatgtccgacggcgcagacgtcgggtttggaatcttcttgaaaacaaaaatgggcgaacgtcagcgcgctggggaaatgaccgaggtgctacccaaccagcgctataattcgcacctggtcccagaagacggtacacttacatgttcagacccagggatctgtaaatacctatgcctgggtaatgctctgaagccccacgtgcagctgagcgcctgtgaggtcccactccccccatggatcttcgggtccgagtgttag

SEQ ID NO: 239750 - DNA, 1119 bp, Artificial Sequence
  Description of Artificial Sequence: Synthetic coding sequence
atgtccaaagcttttggactcttacgtcagatctgccaatctatcctcgccgagtccagccagtcccccgcagacctcgaagaaaaaaaggaagaggattccaacatgaagagggagcaacccagggagaggcccagagcttgggactatccgcacggccttgtgggcctgcataacattggtcagacctgttgcctgaattctctcatccaagtcttcgtaatgaacgtggatttcacccgcatcttgaagcgcatcacagttccacggggtgctgatgagcagcgacgatccgttccattccagatgctgttgctgttagaaaagatgcaggactccaggcagaaagccgtgcgaccacttgagctggcctactgtttacagaaatgtaacgtgccactgttcgtacagcacgatgccgctcagctgtatctgaaactgtggaatcttattaaagatcagatcactgatgtgcacttggttgagaggcttcaggctctgtataccatccgagtaaaggactccttgatctgtgtggactgcgcaatggaaagtagtcgcaattcctccatgcttaccttaccactgtccttgtttgacgtcgattcaaagccacttaagactctcgaagatgctctccattgcttttttcaacctcgcgagttatcatccaaatctaaatgtttttgcgaaaactgtggcaagaaaactcgcggaaaacaagtcctcaaactgacacatctaccacagaccctcacaatccatttaatgcgcttttccatccgaaattcccagacgcgtaaaatttgtcatagtctgtactttccacaatctctggacttttctcagattctccctatgaagagagaaagttgcgatgctgaggagcaatcagggggacagtatgagctattcgcagtcattgcccatgtagggatggccgacagcggacactactgcgtttatatacggaatgcagtagatgggaaatggttttgtttcaatgactctaacatttgtctggtctcttgggaagacattcaatgcacttacggaaaccccaactaccattggcaggagactgcgtacctgctagtatacatgaaaatggagtgttag

SEQ ID NO: 239751 - DNA, 1062 bp, Artificial Sequence
  Description of Artificial Sequence: Synthetic coding sequence
atggagttcagaaagacaatggatatagatcatattcttgactggcagcctccagaggtcattcagaaatatatgcccggtggcctctgcgggtatgaccgggacggatgtcctgtgtggtacgatatcataggccctctggacccaaaaggacttctctttagtgtgaccaaacaggaccttctcaaaactaagatgcgtgattgcgagagaatcctacacgagtgtgacctccagaccgaacgacttgggaagaagatcgagaccatcgtgatgatctttgattgcgaaggactgggcctaaagcatttttggaaaccacttgtggaagtgtaccaggagttctttggattgctcgaagaaaactacccagagactctcaagttcatgctgattgtaaaggccaccaaactatttcccgtcggctacaaccttatgaagccgtttcttagcgaagatacgcgcaggaaaatcattgttctgggcaataactggaaggagggcctgctcaaattgatctccccagaagaactacccgctcagtttggaggaactctcaccgaccctgatggaaatcccaagtgccttaccaagatcaactatggtggtgagatccctaagtcaatgtacgtaagagaccaggtaaaaacacaatacgaacactccgtgcaaatcaatcgcggatcatcacaccaggtggagtacgaaattctgtttccaggctgcgtattgagatggcagttctcatcggacggcgctgatattggcttcggcgtatttctgaagactaaaatgggggagcggcagcgagctggagagatgacagacgtcttaccatcccagcggtacaatgctcacatggtgccagaagatgggaaccttacgtgctccgaagccggagtgtacgtagaatccgaaagcgggaaatcttgctgccacctccccgtaataatttgctctcatgagctccagaattctcactccaactcccaggtgatggcttatcaaatggtaagaaagtgcaagctgtctcgaccccttcccctgccagcctctaactag

SEQ ID NO: 239752 - DNA, 1026 bp, Artificial Sequence
  Description of Artificial Sequence: Synthetic coding sequence
atggaatttagaaagaccatggacatcgaccatattttggactggcagcctccagaggtcattcaaaagtatatgcccggagggctttgcgggtatgaccgggacgggtgccctgtttggtatgatatcatcggcccattggatccaaaaggtttgctcttctccgtaactaagcaagatctccttaagactaagatgcgcgactgcgagcgtatcctgcatgagtgcgacctgcagacggagcggctgggtaagaaaatcgagaccattgtgatgatatttgactgcgaggggctgggactcaagcacttttggaaaccactcgtagaggtgtaccaggagttcttcggcctccttgaggagaactatcccgagacccttaaattcatgctcatagttaaggctaccaagctctttcctgtaggttataacctgatgaagccctttttatctgaggatacgcgcaggaagataattgtgctgggcaacaattggaaagaagggctcctcaaactgatttcccctgaagaactgcccgcacaatttggtggaaccttgactgatcccgatggaaaccccaagtgtttaaccaagataaactacggcggagaaattcccaagtccatgtacgtgcgtgatcaggtaaaaacacagtacgaacactccgtccagatcaatagagggtcatctcaccaggttgagtacgaaattttatttccgggatgcgttcttaggtggcagttcagctctgatggggcagacatcggcttcggcgtgttcttaaagacaaaaatgggggagcgccagagggccggagagatgaccgacgtccttccatcccagagatataatgctcacatggtaccagaagacggaaatttaacctgcagcgaggctggggtttatgttctgcggtttgataacacctactccttcgtgcacgccaagaaggtctcatttactgtcgaagtgcttctgcccgacgaaggaatgcaaaagtacgacaaggagttgacacctgtatag

SEQ ID NO: 239753 - DNA, 972 bp, Artificial Sequence
  Description of Artificial Sequence: Synthetic coding sequence
atggtgattcaaaagtacatgccagggggattgtgcgggtacgaccgcgacggctgtcccgtgtggtatgatatcattggccctttggacccaaaggggctcttattttctgtcacaaagcaagacttgctgaaaactaagatgagagactgtgaaaggattctgcacgagtgtgatcttcagacggagcggctgggcaagaagattgagaccatcgtgatgattttcgactgtgagggacttggacttaagcatttctggaagccactggtggaggtgtaccaggagtttttcggactccttgaggaaaactatcctgagacccttaaatttatgttgattgttaaagccactaagttgtttcctgtcggctacaaccttatgaagccttttctgagtgaagatacccgaaggaagatcatcgttctgggcaacaattggaaggagggtctgctcaaattgattagcccagaagaactgccggctcaattcggaggaaccctgaccgaccctgatgggaaccctaagtgtttgacaaagattaactatggcggagagataccaaaatccatgtacgtccgagaccaagtgaagacacagtacgagcactctgtgcagattaacaggggaagttctcaccaggtcgagtatgagattctgtttccaggttgtgtattgagatggcagttctcctctgacggggcagatattggcttcggagtttttctaaagactaagatgggagaacggcagcgagccggtgagatgaccgacgtgctccctagtcaacgctataatgcacatatggttccggaagacggaaacctgacctgcagtgaggccggagtgtatgtcctccggtttgataatacctattccttcgtgcacgctaagaaggtctccttcacagtggaggttctactgcccgacgaaggcatgcagaagtacgacaaagaactgaccccagtgtag

SEQ ID NO: 239754 - DNA, 972 bp, Artificial Sequence
  Description of Artificial Sequence: Synthetic coding sequence
atggtaatacagaagtatatgccaggcggattgtgtggctacgatcgcgatggctgtccagtgtggtatgacatcattggcccactcgatcctaaagggctcttgttttccgtgactaagcaggacttgctgaagaccaagatgagagactgcgaaagaatcctccatgaatgtgacctgcagaccgaacgcttaggaaagaagatcgagaccatcgtgatgatttttgattgcgagggccttggattaaaacatttctggaaacctttagttgaggtgtatcaagaattcttcggactgctggaagaaaactatccggaaacactaaaatttatgctgatagtcaaagctaccaagctctttccggtgggctataatctgatgaaacccttcctgagcgaggatacccggcgaaaaatcatcgttctgggtaataactggaaagagggattgctcaaactgattagccccgaggaattgccggctcagttcggtggaacattgacagatccagatgggaatcccaaatgtttaaccaagattaattacggcggagaaattcccaaatccatgtacgtcagggaccaggtgaaaacacagtatgaacatagtgtccaaatcaatcgtggaagctcgcaccaggtggagtatgaaatactcttccccggatgcgtgctgcggtggcagttcagttccgacggcgctgatatcgggttcggggtgttcctaaagacgaagatgggcgaacgccagagagctggtgaaatgaccgacgttctaccgagccaaagatataatgcacacatggttccagaggacggcaacctcacctgctccgaggccggagtatatgttctgagatttgataatacttattcctttgtgcacgcaaagaaggtgtcctttacagtggaggtcttgctgcctgacgagggcatgcaaaagtacgacaaggaattaacccccgtctag

SEQ ID NO: 239755 - DNA, 1221 bp, Artificial Sequence
  Description of Artificial Sequence: Synthetic coding sequence
atgtcctccagggtgggcgacctttctccccagcagcaagaagccctagcccgttttcgagagaacctgcaggatctgctccccattctgcccaatgccgatgactattttcttctacgatggctccgtgctcgtaatttcgaccttcaaaagagcgaggacatgctgcgtaggcatatggaattccgaaaacagcaagacctggacaatatcgtaacctggcaaccccctgaagttatacagctttacgattctggcggactgtgtggctacgactatgaagggtgccctgtttacttcaatatcattggcagcctggaccccaagggcctgcttctttctgcttctaaacaagatatgattagaaagcgcataaaggtttgtgagctgctgctgcacgaatgcgaactgcagacccagaaactaggacggaaaatagagatggcccttatggtgtttgacatggaagggctttctcttaagcacttatggaaacctgcggtggaggtctatcaacaattcttcagcatcctggaagccaactatcccgaaacactgaaaaaccttatagtgatccgggcaccaaaactattccctgtggcattcaatctggtcaagtctttcatgagcgaagaaactcggagaaaaatcgtgatcctgggggacaattggaagcaggaacttaccaagttcatatctcctgatcagctcccagtggaatttggtggaactatgacggatcctgacggaaaccccaagtgtctgacaaaaatcaattacgggggtgaggtgcctaaatcatactatttgtgtgagcaggtaagattacagtatgagcatacacgctcagttggtcggggttcttccctccaggtcgagaatgagattttatttcccggatgcgttctgcgttggcagttcgcaagcgatggaggcgatataggattcggcgtcttcctgaagaccaaaatgggtgagcaacagagcgcaagggagatgactgaggttctcccttcacagcgctataacgcccacatggttccggaagacggcagtttgacttgcctacaggctggtgtgtatgtcttgcgatttgataacacctacagccgaatgcacgcaaaaaaactatcgtacaccgttgaggtcctcctgccagataaggcttcagaggaaaccctgcagagcttgaaagcaatgcgcccatccccaactcagtag

SEQ ID NO: 239756 - DNA, 1083 bp, Artificial Sequence
  Description of Artificial Sequence: Synthetic coding sequence
atgtctagtagggtaggtgatctgtctcctcagcaacaggaggctctggccaggtttagggagaatttacaggatctgctgccaatcctgccaaacgcagatgattattttttgctacggtggcttagagcaaggaactttgatctgcagaagagcgaggatatgctgaggcgccacatggaattccgaaagcagcaggacctggacaacatagtgacctggcagcctcctgaggtcatccagttgtatgactcagggggactgtgtggctatgattatgaagggtgccccgtatactttaatatcatcggctcgctcgaccctaaaggattgcttttgtccgcttccaagcaggacatgattcggaagcgaatcaaagtgtgcgaacttctgctccacgagtgtgaactgcaaacccaaaagctggggaggaaaatcgagatggctctgatggttttcgacatggaaggcctaagcctgaagcatctgtggaaaccagccgttgaagtttaccaacagtttttctccatcctggaagctaactaccccgagacgcttaaaaacttgatagtgatacgggcaccgaaactgtttccagtggctttcaatctcgtgaagagcttcatgtcagaagaaacgcggagaaaaatcgttatcctaggcgataactggaagcaggagttgacgaaattcattagccccgatcagctccccgttgaatttggtggaacaatgacagatccagatgggaacccgaaatgtctaaccaaaattaactacgggggagaggttccaaagagttactatttatgtgagcaggtgaggcttcagtacgagcacacccggagtgtcggtcggggttctagcctgcaagttgaaaatgagatcttgttccctggatgcgtactgcgctggcaatttgcatctgacggcggagatatcggcttcggcgtttttctgaagaccaaaatgggagaacaacaatccgcacgggagatgactgaggtgttacccagccagcggtacaacgcgcatatggtgcccgaagacggaagtcttacatgtctacaggccggtgtatag

SEQ ID NO: 239757 - DNA, 1083 bp, Artificial Sequence
  Description of Artificial Sequence: Synthetic coding sequence
atgcttcggcgacatatggagttccgcaaacagcaggatcttgacaatatagtcacctggcagcccccagaggttattcaactgtatgactctggcggtctgtgcgggtacgattatgaaggctgccctgtatattttaacatcatagggtctctcgatcccaaaggcctgctgctttctgcctccaagcaagacatgatccgtaagcggattaaagtgtgtgagctcctgctgcatgaatgcgagttgcaaacacagaaattaggcaggaagattgagatggctttaatggtattcgatatggaaggcctctcactcaagcatctatggaagcccgctgtcgaggtttaccaacagttttttagcatccttgaggccaactacccagaaactcttaagaatttgattgtaatccgcgctcctaaacttttccccgttgccttcaacctggtgaagtccttcatgagcgaagaaacacgcagaaaaatcgtgatcttgggagataattggaagcaggagcttacaaagttcatttcacccgatcagctgccagtcgaatttggcggaaccatgacggatcccgacggtaaccctaaatgcttgactaagattaactacggtggcgaggtgcccaagtcttattatctatgcgaacaagttcgactgcagtacgaacatacacgcagtgtcggaagggggagcagcttacaggttgagaatgagattctgtttccagggtgcgtcctccgctggcagtttgcctccgacggcggagatataggattcggcgtatttctcaagacaaagatgggagagcagcagtcagctcgagagatgaccgaggtactgccttcacagagatacaatgcacacatggtgcccgaggatgggtctctgacatgtctccaggctggcgtgtacgtaagaggactctgctctctgatcacctctcccagcttgcagatgagctgcgctagcaccacccccactgcaggctgcatgcctcgttccagtgcaaccctgtggcggtgttgttttcctacgcgtcccttgaggcggaggtgcagggtgtctcggagatag

SEQ ID NO: 239758 - DNA, 1176 bp, Artificial Sequence
  Description of Artificial Sequence: Synthetic coding sequence
atgttgatgaccacttctagctgcgcgggttgtgaactggaaaccctcacttgccggaatcctaagacctgctccgaggggcctaagagccctcagcctaccagctgcccacatgcactgcgtgcatggcacatggaattccggaaacaacaggaccttgataatattgtgacatggcaaccacccgaggtcattcaactttacgactctggaggtctctgcggctatgattacgagggatgccctgtctattttaacattatcgggagtctggaccctaagggtctcttattgagtgcatccaagcaggatatgatacggaagcggattaaagtctgcgagctgctgttgcacgaatgcgagctacaaacacagaagttgggacgtaaaatcgaaatggctctgatggtgtttgacatggagggcctctcgctgaaacatctctggaagcctgcagtggaggtctatcagcagttcttctccatcctggaagcgaactatccagaaaccctgaaaaacctaatcgtgattcgagcacccaaactgttcccagtggcctttaacctggtaaagtccttcatgtctgaggagaccaggcggaagatcgtcatcctcggcgacaattggaaacaagaactgaccaagttcatatcccccgaccagctgcccgtcgagtttgggggtacaatgaccgatcccgacgggaatcctaagtgccttacaaaaattaattatgggggtgaggtccccaagtcgtactacctgtgtgaacaggtcaggctacagtatgagcacaccaggagtgttggacgcggatcaagtctgcaggtggagaacgaaatcttgtttcccggttgcgtgctgagatggcagtttgcttccgacggcggagatataggttttggggtatttctaaaaaccaaaatgggtgagcagcagtctgctagagaaatgaccgaggtgcttccttcacagcggtacaacgctcacatggtgcctgaagacgggtccttaacatgtttgcaggccggtgtatacgtgttacggttcgataatacttacagtaggatgcacgctaagaagttatcttataccgtggaggttcttctgccagataaggcgtcagaagagactttgcagagtctaaaggctatgaggcctagccctacacaatag

SEQ ID NO: 239759 - DNA, 2256 bp, Artificial Sequence
  Description of Artificial Sequence: Synthetic coding sequence
cccgcagcagccgcatcaagtctagaacgggagacggaaagattcagggaactcctgctgtacgggaggaaaaaagacgccctagagagtgccatgaaaaacggactttggggtcacgccctgttactggcttctaagatggatagcaggactcatgcccgtgtgatgacacgcttcgctaactcactgccaatcaacgacccattgcagacagtataccagttaatgagcgggcgaatgccagctgcatccacatgctgtggagacgaaaaatggggtgattggcgccctcaccttgccatggttctcagcaatctgaataacaatatggatgtggaaagccggaccatggccaccatgggcgataccctcgcatctaggggcctgttggacgccgctcacttctgctacctgatggcccaggcaggctttggcgtttacaccaaaaaaactacaaaactggttctgatcggtagcaatcattccctcccctttcttaaattcgctaccaatgaggccatccaaagaacggaagcgtacgaatatgctcaaagcctcggagctgagacctgcccattgccgtcctttcaggtctttaagttcatttactcctgtaggcttgctgaaatgggcctggccactcaggcatttcattactgtgaggccatcgcgaagagcatcctgactcagccacacctctatagtcctgtgctcatctcccagctcgtgcagatggcaagtcagctgagactgtttgatccccagctcaaggaaaagccagaagaggaatcactcgccgctcctacctggctggtccaccttcaacaggtcgagcgccagataaaggaaggcgctggcgtgtggcaccaggatggtgcactgccccagcaatgtccaggaaccccctcctctgaaatggaacagctcgacagacccggactgagccaacctggtgcactgggaatcgccaatcccctattggctgtcccagctccttctccagaacactccagcccctctgtgcgccttttacctagtgccccacagacccttcctgacgggcctctggcatctccagccagagtaccaatgttccccgtacccctgccacccggacccctggagcccggacctggatgcgtcacccctggacccgctctgggcttcctcgagccctccggacccggtctgccacctggcgtgccccctctacaagaaagaagacacctgcttcaggaagctcgctctcccgatccaggaatcgtcccacaggaggcgcctgtgggaaactctctgagtgaactctccgaggagaatttcgacggtaaatttgcaaatctaacccccagtcggaccgtgcccgactcagaggcgccacccggatgggaccgcgcagactccgggccaacgcagccccctttatcactctcaccagcgcctgaaacaaagagacccggacaggctgcaaaaaaagaaacaaaggagcccaaaaagggtgagtcctggttctttcgatggttaccagggaagaagaaaacagaggcatacctgcccgacgacaaaaacaaaagcatcgtgtgggacgaaaaaaagaaccagtgggttaatctgaacgaacccgaggaagaaaagaaagctccaccaccccctcctacttccatgccaaaaacagttcaggcagcacctcctgctttgccgggaccaccaggcgctcctgttaacatgtattccagacgagccgctggcacacgagccagatacgtggatgtcttgaacccgtccggaacgcaacgttccgagcccgctttggcaccagccgactttgtggctccccttgccccactgccgatcccgagcaacctgtttgttcccaccccagatgcagaagaacctcagttgcccgacggcacgggacgggaggggccagccgctgcaaggggattggctaatccagaaccagccccagagcctaaagtgctatcgtctgcggcttccctgccaggcagcgagctcccaagttcacgacctgaaggatcccagggaggggagctgtccagatgctccagtatgtcaagtctgtcgcgcgaggtgtcacaacatttcaaccaggcaccaggggacttgcccgctgctgggggaccaccctcaggcgctatgcccttttacaaccctgcacagttagcccaagcatgtgctacgagcggaagcagcaggctagggcgaattggacagaggaaacatctggtgttaaattag

SEQ ID NO: 239760 - DNA, 6480 bp, Artificial Sequence
  Description of Artificial Sequence: Synthetic coding sequence
atgcccggactggacagacctctgtctcgccagaatccccatgacggcgtagttacaccagctgcatctccgagtctccctcagcctggcttgcagatgccgggacagtggggacccgtccaggggggtcctcagccatccggccagcatagaagcccctgtcccgagggccctgtgccatcgggcgtaccatgtgctacgtcggtgccgcatttccctacccccagtatcctgcatcaggggcctggtcatgagcagcattccccactggtggcacccccagccgcactaccatccgacggaagagacgaagtctcgcatctacagagcggaagtcatctcgcaaacaattctgaccctgaaagcacttttagacaaaaccccaggatcgtgaatcactgggcatctccagagctgaggcagaacccgggtgtgaagaatgaacatcggcctgccagtgccctggtcaatcctctggcgagaggggatagccccgaaaatcgaacacatcatcctctgggggctggggctggatctggctgtgcccctctcgaagccgattctggagctagcggagcgcttgccatgtttttccaagggggagagacggagaatgaagagaacctcagcagcgagaaagcaggactctccggccaggccgattttgatgacttttgcagtagtccaggcctcggacgaccacccgctccaacacatgttggggctgggtccctatgtcaagccttgttacccggtcccagtaatgaggccgcaggagacgtatggggcgacacggctagtacaggagtgccggacgcctctggttctcagtatgagaacgtagagaatctagaatttgtccagaatcaggaagtgcttcccagcgagccacttaatcttgatccctcctctccttccgatcagtttcggtatggccctctacccggacctgcagttccgagacatggcgctgtatgtcacactggtgcccctgatgcaaccttgcacacagtgcaccccgactcggtgtcaagcagttacagttcgagaagccatgggcgactatctggctcagctcgcccacaggagttggtgggaacctttattcagcaagaggttgggaagcccgaggatgaagcatcaggtagcttcttcaaacaaatagactcctctccagtaggaggtgagacagatgaaacaaccgtatctcagaattatcgtgggtccgtgtcacagcccagtacgcctagcccgccaaaacccacggggatcttccagactagtgctaactcgtcgttcgagcctgtaaaaagccatctcgtgggtgttaaacccttcgaagctgatcgcgctaatgtggttggggaagtgcgggagacatgcgtgcgccaaaagcagtgccgcccagctgctgcgctgcccgacgcctctccagggaatttggaacagcccccagataacatggagacattgtgtgccccacaggtgtgccccctccctctcaatagcactactgaggccgtacacatgctgccccatgcaggagcgccaccacttgacacggtctaccctgcccctgagaagcgcccatcagccagaacacaggggccagtcaaatgcgagtctcccgcaaccaccctgtgggctcagtctgaactgcctgactttggtggcaatgtgctgcttgccccagcggctccagctttatatgtgtgtgctaagccccaacccccagtagtgcaaccgcctgaggaggctatgtccggccaacagagtaggaaccccagcagcgccgcacccgtgcagtcaagaggagggatcggtgcatccgagaacctggagaaccctcccaagatgggagaagaagaagcccttcagtcacaggctagctccgggtatgcgtcgctgctaagttctcccccaaccgagagccttcagaatcctccggtcttgattgcccagccagatcactcttacaaccttgcgcagcctattaacttttccgtgagcttatccaacagccacgaaaaaaaccagtcctggcgtgaggcactggtcggtgaccgtcctgctgtctcttcctgggctttaggaggggattcaggagaaaacacctctcttagcgggattccaacctcatctgtgctcagcttaagcctgccttcctccgtggcccagtctaactttcctcagggctccggagcatccgagatggttagcaatcagcccgctaacctgctggtgcagcctcccagccagccagtgcccgaaaacttagtgccagagtcccaaaaagataggaaggccggatccgccctccctggcttcgcaaactcgccagcgggatccacaagcgttgttttggtgccccctgctcacggaaccctggtccccgacggaaataaggccaaccactcaagccatcaagaagacacttacggcgcacttgattttacactgagtaggacgctggagaatcctgttaatgtttataacccgtcccattcagatagcctcgccagccagcagtccgtggcctctcacccacggcagagcggtcctggcgcacctaacctcgaccggttttaccagcaggtgacaaaggacgctcagggccagccaggactcgagcgggcacaacaggagctcgtgccaccacaacaacaggcaagcccgccacagcttcccaaggccatgttctccgagctgagtaacccagagtctctgccagcacagggacaggctcaaaacagtgcccaaagtccagcctcattggttctagtagatgcagggcaacagttgcctcccagaccgcctcagagctccagcgtttctctggtgtcttccgggtcaggacaggctgcagtgcccagcgaacagccctggccgcagcccgtccccgcactcgccccaggaccaccacctcaggaccttgccgcttattattactacagaccgctttacgacgcctaccagccacagtattcactgccctaccccccagagccaggagccgcaagcttgtattatcaagacgtgtattcactttacgagcctcgatacagaccctacgatggcgcagcgagcgcatacgcgcagaactacagataccccgaacccgaacgcccttcttctcgggcatctcactccagcgaacggcctccaccaaggcagggttacccggaagggtactacagttcgaaatccggatggtcctcgcagtctgactactatgcctcatattatagtagccagtacgattatggagatccaggacactgggacaggtaccattacagtgccagggtcagggacccccgaacctacgaccgtcgttactggtgtgatgccgagtatgatgcctaccgccgagaacactcagcatttggcgacagacccgagaagagggataacaattggagatatgaccccaggttcacagggagttttgacgacgatccagatcctcaccgcgacccctatggcgaggaggtcgatagaagatccgtccactcagagcattcagcccgatcactccacagcgcccactcactggcttctagaagatcatccctgtcatctcatagccaccagagccagatttacaggtcacataatgtggccgcaggcagctacgaggcaccactgcccccaggcagcttccatggcgactttgcctacggaacttacaggtcaaatttttcctccggccctggcttcccggaatacggctatccagcagataccgtgtggccggcaatggaacaggtcagttcacgcccaacttctcccgagaagttctcagtaccacacgtgtgcgctcgctttggccctggcggacagctgataaaggtcataccaaacttgccatccgaaggtcagccagccctcgttgaggtccacagcatggaagccctgctccagcatacatcagagcaggaagagatgagagcctttccaggccctttagctaaggacgatacccacaaagtcgatgtgattaatttcgcacagaacaaagctatgaagtgcttgcagaatgagaatttgattgacaaagaatctgcatctttactatggaacttcatagtgcttctgtgtcggcaaaatggcactgtggtgggcacagatatcgccgagctgctgttaagagatcacagaactgtttggttacccggtaagagtcctaatgaggccaacctgatcgatttcacaaatgaagctgttgaacaggtggaagaggaagaaagtggtgaggcacagctgtcatttttaacaggcggtcctgccgctgcggcttcctccttagagcgggaaactgaaaggttccgagaactgctattgtacggccgaaaaaaagacgctctggaatccgctatgaaaaatggtctgtggggacatgcactgctgcttgcctctaagatggactcccgcacacacgcaagggtcatgacgaggtttgctaattccctgcccataaacgacccacttcagacagtgtaccaactcatgtctggcaggatgccagctgccagcacctgttgcggcgacgagaagtggggggactggaggccacatcttgccatggtgctgtctaatctcaacaataacatggacgtcgagtccagaactatggcgacaatgggcgacactctggctagccgtggcttgcttgatgccgcacatttctgctacctcatggcccaggccggttttggtgtgtacacgaaaaaaactaccaagctcgtattgatcggctctaatcacagcctgccctttctcaaattcgccacaaatgaagccattcagcgtaccgaggcctatgaatacgcccagagcctaggcgcagagacttgtcccttgcctagttttcaggtttttaagtttatttacagctgccgccttgccgaaatgggccttgccacccaggccttccattattgtgaggccattgcgaagagcatcctaactcaacctcacctgtattcacccgttcttatctcccagttggtccagatggcctctcagctgcgtctgtttgatcctcagcttaaggaaaaacctgaggaggagtcactggccgcacccacttggttggtgcatctgcaacaggtagagcgacagatcaaggagggcgctggagtgtggcaccaggatggggctctgcctcaacagtgtcccggaaccccctccagcgagatggagcagttggatcgtcccggtctgagccaacccggagcactggggatagccaaccctcttctggcagttcctgcgccatctcccgagcactcttcacctagtgtgcgtctcctgccttcagctccccaaaccctcccagacggccctctggcatcgccagcaagagttccaatgtttccagtgccactgccaccaggtccattagagccgggacctggatgcgtgaccccagggcctgcgctcggcttcttggagccttctgggcctgggctccctccaggcgtaccacccctacaagagcggaggcatcttctacaggaggctcgaagtccggatccaggcatcgtccctcaggaagcccctgttgggaacagcctcagtgaactgtccgaggaaaactttgacggtaagttcgccaacttgacaccgtccagaacagtgcccgatagcgaggctcctcctgggtgggaccgagcagattccggacccacacagcctcctctctctctgagccctgcccctgaaaccaaacgccctggacaggcagctaagaaggaaacgaaagaaccgaagaagggcgaaagctggttctttagatggctcccagggaagaaaaagactgaggcgtacttgcccgacgacaagaacaagagcatcgtatgggacgagaaaaaaaaccagtgggttaacctaaacgagcccgaggaagagaaaaaagctccacctcctccccctactagtatgcccaaaacagtgcaggccgcaccccctgccctcccgggtcccccaggagctccagtgaatatgtacagcagacgcgctgcaggaacacgggctcgttatgtggacgtccttaatccaagcggaacacaaagatccgaacctgcacttgcacccgctgacttcgttgctcccctggcccctcttccaattcctagcaacctgtttgtgcccactcccgacgcggaggagccgcaacttcctgatggcacagggagggaaggtcctgctgccgcacgtggcctggcgaatcccgaaccagccccagaacccaaagtgttgagttccgctgcctccttgccagggagtgagttaccatcctcccgccctgaaggttctcagggtggggaggccccaggagatcttcctgcagctggaggtcccccttcaggagcaatgcccttttataacccggcacagctggcgcaggcttgtgcaacttccgggagctctagactaggaaggattggtcaacgcaaacacctggttttgaactaa

SEQ ID NO: 239761 - DNA, 7074 bp, Artificial Sequence
  Description of Artificial Sequence: Synthetic coding sequence
atgcaaccaccgcctcagaccgtaccgagcgggatggccggaccgcctcccgctggtaatccgaggtccgtattttgggcctcttccccgtatcggaggcgggcaaacaacaatgccgcagtcgctcctactacctgtccactgcagccagtcaccgaccccttcgcattttctaggcaggcacttcagtcaacacccctgggatcttccagcaagagttctcctccagtgctgcaagggcctgctcccgcaggcttcagccagcaccctggcttacttgtgccacatactcacgcacgcgacagctctcagggcccttgcgagccactgcccggacctctgacgcaacccagagctcacgcttctcccttcagcggagcgttgacgccaagcgcccctcccggtccagaaatgaaccgctccgctgaggtgggtccctcgtcggagcctgaagtccagacgctgccatatctgccgcactatattccgggagttgacccagagacctcacacggtggacacccacatggaaacatgcccggactggatcggccattgtctcggcagaatcctcatgatggcgtcgtcacccccgctgcgagtccaagtctgcctcagcccggactccagatgcctggacaatggggcccagtgcaggggggaccacaaccatccggccagcaccgaagcccttgtcccgagggccctgtgccaagcggtgtgccctgtgccaccagcgtcccccatttcccaaccccctctatcctgcatcaggggccaggtcacgaacaacattcacctctagttgcccctccagccgcactgccttcagatggccgtgacgaagtctctcatcttcagagtggcagccatctggcaaacaactcagaccctgaaagtacatttcggcagaacccccgtatcgtgaatcattgggcgtcacctgagctgcggcagaatcccggagtgaagaatgagcaccgacctgcgtctgccctggtaaaccctctggccaggggtgatagtcctgagaacaggacccaccacccactcggagcgggagccggttccggctgcgcaccgctggaagctgatagcggggcatctggcgctctggctatgttctttcaggggggtgagacagaaaacgaggaaaacctgtcgagcgaaaaagcaggactctccggccaggcagactttgacgatttttgtagttcacccggactggggcgacctcccgctcccacccatgttggggctggctccctgtgtcaggctctcctgcccggtccgagtaatgaagccgcaggcgacgtttggggggatacagcctccaccggagtgccagatgccagtggtagtcagtacgagaatgtcgagaacctagaattcgtccagaatcaggaggtgctaccttcagagcctctcaatctcgacccctcgtccccgtccgatcaattccgctatggccctcttcctggacctgccgtcccgaggcacggggcagtatgccatacaggagccccagacgctacacttcatactgtgcacccagacagcgtatcatcctcgtattctagcaggtcgcacggaaggctctctggatcggctcgtccacaggaactggtcggcacattcatccaacaggaggttggcaagcccgaggatgaagccagcggctctttctttaagcaaatcgactcaagcccggtggggggagagaccgacgagacaacagtgagtcaaaattaccgcggatcggtttctcagccttccaccccgagcccacccaagcccaccggcatttttcagaccagtgctaatagctcgttcgagccggtaaaaagccatctcgtcggcgtaaaaccattcgaagcagatagggctaatgttgtgggcgaagtaagggagacctgcgtgcgccagaaacaatgcagaccagcagccgcactacccgatgccagtcctggaaacctggagcagcctccagataacatggagacattatgcgcgcctcaagtgtgtcctttacccctgaatagtactactgaagcggtgcacatgctccctcatgctggggcaccccctctggacactgtatatcctgcccctgaaaagaggccgagcgccaggactcagggcccagtcaagtgtgaatcgccagctaccaccttgtgggcccagtcagaactcccagacttcggtggaaatgtcctgcttgcccctgctgcaccagcactctatgtgtgtgctaagccccaaccccctgtggtgcagcctccagaagaggcgatgtctgggcagcagagcagaaacccttccagtgcagcacccgtgcaaagccgcggagggatcggagccagtgaaaatctggagaaccctccaaagatgggagaggaggaagccctgcagagtcaagcctcaagcggttacgcatcactgctctcttcacctccaaccgagtcgctacagaaccctccagtgctgattgcccagcccgatcactcatataatctggcccaacctatcaatttcagcgtgagcctctcaaacagtcacgagaaaaatcaatcgtggcgagaagccctggtcggcgacagacccgcagtgtcatcatgggccttaggcggagactcaggggaaaatacatctctgtcgggcattcccacatcatctgtactcagtctgtcgttgcctagcagcgtagcccagagcaacttcccacagggctccggagcgtctgagatggtttctaaccaaccagctaacttactcgtccaacctccttcacagccggtccccgagaatcttgtgccagaatcccagaaggatagaaaggccggtagtgcgctgcccggatttgcaaatagccccgctgggagcacttccgtggtgctcgtgcccccagcacatggtaccctcgtgcctgacggcaacaaagccaatcattcttcacatcaggaggacacctacggcgcacttgactttaccctgagtagaactttggaaaatcccgtcaacgtatataatcccagccattctgactcgctcgccagccaacagtctgtggcctctcacccgagacaaagcgggcctggagcacctaatttggacaggttttaccagcaggttacaaaggacgcccagggccagcccggtctggagcgcgcacaacaggaactggtcccgcctcagcaacaggcaagccctccgcagcttcctaaagccatgttttcggaactgtcaaatcccgaatcccttcctgcccagggccaggcacagaatagtgctcagtctcctgcatcactcgtacttgtcgatgccggtcagcagcttcccccacgacctccacagagctcgtccgtctccctggtctcgagtggctcagggcaggccgctgtgccatcagaacagccctggccccagcctgtcccggctcttgcacccggtcctccaccacaggatcttgcagcgtattactattatcggcctttgtacgatgcctatcaaccgcagtacagtttgccttaccctccggagccaggcgcagcttccctctactaccaagacgtttatagtctatatgagccacggtacagaccatacgatggcgctgcttccgcatatgcccagaattaccgatatcccgagccagagagacctagttcgagagcttcccactcctctgagcgcccacccccacgccagggttacccagaaggttactatagtagcaaatccggttggtcctcacaaagtgattattatgcttcatactactctagccagtatgactacggcgaccctggccactgggaccgctaccactatagcgctcgggtcagggatcctcggacgtatgatagacgctattggtgtgatgcggagtacgatgcttatcgaagagaacactccgccttcggggatcgtcccgagaagcgggacaacaattggcgctatgacccaaggtttaccggcagcttcgatgacgaccccgatccccatcgcgatccatatggtgaggaagttgaccgccgttcggtgcatagtgaacattctgccaggtctctgcattctgctcatagcctggccagtagaagatcatccttgtcaagccactctcatcagagccagatttaccgctcacacaatgtagccgcaggttcatacgaggctccactgcctccgggttcatttcacggagacttcgcttacggcacgtatcgctcaaatttcagcagcggtccagggttccctgaatatgggtaccccgctgacactgtttggccagcgatggaacaggtctcgtccaggcctacttctcccgagaagttttctgtgcctcacgtgtgtgccaggttcgggcctgggggtcaactgattaaggtcattccaaatctgcctagtgagggccagccagccctcgttgaagtacattccatggaagcacttctccagcacaccagcgaacaggaagaaatgcgcgctttccccggaccacttgcaaaggacgacacccacaaagtggatgtgattaactttgctcagaacaaggcaatgaaatgcctgcaaaatgagaacctgatagacaaggagtcagcatctctcctgtggaattttattgtcctcctctgccgacagaacggaacagtggtgggcaccgacatcgctgagttattgcttcgcgaccaccggaccgtatggttgccgggtaagtctcctaacgaagctaacctaatcgacttcaccaatgaggccgtcgagcaggtggaggaggaagagtcgggggaggcccagctttccttcttgacaggcggacccgctgctgctgcgagttcgctggaaagagagactgagcgctttcgcgaactgctgctgtatgggaggaaaaaggacgctctcgagtcggccatgaagaatggtctgtggggtcatgccctcctcctggcaagtaagatggacagtaggacccacgccagggttatgaccagatttgccaattctctccctatcaatgaccccttgcaaaccgtgtaccagctgatgtcaggcagaatgcccgcagcaagcacttgctgtggagacgaaaaatggggcgattggcgtccacatcttgctatggtcttgtctaacctgaataacaatatggacgttgaaagccgtacaatggctacgatgggcgacacactggccagcagaggcctgcttgacgccgcacacttttgttaccttatggctcaggccggattcggtgtttataccaaaaaaaccaccaaactggtgctaatcggttcaaatcattcactccctttcctcaagttcgctaccaacgaggccatccagagaacggaagcttatgagtacgctcagtctcttggagctgaaacatgtcctcttccctccttccaggtatttaagttcatctactcctgtcggctagctgaaatgggccttgctactcaggccttccactactgcgaggccatcgcaaagagcatactcacacagcctcatctctattcacccgtgctaattagccagctcgtgcagatggcatcccaactccgccttttcgaccctcagttaaaggaaaaaccggaggaggaaagtttggcggctcccacctggctcgttcacctccagcaagtagagagacagattaaggagggggctggcgtttggcaccaggacggggctctcccacaacagtgtcccggtactccctcctccgagatggagcagctggataggccaggcttgagccaaccaggggctctggggatagccaatccgctgttggccgtgccggctccttcacccgagcacagcagtccgagtgttaggttactacccagtgcaccacagacccttccggacggtcccctggcatctcctgctagagtccctatgttccccgtgcctctgccccctggcccactggaaccaggaccaggctgtgttactcctggtcctgcacttggctttcttgaaccttcaggtcccggtctaccccctggtgtgccgcctttacaggaacgacggcacctcttacaggaagcgagatccccggaccccggtattgtcccccaagaagcccctgtgggtaacagcctgtctgagctttctgaagagaacttcgacggaaagttcgctaacctgacaccttcccgaacagtaccagacagcgaagccccacctgggtgggaccgggctgatagcggacctacccagccaccactgtcccttagtccagcccctgaaacaaagaggcctggacaggctgccaaaaaggaaactaaagagcccaagaaaggggagtcatggttcttccgctggctgccaggcaaaaaaaaaacagaggcctatctgcctgatgacaaaaacaaatcaatcgtttgggacgagaaaaagaatcagtgggttaatctgaatgaacctgaagaagagaagaaagctcccccaccccctcctacatccatgccaaagacggtgcaggccgcaccgcctgctcttcccggacccccaggcgctcccgtcaacatgtatagtagacgggcagccggaacccgagcccgatacgtggacgtgctgaacccctccggcactcagaggagtgaacctgcactggccccagccgactttgttgctcctctggcgccactgccgataccatccaacctgttcgtcccaacccctgatgccgaggagccccagcttccagatgggacaggtcgcgagggcccagctgcggcaagagggttggctaatcctgaaccagctcccgaaccgaaggtcctatccagtgccgcatcactccccggtagcgaattaccatccagccgccctgaaggatcacagggaggcgaattaagtaggtgctcgtcaatgagttcactctcgagggaggtctctcaacactttaatcaagcccctggggacctgccagcagcgggaggcccaccttccggggcaatgccgttttacaatcccgctcaactcgcgcaggcttgcgctacaagtggatcatctcggctgggccgtattggtcagcgaaagcatctggttttaaactaa

SEQ ID NO: 239762 - DNA, 1158 bp, Artificial Sequence
  Description of Artificial Sequence: Synthetic coding sequence
atggatctgctgcctacctccattttgcttgcttcactgtggatttgtagccatctccaccctcctggggtgtcggtggatctcccacctacatccatcctccttgtgtccctttggatctgtagtcatcttcacccacccggtgtttcagtggatcggcctcctcccccaagttcttggtgcttgtgcggatccccccctactagcatcctgctcgtcagtctctggatttgctcccctccgccttcgtcctggtgtctctgcggcagcgccccaacaagtattctgctggtctctctgtggatctggcggctttggggcttaaccgaaggagaaagctggttctttcggtggctgcccggaaagaagaaaacagaggcgtatttaccggacgacaaaaataaatcaatcgtgtgggacgagaaaaagaatcagtgggtcaacttgaacgagccagaggaagagaaaaaagcaccacctcctcctccaaccagtatgcctaaaacggtacaggcagcaccacccgcacttccgggaccaccaggagctccagtcaatatgtatagtcgtcgtgccgcaggaacccgcgctcgctacgtggatgtcctgaacccgtctggaacccaacggtcagagcccgctctggctcctgcggatttcgtggcgccactggcacccttgcccattccaagcaatctgtttgtccccaccccagtgtcttctgtccgaccccaaggacgctcgggaaggaacgatggactgctggccctgtcctcaccggatgctgaggaaccccagctgccagatggcaccgggcgtgagggtcctgccgcagctcgcggtctggccaaccccgagccagctccggagccaaaggttctgtcatccgctgcatctctgcctggctctgagctgcctagcagcagacctgaaggcagtcaggggggagagctgagccgctgttcatcgatgagtagtctgtcacgcgaggtctcgcagcactttaaccaagccccaggcgacctgcccgctgcaggtggcccaccgagcggcgcaatgccgttttacaatcccgcacagctagcccaggcttgtgccacttcaggatcatccagactggggagaattggccagagaaagcacttggtactgaactag

SEQ ID NO: 239763 - DNA, 6404 bp, Artificial Sequence
  Description of Artificial Sequence: Synthetic coding sequence
atgccgggtctggaccgcccactatccaggcaaaacccgcatgacggggttgtaactccagccgctagcccttcgttgccccagccaggactgcagatgcctgggcagtggggtccagtgcagggcggtcctcagcccagcggacagcatcgcagcccgtgccctgaggggcctgtgccgtcaggagtgccttgcgcgacatccgtgccgcatttcccgactccgtccattttacaccagggacccggtcacgagcagcacagtcccttggttgccccacccgcagccctgccgtctgacgggagagacgaggtctctcatctgcagtctgggtctcaccttgccaataacagtgatccagaatcgactttccgccagaatccaaggatagttaatcattgggcttcacctgaactgcggcagaacccaggtgtaaagaacgagcatagaccagctagcgctctcgtgaatccgctcgccagaggcgattccccagagaatagaacgcatcatcctcttggggcaggcgctgggagtggatgtgctccgcttgaggccgactctggtgcatccggtgctttggctatgttcttccaggggggagagactgagaacgaagaaaatctctcgtctgaaaaggctggattaagcggccaggcagacttcgacgacttctgcagcagcccaggtcttggacgaccccctgcacctacccatgtcggagccggatcactgtgccaggccttgctaccgggtccatccaatgaggcggctggtgatgtgtggggggacacagccagcactggggtcccagatgcctcgggtagtcaatatgagaacgtggaaaacctggaattcgtccagaaccaggaggtattaccatctgagccacttaacctcgatccctccagtccctctgaccagtttcgctacggacctcttccagggcctgctgtgcctagacatggcgctgtatgccataccggcgcaccagacgctaccctgcataccgttcatcccgattcagtgtcttcatcttattccagtaggagccacgggcgtctcagtgggtccgcacggcctcaagagttggtcggtacctttattcaacaggaggtgggaaaaccggaggacgaagcttctggaagcttctttaagcagatagattccagccctgtgggaggcgagacagacgaaaccactgtgagccagaattatcgaggctctgtgtcgcaaccctcgactccaagtccccctaagcccaccggtatattccagacatctgcaaactcatcattcgaaccagttaaatcccatctggtaggagtcaaaccttttgaagcagacagggcaaatgtggtgggggaggtacgtgagacatgtgtgagacagaagcagtgtagacccgcagccgcactccccgacgcttctcccggaaatttggagcagccccctgacaacatggagactctgtgtgcccctcaggtctgcccgcttccattgaactcaaccacagaggctgtccacatgctgcctcatgccggagccccacctcttgataccgtgtatcccgcacccgagaaacgccctagtgctcgcacgcagggaccggtcaagtgcgaatcccctgctacgactctgtgggcacagagtgagttgcccgatttcggagggaacgttctgttggctcccgcagcccctgcactgtacgtgtgcgccaagccccagcctcctgttgtccagcctcctgaagaggccatgagtggtcagcagagtcgtaacccaagttccgctgccccagtgcagtccaggggaggtatcggggcttcggaaaatctggaaaatccaccgaagatgggagaagaggaggctttacagtcacaggcttccagcggctatgcttctctgctttcttcaccacccactgaatcattacaaaatccccctgtgcttatagctcagcccgaccattcttacaacctggctcaaccaataaacttctctgtctctctaagtaactctcatgaaaaaaatcagtcgtggcgggaggcactggtaggggaccggccagctgtttctagctgggccctcggcggagatagcggggaaaacacgtccctgtccggaattccaacatcatccgtgctctctctaagtttaccaagcagcgtggcacaatctaacttcccacagggatctggggctagtgaaatggtgtcaaaccagcccgctaacctgttagtgcaacccccatcacaaccggtgcccgaaaacttagtgcctgagtcccaaaaagatagaaaggcgggaagtgcgctgcccggatttgcaaactctcccgctggttccacctccgtggtgctcgtgccgcctgcacacgggactctggtgcctgacgggaataaggccaaccacagttcacaccaggaagacacgtacggagccttggattttacgctgtcccgaacgttagaaaatccagtgaatgtgtacaaccctagccactccgatagtctggcctcacagcagagcgtggcttctcatccgaggcagtcaggccctggtgccccaaaccttgacagattttaccagcaagtaactaaggatgcccaaggccaacctgggctggaacgcgcacaacaggagttggtgccacctcaacagcaagcttcccctccgcagctcccaaaggccatgttctcagaattgagcaacccggaaagccttccggctcagggccaggcccagaatagcgcgcaaagccccgcaagcctggtattggttgacgccggacagcagttgccgcctagaccgccacagagtagtagcgtctcactcgtcagctccggatcaggccaagcagctgttccttccgaacagccatggccccaaccagtgcccgcactagcccctggaccccctccccaggatttagcagcttattattattacagacccctgtacgacgcataccaaccccagtacagcttgccttacccgccagagccaggggctgcctctctttactaccaagatgtgtactcactatacgaacccagatatcgcccatatgatggcgctgcctctgcttacgctcagaactacagatatcccgaaccagaaaggccctcctcgcgcgcttctcatagttcagagaggccaccgcctagacaaggataccccgagggatactacagttcaaagagcggctggtcttcacagtcggattattatgctagctactattcttcccagtacgactatggcgacccaggccattgggataggtaccattatagtgctcgtgtcagagacccacggacctacgaccgccgatactggtgcgacgccgagtacgatgcatacagacgagagcactcggctttcggagaccgccctgagaaaagggacaataactggcgttatgaccccagattcacaggaagctttgacgatgatcccgatccccaccgcgatccttacggcgaagaggttgaccggcgatctgtgcattcggagcattcggctcgctccctccacagtgcgcacagcctagcttctagacgcagtagtctttcatcacatagtcaccagtctcaaatctaccgcagtcataatgtagctgccggttcatacgaggccccattaccacctggttcatttcacggcgacttcgcctatggaacttatcgatcaaacttctcctctggcccagggttcccggaatatggctaccccgcagacacagtttggcctgccatggagcaagtgtccagtagacccaccagcccagaaaagtttagcgtcccccacgtgtgcgccaggttcggacccggtggtcaattgataaaagtcatccccaacttaccctcggaagggcagcccgctctggtagaagtgcactctatggaggccctcttacagcacacgtccgagcaggaagagatgcgcgctttcccaggtccgcttgctaaagatgacacacataaggtagacgtcattaactttgcgcaaaacaaagccatgaagtgccttcagaacgaaaatttgattgacaaggaatccgcaagtcttttatggaattttatcgttctgctttgtcgccaaaacggaacagtggttgggactgatattgccgagctgctcttaagggaccatagaacagtctggttacctggcaagtctccgaatgaagccaacttgatagattttacaaatgaggccgtggaacaagtcgaagaagaggagtccggtgaggctcagctctcattcctgactggcggtccagccgctgcggcatcatctctggaaagagagaccgagagatttcgagaactgctcctctacggccgaaagaaggatgcattagaatcagccatgaagaatgggttatggggccacgcactgctgctagcatctaaaatggattcccggacccacgccagggtaatgacacgttttgcaaacagccttcctatcaatgaccctctccagacagtgtatcagctaatgagtggtcgtatgccagccgcttccacttgttgtggggatgaaaagtggggtgattggaggcctcatctggccatggtgctatccaacctcaataacaacatggatgtggagtctaggaccatggccactatgggggatactctggcctcgcgcggattattagatgcagcccacttctgttacttaatggcccaagcagggttcggggtgtatacaaagaagaccacgaaactggttctgataggctctaaccattccctgccatttttgaagtttgcgacaaatgaagccattcagagaaccgaggcatatgaatacgcccagtccctcggagctgaaacatgccctctcccttcattccaggtgttcaaattcatttattcttgtaggctggcagagatgggccttgcaacccaggcatttcattattgcgaggccattgcaaaatctattctgacccagccacacttgtatagtcctgtcctgatctctcagctggtccagatggcgtctcagctcagattgttcgacccacagctgaaagagaagcctgaggaagagtcattggctgctcccacatggctggtgcacctccagcaggtagagcgtcagattaaagaaggcgcaggcgtttggcatcaggatggggcactgccacagcaatgtccgggaactcctagtagcgagatggaacagctggacaggcctgggctctcacagcccggagctctgggtatcgccaatcctctgttagccgtccctgcaccatccccggagcactcttccccctccgttaggcttctgccaagcgctcctcagacgctcccggacgggcctttggcgtctcccgctagagtacccatgttcccagtcccactgccaccaggaccactagagccaggtcctggctgcgtcacaccgggaccggctctgggatttctcgaaccatctggcccaggtctcccaccaggcgttcccccacttcaggaacgcaggcatctgctgcaggaagcaagatcccctgaccccggaatcgtcccccaggaagcccctgtggggaattcactttctgagttatccgaggagaacttcgatgggaagtttgccaacctgactccctcaagaactgttcctgactcagaggccccaccgggttgggacagggctgactctggcccaacccagccacccctttccctgtctcccgctcccgagaccaaaaggccaggccaggcagccaaaaaagagactaaagagcctaagaaaggggaatcatggttctttcgctggctcccgggtaagaaaaagactgaagcttatcttcccgacgacaaaaataagagcatcgtgtgggacgagaaaaagaatcagtgggtcaacctcaacgaacctgaagaggaaaagaaggcgcctccaccccctcctacttccatgcctaaaacagtccaggctgccccacccgctctgcccggaccgccaggggctcccgtcaacatgtatagccgcagggctgccggaactagggccagatacgtcgacgtgctgaatccttctgggacacagcgttccgaacccgcactcgctcccgctgactttgtagcccctttagccccacttcctatccctagtaatttattcgtaccgaccccggacgcagaagagccccaacttccagacggcacagggagggagggacccgcagccgctcgcggactggcaaatcctgagccagcccctgagcctaaggcccctggagacctccctgcagcaggcggacccccatccggagcgatgcctttctataacccggcacagctggcccaagcctgcgcaaccagtggctctagtcgactggggagaatagggcaaagaaagcaccttgtacttaacta

SEQ ID NO: 239764 - DNA, 423 bp, Artificial Sequence
  Description of Artificial Sequence: Synthetic coding sequence
atggacctgctgccgaccagcattctgctcgcttctctttggatatgtagtcacttgcacccacctggcgtgtccgtggatttgccgcctacttccatactactggtctctttgtggatctgctcccacctccacccccctggggtgtctgttgaccgaccaccaccaccctctagctggtgcctttgtggctcacctcccacttccatcctgctggtgagcctttggatctgttctccccctccatcttcatggtgtttgtgtggcagtgcgccaacatccattctgctggtatcactctggatttggagactgtgggggctcaccgaggtcggccacgtggaattcgtgttccttccctggctgatctcatggaacatcatgttcagtaagcttttcagctgctttttgtatctcggatag

SEQ ID NO: 239765 - DNA, 2205 bp, Artificial Sequence
  Description of Artificial Sequence: Synthetic coding sequence
atgttctcagaactcagtaatcctgaatctctgccagcccagggccaagctcagaacagtgcacagtcacctgcaagcctagtcctcgtagacgctgggcaacagttgcctccaagacctcctcagtcatccagcgtgagtttagtttcctccggaagtggccaggcggctgtgcctagcgagcagccatggccgcagccggttcctgcacttgcaccaggcccaccccctcaggatcttgctgcttactattattaccgcccactctacgacgcttaccagccccaatactcactcccttatcccccagaacccggtgccgcttccctgtactaccaggatgtgtactcactttatgaacccagatatagaccctatgatggagcagccagcgcgtatgcccagaactatcgatacccagaaccagagcgcccttcgtccagggctagccactctagcgagagacccccacccagacagggatacccagagggatattactcaagcaaaagtgggtggtcttctcagtcggattattatgccagttattatagctcccagtatgattacggggaccccggtcactgggatcgctaccactactcggccagagtgagagaccccagaacgtacgatcggcgttattggtgcgacgccgagtacgatgcttaccgtcgggaacactctgcgttcggagacaggccagagaaacgagataacaactggcgatacgatccacgctttacaggcagtttcgatgacgatccggatccccaccgcgatccctacggtgaagaggttgatagacggagcgtacactcagagcacagtgctcgctccctgcattcagctcattccctcgcgagccgccgaagtagcttgtcctcccattcccaccagtcccagatatatcggagccacaatgttgcagccggatcctacgaggccccattgccaccaggatccttccatggagactttgcatacggtacctaccgctccaatttctccagtggcccaggcttcccagagtatggctataggccagctctcggttttcttgaaccttctggccctggcctccccccaggtgtgccaccactccaggaaaggagacacctgttgcaggaggcgagatcgccagatccaggtattgtcccacaggaggcccctgtcggtaacagcctcagcgaattaagcgaagagaactttgacggcaaatttgccaatctgactccttcaagaaccgtacccgattccgaggcacctcctgggtgggatcgggcagatagtggccctacgcagcccccactgagtctgtcccccgcaccagagacaaagcggcctggccaggctgcaaaaaaagaaactaaagagcctaagaagggtgaatcctggttctttagatggctccccggaaaaaagaaaacggaagcttatcttcctgatgacaagaataagagtatagtgtgggacgaaaagaaaaatcagtgggttaacctgaacgagcccgaagaggaaaaaaaagcaccgcctccaccccctacttcgatgccgaagactgtccaggcagcacctcccgctctccccggtccccctggtgcaccagtcaatatgtattcccgcagggccgctggaacacgggcacgttacgtggatgtactgaacccaagcggcactcagagatcagagccagccctcgcaccagcagattttgtggcccctttggcgccactgccaattccctctaatcttttcgttcccacgccagtcaggcctcagggacgttccggtcgtaacgacgggctgttagctttgtcctcaccagatgccgaagagccccagctccccgacggaacaggtcgggaagggcctgctgcagccaggggcctggctaacccagagccggctccagagcccaaagttctgtcctcagctgctagtttgcctggttcagagctgccctctagtcgcccagaggggtcacagggcggtgagttatctaggtgcagcagcatgagcagccttagccgcgaggtgtctcaacacttcaaccaggcgccaggagatctccccgctgccggaggacccccatccggggctatgcctttctataatccggctcagctggcacaagcatgcgccacttctggttccagcaggctggggagaattggtcagcgcaaacacctcgtcctgaactag

SEQ ID NO: 239766 - DNA, 5183 bp, Artificial Sequence
  Description of Artificial Sequence: Synthetic coding sequence
atgttctttcaaggaggtgagacagaaaatgaggagaatctgagcagcgagaaggccggactgtcaggacaggctgacttcgatgacttttgtagtagtccagggctgggaaggccaccagccccaacccatgtcggcgctggtagcctctgccaggccttgctgcctggaccaagcaacgaggcagcaggagatgtgtggggagacactgcctcaacgggcgttcctgatgcatctggatcccagtatgaaaatgttgagaatctggagttcgttcaaaatcaggaagtgttgccttccgagcctctcaatctcgatccttcaagcccctcagatcaattcaggtacggccctctgcccggtcccgctgtgccaaggcatggcgctgtgtgtcatactggggcacctgatgcgactttacataccgtgcatccagactcagtgtcctcgagttacagctcacgctctcatggcaggctctccggttctgcccgtccacaggaactggtcggcacctttattcagcaggaggttggcaagccagaagacgaagccagcggttcgtttttcaaacagatcgattctagccccgtggggggagaaacagatgaaacaacagtgtcccaaaattatcggggatcggtctcccagccctcgactccctctccgcctaagcctacgggaatcttccaaacatctgccaattcgtcctttgagcccgtgaagtcacaccttgtgggagtcaagccctttgaggcagatagggccaatgtcgtgggggaggtgcgtgagacttgcgtgcggcagaagcagtgtcgtccagccgcagccctcccggatgcaagccctgggaacctggagcaaccacccgataatatggaaaccctgtgcgcaccgcaggtgtgcccattgccattgaattctactaccgaagccgtgcatatgctgccccatgccggagcaccgcctctggacacagtttatcccgcacctgagaagagaccttcagcccgaacacagggccctgtcaaatgtgagagtccagccacaactctctgggcacagtctgagctccccgatttcgggggaaatgttttgctcgcaccagccgctcccgcactctacgtgtgtgccaaaccccagcctcctgtggttcagcccccagaggaggcaatgagtggacaacagtcaagaaaccctagtagtgctgcacctgtgcagagccgcggtggcatcggtgctagcgagaatctggagaacccccctaagatgggcgaggaagaagcacttcagtctcaggtcacaaaggacgcccagggacagccagggctggagagagcccagcaggagcttgtcccaccacagcaacaggcttcgccccctcaacttcccaaggctatgttttccgagctttcaaacccagagtcattgcctgcacagggtcaggcacagaacagcgcccagagccctgcgagcttggtcttagttgatgctgggcagcagctgcctcccagaccacctcagtccagttcagtgtcacttgttagtagtggctcaggccaggcggcagtgccctctgagcagccttggccacaacctgtccctgcgctggcccctggtcccccacctcaagatcttgctgcatactactattatcgccctctgtatgacgcataccagccacagtactccctgccttatcctcccgaacctggagccgctagcttatattatcaggatgtttactcattgtacgaacccaggtaccgcccatatgacggtgccgcatcagcttacgcacaaaattatagatatccagagcccgagcggccaagctctcgggctagccactcaagcgaacggcctccgccaagacaaggatacccagaaggctactacagttcaaagtccggctggtctagtcaatcagattactacgccagctattattcctcccagtatgactatggtgatccaggacactgggacaggtatcattatagcgccagggtacgagatcctaggacctacgacagacgttactggtgcgacgccgaatacgacgcctatcgaagagagcacagcgcctttggcgaccgacctgagaaacgcgacaataactggagatatgacccgaggttcactgggagttttgatgatgaccccgaccctcacagggacccctacggggaagaagtcgaccggaggagcgtccactccgaacattctgccagatcacttcattccgcacactccctggcctctcgcagatcctctctatcatcccacagtcatcagagtcaaatttatcgttcgcacaatgtcgcagcagggagttacgaagcacccttgcctccaggttcatttcacggggatttcgcttacgggacatatcgctctaatttctcatcagggcctggcttcccagagtacggctatccggctgatactgtgtggccggctatggagcaggtttcctcaaggcctacatctccagagaagttttctgtcccgcatgtctgcgctagattcggtccgggtggacagttgattaaggtgatacccaatctgccaagcgaagggcagccggcattggttgaggtacacagtatggaggctctgctgcagcacaccagtgaacaggaggagatgagagcgttccctggccctctggctaaagatgacacacacaaggtagacgtgataaactttgctcagaataaagctatgaagtgcttgcagaatgaaaatctgatcgataaagaatcagctagtttgctctggaactttattgttctgctgtgcagacagaatggtacagttgtgggaactgacatcgcggagttactgctgagggatcataggactgtgtggttgcccggtaaatcaccaaacgaggccaatcttattgattttacaaatgaagcagtggagcaagtggaggaagaggagagcggcgaggcccagctgagtttcctaacgggcggacccgcagcagcagcttcctcgttggaaagagagaccgagcggttcagagaactcctgttgtacggcaggaaaaaagacgctcttgagtctgccatgaagaatggcctgtggggacatgcccttctgctggccagcaaaatggactcccgcacccacgcacgggtcatgaccaggttcgccaatagcctgcccatcaacgatccactgcagacggtgtaccagctgatgtcgggcaggatgcccgctgcatccacatgctgcggggacgagaagtggggcgattggcgtccgcatctggccatggttttatctaacctgaacaacaatatggacgttgagagtcgaacaatggccactatgggcgacacactggcctctaggggtctgctcgacgccgcacacttctgttacctcatggctcaggctggtttcggcgtttatactaaaaagaccaccaagctggttctcattggaagcaaccactcactgccctttcttaaattcgcgacaaacgaggcaattcagcggacggaggcttatgagtatgcacaaagtctgggagccgagacatgccccctgccatcattccaggtcttcaagttcatatactcctgccgcctggccgagatgggcctggccacccaggcattccactattgcgaggcgatcgctaagtccatcctgacccagccacacctctattcacccgtgctaataagtcagcttgtgcagatggcctcccagttgagactgtttgaccctcagctaaaggagaagcccgaagaggagtcccttgcagcccctacatggctcgtgcacctgcaacaggtggaacggcagattaaggaaggagccggagtgtggcatcaggatggggctttgccccagcagtgtcccggtactccctcctccgaaatggaacagttggatcggcctggtcttagccagcctggcgcactgggcatcgccaacccactgctcgcggttcctgccccaagccctgagcattcctccccctctgtccgcttattgccaagcgcaccccaaacacttcctgacgggccattagcctcaccagcacgggtgcccatgttccctgtgcccctgccccctggcccactcgagcccggtcctgggtgcgtcacccccggaccagctctcggcttcctggagcctagcgggcctggcctccctcccggagtgccacccctccaggagcgaagacacttgttgcaggaagccaggtcgccagatccgggaatcgtgcctcaggaggcccctgtcggaaactctcttagcgaactgtcagaggagaattttgacggcaaatttgccaacctcacaccatctaggaccgtccctgattctgaagcaccacctggatgggatagagccgactctgggccaactcagcccccactatctttgtccccggcacccgaaaccaaaagacccggtcaagcagcgaaaaaagaaacaaaggaacccaagaaaggggagtcatggttcttcagatggctccccggaaaaaaaaagaccgaggcctacctccccgacgacaaaaacaaaagcatcgtatgggatgaaaagaagaatcagtgggtcaatctgaatgaacccgaagaagaaaagaaggccccaccccctcctcctacatcaatgcccaagaccgtgcaggcagcacctcccgcacttccaggcccacctggcgcacccgtgaacatgtactctagaagagctgccggaactcgggcacgctatgtagatgtgttgaatcctagtggaacgcagcgcagtgagcctgcactcgcccctgctgacttcgtggcaccgcttgccccattgcctattccaagtaacctgttcgtgcccaccccagatgcagaagagccccaattgccagacggtactgggagggagggcccagctgccgcaaggggccttgctaaccctgagcccgcaccagaaccaaaagtgctgagctccgctgcgtcactaccagggagtgagctgccctcttcaagacctgagggctctcagggtggcgaggccccaggcgaccttcctgcagccggtggtccgccttcaggagctatgccattttataaccccgctcagcttgcacaggcttgcgccacctctggatcgtccagactcggtcgcattggacagcggaagcatttagtgcttaatta

SEQ ID NO: 239767 - DNA, 6464 bp, Artificial Sequence
  Description of Artificial Sequence: Synthetic coding sequence
atgcccggactcgatagaccactgagtcgccaaaatccccacgatggggtggtgactcccgctgccagcccttctctccctcagccagggctgcagatgcctgggcagtggggcccagtccaggggggaccccagcccagtgggcagcacaggtcaccctgcccagaggggccagtaccctcaggggtgccttgcgccaccagcgtgccccacttccccactccttctattcttcaccaaggcccaggacacgaacaacactctcctctggtggccccacctgccgctttgccctccgatggccgtgatgaggtttcacatcttcaatccggcagccacctggctaacaattcagatcctgagtctacctttagacagaacccccgaatcgtgaaccactgggctagtccggagctgcggcagaacccaggtgtgaagaatgaacaccgtcccgcatcagctctcgtcaatccattggccagaggcgattctcccgagaatagaacacaccatcctctgggggctggggctggaagcggctgcgcccctctggaagctgactctggcgcttccggcgcactagctatgttttttcaaggcggtgaaactgaaaacgaggagaacttgtccagtgaaaaggccggactaagcggacaggcagacttcgacgatttttgtagcagccctggtctggggcgacccccagctcccacccatgtcggagccggaagtctgtgccaagctcttctccctggacccagcaacgaagctgccggagacgtgtggggagatacagcgtcaaccggcgtgccagacgccagtggcagccagtacgagaatgttgagaacctggagtttgttcagaatcaagaagtgttaccatccgagcctctgaatttagacccatcaagccccagcgatcaattccgctacggcccactgcccggaccagccgtccccaggcatggagccgtgtgccatacaggcgcaccggatgcgactcttcacacggttcatcctgactccgtgtcctccagttacagttcacgtagccatgggcgtctgtctggctccgctagaccccaagagctggtgggcacctttattcagcaagaggttggtaaacccgaggacgaggctagcggctccttctttaaacagattgactctagtccagtgggcggagagaccgacgaaaccactgtctcccaaaattaccggggaagtgtgagccaaccttctactccctccccccctaagcccaccgggatcttccaaacaagcgcgaactccagcttcgagccagttaagtcccaccttgtgggagttaagcctttcgaggctgatcgtgctaacgtcgtgggcgaggtccgggaaacatgtgtccgccagaagcaatgccggcctgcggctgctctccccgacgcaagtcccggaaatctggagcagccacctgacaacatggagactctctgtgctccccaggtgtgcccattacccctgaattctacaacagaagctgtgcatatgctgccgcacgcaggggctccaccactcgacaccgtgtatcccgcacccgagaaacggcctagtgccagaactcagggacctgttaagtgcgaaagcccggctactactctgtgggcgcagagtgagctacctgattttggcggaaacgtcttactcgcccctgccgcaccagccttatatgtgtgcgccaaacctcagccacctgtggtgcagccacccgaggaggcgatgagtgggcagcaatccagaaacccatcctctgcagctccagtgcagagtcggggagggataggagccagcgaaaatttagaaaaccccccaaagatgggggaagaggaggccttgcaatcccaggctagctccggctacgccagtctgctgtcatctccacccacagaatcactgcaaaatcctcctgtccttatcgcacagccagaccactcatataatttagcccagcctattaatttttcagtttccctgtccaactctcacgaaaaaaatcagagctggcgggaggccctagtcggagaccgacccgcagtctcatcttgggctctcgggggtgacagcggtgagaacacaagccttagtggaattcccacttcctcagttctgagccttagtctgccttcctccgtggcccagagtaattttccccaaggctctggcgcaagcgaaatggtaagtaatcagccagccaatctgcttgtgcaaccaccctcccagcccgttccagagaatctggtgccagaatctcagaaggatcgcaaagccggaagcgcactaccgggatttgcaaatagccctgccggaagcaccagcgtggtcctcgtgcccccagcacatggcactcttgtgcccgacggaaacaaagccaaccacagcagccaccaggaagatacgtatggagcccttgactttaccctttctcgcactttggagaatccagtcaacgtctacaaccccagccactcagatagtcttgcctctcagcagagcgttgcctctcaccctcgtcagagcggcccaggagcccctaacctggatagattttaccaacaagtgactaaggacgcgcagggacagcccggactggagcgagctcaacaggagctggtaccgcctcaacagcaagctagcccacctcaattaccaaaggccatgtttagtgaactgagtaaccctgaatctctccccgctcagggacaggcacaaaactccgcccagtcccctgcatctttagtcctcgtggacgctgggcagcagctgcccccaaggccccctcagtcttcctcagtctccctggtcagcagcggatctggacaagctgctgtcccaagcgaacagccttggccgcagccagtgcctgccctcgctccgggaccaccgccacaggacctggcagcttattactactatcgccctttgtacgacgcctaccagcctcaatatagcctcccctacccaccagagcccggagcagcctctttgtactaccaggatgtttatagtctgtacgagcccagatatagaccatatgacggagcggcttcagcctacgcccagaattaccgatatccagagccggagagaccgtcgtctcgagcctctcactctagtgagaggccacccccaagacaggggtatcctgaggggtactacagtagcaaatctggctggagtagccagtctgattattatgcctcctactactcgtcgcaatatgattatggtgatccagggcattgggacagatatcactactccgcacgtgttcgggatccacgaacctacgaccggcgttattggtgcgatgccgaatatgacgcctatagacgggagcactctgcattcggcgaccgccctgaaaaacgggataacaattggagatatgaccctagattcactggcagcttcgatgacgatccagatccacacagagatccttacggggaggaagttgatcggcgaagtgtgcactccgagcatagcgctcgttcacttcactcggctcactccctggccagtaggcggtcttctctctcttcacattctcaccaatctcagatctatcgctctcataacgtcgctgctggttcatatgaagcacctctccctcccggtagtttccacggtgacttcgcctatggcacctacaggtctaacttcagctccggaccgggatttcctgagtatggataccctgctgacactgtgtggcctgctatggaacaggtcagtagtagacccacctcaccggagaagttttcagtgcctcacgtatgtgcccgattcggacctggtgggcaacttattaaagttatccccaacctgcctagcgaagggcagccagcgctggtggaagtgcacagtatggaggccctcctccagcatacttcggagcaagaggagatgcgggcatttccgggacccttagctaaagatgatacacacaaggtcgacgtgattaacttcgcacagaataaggccatgaagtgtcttcagaacgagaatcttatcgacaaggaatccgcttccctgctgtggaacttcatcgtactgctgtgccgccaaaatggcaccgttgtggggaccgatattgcagagcttctcctgagagatcatcggaccgtctggttgccagggaagtcccctaatgaagcaaacctaatcgactttacaaacgaagcagtggagcaggttgaggaagaggagtcgggcgaggcacaattgtcatttctgactggtgggccagctgcggctgctagctcccttgagcgagaaaccgagagatttcgagagctcctcctgtacggtcgcaagaaggatgcccttgagagtgctatgaagaacggactgtgggggcacgctctgcttctcgcatctaagatggattccagaactcatgccagagtgatgacaaggttcgctaactctttacccattaatgatcccctgcaaaccgtctaccagctaatgtctggccgtatgcccgcagccagtacatgctgtggtgacgagaaatggggcgactggcgaccccatctggctatggtgctcagtaatctgaacaacaacatggacgtcgaatcacggacaatggctactatgggcgataccctggcgtccagaggcttactcgacgccgcacatttctgctacctgatggcccaggctggctttggcgtttacaccaaaaagactacaaagctcgtcctgattggctctaaccacagcctcccttttctgaaattcgcgaccaatgaggcaatacagaggacagaagcgtatgaatatgcccagagtctcggtgctgaaacctgccccttgccatcattccaggtgttcaagtttatttatagctgtagacttgctgaaatgggcctggcaacacaggcctttcattattgtgaggctatcgctaagtcaattctcacccagccacatctctactcccccgtcttgatatcccagctcgttcagatggcatcccagctgaggctgttcgacccccagctaaaggaaaaaccggaggaggagtctctggccgctccaacctggttggtccacctgcagcaggtcgagcggcagataaaagagggggcaggtgtatggcaccaggacggagctcttccacagcaatgtccaggaacgcccagcagcgagatggaacaattggatcgcccaggcttatcccagcccggtgctctcggaattgcgaatcccctgctggctgttccggcaccaagcccagaacactcttcaccttctgtcaggctgctgccttctgcaccacagactttgcctgacggcccactcgccagtccggcacgggtgccgatgttccctgtgcccctccccccaggccctctggagcctggtcctggctgtgtgacacccggtcccgctcttggatttctagaaccgtccggccctggactaccacccggtgttccacccctgcaggaacgacggcacctgctgcaggaggcacgaagcccagacccaggtatcgtgcctcaagaggcaccagtgggcaacagtctcagcgaactgtctgaggagaattttgatggcaagttcgccaatctcacccccagcagaacggtcccagacagtgaggcacctccaggctgggatcgggcagacagtggcccaactcagccaccgctcagcctgtcaccagcccctgaaaccaagagaccgggacaggctgctaagaaggagaccaaggagcctaagaaaggtgaatcctggttctttcggtggctaccgggtaaaaagaagaccgaagcgtatctgcccgacgacaagaacaagtccatcgtgtgggatgagaaaaagaatcagtgggttaacctcaacgagcccgaggaggagaaaaaggcacctcctccaccccctaccagtatgccgaaaactgttcaagccgctccacctgcgctacccggtccccctggcgctcccgtgaacatgtattctcgccgtgcagccggaaccagagctcgttacgtcgatgtgctaaacccctccggcacccaaaggagcgagccagccctggcacccgcagattttgtagccccacttgctcctcttcctattcctagcaatctatttgtacccacaccagatgccgaagagccgcagttgccggatgggacaggccgagaagggccagccgcagcccgtggcctggctaacccagagcctgctcccgagcctaagttgagtaggtgcagctctatgtcgtctctgtcgcgggaagtaagtcagcacttcaaccaggctcctggcgacctaccggctgcaggcggacccccttctggcgctatgccattttacaaccctgcacagctcgcacaagcctgcgccacttccggctcttcacgactcggacgtatcggacaacgtaagcatctcgtgctaaacta

SEQ ID NO: 239768 - DNA, 1521 bp, Artificial Sequence
  Description of Artificial Sequence: Synthetic coding sequence
tgatccgcctttggagacagacccgagaaaagggataacaattggcgctatgatcccaggttcaccggttcgtttgacgacgatcccgatcctcacagagacccctatggagaggaggttgatcgccgttccgtacacagtgagcattctgccagaagtctccactcagctcacagcctggcttccagacgttcttcgctgtcatcccactcccatcaatcccagatatacagaagccacaatgtggctgctgggagttatgaagctccgttaccacccggaagctttcatggcgactttgcctacgggacatacaggtccaattttagctcaggacccggatttccagagtacggttaccccgcactcggcttcttggagccatctgggcctggtttgccacccggtgtacctccacttcaagaaaggaggcatttactgcaggaggcaagatctccagaccccggtatcgttcctcaagaggcccctgtcggcaattccctttcggaattatctgaggagaattttgatgggaaatttgccaacttaacacctagccgcactgtgcccgactcagaggcacccccaggttgggaccgcgctgactcaggacctactcaaccgcctctgtcattatcaccagctccagaaactaaaagacccggacaggccgcaaaaaaggagacaaaggagccaaagaagggcgagtcatggttctttaggtggttaccgggaaagaaaaagacggaagcgtacctcccagacgacaagaacaaaagcatcgtctgggatgaaaagaaaaatcagtgggtgaaccttaatgaacctgaggaggaaaagaaggcccctcccccacccccaacctcaatgcccaagacagttcaggcagcacctccagcattacctgggcctccgggagcccctgtaaacatgtatagtcgccgtgccgctgggactcgggctaggtacgttgacgtactcaacccgagtggtactcaaaggagcgagcccgcattagctcccgctgactttgtggccccactagcccctttgcccatcccatcaaatctatttgtgcctacaccagttaggccccaaggacggtccggaagaaacgatgggctattggctctttctagtccagatgcagaggagcctcagttgcccgatggcaccgggagggaggggccagctgcagctcggggattagcgaaccccgagcccgcaccagaaccaaaggtgctgtctagcgcagccagcttgcctgggagcgaactgccgtcctctcgcccagaaggaagtcagggcggagagttgagccgatgttcatcaatgtcctcattaagtcgggaagtgtcccaacattttaatcaagcgcctggagatctgccagccgctgggggacccccttccggcgctatgcctttttataatcctgcccaactggctcaggcatgcgccactagcgggtcttcccggctcggcagaattggccagagaaagcatctggtgcttaactag

SEQ ID NO: 239769 - DNA, 3180 bp, Artificial Sequence
  Description of Artificial Sequence: Synthetic coding sequence
gccagggtcagggaccccaggacgtacgaccgcaggtactggtgcgacgccgagtacgatgcttatcgcagagaacactcagcctttggggatcgaccggaaaagcgggataacaactggagatacgacccgagatttaccggatcgtttgacgacgaccctgacccccacagagatccctatggagaggaagtcgatcggagatcggtgcatagcgagcattcagctcgatccttacacagtgcccacagccttgcgtcaaggaggtcatctctatcctctcacagccaccagagtcagatttataggtcccacaatgtggcagctggcagttacgaggctcccttacctccagggagcttccatggcgattttgcctacggcacatatcgatctaacttttcctccgggccaggcttcccagagtacggataccccgctgacactgtgtggcctgctatggagcaagtctcgtcacgcccaacctctccagagaaattttccgtccctcacgtttgtgcgaggttcggccctggtgggcagctgattaaagtgatccctaacctccctagtgaaggccagcccgctctcgtcgaagttcactccatggaagctttgctccagcacactagtgagcaggaggaaatgagggccttccctggcccattggccaaggacgacactcacaaggtggacgtgatcaacttcgcccagaacaaggcaatgaaatgcttgcaaaacgagaatctgattgacaaagagagtgcgtcactcctgtggaatttcattgtcctgttgtgtcgccagaacggtactgtggtcggtacggacatcgctgaactactgctgcgggatcatcgcaccgtgtggctccctggcaagagcccaaacgaggccaatctgatcgacttcaccaacgaggccgtcgaacaggtcgaggaggaggaaagtggagaagctcaactgtcctttctgaccgggggacctgccgctgccgcttccagtttagaacgagagactgagagatttcgcgagctgttgctgtacggcaggaagaaggacgctttggagagcgctatgaaaaacggcctgtggggtcacgctttgctgttggcttctaaaatggatagccgcacccacgcaagagtaatgacccgatttgctaattcccttcccattaatgatcctctacagactgtgtatcagctgatgtccggccgaatgcccgctgcttctacctgctgcggtgacgagaaatggggcgattggcgaccccacctagccatggtgttgagcaatcttaacaacaacatggatgtagagagcaggactatggctactatgggcgatacactcgcgtcccggggtttgcttgacgcagcacatttttgctacctcatggcacaagcagggtttggtgtctatacaaaaaaaactacaaagcttgtgctcattgggagtaatcactcgcttccgtttctcaagtttgccacgaatgaagcgattcagagaaccgaggcatacgaatatgcacaatcgctgggggctgagacatgtcccttaccctcatttcaggtgttcaaattcatctactcctgccggttagcagagatgggcttagcgacccaggcatttcactattgtgaagctatcgctaagtccatccttactcagccacacctgtatagtcccgtgcttatctcccagctagtgcagatggcctcccagctacgtctgtttgatcctcagctcaaggagaaacccgaggaagaaagtctggctgcgcctacttggttggttcacttacagcaggtcgaacgccagattaaggaaggcgcaggtgtgtggcatcaagacggcgctctgccacagcaatgccctggcacacccagtagtgaaatggagcaacttgaccgccctggcctgtcccagccgggagccttgggcatagctaacccactcttagcagtgcccgcaccctcacctgagcacagttcgccatcagtccgactactgccgtcagcaccccaaaccctacctgatggaccactggcgtctcctgctcgagtgcccatgttcccagtgcccctgccacctggcccactggagcccggacctggctgtgtaacaccagggccagccttaggattcttggaaccttctgggccagggttaccacccggagtcccaccgcttcaggaaagacgacatctgctgcaggaggcccgaagtccagatccaggcattgtaccacaggaggccccagttgggaattcactaagcgagttgagcgaagaaaacttcgacggcaagtttgctaacctcactcctagcagaacagtgcccgatagtgaagcccctcctggatgggatagagctgattccgggcctactcaaccgcctttaagcctgagcccggctccggagacaaaacgcccaggtcaggccgctaagaaggaaacaaaggaacctaaaaagggtgaatcttggtttttccgttggctccccggaaagaaaaagaccgaagcatacctgcctgatgataaaaacaagtcaatcgtgtgggacgagaagaaaaaccagtgggtgaacctgaacgaaccagaagaagaaaagaaagcaccccctcctccaccgacttcaatgccgaaaactgtgcaggctgcccctcctgctttacccggaccacctggagccccagtcaatatgtattccagacgggcagccggaacaagagctcgctatgttgacgtgctcaatcccagcggaactcagagaagcgagccagctctagcccctgctgacttcgtggctccgcttgcccctcttcccattccaagcaatctgttcgtccccacccccgatgccgaggagccacagctgcccgacgggactggacgtgaaggtcccgctgctgctcgtggtctcgcgaacccagagccagcccctgagccgaaggtcttgagctctgccgcttcattgcccggatctgagctcccctcctcaagacccgaggggtcccagggtggtgaggcgccaggagacttacccgctgcagggggtccaccatcaggcgctatgcctttttataacccagcccaactggcacaggcttgcgccacgtcaggatcaagtagattgggacgtataggacagcgaaagcatctagtcttgaattag

SEQ ID NO: 239770 - DNA, 603 bp, Artificial Sequence
  Description of Artificial Sequence: Synthetic coding sequence
atgcccaagacagtgcaggctgcccctccggcactgccaggacccccaggtgccccagttaacatgtactcccggcgagcagctggcacaagggctagatatgtagacgtcctgaacccctctgggactcagcgaagcgaaccagcattggcgccagctgacttcgtggcacccctcgcgccattaccaatcccctccaatctattcgtgcccaccccggtgtctagtgtgcgcccacaaggaagaagtggcaggaacgatggtctcctcgctctgtcttcgcccgacgccgaggagcctcaattgccggacggaacaggtcgcgaggggcctgctgccgcaagggggctggctaaccccgaaccagctccggagccgaaggtgctatcatccgccgcatccctacccggatccgagctgcctagttctagacccgaagggagccagggcggagaagccccaggggacttgcccgctgcaggcggtcctccaagtggcgcaatgccgttctacaaccctgcccagctggcccaggcatgtgcgacctctggatcctctcgcctaggtcgcatcggccagcgaaaacacctcgtgctcaactag

SEQ ID NO: 239771 - DNA, 924 bp, Artificial Sequence
  Description of Artificial Sequence: Synthetic coding sequence
atgtctatgatcttgtccgctagtgtgataagagtcagagatgggctcccactgtcagcctctactgattatgaacaatctacaggcatgcaagaatgcagaaagtactttaagatgttatctcgcaagctagctcagctgccagataggtgtaccctgaagactggacattacaatatcaactttatttcatctctgggggtttcctatatgatgctgtgtaccgaaaactatccaaacgtgctggcctttagcttcctagatgagctgcagaaggagttcatcaccacttacaatatgatgaagacgaacaccgccgtcagaccttattgttttatcgagttcgataattttatacaaaggacgaagcaacgctacaataaccctagatcactgtcgactaagattaatctaagcgacatgcagacagagatcaagctgcgacccccataccagattagcatgtgtgaactaggatcagccaacggagtcacctccgcattcagtgtggactgtaagggggcaggaaagattagctccgcacatcagaggttagagcctgcgacactgtccggcatagtgggttttatactgtccctgttatgtggcgctttgaatctgattagggggttccatgccattgagagcctcctgcagagcgacggggatgattttaattacataattgcattctttctgggcacagccgcatgcctgtaccaatgttaccttctcgtgtactacactggatggaggaatgtgaagtcattccttacgttcggactcatctgcctgtgtaacatgtacctgtacgagctgcggaatctgtggcagctcttctttcatgtgacagtcggggcttttgtgacactccagatttggctccggcaggctcaggggaaggcacccgattatgatgtttag

SEQ ID NO: 239772 - DNA, 330 bp, Artificial Sequence
  Description of Artificial Sequence: Synthetic coding sequence
atgtccatgatcctcagcgcatccgtgattagagtgagggacgggctccctttgtctgcttcgaccgattacgagcagagtactggcatgcaggagtgcaggaagtacttcaagatgttgtcccgcaaattggcacagctgcctgaccgatgtacgttgaagactgggcattacaacataaactttatctcaagtctgggggtgtcttatatgatgctgtgcaccgagaactatccaaatgtattggcctttagctttctggacgagctgcagaaagagttcatcaccacctacaatatgatgaaaacgaacactgctgtaagaccatag

SEQ ID NO: 239773 - DNA, 870 bp, Artificial Sequence
  Description of Artificial Sequence: Synthetic coding sequence
atgtccatgatcctgtctgcgtctgtaatacgagtcagagatgggctgcctttgtctgcctctacggattacgaacagtcgaccggtatgcaagagtgccgcaaatacttcaaaatgctctctagaaaactggctcagctcccagaccgctgtaccctgaagaccggacactacaatatcaacttcatttcttctctgggcgtgtcatacatgatgctctgtaccgaaaactatcccaacgtgctcgctttcagcttcttggacgagttgcagaaggaatttattactacatataatatgatgaaaacgaacactgccgtcagaccatactgcttcattgagtttgataattttatccaaaggactaagcagcgctataataatcccaggagcctgtcgacgaaaattaacttaagcgacatgcagactgaaataaaattgcgccctccataccaaatctctatgtgtgagctgggcagcgccaacggagtgacatccgccttcagtgttgactgcaaaggcgctgggaaaattagctccgcccatcagcgcctggagccagcaactctttcgggtattgtcggattcattctcagcctcctgtgcggggctctcaatctgatcagaggattccacgctatagaatctcttttgcagagcgacggtgatgactttaactacattattgccttcttccttggcaccgccgcatgcctgtaccagtgttatctacttgtatactataccggctggaggaacgtgaagagcttccttacatttggactgatctgcctgtgcaacatgtacctctatgaattaaggaatctctggcagctatttttccacgtgactgtgggagcatttgtttag

SEQ ID NO: 239774 - DNA, 417 bp, Artificial Sequence
  Description of Artificial Sequence: Synthetic coding sequence
atgagcatgattctcagcgccagtgtgattcgtgttcgggatggtctgcctttaagcgcaagcacagactatgaacagtcaactggaatgcaagagtgcagaaaatatttcaaaatgctttcgcgtaagttagctcagctcccagacaggtgtaccctcaagaccggtcactacaacataaactttatctccagtctgggcgtgagttacatgatgctatgcacggaaaattaccccaacgtgttggccttttccttccttgacgagcttcagaaagagttcatcaccacgtataatatgatgaaaactaataccgcggttcgcccttactgttttatcgaatttgataacttcattcaacggactaaacagaggtataataatccccgaagtctgagcaccaagatcaacctgtag

SEQ ID NO: 239775 - DNA, 657 bp, Artificial Sequence
  Description of Artificial Sequence: Synthetic coding sequence
atgtctatgatcctaagcgcctcggtcatccgggtgcgtgacggcctgcccctgtctgccagcaccgactacgaacagagtaccggcatgcaggaatgcaggaagtactttaaaatgctgagccggaaattagcacagctgccagaccggtgcaccctgaagaccggtcattacaacattaactttatctctagtttaggtgtaagctacatgatgctgtgtacagagaactacccgaacgtgctggccttcagcttcctcgacgagctgcagaaggagttcattacaacctataacatgatgaagaccaacacagccgtgcgcccatattgttttatcgagttcgacaattttatccagcgcactaaacaaagatataacaacccacggtccttgagtaccaagatcaacctgtccgacatgcagactgagattaagcttcggccaccctatcaaatttcgatgtgcgaattgggatccgctaacggggtgactagtgcgttctccgtggattgcaaaggcgctggaaagatcagcagcgcccaccagcgcttggagcctgccacgctctctgggatcgtaggtttcattctctcattactgtgcggcgcacttaacctcatcaggggcttccacgccatcgaatccctactatag

SEQ ID NO: 239776 - DNA, 306 bp, Artificial Sequence
  Description of Artificial Sequence: Synthetic coding sequence
atgtccatgattctatccgcatctgtgattcgggttagagatgggctgccgctaagcgcctctactgattacgaacagtccacaggaatgcaagagtgtcgcaagtattttaaaatgctttctaggaaactggcccagctgcctgatcgatgcacactgaaaaccgggcattataacattaactttatcagctctctaggagtgtcatatatgatgctctgcaccgagaactatccgaatgtccttgccttctcctttctggatgaattgcagaaggaattcattactacatacaacatgatgtag

SEQ ID NO: 239777 - DNA, 924 bp, Artificial Sequence
  Description of Artificial Sequence: Synthetic coding sequence
atgtctatgatattgtcggccagcgtaatccgtgtacgcgatggacttcccttgagcgcatccacagactacgaacagagtaccggcatgcaggagtgcagaaagtattttaaaatgttaagtcgcaagctagctcagctacccgatcgttgcacattgaaaacagggcactataacatcaattttattagctccctaggagtctcgtacatgatgctgtgtactgaaaactacccaaatgtgcttgccttctcctttcttgatgagctgcagaaagagtttatcacgacctataatatgatgaagactaataccgccgtccggccttattgctttatcgaattcgataattttatccagcggacaaaacagaggtataataacccccgttcattgtcaaccaaaatcaacctttcagatatgcagaccgagattaagctacgccctccataccagatctccatgtgcgagttgggctccgcgaatggtgtaacatctgcattcagtgtggactgcaagggcgctggaaaaatcagcagcgcccaccagagactagaacctgcaacacttagcgggatagtgggatttatcctgtccctgctatgcggggctcttaacctcattcgcggatttcacgcgattgagagtctcctacaaagcgatggcgacgacttcaactacatcattgctttttttctgggaactgcagcatgcctgtatcaatgttatctgttagtctattacactggttggagaaacgtcaagtcatttctgacctttggactcatatgcctatgtaatatgtacctctatgagctgcggaatctgtggcaacttttctttcatgtcaccgtcggagcctttgtcactctgcagatctggctgcgccaggctcaaggaaaggccccagattatgacgtgtag

SEQ ID NO: 239778 - DNA, 2298 bp, Artificial Sequence
  Description of Artificial Sequence: Synthetic coding sequence
atgacgacatacctggaattcattcagcagaatgaagaacgggacggcgtgagattctcttggaatgtttggccgtcctctcggctggaggccacacggatggtggtgccagtcgccgctctcttcacacccctgaaggaaagacccgaccttccccctattcagtacgaaccagttctgtgttctcgcacaacctgtagggcagttttgaaccccttatgtcaagtggattatcgagctaaactatgggcctgtaacttttgttatcagcgcaatcagtttcccccatcctatgccggaatatcagagttgaaccaaccagctgaacttctgccgcagttcagttcaatcgaatatgtggttctaaggggcccacagatgcccttaatctttctttacgtggtagatacctgtatggaagatgaagacctgcaggccctgaaggaatcgatgcagatgtccctgagccttttacctcctacggcccttgtcggcttgatcacatttggacgcatggtgcaggtccatgagctgggttgtgaaggaatatcaaaaagctatgtatttagggggacaaaagatctgagtgccaaacagttacaagagatgttgggactcagcaaagtgcccctcacacaggctactcgaggtcctcaggttcagcagccacctccttcaaatcgatttctgcagcctgtgcaaaagatcgatatgaatctcactgatctcctgggggagttgcagagggatccttggccagtccctcagggtaagcggcctctgaggagctctggcgttgccctgagcatcgctgtgggactactggagtgcactttccccaataccggagccagaattatgatgttcatcgggggaccagctacccagggcccaggcatggtggtgggtgatgaactgaagacccccatcagatcgtggcatgatatagacaaagacaatgctaagtatgtcaaaaaaggtactaaacatttcgaagccctcgcaaatcgagccgcaaccactggacacgtgattgacatttatgcctgcgctcttgaccagacaggactccttgaaatgaagtgctgcccgaatctcacaggaggctatatggtgatgggagactcatttaatacatctttgtttaaacagacatttcagagggtattcaccaaagatatgcatggccagtttaaaatggggtttggaggcactttggaaatcaaaacaagccgggagataaaaattagcggggctattggcccttgtgtgagtctcaactctaaaggcccttgcgtgagtgaaaatgagattgggactggtggtacttgtcagtggaagatatgcggcctatctcccactacaactctggccatttacttcgaggtggtcaaccagcacaacgcgcctattccacagggcggtcgaggcgcaatccagtttgtgacacagtaccagcattcatccggacagcggcgtatccgcgtgacgactatcgccagaaattgggcggacgcacagacgcagatccagaacatcgccgcatcatttgatcaggaagcggctgcaatcctgatggcccgtcttgccatataccgggcagaaacagaagaaggccctgatgtcctccgatggctggatcggcagctcatacggctgtgccagaaatttggggaatatcataaagatgatcctagctcattccggttttccgagacttttagcctgtaccctcagtttatgttccatctcagaagaagtagcttcttgcaggtcttcaataactctcctgatgagagttcttactaccgccatcacttcatgaggcaggacctgacgcagagcttgatcatgatccagccgatcttatatgcctacagctttagtgggccacccgagccggtgcttctagacagttcaagtattttagcggatagaattctgctgatggacacattttttcagatactgatctaccacggcgagacaattgctcagtggaggaagagtgggtaccaggacatgcccgaatatgagaattttaggcaccttctccaggcccctgtggatgacgctcaagaaattctccattcgagattccctatgcctcgatacatagacaccgaacatggagggtcccaagctaggttcctgctgagcaaagtgaacccatcccagacgcataacaatatgtacgcctgggggcaggaatctggagctccaattctgactgacgatgtgagcctccaggtgttcatggaccacctcaaaaagctagcagtgtcctctgcggcttag

SEQ ID NO: 239779 - DNA, 1992 bp, Artificial Sequence
  Description of Artificial Sequence: Synthetic coding sequence
atgcctctgattttcctctatgtggtagacacatgtatggaggatgaagatctccaggcactgaaggaatctatgcagatgtccctctcacttttgcctcctacagccctggtcggactgatcacatttggaagaatggtgcaggtgcacgaactgggatgcgaaggaatctccaagagctatgtgttcaggggcacaaaggatctctccgcaaagcagttgcaggaaatgctgggactttctaaagtccctctgacccaggctacgcgcggtcctcaagtgcagcagcctccccctagtaacagatttctgcagcccgtccaaaagatcgatatgaacctgaccgatctgttaggtgaactgcagcgcgatccctggcctgttccgcaaggcaagcggccacttaggagtagtggagtggccctaagtatcgccgtgggcctgcttgaatgtacctttcctaacacaggagcacgcattatgatgttcatcggaggtcccgcaactcagggaccgggaatggtggttggggatgaattaaagaccccaatccgcagttggcacgacatcgacaaggataacgctaaatatgtgaaaaaggggacaaagcatttcgaggcccttgccaatcgggctgcaactacgggtcacgtgatcgacatatatgcctgtgcgctcgatcagactggcttgctggagatgaagtgctgcccaaatctcacaggcggatatatggtgatgggcgactcatttaatacctctctgtttaagcagacctttcagagggtgttcaccaaggatatgcatggccagtttaaaatgggcttcggcggtacgctggagataaagactagccgggagatcaagatatccggcgctattgggccttgtgtgagtctgaatagcaaaggcccatgcgtctctgagaatgaaatcggtacagggggaacatgtcagtggaaaatatgcgggctgtcccctactaccaccctcgccatttatttcgaggtggtgaatcagcataatgcccctattcctcagggcggtcgcggagctattcaattcgtcacccaatatcagcattctagtggacagaggcgtattcgggtcactaccatcgccaggaactgggcagacgctcagactcagatccaaaatatagctgcctcctttgatcaagaggctgccgctattcttatggctcgattagccatatatcgcgctgaaaccgaagagggaccagatgtcctacgatggctcgacagacaactaatcaggctgtgtcagaagtttggcgaatatcacaaggatgacccttcgtcatttcggttttcagagactttttcactctaccctcagcgcagagatttccccaagacctccggggagattctggaaaatcaggaaaaggcgagatccgcatgtctgaaattcatgtttcatctgaggcggtcttccttccttcaggtttttaataattctccagatgaaagcagctattacagacatcattttatgcgccaagatcttacccaaagcttgatcatgatccaaccaatcctttacgcctactccttttcaggaccgccagagccagttctccttgactcgtcttccattttggccgaccgaattctcctaatggatacttttttccaaatactgatctatcatggggaaacgatcgctcaatggcgcaaatctggttatcaggatatgcccgagtatgaaaacttccgtcatctgctgcaggctcctgttgacgatgcacaggaaattctccacagcagatttcctatgcccagatatatcgatactgagcacggagggtcccaggccagatttctgttatctaaagtgaatcccagccaaactcacaacaacatgtacgcatggggccaggaatcaggcgctcctatcctcactgatgatgtatctttgcaggtattcatggaccacttgaagaaactcgctgtttcatccgccgcatag

SEQ ID NO: 239780 - DNA, 1692 bp, Artificial Sequence
  Description of Artificial Sequence: Synthetic coding sequence
atgttgggccttagtaaagtgcccctcacccaggccacgagagggccacaggtccagcagcctccccctagcaacagattcttacagccagtccagaagattgacatgaacttgactgacctgttaggggagctgcagagggatccatggccagtgccgcaaggtaagagaccgttgaggtccagcggcgtggcgcttagcatagcagtgggcctgctagagtgcacatttcccaacactggggcacgtatcatgatgtttattgggggacctgctacccaaggacccggaatggtggtcggagatgagttgaagaccccaatccgctcttggcacgatattgataaggacaacgctaaatatgtgaagaaaggcacgaagcactttgaggcccttgccaacagagccgctactacggggcatgtaattgacatctatgcatgtgccctggaccagacagggctgcttgaaatgaagtgctgccccaatctcacgggcggttatatggttatgggggatagttttaacacgtcgctttttaagcagactttccagcgcgtattcacaaaagacatgcatggacagtttaagatgggcttcggcggtacgcttgagatcaagacttccagggaaatcaagatatccggcgcaataggcccatgcgtttccctgaattctaagggcccttgtgtctccgagaacgaaatcggtaccgggggaacctgtcagtggaaaatctgtgggttaagcccgacaaccacactggctatctatttcgaggtggtcaaccagcacaacgctcccattcctcaggggggacgcggtgctattcagtttgtgacccagtaccagcactcaagcggccagcggagaatcagggtcaccacgatcgcccgtaattgggcagacgcccagactcagatccaaaacatcgctgctagttttgaccaggaggcggctgccatcctcatggctcggctcgccatctaccgagccgaaaccgaggagggcccagatgtcctccgctggctggacaggcaactgatacgcctttgtcaaaagttcggtgagtaccacaaggatgatccctcatcctttcgtttttccgaaacattcagcctgtaccctcagttcatgtttcatttgagaaggagtagcttcctgcaagtcttcaataatagcccggacgaaagttcctattaccggcatcattttatgcggcaggatcttactcaatcccttattatgattcagcccattttgtatgcttattccttcagtggtcccccagaacctgtccttctcgattcttctagcatccttgccgaccgcatactgttaatggacaccttttttcagattctaatttatcacggggaaacaatagctcagtggcggaagtcaggataccaggacatgccagagtacgagaatttccggcacctgctgcaggcccctgtggacgacgctcaggagatcttgcatagtagattcccaatgccgagatatattgatacggaacatggaggcagtcaggctcggttcctgctgtccaaagtgaatccctcacaaacccataataatatgtatgcttggggccaggagtccggagcgccaatcttaacagatgacgttagcctgcaagtgttcatggaccacctgaagaagttggccgtgtcctcagccgcatag

SEQ ID NO: 239781 - DNA, 2211 bp, Artificial Sequence
  Description of Artificial Sequence: Synthetic coding sequence
atgaccacttatctcgaatttatacagcagaatgaggagcgcgacggagttcgcttcagttggaatgtgtggccatcttctcggttagaggccacacggatggtggtgcccgtcgctgcactctttactcctttaaaagaaagacccgatctcccgccaatacaatacgagcctgtactgtgtagccgcactacctgccgggcagtgttgaaccccctgtgtcaggtcgactatagggctaagctatgggcgtgcaatttttgttaccagcgcaaccagcgtgggccacaaatgcctctgatctttctttacgtggtggacacatgcatggaggatgaggatcttcaggcactgaaagagtctatgcaaatgtccctgtcgttgcttccaccaaccgccttggtgggcctgataaccttcggacgcatggttcaggttcacgagctgggttgcgaaggaattagcaaatcttacgtgttccggggaacaaaggatttgagcgccaagcaattgcaggagatgcttggcctgagcaaagtgccactgacacaggccacccgaggccctcaggtgcagcagccccctccttctaaccgctttctccagccagtgcagaagatagacatgaatctgaccgatctgcttggcgagctccagcgcgacccatggcctgtgccacagggcaaaaggcctctgaggtcctcgggagtggccttgtccatcgccgtgggcttacttgagtgtacattccctaacacaggagctcgaatcatgatgtttatcggtggccctgccactcagggcccaggcatggtcgtgggggacgaacttaagacacctattagatcttggcacgacatagataaggataacgctaaatacgttaagaaggggacgaagcactttgaggccctggcgaatcgagccgctaccactggccatgtgatcgacatctatgcttgcgcgctagaccagactgggctccttgagatgaaatgctgcccgaacctaacaggaggttacatggtcatgggcgatagttttaacacatcattgtttaagcagactttccagagagttttcaccaaagatatgcacggtcaatttaaaatgggtttcgggggtacgttagagattaagacaagtcgggagataaagatttctggagctattgggccatgtgtgtccctgaacagcaaaggaccttgtgtgagtgaaaacgagatcggaaccggaggaacatgtcagtggaagatctgcggtcttagtcctacaactaccttagctatttatttcgaagtggtcaaccagcacaatgcccctattcctcaagggggtcggggagctatccagttcgtgacacagtaccaacactcttcaggacaacgcagaattcgtgtgacaacaatcgccaggaactgggctgatgcccagacgcagatccagaatatagcagcaagtttcgatcaggaggcagctgccattcttatggcacggctggctatctatcgagctgaaacagaggagggaccggacgtgttgaggtggctcgaccgacagctaatccggctctgccagaaattcggtgagtaccataaagacgatccaagttcattccgattcagcgagacgttctccctgtatccccagttcatgtttcatctaagacgcagctcatttcttcaggtttttaacaactcaccagatgagagttcatattaccgacaccacttcatgcgtcaggacctgacccagagtctgattatgattcaaccaatattgtatgcctacagtttttctggacctcccgaacccgtactattggatagtagcagtatactggccgatcgtatcttgctcatggataccttctttcaaattttaatttaccacggggagactatagcccagtggcgaaaatctgggtaccaggacatgcccgagtacgaaaactttcggcatctgcttcaggcacctgttgatgacgctcaagagatcttgcactctaggtttccaatgcctaggtacatcgacactgagcacggaggtagtcaggccagatttctgctcagtaaggtcaacccttcccagacgcacaataatatgtacgcctggggccaagaatctggcgctccaatactgaccgatgatgtgagtcttcaagtcttcatggaccacctcaaaaaactggccgtgagtagcgctgcttag

SEQ ID NO: 239782 - DNA, 510 bp, Artificial Sequence
  Description of Artificial Sequence: Synthetic coding sequence
atgacaacttatctggaattcatccaacagaacgaggagcgcgacggcgtgaggtttagctggaatgtgtggccgtctagcaggctggaggccactcgcatggtagtgcctgtcgccgctctgtttacccctttgaaggaacgcccagacttgccccctattcaatacgagcccgtcctttgttctagaacgacttgtagggccgtgttgaaccccctgtgccaggtggactatagagccaagctgtgggcctgcaacttttgttaccaacggaatcagtttccaccaagctatgcgggaatctctgaactgaatcaacccgctgagctgctccctcagtttagctccatcgaatatgtagtgctccgcggaccgcagatgccgttgatctttctgtatgtggtcgacacctgtatggaggacgaagacctccaagccctgaaggagagcatgcagatgtccctttctctgcttccacctacagctctcgtggggctgatcaccttttag

SEQ ID NO: 239783 - DNA, 285 bp, Artificial Sequence
  Description of Artificial Sequence: Synthetic coding sequence
atgacgacatatctcgagttcattcagcagaacgaagagagagacggagtgagattctcttggaacgtttggccctcatccagactcgaagcaacacgcatggtggtgccagttgcagctctcttcactccgcttaaagagaggccggatttgcccccaatacagtatgagccggtgttgtgtagccgaacaacctgcagagctgtgctgaaccctttgtgccaggtggactatcgggctaagctgtgggcttgtaatttttgctatcaaagaaatcaagtctag

SEQ ID NO: 239784 - DNA, 423 bp, Artificial Sequence
  Description of Artificial Sequence: Synthetic coding sequence
atgacaacatacttggaatttatccagcaaaatgaagaaagggacggggtccggttttcttggaatgtgtggccctcatcacggcttgaagccacccgtatggtggtccctgtcgccgcactctttacacccctcaaggaacgacctgacctgccacctattcagtacgagccagtactatgttccagaacaacttgtagagccgtgctcaacccactttgccaggtggactatcgagcaaagctgtgggcatgcaacttttgctaccaaaggaaccagtttcctccctcctatgcgggaatcagtgagcttaatcagcccgctgagctgctgccacagttcagtagtattgagtacgtcgtgctccgaggacctcagatgcctttgatcttcctatacgtcgtggatacttgtatggaatag

SEQ ID NO: 239785 - DNA, 123 bp, Artificial Sequence
  Description of Artificial Sequence: Synthetic coding sequence
atgacaacttacctggaattcatccaacagaatgaagagagggatggagttcggtttagctggaacgtgtggccctcttctaggctggaagcaacacgaatggtggtgcccgtcgcagcctag

SEQ ID NO: 239786 - DNA, 2304 bp, Artificial Sequence
  Description of Artificial Sequence: Synthetic coding sequence
atggcaacctatctggaatttattcagcagaacgaagagcgcgacggtgtgcgattcagctggaatgtctggccctccagcaggcttgaggcaacgcgcatggtagtgccactagcttgcctgcttacgcccctgaaagagcgcccagacctgccccctgtgcaatacgagcccgtgttgtgtagtcgcccaacttgcaaggcagttctgaacccgctgtgtcaagtagattaccgagccaagctgtgggcttgcaacttctgtttccagcgaaatcagtttccacccgcttatgggggaatctctgaagtcaaccaacccgctgagttgatgccccaattctcaaccattgaatatgtgatccagagaggtgctcagagtcccctgatcttcctttacgtggtcgatacctgcctcgaggaggacgatctgcaggcactgaaggaaagtctgcagatgagtctatctctcctgcctcccgatgctctggtgggactgatcacatttggcaggatggtacaggtgcatgagctctcatgtgagggaatcagtaagagctatgtgtttagaggcactaaggatttaaccgccaagcagatacaggacatgcttggcttaaccaaacctgccatgccaatgcagcaggcacgccctgcccaacctcaagaacatccctttgcaagctcacggtttttgcagccggttcacaagattgatatgaatctgaccgacctcctcggagagttgcagcgtgacccttggcctgtaacccagggtaaaagaccgctccgatccactggcgtcgccctctctatcgcagtcgggctccttgaggggactttccctaataccggtgccaggattatgctcttcacaggaggtccccctacccagggaccaggaatggtcgtgggcgatgagctgaagattcccattagatcttggcacgacatcgagaaagataacgctcgctttatgaaaaaagcaaccaaacactatgagatgttggccaatagaaccgccgctaacggccactgcatcgacatttatgcctgtgcgctcgatcagaccggattgcttgagatgaagtgctgcgcgaatctgacaggcggatatatggtaatgggggactcttttaacaccagccttttcaagcagactttccaaagaatattcacaaaagacttcaatggagatttcaggatggcatttggcgctacgctcgatgttaagactagtcgggagttgaagattgccggagccattggaccctgtgtttcactcaatgttaagggcccttgcgtgtctgaaaatgaactgggagtgggcggtacctcgcagtggaaaatctgcgggttggacccaacctctaccctgggtatctatttcgaggtcgtaaatcagcataacacacctattccacaaggaggaaggggggcaatccaattcgtgactcattaccagcacagcagtactcagcgtcggataagggtcacaacaatagctcgcaactgggctgacgtgcagagccagttgcgtcatatagaggccgcattcgatcaggaggcagcagctgtgctaatggcgcgtctaggagtgttccgagcggagtcagaggagggccctgatgtgcttagatggctggataggcagctgatcagactgtgtcagaaatttggccagtataataaggaggatcccacatctttccgactctctgacagcttcagtctttacccgcagtttatgtttcacctgcgcagatccccgtttttgcaggtgttcaacaactcaccagacgagtcttcttattacagacaccacttcgccagacaggaccttacacagagtctcatcatgattcagcccattctgtactcttactcctttcatggccctcccgagcccgtgttactggacagctcttccattctggctgacagaatcctgcttatggatacttttttccagattgtcatttacctaggcgaaaccatcgcccagtggagaaaagccggatatcaggatatgccagagtatgagaattttaagcacctcctgcaggctcccctagacgacgcacaggaaatcctgcaggcgcgttttccaatgcctcggtacatcaatacagaacacggagggagtcaggccagattccttctcagtaaagtgaatcctagccagactcacaacaacttatacgcttggggccaagagaccggcgctcccatcctcactgatgacgtttcattacaggtgtttatggaccacctaaagaaattggcagtctcgagcgcttgttag

SEQ ID NO: 239787 - DNA, 2304 bp, Artificial Sequence
  Description of Artificial Sequence: Synthetic coding sequence
atggccacttatcttgagtttatccagcagaacgaggaaagggatggtgtacgattttcgtggaacgtttggcctagtagccggctcgaagcaacaaggatggtagtgccattggcttgcctccttactccacttaaggagcggcctgatctgcctccggtccagtacgagcccgtgttgtgttctaggcccacctgcaaagccgtgctcaatcctctctgtcaggtagattacagggcaaaactctgggcgtgcaacttctgtttccagagaaaccagttccccccagcctacgggggtatttctgaagtgaaccagcccgcagagctcatgccgcagttttctacgattgagtacgtgatccagcgcggtgctcagagcccactgatctttttgtacgtagttgacacctgtttagaagaggacgatctacaagcactcaaggagtccctccagatgtcattatccttgttgccccctgatgcccttgtgggacttattactttcggcagaatggtccaggtgcacgagctttcctgcgagggtatttccaaatcttacgtgttcagaggaaccaaggacctgaccgctaagcagatccaagatatgctggggctcaccaagcctgctatgcctatgcagcaggccaggcctgcacagccacaggagcacccgttcgcctcatctcggtttcttcagcctgtccacaagattgacatgaacctgacagacctcctgggcgaactacagcgtgatccctggccagtcacccagggtaaaagaccactcaggtctactggagtggcactttcaattgctgtgggcctgctcgagggaacttttcccaatacaggtgcgaggataatgctcttcacgggcggtccacctacacagggccctggcatggttgtcggcgacgaactgaaaatcccaattaggtcttggcacgatatcgagaaagataacgcaagatttatgaagaaggccacgaagcattatgagatgctggctaaccggactgcggctaacggacactgtatcgacatctatgcatgcgcactggatcagactgggctgctcgaaatgaaatgttgcgctaacctgactggtggttacatggtgatgggggattcatttaatacctctctgttcaagcagacattccagaggatcttcactaaagacttcaatggcgactttcgcatggcgtttggcgcaactctcgatgtcaagacatctagggagctgaagattgctggtgccattgggccttgtgtctcactgaacgtgaagggtccttgtgtgtccgagaacgaactgggggtaggaggcacctcacagtggaagatttgcggcttggatcccacgagcaccctcggcatttacttcgaggtggtcaatcaacacaacacaccaatcccacagggtggccgtggggcaattcaattcgttacacactatcagcactcaagcacacagaggcggattcgcgtaactaccattgccagaaattgggctgatgttcagtctcagctgagacatattgaggctgcctttgaccaggaggctgccgcagtgctgatggcaaggctgggcgtcttccgtgccgagtccgaagagggccctgatgttctccgctggctggatcggcagttaattcggctttgccagaagttcggccagtacaacaaagaggatccaacctcgttccgcttatctgatagcttctccctgtaccctcagtttatgtttcacctcaggaggagcccattcctacaggtgttcaataactcaccggatgagtcttcctattacagacatcactttgcacgccaagatctcactcaatcgctcattatgattcagcccatactgtacagctactccttccatggacccccagaaccagttctcttggactcttcgtccatcctcgcagaccgcattctcctgatggacactttctttcagatcgtgatctacttaggggagaccattgcccagtggaggaaagctggatatcaagacatgcctgagtacgagaacttcaaacatctgctgcaggctccgctcgacgacgcacaagagatattacaggccaggtttcccatgccaagatacattaatactgaacacggaggttctcaagccaggttcttgctcagcaaggtaaatccaagtcagacccacaacaacctctacgcatggggacaggagacgggggctccaatccttacggacgatgttagcttgcaagtgttcatggaccacctgaagaagctcgccgtgagcagcgcctgttag

SEQ ID NO: 239788 - DNA, 2304 bp, Artificial Sequence
  Description of Artificial Sequence: Synthetic coding sequence
atggctacctacttggagtttatccaacaaaatgaggagagggacggagtgcgcttttcttggaacgtgtggccgagcagcaggctggaagccacacggatggtagttccgctcgcctgtctgctcactcctctgaaggaacgcccagatctaccccctgtgcagtatgagcccgtgctttgcagccggcctacgtgcaaggcggtacttaatccgctgtgtcaggtagattaccgggctaaactgtgggcctgcaatttctgtttccagaggaatcagttcccaccagcctatggagggatttcagaggtgaaccagcctgcagagctgatgcctcaattttcaactattgaatatgtgatccagcgcggtgcccagagccctcttatctttctctacgtagtggacacctgtctggaagaggacgatttgcaggccctaaaggagagcctccagatgtcactttcacttttacctcctgacgccctggtgggactgatcacattcggaaggatggtacaggtacatgagctttcgtgcgaggggatttccaagagctacgtttttaggggcacaaaggatctcacggccaagcagatacaggacatgctgggactgaccaagccggctatgcctatgcagcaggccaggccagctcagccacaggagcatccatttgcttcttctcgttttctacagcctgtgcataagattgatatgaaccttactgacttactaggtgagctgcagagggatccttggcccgtgactcaaggaaagagaccgctgaggagcacgggagtcgctctgagtatcgccgttggactcctggaaggcacatttccaaataccggggctcgcattatgctatttaccgggggacctcctacccaggggccaggtatggtagtgggcgatgaattgaagatccctatccgatcttggcatgatatagaaaaagataatgcccgatttatgaaaaaggcgaccaaacattacgaaatgctggctaaccggaccgccgctaacggacactgcattgatatttacgcgtgcgccctggaccaaaccgggcttctggagatgaaatgctgcgccaatctcaccggaggatacatggtcatgggtgacagctttaacacctcactcttcaaacagacctttcagaggatctttacaaaggattttaacggagactttaggatggccttcggcgcaactttggatgtgaagaccagtcgcgagttgaagattgcaggtgctatagggccatgtgtttcgttgaatgttaaaggcccttgcgtgagcgaaaacgagctgggcgttggaggtacatcccaatggaaaatctgcggcctcgaccccacgtctacactggggatatactttgaggtcgtgaaccagcacaatactcccatcccccaagggggacggggagccatccaatttgttactcactaccagcactcctccacacagcgacgaatccgcgtgacaactatagcccgaaattgggctgatgtgcagagtcagctcagacatatagaggctgccttcgatcaggaggcagctgccgtcctgatggcacggctcggtgtgttcagagccgagtctgaagaagggcctgacgtccttagatggctggaccgtcagttaattcgcctgtgtcaaaagttcggccagtacaacaaagaagacccaaccagctttaggctttctgacagtttctctctctatccgcagttcatgttccaccttagacgcagcccgtttctgcaggttttcaataattctcctgacgaaagctcctattaccggcaccattttgcgagacaggacctcactcagtctctgattatgatccagcctatactgtatagttattcctttcacggtccaccagagcctgtgctattggattccagttccatactcgccgataggatattactgatggatacatttttccagattgtgatttacctgggtgaaacgatagctcagtggaggaaggccggttatcaggacatgccagaatacgaaaactttaagcatctgctccaagcccctctggatgacgcccaggaaatactgcaggccaggttcccaatgcctcgatacatcaataccgaacatggtgggtcacaagcgaggttccttctctccaaagttaatcctagtcagacccacaacaacctctacgcttggggccaggaaacgggggcaccgattttaactgacgacgtgagtctccaggtgtttatggaccacttaaaaaaactggctgtatcatctgcttgttag

SEQ ID NO: 239789 - DNA, 2304 bp, Artificial Sequence
  Description of Artificial Sequence: Synthetic coding sequence
atggcaacttatctggagtttatccagcagaatgaggagcgcgatggcgtccgattcagttggaacgtgtggcccagttccagactggaagccaccaggatggtggtccccttggcctgccttctgacccccctgaaagagaggccagatctgcctccagtacaatacgaaccagtcctgtgctctcgccctacatgtaaagctgtgctcaaccctctctgtcaggttgattatagggccaagctgtgggcctgtaatttctgtttccaaagaaatcagttccctcctgcttacggagggatttcagaggtgaaccaacccgctgagcttatgccccaatttagtaccattgagtacgtgatacaaagaggcgctcagtcgcctcttatattcctctacgtggtcgacacttgtctcgaagaagatgacctgcaggctttaaaggaatctcttcagatgtctctgagcttgttgccccctgatgctctggtggggctcattacttttgggcgaatggtgcaggtccacgaactgtcctgtgaaggaatatcaaaatcctatgtttttagagggaccaaggacctgacggcaaaacagatccaagatatgcttggcttgaccaagcccgcaatgccaatgcagcaggccaggccggctcagccacaggagcacccttttgcatcctcccgattcttgcaaccagtccataagatcgacatgaacctaactgacctattaggagagctgcaaagggacccatggcctgtcacccaagggaagcgcccactccggtctaccggcgttgcgttatccattgccgtgggtctgttagaaggcactttccctaacacaggagcaaggattatgctcttcaccggtggacccccaacccaggggccaggcatggtcgtgggcgatgagctgaagataccaatccggtcctggcatgacatcgagaaggacaatgcgaggtttatgaagaaagcaacaaaacattatgagatgcttgcgaaccggaccgctgcgaacggccattgcatcgacatttacgcatgcgctcttgaccagactggccttctggagatgaagtgctgtgccaatcttaccggcggttacatggtgatgggggacagctttaatacatccttgtttaaacagaccttccagcgcatctttacgaaggacttcaatggtgattttcggatggcattcggagctactcttgacgtcaagacttcgagggaactgaagattgctggagcaattggaccgtgtgtttccctgaatgtaaagggcccatgcgtgagcgaaaacgagctgggagtggggggaacttcccagtggaagatttgtggccttgacccaacctctaccttgggtatttatttcgaggtcgtcaatcagcataacacaccgatccctcaggggggtaggggagccatccagtttgtcacgcattaccaacactcctcaactcagcggaggatcagagtcactactatcgccagaaattgggcagacgtgcagtctcagctgagacacatcgaggcggcattcgatcaggaggcagctgctgtcctcatggcgcgtctcggggtttttcgcgctgagtcggaggaagggcctgacgtcctacggtggctggacaggcagcttatcagattatgccagaaatttggccagtacaacaaggaggacccgacgtcctttcggctttctgatagctttagtctttatccccagttcatgttccacctgcgccgatctccattcctacaggtcttcaataattctcctgatgagagcagttattaccggcaccactttgccaggcaagatctgacacaaagcctgataatgatccagcctatcctttacagctattcctttcacggtcctcctgagcctgtgctgcttgacagcagcagcatcctggcggacagaatactgctcatggatacattcttccagattgttatctatctcggggaaacaattgctcagtggcgaaaggctggctaccaagatatgccagaatatgagaactttaagcacctgctgcaggcgccactggacgatgcacaggaaatcctgcaggccaggttcccaatgcccaggtacatcaacaccgaacatggtggtagccaggccagattcctgctgtccaaggtcaaccccagccagacgcacaataatttgtatgcttggggacaagagaccggcgctcccatcctcacagatgatgtcagcctgcaggtgttcatggaccacttgaagaagctggccgttagcagtgcctgctag

SEQ ID NO: 239790 - DNA, 741 bp, Artificial Sequence
  Description of Artificial Sequence: Synthetic coding sequence
cagagaaggattcgcgtcaccactatcgcaaggaattgggcagatgtccagagccaattgcgccatattgaggcagccttcgaccaggaggcggctgccgttttgatggccaggctgggtgtcttccgagcggaaagcgaagaaggtccagatgttttacggtggctggacaggcagcttattagactgtgtcagaagttcggccagtataacaaagaagaccccaccagttttcgcctgtcagacagttttagcctgtacccccagttcatgtttcacctgcgcagatccccattccttcaggtgttcaataatagtcccgatgagtctagctactaccgccaccacttcgcccgacaagacctcacccagtccctgataatgattcagcccattttgtatagctacagtttccacggtccgccagagacaattgcccagtggcggaaagcaggttaccaggacatgcccgaatacgaaaactttaagcaccttctgcaggcacctctcgacgacgcacaggagatcttacaggctcgcttccccatgcctaggtatatcaatactgagcatggaggcagccaggctcgctttctcctctctaaggtgaacccatcacagacacacaacaatttgtatgcatggggacaggaaaccggagcccctattctgaccgatgacgttagcctacaggtttttatggaccatctgaagaagttggcagtgtcaagtgcgtgctag

SEQ ID NO: 239791 - DNA, 996 bp, Artificial Sequence
  Description of Artificial Sequence: Synthetic coding sequence
atggcgacctatctggagttcatacaacagaacgaggagagagacggggtgcgtttcagttggaacgtttggccatcaagtaggctggaggccactaggatggttgtgcctcttgcatgtctgctgacacccttgaaagaaagacctgatcttcctcccgtgcagtacgaaccagtgctgtgtagccgccctacatgtaaggctgtgttgaaccccctgtgtcaggtcgattatcgagcgaaactgtgggcctgcaacttttgtttccaaagaaatcaatttccgccagcatacggcggaatcagtgaggtcaatcagccagccgagctaatgccccaattcagcaccattgagtacgtcatccaaaggggggcacagtcaccgctaatatttctatatgtcgtcgacacttgtctggaggaggatgacttgcaggccctgaaagagtcactccagatgtccctctccctgctgccccctgatgctctagtgggtttgatcactttcgggcgaatggtgcaagtgcatgagctgtcgtgtgagggtatttccaagtcatacgtgtttcgcggaactaaggaccttaccgccaagcagatccaggatatgttgggattaacaaaaccagccatgcccatgcagcaggccaggccagcccagcctcaagagcacccctttgcctcctcccgcttcctgcagcctgtacataagattgacatgaacttgacagaccttttaggagagctgcaaagagatccatggcccgtcacccaaggcaaacggcctcttaggtcgaccggagtcgccctctccatcgccgtgggtctgctcgagggtaccttcccaaacactggcgctagaattatgttatttacaggtggcccacctacacagggtcctgggatggtggtgggcgatgaactgaaaattcccatacgaagttggcacgacatcgaaaaggataacgcgcgtttcatgaaaaaagcaaccaagtag

SEQ ID NO: 239792 - DNA, 1200 bp, Artificial Sequence
  Description of Artificial Sequence: Synthetic coding sequence
atggctgagcggaggagacataagaagaggatccaagaggtgggcgagccatcaaaagaagaaaaggcagtcgctaaatatctgcggttcaactgccctactaaaagtactaacatgatggggcaccgggtcgattactttattgcttcgaaggcagtcgactgtctcctggactccaaatgggcgaaggcaaagaaaggagaggaggctctgttcaccacacgagagtcagtggtggactactgtaatcgactgctgaagaagcagttctttcacagggcattgaaggtcatgaagatgaagtatgataaggatattaagaaggaaaaggacaagggcaaagcggagagcggtaaggaggaagacaaaaagtccaagaaagagaatattaaggacgagaagaccaaaaaagagaaggagaagaagaaggatggtgagaaagaggagtctaagaaagaggagactcccggaacacctaagaagaaagagaccaagaagaagtttaaactggagccacacgacgaccaggtgttcctggacgggaacgaagtgtacgtctggatctacgacccagtacatttcaagacctttgttatggggctgatcttagtgatcgcagtcatagctgctaccttattccccctgtggccagccgagatgcgagtgggcgtttattacctctctgtgggcgctggttgtttcgttgcctccatactgctactggccgttgctcgctgtatactgttccttatcatctggctgatcaccggcggaaggcatcacttctggttcctgcccaacctgacggctgacgttgggtttatcgatagctttcgaccgttatacactcatgaatacaagggaccaaaagcagacctcaagaaagacgagaagagcgagacaaagaagcagcagaagtccgacagtgaggagaagtccgatagcgaaaagaaggaggacgaggagggaaaggtgggccctggtaatcacggcaccgagggatctggcggagagcgacattctgacacggactctgaccgaagggaggacgatcgctcccagcattctagcggtaatgggaatgacttcgagatgattaccaaagaggagttagaacaacagacagacggagattgtgaagaggacgaggaggaagaaaatgatggcgagaccccgaagagtagccatgagaaaagttag

SEQ ID NO: 239793 - DNA, 1200 bp, Artificial Sequence
  Description of Artificial Sequence: Synthetic coding sequence
atggcagagcgccgtaggcacaaaaagaggatacaagaagtcggggaaccgtctaaggaagagaaagctgtggcgaaatatctccgtttcaactgtcccacgaagtcgacgaacatgatgggtcatcgggtggactattttatagccagtaaggctgtcgattgtctcctcgactctaaatgggccaaggccaaaaagggcgaggaagcattattcacaacgagagagagcgttgtggactactgtaacaggctgctgaagaaacagttctttcacagagctttgaaagtgatgaagatgaaatacgacaaggatattaagaaggaaaaggataaaggcaaggcggaatccggtaaagaagaggacaagaaatcaaagaaggaaaacattaaagacgaaaagacgaaaaaagagaaagagaagaaaaaggatggtgagaaagaggagagtaaaaaggaggaaacccctgggacgcccaaaaaaaaggagacaaagaagaaattcaagcttgaaccacatgacgaccaagtctttctggacggtaacgaggtctatgtatggatctacgatccagttcacttcaagacgtttgttatggggctgattctcgtgattgctgtcatagccgcaaccctgttcccgctctggccagctgagatgcgggtgggcgtgtactatctgtcggtaggtgcagggtgtttcgttgcctcgatcctcctgctggcagtcgcgcgatgcatattgtttctcataatctggctcatcaccggaggcagacatcacttttggttcttgccaaaccttactgcagatgtgggattcatcgacagttttcggcctctatacacccacgagtataagggccctaaagctgacctgaagaaagacgagaaaagcgaaacgaaaaagcagcagaaaagcgacagcgaggaaaaaagcgatagtgagaaaaaagaagatgaagaggggaaggtgggacccggaaaccatggaaccgagggcagtggtggagagaggcattccgatactgactccgataggcgcgaggacgatcgctcacagcactcctccgggaacggcaacgattttgaaatgatcacgaaagaagagctggaacaacagaccgatggagattgcgaagaagatgaagaggaagagaatgatggagagacccccaagagcagtcatgagaagagctag

SEQ ID NO: 239794 - DNA, 372 bp, Artificial Sequence
  Description of Artificial Sequence: Synthetic coding sequence
atggctgagaggaggcgacacaaaaagcggattcaggaggtcggagaaccttcgaaagacgagaaatcagagacaaaaaaacaacaaaagtctgattcggaagaaaaatctgacagtgagaagaaagaggacgaggagggcaaggtggggcctgggaatcacgggaccgaggggagcggaggtgagaggcactcagataccgatagtgacaggcgcgaagacgatcggagccaacattcctctgggaatgggaatgactttgagatgatcactaaggaggagctagaacagcagactgacggggactgcgaggaagatgaagaggaggaaaatgatggtgaaacaccgaaatccagtcacgagaagtcctag

SEQ ID NO: 239795 - DNA, 2283 bp, Artificial Sequence
  Description of Artificial Sequence: Synthetic coding sequence
atggccggtcaacagttccagtacgatgactccgggaacacctttttctatttcctgacatctttcgtcggcctgatcgtcattccagccacatattatctctggcctcgcgatcagaacgccgagcagatacggctgaagaacattcgcaaggtttatggacgatgcatgtggtatcgcctgcgattgttgaagcctcagcctaacattatccccacagtcaagaagatcgttctccttgctgggtgggcccttttcctttttctcgcatataaagtgagcaagaccgacagagagtaccaggagtataacccttacgaagtgctcaacttagatccgggtgccaccgtggctgaaatcaaaaaacagtatcgcttgcttagtctgaagtatcacccagataagggcggagacgaggtaatgtttatgcgaattgcaaaggcctacgccgcactcaccgacgaggaatctcgtaagaattgggaagagttcggcaatcctgatggtccccaggcaactagtttcgggattgctcttccggcttggatcgtggaccagaagaactctattttagtcctcctagtgtacgggctagctttcatggtgattcttccggtagtagtgggcagttggtggtatagatctatccggtactccggtgatcagatccttatcagaacgacccagatttacacctatttcgtttacaaaacccgcaacatggatatgaagcgcttaattatggtgctggccggagccagtgaatttgacccgcagtacaacaaggacgccacttcccgcccaacagacaatatcttgatccctcagctcattcgcgaaattggatcgattaacctgaagaagaatgagccccctctcacctgtccttattcattaaaagccagagttctgcttttgtctcacctggccaggatgaaaattcctgaaaccttagaggaagatcagcagttcatgcttaaaaaatgtcccgctctgctccaggaaatggtcaacgtgatctgccaactgattgtaatggccagaaatagggaggaacgggaattccgggcacctaccctagcctcattagaaaactgcatgaaactgtcccagatggctgtacagggccttcaacagttcaagtctcctttgctacagctgcctcatatcgaagaagataaccttaggagggtctccaatcataagaagtacaagataaaaaccattcaggatctcgtcagcttaaaggaaagtgaccggcacacccttctccactttctggaggacgagaagtatgaggaggtcatggctgttttaggatccttcccctatgttaccatggacatcaaatctcaggtcctggatgacgaagacagtaataacatcacggtgggcagtctggttacagtactcgtgaaactcacccggcagaccatggctgaggttttcgaaaaagagcagagtatttgcgcagctgaggagcagccagccgaagacgggcaaggagagactaataaaaatcgcaccaaagggggttggcaacagaagagcaagggtcctaagaaaactgctaaatcaaaaaaaaaaaaaccacttaagaagaagcctacccctgttctgctgccgcagagcaaacagcagaagcagaagcaagccaacggtgtagtggggaatgaagccgctgtcaaagaagacgaggaagaggtaagcgacaaaggttctgatagtgaggaggaagagacaaatcgcgactctcaatctgaaaaggatgacggttcggatagagattctgatcgggagcaggatgaaaaacagaacaaggatgacgaggccgagtggcaggagcttcagcagagcatccagcgtaaggaaagggcgcttttggaaaccaagtcaaaaatcacacacccagtatattctctgtatttccccgaagagaaacaggaatggtggtggctgtacatcgccgaccgaaaagagcaaactctgatctcaatgccctaccacgtatgtacactcaaggacacggaggaagtcgaactgaagtttccggcacccggaaagcctgggaattaccagtatacagtcttcctgcgctctgattcttatatgggactggatcaaatcaaaccattgaaactcgaagtgcatgaggccaagcccgttccggaaaaccacccccaatgggacactgccattgagggggacgaagaccaagaggattccgagggcttcgaagattccttcgaagaggaggaggaagaggaagaggatgatgattag

SEQ ID NO: 239796 - DNA, 1254 bp, Artificial Sequence
  Description of Artificial Sequence: Synthetic coding sequence
atgttcatgaggatcgcgaaggcatacgcagccctcactgatgaagagtcccgtaagaactgggaggagttcggcaacccagacggcccacaggcgacaagttttggcattgccctcccggcatggatcgtggaccagaaaaacagtatcctcgtgcttctggtgtatgggcttgctttcatggtaatattgcctgtggtcgtggggagctggtggtaccggtccattcggtattcaggggatcagatactcatcagaaccacgcagatctatacatacttcgtgtacaaaacacgcaatatggacatgaagcgccttatcatggtactcgcaggggcttccgagtttgatccccagtacaataaggacgccacatctcgacccacagacaacattctcattccccagctcatcagggagattggttctatcaacttaaagaaaaacgagccgccattgacatgtccatacagcctcaaggccagggtgctcctactgtctcacctggcacgaatgaagatcccagagaccttggaggaggatcagcagtttatgttaaagaaatgcccagcgttgctgcaggagatggtcaacgtgatctgccagttgatagtaatggcacggaaccgcgaggaaagggagttcagggctcctaccctcgctagcctggaaaactgtatgaagctgtcccagatggccgttcagggcctgcagcagttcaagtctccccttctccagcttcctcatattgaggaggacaatctgcgacgcgtgtccaaccataagaagtataagataaagaccatacaggacctcgtgtctttgaaggagtccgacaggcacacactcttgcacttcctcgaggacgagaaatatgaagaagtgatggccgtattggggtccttcccgtacgtgactatggacattaagagccaggtccttgatgatgaagattctaacaacattaccgtgggcagcctggttactgtgctggtgaagctcacccggcagaccatggcagaagtttttgaaaaggaacaaagcatttgcgctgctgaggaacagccggctgaagacggacagggcgagacaaataagaacagaacaaagggcggatggcagcagaagagcaaaggacctaagaagactgccaaaaagaaaaaggagacattcaagaagaagacctacacctgcgccattactactgttaaagcaacagaaaccaaggcaggaaaatggagccggtgggagtag

SEQ ID NO: 239797 - DNA, 1137 bp, Artificial Sequence
  Description of Artificial Sequence: Synthetic coding sequence
gaacatgagagagaatttcgtgcacctactctggcttccctggagaactgtatgaaactgtcacaaatggccgtacagggacttcaacagttcaagtcgcccctgcttcaattaccccatatcgaagaggataacctgcgccgtgtgagtaaccacaagaaatataaaatcaaaactattcaggatctcgttagcttgaaggagagcgaccgccacaccctcctgcactttctggaagacgagaagtacgaggaggtgatggccgtgctcggcagctttccttatgtcaccatggatatcaaaagccaggtcctggatgatgaggacagcaataacattaccgtgggttctctagtgacggtgttagtgaagttaacgcgccagaccatggcagaagtgtttgagaaggagcagtccatctgtgctgctgaagagcagcccgcagaggacggtcagggggaaactaataagaacaggaccaagggaggctggcagcaaaaatccaaaggacccaagaagactgcaaagtccaagaagaagaaaccacttaaaaagaaacccacacctgttctgcttccccagagcaaacagcagaagcagaaacaggcaaacggggttgtcggaaacgaggctgctgtcaaagaggacgaggaggaggtctcagacaaaggctcagattccgaggaggagtggcaggagctgcaacagagcatccaaagaaaggagcgcgctctgctggaaaccaagtctaagattactcatccagtgtactctctgtattttcctgaggaaaagcaggagtggtggtggctctacatcgccgaccgcaaagaacagactctcatttccatgccatatcacgtatgtactcttaaagacacagaagaggtggaactgaagtttcctgcgccaggcaaacctggaaattaccaatacaccgtattcctgcggtctgattcttatatgggactggaccaaataaaacccctgaagttggaggtgcacgaggccaagccagtgcctgagaatcatccacaatgggacacggccatcgagggcgatgaagaccaagaggatagcgagggcttcgaggactcctttgaggaagaggaagaggaagaggaggacgacgattag

SEQ ID NO: 239798 - DNA, 2346 bp, Artificial Sequence
  Description of Artificial Sequence: Synthetic coding sequence
atggtccgcgtgcttcgtagcatgtgtctcccacagctctgctctcacattctctccgtgtgctcagggaccaccagcgaccggaatgtctactctgtcccagggagccagtatctctacaatcagccttcctgttacagggggttccagaccgtcaagcatagaaatgagaatacatgtcctctgcctcaggagatgaaggccctattcaaaaaaaagacctacgatgaaaagaaaacgtacgaccagcagaagttcgacagcgagagagctgatgggaccatcagctccgagatcaagtccgcgcgtggatcccaccatctgagcatatacgccgagaactctctcaaaagcgatgggtaccacaaaagaactgatagaaaatcaaggatcattgccaaaaacgttagcacctcaaaaccagagtttgagtttaccacattagacttccccgagctacagggagctgaaaacaatatgtctgaaatacaaaagcaacctaagtggggacctgtacacagcgtgtcaacagacatctcgctcctccgggaggtggtgaagcctgctgccgttctcagcaaaggggagatcgtggttaagaacaacccaaacgagtccgtgacagccaatgcagccacaaacagtccctcctgcaccagggagctgtcatggacccccatgggctatgtggtacgccaaactctctccacagaactgtcagctgccccaaagaatgttacaagtatgattaatttgaaaacaattgctagctccgccgatccaaagaacgtgtccataccttcctcagaagccctctcctctgacccttcctacaataaagagaaacacataatccatccaactcaaaaatcaaaggcctcccagggatccgacctggagcagaacgaggcctcacggaagaacaagaagaaaaaagagaagagcacaagcaaatacgaggtgctaaccgtccaggagcctccaagaattgaagatgccgaggagttcccaaatctggcagttgcctccgagcgtcgcgatcgcattgagacacctaagtttcaatcaaaacagcagccgcaggacaatttcaaaaataacgtcaagaagtcgcagctgccggttcagctggacttgggcggaatgctcaccgccctggagaagaaacagcatagccagcatgccaagcaatcctctaaacccgtcgtggtctccgttggagcggtgcccgtgctgagcaaagagtgtgcctcaggtgagagaggtcggcgtatgtcgcagatgaaaacaccccacaacccgcttgatagctccgcccctctgatgaaaaaaggcaagcagcgagaaatccctaaggcaaaaaagcccacaagccttaaaaaaatcattttaaaagagaggcaggagcgaaagcagcggctccaggagaatgcagtaagtcctgcatttacctcagacgacacacaggatggggagtcaggcggagacgaccaattccctgaacaggcagagctgagtggaccggaaggcatggatgaactgatcagcactcccagcgtcgaggacaagtccgaagagccccctggaacggaacttcagcgcgacaccgaggcctctcacctggccccaaaccatacaacattccccaaaattcatagccgacgatttcgggactactgtagccagatgttgagcaaggaagtcgacgcttgtgtgactgatctgctaaaggagctcgtccggtttcaggatcggatgtaccagaaggatcctgtgaaggccaagaccaagcggcgactggtgctcggactgagagaagttttaaagcatctgaaactgaaaaagctcaagtgcgtgatcattagcccgaactgtgagaagatccagtcaaaagggggtttagacgacacactccatacaattattgactacgcctgcgagcagaacatcccctttgtgttcgccttgaaccgaaaagccctgggacgcagcctgaacaaagctgttccagtatctgtcgtagggattttctcttacgatggggctcaggaccagttccataagatggtggagctgaccgtggccgcacgccaggcctacaagacgatgcttgagaatgtgcaacaggagctggtgggcgagccccgaccccaagcccctccgagcctgccgactcaaggcccatcctgcccggctgaagatggaccacccgcactcaaagaaaaggaagagcctcactatattgagatctggaaaaaacatcttgaagcctactcaggatgcacattggagcttgaagaatcactggaagcgagcactagtcagatgatgaacttgaatctctag

SEQ ID NO: 239799 - DNA, 2565 bp, Artificial Sequence
  Description of Artificial Sequence: Synthetic coding sequence
atggcttctgaggggccacgggaacctgaatccgagggcatcaagttgagtgctgacgttaaaccgttcgttccgagatttgcagggctcaatgtcgcttggttggagagcagcgaggcgtgcgtgttcccctcatctgccgctacgtactacccttttgtgcaggaaccaccagtaacggagcaaaaaatctacactgaagatatggcgtttggggcatcaacatttcctccccagtacctgtctagcgagatcacattacacccgtatgcgtactctccttatacacttgattctacacagaatgtgtattcggtccccggttcacagtacctgtacaaccagccttcctgctaccggggatttcaaactgtgaagcaccggaacgaaaacacatgccctttgccccaggaaatgaaagcacttttcaagaagaagacctatgatgagaagaagacctacgatcagcagaagtttgattctgagagagctgacggcactatctcttctgagatcaaatccgcgagagggtctcaccatctctccatttatgcagagaactctctcaagtctgatggataccataagagaaccgacagaaagagccgaattatcgccaagaacgtttctacttctaagcctgagttcgaattcaccaccctcgacttccccgagctgcagggggctgaaaataacatgtccgagattcagaagcagcctaagtgggggcctgtgcacagcgtgagtacggacatcagcctgcttcgagaggtagtcaagcccgcagccgtcctttcgaagggcgaaatcgtggtgaaaaataaccccaacgaaagtgtgaccgcgaacgccgctactaacagcccctcctgtacacgagagttatcctggacacccatgggctacgtagttcgtcagacgctgtccactgagctttcagctgcccctaagaatgttacatccatgattaacttgaaaacaatcgcttcttctgcagatcccaagaatgttagtattcccagctccgaagccctgtcttctgatccaagttataacaaggaaaagcatataattcatcccactcagaagagcaaagcatcccagggcagtgacctggagcagaacgaagccagccggaaaaacaagaaaaaaaaagaaaaaagcacaagcaaatatgaagtgctgaccgtacaggagcctccaagaattgaggatgccgaagaatttcccaatctcgcagtggcttctgagagacgggaccggatcgaaaccccgaaattccaaagtaagcagcagccgcaggataactttaagaacaacgtgaaaaagtctcagttgcctgtccagcttgatttgggtggcatgttgacggcccttgaaaaaaagcagcactcccagcatgccaaacagtccagcaagcctgtcgtcgtgtcagtcggtgcagtcccggtgttgagcaaagagtgcgcctccggggagagagggagacgcatgtctcagatgaaaacaccgcacaatccactcgatagttccgcacccctcatgaagaagggcaaacagagagagatcccaaaagccaagaaaccaaccagtctgaagaagatcatcctaaaggaacgtcaggaaaggaagcagagactccaggaaaacgctgtctctcccgcatttacatcagacgatacccaagacggcgagagcggaggcgacgatcagttccccgaacaagccgagctgagcggccctgaagggatggacgagctaatttcgacccccagcgtagaggacaagtctgaggagccccctgggaccgaactacaacgggatactgaagcttcccatttagcacccaatcacaccacctttccaaaaattcattccagaagatttcgggattattgctcccagatgttatcaaaagaggtcgacgcctgtgtgaccgatttgctgaaggaactggtgcggttccaggatagaatgtaccaaaaagatcccgttaaggctaagacaaaaagacggctggtcctgggactgcgggaggtgcttaagcaccttaaacttaagaaactaaagtgtgtgattatttcccccaactgtgagaaaattcagagcaaaggtggtttggacgataccctgcatacaattattgattatgcctgcgagcagaatatcccttttgtgttcgcactcaatcgtaaagcactggggagatcgttaaacaaagccgttcctgtgtcggtagtggggatcttcagctacgatggagcacaggaccaattccacaagatggttgagcttaccgttgctgcgagacaggcctataagacaatgttggagaatgtgcaacaggaacttgtgggagagcctagacctcaggcccctcccagcttgcccacgcaggggcctagctgccctgctgaggacggccctcccgctttgaaagagaaggaggagccccactacatagagatatggaaaaagcacctggaggcttactccggatgtactctggaattggaggaatctttggaagccagcacatctcagatgatgaatcttaacctctag

SEQ ID NO: 239800 - DNA, 2583 bp, Artificial Sequence
  Description of Artificial Sequence: Synthetic coding sequence
cccgcttcaagacggcctgcggctgggttaagggatgctgccagttctgccccaagaggaatggcatccgagggacctagagagcccgagtccgagggcattaaactgtccgccgacgttaagcctttcgtgccacgctttgcaggtctgaatgtcgcgtggctcgagtcatctgaggcttgtgtcttcccttctagcgccgcaacctattaccctttcgtgcaggaacccccagtcactgagcagaagatctacacagaagacatggcatttggcgcttcaacattccccccacagtatctgtcatccgagatcaccctgcacccatatgcatactctccgtataccctagatagcacacagaacgtgtatagtgtgcccggaagtcagtacttgtacaatcaaccatcttgttataggggtttccagactgtcaaacaccgaaacgaaaacacgtgtcccttgccccaggagatgaaggccctgttcaaaaagaagacttacgacgaaaaaaagacttacgaccagcagaagttcgacagtgaaagggcggacgggaccatctcctcagagatcaaaagcgctagaggaagccatcacttgtccatttacgctgagaattctctaaagtctgatggctatcacaagcgaaccgaccggaaatctcgaatcatcgcaaagaatgtgtcaacaagtaaacctgaatttgaatttacaacacttgactttcctgaacttcagggagctgaaaataatatgtccgagattcagaaacagcctaagtggggacctgtgcactccgtttcaacagatatcagtctgctccgcgaggtggtcaaacccgctgctgttttgtccaagggtgaaatcgtagttaaaaacaatccaaatgagtcggtgttgatgcctctcccaatcctgctgcatgttcaggagacgcttagcaccgaactgtccgccgcacccaaaaatgtgactagtatgataaaccttaaaaccatcgccagctcagctgatccaaaaaatgtgagtattccctcctccgaagcattatcctccgatccaagctacaacaaggagaagcacataattcatcccacccagaagtcaaaagcatctcagggctctgatctcgaacagaacgaagccagcaggaaaaataagaaaaaaaaagagaaatccaccagcaaatatgaagtactgaccgtccaagaaccccctaggattgaggatgctgaggagtttcccaacctcgcagtggccagcgagcggagagatcgtattgagactccaaaatttcaatctaaacaacaaccccaggacaattttaagaataatgtgaaaaagagccagctgccagtgcagctggacttagggggtatgctcacggcactcgagaaaaagcagcactcccagcacgcgaagcagtcatccaaaccggtggtggtatcggtgggagctgtgcctgtcctgagcaaggagtgcgccagcggagagcgcggacgcagaatgtcacagatgaagactcctcacaatcccctggatagctctgcacctctcatgaagaaggggaaacagagagagatccctaaagctaaaaaacctaccagtctgaagaagatcatcctgaaggagaggcaagaacggaaacaaagactgcaggagaatgctgtgtctcctgcctttacatccgatgacacacaggatggagagagcggtggggacgatcagtttccagagcaggccgagctgtccggacccgaagggatggatgagctcatctcaaccccctccgtcgaggacaaatcagaggagcctcctgggacagaactccaacgggatacagaggccagtcacttggctccaaaccacaccacattccccaaaatacatagccggaggttcagggactactgctctcagatgctgagcaaagaggtggatgcttgcgtgaccgacctcttaaaagaattagtgcggttccaggaccgtatgtatcagaaggatccggtgaaggctaagaccaagaggcggcttgtcctgggtctgcgagaggttctgaaacatctgaaattgaagaagctgaagtgcgtaattatcagccccaactgcgaaaagatccagtccaaaggcggactcgatgatactctgcacactatcattgactacgcctgtgaacagaatattccctttgtctttgctctgaatcgaaaggctctcggaagatcactcaataaggcagtgccggtctctgttgttggaatattcagttacgatggggctcaggatcagttccacaaaatggtcgagcttacagttgctgcccgacaggcctacaaaaccatgcttgagaatgtgcagcaggagctagttggtgaacctcgcccacaggccccaccctcgctcccaacacaggggccatcctgtccagccgaagacggtccacctgccctcaaggagaaggaggaaccccactatattgagatatggaagaaacacctggaggcctatagtgggtgcactttggaacttgaagagagcctcgaagcatccacgtcccagatgatgaaccttaatctgtag

SEQ ID NO: 239801 - DNA, 828 bp, Artificial Sequence
  Description of Artificial Sequence: Synthetic coding sequence
gggaccatatcatcagagattaagagtgctcgtgggagtcatcacctatccatctacgccgagaatagtctcaagtcagacggttaccacaaacgcactgatcgaaagagccgaatcatcgcaaagaacgtctcgacatcaaagcccgagttcgaattcacaacacttgatttccccgaactccagggagctgaaaacaatatgagcgaaattcagaagcagcctaaatggggccctgtccatagcgtttcaactgatatttccctcctccgcgaggtggttaaacctgctgcagtcctttctaagggagaaatcgtggtcaagaacaaccctaacgaaagcgttacagccaatgctgccacaaactctccctcatgtaccagagcggaccctaaaaatgtgagcattccctcaagtgaagcacttagttccgacccatcatacaacaaggagaaacatattatccacccaacacagaagagcaaggcatctcagggctccgatctggaacagaacgaggcctctcgcaagaataaaaagaaaaaagaaaagagtacgagtaaatacgaggtcctgacagtgcaagaacctccaaggattgaggatgccgaggagtttccaaatctggctgtcgcctccgagagacgtgaccgaatcgagaccccaaagtttcagtcaaagcaacagccccaagacaactttaaaaacaatgtgaagaaaagccagctacccgtgcagcttgatttaggaggcatgctaacagcccttgaaaagaagcagcacagtcagcatgcgaagcaatcatctaagcctgtcgtggtttcgtag

SEQ ID NO: 239802 - DNA, 183 bp, Artificial Sequence
  Description of Artificial Sequence: Synthetic coding sequence
atgcccctgcccatcctgctccacgtgcaggaacagatactcaagatgttagtctatcacctcctgaagttgtatctgcgcattctgcccacgactaagaaaaatacgctgtttattttgcctaagtctcttaaacatcataaggtggtgactctaaataagatgaaacctcaggagcggtag

SEQ ID NO: 239803 - DNA, 2361 bp, Artificial Sequence
  Description of Artificial Sequence: Synthetic coding sequence
atggcgttcggcgcttctacatttcccccacagtacttaagctccgagataaccctgcatccctatgcttacagcccatatacacttgactctacccaaaacgtatactccgtgccaggctcccaatacctttataatcagcctagctgctatagaggcttccaaaccgtgaaacatcgcaatgagaacacttgcccgctgccccaggaaatgaaggcgctgtttaaaaagaagacctacgatgaaaagaagacatacgaccaacagaagtttgatagcgaacgcgctgacggcaccatcagctccgagatcaagagcgctcggggttctcaccacctaagcatatatgcggagaattcattaaagagcgacggataccacaaaagaaccgaccgtaagagcaggataattgccaagaacgtgtccaccagtaaaccagagttcgaattcaccaccttagatttcccggagcttcaaggggctgagaacaacatgtcggagattcagaagcagcctaaatggggtccagtacattcggtgtcaactgatattagtttgctccgagaggtagttaagccggctgccgtgctgagcaaaggcgaaatagttgtgaagaataacccgaatgagtccgtgactgccaacgcggctactaattcacccagttgcacgcgggagctctcctggacccccatgggatacgttgtccggcagactctgagcacagagctgtcagccgctcctaagaatgtgacatctatgatcaatctgaaaactatcgcttccagcgcggacccaaagaacgtgtctatccccagctccgaggccctcagcagtgacccaagctacaacaaagagaagcacatcatccatcccacccagaagagcaaggcatctcaagggtctgaccttgaacaaaacgaagctagccggaaaaataaaaaaaaaaaggagaaatctacttcaaagtatgaggttctcaccgtgcaggagcctccacgcatcgaggatgccgaggaattcccaaacctggctgtggctagtgagaggagggaccgtatagaaacacccaaattccaatctaaacagcaaccccaagacaacttcaaaaataatgtgaaaaagagccaactacctgtccagctggacctgggtggaatgctgacagccctggagaaaaagcaacactcacagcacgcaaagcagtccagcaaaccagtcgttgtttccgtcggagcagtgcccgtgcttagcaaggagtgtgcaagtggagaacgcggtcgtcggatgtctcagatgaagacaccccacaaccccctcgacagctctgcacctctgatgaaaaaaggaaagcaaagggagatccccaaagctaaaaaaccaacaagtctgaagaagatcatcttgaaggagcgccaagagagaaaacaaaggctccaagaaaacgctgtgagccctgccttcacctccgatgatacccaggatggggagagtggtggggacgatcagttccccgagcaagccgagctttctggtccagaaggtatggatgaattaattagtactccatccgtagaagataagtcagaggagccacctgggacagaacttcaacgagatacagaagcaagtcatctcgcacccaaccacaccacctttccgaaaattcactcaaggcgctttagggactactgctcgcagatgctttcgaaggaggtggacgcctgtgttactgatctcctgaaagagctcgttcgcttccaggacaggatgtaccaaaaggatccagtgaaagccaaaacaaaaaggcggctggtgctaggactgagggaagtcctaaagcacctgaagttaaagaaattgaaatgcgtgattatttctcccaattgcgaaaagatccagagcaaaggtggtctggacgacaccctccacacaattatcgactacgcctgtgagcagaatatcccttttgtgttcgccctgaacaggaaggccctgggtaggtcgcttaataaggcagtacccgttagtgtggtggggatcttttcatatgacggcgctcaggaccagttccataagatggtggagctcaccgtggcagctcgccaggcgtataaaacgatgctggaaaatgtgcagcaggagctcgtgggggagcctcgccctcaagcacccccttccctgcctacacaaggcccatcctgccctgcagaagacggccctcctgccctcaaggagaaagaagagccacactacattgagatttggaaaaaacacttggaagcctactctggctgtaccttggagctggaggaaagtctggaggccagcaccagccagatgatgaacctgaacttatag

SEQ ID NO: 239804 - DNA, 747 bp, Artificial Sequence
  Description of Artificial Sequence: Synthetic coding sequence
atgcagacctgccccttagcattccccggacacgtaagtcaagctcttggcacactcttatttctcgcagctagtctgtccgctcagaacgagggatgggacagccctatatgcacagaaggggtggtgtccgtttcatggggagaaaacactgtaatgagctgtaatatcagcaacgctttcagccatgtgaacatcaagcttcgagctcacgggcaggagagcgcaatctttaatgaggtagcacctgggtacttctctcgcgacggctggcagcttcaggtgcaggggggtgtggcccagctggtcattaaaggcgctcgtgactcccacgccggtctctacatgtggcacctggtgggtcaccagagaaataacagacaggtcacactcgaagtctccggggcagagccccagagcgcaccagatacaggtttctggccagtccccgctgttgtgaccgccgtgtttatactgcttgtggcactggtgatgttcgcatggtataggtgtaggtgttcacagcaacgcagagaaaagaagttttttttgcttgagcctcagatgaaggtggcggcattaagagccggtgcccagcagggactgtcaagagcgtcagctgagttgtggacaccagattccgagccaacgcctcggccactggctctggtttttaagccctctcctctgggtgctttggagctactatccccacagcccctcttcccctacgcagcagacccatag

SEQ ID NO: 239805 - DNA, 888 bp, Artificial Sequence
  Description of Artificial Sequence: Synthetic coding sequence
atgcttcaaggacctggctccctgctgctgctgtttctagctagccactgctgtctaggatctgctcgagggctgttcctgttcggacagcctgacttttcctacaagcgtagcaactgtaagcctatccccgctaacttgcagctgtgccacgggatcgagtatcagaacatgaggttgcctaatctcttaggtcacgagaccatgaaggaggtgctggagcaggcaggagcatggatccctctggtgatgaaacagtgtcatcccgacacaaaaaagtttttgtgttccctttttgccccagtgtgtttggatgacctggatgagactatccagccctgccacagcctctgtgtccaggtgaaagacagatgtgccccagtgatgtctgctttcggctttccgtggcccgacatgctggagtgtgaccgattcccccaggacaatgacttatgcattcccctggcaagctctgatcacttacttcctgccaccgaagaggcacctaaggtgtgcgaagcttgtaaaaataagaacgacgatgataatgatattatggaaactctctgcaagaatgactttgctctcaagataaaagtaaaggagattacctatataaatagagataccaaaattattctcgaaaccaagtcaaagactatctacaaactgaatggagtctctgagcgtgacctaaaaaagagcgtgctttggctcaaggatagcctgcaatgtacatgtgaggagatgaatgacataaatgccccttatctggtcatgggccagaaacaggggggagagctggtcatcaccagcgtgaaaaggtggcaaaaggggcaaagggaattcaagcgtatttctcggtctataaggaagctgcagtgctag

SEQ ID NO: 239806 - DNA, 312 bp, Artificial Sequence
  Description of Artificial Sequence: Synthetic coding sequence
atggccagtagatgggctgtgcagctgttgctagttgcagcctggagtatgggttgcggagaggcacttaagtgttatacttgcaaggagcccatgacctctgcttcttgcagaaccattactagatgcaaacccgaggatacagcttgtatgacaactcttgttactgttgaggcagaatatcccttcaaccagagcccagtcgtaaccagaagttgctccagtagttgtgtggcaactgatcccgactctatcggtgccgctcacctgattttctgttgtttcagagatctgtgtaactctgagctttag

SEQ ID NO: 239807 - DNA, 636 bp, Artificial Sequence
  Description of Artificial Sequence: Synthetic coding sequence
atgatttcaaggatggaaaaaatgaccatgatgatgaaaatactgatcatgtttgccttggggatgaattactggtcctgtagtgggttccccgtttatgattacgatccttcatcattgagagacgctctttccgcgtctgttgtgaaggtgaactcacaatccctctccccatatctgttcagagcgttccgctctagcctcaagagagttgaagtgctggatgaaaacaatctggttatgaatcttgagttctctattagagaaactacgtgccgaaaggacagcggagaggatcctgctacctgtgcctttcagcgcgactactacgtgagcaccgcagtttgtcggtccacggttaaggtctcggcacaacaggtccagggagtgcacgcccgatgttcctggagctcttccacttctgagagttattcaagcgaagagatgatctttggcgatatgttaggctctcacaagtggaggaataattatcttttcggactaatttccgatgaatcgataagcgaacagttttacgatcgctctttgggaatcatgcgaagggtcctcccacccggtaatcgaaggtacccgaaccacaggcacagggcccgtataaatacagacttcgagtag

SEQ ID NO: 239808 - DNA, 636 bp, Artificial Sequence
  Description of Artificial Sequence: Synthetic coding sequence
atgatttcaagaatggaaaaaatgaccatgatgatgaagatcctgatcatgttcgcactcggcatgaattattggtcctgtagtggctttcccgtatacgattatgatccttccagtctgcgggatgccttatctgcctcagttgtcaaggtgaattcgcagagcttaagcccttatctgtttcgggcatttcgttcgagcctgaaaagagtcgaggtgctagatgagaataatctggtcatgaatttggagttttcgatcagagaaaccacgtgtcgcaaagactcgggtgaggatccagccacatgcgcattccaacgagattattacgtgtctaccgcagtgtgtcggagcacagtgaaggtcagtgcccagcaggtccagggtgtacatgccaggtgttcatggagtagttccacaagcgagagctatagttctgaggagatgattttcggcgatatgctgggctcccacaagtggcggaacaactacctctttggattgatcagcgacgagtccatttccgagcaattttatgatcggtctttgggaattatgagaagggtgttgccgcctgggaatcggagatacccaaaccatcgccatagggctcgtattaatacggacttcgagtag

SEQ ID NO: 239809 - DNA, 366 bp, Artificial Sequence
  Description of Artificial Sequence: Synthetic coding sequence
atggccccacgaccactactgttactgctgttgctgctgggaggatcagccgcaaggcctgctccacctcgagccaggaggcattctgatgggacttttactagcgagctttctcgactcagagagggcgcaaggctccagaggctgctgcagggtttggttgggaagcgaagcgagcaagacgcagaaaattccatggcttggacccggctgtccgctgggcttctctgcccaagtgggtcaaacatgcccattctgcaagcatggatgccccttgacggcacttggtcgccatggctgcctcctgggccaatggtctcagaacctgcgggtgccgcagccgagggaaccctgaggcccagatag

SEQ ID NO: 239810 - DNA, 1323 bp, Artificial Sequence
  Description of Artificial Sequence: Synthetic coding sequence
atgcgtccacatctatcccctccgttacagcagctgctcctcccagtactcttagcctgcgctgcacattctacgggagcattacccaggctttgcgatgtcttacaggttctatgggaggagcaggaccagtgcctgcaggagctttctcgagaacagaccggagatctgggaactgaacagcccgtgccagggtgcgaaggcatgtgggataacataagctgttggccatctagcgtaccaggcagaatggttgaagttgagtgccccaggtttctcagaatgctcacatcccgaaacgggagtctctttcgaaattgcacacaggacggctggtcagagactttccctcgaccgaacctggcatgcggcgtcaacgtcaacgatagctccaacgagaagcgacacagctacttgctcaagctgaaagtcatgtatactgtcggatacagcagctccctggtaatgctgttggtggccttggggatcttatgtgcttttcggcgtcttcattgcactcgtaattacattcacatgcacctgtttgtgtcttttatcctacgggcactttctaactttattaaagacgccgtactcttttcttctgacgacgtgacatattgcgatgcacacagggcaggctgtaaactggtaatggtccttttccagtactgcatcatggcaaattactcttggctgcttgtggagggcctctacctacacactctgctcgcgatctcattcttctccgagcgcaaatacctgcaggggtttgtggccttcggctggggcagtcccgcaattttcgtcgcactgtgggcaattgccagacactttctggaggatgtggggtgttgggacattaatgcaaatgctagtatctggtggattatccgcggacccgtgatcctgtccatcctgattaactttatcctctttatcaacatactccgaatattgatgcggaaactccgaacccaggaaactagagggaacgaggtgagtcactataagagactggctaggtcgaccttgcttctgataccactgttcggcattcactacatcgtatttgctttttcgcctgaagatgctatggaaattcaactgttcttcgagctggccctggggagctttcagggattggtggttgctgtcctttactgcttcctcaatggcgaggtgcagctcgaggttcaaaagaaatggcagcagtggcacctgcgtgaatttcctttgcacccagttgcgagcttctctaattcgaccaaggcgagtcatttggaacagtcacagggaacgtgtcgaactagcatcatctag

SEQ ID NO: 239811 - DNA, 288 bp, Artificial Sequence
  Description of Artificial Sequence: Synthetic coding sequence
atgaaactgctgatggtgctgatgctggctgccctgctactacactgctacgccgatagcgggtgtaaattgctcgaggatatggttgagaagacaatcaactcagatattagtatccctgagtacaaggaacttttgcaggagtttatcgattcagacgcagccgctgaggccatgggaaaatttaagcagtgtttcctgaaccaatcgcacagaacactaaagaatttcggactgatgatgcacaccgtgtatgatagcatctggtgtaatatgaaatccaattag

SEQ ID NO: 239812 - DNA, 1746 bp, Artificial Sequence
  Description of Artificial Sequence: Synthetic coding sequence
atgcctgctcccagggctcgagaacagccgagagtgccaggggaacgtcagccactactcccacgcggagcgaggggacccagacgatggcgcagggctgctggggctgccgtgttactggtcgagatgctggagagagccgctttcttcggtgtgaccgctaatctggtactctacctaaacagcactaatttcaactggactggcgaacaggcaaccagagctgccctagtgttcctgggcgcatcttacctactcgctcctgtggggggatggctcgccgatgtgtacctgggacggtaccgggcagtggctctgtcgctcctgctgtatttagcagccagtggcctgcttccagctaccgccttccccgacggacgatcaagtttctgcggcgagatgcccgcttcgcccctcggccctgcttgtccttccgccggttgccccaggtctagcccatccccctactgcgcacccgtgctgtacgccggactcctgctgctgggactggccgcttcaagtgtccgtagcaatctgacaagcttcggcgctgatcaagtgatggacctggggagggacgctactagaagattctttaactggttctattggtccatcaatctgggcgctgtactatcacttctggtcgttgcatttatccagcagaatatcagctttcttctcggctatagcatacctgtcgggtgcgtcgggttagcgttcttcattttccttttcgcaacacccgtctttattacgaagccccctatgggatctcaggtctcatctatgctaaaactcgccctccagaattgctgcccacagctgtggcagaggcacagtgccagggaccggcagtgcgcgagagtgcttgccgacgaaaggtcaccccagccaggcgcatccccccaggaagacatcgctaatttccaggtgctggtcaagattctccccgtcatggtgacactggtcccatactggatggtctatttccagatgcagtccacatacgtgctgcaagggttgcacctgcatattcccaatattttccctgcaaatcccgctaacatctcagttgccctgagagcacagggatccagttacaccattcccgaggcctggctgcttctggccaacgtcgtcgtagtccttatactagtgccactgaaagatcgcctcatcgacccattactgctcagatgtaagctgctccccagtgctctacagaagatggccttgggtatgttcttcggcttcacctccgtgatcgtcgccggagtactggaaatggagagactccactacatccaccataacgagaccgtttcgcagcagataggtgaggtgctgtataacgccgctcctctgtccatatggtggcagatcccgcagtatctcttaataggaatcagcgaaatcttcgcaagcatccccggattggaattcgcatattcagaggctcccagaagtatgcaaggcgctattatgggaatctttttttgtctgtcaggggtgggaagcctattaggcagtagtcttgtagcactgctgagccttcccggtggatggttacattgtccgaaggattttggcaatataaataattgcaggatggacttatacttcttcctgctggctgggatacaggccgtgactgctcttctgttcgtctggatcgccggtcggtatgaaagagcctctcagggtccagcttcccactcacggttcagtcgcgacagaggatag

SEQ ID NO: 239813 - DNA, 363 bp, Artificial Sequence
  Description of Artificial Sequence: Synthetic coding sequence
atgaaactcctgatggtcctcatgctggcggctctgagtcaacattgttatgctggcagtggttgtccactgctagagaatgtgatatccaagaccatcaacccgcaggtgagtaaaactgaatataaagagctgttgcaggagttcattgacgataatgcgaccactaacgctatagacgagctgaaagaatgctttctgaatcaaacagatgagacattgtcaaatgttgaggtgtttatggtgatctctttttcgagctacaaactgttcaagtcgcccgatcaaggacaggttggatctagttttctcactgataacgctaaggcgacttccgagcaggccttctcttatatcggttag

SEQ ID NO: 239814 - DNA, 315 bp, Artificial Sequence
  Description of Artificial Sequence: Synthetic coding sequence
atgaagctcgccgctttgcttggcttgtgcgtcgccctgtcatgcagctctgctgctgcattcttggtgggaagcgctaagcctgtggctcaaccggtcgcagccctcgagtcagctgctgaagctggagcaggaaccctcgcgaaccctctgggaacactcaatccactaaagctactactgtcaagcttggggatacccgtgaatcatctgatagaggggtcccagaagtgtgtagcagagcttgggccacaggccgttggagctgtcaaggccctcaaagcactgctgggggctcttaccgtatttgggtag

SEQ ID NO: 239815 - DNA, 282 bp, Artificial Sequence
  Description of Artificial Sequence: Synthetic coding sequence
atgaagctcgtgaccatcttcttgttagtgacgatcagcctctgctcctactcggcaaccgcttttcttattaataaggttcctctccccgtggataagctagctccattaccactcgacaacattctgcctttcatggacccactgaagcttctgctgaaaacactgggcatctcagtggaacacctggtggagggactaagaaagtgcgtgaatgagttgggccctgaagcctcagaggccgtcaagaaattactggaggccctgagtcatttggtttag

SEQ ID NO: 239816 - DNA, 1854 bp, Artificial Sequence
  Description of Artificial Sequence: Synthetic coding sequence
atggctgaagctaaaactcactggctgggtgccgcactgagccttatccctctgatttttctcataagtggtgccgaggcagcgagttttcaaaggaaccagcttttacagaaagagcctgacctcagattagagaatgtgcagaagtttccaagtcctgagatgatacgcgctctcgagtacatagaaaatctcagacaacaggcccataaggaagaatcaagccccgattacaacccttaccagggcgtgtcggtgccgctacagcaaaaggagaatggtgacgagagccacctgccggaacgagactcgctcagcgaggaggattggatgcggataatccttgaggccctgcggcaggccgagaatgagccacaatcagcccctaaggaaaacaagccctacgccctcaactcagagaaaaattttcctatggacatgtctgatgactacgaaacccaacaatggcccgagcggaagctgaaacatatgcagtttccgccaatgtacgaggagaattctcgagacaatccatttaaacggaccaatgagatagtagaagaacaatatacgcctcagtccttggccacccttgagtctgtctttcaggagttaggtaagttgactggccctaacaaccagaagcgcgagcgcatggacgaagaacaaaagctgtacacggatgacgaggacgacatttataaagctaacaacatcgcatacgaggatgtcgttggaggggaagactggaaccccgtggaggagaaaattgaatctcaaacacaggaagaagtcagagattctaaggaaaacatcgagaagaacgagcagattaatgatgagatgaaacggagcgggcagctcgggatccaggaagaggacttaaggaaggagtcgaaggatcagctctcagacgacgtgagtaaagtcattgcctatcttaaacggctagtcaacgccgcaggatctggcagattacaaaacggccagaatggggagcgcgctacccgcctgttcgagaaaccactcgactctcaatctatttaccagctgattgagatttcccgaaacctgcagatccccccagaggatctcattgaaatgttaaaaactggggaaaaaccaaatggatctgtggagcctgaaagagagttggacttgcccgtggacttggacgatattagcgaggccgacctagatcaccccgacctattccagaaccggatgctgagcaagtctggctatccaaaaactccaggacgggctgggacggaagccctaccagatggcctgagtgtggaggatattcttaatctgctggggatggagagtgccgctaaccagaagacttcctatttccctaacccatataatcaggaaaaagtgctccccaggttgccatatggcgctgggagatctaggtccaaccagttgccaaaggccgcttggattccccacgtggaaaacaggcaaatggcatacgagaatctgaatgataaggaccaggagttaggtgagtatttagcccgaatgttagtaaaatatccggaaatcattaactcaaatcaggtgaaaagggtccccggtcagggctcctctgaggatgatcttcaagaagaagagcaaatcgaacaggctatcaaggagcacctgaaccagggttcgtcccaggaaaccgacaaactcgctcccgtatcaaaaagattccctgtcgggccacccaagaacgacgataccccaaataggcagtactgggacgaagacctgcttatgaaagttctcgaatacctcaatcaggagaaagcagagaagggaagggagcatatcgctaaacgggcaatggagaacatgtag

SEQ ID NO: 239817 - DNA, 435 bp, Artificial Sequence
  Description of Artificial Sequence: Synthetic coding sequence
atggccgaggccaaaacacattggttgggcgctgcactctcattgatcccattaatcttcctgatatcaggggctgaagccgcttcctttcagaggaatcaactgctgcagaaggagcctgatctgcgcctcgagaacgtgcagaagtttccaagccctgagatgattcgtgcgctcgagtacattgaaaacctgcgtcagcaagcccataaggaggaatcatccccagactataatccatatcagggtgtgtctgtgcctctccagcagaaagagaacggcgacgaaagccacctaccggaaagggattccctatccgaagaagactggatgagaattattcttgaggccctgaggcaggctgagaatgaaccccagtctgcccctaaagagaataaaccatacgccctcaattccgagaaaaatttcccctag

SEQ ID NO: 239818 - DNA, 378 bp, Artificial Sequence
  Description of Artificial Sequence: Synthetic coding sequence
atggcagaagcaaagactcactggcttggagcggcacttagtctcataccgcttatattcctcatcagcggcgcagaagccgcttcttttcagagaaaccagctgctgcagaaagagccagacctccggctcgaaaacgtacagaaattccctagccccgaaatgattcgagcattagaatacatagaaaatttgagacaacaggcgcacaaggaagagtctagcccagactataacccgtaccaaggggtgagtgttcctctgcaacaaaaggagaatggcgacgagagtcacctccctgagcgagactcactgagcgaggaggactggatgcgcattatactcgaagccttgcgccaggctgagaatgagccatag

SEQ ID NO: 239819 - DNA, 1434 bp, Artificial Sequence
  Description of Artificial Sequence: Synthetic coding sequence
atggctgaggctaaaacccattggcttggcgcagcgctttctctgatccctcttatctttctcattagcggtgcagaagccgcatcctttcagagaaatcagctgctccaaaaggaacccgaccttcgattagagaatgtccagaaattccccagccccgagatgatccgggctttggagtacatcgagaatctgcgacaacaggcccataaggaggagtcttccccagactacaatccatatcagggtgtgtctgttcctctgcagcaaaaagagaacggagatgagtcacacttacctgaaagagactctcttcgcggagaagattggaatcccgtagaggagaagattgagtcccagacacaagaggaggtacgagactctaaggagaacatcgagaagaatgagcagatcaacgacgaaatgaagcgaagtggacagctcggaatccaggaggaggacctgagaaaggagtcaaaggaccaactgagtgatgacgtctccaaggtgatcgcctacctgaaaaggctcgtcaacgctgcagggtctggccgattgcagaacggccagaacggggaaagagctacaagactgttcgaaaaacccctagacagccagtctatatatcaattgatagagatatcacgcaacctccagattccaccagaggatctaatcgagatgttgaaaacaggcgagaagcctaatggctcggtggaaccagaacgagagctagacttgcccgtcgatttagatgacatctcagaagcagatttagaccacccggatttatttcaaaatcggatgctctctaaatccgggtatcctaagactccgggaagggccggaacagaagcgttaccagacggattgagtgtggaagatatcttgaatctcttaggcatggagagcgctgcgaaccagaaaacttcatacttccctaacccttataatcaggagaaggtcttacctcgactgccatacggcgctggaaggtcccgttccaaccagctgccgaaagccgcttggattccacatgtggaaaataggcagatggcctacgagaatctgaacgacaaggatcaggaattgggcgagtacctagccagaatgctggtaaaatatccggagatcattaacagtaatcaagtgaaaagagtgcccggacagggatcatccgaggatgatctccaggaagaggaacaaattgaacaggccatcaaggaacacctgaaccaggggtccagccaggagactgacaaactcgctccagtttctaaacgcttccccgttggaccgccaaagaacgatgacacccctaaccgtcagtattgggacgaggatctgctgatgaaggtcctggaatacctgaatcaggagaaagcagagaaaggcagggaacacattgctaaacgggctatggagaacatgtag

SEQ ID NO: 239820 - DNA, 390 bp, Artificial Sequence
  Description of Artificial Sequence: Synthetic coding sequence
atggaacccagccagtgcgtggaggagttagaggacgacgtgtttcagcctgaagacggtgagcccgtaacccagcccggtagcctcctgagtgccgacctcttcgcccagagcctcttggactgccctctcagtaggctgcagctcttccccctcacccactgctgcggacctgggttgaggcctacctcacaggaagacaaagccacacagaccctgagccccgcttcaccttcacagggcgttatgttgccttgcggagtgacggaagaaccacaaaggttattctatgctcctgctgaacctaagtcttgtgtagttgctgaccccccactaccggctcaaccctgttttgaatggcggagggagcaggagagaggtcgaccctag

SEQ ID NO: 239821 - DNA, 711 bp, Artificial Sequence
  Description of Artificial Sequence: Synthetic coding sequence
atggcggcaatccaggatggcctggcaaagggtgagaatgatgagaccgttagtaataccctcaccctgacgaatgggctggagcggcgtacaaagacttactccgaagacaacttcgaggaactgcagtactttcctaatttctacgctttgctgaagtccattgactcagaaaaagaggctaaggaaaaggaaaccctgatcacaatcatgaaaaccctgattgattttgtgaagatgatggtcaaatatgggactatttcgcctgaagagggggtctcctatctcgagaacttggatgaaatgatcgccctgcaaacgaagaacaaacttgaaaagaacgcaaccgataacatcagcaaactgtttccagcaccaagcgaaaagtcccacgaagaaaccgattcgaccaaagaagaggctgcgaagatggagaaggaatatgggagtctgaaggactctacaaaagatgacaactccaaccctggaggcaaaaccgacgagcctaaagggaagactgaagcctacttagaggcaattcggaagaacatcgagtggctgaagaagcacgacaaaaagggaaacaaggaagattacgacctctcgaaaatgcgggattttatcaacaagcaggcagacgcttatgtggagaaaggcatcctggacaaggaagaagccgaagcgattaagcgtatttatagttccctttag

SEQ ID NO: 239822 - DNA, 174 bp, Artificial Sequence
  Description of Artificial Sequence: Synthetic coding sequence
atggcagcaatccaagatggattggcaaaaggcgaaaacgacgaaactgtctccaacacactaactctgacaaatgggctggaacgcaggactaaaacttacagcgaagataacttcgaggaattgcagtatttcccaaacttttatgcactcctgaagtccatagacagttag

SEQ ID NO: 239823 - DNA, 990 bp, Artificial Sequence
  Description of Artificial Sequence: Synthetic coding sequence
atgagtgcgttcgacactaaccccttcgccgaccccgtcgatgtgaatccattccaggatccgtccgtgacacagttaactaatgccccacaagggggtctggctgagttcaatccattcagtgaaacgaacgcagcaacaaccgtgcccgtcacccagcttccaggctcttcccagccagctgtactccaaccttccgtcgaacctacacagccaaccccacaggctgtggtatcagccgcacaggccggtttattgcggcagcaggaggaattggatagaaaggccgctgagcttgaaagaaaagagcgggagctgcagaacacggttgcaaatctccacgtaagacaaaacaattggccacctcttcccagctggtgtccggtgaagccatgtttctaccaggacttttctaccgaaatccctgcagattatcagagaatatgcaaaatgctgtattacctatggatgctacacagtgtgacactgttcttgaatctactcgcttgtctggcctggttttcaggtaactcatccaaaggtgttgacttcggactatccatcttgtggtttctgatcttcacaccttgcgccttcctatgctggtataggcccatctacaaggcttttcggtctgataactccttttctttctttgtctttttcttcgtgtttttctgtcagataggcatttatataatccagttggtggggatcccaggtctcggagattctggatggatcgccgcactgtccaccttagataaccactcactcgctattagcgttattatgatggtggtggctgggttcttcactctgtgtgccgtcctgtctgtgtttttacttcagagggtgcactccttatatcgccgaaccggtgcctccttccagcaggcgcaagaagagttttcccagggtatttttagctcccggaccttccaccgggcagcctcttcagccgctcagggagcgtttcagggaaattag

SEQ ID NO: 239824 - DNA, 864 bp, Artificial Sequence
  Description of Artificial Sequence: Synthetic coding sequence
atgtctgcatttgatacgaacccatttgccgataccaacgctgcaacaaccgtgccagtgactcaacttcctggctcgtcccagccagccgtgctgcaaccctcagtcgagcccacacagccaacaccacaggccgttgtaagtgccgctcaggcaggcctgctgagacagcaggaggagctggatcggaaagccgcagagcttgaaaggaaggaacgtgagctgcagaatacggtggccaatctccacgtgcggcagaacaactggcccccactgccatcttggtgtccagtgaagccatgcttctatcaggatttctcaaccgagatccccgcagattatcaaagaatctgcaagatgctgtattatctgtggatgctgcacagtgtgacactttttcttaatctgcttgcatgcttagcgtggttttcaggtaactcctccaagggcgtggattttggcctctcaattctgtggttcctgatctttaccccatgtgcctttctgtgctggtatcgcccaatctataaggcgtttaggagcgataactcattttcattcttcgtgtttttcttcgtgttcttctgtcagatcggcatctacattatacaactggtgggcatccctggtctcggggattcaggatggatcgctgccctgtcaaccctggacaatcattcccttgcaatctcagtgattatgatggtggtggcaggcttctttacgctttgcgctgtgctgtcggttttcctcctccagcgcgtgtctggcgtcggccgagcagattccaaatgggaagaggccggaaatcgtttcctgccgctgcctcgcgatgttttccatcactgtagctgggctagttag

SEQ ID NO: 239825 - DNA, 1044 bp, Artificial Sequence
  Description of Artificial Sequence: Synthetic coding sequence
atggctcagtcaagagacggcggaaatcctttcgctgagccctctgagctcgacaatccgttccaagaccctgcggtcattcaacatcgcccatctcggcaatacgcaacgctggacgtctacaacccctttgagactcgagagccgcctcctgcctatgagccccctgcccctgctcctcttccgccaccctctgcccctagcttacagccaagtcgtaaattgtctcccacagagcctaagaattacggcagctactctactcaggcttccgccgctgcggctactgcagaactgttaaagaagcaggaggagctcaatcgtaaggccgaagaactagatcgccgagagagggaactccagcatgcagctctcgggggaaccgccacgagacagaacaattggcccccactcccctctttctgccctgtgcagccatgcttttttcaggatatctctatggaaatacctcaggagtttcagaagaccgtttccacaatgtactacctctggatgtgttccaccctagccttgctgttaaattttcttgcatgtttggcgtcattctgtgtagaaactaacaacggggcaggtttcgggctgagtatcctttgggtcctcctcttcacaccctgctcttttgtgtgctggtatcgccctatgtataaggcttttagaagcgactccagcttcaacttcttcgtgttcttcttcattttttttgtgcaagacgtgttgttcgttctccaagccatcggcattccaggctggggattcagcggctggatctccgctctggtggtgccgaagggtaatacagcggtttctgtcctaatgctgttagtagcgctgttgttcaccgggatagccgtcttagggatcgtgatgttgaaaagaattcatagcctgtatagacgcactggcgcttcttttcagaaggcccagcaggagtttgccgcaggtgtctttagcaatcctgctgtgcgcaccgcagccgctaacgcagcggctggcgcagcagaaaacgcctttagagccccttag

SEQ ID NO: 239826 - DNA, 966 bp, Artificial Sequence
  Description of Artificial Sequence: Synthetic coding sequence
atggctcagagcagggacgggggaaatcctttcgccgagccttccgagctggataatccctttcagccaccaccagcctacgagccacctgcccctgctccacttcctcctccatcagctccttctctccagcctagcagaaagctgtcacccactgaaccgaagaattacgggtcatattcgactcaggcttctgccgctgccgctactgcagagttactgaagaagcaggaagaactgaacagaaaagcagaggaattagatcgcagggaacgggaactgcaacatgcggcacttggagggacggcgacccggcagaataactggccccctctgccgtccttctgtcctgtccagccctgctttttccaggatatcagcatggagattcctcaagagttccagaaaaccgtgagcacaatgtactatctttggatgtgtagcaccctggccttattgcttaactttttggcgtgcttagcctccttttgtgtggaaacgaacaatggagccggttttggtcttagtatcctttgggtactactgttcacaccctgtagcttcgtgtgctggtatcgacccatgtacaaagcctttcgctccgatagcagtttcaacttttttgtgttcttcttcattttcttcgtgcaggatgtgttatttgtcctccaggctattggcattcccggatggggcttcagcgggtggatatctgctcttgtcgtgccaaaaggcaacaccgccgtgagcgtgctaatgttgcttgtcgccttgttgtttaccgggattgccgtgctaggaattgtgatgcttaaacggatccactccctatacagacgcactggagcatcattccagaaggctcaacaggagtttgcagcgggtgtgttttcaaatccagccgtgagaaccgcggctgccaatgcggctgctggcgctgcagagaatgcattccgggctccttag

SEQ ID NO: 239827 - DNA, 690 bp, Artificial Sequence
  Description of Artificial Sequence: Synthetic coding sequence
atgtctgagaaggagaacaactttcccccattacctaagtttataccggtgaagccttgtttctaccaaaacttcagtgacgaaataccggtggaacaccaggtgttggtcaaacgcatctatcggctgtggatgttctactgcgcgactctgggggttaacctgatcgcatgcctggcatggtggataggaggaggcagtggcactaatttcgggttggcctttgtttggctgcttctcttcactccatgcggttatgtgtgttggtttcgaccagtctacaaggctttcagggccgattccagctttaatttcatggccttcttcttcatttttggggcacagtttgtcctcaccgtcattcaggccattgggtttagcggatggggcgcttgtggatggctcagcgctattggcttttttcaatacagccccggagctgcagtggtgatgctgcttcctgctataatgttttccgtatcagctgcgatgatggccattgccattatgaaggtgcataggatctatcgtggcgctggcggtagttttcagaaagcacagactgagtggaatacgggaacttggcgaaatccaccatccagagaggcacagtacaataattttagcgggaattcccttcccgaatatccaactgtccccagttatcctggaagcgggcagtggccctag

SEQ ID NO: 239828 - DNA, 588 bp, Artificial Sequence
  Description of Artificial Sequence: Synthetic coding sequence
atgagcgaaaaagagaacaatttcccacccctgccgaaattcattccagtcaagccttgtttctatcaaaactttagcgatgagatacctgttgaacatcaggtgcttgtgaaacgtatatatagactgtggatgttctactgcgctacgctgggggtgaatctgatcgcctgtctagcttggtggattggcggagggtcaggcaccaacttcggtctggctttcgtttggcttctgctgtttaccccatgtggttatgtgtgttggttccgacctgtgtacaaagccttccgcggatggctgagtgcaattggctttttccagtattcccctggagccgcagtggtgatgctactccccgctattatgttttctgttagcgcagctatgatggcaatcgctatcatgaaggtgcatagaatatatagaggcgcagggggatcctttcagaaagcccagacagagtggaacactggaacctggaggaaccctccttcacgggaggcacagtacaacaacttttcaggcaattccttgccagagtatcctacggtgccctcctaccccggatctggccagtggccatag

SEQ ID NO: 239829 - DNA, 588 bp, Artificial Sequence
  Description of Artificial Sequence: Synthetic coding sequence
atgattcagagacacattccagtgtgcgggcgatccagaccttatcagcggggatgtgtggtccaggctggatcctccggctcccctggctggtcccactttaaaatcatctgtggactggctccagctcctagtgaagcggttctatctgctcgtaacaattgcgagcacaccggagggtgccggctgcagccggcattagtgggtgaaacagaaatgtccgagaaggagaataacttcccaccactgcctaagttcattcctgtaaagccatgcttctatcagaatttttccgatgaaatccccgttgagcaccaggtcctcgtgaaacgcatctatcgactgtggatgttttattgtgcaacattgggcgtgaatctaatcgcttgtctcgcgtggtggataggtgggggtagcggaactaacttcggactggccttcgtgtggttgttgctgttcactccctgtggatatgtttgttggtttaggcccgtgtataaagctttccgagcagactcaagctttaattttatggcttttttctttatcttcggagcacagttcgtgctcaccgtaatacaggcctag

SEQ ID NO: 239830 - DNA, 708 bp, Artificial Sequence
  Description of Artificial Sequence: Synthetic coding sequence
atggctgaaaaggtcaacaacttcccacccctcccaaaattcattccattaaaaccttgtttctatcaggactttgaagccgatatacctcctcagcacgtgagcatgaccaaacgcctttattatttatggatgctcaactcggtgacactggcagtaaacctggttggatgccttgcctggctgattggaggcggtggagccacaaatttcgggctggcgttcttgtggttgatcctgttcaccccctgctcctatgtgtgctggtttcggcctatttataaggcattcaagacagattcgtcctttagcttcatggcattcttttttaccttcatggcccagctcgtcattagtatcatacaagccgtggggattcctggctggggcgtttgtggatggatcgccacaatctccttcttcggcactaatatcggtagtgccgtggtgatgctaattccgactgttatgttcaccgtgatggcggtgtttagctttatcgccctgtcaatggtacacaaattctaccgagggagcgggggtagttttagcaaggctcaggaggaatggaccacaggagcttggaaaaaccctcacgtgcagcaagcggctcagaacgccgctatgggtgccgctcagggagccatgaatcaacctcagacacagtactcggcaacccccaattacacatattccaacgaaatgtag

SEQ ID NO: 239831 - DNA, 708 bp, Artificial Sequence
  Description of Artificial Sequence: Synthetic coding sequence
atggctgaaaaagtgaataactttcccccattacccaaattcatcccgctgaagccctgcttctaccaagacttcgaggctgacattccacctcagcatgtatcgatgacaaagagactttattacctgtggatgctgaactctgtcacactcgcagtgaatctcgttggttgtctcgcttggctcatcggaggtggcggagccactaacttcggcctggcatttctctggctgattctgtttactccttgcagctacgtgtgctggtttcggccaatctataaggcgttcaagaccgactcatcctttagttttatggcctttttttttaccttcatggcccagcttgtgataagtattatccaagccgtgggcattccgggatggggagtgtgtggatggattgcaactatcagttttttcggcaccaatattggttccgctgtggtcatgctcattcccaccgtcatgttcaccgtgatggctgtcttttccttcatcgccctgtcaatggtgcataaattttaccgcggaagtggcggatccttttctaaggcccaggaagagtggaccaccggggcatggaagaaccctcatgtgcagcaggcagcccagaatgcggctatgggggcagcacagggcgctatgaaccagccacagacccaatattccgctaccccaaattacacatattcgaacgaaatgtag

SEQ ID NO: 239832 - DNA, 495 bp, Artificial Sequence
  Description of Artificial Sequence: Synthetic coding sequence
atgttcctgcctcgcctacgagggcgttatagttctcccgcttgtcagcacgatcaggcccctctgctgcctttagatgtgaccgattcatccttttcttttatggccttttttttcactttcatggctcaactcgtgatctccatcattcaggccgtgggaatccctggatggggtgtctgtggctggattgctacaatcagcttttttgggacaaatatcgggagcgctgtggtgatgctgattccaacagtgatgtttaccgtaatggctgtgttttcattcattgccctttcaatggtgcacaagttttacagaggatcaggtggatccttcagcaaagcccaagaagaatggactactggggcttggaagaacccccatgtccagcaggccgctcaaaatgctgccatgggcgctgcccaaggggctatgaatcagccccagacccagtactctgcgacccctaattatacttattctaatgaaatgtag

SEQ ID NO: 239833 - DNA, 1083 bp, Artificial Sequence
  Description of Artificial Sequence: Synthetic coding sequence
atgttcgtggcccgaagcatagcagctgatcataaggatctgatacacgatgtctcttttgattttcatggacgcagaatggctacctgcagctccgaccagtcggtgaaggtgtgggataaatctgagtcaggagactggcattgtacggccagctggaaaactcactcgggctccgtgtggagagtgacttgggcccaccccgagtttgggcaggtactcgcttcctgtagctttgacaggacagccgctgtttgggaagagatcgtgggggaatctaatgataagttgcggggacagtctcattgggtgaagcggacgactctcgtcgactcccggaccagtgtcactgatgtgaaatttgctcctaagcatatgggcctgatgctggccacttgcagcgctgatggaatcgtacgaatctacgaagcgccagacgtcatgaacctatctcaatggtctcttcagcatgaaatatcatgtaaactctcctgttcatgcatatcatggaatcctagttcttcccgagcccattctcccatgattgccgtgggcagtgacgatagcagtcccaatgcaatggccaaagtgcagatctttgagtataatgagaatacccgaaagtatgcgaaggctgaaaccctgatgacagtgaccgatcccgtgcatgatatcgctttcgcgccaaatctcggaagaagctttcacattctggctatagccacaaaagatgtcagaattttcaccctcaagccggttcgcaaggagcttactagctcagggggacccaccaagttcgagattcacatagtggcacagtttgacaatcacaatagccaggtgtggcgggtgagttggaatatcacagggacagtgttagcctccagcggcgacgacgggtgcgtgcgtctgtggaaggccaactacatggacaattggaagtgtacagggattctgaaaggaaatggtagccccgttaatggcagcagtcagcaaggcacctcgaatcctagcctgggcagcaccataccatcattgcagaactcactcaacggaagctccgctggccgaaagcactcctag

SEQ ID NO: 239834 - DNA, 1266 bp, Artificial Sequence
  Description of Artificial Sequence: Synthetic coding sequence
atgtttgtggctcgctcgattgccgctgatcacaaggatttgatccacgacgtgtccttcgattttcacggcaggagaatggcaacttgctcgtccgatcaatccgttaaagtgtgggataagtccgaatcaggcgactggcattgtactgcatcttggaaaacccactctgggtctgtatggcgggtcacttgggcacacccagaattcgggcaagttctggccagctgcagtttcgataggacagctgccgtgtgggaggagatcgtcggagaatcgaatgacaagctgcgagggcagtcgcactgggttaagagaactactctggtagatagcaggacatctgtcacggatgtaaagttcgcacctaagcacatgggcctaatgttggccacttgtagcgccgacgggatagtgcggatatacgaggcacctgacgtgatgaacctgtcccagtggagcctccaacatgaaattagttgtaagttgagctgttcctgcatttcttggaacccatccagcagccgcgctcacagtcccatgatcgctgtggggagtgatgactcttctcccaatgcgatggcaaaagtccagattttcgagtataatgagaatactcgaaagtacgccaaggcagaaactttaatgactgtgacggatccagttcatgacatagccttcgcacccaaccttggccgatccttccacatcttagccattgccacgaaggacgtgaggatctttacactgaagcccgttcgtaaggaactcacctcttccggcggacctacgaaatttgaaatccatattgtagcacagttcgataaccacaattcccaggtttggagggtctcttggaacattactggaaccgttctagcgagtagcggtgatgatgggtgcgttcgcctttggaaagctaactacatggacaattggaaatgcactggcattctgaaggggaacggctcccccgtgaatggcagttcgcagcaggggacgagtaacccatcgttaggctcaacaatcccgagtctgcagaactcgttaaatggttcatctgctggcagatatttcttcacccctctagactcacctcgcgcagggtcccgctggtcctcctatgctcagctattacctcctccacctccacccttggtggagcactcctgcgatgccgacactgccaacctgcagtaccctcatcctcgccgacgttacctctccaggcctctgaatccgttaccagagaacgagggtatctag

SEQ ID NO: 239835 - DNA, 3075 bp, Artificial Sequence
  Description of Artificial Sequence: Synthetic coding sequence
atgcctgctgctaggccccctgccgctgggcttagagggatctccctcttcctggccttgcttctggggtctcccgcagcggctttggaaagagacgcactccctgagggcgacgcttccccactggggccttatttactgccgtctggtgctcctgagcggggatctccaggcaaggagcaccccgaagaaagagtggttaccgcaccacccagttccagccaatcagctgaagtgctgggagaactcgtcctggacgggacagcgcctagtgctcatcacgacatccctgctctgagcccattgcttcccgaggaggctcgtccaaagcacgcgctaccgcctaagaaaaaattgccctcgcttaagcaggtcaatagcgcaagaaaacaacttcgccctaaggctacgagcgccgcaacagttcagagagctggcagtcaaccggcaagtcaggggcttgatctattgtcatctagcaccgaaaagcccggtccccctggggatccggaccctattgtcgccagcgaagaggcgtctgaggtcccgttgtggctagaccggaaagaatctgctgtgcccactacccccgcaccactgcaaatcagtccattcactagccaaccatacgtggcccacacccttccccaacgaccggagcccggagagccaggaccagatatggcacaggaggctccgcaagaggacaccagcccaatggctctaatggataagggcgaaaatgaactgaccggaagtgccagcgaggagagtcaggagactaccacgtctaccatcattactacgacagttattaccactgagcaggcacccgctctgtgttcagtgtctttctctaatcctgagggttatattgactccagtgattatccactgctgcccctgaacaacttcttggagtgcacgtataatgtgacggtatacacagggtatggggtggagctgcaagtgaagtccgttaatctctctgatggcgagttgctgtcaataaggggtgtcgacgggcctacattgactgtcctggccaaccagacactcctggtggaaggtcaggtgattcgttctcccactaatacaatctcagtttatttcaggacattccaggatgacggcttagggaccttccaactgcactaccaggcctttatgctaagctgcaattttcccagaaggcccgattcaggagatgtgaccgtcatggatctccactctggcggagtggcccactttcactgtcacctaggctatgaacttcagggtgcaaagatgctgacttgtatcaatgcctccaagccacactggtcgtcacaggaaccgatatgctctgcgccatgcgggggtgcggtgcacaacgcgaccatcggcagggttctgtcccctagttatcccgagaacactaatggctctcagttctgcatttggactatagaggccccagagggccagaagttgcacttgcactttgagcgcctcttgctgcatgacaaggaccgtatgaccgttcactcaggccagactaacaaaagtgccctcttatacgattccctacagacagaatctgtgcccttcgaaggactcctgagcgaaggaaacacaatccgcattgagtttactagtgatcaggccagagctgccagtacctttaatatccgtttcgaagcgttcgagaaaggccattgttacgagccttatattcagaacgggaacttcactacctccgatcccacctataacattgggaccatagtcgagttcacatgcgaccctggccattcattggaacagggaccggctatcatcgagtgcatcaatgtgcgcgacccgtattggaacgataccgaaccgttatgcagggccatgtgcggaggcgagctatcagccgtggccggtgtagtgttgtctcctaattggcccgaaccatatgtggaaggagaagactgcatttggaagatccacgtgggcgaagagaagcgaattttcttggacatacagttcctgaacctgagcaattccgacattctcactatctacgacggtgacgaggtgatgcctcatattctgggtcagtatctgggaaacagcgggccacaaaagctctattcctccactcctgatctgacaatacaatttcactctgaccctgcaggcctcatttttggcaagggccaagggttcatcatgaattacattgaagtgagcaggaatgactcttgctctgacctccctgagattcagaacggttggaagactactagccacaccgaactcgtccgaggagcacgcattacgtaccagtgcgacccaggatatgacatcgtgggcagtgacaccctgacatgtcagtgggacctgtcatggagctcagatcctcctttctgcgagaagattatgtactgcacggatcctggagaagtcgaccatagtacccggttaattagcgaccctgtccttcttgtaggcacaactatacagtacacatgtaatccagggtttgtgctcgagggctctagtctgcttacatgttattctcgcgagacaggcacacccatatggacaagcaggctgccacactgtgtgtccgaggagtcactggcctgtgataatcctggactgcctgagaacggctatcagatcctgtataagagactgtacctgcctggagaaagcctaacttttatgtgttacgaaggattcgagttgatgggcgaggtgactatcaggtgcattcttggacaacccagccactggaacggccctcttccggtctgtaaggtgaatcaagacagttttgagcatgccttggaggtcgccgaagccgcagcagaaaccagcctggaaggcggaaacatggccctggccatctttattcctgtgctaatcatctccctgttacttgggggtgcctacatctatataaccagatgtagatattactccaacctgcgactgcctttaatgtattcgcacccgtattcacagatcaccgtcgagactgaatttgacaatcctatctacgagacaggtgagactagggagtatgaagtgagcatttag

SEQ ID NO: 239836 - DNA, 2847 bp, Artificial Sequence
  Description of Artificial Sequence: Synthetic coding sequence
atgcccgctgccaggccgcctgccgcaggcctccgaggcatctcacttttcctggcgctgcttctcggatcccctgcggctgctctcgagagagatgccctgcccgaaggagatgcatctcccctgggaccttaccttctgccgtctggggctccagagagaggatctccaggtaaagagcacccggaagagcgcgtggtgaccgcccctccctcctcttctcagtctgccgaagtgctcggcgaacttgttctcgacggtaccgctccaagcgcccaccacgacattcccgctctgtccccactactaccagaggaagctaggcccaaacacgccttaccaccgaaaaagaaactgccttctttgaagcaggttaacagcgcaagaaagcagttgagaccaaaagcgacaagcgccgctactgttcagagggcgggaagtcagcccgcaagccaaggtcttgatctgttgagcagctccacggaaaaacccggacctcccggagacccggatcccatcgttgcaagcgaagaagccagtgaggtcccgctgtggctggaccgaaaggaatcagctgttcctaccaccccagcaccccttcaaatctctcccttcactagccagccatatgttgcacacacattgccacagaggccggagcctggcgagcctggcccagacatggctcaggaggccccacaggaagacaccagccctatggccctcatggataagggggagaacgaactcaccggctcagccagtgaagaaagtcaagagaccacaaccagtactattatcaccacgaccgtcattaccacagaacaggctcctgccttatgctccgtctccttttcaaacccagagggttacatcgacagttcagactacccactacttcctctgaacaacttcctggagtgcacctacaacgttacggtctacactggatacggcgtggagctgcaggtgaagagtgtgaatctgagcgacggagaactgctcagcattaggggcgttgacgggccaaccctgacagtgctggccaaccagactctgctggtagagggtcaagtgattcgatctccgactaataccatctctgtctatttccgaacctttcaggacgatggcctagggactttccagctgcactaccaggcatttatgctgtcttgtaatttccctcgacgacccgattcaggagatgtaaccgtaatggacctgcactcgggcggagtagctcactttcattgtcacctgggctatgagttacagggcgctaagatgctgacctgcatcaacgccagcaaaccgcattggtcgagtcaggaaccgatctgcagcgctccttgtggaggagccgtgcacaatgctaccatcggcagggtgctctcgccctcttaccccgagaacaccaatggcagtcagttctgcatctggactatcgaggcaccagaggggcaaaagctccatttgcacttcgagagactcctcttacacgacaaagaccgaatgactgtgcactccggccagaccaataagtcagcattgctgtacgacagtctgcagacagaaagcgttcctttcgaggggctcttatcagaagggaatacgataagaatcgagtttactagcgatcaagctcgggcagcgagcacttttaacattcgctttgaagctttcgaaaaaggacactgctacgagccctatatccagaatggcaacttcacaacaagtgatccaacatacaacataggcacgattgtagaatttacctgcgacccagggcacagccttgaacagggaccagcaattatcgaatgcatcaatgtcagagacccttactggaatgacacggagcccctctgtcgggcaatgtgcggcggtgaactgagtgctgtggccggagtcgtgttatcccccaattggcctgagccttatgtggagggagaagattgcatctggaaaatccacgttggcgaggaaaaacgtatctttctagatatacagttcctcaatttatcaaattcagatatcttgacaatctatgatggagatgaggtaatgccacacattcttggtcagtatttgggaaactccgggcctcagaaactatatagctcaacgccagatttaactattcagtttcactccgatcccgctggcctgatctttggcaagggacagggattcatcatgaattacattgaggtctcaagaaacgactcttgtagcgatctgccagagatacagaacggctggaagaccacaagccacacagagctcgtgcgaggagccaggattacatatcagtgcgaccccggatacgatatcgtcggttccgataccttgacatgccagtgggatcttagctggagcagcgacccgccattctgcgaaaagataatgtactgcacagacccaggggaggttgatcattccacgaggctcattagtgaccccgttctccttgtgggcacaactatccaatatacatgcaatcctgggtttgtgctggagggttcatcactcttaacgtgttacagccgagagacaggcacgcccatttggacctctcggctaccgcattgtgtgctggcggaagcagcggctgagacatcactcgaaggcggtaatatggctttagccattttcatacctgttctcatcatctctctgcttctgggtggcgcatatatatacatcactcgttgtcggtattactccaatctgaggttacctctgatgtactcacacccctacagccagattacagtggagacagagtttgacaatcccatttacgagacgggggagacccgcgaatatgaggttagtatctag

SEQ ID NO: 239837 - DNA, 2850 bp, Artificial Sequence
  Description of Artificial Sequence: Synthetic coding sequence
atgcccgctgcccgaccacccgctgccggtctgagggggatttcattgtttctggctctgctcctcggcagtccggcagccgctttagagagggacgcgttgcctgagggagacgctagtccattaggcccttacctgctgccctcaggcgctccagaaaggggctctccaggaaaagaacaccccgaagagagagtggtgaccgctcccccaagcagctctcagagcgccgaggtgctgggcgagctcgtgctggatgggacagcccctagtgcccaccacgacatcccagctctgagccctctgctgccagaagaagcccgtcctaagcacgctctgcctcccaaaaagaaactgccttctctgaaacaggtcaactcagctcggaagcagttgcgaccaaaggcaacaagcgctgccacagtgcagcgggctggatctcaacctgccagccaaggcctggacctgctgtcgtcaagcactgagaaaccaggtccacctggtgatcctgaccccatagtggcttctgaagaggcttccgaggttcctctgtggctggaccgcaaagagtctgccgttcctacaacgccggctcccctgcagatctctcctttcacatctcaaccatacgttgcccatactttgccccaaagacctgagcccggagaacctggtccagacatggcacaggaggcgcctcaggaagatacatctcccatggccctgatggacaaaggggagaatgaacttactggcagtgcatcagaagagtcgcaggagacgactacctctaccatcattaccacgacagtgattacaactgaacaggcccctgcattgtgctctgtctccttctccaatccggaaggctatattgattcctccgattaccctctgcttccgctgaacaattttctcgaatgcacctacaacgtgaccgtgtacacggggtatggcgtggagcttcaggtgaagtccgtgaacctctccgatggcgaactgttaagtatccggggtgtcgacgggccaacactgaccgttctcgcgaatcaaaccttgttagtcgaggggcaagtgatccgatccccaacgaatactatctctgtgtactttagaacgtttcaggatgatgggctgggcacttttcagctgcattatcaggccttcatgctcagctgtaattttcctcggagaccagatagcggggacgtcacagtaatggacctgcacagtgggggagtcgcccacttccactgccacctgggctatgagctccagggtgccaaaatgctgacttgcatcaacgcaagtaaaccacactggtcgtcacaggagcctatttgctcggccccatgcggtggggcagtgcataacgcgacgatcgggagggtgttgagtccctcctatcccgaaaataccaacggttcgcagttttgtatatggactatagaggccccagaaggccagaagctgcatttgcattttgaaagactgcttcttcatgacaaggatcggatgacagtccactctgggcaaaccaataagagcgccctgctctacgatagtcttcagaccgagtcagtgccattcgaaggattactgtcagaaggaaatacaattaggatcgaattcacttccgaccaggcgcgagctgcctctacattcaacataaggtttgaagcattcgagaaaggccattgctatgaaccctacatacagaatggcaacttcactacgagcgatcctacgtacaatatcggaaccatagtggaattcacatgcgacccaggccattcactggagcagggtccggcaatcattgagtgcatcaacgttagagatccatactggaacgacactgaaccactctgcagagccatgtgcggcggagagctgtccgccgtagctggggtggtgctgagtccgaactggcccgagccttacgtcgaaggagaggactgcatctggaaaatccacgtgggcgaggagaaacgtatctttctagatatccagttcctgaacctgagcaattccgatattctgacaatctatgacggcgatgaggtgatgccacacattcttgggcagtacttgggtaattctggtccacagaaactgtacagttctactcccgacctaacaatccaatttcacagtgatcctgcaggcctgattttcggaaaaggccaaggctttattatgaactatatagaagtgtcaagaaatgattcatgcagtgatttgcccgagatccaaaacgggtggaaaaccacctcgcacaccgagctggtgaggggggctaggattacctatcagtgcgatcccggttacgacatagtaggctccgacaccctgacctgtcagtgggacctctcttggtccagcgatcccccattctgcgagaaaacagaagagtccctggcctgtgataaccctggcctcccagaaaacggttatcagatcctttacaagcgcctctatctgcctggcgaatccttaactttcatgtgttatgagggctttgagctgatgggtgaggtgacgatacgctgtatcctcggccaaccgagccactggaatggcccacttcccgtctgcaaagtcgcagaggcagccgcagaaactagtctggagggaggaaatatggcactcgcaatctttattcccgtgctgattatcagtcttctgctgggtggtgcatacatttacataacccgatgtcgatattactccaacctgagattgcctcttatgtatagccacccctattctcaaatcaccgtggaaaccgagtttgacaatcccatttacgagaccggcgagactcgggagtacgaggtgtcaatctag

SEQ ID NO: 239838 - DNA, 420 bp, Artificial Sequence
  Description of Artificial Sequence: Synthetic coding sequence
atgtactgcaccgacccgggtgaggtagaccactccacacggctgatttctgatcccgtactgctcgtaggcactaccatccaatatacctgcaacccagggttcgtgttggagggttcatccctactgacatgctactcacgagaaacaggcacacccatttggacttcacggcttcctcactgtgtcagtgaggagtcgctggcttgcgacaatcctggtctgcctgagaacgggtatcagatcctttacaagaggctgtacctgcccggagagagcctaactttcatgtgttacgagggctttgaactgatgggagaggtgacgattaggtgtattctcgggcagcctagtcactggaacgggcctctgcccgtctgtaaggatgtagctactattcctactagcgcatgtctgtag

SEQ ID NO: 239839 - DNA, 3042 bp, Artificial Sequence
  Description of Artificial Sequence: Synthetic coding sequence
atgcctgccgcacgacctcctgccgcagggctacgtggtatctctctgtttcttgcgcttttactggggtctcccgctgcagctctcgagcgggacgcgctgcccgagggcgatgcctcacctctggggccatacctgctgccctcgggcgcaccagagcgcggatcccccggaaaagagcaccccgaagagcgcgtggtgaccgccccaccttccagttctcagagtgcggaagtgctcggggagctcgttttggatggaacggccccatcagctcaccatgacattcctgctctgtcccccctgcttcctgaagaagcacgaccaaaacacgctctaccgcctaagaagaagctcccttcattgaaacaggtgaactccgcgaggaaacagctgcggcctaaggccacttccgcagccacagtgcagcgggctggcagccagccagcttcccaaggtctggatcttctgagcagctctacagaaaagccgggaccccctggggacccagatccgattgtcgctagtgaggaagcatctgaggtgcccctgtggctggatcggaaggaatcagcagtccccacgaccccggcacctctccagataagtcccttcacgtcacagccctatgtcgcccatactttacctcagcggccagagcccggagagcccggaccggatatggcccaggaggctcctcaggaagacacttccccaatggcactcatggacaaaggagaaaacgagcttacagggtcagcttcagaggaatctcaggaaactaccaccagcaccattatcaccacaacagtgatcacgaccgagcaggctcctgccctgtgcagcgtttcttttagcaaccctgagggatatatcgacagctctgattaccctttgctgcccttgaataatttcttggagtgcacatataatgttacagtgtacaccgggtacggagtggaactgcaggtcaaatcagtgaatctaagcgatggagaactgttgagcatcaggggagttgacggccctacactcactgttctggctaaccagacactactggtcgagggccaagttataagatctcccacaaacactatctctgtatatttccggacttttcaagacgacgggttgggcaccttccagcttcactatcaggcatttatgctgagttgtaacttccctagacgcccagatagcggggacgtcaccgttatggacctgcatagcgggggagtggcccatttccactgccacttggggtatgagctccagggggcaaaaatgctgacatgcatcaatgcgtctaagccccactggagctcgcaggaacctatctgcagcgcgccatgtgggggtgcagtgcacaatgccacaattggtagagttctcagcccatcttatccagaaaataccaacgggtcccagttttgcatctggacgatcgaggctccggaggggcaaaagcttcatctgcactttgaacggctgttgttgcacgataaggaccgtatgacagtccactctggccagactaacaaatcggcgcttctgtatgactccctgcagactgagtcagtccccttcgaaggactgctgtccgagggcaacactataaggatcgagtttaccagcgaccaggctcgagccgcttccacctttaatatcagatttgaagccttcgaaaagggtcactgttacgaaccatacatccagaacgggaatttcaccacaagcgaccccacatacaacatcggcacgatagtggaattcacatgcgaccccggtcactcactggagcaaggtcctgcgatcatcgaatgtatcaatgttcgggacccttactggaacgatacggagcccctctgtagggcaatgtgcggcggtgagctctccgccgtcgccggagtggtcttgtcacccaattggcccgaaccatacgttgagggggaagattgtatatggaagatccacgtaggggaagagaagagaatttttctcgatattcagttcctcaacttatccaacagtgatatcctgactatctatgacggggatgaggttatgccgcacattcttggacagtatttaggaaattcaggtccacagaagttgtactccagcacgcccgatttaactatccagttccacagcgatccagccggtcttatctttggaaagggacagggcttcataatgaattacattgaggtctctcggaacgactcgtgtagcgatctgcctgaaattcaaaatgggtggaaaacaacttcacatactgaattagtgcgcggagctagaatcacgtatcagtgcgatccaggctatgacatcgtcgggtcagacactttaacctgccaatgggatctctcctggagttcggatcctccgttttgtgagaagatcatgtactgtacggatcccggtgaggtggaccattccaccaggctgatctctgatcctgtgttgctcgtcggtacaactatccagtacacctgcaatccaggatttgttctcgagggatcctccctgctcacctgttattctcgcgagaccggcactccaatttggacgagccgcctccctcattgcgtctcagaggagtctctggcttgcgataaccctgggcttccagagaacggctatcagatcctctacaaaaggctgtatctgcctggagaaagtctaacttttatgtgctatgagggatttgagctaatgggcgaggtaacgatacgttgtatactgggacaacccagtcattggaacggccctttgccggtgtgcaaggtggctgaggccgcagcagaaactagtctggagggaggaaacatggcgcttgctatctttattccagtgctgatcatctccctgctgctggggggagcatacatctacatcacgaggtgtagatattatagtaatttaaggttgcctctgatgtactcacatccgtacagccaaatcacagtggagactgaattcgacaatccaatatatgaaacgggtgaaacccgcgaatacgaggtctccatttag

SEQ ID NO: 239840 - DNA, 3072 bp, Artificial Sequence
  Description of Artificial Sequence: Synthetic coding sequence
atgcccgctgctcggccacccgctgccggactgcgcggtatctccctctttcttgctctgctgctgggctctcccgctgctgctctggaaagggacgcactgccagaaggtgatgccagcccgttgggaccctaccttctcccttccggcgctcctgagcgtggttccccaggtaaggagcatccggaggagcgcgtggtgacagcccctcccagctcctcccaatctgccgaagttctaggcgaactggtcctggacggaactgcccctagtgcgcatcatgacattcccgctctgtctcccctcttgcccgaggaggccaggcccaagcacgccctgccacccaagaaaaaattgccctcccttaaacaggtgaattctgccagaaagcagctgcggccaaaagccacttccgccgctactgtgcagagagctggaagccagcctgcctcccagggcctagacctcctttcaagctcaacagaaaagcccggacctccaggtgatccagaccctatcgtggcatcagaagaggcttcagaagttcccctgtggcttgaccggaaggaatccgctgttcccacaactcctgccccactccaaatttctccatttaccagtcagccctacgtggcccacacactccctcaacgccctgaacccggtgagcccggtcccgatatggcacaggaggcccctcaagaagacaccagtcccatggcattgatggacaagggcgaaaacgaacttaccgggagtgccagcgaggagagccaggaaacaactacctccacaattatcacgaccactgttatcacaacagagcaggccccagctctctgctccgtctctttttctaatcctgagggctatatcgactcatcagactaccctctgctgccacttaataattttcttgaatgcacttacaatgtgaccgtgtacacaggttacggagttgaactgcaggtgaagtctgtgaatttaagtgacggagaactgctcagtattagaggggtggatggccctactctgacggtgctggccaatcagaccttgctagtcgaaggtcaggttatcagatcccctaccaacacaatcagcgtgtacttcagaacatttcaggacgatggattgggcacctttcagctccactatcaggccttcatgctatcctgcaattttccgcgtaggcccgacagcggagacgtcacagtgatggacctgcattctggaggagtcgcacacttccactgccacctaggttacgaactccagggagcgaagatgctcacttgtatcaacgcttcaaagccccactggtcaagccaggaacccatctgcagcgccccatgcggcggagccgtgcacaatgccaccatcgggagagtgctgagcccctcctatccagagaacactaatggcagccagttctgcatctggacaatcgaggcgccagaaggccagaaattgcacctgcacttcgagcgattgctcctgcacgataaagatcgaatgacagtccattctggccaaactaacaagtctgctctgctctatgattctctgcaaacagagagtgttccctttgagggtctgctgtccgagggaaataccattcgcattgagtttaccagtgatcaggcccgagctgcttcgactttcaacattcgatttgaggcattcgaaaagggccattgctatgaaccctatatacagaatggtaacttcacaacttctgaccctacctacaatattgggactatcgtcgagtttacctgcgacccaggacacagccttgagcaggggccagccataatcgaatgcatcaatgtcagagatccctactggaatgacacggagccactgtgtcgtgcgatgtgcggtggagaactgtctgccgttgctggcgtggttctgagccccaattggccagagccatatgtggagggagaggactgcatatggaaaatacacgtgggagaggagaaacggatctttctggatatacagttcttgaacctctctaacagtgacatcctgaccatatacgacggggatgaggtaatgccccacattcttggccaatacttggggaacagtggccctcaaaagctgtattctagtacacctgatctcacgatccagttccacagcgacccagccggattgatcttcggaaaaggccagggttttataatgaattacatcgaggtgtccaggaacgatagttgtagtgatctgcctgagatacagaacggctggaagacaacaagtcacactgaactcgtgcgcggtgcacgcatcacctaccagtgcgatcctgggtacgatatcgtgggcagtgacaccctgacatgccagtgggatttgagttggtcctctgaccctcccttctgcgaaaaaattatgtactgcactgacccaggcgaggtggaccactccactcgactgatctccgaccctgtgctcctggttggtacaactatacagtacacctgtaacccgggttttgtgctcgaaggttcctccctgctcacctgctattctagggagaccgggacaccaatctggacctcacggcttccccattgcgtttctgaggagtccctcgcctgtgataatccaggcctgcccgagaacgggtatcagatcctgtacaagcgactgtacctccccggagaaagcctgactttcatgtgttacgaaggattcgagctcatgggcgaagtgacaatcaggtgtattctgggccaaccttcccactggaatggcccattaccggtatgcaaggttaaccaagattcctttgagcatgcactcgaggccgaagcggcagcagaaacctcactagagggcggaaatatggctttggcgattttcattcccgtattgatcatatctttacttttgggaggagcctacatctatattacccggtgccgctactactcaaacctgaggctcccgctgatgtatagccacccttactctcaaattactgtggagacggagttcgacaaccctatctatgaaaccggggaaacccgggagtacgaggtgtcaatttag

SEQ ID NO: 239841 - DNA, 258 bp, Artificial Sequence
  Description of Artificial Sequence: Synthetic coding sequence
ggatttggtactgacgtcgactacgagaccgcttttatacactatcgactggcctccgagcagcagcacagcgcacaagctatgttcaatctggggtacatgcatgaaaagggactgggcatcaagcaggacatccatcttgctaagcggttctacgatatggccgcatcccagccccgttgtacctcatcaagcctaccatctcccttgcagattggaagaagactcttccttgcagtgcacaccggcaataaatag

SEQ ID NO: 239842 - DNA, 2385 bp, Artificial Sequence
  Description of Artificial Sequence: Synthetic coding sequence
atgcgagtaagaatcggcctgacactgttgctctgtgcggtgcttctgagcctggcctccgcctctagcgacgaagagggcagtcaggatgagtcactggactctaagacaactctcactagtgatgagagtgtcaaggaccataccacagccggacgtgtcgtcgccggacagatcttccttgacagcgaagaatcagagctggaatcctccattcaggaggaggaagatagtctgaagtcgcaggagggggagtccgtgactgaggacatttccttcctcgaaagtccgaaccccgagaacaaggactacgaagaacctaagaaggtgcgcaaacctgcactgacggcaattgagggtacagcccatggagaaccttgccatttcccattcctgtttctggataaagaatatgacgaatgcactagtgatggcagagaggacggcagactatggtgcgccaccacctacgactacaaggccgacgaaaaatggggattctgtgagactgaagaggaggccgcaaaaaggaggcagatgcaggaggccgagatgatgtatcagaccggaatgaagattctgaacggctccaacaagaagagccagaagagggaggcataccgctatctgcaaaaagccgcatctatgaatcacactaaagcactggaacgtgtgagctatgctctcctttttggcgactacttaccgcagaatattcaagcagctagagaaatgtttgagaagctcactgaagaagggagccccaagggtcagacggcgcttgggtttctatatgcctcgggattgggtgtaaacagctcacaagctaaggcactggtgtactacacctttggtgcacttgggggtaatctgatcgcacatatggttctaggctataggtactgggccggaatcggcgttttgcaatcctgcgagagcgctttaacacattaccgattagtcgcgaatcacgttgccagtgacatctctcttaccggcggaagcgtggtccagaggatcaggttaccggacgaggtggagaatccaggcatgaactcaggtatgctggaagaagacctgattcagtattaccaatttctcgcagaaaagggagacgtgcaggcccaggttgggcttggccagctgcacctgcacgggggtcgaggagtcgaacagaatcaccagcgagcgtttgactactttaatctggctgctaacgctgggaatagtcacgccatggcgttcttgggaaaaatgtattcggagggatctgatatcgtgccccagagcaacgaaactgctctgcactactttaagaaggcggcagatatggggaatccggtgggacagtctggtctcggtatggcgtatttgtacgggaggggtgttcaggtgaactacgatctagcactaaaatacttccagaaggctgcagagcagggttgggtggacggtcagctgcaactgggcagcatgtattacaatggaatcggagtgaagagagactacaaacaggcattaaagtatttcaacctggcgtctcagggagggcacatcctggctttctacaatctggcccaaatgcatgccagcggaacgggggtcatgcggtcctgtcatacagctgttgagctctttaaaaacgtctgtgaacgcggacgatggtctgagcggctgatgacagcctataatagctacaaagatggtgactataatgcggctgttatccagtatttactactggcggaacaagggtatgaagtcgcccagtccaacgcagcatttatcctggaccagagagaagcttccatcgtgggggagaatgagacctatcctagagcactcctgcactggaaccgcgcagccagtcaaggctacacagtcgccagaatcaaactgggggactatcatttctatgggtttgggacagacgtggactacgagacagcatttatacattacaggctggcctctgaacagcagcactcagctcaggccatgttcaatctgggctatatgcacgagaagggtcttggaatcaaacaggacattcatttagcgaagcgcttctatgacatggctgcagaggcctcgcccgacgcgcaagttcccgtgttcctggccttgtgcaaactgggcgtcgtgtactttctgcagtatattagggaaactaacatccgtgacatgtttacacagctggacatggatcaactcctaggccctgagtgggatctgtacctaatgactattattgcactgctgctggggactgtgattgcttaccggcagagacagcaccaggatatgcctgcacctaggcccccaggccctcgcccagctccccctcagcaggaggggccacctgaacagcagccaccacagtag

SEQ ID NO: 239843 - DNA, 906 bp, Artificial Sequence
  Description of Artificial Sequence: Synthetic coding sequence
atgcgcgtcagaatcggacttacactcctgctctgcgccgtactcctgagtttggcgtccgcaagcagtgatgaagaaggatcccaggatgagtcacttgactccaaaactacactcacaagcgatgaatccgttaaggaccataccacagccggaagggtggtggcagggcaaatcttcttggactcagaggaatctgaactggagagttccattcaagaagaggaagacagtttaaagtcccaggaaggggaatcagtgacagaggatatcagcttcctggaatcccctaaccccgaaaataaagactacgaagagcctaaaaaagtgaggaagcccgcactgacagcaattgagggtaccgctcatggggaaccatgtcacttcccttttctgttcctggataaagaatacgatgaatgcacaagtgacggtcgggaggacggacggttatggtgtgcgacgacctatgattataaggcggatgagaaatggggcttttgcgaaaccgaggaggaggctgctaaacggcgtcaaatgcaagaggctgaaatgatgtatcagacgggtatgaagatcctaaacggctccaataagaagtcccagaaacgtgaggcttatcggtacctgcagaaggccgctagcatgaatcacaccaaagctctggagcgcgtttcgtacgctctcctctttggggattaccttccacaaaatattcaggccgctcgtgagatgttcgagaagttaaccgaagagggctcccccaaaggtcaaactgccctcggatttctgtacgcctcaggcctgggcgtcaactccagtcaggcaaaggcgctcgtgtactatacctttggggcactggggggtaatttgatagcgcacatggtgctcgtgtccaggctgtag

SEQ ID NO: 239844 - DNA, 2067 bp, Artificial Sequence
  Description of Artificial Sequence: Synthetic coding sequence
atgaaaccactgtcactcctaatcgaaatcctcataattttgggtgtgactatcaaaaccatcaaggcagaagaacacaacaagcggcagaaagaaagaaatgtgacaacccaagtctctgtcaacgagatcaaacagtatctcagccatatccttgaacaaagaacttcttccaatgtcataaataaaagagagaacctgctggaaaagaaaaagaaccaaagaaagataagaattaagggaatccagaataaggacatccttaaacgaaacaagaatcatctccaaaaacaggccgaaaaaaacttcactgatgagggcgaccaactgtttaagatgggaattaaagtcctgcaacagagcaaatctcagaaacagaaagaggaagcatatctgctatttgccaaggccgctgatatgggcaatctgaaagctatggaaaaaatggccgatgcactgttgtttggaaatttcggcgtacagaacattacagcagctattcagttgtatgagtctctcgcgaaagagggatcctgcaaggctcaaaacgccttgggctttctctcttcctatggaatcggcatggagtacgaccaggctaaggcactaatttactacacattcggatctgctgggggaaacatgatgtcccaaatgatcctggggtaccggtacctgtccggaattaacgtgctgcaaaattgtgaggtcgctctctcttactacaaaaaggtggccgattatattgccgacacttttgaaaaaagtgagggcgtgcccgtggagaaagtacggctgacggaaagacccgagaatctgtccagcaactctgagatacttgattgggatatctatcagtattacaaattccttgcagaaaggggggatgtccagatacaggtgtcactcgggcagctccatctcattggtcgcaagggtcttgaccaggactattataaggccctgcactattttctcaaggctgctaaagcaggctcggccaatgccatggcattcattggaaagatgtaccttgagggcaacgccgcagtgccgcagaataacgctacagcgtttaagtatttctcaatggccgctagcaagggaaacgcaatagggcttcacgggctgggcttgctgtatttccacggaaagggcgttccgctgaactacgcggaagccctcaaatatttccaaaaagcggcagagaagggctggccggacgcgcaatttcagctgggctttatgtattattccggcagcggcatttggaaggattacaagttggcctttaagtatttttatcttgcctcacagtcaggccaacctctggctatttattacctcgccaagatgtatgccaccggaactggcgtggttcgctcgtgtcgaaccgccgtagagctctataagggggtgtgtgagcttggccactgggcagagaagttcctaactgcctattttgcctacaaagatggcgacattgattctagtctagtgcagtatgccctcctcgccgagatgggatacgaagtcgcccagtctaactcggcttttatactggagagcaagaaagcaaacatcctggagaaggaaaagatgtatccgatggcgctcctgctgtggaaccgggctgctatccaggggaatgcttttgctagagtcaagatcggggattaccattattatggatacggcaccaaaaaggattaccagacggctgccacccattactccattgccgctaataagtaccacaatgcccaagccatgtttaacttggcttatatgtatgaacatggcctcggcataactaaagatatacaccttgctcgcaggctctatgacatggctgcccagacctcacccgacgctcacatcccagtcttgtttgccgtgatgaaactggagacaacacatcttttacgggacatcctttttttcaatttcacaacccgctggaattggctcaagctcgacaatactataggcccacactgggatctgttcgtgattggattgattgttccagggttaattctgctcctgagaaaccatcacggctag

SEQ ID NO: 239845 - DNA, 1728 bp, Artificial Sequence
  Description of Artificial Sequence: Synthetic coding sequence
atgaagccactcagtttgctcattgagattctgattattctgggagtgactattaaaactatcaaggctgaagagcataataaaaggcagaaagaacgtaatgtgacaacacaggtgtccgtgaacgagattaagcaatatctgagccacattctggaacagcgtacttccagcaatgtaatcaacaagcgggagaacctgctggagaaaaagaagaaccagcgcaagattcggattaaaggcatccagaacaaagacatcctcaaacggaataagaatcaccttcagaagcaggccgagaaaaattttacagacgagggggaccagctatttaaaatggggattaaagtgcttcaacagagcaagagtcagaagcaaaaagaggaagcctacctattattcgcgaaggctgccgatatgggcaatctgaaagcgatggaaaaaatggcggacgccctgctatttggtaactttggggttcaaaacatcacagccgcaattcagttgtacgaatctttggccaaggaagggtcctgcaaagcccagaacgcactgggctttctgtcatcgtacggtattgggatggaatacgatcaggctaaggcattgatatattacacgtttggcagcgccggtgggaatatgatgtcccaaatgatcctgggataccgctatctgagcggcattaatgttctgcagaactgcgaagtggccttgagttactataagaaggtggcagattacatcgccgacactttcgagaagtctgaaggggtcccggttgagaaagtgagactcacggagcggccagagaatttaagttctaactccgagatcctggattgggacatttaccagtactacaagtttctcgcagagagaggagacgtgcaaattcaggtttcccttgggcaactccacctgatcggaagaaaggggttggaccaggattactacaaggccctgcactatttcctgaaagctgctaaagcgggtagtgccaacgctatggcctttattggcaagatgtatctcgaagggaacgcagcagtgccgcaaaacaatgctaccgcattcaaatatttctccatggccgctagcaagggaaatgcgatcggactccacgggctagggctcttgtacttccatggcaagggggtgccgctgaattatgccgaggccttgaagtactttcaaaaggccgcagaaaagggttggccggatgcacagtttcagctgggatttatgtactacagcggctctgggatctggaaggattacaaactcgccttcaagtacttttacttggcctctcagtccggtcaacctctcgccatctactaccttgcaaaaatgtacgctacaggcactggggtagtcagatcctgtcggacggcggtagagaaacgtttgaccttcctcaagaagcgcaggtgcatacagtggaggttctcttacggaatcgagctgcctttcaaggatattcatctggcaaggcggttgtacgacatggctgctcagaccagtcctgacgcgcatatacccgtgttgtttgccgttatgaagctggagactactcacctgttgcgggacatcctgtttttcaatttcactacacgatggaactggcttaagcttgacaataccatcggccctcactgggacctattcgtaattggcttgatagttccaggacttattttgcttctgcggaaccaccacggctag

SEQ ID NO: 239846 - DNA, 1833 bp, Artificial Sequence
  Description of Artificial Sequence: Synthetic coding sequence
atgattgcttcacagtttctttctgcactgacactggtgctcttgattaaggagtcaggtgcctggtcctacaatacatccacggaggcgatgacatatgatgaagcaagtgcgtattgtcaacagcgttacacgcatctggtggccattcagaataaagaagagatagagtacctgaattccatactgtcctactctccatcttactattggataggaatcagaaaggtgaataacgtctgggtatgggtgggcactcagaagcctctgacagaggaggccaagaattgggctccaggtgaacctaacaaccgacagaaggacgaggattgtgtcgaaatatacatcaaaagggaaaaggatgtgggaatgtggaatgacgagcgatgctcaaagaagaagttggcactgtgttataccgccgcatgcaccaacacttcctgctcaggccacggagagtgcgtggaaacaattaacaattatacttgcaagtgtgacccgggattttctgggctaaagtgtgaacagattgtcaattgcaccgccctcgagtccccagagcatgggtccctggtgtgctcgcatccacttggtaactttagctacaactctagttgctctattagttgcgacagaggatatctccctagctctatggaaaccatgcaatgcatgtcatcaggggagtggtctgccccaatccccgcttgcaatgtagtcgaatgcgacgctgtgactaaccctgccaatggctttgtcgagtgctttcagaatcctggctcatttccctggaatacgacctgcaccttcgactgcgaggaagggtttgaattgatgggtgcccagtctctccagtgtacctccagtgggaactgggacaatgaaaaacctacctgcaaggcagtgacatgccgggcagtgcgacaacctcagaatggcagcgtgaggtgctcacactctccggcaggagagtttacgtttaagtctagctgcaatttcacttgtgaagaggggttcatgctgcagggccctgcgcaggtagaatgtaccacccagggccagtggacacagcagattcccgtgtgcgaagcctttcagtgtacagccttgtctaacccggagagggggtacatgaactgtcttcccagtgcctccgggtcattcagatatggctcttcctgtgagttcagctgcgagcagggctttgtgttgaagggaagtaaaagactacagtgcgggcctaccggagaatgggataatgaaaagcccacctgcgaagccgtgaggtgcgacgccgtgcaccagcccccaaagggcctggtgagatgtgctcatagtcctatcggcgagtttacttacaagtcttcctgcgcctttagttgcgaggagggctttgagctccacgggtctacacaactagaatgcacctcccagggtcagtggaccgaggaagtcccttcttgtcaggttgttaaatgctcgtccctggccgttcccggtaagattaatatgagctgctctggggaaccggtatttggaacagtctgtaagtttgcctgccccgaaggctggactctgaacggtagtgccgctcgaacctgcggagcaacaggacattggtccggattactgcctacctgcgaagccccaacagagtcaaacattcccctcgtggctggtttgtccgctgcgggtctgtcactcctgacactcgcaccctttctcctctggctacgcaaatgcctaagaaaagccaaaaagttcgtgcccgcttcctcatgccagagtctggaaagtgacggatcctaccagaaaccatcgtatattctttag

SEQ ID NO: 239847 - DNA, 1455 bp, Artificial Sequence
  Description of Artificial Sequence: Synthetic coding sequence
atgatcgcaagtcagttcctgagcgcacttacactagtcctcctgattaaggaatcgggcgcttggtcttataacaccagtactgaagccatgacttacgacgaagcgagcgcctactgtcaacagcgctacacacacctggtcgctatccagaacaaagaggaaatagagtatttgaatagtattctcagttattcgcccagctactactggatcggaattagaaaggtaaataatgtgtgggtctgggtgggtacacaaaagccgttgaccgaggaggccaaaaattgggccccaggggagccaaataaccgccagaaggatgaagactgtgtagaaatatacataaagagggaaaaagatgtgggcatgtggaacgacgaaagatgttctaagaaaaagttggctctgtgttatactgcagcctgtacaaacaccagctgttccgggcatggcgagtgtgtggagacaattaacaactacacctgtaaatgcgaccctggattttctggtctgaagtgcgagcaaatcgttaattgtacagctttagagagccctgagcacggaagcttggtttgctcccacccattgggcaatttttcctacaattctagctgttcaatcagctgcgaccgtggctacctaccctcatccatggagacaatgcagtgcatgagctccggcgagtggtctgccccaattccagcctgtaatgtggtggagtgtgatgccgtcactaatccggctaatgggtttgtcgaatgtttccaaaatcccggaagtttcccctggaacactacttgtacttttgactgcgaagaaggtttcgagctgatgggcgctcaatccctgcagtgcactagctcaggcaactgggacaatgaaaaaccaacatgcaaggcagtgacctgtagagcagtgcgccaacctcagaatggctccgtgagatgttcccatagccccgcaggagagttcacatttaaaagctcctgcaacttcacttgtgaggagggcttcatgctgcaaggacctgcgcaggttgagtgtacaactcagggccagtggacccagcaaataccggtctgtgaggtcgtgaagtgctcttcactggcggtacctggaaagattaacatgagctgcagcggtgagccagtctttggcacagtatgtaagttcgcttgcccagagggatggacactgaatggcagtgctgcacgcacatgtggggctacaggtcattggtcaggccttttaccaacctgtgaggccccaactgaaagtaacatccctctcgtcgccggtcttagcgcagctgggctgtcactgctgacactggcgccattcttgctttggttgcggaagtgtttgcgcaaagccaaaaagttcgtgcctgcctcctcttgtcagtcactagagtccgatggatcgtaccagaagccgagctatattctatag

SEQ ID NO: 239848 - DNA, 1458 bp, Artificial Sequence
  Description of Artificial Sequence: Synthetic coding sequence
atgatagctagccaattcttatctgctctaacccttgttctccttataaaggagtctggcgcttggtcctacaatacgagcaccgaggctatgacgtacgatgaggccagcgcctattgccagcagcggtacacccatctggttgcgatacaaaacaaggaggagatcgagtacctcaactctatcctgtcatattctccctcttactactggatcgggatcaggaaagtcaataacgtatgggtatgggtgggaacgcagaagcccctgacggaggaagccaagaactgggcaccaggcgagccaaataatcggcagaaagacgaggattgcgtcgaaatatatattaagagggagaaagatgtgggcatgtggaacgacgagcggtgctcgaaaaagaaacttgcgctctgttatactgctgcctgcacaaatactagctgctcagggcacggggagtgcgtggaaacgattaataactatacctgcaagtgtgatcccggtttctctgggctaaagtgtgaacagatggtcgagtgcgacgcagtcaccaatcccgctaatggctttgtagagtgcttccagaaccctgggagctttccctggaacacaacctgtacgttcgattgcgaagaggggttcgaactcatgggggcacagagtctgcagtgcaccagttctggcaactgggataatgagaaacccacctgtaaggctgtgacctgccgggcagtccggcagccgcagaatggtagcgtgaggtgttctcactcccctgccggtgaattcacattcaaatcatcttgtaacttcacgtgcgaggaaggctttatgttacaagggcctgctcaggtggaatgtactactcaaggccaatggactcagcaaattcctgtatgtgaagcagtgcgctgcgatgcagtacaccagccccctaaagggctggtccgatgcgcacacagcccaatcggtgaatttacgtacaagtcctcttgcgccttcagctgcgaggaggggttcgaattgcatggctctactcaactggaatgcactagtcaggggcagtggacagaggaggttccaagctgtcaagtggtgaaatgcagcagcctcgccgtccctggtaagattaacatgtcttgctctggcgaaccagttttcggaaccgtgtgtaagttcgcttgtcccgaaggctggaccctcaatggttccgctgccagaacctgtggcgctacaggccactggtcaggcttgcttcccacatgcgaggcaccaacagaatcaaacattccccttgtggccggattatccgccgcaggactcagtctgcttacactcgccccatttttactatggctaagaaaatgcctgagaaaggccaagaagtttgtgccagcctcttcctgtcagtctctagagtcggatggctcctatcagaagccttcttatattctatag

SEQ ID NO: 239849 - DNA, 1644 bp, Artificial Sequence
  Description of Artificial Sequence: Synthetic coding sequence
atgattgcatcccagttcttatctgcactgacactggtgctgctcataaaagagagcggcgcttggagctataatacctcaacagaagccatgacgtacgatgaagcctcagcttactgccaacaacgttacacacacctggtagccatccagaacaaagaagaaatcgaatatttaaattcgatcctttcctatagcccaagttattactggatcggaatccgcaaggtcaacaacgtgtgggtgtgggtcgggactcagaagccgcttaccgaggaagcaaaaaactgggccccaggagaacctaataatagacagaaggatgaggattgtgtggagatatacatcaaacgcgagaaggatgtaggcatgtggaacgacgagcgctgtagcaaaaagaagctagccttatgctacaccgctgcttgtaccaacaccagttgttcgggacacggcgagtgcgttgagacaataaataactacacttgtaaatgcgatccagggtttagtggcttgaagtgtgaacagattgtgaactgcactgcactggaaagccctgagcacggctccctggtctgtagtcaccctctcggaaactttagctacaatagcagctgcagcatctcctgtgaccgtgggtacttgccttcttccatggaaactatgcaatgtatgagtagtggagaatggtccgcccctatccccgcatgtaatgtagttgaatgtgatgctgtaaccaaccccgctaatggttttgtcgaatgttttcagaatccaggaagcttcccctggaacactacctgtacattcgattgcgaagagggctttgagctgatgggggcacaatctctccagtgcacctccagtggtaactgggataacgaaaaacctacatgtaaagccgtgacttgcagagcagttagacagcctcaaaatggatcggtgcggtgttcccatagtcccgctggagagtttacctttaaaagctcctgtaatttcacatgcgaagaaggatttatgctgcaggggcctgctcaggtagagtgcacaacacaaggccagtggactcagcagatccctgtttgcgaggctgtgagatgcgacgccgttcaccaacctcctaaaggtctggttagatgtgctcacagccctatcggcgagtttacttataaatcatcctgtgccttttcttgtgaagagggatttgagctccacggttctacccagcttgagtgcacatcccaagggcaatggactgaggaagttccaagctgccaggtcgtcaaatgctcaagtctcgccgtgcctggaaaaattaacatgtcctgcagcggggaacctgttttcggcaccgtctgtaaatttgcgtgcccagaaggctggacactgaacgggtccgccgctaggacgtgtggtgctacgggccactggtctgggctgctgcctacgtgcgaagctccaaccgagtccaacattccgctcgtggccggtttgagcgcggctggattgtccctgttaacactggcgcctttcctgctgtggttaaggaaatgcttgaggaaggccaaaaagtttgtccccgcatcttcctgtcagtctttggagtctgacggcagctaccagaaaccttcctacattctatag

SEQ ID NO: 239850 - DNA, 1644 bp, Artificial Sequence
  Description of Artificial Sequence: Synthetic coding sequence
atgatcgccagtcagtttttatcagccttgacccttgtgctcctgattaaagaaagtggggcttggagctataatacttcaaccgaggctatgacctatgatgaagccagcgcatattgccagcaacggtatactcaccttgtcgcgatccagaataaggaagagattgaatatctgaacagcatcctgtcatatagtccaagttactactggattggtatacggaaggtcaataacgtctgggtctgggtcggaactcagaagcccctcaccgaagaagccaagaactgggctcccggagagccaaacaaccgccagaaggacgaggactgcgtggaaatatatattaaacgcgagaaggatgtggggatgtggaatgacgaacggtgcagcaaaaaaaagttggcactgtgctacaccgccgcttgtactaatacttcgtgtagcggacacggagagtgtgtagaaactataaataactatacctgcaagtgtgatccaggcttcagcggcctcaagtgtgagcagatcgtgaactgcacagcccttgaatcaccggagcacggatcactcgtgtgctcgcatcccctcggcaatttcagctacaactctagttgcagcatcagttgcgataggggatacctgccaagcagcatggagactatgcagtgcatgtcctcaggagaatggtcagcaccgatacctgcttgcaacgtggtcgagtgtgacgccgtgaccaaccccgctaacggcttcgttgaatgtttccagaacccagggagcttcccttggaatacgacatgcaccttcgattgcgaagagggctttgaattaatgggggctcaatctttgcagtgtaccagtagcggcaactgggacaacgaaaaacccacctgtaaagccgtgacatgccgcgcagtgcggcagccccagaatgggtctgtgcgctgctcacatagcccggctggtgaatttaccttcaagtcttcctgcaactttacctgcgaagagggtttcatgttgcagggcccagcacaggtagagtgtactacgcagggccagtggactcaacaaatacctgtgtgtgaagcatttcagtgcactgcattatctaatccagagcgaggatatatgaattgtctgccttccgctagtggatctttcaggtatggaagttcgtgtgagtttagctgtgaacagggctttgtattgaaaggctcaaagcgactccaatgtgggcctactggagaatgggataatgaaaaaccaacatgcgaagtggtgaagtgcagcagtcttgcagtcccaggaaagattaacatgtcatgctctggggagccggtgtttggtactgtttgtaaatttgcttgtccggaggggtggactctcaatgggtctgccgcaagaacctgcggagccacagggcactggtctgggttgctgcctacttgcgaagcacctactgaatccaatatccccctggtggccggtctctccgccgcagggttatcccttttgacactggctccctttctgttgtggctgcggaaatgcctgcggaaggcgaagaagttcgtgcccgcatctagctgtcagtccctggagtctgatggaagttatcagaagccctcctatatactgtag

SEQ ID NO: 239851 - DNA, 1455 bp, Artificial Sequence
  Description of Artificial Sequence: Synthetic coding sequence
atgattgcatctcagtttttgtccgccctcacattagtgctgttgatcaaagagagcggtgcatggagttataatacgtctacggaagctatgacttacgacgaagcttccgcctattgccaacagcggtacacgcacctagttgccattcagaacaaagaggagatcgagtacctcaatagtattctctcctactcaccgtcctactactggattggcatacggaaggttaataatgtctgggtttgggtcggaacacagaagccgcttactgaagaggctaagaattgggcccctggcgagcccaataatcgacaaaaggacgaggactgcgttgagatttacatcaagcgcgagaaggatgtcgggatgtggaacgacgaacgatgctccaaaaagaagctggcactttgttacacggcagcctgtacaaacactagctgttcaggccatggcgagtgcgttgaaacaattaataactatacttgcaagtgcgaccctgggttctcaggcctgaagtgcgaacagattgttaattgcactgcactagaatctccagagcacgggtctcttgtttgcagtcaccccctgggcaacttttcttacaattcaagttgttcaatttcatgcgacaggggctatctgccctcctccatggagaccatgcagtgcatgagcagcggcgagtggtctgccccaattccggcatgtaacgttgttgagtgcgacgccgtgaccaatcctgctaacggattcgtggagtgctttcagaacccgggatctttcccatggaatactacatgcaccttcgactgtgaggaggggttcgaactcatgggcgctcagtctctccagtgcaccagctcaggaaactgggacaatgagaagcccacctgtaaggccgtgacctgcagagccgtccgacagccacaaaatgggtccgttaggtgctctcactcccctgccggtgaattcacgtttaagtcctcttgtaacttcacctgcgaagaaggtttcatgcttcaaggcccagctcaggtcgagtgcactactcagggccagtggacccagcaaatcccggtctgtgaggtcgtgaaatgctcttcactggctgtgcccggtaagatcaatatgagctgctctggagagccggtttttggaactgtgtgtaagtttgcttgtcctgagggatggaccctgaacggcagcgccgcacggacctgtggagccactgggcactggtcaggtttgttgccaacctgcgaagcgccaactgagtctaatattccgctcgtggctggcctgagcgcagctgggctgtccctcctgacactggcaccctttctactgtggctgcgaaaatgcctgagaaaagccaagaaattcgtgccagcttcatcatgtcagagcttagagtcagatggctcgtatcagaagcccagctacattctttag

SEQ ID NO: 239852 - DNA, 1458 bp, Artificial Sequence
  Description of Artificial Sequence: Synthetic coding sequence
atgattgcctcccaattcctttcagctttgactctcgtacttcttataaaagagagtggagcatggtcctacaatacgtcaactgaagctatgacctacgacgaagcctcagcatattgtcagcaaagatacactcacttagtagccatacagaataaagaggaaatagaatacttaaattcgatactttcttacagcccaagttactactggattggcatccggaaggttaacaatgtttgggtgtgggtcggcacacagaagccactcacagaagaggcaaaaaattgggctcctggggaacccaataaccgccagaaggatgaagactgtgtggagatctatattaaacgggagaaggacgttggtatgtggaatgatgaacgttgcagcaaaaagaagctggccctttgttatactgcggcttgcaccaatacaagttgcagcgggcacggagagtgtgttgagaccatcaacaactatacttgcaagtgcgacccaggatttagtggacttaagtgtgaacagatggtggagtgtgatgccgtcacaaatcccgcaaacggatttgtggagtgtttccagaaccccggatcatttccctggaataccacttgtaccttcgattgcgaagaagggtttgaactcatgggtgcacagtccctgcagtgtacctcttccgggaattgggacaacgagaaacccacatgtaaggccgtgacctgtcgcgctgttaggcagccccaaaatgggagtgtgcgttgctcgcattcccccgcaggggagttcacttttaaaagctcatgcaattttacatgcgaagaaggcttcatgttgcagggaccagcacaggttgagtgtactacccagggtcagtggacccagcaaattccagtttgtgaggccgtgcgatgcgacgccgtgcaccagccacctaaaggattggttcgctgtgctcattctcccatcggggagttcacttacaagtcatcctgtgctttttcgtgtgaagaggggttcgaactacacggctccacccagctggagtgtacctcccagggtcagtggacagaggaggtcccctcttgccaagtagtcaagtgtagctcccttgccgtccccggaaaaatcaacatgtcatgttcaggcgaacccgtctttggtacggtgtgtaagtttgcatgtccagagggttggacattaaatggttccgcggcaaggacatgtggggctacaggccactggtcgggtcttctgccaacatgcgaggcccctacagagagtaacattccgttggtggctggcctctcggctgccggtctctccctgctgactcttgcccctttcctcttatggttacgaaagtgcctgcgcaaggccaaaaagtttgtgccagcatctagctgccagagcctagaaagcgatggttcctaccagaaacctagctatattttatag

SEQ ID NO: 239853 - DNA, 1644 bp, Artificial Sequence
  Description of Artificial Sequence: Synthetic coding sequence
atgatcgcgtcacagtttttaagtgccttgaccctggttttattaattaaggaatctggcgcttggtcctataacacatccaccgaagctatgacttacgatgaagcatcggcctattgccaacagagatatacacatctcgtggccattcagaataaagaggaaattgaatatctcaacagtattctttcctactcacccagttactattggatagggatccggaaggttaacaacgtctgggtctgggttggtacacagaagccacttacggaagaggccaaaaactgggcccctggcgaaccaaataaccgacaaaaagatgaggactgtgtggagatatatattaagagggagaaggacgttggcatgtggaacgacgaacgttgtagcaagaagaagttggctctctgctatacagctgcttgtacaaacacaagctgttcaggccatggcgagtgcgtggagaccattaataactacacttgtaaatgtgaccctggattctccggccttaagtgtgagcagatcgtgaattgcacggccttagagagtccagagcacggatcgctcgtgtgttcccatcctctcgggaatttttcatataattcttcatgttctattagctgtgatcgtgggtatctaccgtcctccatggaaacaatgcagtgtatgtcatccggagaatggagcgctcctatcccagcctgtaatgttgtggaatgtgatgctgtgacaaatccggcaaacgggttcgtggaatgcttccagaaccccggaagctttccttggaacacaacttgtactttcgattgcgaggaaggatttgaactcatgggggcacagagtctgcagtgcacatccagcggtaactgggataatgaaaaacctacctgcaaggccgtcacctgccgagccgtgcgccagccacagaatggcagcgtgcggtgtagtcacagccctgccggagaattcacatttaagtcgtcctgtaacttcacttgtgaggagggctttatgcttcaaggacctgctcaggtagagtgcaccactcagggacagtggacccagcagatccctgtctgtgaggctgttcggtgcgatgcggtacaccagccacccaagggtctcgtgcgatgtgctcacagccccatcggagagttcacctacaaatccagctgcgccttctcttgtgaggaaggatttgaactgcacggctcgacccagctggagtgcaccagtcagggacagtggacagaggaggttcccagctgccaggtggtgaagtgctccagcttggccgttccgggtaagattaatatgagttgctccggtgagcccgtttttggcaccgtttgtaaattcgcttgtcccgaaggctggacacttaacggcagcgcagcccgaacgtgcggcgctaccgggcactggtccggactgctacccacatgcgaggctcctacagaatccaacattcccctcgttgccggactttccgcagctgggctgtccctcttgacactggctccttttcttctctggctgcggaagtgtttgcggaaggctaagaagtttgtcccggcatccagttgtcaatcacttgagtcggatggatcatatcaaaagccttcctatatcctatag

SEQ ID NO: 239854 - DNA, 1644 bp, Artificial Sequence
  Description of Artificial Sequence: Synthetic coding sequence
atgatcgcttcacagtttcttagcgccttaaccttggttcttctgattaaggagagtggagcctggagttacaatactagcaccgaggccatgacctatgacgaggcctccgcgtattgccagcagcgctacacccaccttgtcgccatccagaataaagaggaaatcgagtatctcaattctatcttatcctactctccttcatattactggatcggaattaggaaggtcaacaatgtatgggtgtgggtgggcacccaaaaaccgcttactgaggaagccaagaactgggctcccggtgaacccaataacagacagaaagatgaggactgcgtcgagatctatatcaaaagggaaaaggacgttgggatgtggaacgacgagagatgctccaagaaaaagttagctctgtgctacacggccgcatgcaccaatacgagctgctctggccatggtgagtgtgtagagacgataaataactatacgtgtaaatgtgatccagggttctcgggtcttaagtgtgaacagattgttaattgcactgccctggagtcacccgaacatgggtctcttgtctgttctcaccctctcggtaacttctcgtataactctagttgctctatttcctgtgacagggggtatctgccctcctccatggagactatgcagtgcatgagttccggggagtggtcagccccaatccccgcttgtaacgtcgtagagtgcgacgccgtgactaaccccgcaaatgggtttgtggaatgttttcaaaatccaggatccttcccgtggaacactacatgcacctttgactgcgaggagggttttgagctcatgggggctcagtccttacaatgtacctctagcgggaattgggataatgaaaagccaacctgcaaagccgttacatgccgagctgtccggcaaccccagaacggctctgtgcggtgctcacacagccctgcaggtgaatttacctttaagtccagttgtaatttcacgtgcgaagaaggctttatgctacagggcccagcccaggtggagtgtacaactcagggacagtggacacagcagatcccagtctgcgaagcgtttcaatgtacagcgctctccaatccggagcggggatatatgaactgcctgccatcggctagtggatctttcaggtacgggagcagctgtgagttctcatgtgaacagggattcgtgctcaaagggtccaagcgactgcaatgcggtcctacgggagagtgggacaacgaaaagcctacatgcgaagttgtgaaatgcagctcactggctgtacctggaaaaatcaacatgtcgtgttccggagagccagtgttcggcactgtttgtaagtttgcctgtccagagggatggacgcttaatggctcggctgcgaggacgtgtggagcgactggtcactggagtggcctgctgccaacatgcgaggccccaacagagtccaacatccctctggtggctggtctgtcagcggcaggcctctccctcctcaccctcgcacccttcctgttatggcttagaaagtgcttgagaaaggctaagaagtttgtgcctgcctcttcttgccagtccctggagtccgacggctcttaccagaagccgagctacattttgtag

SEQ ID NO: 239855 - DNA, 1158 bp, Artificial Sequence
  Description of Artificial Sequence: Synthetic coding sequence
atgggatgcaggagaaccagggagggacccagcaaggctatgatctttccttggaagtgccagtccacacaaagagacctgtggaatatttttaaactctggggatggacaatgctgtgctgtgacttcctggcacatcacggtacagattgttggacttatcattactcggagaaacctatgaactggcagagggccaggcgtttttgcagagataattataccgatcttgtggcaatacagaacaaagccgaaatcgaataccttgagaaaacgttgcctttttccaggagctactattggataggaatacggaaaatcggaggcatctggacatgggtgggaacaaacaaatcattgacagaggaagctgagaactggggagacggcgaacctaacaataaaaaaaacaaggaggattgtgtggaaatctacatcaagcggaacaaagatgccggaaaatggaatgatgacgcttgccacaaacttaaagcagcactctgttataccgcatcctgccagccatggtcctgctctgggcacggagaatgtgtcgagattatcaacaattacacctgtaactgcgacgtggggtattacggccctcagtgtcaatttgtgatccaatgcgaacctttagaggccccagagttgggtaccatggactgtacgcaccccctaggaaatttctctttcagcagccaatgcgcatttagctgcagcgagggcacgaatctaacgggtatcgaagaaacaacatgcgggccatttggcaactggtccagcccagaaccaacttgccaagttattcagtgcgaacccctctcagcaccggacctggggatcatgaactgctcgcaccctctggcctcgttttcatttacgtctgcttgcacatttatatgtagcgaggggaccgaactgatcggaaagaagaagaccatatgcgaatcgagtggaatctggtccaatcccagtcccatctgccagaagctcgacaagagttttagtatgatcaaagagggggactacaatccacttttcataccggtagcggttatggtgacagccttctctggactcgcttttattatttggctggccagacggcttaaaaaggggaagaagtccaagaggagcatgaatgatccttactag

SEQ ID NO: 239856 - DNA, 2493 bp, Artificial Sequence
  Description of Artificial Sequence: Synthetic coding sequence
atggctaattgtcagatcgcaattttgtaccagcgcttccaacgcgtggtgtttggcatctctcagttactctgcttctccgccctcatcagtgaactcacaaaccagaaggaggtggccgcatggacctatcattacagtaccaaagcatatagttggaacatttccagaaagtattgccagaaccgttacacagaccttgtggccatccagaataaaaatgagatcgattacttgaataaagttttaccttattatagttcttactactggataggcattaggaaaaataataaaacctggacttgggtgggaaccaagaaggccctcacaaacgaggccgaaaactgggctgacaatgaacctaacaataagaggaacaatgaagattgcgttgaaatttacatcaagagcccatcagctccgggtaaatggaatgatgagcattgcctgaagaagaaacatgccctttgctacacagcatcctgccaggacatgtcatgctcgaagcagggagagtgcctggaaactatcggcaactatacttgcagctgttaccccggtttctacggaccagagtgcgaatacgttcgggaatgtggcgagctggagcttccccaacacgtgcttatgaattgcagccatcccctcggcaatttttcatttaactcccagtgtagcttccactgcacagacggataccaggttaatggaccaagcaaactggagtgtctggcttccgggatctggaccaacaagccacctcagtgcctcgctgcccagtgccctccgctgaagataccagagagggggaatatgacctgcctgcatagtgccaaagcctttcagcaccaatcatcctgtagcttctcatgcgaagaaggctttgctctggtagggcctgaggtcgtgcagtgtacagcctctggcgtctggacagcacccgctcctgtctgcaaagccgtccaatgccagcatttagaagctcctagcgaaggcaccatggactgtgtgcatcctcttaccgcctttgcctacgggagtagttgcaagtttgaatgtcagccagggtaccgagtccggggactagatatgctccggtgtatcgattcaggccactggtcggcaccccttccaacatgtgaggctatttcttgcgagcccctagagagtcccgttcacggtagcatggattgcagcccgagcttaagagcatttcagtacgatacaaattgcagttttcggtgcgccgagggctttatgctgcggggtgcggatatcgttagatgcgacaacctgggtcagtggactgcgccagctcctgtgtgccaggcgcttcagtgtcaggatcttcctgtgcctaatgaagctcgtgtgaattgcagccaccccttcggcgctttcagataccagtcggtgtgttcctttacatgtaatgagggtctgctcctggtaggtgccagtgtcttacagtgtctcgccaccggtaactggaactctgtgcccccagaatgtcaggcgatcccctgtactccgctgttatccccgcaaaatggcacaatgacctgtgtccagccgttgggctcgagctcctacaaaagtacctgccagttcatttgtgacgagggctactcgctgtctgggccagagcggctggattgcactagatcaggtcgatggactgactcccctcctatgtgcgaggccatcaaatgccctgagcttttcgctcccgagcaaggatcactcgattgcagcgacactaggggagaatttaacgtgggctcaacttgtcattttagttgtgataacgggttcaaactggagggaccaaataacgtcgagtgtacaaccagcgggaggtggtcagccactccgccaacttgcaagggaatcgcttctctgcccacccccggtgtgcagtgcccagctctcactacacctggccaggggaccatgtactgcaggcatcacccaggcactttcggctttaacaccacttgttactttgggtgtaatgcgggttttactctcataggggattcgactctttcctgccgacccagtggacaatggaccgccgttactcccgcttgccgagctgtcaaatgttccgaactccatgtcaacaagccaatcgctatgaattgctccaatctctggggcaacttttcttatgggtccatatgttcatttcactgcctggaaggccaactgctaaatggatccgcccaaactgcctgccaggagaatggacactggagcacaacagtcccaacttgccaggcaggacctctcaccattcaagaggcattgacttacttcgggggagctgtggcgtctacgattggactgattatggggggtacccttctcgctctcctgagaaagaggtttagacagaaggatgacgggaaatgccccctgaacccgcacagccacttgggaacctatggcgtgttcacgaacgctgcttttgatccgagcccttag

SEQ ID NO: 239857 - DNA, 2307 bp, Artificial Sequence
  Description of Artificial Sequence: Synthetic coding sequence
atggccaattgccagattgccatcctctatcaaagatttcaacgtgtggtctttgggatcagccagcttctatgctttagcgctctgatttccgaactgactaaccagaaagaagtggccgcatggacgtatcactacagtacgaaagcgtatagttggaacatcagtagaaaatattgccaaaacaggtacacggacttagtcgctattcaaaataaaaatgaaatcgattatctgaacaaggtcttgccttactattcatcttactactggattggcattaggaaaaacaacaagacctggacttgggttggtacaaagaaggcactgaccaacgaagcggagaattgggcagataacgagccaaataacaagcggaacaacgaagactgcgtggagatctatattaaaagccccagtgcccctgggaaatggaacgatgagcactgccttaagaagaaacacgccttatgttacacagccagctgccaagacatgagctgctcaaaacagggcgaatgtcttgaaacgatagggaactatacttgttcttgctatcctggattttatggaccagagtgtgaatatgtgagagagtgtggggagttggagttaccacagcatgtactgatgaactgttctcacccattaggaaacttctccttcaactctcagtgttcctttcactgcaccgatggctaccaggttaatggccctagtaagttggagtgtctggcaagcggaatctggactaacaagcctccccagtgcctggcagctcagtgcccgcctctcaaaatccccgaaagaggtaacatgacatgcctgcactcagccaaggccttccagcaccagagcagctgttcattcagctgcgaagaaggttttgccttggtagggccagaggtggtgcaatgtacagcatcaggcgtgtggacagctcctgccccagtgtgtaaggccatatcatgcgaacccctcgaaagcccagttcatggaagcatggattgtagcccatctctaagggccttccagtatgacacaaactgctccttcagatgcgcggaaggattcatgttacgcggagcagatatcgtcagatgtgacaaccttggccagtggactgcacctgctcccgtttgtcaggcgctacagtgtcaggacttgcctgttccaaatgaagccagggtgaactgctcccaccctttcggcgcattcaggtaccagagcgtatgcagcttcacatgcaacgagggtctgctcttagtgggagcctctgttctgcagtgcctggcgactggcaactggaacagtgtgccccctgagtgccaggccatcccatgcactcccctcctgtccccacagaatggcaccatgacctgcgttcagcccctgggatcttctagttataaaagcacttgccagttcatctgcgacgaggggtattccctctccggaccagaacgcctcgattgtacccggtcaggtcgctggactgatagcccacccatgtgcgaagcaatcaagtgcccagagttgttcgcaccggagcagggttcactggattgttccgataccagaggagaattcaacgtcgggagcacttgccactttagttgcgacaatggctttaagctggaagggccaaacaatgtggaatgcactacaagcgggaggtggtcagccacccccccaacctgcaaaggtatcgcctctctccctaccccgggagtgcaatgtcccgctctcacaaccccaggccagggcactatgtattgcaggcatcatcctggcacctttggttttaacacaacatgttatttcggctgtaatgcaggttttacacttataggggactcaacgctgtcatgccgaccttccggtcagtggaccgcagtaacaccagcctgccgagctgtcaaatgctctgagctgcatgtcaacaaaccaatagctatgaattgcagtaatctgtggggcaatttctcatacggatccatatgtagctttcattgtctggagggccagttgctcaacggctcggcccaaaccgcgtgtcaggagaatgggcactggagcactaccgtacccacctgccaggccggacccttgactatccaggaagcactgacatactttggtggagctgtggcttcaaccattggactgatcatgggaggcaccctcctcgcgcttctaagaaaacgtttccggcagaaagatgatggaaagtgcccactgaatccccattcccacctgggcacctatggcgtgttcacaaacgccgcattcgatccctctccttag

SEQ ID NO: 239858 - DNA, 2307 bp, Artificial Sequence
  Description of Artificial Sequence: Synthetic coding sequence
atggctaactgtcaaatcgctattctctatcaacgattccagagggtagtgtttgggatttcacagcttctgtgctttagcgccctgatcagcgagctgacaaatcagaaagaagtggccgcatggacgtaccactactctaccaaggcgtactcctggaacatctcccggaaatactgtcagaacagatacacagacctggtcgccatccagaacaagaacgagatcgactatctgaacaaggttctcccatactactcttcctactactggatagggatccgcaaaaataataagacttggacttgggtgggcacgaagaaggcacttaccaacgaggccgagaattgggccgataacgagcctaataataagaggaacaatgaggattgtgtcgaaatctatataaagtcaccttctgcccctggcaagtggaacgacgaacactgcctgaaaaagaagcacgcactatgttacaccgcttcctgccaagatatgtcatgctcaaaacagggcgagtgcctggaaacgatcggaaattatacttgtagctgctatcctgggttttacgggccagaatgcgagtacgtccgagagtgcggagaactagaattgccccaacatgttcttatgaactgcagccaccctctgggcaacttttctttcaacagccagtgcagttttcattgcactgacggctatcaggtgaacggcccttctaagcttgagtgcctcgcttccggaatctggacaaataaaccgccacagtgtctggcagtgcagtgccagcacctcgaggcaccctctgaaggcactatggattgtgttcatccgctgacagcctttgcctacggatcatcatgtaagtttgaatgccagcctgggtacagggttcgaggtcttgacatgttgcgatgtattgattctgggcactggtctgctcccttgcccacctgcgaggccatctcatgcgagcctctggaatctcccgtgcacggaagtatggactgctcaccgtccttacgtgcctttcagtatgacacaaattgctccttccgttgcgcagaagggtttatgttgagaggagcagatattgttaggtgcgataatttggggcaatggacagcccctgctccagtgtgccaggcattgcagtgccaagatctgcctgtgccaaatgaggccagggtgaattgctcccacccttttggggcttttcgttaccagagcgtgtgctccttcacgtgcaacgagggtctcttgctcgttggagcaagtgtgctgcagtgcttagccaccggaaattggaactctgtccctcccgaatgtcaggctattccctgcacaccactgctgtccccacagaatggaacgatgacatgcgtgcagcctctgggcagtagcagttacaagtctacctgtcagtttatctgcgatgagggttattctctgtcaggtcccgagcggctggattgcacaaggagcggccgatggacagatagtccacccatgtgcgaggcgatcaagtgtcctgagctctttgcccctgagcagggttctctggactgctcagatactaggggcgagttcaatgttggcagtacatgtcactttagctgcgataacggtttcaagttagaaggtccaaacaacgtagaatgtactaccagcgggagatggagtgccactcctcccacatgtaaaggcatcgcaagcctaccaaccccaggagttcagtgccccgctctcactacgccagggcaaggcacaatgtactgtaggcatcacccaggtaccttcgggtttaataccacatgttacttcggctgcaatgctggcttcactctgattggagactcaacactgagttgtcgtcccagcgggcaatggaccgctgtcactcccgcttgcagagccgtgaaatgctctgagctgcatgtcaacaagcccatagcaatgaactgtagtaatctctggggcaatttttcttacggctcgatctgttcgtttcattgccttgaggggcagctcttgaacggaagcgcccagaccgcctgccaagaaaatgggcactggtcaaccacggtgcccacttgtcaggccggtccgctaaccatccaggaagccttgacctactttgggggtgcagtggccagcaccatcggcctgatcatggggggtaccttgttagcacttctgagaaagcggttccggcagaaagacgacggcaaatgccccctcaacccacactctcacctcggaacatatggggtattcacgaatgcagccttcgatccttccccttag

SEQ ID NO: 239859 - DNA, 1941 bp, Artificial Sequence
  Description of Artificial Sequence: Synthetic coding sequence
atggctaattgccaaatcgccattctgtatcagcggttccagcgagttgtttttgggatcagccagttactctgtttttccgccctgatatctgagctcaccaaccaaaaagaggtggctgcctggacatatcactattcaactaaggcatactcctggaacatcagccgcaagtactgccaaaatagatacacagaccttgtggccatccaaaataagaacgaaatcgactacctcaacaaggtgctcccctattattcctcttactattggattggtattcggaaaaacaataagacatggacatgggtgggcacaaagaaagccctaactaatgaagcagagaattgggccgataatgagccaaataataagcgcaacaacgaagactgcgtggagatctatatcaagtctccctctgcaccgggaaagtggaacgatgagcattgccttaaaaaaaaacacgcgctgtgttatacggcctcatgtcaggatatgtcttgcagtaagcagggagagtgcctggagacaatcggaaactatacttgttcttgttacccaggcttctacggcccagaatgcgagtacgtcagagagtgtggagaacttgaactaccacagcatgtgttgatgaactgctcgcaccctttaggaaatttttccttcaattcccagtgctcatttcattgtacagacgggtaccaggtgaacggaccatctaagctcgaatgccttgcaagcgggatatggactaataaaccgccacaatgcctggctgctcaatgtccacccctcaaaatcccagaaagggggaacatgacatgtctgcatagtgccaaggcgttccagcaccagtcttcctgcagcttctcttgtgaggaaggctttgctctggtggggccagaagtcgtgcagtgtaccgcgagcggtgtctggactgctcccgctcccgtgtgtaaggcaatctcgtgcgagccactcgagagccccgtccacgggagcatggattgttctccttctttgcgagcatttcaatatgacacaaattgcagttttagatgcgccgagggttttatgctgaggggtgccgacatcgtgcgctgtgataacctggggcaatggacagccccagctcctgtctgccaggctctgcagtgtcaggacctgcctgtgcctaacgaggcccgagtgaattgcagccatcccttcggtgcgtttcgatatcagagcgtgtgctctttcacctgcaacgaaggtttactcctcgtcggggcttctgttctgcaatgtctggctaccggtaactggaacagcgtgcctccagagtgtcaggggaaatctattgcttctttgcctacacctggggtccagtgtccggctctgacaacacctgggcagggcacaatgtactgtagacatcaccctggaacgttcggatttaacaccacctgctattttggatgcaacgccggatttactctcatcggtgactcgaccctgagctgtagaccttccggccagtggaccgccgtcacccccgcttgcagggcagttaaatgttctgagctccacgtgaataaaccgatcgctatgaattgctcgaatctgtgggggaatttcagttacggatctatttgttcatttcactgcctagagggccagctgctcaatggtagcgcccaaactgcctgtcaggaaaacggacactggtcaaccactgtgccaacatgccaggcaggtccactgacaattcaggaagctttgacctactttggcggagcagtcgcttcaacaattgggttaatcatggggggtaccctgcttgcacttttgcgtaagcggtttcggcaaaaagacgatggcaaatgccccctgaatcctcatagccaccttggaacctacggagtgtttactaacgcagctttcgacccatctccgtag

SEQ ID NO: 239860 - DNA, 2493 bp, Artificial Sequence
  Description of Artificial Sequence: Synthetic coding sequence
atggcaaattgccagatcgctatcttatatcaaagattccagcgcgttgttttcggaataagtcaactcttgtgcttttcggccctgatatccgagttgacaaatcaaaaggaggtagccgcatggacctaccactacagtactaaagcttatagttggaacatctctcgtaagtactgtcagaacagatacaccgaccttgtggcgatacagaacaagaatgagatagactatctaaataaagtcctgccatactactcatcgtattactggatcggaatcaggaagaataacaagacttggacctgggtaggaacgaagaaagccctcacaaacgaggcagagaattgggctgacaacgaaccaaacaacaaaaggaataacgaggactgcgtggagatttatatcaaaagtccttccgccccagggaagtggaacgacgagcactgcctcaagaaaaagcacgctctgtgttacactgcgagctgccaggacatgtcctgtagcaagcagggcgaatgcctggaaactataggtaattacacatgttcatgttacccgggtttctatgggccagaatgcgaatacgtgagagaatgcggtgagctggagctcccccagcatgtcctgatgaattgctcgcatccattaggaaatttttccttcaactcccagtgctcattccattgtacagacggttatcaagttaacggaccctccaaactggaatgcctggcctcagggatttggacaaacaaaccacctcagtgcctggcggcacagtgccctccgctcaaaattcctgagcgaggaaatatgacatgccttcatagtgctaaggcatttcaacatcagagcagctgctctttttcctgcgaggaaggttttgcactggttggtcccgaagtggtgcagtgtactgccagcggagtttggacagccccagcccctgtgtgtaaggccgtgcaatgccagcaccttgaggctccctcggagggaactatggattgtgtccaccctctgaccgcattcgcatatgggtcaagctgcaagtttgaatgccaaccgggataccgcgtgagaggtctggatatgcttcgctgtattgactctggtcactggagcgcccctctgcctacctgtgaggctatatcatgtgaacccctcgaaagcccggtacacgggtctatggattgctccccgtcacttagagcttttcagtacgatacgaactgctcttttaggtgtgccgaaggattcatgttacgtggagcagatattgttcggtgtgataacctgggccaatggactgcccctgctcctgtatgtcaagctctgcagtgtcaggatcttcctgtgccaaacgaggctagagtgaattgttcacatccttttggggctttcagatatcagagcgtgtgttcctttacgtgcaatgaggggctgctgttggttggggcatccgtccttcagtgcctggccactggcaactggaacagcgtgcctccagagtgtcaggcaattccatgtacccccctgctgtcgcctcagaacgggaccatgacctgtgtgcagcctttgggcagttcaagctataaaagcacatgccagttcatatgtgatgaagggtattctttgagcggcccagagcgcctggattgtactcggtctgggcgttggactgacagccctccgatgtgtgaagcgattaagtgccccgagttattcgccccagagcagggctcactggactgtagcgacacccggggagagttcaacgtaggttcgacatgccactttagttgtgacaacgggttcaagttagagggcccaaacaatgtagagtgtacgacctctggtaggtggtcggccacaccacccacctgcaaagggattgcctcgctgcctacaccaggcgtgcagtgtccagccttgacaactccaggacaggggaccatgtattgccgccaccatccagggacgtttggcttcaatactacctgttactttggctgcaacgcaggttttactctgataggtgactccacactgtcttgccgaccctccggccaatggacagccgtgacacccgcttgccgtgcagtcaaatgctctgagctccacgtgaacaaaccaatcgctatgaattgtagtaatctgtgggggaacttttcttacggaagcatctgcagcttccattgtctggagggccagttgctgaacggtagcgctcaaacagcctgccaggagaacggccattggagtacgacggtgcccacttgtcaggctggcccactgaccatccaggaggccttgacatattttggcggagctgtagcttctacgatcggattaatcatgggcggaacattgttagcgctcctccgcaagcgcttccgacagaaagacgatggcaaatgtcctctcaaccctcactcccacctgggaacctacggcgtgtttactaatgccgcttttgatcctagcccctag

SEQ ID NO: 239861 - DNA, 1935 bp, Artificial Sequence
  Description of Artificial Sequence: Synthetic coding sequence
atggctaattgccagatagctattctctatcagaggtttcagcgcgtcgtcttcggcattagccagctgctatgcttttcagcacttatttccgagcttacaaaccagaaagaggtcgcagcttggacgtaccactacagcaccaaggcttactcctggaatatctcccggaagtactgccagaacaggtataccgatctggtcgccattcagaacaagaacgaaatcgactacttgaataaggtgttgccctattacagttcatactattggatcgggattagaaagaacaacaaaacatggacgtgggtaggaaccaaaaaggccctgacgaacgaggccgagaattgggctgacaatgagccgaacaacaagcgaaacaacgaagactgtgttgaaatctatattaagtccccatctgcacctggcaagtggaatgacgaacactgcctgaaaaagaagcacgccctgtgctataccgcctcatgtcaggatatgagctgcagcaagcaaggcgagtgcctcgaaaccatcgggaactacacatgctcatgctaccctggattttacggcccagagtgtgagtatgtccgggaatgcggggaattagaattaccacaacacgtgttgatgaactgcagccatccgttaggaaatttctcattcaattcccaatgtagctttcactgtaccgacgggtaccaggtgaatggaccttccaagctagaatgtcttgcttcaggcatctggaccaacaaaccccctcaatgtctggccgctcaatgcccaccactgaaaatcccggaacgaggcaacatgacctgcttgcactccgccaaagctttccagcatcaaagctcttgctctttctcatgtgaggagggcttcgcactggtggggcctgaggttgtccagtgtacagcctccggtgtgtggacagccccagctcccgtgtgcaaagcacttcagtgtcaggatttgcccgtgcctaacgaagctagggtgaactgctctcacccctttggggcatttagatatcagtccgtctgtagcttcacttgcaacgaaggcttgcttttggtgggtgcctcagtcctccaatgtctggccacaggaaactggaactcagttccacccgagtgtcaggccatcccgtgtacacctttactgagtccccagaacgggactatgacctgcgtgcaacccctgggtagcagctcgtacaagagcacttgtcagttcatttgcgatgagggatatagtctctccgggcctgagaggctggactgtactagatctggcaggtggacggattccccacccatgtgtgaaggaattgcttcactcccaaccccaggcgtacagtgtccggcactgaccacaccaggccaaggcacaatgtattgtcgtcaccatcccggtacctttgggtttaacacaacctgctattttggctgtaatgcaggcttcacgcttattggagactctactcttagctgcagacctagcggacagtggaccgctgtgacaccagcttgccgcgcagtgaagtgctccgaactacacgtaaataaaccaattgcaatgaattgtagtaacctgtggggaaatttttcctatgggtccatctgctccttccattgcctggaggggcagctgctaaacggatcagcccagacagcttgtcaggaaaacgggcactggagcaccacggtgcctacctgccaggccggacctctcacaattcaggaggcgctaacatattttggaggcgctgttgctagtacaattggactcatcatgggcggtacacttttggccctattgcgtaaaaggttcaggcagaaagatgacggaaaatgcccattgaaccctcattctcacttagggacctatggcgttttcaccaacgctgcctttgatccttccccgtag

SEQ ID NO: 239862 - DNA, 1941 bp, Artificial Sequence
  Description of Artificial Sequence: Synthetic coding sequence
atggctaattgtcagatcgctattttataccaacggtttcagcgagttgtgttcggaatctcacagctgctttgttttagtgccctgatttcagaactgaccaaccagaaggaggtggctgcatggacgtaccattatagtaccaaggcctactcttggaacatctcacggaagtactgtcaaaaccgctacacagacctcgtggcaatccagaataagaacgaaattgactatttaaacaaagttcttccatactacagctcctattactggattggaatcagaaagaacaataaaacttggacctgggtgggcacgaagaaggccctcaccaacgaggcggagaattgggctgacaacgagcccaacaacaaacgcaataatgaggattgcgtggagatatacataaagagcccatctgctccaggtaagtggaacgacgagcattgtttgaaaaagaaacacgctctttgctacacagccagctgccaggatatgagctgctctaaacaaggggagtgtctggagaccattggcaactatacttgctcttgctacccgggtttctatgggcctgaatgtgaatacgtaagagaatgcggcgagttagagctgccacagcacgtgttgatgaactgttcccatccactcgggaatttttcattcaatagtcagtgttcttttcattgtactgacggctaccaggtaaacggaccctctaagctggaatgccttgcgagtggtatttggacgaataagccgccacagtgtcttgcagcccagtgccctccactgaaaataccggagcgcggaaatatgacgtgcctgcattccgcaaaagcctttcaacaccagtcctcctgcagctttagctgcgaggaaggatttgcactggtggggcctgaagttgttcagtgtacagcctccggagtctggactgccccagctcccgtgtgcaaggccatctcctgtgaacctctggagagccccgtgcacggtagcatggactgctctccctcattgagagcctttcagtacgataccaattgcagtttccgatgtgccgagggcttcatgctgcggggagcagacatagtacgttgcgacaatcttggacagtggactgcccctgcccctgtttgtcaggccctgcagtgccaagacctgccagtcccaaacgaagctcgcgtgaactgttcccacccttttggggctttccgctatcaaagcgtgtgctcattcacgtgcaatgagggcttgcttctggtgggagcatctgtgctccaatgcctggctacaggcaactggaattccgtccctccggaatgccagggaaaatcgattgcatccctgcctacacccggtgtgcagtgcccagcgcttaccacgcccggacaggggacaatgtactgtcggcatcacccagggacgttcgggtttaacaccacctgttatttcggctgtaacgctggctttacacttataggagacagtaccttgtcgtgtcgtccgagcggccagtggaccgcagtgactcccgcttgtcgggcagtgaagtgttccgaactgcatgtgaacaaacctatcgcaatgaattgctctaatctgtgggggaatttttcatacgggtccatttgttcttttcactgtctggaaggtcagctcctgaacggcagcgctcagaccgcctgccaggagaacggccattggtctaccaccgtcccaacatgtcaagccggacctctcacaatccaggaagctctgacatatttcggaggcgctgtggcgtcaaccatagggctgataatgggtggaaccctactggccttactaaggaaaagattccgccagaaagacgacggcaagtgtcccctgaacccacacagccatcttggcacatacggcgtcttcacaaacgctgcctttgacccaagcccatag

SEQ ID NO: 239863 - DNA, 2307 bp, Artificial Sequence
  Description of Artificial Sequence: Synthetic coding sequence
atggccaattgccagatagccattttgtatcaaaggtttcagagagtcgtttttggtatctcccaattactgtgtttcagcgctctgatctccgagctgaccaatcagaaggaagtcgccgcatggacatatcactattctaccaaggcatatagctggaacatttctagaaaatattgccaaaaccgctacacagatctcgtggctattcaaaataaaaatgaaatcgactacctcaataaagtgcttccatactattctagctactactggatcggcattcggaaaaacaataaaacctggacgtgggtgggtaccaaaaaggccctcaccaatgaggctgaaaactgggccgataacgagcccaacaacaagcgcaataatgaagattgcgtggagatatacatcaagtcaccttcagcacccggaaaatggaacgacgagcattgtctgaagaaaaagcatgctctctgctacaccgcaagctgccaggatatgagctgttcaaagcaaggggagtgccttgaaacgatcgggaattacacttgctcttgttatccaggattttacggtccagaatgcgagtatgtgagggagtgcggcgagctggagttacctcaacacgtcctcatgaattgctctcaccctctgggcaacttctccttcaattcacagtgcagttttcactgtactgacggctatcaggtgaacgggccttcaaaactcgagtgtctggccagcgggatctggacaaataagccaccccagtgtttggctgtgcagtgccagcacttagaagctccaagcgaaggaacgatggactgcgtgcacccgttaacggccttcgcttacggctcctcctgtaagttcgagtgtcagcctggctacagggtcaggggcctggatatgcttcggtgtattgattccgggcactggtccgcccctctgcctacctgcgaagccattagctgtgagccactggagtcaccagtccatgggtctatggactgctccccttctctaagggcctttcagtatgatactaattgttcttttaggtgtgcggagggtttcatgcttagaggggctgatatcgttcgttgcgataacctggggcagtggaccgcccctgcccctgtctgccaggcccttcagtgccaagacttgcccgttcctaatgaagcacgcgttaattgttctcacccgtttggggcatttcgctaccaatcagtctgttcattcacttgcaacgagggcctcttgcttgtgggagcatctgtcctgcagtgtctcgcaacaggtaactggaattctgtgccgcctgagtgccaagctatcccatgcactcccctgttgtctccacagaatggcaccatgacctgcgtacagcctctgggttcaagttcttacaagtccacctgtcagtttatctgcgacgaagggtatagtctgtcgggcccagaacggctggattgtacccgatcagggaggtggactgactcaccaccaatgtgcgaggctattaaatgccctgaactgtttgcaccggaacagggaagcctggactgcagcgacacacggggagagttcaacgtcggaagcacctgccatttctcctgcgacaatggattcaaattggagggtcccaataacgttgaatgtacgaccagcgggagatggagtgcaactcctccgacatgtaagggcattgcctcactccctacaccaggcgtccagtgtccggcattaaccactcctggtcagggaacgatgtactgtcgtcaccatcccggaactttcggttttaataccacctgctatttcgggtgtaatgcgggatttactctaatcggagattctactctttcttgcagaccatccgggcagtggactgcagttaccccggcttgccgtgctgtgaagtgttcagagctgcatgtgaacaaacccattgctatgaactgttcgaacctctggggcaacttcagttacggctccatctgttcttttcactgtctggagggccaactgctgaatggatcagcgcagacagcctgccaggaaaacgggcattggtctactactgtgcccacgtgtcaggcaggcccactgaccatacaggaggcactcacttattttggaggagccgtggccagcacaatcggactgatcatgggcggaacattgctagccctgctccgtaaaagattccggcagaaagacgacggcaagtgccccctgaatccccattctcacctaggcacctatggtgtgttcacaaacgccgcattcgatccgtcaccttag

SEQ ID NO: 239864 - DNA, 2307 bp, Artificial Sequence
  Description of Artificial Sequence: Synthetic coding sequence
atggcgaactgccagattgccatcttgtatcaacgctttcaacgggtagtttttggcatctcacagctcctctgctttagcgccctgatctcagaacttacgaaccagaaggaggtggctgcatggacctatcattacagcacaaaagcttacagctggaacatatcccggaagtactgtcaaaaccggtatacagatttagtggctatccagaataagaatgagatcgattacctgaataaagtcctgccttactattcctcctattattggattgggatccggaaaaacaataagacctggacctgggtggggactaaaaaggccctcactaatgaggccgaaaattgggcagacaatgagcctaacaacaagcgcaataatgaggactgtgtggagatttatatcaaatcgcctagcgcgccaggaaagtggaatgacgagcactgtcttaaaaaaaaacacgccctttgctacaccgcttcgtgtcaggatatgagctgctcgaagcagggagaatgcttggaaaccatcggaaattatacttgttcctgctatccaggtttttatggacctgaatgcgagtatgtaagggaatgcggggagctggaattgcctcagcatgttttgatgaattgttctcatccactcggcaatttcagtttcaactctcagtgcagttttcactgtacagacggatatcaggttaatgggcctagtaagctggagtgtctggccagcgggatctggaccaacaagcccccacagtgccttgccgctcaatgccccccactgaagattcccgaacgaggcaatatgacttgtttgcattctgccaaagcctttcagcaccagtcatcctgttccttttcttgtgaggaggggttcgcactagttggaccagaggtggtccagtgtaccgcgtcaggagtgtggactgctcctgcccctgtctgtaaggctatctcctgtgaaccattggagtcacccgtgcacggctccatggactgctctccttccttacgcgcatttcagtatgacacaaactgctcatttcgatgtgctgaggggttcatgctgagaggcgctgatattgtgcgatgcgacaatcttggccagtggacggcccctgctcctgtctgccaggccttgcaatgccaggatctgccagttcctaatgaggctagggtgaattgtagtcacccattcggtgccttccgctatcagtctgtctgttcttttacctgcaacgaaggcttgctcctggtcggagcttcagtgcttcaatgtctggctacggggaattggaattcggtcccccctgagtgtcaggcaataccttgtactccacttctgtcgccccaaaatggcacgatgacttgtgtgcagccccttggctcttcctcctacaagtcaacctgccagtttatctgcgatgagggttattccctatccggtcccgagagattagactgtacccggtcggggcgatggacagattcaccacctatgtgcgaagctatcaaatgtccagagctgttcgcccctgagcagggatctcttgactgtagcgacacccgcggagagttcaacgtgggcagtacttgccactttagttgtgataacggcttcaaactggaggggcctaataacgttgagtgcaccactagcggcaggtggtcagcaacaccaccaacatgcaaagggatcgcctccctgcctacccccggagtccagtgccctgccctgacgacgccgggacagggtactatgtactgccggcaccaccctggtaccttcgggtttaatacaacctgttacttcggctgtaacgccggttttactctcattggtgactctacactgtcctgtagaccaagcggccagtggaccgccgttacccccgcatgccgggctgtaaagtgctccgagctgcatgtcaataagccgattgctatgaattgttccaacctctggggtaacttctcttacggcagcatttgtagcttccactgtttagaggggcagctcctcaacggctcagcccagaccgcctgtcaagaaaacggtcattggtccactaccgtgcccacttgccaggccggtcccctgaccatccaggaggccctcacgtatttcggcggagccgttgcttcaactatcggactgattatggggggtactttactcgcccttttgcgtaagagatttagacagaaagatgacggcaaatgtcctctgaaccctcatagccacctcggtacatatggggtgtttactaacgcggcttttgacccttcaccatag

SEQ ID NO: 239865 - DNA, 1935 bp, Artificial Sequence
  Description of Artificial Sequence: Synthetic coding sequence
atggctaattgccagattgctatactttaccagaggtttcagcgggtagtgttcggtatctcacagctgttgtgtttttctgctttgatttctgagttgacaaaccaaaaggaggtggctgcatggacgtatcactatagcaccaaagcatatagttggaacatctctagaaaatactgccagaataggtataccgatctagtcgctattcagaacaaaaatgaaatagattatctgaataaagtgctgccgtattactccagctattactggatagggatcaggaagaataacaaaacctggacatgggtggggaccaaaaaagctttgaccaacgaggctgagaactgggccgacaacgagcctaataacaagcggaacaacgaagactgtgtggagatttacatcaagagcccttcagcccctgggaaatggaacgatgagcattgtctcaagaaaaaacacgccttgtgttatactgctagttgccaggacatgagctgttctaaacagggcgaatgcctcgaaactatcggaaactacacttgttcctgttatcccggtttctatgggccagagtgcgagtatgttagagaatgcggggagctggaattaccacagcatgtgttaatgaactgcagtcatcccttgggaaacttctcctttaacagccaatgcagctttcattgtacggacggctaccaagtgaacggaccttctaaattagagtgcctggcaagtggtatttggactaacaagccccctcagtgcctggctgcccaatgccctcctttgaagatacctgaaagagggaatatgacgtgcctccactccgctaaggcttttcagcaccagagctcctgtagttttagttgcgaagaaggtttcgctctcgtgggaccagaggtcgtgcagtgcaccgcctcaggtgtgtggacagcgccagctccagtttgtaaagccctgcagtgccaggatcttcccgtaccaaatgaagccagggttaattgcagtcatccatttggagcgttccgataccaaagtgtgtgctcttttacatgtaacgaaggactgttgctcgttggcgcttccgtcctgcagtgcctagctacaggtaactggaacagcgtgccccctgaatgtcaggctatcccatgcacgcccctgctgtcgccgcagaatggaaccatgacatgcgtgcagcccctcggatcaagcagttataagagcacgtgccaatttatctgtgacgagggctacagcctatctggtcccgagagacttgactgcaccaggtctggcagatggactgactctcctcctatgtgtgagggaattgccagcctgcccaccccgggtgtgcagtgtcctgcgctgactacacccggacaggggactatgtactgccggcatcaccctggaacctttggatttaacactacttgctattttggctgcaacgctggcttcaccctcatcggggactccacactgagttgccgtcccagtggacagtggacagccgttaccccagcgtgccgagcagttaaatgctccgaactgcacgtcaacaaacctatcgcaatgaactgctctaatctttggggcaacttcagttatggcagcatatgttcatttcactgcttagagggccaattgctgaacgggagcgcacagacggcgtgtcaggagaatggtcactggtcgactacggttccaacgtgtcaggcgggtcctctgacaatccaggaagccctgacttactttggaggcgctgttgcatccactattggcctaatcatgggcggaaccttgcttgcgctgctaagaaagcgtttccgtcagaaagacgacgggaagtgtccccttaatccacactcccatctcgggacttacggggtgtttaccaacgctgcctttgatcccagcccatag

SEQ ID NO: 239866 - DNA, 2490 bp, Artificial Sequence
  Description of Artificial Sequence: Synthetic coding sequence
gcaaactgccagattgcaattctgtaccagaggtttcaacgcgtagtgttcgggattagccagctgctctgcttctccgcactgatcagcgagttgactaatcaaaaagaagtggctgcctggacatatcactactcgacaaaggcatattcatggaacatatccaggaagtattgccagaaccgctacactgatcttgtggctatccagaataagaatgagattgactacctgaacaaggtgctcccctactactcatcctactattggatcggcatacgcaagaacaacaagacttggacatgggttggcaccaagaaggccttgaccaacgaggctgaaaactgggcagataacgagcctaataataagagaaacaacgaagactgcgtggaaatttacatcaaaagcccttccgcacccggtaaatggaatgacgagcactgtctaaaaaagaaacatgcattgtgttataccgcaagctgccaggatatgtcctgttctaagcaaggcgaatgcctggagactattggtaattacacctgttcttgttatccgggtttttacggaccagaatgtgagtacgtacgtgagtgcggagaattagagttacctcagcatgtgctgatgaactgctctcatcccctcggaaatttcagctttaactcgcagtgttcattccattgcacagatgggtaccaggtgaatgggccaagtaaacttgaatgtctggcgtccggaatatggacgaacaagccacctcaatgcctggctgcccagtgtccacctctcaaaatccccgagagagggaatatgacttgtctgcactctgcaaaggcattccaacatcagagttcatgttcattttcctgcgaggaagggttcgctctggtcggtccggaagtcgttcagtgtaccgcttctggggtctggactgcgcctgcacctgtgtgcaaggccgtccagtgccagcatctggaggccccaagcgagggcactatggattgcgtgcaccctctcactgcatttgcttacggtagtagttgcaagttcgaatgtcagcccggatacagagtgaggggtctagatatgctgagatgcatagattcgggacactggtcggctcctctccccacttgcgaagccatctcatgcgaacccctggaatcacctgtacacgggagcatggactgcagtcctagcctccgagccttccagtacgataccaactgttcattccgatgtgccgaagggtttatgctgcgtggggcagacattgtccgatgcgataatcttggccaatggacagcacctgcgccagtgtgccaggcccttcagtgtcaggatcttcctgtccccaacgaggcgagggtaaattgctctcatccatttggtgcgttcagatatcagtcagtgtgctcttttacttgcaacgaaggactgttactcgttggcgcaagcgtactccagtgcctggccactgggaattggaattctgtgcctcccgagtgccaggcaattccatgtacccccctgctgagtcctcagaatggcacaatgacctgtgtgcagcccttggggtcctcgtcgtacaaaagtacctgccagtttatttgcgacgaagggtatagcctgagtgggcctgagcgattagattgcactcgaagtggacgctggacagatagtccacctatgtgtgaagctattaagtgtcccgagctctttgctccagaacaaggatccctggattgcagcgacactcgtggggaatttaatgtaggcagtacctgccacttcagttgcgacaacggcttcaagctggagggcccaaataatgtggagtgtactacctctggtcgatggtcggccactcccccaacgtgtaagggaatcgccagcttgcccacacccggagtccagtgtcccgctcttaccacacccggacagggcacgatgtactgtaggcaccacccgggtactttcgggttcaacaccacctgttacttcggctgcaacgccggtttcactctcataggggacagcacactatcttgtagaccatccgggcagtggacggccgttactccagcatgccgcgctgtgaaatgcagtgagctgcacgttaataagcctatcgcaatgaattgcagtaacctatggggtaattttagttatgggtccatatgcagttttcattgcctggaaggccagctattgaatggctcagcccagacagcatgccaggaaaatggccactggtccactaccgtgcctacctgtcaggccggtcccctcactattcaagaggcccttacctacttcggcggtgcggtggctagtactatcggactcataatgggtgggacactgctagctctgctcaggaagcgatttcggcagaaggatgacggcaagtgtccgctgaatccacacagccatttggggacttatggcgtgttcaccaacgccgcttttgaccccagtccctag

SEQ ID NO: 239867 - DNA, 1941 bp, Artificial Sequence
  Description of Artificial Sequence: Synthetic coding sequence
tgagcaaactgtcagattgccattttgtatcagagattccagagagtggtgtttggcatttctcaacttctatgcttctctgcccttatatcagagctcacaaatcaaaaagaggtggccgcttggacataccattactcgacgaaggcatactcatggaacatttctcgcaaatactgtcaaaatcgctatacagatctcgtggccattcagaataaaaacgaaatcgattatctcaacaaagtcctgccctactactcctcatactattggatcggaatcaggaagaacaacaagacatggacctgggtgggaactaaaaaagccctgaccaacgaagcggagaactgggcagataacgagcctaacaacaaacgcaacaacgaggactgtgtcgaaatttatatcaagagtcccagcgctccaggaaagtggaatgacgaacactgcttaaaaaaaaagcacgccttgtgctacacggcatcttgtcaggacatgagttgcagcaaacagggggagtgcctggaaaccattggaaactacacctgtagctgctaccctggtttctacgggcctgagtgtgagtacgttcgcgaatgtggcgaactcgaactgccccagcatgtgctcatgaattgctcacaccctctcggtaacttttcttttaattctcaatgttcattccactgtaccgacgggtatcaggtgaatgggccaagcaaacttgaatgcctcgcttcgggtatctggactaacaagcctccacagtgcctggctgctcaatgcccacctcttaagatccctgagcgtggcaacatgacttgtctccacagtgcaaaggcattccagcaccaaagcagctgtagcttttcctgcgaggagggatttgctctagtgggtccagaggttgtgcagtgtactgcctccggggtgtggacagcaccagcaccagtttgcaaagccatttcctgcgaaccacttgagagccccgtgcacggttctatggactgttcaccaagcctccgtgcctttcaatacgacacaaactgcagttttaggtgcgctgagggctttatgctgcggggagccgacattgtgcggtgtgataacctaggacaatggaccgcccctgccccagtttgtcaggctctccaatgtcaggatcttccagtgcccaatgaggccagggtaaattgctcacacccctttggtgcattccggtatcagtcggtgtgctcttttacctgcaacgaaggcctgctgctggtgggtgcaagcgtccttcagtgcctagcaactgggaactggaactccgtgccccctgagtgccagggaaaatctatcgcctcccttcctactccaggggttcagtgtcccgcacttacaacacctggtcagggcacaatgtattgccgacaccaccctggcaccttcgggttcaataccacctgctacttcggctgcaacgccggttttacactgatcggcgactccaccttgtcttgcaggccttctgggcagtggacagccgtaacccctgcctgcagggccgtaaaatgctctgagttgcatgtgaataaaccaatagccatgaactgtagtaacttgtggggtaacttcagttatggaagcatatgctcctttcactgtctggagggacaattgctgaatggaagcgcgcagaccgcttgccaggaaaacggacattggtctaccacggtccctacctgccaggctgggccattgacgatccaggaggctcttacttactttggaggtgccgtggcaagtactattggcttgatcatgggtggaacgcttctggctctactgcgcaaacggtttagacagaaggacgacggcaaatgtccactgaatccacatagtcacctgggcacatatggagtgtttactaacgcagcattcgacccatcgccctag

SEQ ID NO: 239868 - DNA, 2262 bp, Artificial Sequence
  Description of Artificial Sequence: Synthetic coding sequence
gttgtgttcggcattagccagctcctatgcttttctgccttgatatccgagttaacgaatcaaaaggaagtcgccgcttggacgtaccactacagtacgaaagcctacagctggaacatcagccgcaaatactgccagaaccggtacactgatctggtggccatacagaacaagaacgagatcgattatctgaataaggtgctgccctattactcctcttactattggattggcatccgaaaaaataataaaacttggacatgggtggggacaaagaaagctttgacaaacgaggccgaaaattgggcagacaatgaacccaacaacaagcggaacaacgaggattgtgtggaaatttacattaagagcccaagtgctccagggaagtggaatgacgagcattgcttgaagaagaaacatgcactttgctacactgcatcttgccaggacatgagttgcagcaagcagggcgaatgcctcgagacgattggtaattatacatgtagctgctatccgggtttctacggccctgagtgtgagtatgtgagagagtgcggcgagctggagctgccgcagcacgttctgatgaactgttcccaccctttgggcaatttttcattcaattctcagtgcagcttccattgtaccgatggctatcaggtcaatggtcccagcaagcttgaatgcctggcatccggtatatggacaaataaacctccacagtgcttggcagcccagtgtcctcctctgaagataccggagcggggaaatatgacgtgcctgcattctgcaaaggctttccagcaccagagtagctgctccttctcatgtgaggagggcttcgctctcgtcggtccagaggttgttcaatgtactgcctcgggagtgtggacagctcccgcacctgtttgcaaggccatcagctgcgaacccctggaatcaccagtccatggttcaatggactgcagcccctccctaagagcctttcagtacgacaccaattgctccttcagatgtgctgaaggtttcatgcttcgaggtgctgacattgtcaggtgcgacaacctcggccagtggaccgccccagcccctgtgtgccaggcattacagtgtcaggatctgcctgtacctaatgaagctcgagtgaactgcagccatccctttggtgctttcagatatcagtccgtgtgttccttcacgtgcaacgagggattgctgcttgtcggtgccagcgtcttacagtgtttggctacagggaattggaattctgtgccaccggaatgtcaggcgatcccttgtactccacttctctctccccagaatgggacgatgacatgtgtccagccccttggttccagtagctacaaatctacctgtcagtttatctgcgatgagggatattcactctctggacccgagagactggactgtacccggtcaggcaggtggacagactctcccccaatgtgcgaggctatcaaatgtccggagctattcgcacctgagcagggatcgctggactgctctgatacccgcggagagttcaacgtcggatctacctgccactttagttgtgataatgggtttaaactcgagggcccaaacaatgtggaatgtactacctctgggagatggtccgctactcccccaacatgtaaaggcattgcgtctctgccaacgccaggcgtgcagtgtccggcattgacaacacctgggcaggggactatgtattgccgtcatcacccagggactttcgggtttaacactacttgctacttcggctgtaacgcaggtttcactttgatcggcgactccaccttgtcttgccgtccttccgggcagtggaccgcagtcacgccagcttgtagagctgtgaagtgctcagaactgcacgtcaacaaacctattgccatgaactgtagtaatctctggggcaatttctcctacgggtccatttgctctttccattgtctggagggccagcttcttaatgggagtgcccagaccgcttgtcaggagaatgggcactggagcaccacagtgccgacatgccaagccggtcctcttacaattcaggaggccctgacttatttcggcggagctgtcgcaagcaccatcggtctgatcatggggggaacactacttgccctccttcgaaagcgcttccgccaaaaggatgacggcaagtgtccactgaatccccattcccacctaggcacctacggcgtttttacaaacgcggctttcgatccatcaccgtag

SEQ ID NO: 239869 - DNA, 2373 bp, Artificial Sequence
  Description of Artificial Sequence: Synthetic coding sequence
atggccaactgtcagattgctattttatatcaacgcttccagagagtggtgttcgggatctctcagttactctgctttagcgccctcatcagcgagctaaccaatcagaaagaagtggctgcctggacctaccactacagcacaaaggcctattcctggaatatcagccgcaagtattgtcagaataggtacacggatctcgtggccattcaaaacaagaatgagatcgattacctcaacaaggtcttgccatactatagttcatattactggatcgggattaggaaaaataacaagacgtggacttgggtcggtactaaaaaagcccttaccaacgaggcggagaactgggctgacaacgagcccaataacaagaggaacaatgaggattgtgtggaaatttatattaaaagccctagcgccccaggaaaatggaatgatgagcactgtctgaagaaaaaacatgcactctgttacaccgcgagctgtcaggacatgtcatgctctaaacagggcgagtgtctggaaacaatcggtaactatacatgcagctgttatcctgggttttacggacccgaatgcgagtatgttcgtgaatgtggtgagcttgagctaccccaacacgtgctgatgaattgttctcatcctctgggtaacttttccttcaattctcagtgttccttccattgcaccgacggataccaagtaaacggcccttccaagctggagtgtctagctagcggcatctggacgaacaaaccccctcagtgcctcgcagctcagtgtcccccactgaagattcccgagagaggaaacatgacttgcttacattccgcgaaagccttccagcaccagagctcatgcagcttctcgtgtgaggagggttttgctctggtgggcccagaggtagtgcaatgtactgcctctggcgtgtggacggcacccgctccggtgtgtaaagccgtacagtgtcagcatctggaggccccttctgagggcactatggactgcgtccaccctctaaccgcctttgcttatggcagcagctgcaaattcgagtgtcagcctgggtaccgggtccgagggcttgatatgctaagatgcatcgattccggccattggtccgcaccactgcccacctgcgaggcgatatcttgcgagccgctcgagtcccccgtgcacggctccatggactgcagcccttctctgagagcttttcaatatgacactaactgtagcttccgatgcgccgagggtttcatgcttagaggagcagacatcgtgagatgcgacaacctgggccagtggacagcccctgctccagtttgtcaggcactccagtgtcaggatttgcctgttccaaacgaggctcgtgtgaattgtagtcatcccttcggtgcttttaggtaccagagcgtgtgttcatttacatgcaacgagggccttttattggtcggcgcatctgtcttgcaatgtctggcgaccgggaattggaatagcgtgccaccagagtgccaggctataccatgcacacctcttctgagtcctcagaacgggaccatgacctgtgtgcagccactgggtagttcctcgtacaaatccacctgccaatttatttgcgacgaaggctattccttatctgggcctgagcgactggattgtaccaggtccgggaggtggactgacagtcctcctatgtgtgaggccatcaaatgcccggagctctttgcccctgagcagggctccttggattgctcagacaccagaggcgaattcaacgtcggctccacctgccattttagctgtgacaatggcttcaagctggagggacccaataacgttgagtgcaccaccagcggacgatggagcgccaccccacccacctgcaaaggcattgcctctttgccaacacctggcgtccagtgcccagcccttactacaccaggacaggggacaatgtattgtcgacaccacccgggtacatttggcttcaatactacctgttacttcggctgcaacgctgggttcaccttgattggggactccacgttgtcgtgccggccatccggtcagtggaccgccgtcactcctgcctgtagggcagtgaaatgtagcgagctccacgttaacaagcccatagccatgaactgcagcaatttgtggggaaacttctcatacggaagcatctgctcctttcactgtcttgaaggccaactcctgaatgggagtgcccagacggcttgccaagagaacgggcattggtctactactgtgcccacctgtcaagacgatggcaagtgtccgctgaaccctcatagccatctcgggacctacggagtttttaccaacgctgcatttgacccaagcccttag

SEQ ID NO: 239870 - DNA, 450 bp, Artificial Sequence
  Description of Artificial Sequence: Synthetic coding sequence
atgatgaccaaacacaagaagtgtttcatcattgtcggcgtgttgattaccactaatataattactctcatcgtgaaactgacacgggacagccagagcctgtgcccctacgactggatcggattccagaacaaatgttactatttctccaaggaagaaggagattggaactctagtaagtacaattgctccacacagcacgctgatcttactattatcgacaatatagaggagatgaacttcttgcgcagatacaaatgtagttctgaccactggattggcctgaagatggccaaaaatcggacgggtcagtgggtcgacggtgcaacttttactaaatcctttggtatgcgcggtagcgaaggatgcgcctatctctccgatgatggagctgcaacagcccgatgttacacagaaagaaagtggatctgcagaaagcgaattcactag

SEQ ID NO: 239871 - DNA, 1209 bp, Artificial Sequence
  Description of Artificial Sequence: Synthetic coding sequence
atgccactgcagcttctgctgctgcttatactgctgggtccgggtaacagcttacagctgtgggatacctgggccgacgaggcggaaaaggctctgggcccattgctggcacgcgatcgcagacaggccaccgagtatgaatatctggattatgactttctacccgagacagagcccccagagatgctccgtaattcaactgacactacaccattgaccggacctggtacccccgaatccacaacggtggagcctgcagcgcgacgatcaacaggcctagatgctggcggtgcagtaaccgaactgacaaccgagctggcaaacatgggaaatctgtccacagactcggctgcgatggagattcagaccacccagcctgcagctactgaggcccagaccacccctcttgccgctacagaagcgcaaaccaccagactaacagctacggaagcccaaactacccccctggcagccacagaagcacagaccacacccccagccgctaccgaggcccaaacaacacagcccactggcttagaagctcagactactgcacccgctgctatggaggcccagacgacggcgccagccgcaatggaagcacagacgacccccccagcagcaatggaagcccagactactcagacaaccgctatggaggcgcagactacagcccctgaggccacggaggcccagactacacagcccacagccactgaggcccagacgacacctctcgctgccatggaggccctgtccacggagccatcggctaccgaagctcttagcatggaaccaaccaccaaacgtggtctcttcatcccgtttagcgtatcttctgttacacataagggcatcccgatggctgctagtaacctctccgtcaactatccagtcggcgctcccgaccacattagtgtaaaacaatgcttgctcgcaatcctcatcttggctctcgtggcaaccatattttttgtctgtacagtggtgctcgctgtgcgactgtccaggaagggacacatgtaccctgtgcggaattactcccctactgaaatggtgtgcatatctagtctgctgcccgatggcggagaaggcccatccgcaacagcgaacgggggactgagcaaggccaaatctcctggtcttacacccgaaccgagggaggaccgggaaggggacgatttaacgttgcactcatttctgccttag

SEQ ID NO: 239872 - DNA, 1239 bp, Artificial Sequence
  Description of Artificial Sequence: Synthetic coding sequence
atgcctcttcagctgctcctgctcctaatacttctgggaccaggcaattcactacaactgtgggatacatgggcggacgaagccgagaaggctctgggacctctgctagcgagagaccggaggcaggccaccgaatatgaatacttggattatgattttctgcctgaaaccgaacctccagaaatgttgcgcaacagtactgacacaacacctctgacagggccaggaactccagaatcgactactgttgaaccagcggcaagaagatctaccggcctcgatgctggcggagccgttacagaactgactactgagctcgccaatatggggaacctgtccactgattctgcagctatggagattcagactactcaacccgcagcgaccgaggctcaaactactcaacctgtccccacagaagcgcagactacccccctcgcagcgacggaggcccagacaacccgcctgaccgcgactgaggcccagactacaccactggcagccacagaagcacaaaccacccctcccgcagccactgaggctcagaccacccagccaacaggacttgaggcacagacaaccgcacctgccgctatggaggctcaaacaacagcccctgccgctatggaggcgcaaacaactccacccgctgccatggaggcccaaacaacccagacgactgccatggaagctcagacaactgccccagaggcaacagaggctcagaccacccaaccaacagccaccgaggcacagaccactccactcgccgctatggaggctctcagcactgagccttctgctactgaggccctgtccatggagcctactaccaagcggggattgttcatcccttttagtgtgtcctcagttacccacaaaggcatcccaatggctgcaagtaaccttagcgtgaattatcctgtcggagctcccgaccacatttccgtgaagcagtgcctgcttgctatcttgatcctcgccctggttgccaccatctttttcgtctgcaccgtggtcctagcagtgaggctctcccgcaaaggccatatgtacccggtgcggaattactcacctaccgagatggtttgtatctcctcgctattgcccgatgggggtgaggggccaagcgccaccgcgaatggcggactgagcaaggcgaagtcccctggcttgaccccagaaccgagagaggacagagagggagacgacctcaccctgcattcttttctgccttag

SEQ ID NO: 239873 - DNA, 1419 bp, Artificial Sequence
  Description of Artificial Sequence: Synthetic coding sequence
atggcgaccaaatgtggaaattgcggcccagggtactccacccccctcgaggccatgaagggaccgcgagaggagatcgtgtacctaccttgcatttacagaaatacagggacagaagcccctgactaccttgcaacagtcgatgtggacccgaaaagtccccagtactgtcaagtaattcacagactccccatgccgaacttgaaggatgagcttcaccacagcgggtggaacacatgctcaagttgttttggagactccacgaagagtagaacaaaactggttcttccgtccctgatttcatctcgaatctatgtcgtcgacgttggctcagagcctagagctcctaaacttcataaagtcatcgagcccaaagatatacatgccaaatgtgaactggcgttcttacacacctcccattgcctggcctctggggaggtcatgatctcatccctcggcgacgtgaagggcaacggcaaaggcggatttgtgttactggacggcgagacatttgaggtcaagggaacttgggagcggcctgggggagctgcccctctgggctatgacttttggtatcagcccaggcataacgtcatgatctccaccgagtgggctgctccaaatgtcctgcgggacgggttcaatccagcagatgtggaggcaggcttatatggctctcatttatacgtgtgggattggcagaggcacgagattgtccagaccctgtccctgaaggatggactcatccctttagagatcagatttcttcacaaccccgatgctgcccagggcttcgtgggatgtgcgctctcaagcacaattcagcggttctacaagaacgagggcggaacttggtcagtcgagaaggtgatccaggtgcctccaaagaaagtgaaaggttggctgctgcctgagatgccaggcctgatcacagatatccttctttccctcgatgatagattcctctacttcagcaactggcttcacggagacttgcgtcagtatgatatctccgatccacaacggccaagactgaccggccaactttttctcggcggaagcatcgtgaaaggaggccctgtgcaggtacttgaggatgaagagttgaaatcacagcctgaacccctcgtcgtgaaaggcaaacgggtggctggaggcccacaaatgattcagttgtcacttgacggcaagcggctctacatcacgacatccctgtattcagcttgggataagcagttttacccggatttaatcagggaggggagcgtgatgctacaggtggacgtagacacagtgaaaggagggctgaagctaaaccctaatttcctggtggacttcggtaaagaaccactgggaccggctctcgcccacgaactccggtatcctggcggtgattgtagctcagacatctggatctag

SEQ ID NO: 239874 - DNA, 1227 bp, Artificial Sequence
  Description of Artificial Sequence: Synthetic coding sequence
atgccaaatctgaaagacgaacttcaccactctggctggaacacatgcagttcttgctttggagactctacgaagagcaggactaaactggtattgcccagtttgatttcatcccgcatctatgtggtcgatgtcggcagcgagcccagggctcccaaactgcacaaagttatcgagccgaaggatatccatgcgaaatgcgaactcgcatttctccacacttcccattgcctggcatccggggaagtaatgatctctagcttaggggacgttaaggggaatggaaaaggcggatttgtgctccttgacggcgaaacatttgaagttaaaggaacgtgggaacgcccaggaggagctgcccctctggggtatgacttctggtatcagcctagacacaacgtgatgattagtaccgagtgggccgcaccgaacgtcttacgcgatggcttcaatcctgctgacgtggaggcaggtctatacggctctcatctttacgtgtgggactggcagaggcacgagatagtacaaaccctgtctttaaaggacggcctcatcccccttgaaattagattccttcacaatcctgatgccgcacaggggttcgtggggtgcgcgctcagctctactatccaacggttctataagaatgagggcggaacctggagcgtggagaaggtaattcaggtgccccctaagaaagtgaagggttggctattacctgaaatgcctgggctcattacagacatcctgctgtctctcgacgaccgcttcctgtacttttcaaactggctccacggtgatctccgtcaatatgacatctcggacccccaaagacccagactgacagggcagctgttcctgggcggatccattgtaaagggtggcccagtgcaggtcttagaggacgaagagctgaaaagtcagccggaaccactggtcgtgaagggtaagagagtcgccggtgggccacagatgatccagctctctttggatggcaaacggctgtacattacaacttcgctgtatagcgcttgggataaacagttttaccccgacctgatcagggagggatcagttatgctgcaagtcgacgtcgacactgttaagggagggctcaagctgaaccctaattttctggtagactttggaaaagagccgcttgggcctgctcttgcccatgagctgaggtaccctgggggagactgttccagcgacatatggatctag

SEQ ID NO: 239875 - DNA, 1233 bp, Artificial Sequence
  Description of Artificial Sequence: Synthetic coding sequence
atggccaccaagtgtggtaattgtggtcccggatactccacccccctggaggccatgaagggacccagggaagaaatagtttatctcccatgcatctacagaaacactggaaccgaggcacccgattatttagcgactgtggatgtggatccaaaatccccccaatactgtcaggtaattgaacccaaagatatccacgcaaagtgcgagcttgcctttctgcacacatcgcactgcctagcgagcggtgaggtgatgatcagttctttgggggatgtcaaaggcaatgggaaaggcggtttcgtattgctggacggagaaactttcgaagtcaaaggaacttgggagcggccaggcggtgcggctccactgggctacgacttttggtaccagccacgccacaacgtgatgatttcaactgagtgggccgctcccaatgtcctgcgagatggttttaaccctgccgacgtggaggcagggctgtacggaagtcacctctacgtatgggactggcagcggcatgagattgtgcagaccctgtcactgaaggatggactgataccgctcgagattcgttttctccacaatcctgatgccgcacaaggatttgtaggatgtgctctgagctctactattcaaagattctacaagaatgaggggggtacctggagcgtggaaaaggtgatccaggtgcctccaaagaaggttaagggatggctgctgccggaaatgcccggtctgattaccgatatcttactctctctggacgatagatttctgtactttagcaattggcttcacggggatctcaggcagtacgacatctcagacccacagcgcccacgtttaacaggacagctttttttaggcggatccatcgtgaaaggtggccctgtgcaagttctggaggatgaagaactgaagagtcagcccgagccactcgtggtcaaaggcaagcgggtggcgggtggccctcaaatgatccagctctctctggacggtaaaagattgtacataaccaccagtctctacagcgcctgggacaaacagttctaccccgacctcattagagaaggctccgtgatgctgcaggtggacgttgacactgtgaagggcggacttaaactgaatcctaattttctggttgacttcggaaaggaaccactcggacctgccttggctcacgaattgaggtatccgggaggcgattgctcaagcgatatctggatttag

SEQ ID NO: 239876 - DNA, 1362 bp, Artificial Sequence
  Description of Artificial Sequence: Synthetic coding sequence
atgcccggatcctctggagctggaatggaggctgccgtggctcctggtcgcgacgctcccgctcccgctgctagtcagccatcaggatgcggtaagcacaattcgccagaacgcaaagtgtacatggactataatgctacaacccccctcgagcccgaagtcattcaggccatgaccaaagccatgtgggaggcatggggtaacccctctagcccatatagtgcaggcaggaaagcaaaggatattattaatgccgcaagagagtccttggcaaaaatgattgggggtaaacctcaagacatcattttcacaagtggcggaaccgagtcgaataacttggtcattcacagcgtcgtgaagcactttcacgctaatcagacatcgaaaggccatactggtggccaccactcacccgtgaaaggtgccaagccccattttatcacatcctcagtggaacacgattccatccggttaccacttgagcatttggtggaagaacaggtggctgccgttacctttgtacccgtgtccaaggtcagtggacaagctgaagttgacgacatcctggcagctgtccgaccaaccacccgcctggtgacaataatgctggccaacaatgaaactggaatcgtcatgccagtcccagagatctctcagagaataaaagcattgaatcaggagagagtggccgcaggtcttcccccaattctcgtgcacacagacgccgcacaggctttgggaaagcagcgagtggacgtcgaggacctcggcgttgacttcctcactattgtgggacataagttctatgggccacgaattggtgcactctatattagagggttgggcgagtttacgcccctgtatcctatgctctttggaggaggccaggagaggaactttcggcctggtaccgagaataccccaatgattgccggactcgggaaggccgctgagctggtgacccagaactgcgaggcatatgaggcacacatgcgggacgtgcgggattacctagaggagcgactggaggcagagttcggccaaaagcgtattcatctgaattctcagttccctggaactcagaggctccctaatacgtgtaactttagtatccgtgggcctaggctccagggacacgtcgtcctagcccagtgccgcgtccttatggcctcagtgggggcagcatgccatagtgatcacggggatcagccttctcctgtgttgctcagttacggtgttccgtttgacgtcgcaagaaacgcactgcggctgtccgtagggaggtcaacaacgcgtgcagaggtggacttagttgtccaggatttaaaacaggcggttgctcagctggaggatcaagcatag

SEQ ID NO: 239877 - DNA, 708 bp, Artificial Sequence
  Description of Artificial Sequence: Synthetic coding sequence
ttttcaaacccgttctgtggagagactttcccgaggaagcctgacctgaaaggcacacatagatgggcgccacaaccttccgaaggcggtcaagcaccctttcactatttcctggggggtacgaggctccatcccgctgcccctggcgctcctggcggtcgtacttccggttccctgcttaacgtgaagatgatgaaaatgaagaccttcatgatgatttgcttccatctgatcaatacagttaccttcgttccggtgtctaaggtctcggggcaggctgaagtcgatgacatcttggcagcagtacgcccaacgacgcgccttgtgaccatcatgttggctaataatgaaacggggattgtcatgccagttccagagatctctcagaggatcaaggcactcaaccaggaaagggttgccgctggcttgccccctatcctcgtacacactgatgccgcacaagcgcttggcaaacaaagagtcgatgtagaggatctgggggtcgatttcctgaccatcgtggggcacaagttctacggccctaggataggagcactttacattcgcggactgggcgaattcacaccgctatacccaatgctcttcggagggggacaggaacgcaatttcagacctggcacggagaacactccaatgatagccggtctcggaaaagtttctccgggagagctggaagagatgtcctag

SEQ ID NO: 239878 - DNA, 954 bp, Artificial Sequence
  Description of Artificial Sequence: Synthetic coding sequence
atggaggctgccgtggcgcctgggagagacgccccagcacctgcggcaagccagccatccgggtgtggaaaacataacagccctgaacgcaaggtgtatatggattataacgctaccactcccctggagcccgaggtgatccaggccatgaccaaggctatgtgggaggcctgggggaatccaagttcaccttatagcgccggacggaaggctaaggatatcattaacgcggcaagagaaagtttagcaaaaatgataggcggaaaaccacaagatattattttcacatcaggcggtaccgagtcgaacaacctggtaatccacagcgtggtgaaacattttcatgcgaatcagaccagcaaaggtcatactggtggacatcatagcccagtcaaaggtgcgaagcctcactttattacaagttcagtggagcacgactccatccggctcccactggagcatctggtcgaggagcaggtcgccgcagtgaccttcgtgcctgtgtctaaggtgtcaggccaagccgaggtcgatgacatacttgctgccgtgcgcccaacgacacgacttgtgacaataatgttagctaacaacgaaaccggcatcgtcatgcctgtcccggaaatttcccagcggatcaaggccctgaatcaggagcgggtcgctgcagggctgcctcccatactggtgcacacagatgcagcgcaagctctgggcaaacagcgggtcgacgtggaggacctcggcgtggacttccttaccatcgtcggccacaagttttacggaccgcgaattggggcactgtatatcaggggtctaggtgaatttaccccactttatccaatgctgtttggcggaggacaggaacggaacttccgcccaggtacggagaacactcctatgattgctggactgggtaaggtcagccccggagaacttgaggagatgtcatag

SEQ ID NO: 239879 - DNA, 1056 bp, Artificial Sequence
  Description of Artificial Sequence: Synthetic coding sequence
atggaagccgctgtcgcgccaggcagggacgccccagcacccgcagctagtcagccgtccggatgtgggaagcacaactctcccgaacggaaggtatacatggactacaatgctaccactccacttgagcctgaggtgatacaggccatgaccaaggcgatgtgggaggcctggggaaatccctcttccccttactccgctgccgtaaccttcgttccagtgagcaaagtgagtgggcaggccgaagtcgatgacattctggccgcagttcggccaacgacccgcctagtgacaatcatgctcgcaaataacgagactggtattgtgatgcctgtgccagaaatcagtcagagaattaaggctctgaatcaggaacgtgtggctgcgggtctgccaccaatcctcgtccatacagatgctgcccaagctctggggaaacagcgtgttgatgtggaggatttgggggtcgactttctcactatcgtgggacacaagttctacggaccaagaatcggcgctctgtacatcaggggactgggcgagtttacccctctgtaccccatgttatttggtggtggtcaggaacgaaactttaggcctgggacggaaaatacgcctatgattgcaggcctcggaaaggcagctgagcttgtgacccagaattgtgaagcctacgaggcgcatatgcgtgatgttagggattatctggaggagcgcctggaggccgagttcggacagaaaaggatccacctcaatagtcagttccccggtacccaaaggttgcctaacacttgtaactttagcatccgtggacctcggctccaaggacatgttgtgttggcccagtgtcgcgtactcatggcgtctgtgggggcagcctgccacagtgaccacggcgaccaaccgtctccagtccttcttagctacggggtacccttcgacgtggcgcgtaatgctctcaggttgtctgttgggaggtctaccactagggccgaggtggatctcgtcgtccaggacctgaagcaggcagtggcccagctggaagaccaggcctag

SEQ ID NO: 239880 - DNA, 720 bp, Artificial Sequence
  Description of Artificial Sequence: Synthetic coding sequence
atggaagccgcagtagcacctggccgtgacgctcctgcacccgcagcgtcccagccctcaggctgtggtaaacacaactctccagagagaaaagtgtacatggattataacgcaacaacacctctggaacctgaggtgatccaggccatgacgaaagccatgtgggaagcttggggcaacccaagcagcccatattccgcgggacgcaaggcaaaggacatcattaacgctgctcgcgaaagcctcgcgaaaatgatcggcggtaagccccaagacataatctttacaagtggcggtaccgaggcggctgagctcgtgacccagaattgcgaggcctatgaagctcatatgcgcgacgtacgggactatcttgaagaacgtctcgaagcggagtttggacagaagcggatccacctgaacagccaattcccgggaacacagcgattacctaatacatgtaacttctctattagaggccctcgtctacaaggacacgtggttctggcacagtgccgggtcctgatggcctctgtgggagcggcttgccacagcgaccatggcgatcagccaagtcctgttttgctctcatacggcgttccattcgatgtggctaggaacgccctgcgactcagcgtgggacggagcactactcgcgcagaagtagacctcgtggtgcaagacctaaagcaggccgtggcccaactggaggaccaggcctag

SEQ ID NO: 239881 - DNA, 1338 bp, Artificial Sequence
  Description of Artificial Sequence: Synthetic coding sequence
atggaggccgcagtggcacccggacgagatgctccagcaccagccgctagtcagccgagcggttgtggcaaacacaactctcctgagcggaaagtatacatggactacaatgcaacgaccccactggaacccgaagttatccaagcaatgaccaaggcgatgtgggaagcctggggcaacccctcctctccttatagcgccggacgtaaggctaaagacataatcaatgcagcacgggagtccttggccaaaatgatcgggggtaagccacaggatatcatatttacctctggcggaacagagagcaacaaccttgtgattcactcagtggtgaagcactttcatgccaatcaaacgtcaaaggggcacaccggcggtcatcatagccccgttaagggagcgaaaccccatttcatcacctcaagtgtggagcacgactctattcgcctcccattagagcaccttgtcgaggaacaggtcgcagccgtcacatttgtgccagtctccaaggttagtggacaggctgaggtggacgacatactcgccgcagtccgccctacaacacgtctggttaccattatgctggcaaataacgagaccggtatcgtgatgccagtgccagaaatctcacagcgaatcaaggccctcaaccaggagcgagtggcagcaggccttccacctatcttagttcatacagacgcagcccaggcattgggcaagcagagggtggacgttgaagatctgggagtggactttctgacaatagttggacataaattctacggccctcgaatcggggcactttatattcgtgggcttggagaattcacacctctgtatcccatgctcttcggcggaggccaagagcgaaatttccgcccaggtaccgaaaatacgccgatgatcgccggtctggggaaggcagccgagctcgtaactcagaactgtgaggcctacgaggctcacatgcgggatgtgagggattacctcgaagagcggctcgaggcagagttcggccagaagcgaatccatttaaattcgcaatttcccggaactcagcgactgccgaatacatgcaacttttccatcaggggcccaaggctacagggtcacgttgtgctggcccagtgtcgggttctcatggcaagcgtcggagccgcttgccacagtgaccacggagatcagccttctccggtactcctctcatacggagttccgttcgacgtcgcaagaaatgccctccgactcagcgtggggcgatccaccactcgcgctgaagtggacctcgtcgttcaagacttaaagcaagcagtcgcgcagctcgaagatcaggcttag

SEQ ID NO: 239882 - DNA, 966 bp, Artificial Sequence
  Description of Artificial Sequence: Synthetic coding sequence
atgagcacacgggaaagcttcaatcccgagtcgtacgagctggataagagcttccgcctgacacgctttaccgaacttaaaggcactgggtgtaaggtcccccaggatgtgctccagaagcttctggagtccctgcaggagaatcattttcaggaagatgagcaattcctcggcgcagtcatgcccagactgggcattggcatggacacatgtgtgattcccctccgccacggcggactgtctctggtacagaccaccgactacatctatcctatagtagacgacccttacatgatgggcagaattgcatgtgctaacgtgctgagcgatctctacgctatgggggtcactgaatgcgataatatgctgatgctcttgggggtttcgaacaaaatgacggatagggagcgagataaggtgatgccactgataattcagggatttaaagatgcagcagaggaggccggaacgagcgtgaccggcggacagacggtcctgaatccctggattgtattgggtggggtagctacaaccgtgtgtcaacccaatgagtttatcatgcccgataatgcagtgccaggagacgtgttggttctgactaaaccgctcgggacccaagtcgccgtggcagtccaccagtggttggatattcctgagaagtggaacaagatcaaactggtggttacccaagaggacgtggaattggcctatcaggaggccatgatgaatatggcaaggctaaacaggactggcggactgcttatttgcctcccccgtgaacaggcggctaggttctgtgccgagatcaagtcccccaagtacggtgagggccatcaggcttggatcattggcatagtcgagaaaggcaataggacagcacgcataatagataaacctcgaattattgaggtcgcaccccaggtggctactcaaaatgtgaatcccaccccaggtgccactagctag

SEQ ID NO: 239883 - DNA, 1179 bp, Artificial Sequence
  Description of Artificial Sequence: Synthetic coding sequence
atgtccaccagagagagtttcaaccccgagtcttacgaactcgataagagcttcagactgaccaggtttaccgagctgaaaggcactggctgtaaggtccctcaagacgttctgcagaaactgctagagtcattgcaggaaaatcatttccaggaagacgaacagtttctgggggctgttatgccaaggctgggaataggcatggatacatgcgtcataccactgcgccatgggggactgtctctagttcaaacaactgattacatttaccctatagttgacgacccctacatgatgggccgtattgcctgtgctaatgtcctgagcgacctttacgccatgggcgtgacagagtgcgataacatgctgatgctgcttggcgtgtccaacaagatgacggatcgggagcgtgacaaggtgatgccacttattatccagggatttaaagacgccgcagaagaagccggaacctctgtgactggaggccagaccgtcttaaacccctggattgtgctcggaggggtggccaccactgtatgtcagcccaacgaatttatcatgcctgataatgcagtgcccggtgatgttttggtcctgacgaagccgctcggcacccaggtcgctgtggccgtgcaccagtggttggacatcccggaaaaatggaataagattaaactggtcgtgactcaggaggacgtggagctcgcttatcaggaggccatgatgaacatggcaagactgaaccgcacggccgctgggctcatgcacaccttcaatgcccatgccgcaactgatattaccggttttggtatactcgggcacgcgcaaaatctggctaaacaacagagaaatgaagtgtcattcgttattcacaacctgcctgtgcttgccaaaatggcagccgtatctaaggcctgcgggaatatgtttggtttgatgcacgggacttgcccagaaacaagcgggggactgttgatttgcctcccgagagagcaggccgcaagattttgtgccgaaatcaagagccccaaatacggagagggccatcaagcatggatcatcggcattgttgaaaaaggcaaccggacagcacgcatcattgataagccacggattattgaagtggctccccaggtcgctactcagaatgtaaacccaaccccgggtgccacatcgtag

SEQ ID NO: 239884 - DNA, 966 bp, Artificial Sequence
  Description of Artificial Sequence: Synthetic coding sequence
atgagtactcgggagagtttcaatccagaatcatatgagctcgacaaatccttccggttaacgcgattcaccgaactgaaaggcactggctgcaaggtgccacaggacgtcttgcagaaactgctggagagccttcaagagaatcactttcaggaagacgagcaattcctgggcgcagtcatgccacgcctgggaataggcatggacacttgcgttattcctctgagacatggcggactgtctctggttcaaaccaccgactacatttaccctatcgttgacgacccctacatgatgggtagaatcgcatgtgccaacgtgctctccgatctctacgccatgggtgttacggagtgcgataacatgctgatgctgctgggcgtgagtaataaaatgactgacagggaacgcgataaggttatgcctcttattatccagggatttaaagacgcagcagaggaagccggaacgtcagttaccggcggacagacagtgctgaacccctggatcgtgctgggtggcgtggctacaactgtttgtcagccaaatgagtttatcatgcccgataacgcagttcctggagacgtcctcgttctgactaagccgttgggaacgcaggtggcagtggccgtgcatcagtggcttgatattcctgaaaaatggaacaaaataaaactggtcgtgacgcaggaggatgtggaactcgcttaccaggaagccatgatgaacatggctcgcctgaatcgcaccggcggactgctgatttgtttgcctagggaacaagctgcccgtttttgcgcagaaattaagagccctaaatatggcgaaggacatcaggcctggatcatcggcatagtggagaagggaaacaggacggcaagaattatcgataagcctcgcatcatcgaggtggcccctcaggtcgccacccagaatgtaaatcctactccaggcgcaacaagttag

SEQ ID NO: 239885 - DNA, 501 bp, Artificial Sequence
  Description of Artificial Sequence: Synthetic coding sequence
atgtctacaagggagtcatttaaccccgagtcctacgagctggacaagagcttcaggcttacccgctttaccgaactgaagggcacaggttgtaaggtgccgcaagacgtactccaaaagttgctcgaaagccttcaggagaaccactttcaagaagacgagcagtttctcggagccgtgatgccaagactcggaattggcatggacacctgtgtgatcccccttaggcacgggggtctgagtctggtacagactaccgattacatctaccccatagtggatgacccatatatgatggggaggatagcttgcgctaacgtgcttagcgacctgtacgcaatgggggtcaccgaatgtgacaatatgctgatgctgctgggggtgtctaataaaatgaccgatcgcgaaagagacaaagttatgcccctgataattcagggatttaaagacgccgctgaggaggccggaacatcagtgactggcggacagaccgtcctatag

SEQ ID NO: 239886 - DNA, 279 bp, Artificial Sequence
  Description of Artificial Sequence: Synthetic coding sequence
atggatacctgcgttatcccactgcgtcatggtggcctctcattggtgcagaccaccgactatatttacccgatcgtagacgacccatacatgatggggagaatcgcatgtgctaacgttctgagtgatttgtacgcaatgggagtcacagagtgtgataacatgctaatgctgctcggcgtgagcaacaagatgacagatagagaaagggataaagtcatgcccctcattatccagggtttcaaggacgcggctgaggaagctggaaccagtgtgtag

SEQ ID NO: 239887 - DNA, 978 bp, Artificial Sequence
  Description of Artificial Sequence: Synthetic coding sequence
atggatacgtgcgtgattccgttgcgccacggagggttgtccttggtgcaaaccacagattatatttaccccatcgtggatgacccctacatgatggggcgtatcgcctgcgcaaatgtgctgtcagacctttacgcaatgggggtcactgagtgcgacaatatgcttatgcttctgggcgtctctaacaagatgacagaccgagagcgagacaaggttatgccactcataattcagggatttaaagatgccgctgaggaggccggtacctctgtaactggcggacaaacagtgctcaacccctggatagtactgggcggtgtagcaacaaccgtgtgtcagccgaatgaattcataatgccggacaacgccgtgcccggagatgtcctagttctcacaaagccactcggcactcaggtggccgtcgccgtgcaccaatggctcgacattccggagaagtggaataaaatcaagttagtggtgacccaagaagacgtggagctggcttaccaggaagccatgatgaatatggctagattgaatcgtaccgctgccggtctaatgcatacttttaacgcccacgctgcgacagatatcaccggttttgggatactgggccatgcacagaatctggctaaacaacagagaaacgaagtgagctttgtcatccacaacctcccagtcctcgctaagatggctgccgtctccaaagcatgcggaaacatgtttggcctcatgcatgggacatgcccagagacctccggcggacttctaatctgtcttccaagggaacaggcggctcgcttttgtgccgagatcaaaagcccaaagtacggcgagggacatcaggcatggatcattgggattgttgagaaaggcaaccggaccgccaggattatcgacaagcctcggatcatagaggtggctccacaagtggccactcagaacgtcaatccaacacccggagcaacatcttag

SEQ ID NO: 239888 - DNA, 975 bp, Artificial Sequence
  Description of Artificial Sequence: Synthetic coding sequence
atgagcactagagagtccttcaaccctgagagctacgagttggacaagagtttccgacttacaagatttacagaactgaaaggtactggttgtaaagtcccccaagatgtgctccagaaactcctcgagtctctgcaggaaaaccacttccaagaggacgaacagtttctgggcgctgtgatgcccagacttgggattggcatggacacatgtgttatacccctccgacacggcggtctttccttggtgcagacaacagactatatttatccgatagtggacgacccatacatgatggggcgtattgcatgcgcaaacgttctctctgacctgtacgccatgggagtgacggagtgcgataacatgcttatgctgctgggggtttccaacaaaatgaccgacagggaacgtgacaaagtcatgcctctgataatccagggatttaaagatgctgccgaagaggccggtacgtcagtgactggcggtcagacagtactgaatccttggatcgtgctcggcggagtagccacaacagtgtgccagcccaatgagttcataatgcccgacaatgccgtgccgggagatgtcctggttctcacgaaacctctgggaactcaggtcgcagtggccgtgcaccaatggctggatatcccagagaaatggaataaaatcaaactggtggttacccaggaagatgtcgaactggcctaccaagaggcaatgatgaatatggcacgacttaacagaactgctgctgggctgatgcatacttttaacgctcatgccgctacagatataactggcttcggtattctagggcatgcccaaaacctcgccaaacagcagcgtaacgaagtgtcttttgtcatccataacctacccgtgctcgccaaaatggcggcagttagcaaggcctgcggcaatatgtttgggcttatgcacggtacttgccctgaaacaagcgatgtgcaatag

SEQ ID NO: 239889 - DNA, 1200 bp, Artificial Sequence
  Description of Artificial Sequence: Synthetic coding sequence
atggctgaagcaagcgcaacaggcgcatgtggcgaggccatggccgctgcagaaggatcttccggccctgccggattgacactaggcaggctgacagggttctccgggatgaagggactggtaggcggtcaggaggaagccagtcaagaggccggtcttccagctggagccggaccctctcctacatttcctgccctggggattggtatggatagctgcgttataccattaagacacggaggcttaagccttgtacagaccacagactttttttatccgcttgttgaagacccctacatgatgggaagaatcgcatgcgctaatgtgctatcagatttgtatgccatgggcatcactgaatgcgataacatgctcatgttactgagtgtatctcagtctatgtcagaggaagagcgagaaaaagtgaccccgctgatggttaagggattccgagacgccgctgaggagggagggaccgcggttactgggggtcagacggtcgtaaacccttggatcatcatcggtggagtagcaaccgttgtttgccagcctaatgagtttatcatgccagacagcgcagtggtgggcgatgtcctagtcctgacaaagcccctaggcacacaagtagctgttaatgcgcaccagtggctggacaatccagaacggtggaataaggtgaagatggtggtgagccgagaggaagtggaacttgcttaccaagaggctatgttcaacatggccacactcaatagaaccgccgctggcctgatgcacacgtttaacgcgcacgcagcgactgatataacaggcttcggcattctgggccattcccagaacctagccaaacaacagagaaatgaggttagctttgtgatacacaacctgcctattatcgcaaaaatggctgcagtgtcgaaggcctccggcaggtttggacttctgcagggaacatccgccgagacatcaggcggtctgctcatttgccttccgagggagcaggctgcccgtttttgttccgaaatcaagtctagcaagtacggtgaaggccatcaggcgtggatcgttggcatcgtggaaaaaggtaatcggaccgccaggattattgataagcccagggtcatcgaagtgttaccccgaggcgctactgctgccgtgctggctccagatagttcaaatgcttcctctgagccatcttcatag

SEQ ID NO: 239890 - DNA, 1452 bp, Artificial Sequence
  Description of Artificial Sequence: Synthetic coding sequence
  Description of Combined DNA/RNA Molecule: Synthetic coding sequence
atggccgaggcgtccgccaccggagcttgtggcgaagctatggccgctgccgagggcagctccggaccagctgggcttactctcggtcggtcgtttagcaactataggccgttcgagcctcaggctctggggctatccccaagctggaggctcactggctttagcggtatgaagggcugagggtgcaaagtgcctcaggaggctttgctcaagctgctggctggtctgacccggcctgatgtcaggcctccacttggcaggggcctggtggggggtcaggaggaggcatcccaggaagccggtctccctgcgggagcaggtcctagtcccacttttccagccttgggcatagggatggactcctgtgtaatcccactgcgtcacggaggcttgtctctggttcagacaacagatttcttctatcctctggtggaggatccctacatgatgggacgcatcgcatgcgcaaatgtccttagcgatctgtatgctatgggtataactgagtgcgacaatatgctcatgttgctttctgtctcacaatcaatgtccgaggaagagagggaaaaggtgacacctctgatggtaaaagggttcagggacgctgcagaagagggcggaaccgccgtgactggcggtcaaaccgtcgtcaacccgtggattattattggcggtgtggccactgtagtgtgccagcccaacgagttcatcatgccagatagcgctgtcgtcggcgacgtgctggttctgacaaaaccactgggcacccaagtcgcagtaaacgctcaccaatggcttgacaatccggaacggtggaacaaagtcaaaatggtggtgagcagagaggaagtggaattggcctatcaagaagcaatgtttaacatggcaacattgaaccgaactgctgctggactgatgcatacattcaatgctcacgcggctactgatattactgggtttggtattctcgggcactcacaaaacctcgctaaacagcagaggaatgaggtgagtttcgttatccacaatcttcctattattgccaagatggccgcagtttccaaggcttccggccgttttggcctcctgcaaggcacctctgcggagacctctgggggtctcctgatctgcttgccccgtgagcaggccgcacgtttttgcagcgagattaagagcagcaagtacggagaggggcaccaggcctggatcgtcggaattgtggagaaggggaaccgaacagcacgcatcatagacaaacccagggttatcgaggtgttgcctcgaggcgctaccgccgctgtgttggcacccgactcttctaacgcctctagcgagccgagctcaugagacgagcggaccgaagttgtgtggacgcttgaaccactgagcactattacagacggctcacaggagcttattgtaaggaacttccaaaggagactgcctgcatag

SEQ ID NO: 239891 - DNA, 1347 bp, Artificial Sequence
  Description of Artificial Sequence: Synthetic coding sequence
  Description of Combined DNA/RNA Molecule: Synthetic coding sequence
atggctgaagcctctgcaaccggcgcttgcggcgaagcaatggctgcagctgagggctcatccggacccgcaggcttaactcttggaaggtccttcagcaattatagacctttcgagccccaagccctggggctttcaccaagctggaggttaacaggtttttctggcatgaagggcugaggctgcaaggttcctcaagaggctctcctgaagctgctggctggcttgacaagacctgatgtccgtcccccactgggcagggggctggtgggcggacaggaggaagcgtcacaggaagccggactgcctgccggagcaggaccgtctccaacatttcctgctctcggaatcgggatggactcctgtgtcatccccctgagacacgggggactgtctctcgtgcagacgacggactttttttaccccctggtggaggatccatatatgatgggacggatcgcttgcgcaaacgtactgagtgacctgtatgctatgggcatcaccgagtgtgataacatgctgatgttgctgagtgtatcacaaagcatgtctgaagaagagcgggagaaagtcactcccctcatggtcaaagggttccgggatgccgcagaggaaggaggcactgctgtgaccgggggacagaccgtcgtaaatccgtggatcatcattggcggagtggctaccgtcgtgtgtcaacctaacgaattcatcatgccagactctgcagtggtgggggacgtactagtccttaccaagcctttgggcacgcaggtcgccgtcaatgctcaccagtggctcgacaacccggagaggtggaacaaggtgaagatggttgtgtccagggaggaggtggaactagcctaccaggaagccatgttcaacatggcaaccctcaaccgcacagccgctggattgatgcatacttttaatgctcatgctgcaactgacatcaccggtttcggaatactgggccacagccagaacctggcgaagcagcagcgcaacgaagtctccttcgtaattcacaatttgccaatcattgcaaagatggcagcagtgtccaaggccagcggaagatttgggcttctgcagggcacatccgccgagacgagcgggggattgcttatctgtctgcccagggagcaggcagcaagattctgctcagaaatcaagtcaagcaaatatggcgaaggacatcaggcgtggatcgttggcattgtggaaaaaggtaacagaactgcccgtataatcgataaaccgagagtcattgaggtgctcccccgaggggcaactgctgccgtcctggctcccgactcctccaatgctagctctgaacccagctcttag

SEQ ID NO: 239892 - DNA, 1176 bp, Artificial Sequence
  Description of Artificial Sequence: Synthetic coding sequence
atggcagaagcgtccgccacgggcgcatgtggcgaggccatggcagctgccgagggtagctcggggccagctgggctgaccctcggcaggtctttttccaattaccgtccatttgagccacaggaagctggattgccggcaggcgcaggcccatccccaacctttcccgcactcggcatcgggatggattcatgtgtgattcctttgagacacggcggactgagtctagtacagaccactgacttcttctatcccttggtggaggatccctatatgatggggagaattgcgtgtgccaatgtgctgtctgatctgtatgctatggggatcaccgagtgtgacaacatgctgatgctactttctgtatcccagagcatgtctgaagaagagagggaaaaagtaacgcctcttatggtcaagggttttcgggacgccgcagaagagggtggcactgctgtgacaggtggacaaaccgtcgtgaacccttggattatcatcggtggtgtggcgaccgtcgtttgtcagcccaacgagttcatcatgcctgatagcgccgtagtgggtgatgttcttgtcctcactaaaccactgggaacccaggttgctgtgaatgcacaccaatggctagataatcccgaacgatggaataaagtgaagatggtagtgtcccgcgaggaagtggagctggcctaccaggaggcaatgttcaatatggccactctgaacagaactgctgccggactaatgcacacatttaacgcccatgctgcaacggacatcacaggctttgggattctgggtcacagccagaatctcgcgaaacaacagcgtaatgaagtgtcctttgtgatccacaacttgcccattatcgctaagatggcagcagtctccaaggccagtggacgcttcggcctcttgcagggcacgtcggccgaaacttctggcggactgctgatttgtctcccacgcgaacaggccgctagattttgttctgagatcaagtcttctaaatacggggagggacaccaggcctggatagtcggcattgtagagaagggaaaccgaaccgccaggattattgacaaacctagagtcattgaagtacttccgaggggagccactgctgctgtcttggcaccagactcctcaaacgcgtccagtgaaccgtccagctag

SEQ ID NO: 239893 - DNA, 1671 bp, Artificial Sequence
  Description of Artificial Sequence: Synthetic coding sequence
atggggagagctcgtcctgggcagaggggccctccttctccaggacctgcagctcagcccccagctccccctaggcggcgagccaggagtctagccctgttgggcgctctgctggcagcagcagcagcggcagccgtccgggtgtgtgcccgacacgctgaggcccaggccgctgccaggcaggaactcgctctcaagacactcggcacagacgggttgtttctcttctcaagtttagatacagacggtgacatgtacatttcccccgaggaattcaagccaattgctgaaaaactcaccggctccactccagccgcatcctgtgaggaagaggagctgcccccagacccatcggaggagaccctgacgatcgaggcaagatttcaaccactgctccctgaaaccatgaccaagagcaaagatggattcttgggcgttagcagactggccttatcaggactgcgcaattggaccgcagccgcatcaccgagtgccgtttttgccacaaggcattttcagccatttctgcctccccctgggcaagagttaggcgagccgtggtggatcatcccttctgaactgtcaatgtttaccggatacttatcaaataaccgattctacccgcctccacctaaaggaaaggaggttataatccaccgcctgttgtctatgtttcacccaaggcccttcgtcaagactcgatttgctccacagggcgcagtagcctgtctcactgccatcagtgacttctactacaccgtaatgtttagaattcatgccgaattccagctgtccgaaccacctgattttcccttttggttttcccccgctcagtttactggccacattatcctttcaaaagacgccacccacgtgcgagacttcagactgttcgtcccgaaccatagatccctaaacgttgatatggagtggctctacggggctagcgaatcctcaaatatggaagtggatatcggctacattccacaaatggagctcgaggccacgggcccttctgtgccctcagtgatcctggatgaggatggctccatgatcgatagccatctcccatcaggtgaacctctgcagtttgtgtttgaagaaattaagtggcagcaagaactcagctgggaggaggctgcaaggcgtctagaggttgctatgtacccattcaaaaaggtatcatacctcccattcacagaagccttcgaccgcgcaaaggccgaaaataagctcgtccattcaatactgctttggggggctctggacgaccaatcttgccactgttctggcaggacactgcgagaaaccgtgttggaatcatctccaattctgactctgctgaatgagagtttcatttccacctggagcttggtcaaagaactggaagagctgcagaataaccaggagaactcctcgcatcagaagctggccggacttcacctggagaagtatagcttccccgttgagatgatgatttgcttacccaacggaactgtggtgcatcacataaacgccaattactttctcgacatcaccagcgtgaaaccagaagagatcgaaagcaatctcttctctttcagctcaacgttcgaagatccttccacagcaacttatatgcagttcctcaaggagggacttagacgcggactcccattacttcagccatag

SEQ ID NO: 239894 - DNA, 1773 bp, Artificial Sequence
  Description of Artificial Sequence: Synthetic coding sequence
  Description of Combined DNA/RNA Molecule: Synthetic coding sequence
atgggccgagcaagacccggtcagcgcggacccccaagtcctggccctgcagcccagcctcctgcccctcctcgcaggcgggctcgctctctggcccttctgggggctctcctggcagccgcagcggcagcggctgtcagggtttgcgcccgacacgcagaagctcaggccgcagctcgtcaggaattggctctgaaaacactaggaaccgatggactatttctgttttcttctcttgacaccgacggcgatatgtatatctctcctgaagagtttaagcctatagccgagaagctcactggtagttgctctgtcacccagaccggagtacagtggtgtagccatagctcactccaaccgcagctcccatggctgaacugaagttcgtgcctgagccttttgcggagtacacccgctgcctcgtgtgaggaggaggaattgcccccagacccctccgaagaaacgcttacaatcgaggctaggttccagccccttctgccagaaacaatgaccaagtctaaagatgggttcctgggtgtgtctcgcctggccctttcaggactgcggaattggacggcggcagctagtccttcagctgtatttgcaacacgccattttcaaccattcttgcccccacccggacaagagctgggcgagccttggtggattattccaagtgagctgtcaatgttcactggctacctaagcaataaccgattttacccaccaccaccgaagggaaaggaggtcattatccaccgtctgttgtctatgttccacccaaggcctttcgtgaaaacaagattcgcaccacaaggagcagttgcatgcctgacagccatctccgacttttattacacggtgatgtttcggattcatgctgaatttcagctgtctgaacctccagattttccattttggtttagccctgcacagtttactgggcacattatcctgtccaaagacgccactcacgttcgggactttaggctgtttgtgccaaaccataggtcactcaatgtagacatggaatggttgtatggggcaagcgaatcatctaatatggaggtggacatcgggtacatcccacaaatggagttggaggcaaccggcccatccgtaccttcagtgatcctggacgaggatggctccatgatcgacagccacttgccgagcggcgaaccgctgcagttcgtgtttgaagagataaagtggcagcaggagctttcctgggaggaggcggcacgacggctggaggtcgccatgtatccttttaagaaggtgtcatatctgccatttactgaagcctttgacagagccaaagccgagaataagctggtccactcgatcctactgtggggcgctctggatgaccaaagctgtugagggtccggtagaacactccgtgagaccgtgctggaatcttcccctatcctgactctcttgaacgagagcttcatcagcacgtggagcttggttaaggaattagaagagttgcagaacaatcaggaaaacagctctcaccagaaacttgccggtcttcacctggaaaagtactcattcccggttgaaatgatgatttgtctacctaatggaaccgtcgttcatcacattaatgcaaactatttcctcgacataaccagcgtaaagcctgaagagatcgagagcaatcttttctccttctcaagtacattcgaggatccctctaccgccacgtatatgcaatttctaaaggagggtcttcgtcgtggactccccctgctacagccgtag

SEQ ID NO: 239895 - DNA, 1671 bp, Artificial Sequence
  Description of Artificial Sequence: Synthetic coding sequence
  Description of Combined DNA/RNA Molecule: Synthetic coding sequence
atgggccgtgctcggccaggtcaacggggacctccctcccctggtcccgctgcgcagcctccggcacccccacgccgacgcgctaggtcactggccttgctgggggctctccttgccgcagcggcagccgcagcagtgcgagtgtgtgccagacatgccgaagcccaggcagcggcacgacaggagctggctttgaagactttggggactgatggattatttctgttttcctccctggatacggacggagacatgtacatttctccagaagaattcaaaccaattgccgaaaaactcaccgggtcgactcccgcagcctcatgtgaagaggaggaactgccacctgacccctcagaagagacactcactatcgaggccaggtttcagcctctattgccagaaacaatgacaaaatctaaagacggttttcttggagtctcaagactcgccctttccggcttgaggaactggaccgccgctgcttcaccaagtgccgtgtttgccactaggcacttccagcctttccttccgcctcccggtcaggaactgggagagccctggtggatcatcccctctgaactgtccatgtttactggctatttaagtaacaatcgattctatcctccgcctccaaagggtaaagaggtaatcatccatcgccttctgtccatgtttcatccaaggcccttcgtgaagacccgcttcgcccctcagggagccgtggcctgcttgaccgccatatcagatttttattacaccgtgatgttccgaatccacgcagagtttcagctttctgagcctccagatttccccttctggttctcgccggcacaatttacaggtcatattatactctcaaaagatgcaacgcacgtgagagatttcagattatttgttccaaaccaccggtctctcaatgttgatatggaatggctgtatggggcttcagagagtagcaatatggaggttgacatcggttacatcccgcagatggaactagaggcaacaggtccttcagtcccatctgtgattttagatgaggacggatctatgatcgacagtcaccttccatctggcgaacctctccagttcgtcttcgaagagattaagtggcaacaggagctttcatgggaggaagcggcacgcagactggaggtagccatgtatccttttaagaaggtgagttatctacctttcaccgaagcttttgacagagcgaaagcagagaataaactggttcatagcattctcctttggggtgctctggacgaccaaagttgtugaggctctggacggacgctgagggagaccgtcctggaaagctctccaatcttgactctgctcaatgaaagctttatcagtacttggagtctggtcaaggaacttgaggaactgcaaaataaccaggagaattcaagccatcagaaactggcaggcctgcacctcgaaaaatactcatttccagtcgaaatgatgatttgtctgcccaacggaacagtcgtgcatcacatcaatgctaactactttttggacataacaagtgttaagccagaggagatcgaatccaatttgttctctttctcttctacattcgaagatccctcgacagcgacatatatgcagtttctcaaagaggggttgcgcaggggattaccattgttacagccatag

SEQ ID NO: 239896 - DNA, 1146 bp, Artificial Sequence
  Description of Artificial Sequence: Synthetic coding sequence
  Description of Combined DNA/RNA Molecule: Synthetic coding sequence
atgtggcggtccctcggtctcgccctggctctctgtctcctcccctctgggggaaccgaaagccaggaccagtccagcctgtgtaagcagccgcctgcttggtctattcgggatcaggatcctatgctgaatagcaatgggagcgtcaccgtggtggccctgctgcaggccagtugatatctgtgcattctgcaggcgtccaagttggaagacctacgtgtgaaactgaaaaaggagggctatagcaacatctcctacattgtcgtaaaccaccagggtatcagttctcgcttgaagtacacgcaccttaaaaataaagtcagcgagcacatcccagtgtaccagcaggaagaaaaccagacggatgtgtggactctgctgaacggttccaaagacgattttctgatctatgacaggtgcggccgacttgtgtatcatctgggcttgccattctccttcctgacgttcccctacgtagaagaggcgattaagattgcctattgcgagaagaaatgtggaaattgctccctgacgacacttaaagacgaggatttttgtaaacgcgtgagccttgcaacagttgacaagacagtagaaacccctagcccgcactatcatcacgaacatcaccacaatcacggacatcagcatttaggatctagtgaattgtccgagaatcagcagccaggagcgcctaacgcacccacacaccccgctccacccggtctgcaccaccaccacaagcacaagggacagcaccgacagggacatcctgagaatcgcgatatgcctgcctcagaggatctgcaggatttacagaagaagctgtgccgaaagcggtgcataaatcaactgctgtgcaagcttccaaccgactccgaactcgcccctagaagtugatgttgtcattgcagacatctgatctttgagaaaaccggcagcgccatcactugacagtgtaaggagaaccttccatccctgtgttccugacaggggcttagggcagaagagaacatcaccgagtcctgccagugacgtctgccgcctgctgccugacagatcagccagcaactgatccccacagaggccagcgcatcaugacgcugaaagaaccaggccaaaaagugagaaugaccgagtaactag

SEQ ID NO: 239897 - DNA, 630 bp, Artificial Sequence
  Description of Artificial Sequence: Synthetic coding sequence
  Description of Combined DNA/RNA Molecule: Synthetic coding sequence
atgtggagatccctcggccttgcgttggcgctgtgtctgttacctagcggcggaacagagtcgcaggatcagagctccctctgcaaacagccccctgcttggtccatccgggaccaggaccccatgctgaattcaaatggttctgtgaccgtggtggctctgctgcaggccagtugatacctgtgtattcttcaagcgtctaagctagaggatctgagagtgaagttaaagaaggagggatacagtaatatctcctacatcgtggttaaccatcagggaatcagctccagactgaaatatacccacctgaagaacaaggtgtcagagcatatcccagtgtaccagcaggaagagaatcagacagacgtgtggactctgctgaacggcagtaaagacgactttttaatttatgatcgttgtggacgactcgtctaccatttgggcctccccttcagtttcctgacctttccatacgtggaggaggcaataaagatagcctactgcgaaaagaagtgcgggaactgctccctcacaacactaaaggatgaggatttttgtaaaagagtaagcctggctaccgttgacaaaaccgtagaaaccccaagtccccattaccaccacgagcattag

SEQ ID NO: 239898 - DNA, 1146 bp, Artificial Sequence
  Description of Artificial Sequence: Synthetic coding sequence
  Description of Combined DNA/RNA Molecule: Synthetic coding sequence
atgtggaggtcacttggattagccctggccctctgtctcctgccctcaggcggaaccgagtcacaggatcagagctccttgtgtaagcagccccctgcttggtcaatccgggatcaggatcctatgctgaactccaatggatccgtgactgtggtagccctgttgcaggctagcugatatctctgcatcctgcaggctagtaaactagaagatcttcgagtgaagctgaaaaaggagggttattccaatatatcttacattgtcgtgaatcaccagggaattagttctcggctgaagtacacacatctcaaaaataaagtctccgagcatattcccgtgtaccagcaagaggagaaccagactgacgtctggacactgctgaacgggtctaaggacgatttccttatctacgacaggtgtgggaggttggtctaccacctagggctgccattcagcttcctaacttttccctatgtggaggaggcaataaagattgcctactgcgagaaaaaatgtggaaactgctctctaacgaccctaaaagacgaagacttttgtaaacgcgtctctctggccactgtcgacaaaaccgtggagaccccatccccccattaccatcatgagcaccatcataaccatggccaccaacatctggggagctctgagctctccgagaatcagcagcccggtgctccaaatgcccctacccacccagctcctcccggactgcaccatcaccacaaacataaaggacagcataggcaaggtcacccagaaaatagggatatgcctgcctctgaagatctacaggatctgcaaaagaagctttgccgcaaacggtgcatcaatcagctgctgtgcaagctgccaaccgactcagagctggccccaagatcgugatgttgccattgcaggcacctgattttcgagaagacaggctctgcgatcactugacagtgcaaagaaaacctgccatcactgtgtagtugacaggggttgcgggcagaagagaatatcaccgagtcgtgccagugacggttgcccccagcggcaugacaaatctcgcagcaactgattcctactgaggcctcagccagcugacgtugaaagaatcaagctaaaaagugagagugacccagtaactag

SEQ ID NO: 239899 - DNA, 933 bp, Artificial Sequence
  Description of Artificial Sequence: Synthetic coding sequence
  Description of Combined DNA/RNA Molecule: Synthetic coding sequence
atgtggagaagtcttggcttagctctggccttgtgtttgttacctagtggcggtaccgaatcgcaggatcaatcaagcctgtgtaagcagcccccagcttggtctatccgagatcaggatcctatgttgaatagcaatggttcggtgaccgtcgtggcactcctccaggcatcgugatatctgtgcatcctgcaggcgagtaagctggaagacctgagggtcaagctgaagaaagaagggtacagtaatatttcttacattgtagtcaatcatcagggcattagctcgcggctcaaatatacccacctcaaaaataaggtgtccgagcacattcccgtgtatcagcaggaggaaaaccaaacagatgtttggaccttgctgaatgggagtaaggacgattttctaatctacgataggtgtggaagactcgtgtaccatctcgggcttcctttctctttcctgaccttcccttacgtggaggaagccattaagatcgcatattgcgaaaagaagtgcggcaactgttctttaaccaccctgaaggacgaggacttctgcaagagggtgtctctggcaactgtggacaaaacggtggagaccccctctccgcactaccatcacgaacatcatcacaaccacggacaccaacatctggggtcatccgaactcagcgagaaccaacagcccggtgctccgaacgccccaacccatcccgcacctccaggcttacatcaccaccacaaacataagggccagcaccgccaaggtcatcccgaaaatcgcgatatgccagcatccgaagacctgcaggacctgcagaagaagctatgtcgtaaaaggtgtattaatcaactgctttgcaaactcccaaccgactccgaacttgcgccaagaagcugatgctgtcattgtcggcacctcatattcgagtag

SEQ ID NO: 239900 - DNA, 1146 bp, Artificial Sequence
  Description of Artificial Sequence: Synthetic coding sequence
  Description of Combined DNA/RNA Molecule: Synthetic coding sequence
atgtggaggtccctcggtctggccctggctctctgcctccttcccagcggagggactgaatcacaggatcaaagttcgctgtgtaagcaacccccagcttggtccatcagggatcaagacccaatgctcaactcgaatggcagtgtgacagtagtagctttgcttcaggcttcgugatatctgtgtattctccaggcaagcaagcttgaagacttacgggtgaagcttaagaaagagggatactcaaacatctcatacatcgtcgttaaccaccaaggcatttcaagcaggctgaaatacacgcatctgaagaataaggtgagcgagcacatcccagtttaccagcaagaagagaaccagaccgatgtctggacactgttgaacggctctaaagacgatttcctgatatatgacagatgcggaagattggtgtaccacttgggacttcctttctcttttcttacctttccgtatgtggaggaggcaatcaaaatcgcttattgcgagaagaaatgcggaaattgtagtctgaccacattgaaagacgaagacttctgcaaaagagtgagtctcgccactgtggacaagaccgtggaaacccccagcccccactaccaccatgagcaccaccacaaccacgggcatcagcacttagggtcgtccgagttgagcgaaaatcagcagccaggggctcccaatgccccaacacatccggcaccacccggacttcaccaccatcataagcacaagggccagcatcggcagggacaccctgagaatagggacatgcctgcatcggaagatctgcaggacctgcagaaaaagctgtgtcgaaaacgttgcatcaaccaattactgtgtaaactacctaccgatagcgagcttgccccaagatctugatgttgccattgtcgccaccttatctttgagaagactgggagtgccatcaccugacagtgcaaggaaaatctgccctcactgtgcagcugacagggactgcgagcagaagaaaacattaccgaatcctgtcagugacgcctgccgcctgccgcaugacagattagtcaacagttgattcccacagaggcgagcgcttctugacgaugaaagaatcaggcaaagaagugagagugaccgtccaactag

SEQ ID NO: 239901 - DNA, 264 bp, Artificial Sequence
  Description of Artificial Sequence: Synthetic coding sequence
  Description of Combined DNA/RNA Molecule: Synthetic coding sequence
atggctctggccgtgagagttgtgtattgtggggctugaggatataaaagcaaatacctccaactcaagaaaaagttagaggatgagttccctgggcgattagacatttgcggtgaaggaactcctcaggcaactggcttctttgaggtcatggtcgccggtaaattgattcacagtaagaagaaaggtgacggctatgttgatacggagagtaagttcctcaagctggtagcagcgattaaagcagcgttagcacagggatag

SEQ ID NO: 239902 - DNA, 267 bp, Artificial Sequence
  Description of Artificial Sequence: Synthetic coding sequence
atggccctggccgtaagagttgtctattgctgtggagccggaggctataaatcgaagtatctgcagttaaaaaagaagctggaggacgagttcccagggcgactcgacatatgcggcgagggaactccccaggccactggcttcttcgaagttatggttgccggtaagctcatacactccaaaaagaagggcgatgggtatgtggacacagaatctaaatttctgaagctcgtggcagcgatcaaggccgctctcgctcaggggtag

SEQ ID NO: 239903 - DNA, 351 bp, Artificial Sequence
  Description of Artificial Sequence: Synthetic coding sequence
  Description of Combined DNA/RNA Molecule: Synthetic coding sequence
atgagtttctgttcattctttgggggagaggtctttcaaaaccactttgagcccggtgtctatgtctgtgccaaatgcggctacgaactgtttagttctcggagcaaatatgcacactcttctccttggcccgcattcacagaaactattcatgcagatagtgtcgccaaaagaccggagcataatcggtctgaagccttgaaagtaagttgtggtaagtgcggcaacggcttgggacatgaatttctcaatgatgggcctaaacctggccagagtcgctttugaatctttagctctagtttgaaattcgtccccaaaggaaaagagactagcgccagccagggccactag

SEQ ID NO: 239904 - DNA, 681 bp, Artificial Sequence
  Description of Artificial Sequence: Synthetic coding sequence
atgagtttctgctcatttttcggaggcgaagtctttcagaaccactttgaacctggggtttatgtgtgcgcaaagtgtggatatgagctgttctcctcacggtcaaaatatgcccactccagtccttggccagcctttacagagaccatccacgcggattccgtagccaagcgcccagagcacaacaggagtgaagcgttgaaagtaaggggacatagaggtggcggtggcacgggagctgccagagagtcaagggaacccgtcccccctagcagcctctgtctgccgcattcctcaagagggctcgaggcttctatccctggtcttctgcccttacctggttcttgccaccccaggctctcaggggaacctggattgcttgtacagatgtgggaaactggccaagtttcttgtactggctcaagaacgaaagtgaatctgttatgccgccgaagcgcttgggaaattggtgtgtgggaggaaacgcccagcgctagtcccagcaaaggcctgcattgtggttgtataatggcgagatcgtctccaagttgtctggttatctttccaggggttctgtggcaggtgtggcagtgggtggggcctcgcgtgcctgaaaggcggcctcaggctggcgctgtgccaatactgaatatccagcagctcgcggaagtctgcccatag

SEQ ID NO: 239905 - DNA, 2328 bp, Artificial Sequence
  Description of Artificial Sequence: Synthetic coding sequence
atggcctctgctggtcatattattaccctacttctctggggttacctcctggagctgtggacaggaggccacacagcagataccactcaccccaggttaagattgagccataaggaattactgaacctgaatcgcacaagcatcttccactcacccttcggcttccttgacttgcacactatgctcctcgacgagtatcaggagagactttttgtggggggaagagacctagtgtactcactgtcgctggaacgtatttccgacggctataaggaaattcattggccttccactgcccttaagatggaagaatgcattatgaaaggcaaagatgctggggaatgtgcaaattatgtgagggtcttacatcattataacaggacgcaccttctgacctgtggaaccggtgcattcgaccctgtatgcgcattcattagggtcggctatcatcttgaggaccctctgttccatctggagtcgcccagatctgagcgcggtagggggagatgtccattcgacccttctagttcgttcatctctaccctaatcgggtccgaactttttgccggactgtactctgactattggtctcgcgacgctgccattttcaggtctatgggcaggctcgctcacatcaggacagagcacgatgatgaacgcttgctcaaagagccgaaatttgtcggctcatacatgatccccgacaacgaggaccgggacgataataaagtgtacttcttttttactgagaaagctctcgaggctgaaaacaacgcgcatgccatctacacacgcgtgggacgactgtgcgttaatgatgtgggaggtcaaaggattctggttaataagtggtccacctttttgaaagcccgtctcgtctgcagtgttcctggcatgaacgggatagacacatactttgacgaattggaagacgtttttctgttgcccacacgcgaccacaagaacccagtcatattcggtctgtttaacactacaagtaacatcttcagaggacatgcaatctgcgtctatcacatgtccagcattagggctgcattcaacggtccgtacgcccataaggagggtccggagtatcattggtcggtctacgaaggcaaagttccctacccaagaccaggatcttgtgcctcaaaggtgaatggcggacgatacgggactaccaaggattatcccgacgacgcgatcagatttgccagatcacaccccctcatgtatcaagccatcaaacccgcacataaaaagccaatcctggtaaagactgatggcaaatataacctgaaacaaatagctgtagaccgggttgaagctgaggacgggcaatacgatgtcctctttatcgggacagataatggaattgtgctgaaggttattacaatctataatcaggagatggagagtatggaggaagttattctggaggagctacagatttttaaagaccctgtgcccatcatatcaatggaaatctcttcaaaaagacagcaactgtatatcggcagcgcttctgcggtcgctcaggtcaggttccatcactgtgatatgtatggctccgcctgcgctgattgctgcctggccagggacccttattgcgcttgggatggcatatcatgttcccgctactacccgacaggaacccatgccaaacggcgttttagacgccaggatgtgcggcacgggaacgcagcacagcagtgtttcgggcagcagttcgtaggcgacgcactcgataagaccgaagaacacctcgcttatggtatcgagaataattcaactctcttggagtgcacacccagaagtctccaggcaaaggtgatatggttcgtccaaaaaggccgagaaacacgtaaggaggaggtgaagacagacgatagagtcgtaaaaatggatctggggctgctgttcctgaggctgcataagtcagacgctggcacctacttctgccagactgtggagcattcctttgttcatacggtgaggaaaatcacactagaggttgttgaagaagagaaggttgaagacatgttcaacaaggatgatgaggaggacaggcaccaccgcatgccttgtcccgctcagtcctcaatctcccaaggcgcaaaaccgtggtataaggaattcctccagctgatcgggtatagtaactttcaaagagtggaggagtactgcgagaaggtgtggtgtactgaccgtaaaaggaaaaagctcaaaatgagcccctcaaaatggaaatacgcaaaccctcaggaaaagaaattgcgaagcaagcctgaacactaccgactgccgaggcacaccctagattcttag

SEQ ID NO: 239906 - DNA, 2148 bp, Artificial Sequence
  Description of Artificial Sequence: Synthetic coding sequence
atgttgttggacgagtaccaggaacgcctgttcgtgggcggacgggatcttgtatatagcctttcattggagcggatctcagacggatataaggagatacactggcccagtaccgccttaaagatggaggaatgcattatgaagggtaaggacgccggagaatgtgccaattatgtgcgagtactgcaccattacaaccgaactcatttactcacttgcggtaccggagccttcgatcccgtgtgcgcgttcattcgtgttgggtatcatctggaagatccgctgttccacctggaatcacctagatcagaacgaggccgtggcaggtgccctttcgatcccagctcatcattcatcagcactttgatcggcagcgagctgtttgcaggcctgtacagtgattattggtctagagacgcagctatctttaggtcaatggggagattggcccatatacggactgaacacgacgacgagaggctacttaaggaacccaaatttgtaggatcatacatgattcccgataatgaagatagagatgataacaaagtgtacttcttctttacagaaaaggccctcgaagctgaaaataatgcacacgcgatatacacaagggtcggcaggctctgtgtcaatgacgttggaggacagagaatcctggtcaacaaatggagcacctttcttaaggctcgcttggtgtgctctgtgccaggaatgaacgggattgacacatacttcgacgagctcgaagacgtgttcttgctgcctacccgagaccataaaaacccagtgatctttggcctgtttaacacaacctctaacatttttagaggccacgcgatctgtgtttaccatatgagctcaataagagctgcgtttaacgggccttacgcacataaagaggggccagagtaccattggagcgtctatgagggaaaagtgccatacccacggcctggctcatgcgcatctaaagtaaacgggggtcggtatggaactacaaaggattatcccgatgacgctattcggtttgccagatctcacccattgatgtatcaggctatcaagcctgctcataaaaagccgatcctggtgaagaccgacgggaaatataatttgaagcagatcgccgtcgacagagttgaagccgaggatggtcagtacgatgtcctgttcatcgggactgataatggcatcgtcctcaaggtcattactatctataatcaggaaatggaaagcatggaagaagtcattctagaggaactgcagatcttcaaagaccctgtccccattatcagtatggaaattagcagtaagcgccagcagctctatatcggcagtgccagcgcggtagcccaagtgcggtttcatcactgtgacatgtatggcagcgcctgcgccgattgttgtttagcgcgagatccatactgtgcgtgggacggcatcagctgcagtcgttattacccaacaggaacccacgccaagcgcagatttagaaggcaagatgtaagacacggaaatgctgcccagcagtgcttcggacaacaatttgtgggtgacgctctggacaaaacagaggagcacctggcctatggaatcgaaaataactctactctgttggaatgtaccccgagaagcttgcaagccaaggtgatctggtttgtacagaaagggagagaaacacgcaaggaagaggtcaagacagacgatcgtgttgtgaaaatggacctggggctcctgtttcttcgtttacacaaatcagatgctggtacatacttctgccaaactgtggaacactcgttcgttcacactgtgaggaagattaccttagaagtcgtagaagaggaaaaagtagaagatatgttcaataaggacgatgaggaggacagacaccacagaatgccatgcccagcccagtctagcatctcgcagggcgctaagccctggtacaaagagttcttgcagctgataggttactctaacttccagagggtagaggagtactgcgaaaaggtgtggtgtacagatagaaagcgaaagaagctgaaaatgagtccctctaagtggaagtacgcgaacccccaggaaaaaaagcttagatcaaagcctgagcactatagattaccacgacacacactggatagttag

SEQ ID NO: 239907 - DNA, 2301 bp, Artificial Sequence
  Description of Artificial Sequence: Synthetic coding sequence
atggcgtccgcaggccatataatcacattactactttggggctacctgttagagttatggaccggaggtcatacagctgataccactcaccctcggctgcgcctgtcacacaaagaattacttaacttgaacaggacctctatattccactctcctttcggcttcttggacttgcatactatgctcctcgatgagtaccaagagaggctgtttgttgggggaagagacctggtgtactctctctccctagagagaatcagcgatggttacaaggaaattcactggccaagcaccgccctgaaaatggaggaatgtatcatgaagggaaaagacgccggtgaatgcgcgaactatgtccgggtccttcatcactataacaggactcatctgttgacctgtggaaccggcgctttcgaccccgtgtgcgccttcatacgagtcggctatcatttggaagatcccttgttccacctcgaaagtcccagaagcgagagagggcgaggacggtgccccttcgatccgagtagctctttcatctcgacattgatcggctccgaattattcgccggtctgtattcagactattggagccgagacgctgctattttcaggtccatggggaggctcgcccatattcgcacagaacacgacgacgagcggctgctgaaggagcccaagttcgtgggctcctatatgatcccagataacgaagacagggacgacaacaaggtgtacttttttttcacggagaaagcgttggaagcagagaacaacgcacacgcaatctatacccgcgtcggcaggctgtgcgtaaatgatgtggggggacagcgtatccttgtgaataagtggagcacctttttgaaggccaggctggtatgctcagtccctggcatgaatggcattgacacctactttgatgaactggaggatgtgttcttacttcctactagagaccacaagaatccagtcatttttggcttgtttaatacaaccagcaacatcttcaggggacatgctatttgcgtatatcacatgagttcgatcagggccgcattcaacgggccatacgctcataaagagggaccggaatatcactggtccgtttacgaggggaaagtcccatacccaaggcccggaagttgcgcttccaaggtgaatggaggacggtatggaacaaccaaagattaccccgacgacgctattcgtttcgccaggagccaccccctgatgtaccaggccattaagcctgctcacaaaaagccaattcttgtgaagactgatgggaaatataatctcaaacagattgccgttgatcgagtggaggctgaagacgggcagtacgacgtgttgttcattggtacagacaacggaatagtgctgaaagtgatcaccatctataatcaggagatggaatctatggaagaagtcattcttgaagaactgcagatctttaaggatccagtgcccataatatcaatggagatcagtagcaagaggcagcagctgtatattggttccgcctccgcagtggcccaggtgagattccaccactgcgacatgtacggttcagcgtgtgcagactgctgtctcgcacgcgatccttactgcgcatgggacggtattagttgttcaaggtactatcctacgggaacacacgccaagcgcagatttcgtcgtcaggatgtgaggcatggaaacgccgctcagcagtgtttcggccagcagtttgtaggcgatgctcttgataagaccgaagaacacttggcctatggaattgaaaacaacagtacgctgctggagtgtaccccccgatccctacaggcaaaagtgatttggtttgtccagaaaggccgtgaaacccgaaaagaagaagtgaagaccgacgaccgggtagttaaaatggacttagggcttctcttcctgagattgcacaaatccgacgctggtacatatttttgtcagaccgtcgaacactcattcgtgcacaccgtacggaagataacactggaggtggttgaggaggaaaaggtcgaagacatgttcaataaggacgatgaggaggacagacaccatcgcatgccatgccccgcacagtcaagtataagtcagggagccaagccctggtataaggagtttctgcaacttattgggtactccaacttccagagagtggaagagtattgcgaaaaggtttggtgtacagacaggaaaagaaaaaagttgaagatgagtccatcgaaatggaaatacgcaaacccacaacactacagactgcctcgccatacccttgactcctag

SEQ ID NO: 239908 - DNA, 2286 bp, Artificial Sequence
  Description of Artificial Sequence: Synthetic coding sequence
atggccctgcccgcactgggcctcgatccttggagtctgctcgggctgttcctgttccagctccttcagctcctattgcccaccacaaccgccggaggcggaggacaggggccaatgcctcgcgtgcggtactatgcaggcgacgagaggcgtgccttaagtttttttcaccagaaagggcttcaagacttcgatacactgttactctcaggcgatggaaatacattgtacgtcggtgcacgcgaagccatcctcgcgttggacatccaggatccaggtgtgccaaggctgaaaaatatgatcccatggccagcctccgaccgaaaaaagtctgagtgtgcttttaaaaagaaatcgaacgaaacacagtgcttcaattttatcagggttttggtatcttacaacgtcacccatctgtatacctgcggcactttcgctttttcgcccgcttgcaccttcatcgaactgcaggacagctatctgcttcctatcagcgaagacaaagtgatggagggtaagggacagtccccttttgaccccgcacacaaacataccgctgtgcttgtcgatgggatgctgtattccggaaccatgaataatttcctgggatccgagccaattctgatgagaactctgggtagccagcccgtcctaaagaccgacaatttccttagatggctgcatcacgatgccagttttgtggcggcaatcccttcaacccaggtcgtttacttcttttttgaggaaacggcttcagaatttgactttttcgagcggctgcacacctcacgggtggcacgcgtctgtaagaacgatgtcgggggagaaaaacttttgcagaaaaaatggacaacatttctgaaggctcagctgctgtgtactcaacctggacaactgccttttaacgttattcgacatgccgttctccttcccgcagactcccccacagcacctcacatttacgctgttttcacgtcccaatggcaggttgggggtacccgctcctcggctgtgtgcgcgtttagcctgttggacattgagagagtcttcaaggggaaatataaggaactgaataaggaaacttctcgctggaccacatatcgtggcccagagactaatcccagacctgggtcatgttccgtgggtccaagtagcgacaaggccctcactttcatgaaagaccattttttgatggacgagcaagtcgtgggcacacccctgctggtcaagtctggcgtggagtatacgcggctcgcagtagagaccgctcagggtttggacggccactcacatctagtgatgtacttagggactacaacaggaagcctccacaaggctgtggtgtcaggagattcttctgcccacctggtggaagagattcagctgtttcctgatcccgagccagtgcggaacctgcagctcgcacctactcagggggcagttttcgtcggcttctcgggaggagtttggcgagtccctcgcgcaaactgctccgtttatgagagctgcgtggattgcgttttggccagggatcctcattgcgcttgggatccggagagcaggacttgctgcttacttagcgcgcctaaccttaactcgtggaagcaggacatggaaagaggaaaccctgaatgggcctgtgcctccgggcctatgagccgctccttaagaccccagtcccggccacagataatcaaggaagtgctggccgtgcccaacagcattctagagcttccctgccctcatctcagcgccttagccagctattactggagccacggaccggctgccgttccggaggcctcaagcacagtatataatgggtctcttttactgatcgtgcaggatggtgtcggcggactgtaccaatgttgggcaaccgagaacggattcagctacccagtgatctcgtactgggtggacagccaggaccagacactggctctcgacccagaacttgccggtattccgcgtgagcacgtaaaggtgcccctcactcgggtgtccgggggagctgctctggccgcacagcagagctattggccccacttcgtaaccgttacagtgctcttcgcactggtgctgtcaggcgctctgatcatcttggtagccagccctctccgcgctctccgtgctaggggcaaggtgcagggatgtgaaacgcttaggcctggggagaaggctcccctatctcgggagcagcatcttcagtcaccaaaagagtgtagaacttcagccagcgacgtggatgccgacaataactgccttggaacggaggtcgcctag

SEQ ID NO: 239909 - DNA, 2286 bp, Artificial Sequence
  Description of Artificial Sequence: Synthetic coding sequence
atggctctgcccgcattaggactggatccatggagcctgctgggcctatttctatttcaactcttgcaactgctgctgcctactaccaccgccggagggggaggccaaggcccaatgcccagagtaaggtactatgccggagatgagaggagagccttatcattttttcaccagaaagggctccaggattttgataccctgttgctgagcggggatggaaatacactttatgtcggggcacgggaagctattttagctctagacatccaggaccctggcgtgcccagactgaaaaacatgatcccctggccagcctctgacagaaaaaaaagtgaatgtgcgtttaaaaagaagagtaacgagacgcagtgtttcaactttatacgggtcttagtgtcctacaatgtgacccacctctacacatgtggaacattcgccttctctccagcctgcactttcattgaactccaggactcctacctgcttccaatttccgaggataaggtaatggaaggcaaggggcagtccccctttgatcccgctcataagcataccgcagtgttggttgacggcatgctgtacagcggtaccatgaataattttttaggcagtgaacctatattgatgcgcacactggggagtcagccagtgttgaagactgacaatttcctgaggtggttacaccacgacgcctcttttgtggctgctattccatcaacccaggtcgtgtactttttctttgaagagactgcatctgagttcgacttctttgagagactgcacacttctcgggtggccagggtatgcaagaacgatgtcggaggagagaaactgctgcaaaagaaatggacaacctttctcaaggcccagttgttatgcacccagcccggacagctcccctttaacgtcatccggcacgcggtgttgctgcctgctgactcccccaccgctccccatatctatgctgtgttcacttctcagtggcaggtgggcggaacaagaagctccgcagtgtgtgcattctcactgctggacattgagcgggtgttcaaaggcaaatacaaagagttgaataaggagaccagccggtggacgacatacaggggccctgagaccaaccccagacctggatcctgcagtgtgggtccgtcttcagataaggcgctgacatttatgaaagaccacttcctcatggatgagcaggtggtgggtaccccattgcttgtcaagtcgggagtggaatacactaggctcgcagtggagacagcccaggggctcgatgggcacagtcatctggtaatgtatctgggcacaacaactggcagtctacataaagctgtggtgagtggcgactcctccgcccacctggtagaggaaatccaactttttccagaccctgagcccgtaaggaacctgcagctcgcccctactcagggggcagtgttcgtaggtttcagcgggggtgtgtggagggtgccaagggccaattgcagcgtttacgagtcctgcgtggattgcgtgctggccagggacccccattgcgcctgggaccccgagtccagaacctgctgcctcttgtctgccccaaatctcaacagctggaaacaggacatggagcggggaaatcccgagtgggcatgcgcatcagggccaatgtctcgatcgcttagaccccaatcccgccctcagatcattaaggaggtgcttgccgtccccaactccattctcgagttgccatgtcctcacctatctgccctggccagttactactggtcccatggcccagcagccgtaccagaggcttcaagtaccgtatacaatgggtctttattgctcatcgtgcaggatggagtggggggactgtaccagtgttgggccacagagaatgggttcagctaccccgtgattagctactgggtcgactctcaggaccaaactctggcgctcgaccctgagctcgccggtatcccgcgagaacatgtgaaagtgccattgacgcgcgtaagcggaggagctgctttagcagcccagcagtcttactggcctcacttcgtgacagtcacggtgcttttcgcgctagtgctgtctggcgctctgatcatcctggtagcatctcctctcagagcgctccgcgcaagaggcaaggtacagggatgtgagacgctgaggccaggagagaaggctcccttgtctagagagcaacatctgcaatcacccaaagaatgccgcactagtgcttcagacgtcgacgccgataataactgtctaggcacagaggtcgcctag

SEQ ID NO: 239910 - DNA, 2172 bp, Artificial Sequence
  Description of Artificial Sequence: Synthetic coding sequence
atgccccgagtcaggtactacgctggcgatgaacgacgtgccctgagctttttccaccagaagggactgcaggactttgatactttgctattgagtggagacggcaacacactttatgtgggtgcgcgtgaggccatattggcactggacattcaggacccgggagtcccgaggttgaagaatatgatcccctggcccgcatcagatcggaagaaaagtgagtgcgccttcaaaaaaaaaagcaatgaaacgcagtgttttaacttcattagggttctggtcagctataatgtgacgcatttatacacatgcgggacattcgccttcagtccagcgtgcacgttcatcgagctgcaagactcctacttgctgccaatctccgaggacaaagtgatggaaggcaagggccaaagtccctttgaccccgctcacaaacatacagccgtgctggttgacggaatgctctatagcggaacaatgaacaatttcctggggtccgagccgattctgatgcgcaccctagggtctcagccagtgctaaagactgacaattttctgcgctggttacaccacgacgcaagttttgtcgcagcaatcccatctacccaagtggtatactttttcttcgaagaaaccgcctcggaatttgacttctttgagcgcctgcatactagcagggtcgccagagtctgtaagaacgacgtaggaggggaaaagctcctgcaaaaaaaatggacaaccttcttgaaggcccaactgctgtgcactcaacccggtcagttgccgttcaacgttatccgacatgccgtgctactcccggcagactcaccaaccgctccccacatctatgcggtgtttactagtcagtggcaggtcggaggcacgcgcagctcagccgtttgcgcattctccttgctagacatcgagcgagtgtttaagggcaaatacaaagagctgaataaggagacatcccgatggactacctacaggggaccagagacgaaccccaggcccggatcctgttctgtagggcctagtagcgacaaggctctcacttttatgaaggaccacttcctgatggacgagcaggtggtcggcacacctcttttagtcaagtcaggagtcgaatacacccggttggccgttgaaacagcacaggggctcgacggacacagtcacctcgtaatgtacttaggaaccactacgggttccctccacaaagcagtggtgagtggagattctagcgctcacctggtcgaggagatccagctgttccctgacccagagccagtgcgaaacctgcaattggctcccacacagggggctgtttttgtgggattcagcggaggggtgtggcgggtgccacgagctaattgcagcgtgtatgagtcttgcgttgactgcgttttagcaagggatccacactgtgcttgggaccctgagtctcgaacctgctgtctgctcagtgccccaaatctcaatagctggaaacaggacatggagagaggtaaccccgagtgggcgtgtgccagtggcccaatgagtagaagtttgaggcctcagagtcgaccacagattattaaagaagtgctcgctgtcccaaattccattctggagttaccctgtccacacttgtccgctctggcctcttattattggagccacggacctgctgccgtgccggaagcttcctcgacagtgtataatggtagcctactgctgatcgttcaggacggtgtgggagggctgtatcagtgttgggccacagaaaacggcttttcgtacccagtgatttcctactgggtcgactctcaggatcaaactctcgcattggacccggagctagccggtatccctagagagcacgtaaaggtgcccttgaccagagtctcagggggtgctgcccttgccgctcagcagtcttactggccacatttcgtgaccgtgacagtccttttcgctctcgtcctgagtggcgctttgattattctggtggcaagcccactaagggcattacgagcacgcggtaaggtgcaagggtgtgagaccctccgccctggcgaaaaagctcccctcagccgcgagcagcatctgcagtcaccaaaagaatgtcggaccagcgcatccgacgtcgacgccgacaacaattgcctgggaacagaggtggcctag

SEQ ID NO: 239911 - DNA, 1890 bp, Artificial Sequence
  Description of Artificial Sequence: Synthetic coding sequence
atgattccatggcctgcctcagaccggaagaagtccgaatgcgctttcaagaaaaaaagtaacgaagagcttcaggatagttacttgttgcccattagcgaggataaggtgatggaaggtaaggggcagagtccattcgatccagctcacaagcatacggccgtgttggtggatggcatgctttactcaggaactatgaataacttcttgggctctgagcccatactaatgagaaccttggggagtcagcccgtcttaaaaaccgataattttttgagatggttgcatcacgatgcctcttttgtggcagcgatccccagcacgcaagtggtctatttctttttcgaggagacggcctcagaatttgacttcttcgagcgtctccacacgagccgagtcgctcgggtctgtaaaaacgacgttgggggagagaaactactgcaaaagaaatggaccacattcctaaaagcacaattactgtgcacacagccagggcaacttccatttaacgtcattcgccatgctgtgctcctgcctgctgattctcccaccgctccacacatatatgcagtgttcacatcacagtggcaggtcgggggtacccggagttcagcagtctgcgctttctccctgcttgatatcgagagggtttttaaaggcaagtacaaggaattgaataaggaaacatcccggtggactacctatagagggcctgagacgaacccgcgaccaggcagttgtagcgtcgggccatctagtgacaaagcactgacatttatgaaggaccattttctgatggatgagcaggtggtgggaaccccccttttggtgaaatccggggtggagtacacccggcttgctgttgaaaccgcccaaggcctggatggacattcacatctcgtgatgtatctggggaccacgaccggttcactgcataaagcagtggtatctggggattcgtccgcacatctcgttgaggagatccagctgttccccgatccagaacctgtccggaatctgcagcttgcccctacccaaggggcagtcttcgtcggcttttccggaggcgtgtggcgggttcccagagcgaattgtagtgtatacgagagctgcgtggattgtgtgctggctagagatccccactgtgcttgggatcctgagtcacggacctgctgtctcctttccgcacccaatttgaacagttggaaacaagatatggaacgtggcaacccggagtgggcatgcgccagcggaccaatgtcccgatcgctcagaccccaaagccgtccacagataatcaaagaggttctggctgtccccaatagtatactggaactgccctgccctcacctctccgcacttgctagctactactggagccacggacctgcggctgtgccggaagcctccagcacggtgtacaatggatctcttttgttaatcgtgcaagatggtgtcggagggctttaccaatgttgggctacggaaaacgggttttcataccccgtgatctcttactgggtggactcgcaggaccaaactctagccctggaccctgaactcgccggaatcccaagagagcacgtgaaggtccccctgacccgagtctccggcggtgctgctctggccgctcagcagagctattggccccactttgtcactgtcacagtcctgttcgcgttagtgctgtcaggcgcacttattatcctggtggcatccccactgcgagctctccgagccagagggaaagtgcagggatgcgagacactgagacccggagaaaaggcacccctgtcccgggaacagcacttgcagagccctaaagagtgccggacaagtgcttccgacgttgacgcagataacaactgtctcggcactgaagtagcatag

SEQ ID NO: 239912 - DNA, 2286 bp, Artificial Sequence
  Description of Artificial Sequence: Synthetic coding sequence
atggcactgcccgctctcggactggacccctggagcctcctaggactgtttttgttccaactattacagcttcttttgcccacaacaactgccggtgggggagggcagggcccaatgccccgtgtccgatactatgctggtgatgaacgccgtgccctgtccttcttccatcagaagggacttcaagattttgatacgctgttgctgtcgggggatggaaacaccctgtatgtgggcgcaagggaggccatccttgcccttgacatccaggatcctggtgtcccaaggctcaaaaatatgattccttggcctgctagcgaccggaagaaatctgaatgtgccttcaaaaagaaatcaaacgaaacgcaatgtttcaatttcattagggtactagtctcgtataatgttacccacctgtatacttgtggaactttcgcgttttccccggcttgcactttcatcgagttgcaggattcctatctgctgccaatttccgaggataaggtcatggaggggaaaggacaatccccttttgaccctgcacataaacataccgcagtccttgtggacggaatgctttactctggcaccatgaataacttcctggggtcagaaccaatactcatgagaactctgggaagccaacccgttttgaagaccgacaacttcctgcgctggctccaccacgatgcttcgttcgttgctgcgatcccctcaacacaagtggtatactttttctttgaggaaacggccagcgaattcgatttcttcgagcgcctgcacacctcacgggtagccagagtgtgtaaaaatgacgtgggcggagaaaagctgctgcagaaaaagtggacaacctttctaaaagcacagcttctgtgtacccaacccggtcaactccctttcaacgtgatcaggcacgcagtccttctccctgccgattcacccaccgcccctcacatctacgccgtctttactagtcagtggcaggtggggggtacacggtcaagcgccgtttgcgccttttctcttctggacatcgaacgtgtgttcaagggcaagtacaaggagctgaacaaagaaacctctagatggacaacctaccgcggtcctgaaaccaacccacggcctggctcttgtagtgtgggcccaagctcagataaggctctgacttttatgaaggatcacttcctaatggatgaacaagtcgtgggcactcctttgctagttaagtcaggggtcgagtacactagactggcggtcgagactgctcagggattggacggacactctcacctggtgatgtatctcggaaccacgactggcagcttgcataaagccgtggtctccggcgattcctcagcccacttggtggaggagatacagctatttcccgatcccgaaccagtccggaatctgcagcttgcacccactcagggagccgtgtttgtgggattcagcggcggtgtgtggcgagtcccacgcgctaattgcagcgtgtacgagagctgtgtggattgtgtgcttgcacgggacccacattgcgcctgggatcctgaatcaaggacatgttgtctgttatctgccccaaacttgaactcatggaagcaggacatggaaagaggtaatcctgaatgggcctgtgcttccgggcctatgtcccgaagcctcagaccacagagcagaccccagattataaaagaggtgctggccgtgcctaactctatattagaacttccatgtccacacctgtccgctttggcatcttactactggtcccatggaccagctgcggtgcctgaggcaagcagtacagtctataatgggtccctgcttctcatcgtgcaagatggcgtggggggattgtatcagtgctgggcgacggaaaatggctttagctacccagtgatttcatattgggttgacagtcaagatcagaccctggcgttagaccctgagttggccggaattccccgagagcacgtcaaagtgcccctcactagagtgtctggaggcgctgcgctggcagcccaacaatcttactggccccactttgtaactgtaactgtgctgtttgccctcgtgttaagcggggctctgattatactggtggcatcacctctgcgggctctgagagcccgaggcaaggtacagggctgtgagaccctgcggcctggcgagaaggcaccactgtcaagagagcagcatcttcagtcaccaaaagaatgccgtacctctgctagcgatgtggatgcagacaacaactgtctcgggactgaggtcgcttag

SEQ ID NO: 239913 - DNA, 1890 bp, Artificial Sequence
  Description of Artificial Sequence: Synthetic coding sequence
atgattccttggcccgcttctgacaggaagaagagtgaatgcgcctttaaaaaaaagagcaacgaggaactgcaagatagttacctgctgccaatttctgaggacaaggtcatggaaggcaaggggcagtcgcctttcgatcctgcacacaagcatacagccgttctggtagatggaatgttgtactcgggtactatgaataactttttgggttcagagcccatcctaatgagaacattgggttctcagcctgtgctcaagactgataatttcctgcggtggctccaccatgatgcctccttcgtagctgcaatcccaagtacacaggtggtgtattttttcttcgaggaaactgcttcagagtttgactttttcgagagactccatacctcacgcgttgcgagagtgtgcaagaatgacgtgggcggagagaagcttctgcagaagaaatggacaacattcctcaaagcccagcttctgtgtacccagccgggtcaactcccatttaacgtgattcgccacgccgttctgctgccggctgactcccccaccgccccacacatatacgccgtgttcacctcccagtggcaagttggaggcaccagaagcagtgctgtctgtgctttctctctgctcgacattgaacgagtgttcaaaggcaagtacaaggagttgaataaggagacttcgcgctggactacctataggggcccagagactaacccacgtccaggttcttgcagtgttggacccagcagcgataaggcattgaccttcatgaaggatcacttcttgatggatgaacaagttgtagggactcccctgctggtgaaaagtggcgtggagtacacaagattggctgtcgaaactgctcagggattggatggccactcgcacctcgtgatgtacttgggcacgaccactggatccctgcataaggctgtggtaagtggggattctagcgcccacctggtcgaggaaatccagttattcccagaccccgaaccagtgaggaatctgcagctcgcacccacccagggcgctgtcttcgttggattctcaggtggggtgtggcgggtaccaagagctaattgttccgtgtatgagtcatgtgttgactgtgtgctggccagggaccctcattgcgcctgggaccccgagagtcgcacgtgttgtctgttatcggcgccaaaccttaatagctggaagcaggacatggagcgtggaaaccctgaatgggcctgcgcctcaggcccaatgtcacgaagcctccggcctcagagccgccctcaaattattaaggaagtattagcggtccctaactctatcctggagctgccgtgtccccacctgagtgcgcttgctagttattactggtcacatggtcctgccgcagtgcctgaggcttcaagcactgtatataatggttctttacttctcattgtccaggacggagtaggcggactctatcagtgctgggctaccgaaaacggcttctcctatccagtgatctcctattgggtggacagccaagatcaaacgttagccttagacccagagctggccggtatccccagagagcatgtcaaagtccccctgacccgggtatctgggggagcagccctcgccgctcagcagtcctactggccccatttcgtcaccgttacagtgctattcgccctcgtcctttcaggagcgcttatcatcttagtggcttcccctttgcgggcattgcgggctcgcggtaaagtccagggctgcgagactctgcgccctggtgagaaggcccctctgagccgggaacaacatctgcagtcgcccaaggagtgcaggaccagtgcctcagacgtagacgcagacaacaattgtttgggaaccgaagtcgcctag

SEQ ID NO: 239914 - DNA, 663 bp, Artificial Sequence
  Description of Artificial Sequence: Synthetic coding sequence
atgattccttggcctgcttccgatcgcaagaagtccgagtgcgctttcaaaaagaaaagtaacgaaacccagtgcttcaattttataagggtgctggtgtcctacaacgtgacgcatctttacacctgcggcacctttgctttttcccccgcatgtacatttatcgagctgcaggattcctatcttttgcccatcagcgaagataaagtaatggagggaaaagggcaatctccatttgaccccgctcataagcacaccgccgtactggttgatggaatgttgtattctggcaccatgaacaactttttgggcagcgaacctattttgatgcggacgctggggtctcaaccagtgttgaaaaccgataattttctgagatggctccaccatgatgctagcttcgtcgcagcaataccatccacccaagtagtttatttcttctttgaggaaacagctagcgagttcgactttttcgaacgcctccatacatccagagtggctcgggtgtgcaagaatgacgtaggtggggagaaactgttacagaagaagtggacaacatttctgaaggcccagcttctctgcacccagcctggccagctcccctttaatgtcatccggcacgctgtgttattaccggcagactctcctactgctcctcactag

SEQ ID NO: 239915 - DNA, 966 bp, Artificial Sequence
  Description of Artificial Sequence: Synthetic coding sequence
atggctcttcccgcattgggactcgacccttggagcctgttagggctgttcctcttccagctgttacaactcttgcttcccacaaccacagccggagggggtggacagggccctatgcctcgtgtgagatattacgccggagatgaacgacgggctctgagtttcttccaccagaagggattgcaggacttcgataccctgctgctgtctggcgacggaaacaccctttatgtcggtgctcgcgaggcaatcctggcactggacattcaggaccctggcgtcccacggctaaagaatatgattccgtggcccgcatccgaccggaaaaagtcagaatgtgctttcaaaaagaagtctaatgagacacaatgcttcaacttcataagggtgctcgtatcttacaatgtcactcatctgtacacctgcggcaccttcgcattttcccctgcatgcaccttcatcgagttacaggattcttaccttttaccgatatctgaagataaagtgatggaaggaaaagggcaaagtcccttcgacccagcacacaagcatacagcagtgctggtggatggtatgctttatagtggaacaatgaacaattttcttgggtctgagcctattctcatgcggactctggggtctcaaccggtgcttaaaaccgacaacttcttgcggtggctgcatcacgatgccagctttgtggcagctatccccagcacacaagtggtctacttttttttcgaagaaacggccagtgagttcgacttcttcgagcggctgcatacaagccgggtcgcaagagtgtgcaaaaacgatgtcggcggtgaaaagctcctccagaaaaagtggacaacattcctcaaagctcagttgctgtgcactcagcctggccagctccccttcaacgtgattagacatgcggtgcttttacctgctgatagtcctactgccccacacatttattag

SEQ ID NO: 239916 - DNA, 711 bp, Artificial Sequence
  Description of Artificial Sequence: Synthetic coding sequence
atggccctgcctgccctgggcctcgatccctggtccctgcttggactgtttctgttccagctgctgcagctgctcctgccgacaactaccgcgggaggagggggacagggacctatgcctcgagtgcgatactacgccggtgacgagagaagagcacttagcttttttcaccagaagggcctccaagacttcgatactttactcctgtctggagatggcaacaccctgtacgttggcgctcgggaagctatcctggcgcttgatattcaggatcccggagtgcccaggctgaagaatatgattccatggcccgctagtgatcgcaaaaaatccgagtgcgctttcaagaagaaatcaaatgaggagcttcaagactcatatctactgccaatcagcgaagacaaagtcatggagggcaagggccagagcccctttgatcccgcacataaacacactgccgttctcgtcgatggaatgctgtatagcggtactatgaacaatttcctagggtcggagccaattttaatgcggaccctcggtagccagccagtgctcaagaccgacaatttcctgcgatggctgcatcacgatgcttctttcgttgccgcaatcccctcgacacaggtcgtctacttttttttcgaagagactgcaagtgaattcgattttttcgagcgcttacatacatcccgagtggctagagtgtgctag

SEQ ID NO: 239917 - DNA, 2172 bp, Artificial Sequence
  Description of Artificial Sequence: Synthetic coding sequence
atgcccagagtgagatattacgccggagatgaaagacgggctctgtccttctttcatcagaagggccttcaggactttgataccctgctactctccggcgatggcaacacactttatgtgggggctagagaagctatcctagccctggacattcaggacccaggcgtgccacgactgaagaacatgataccatggcctgcgtcagatcgcaaaaagtcggagtgtgcattcaagaaaaagtctaacgaaacgcagtgcttcaacttcattcgggtactagtaagctataacgtcacccacctgtatacatgcgggactttcgcctttagtccggcatgcactttcatagagctccaagacagctacttgcttccaatctcagaggataaggtgatggagggaaagggccaatctccattcgatcccgcacataaacacacagccgtgctcgttgacggtatgctctacagtggcaccatgaacaactttctcggatctgagcccatcctaatgcgcaccctggggtcgcagcccgtgctgaaaactgataactttctccgatggctgcaccacgatgccagctttgttgctgccatcccctccacccaggttgtctatttcttctttgaagaaaccgcgtccgagtttgattttttcgagcgacttcacaccagccgcgttgctagggtttgcaagaacgacgtaggcggagagaaactgctgcagaagaaatggaccacatttctgaaggctcagcttctctgcactcagccaggtcaattgccattcaacgtcatcagacacgctgtgcttctgcctgcagattcacctacagctcctcatatctacgctgtgttcacttcccagtggcaggtgggtggaactcggagctccgcggtctgcgcattttccttactcgatattgagagggtcttcaaaggaaaatataaggagctgaacaaagaaactagtcgatggacaacttaccggggaccggagaccaatcccaggcctggtagctgttctgtagggccatcaagcgacaaggctctgaccttcatgaaggatcactttctaatggacgaacaagtcgtcggaacaccactgctggttaaatctggagtggagtatactaggctcgccgttgagacagctcaggggctagacggtcacagtcacctggttatgtatctgggaactactaccggatccctgcacaaggccgttgtgtccggcgactcatccgcacaccttgtggaggaaattcagcttttccctgatcctgagcccgtgaggaatttgcagctggccccaactcaaggagccgttttcgtaggattcagtggtggcgtgtggcgagtgccccgagctaattgtagtgtgtatgagtcttgtgtggattgtgtcttagcccgtgacccacactgcgcatgggaccccgagtcacgaacctgttgtctgcttagtgcccctaacctgaacagttggaaacaggatatggaaaggggaaaccccgagtgggcctgcgcttctgggccaatgagtaggtctctccgtccacagtcaagaccacagattatcaaagaagttttggccgtgccaaattccatcctagagctgccctgcccacacctgtccgctttggcgagctactattggtctcacggccctgccgcagtgcctgaagcatctagtacagtgtacaatggatccctccttctgattgtccaagacggagtcgggggactctatcagtgttgggccactgagaatggcttcagctatcctgttatctcttattgggttgattcccaggatcaaacgctggccctggatccggagctggctggcatcccgcgagaacacgtgaaagtgcctctaacacgagttagtggaggggctgccctcgctgcccaacagtcttactggccccactttgtcacagtcactgtgttgttcgctctggtgttaagcggcgcactcatcattctcgtagcctcaccgctgcgggcactccgagcccgaggaaaggtgcaggggtgtgagaccctgagaccgggagagaaggctccactctctcgggagcaacacctccagtcccctaaagaatgtcgtacatcagccagcgacgtggatgccgataacaactgtctgggaaccgaggtcgcctag

SEQ ID NO: 239918 - DNA, 3225 bp, Artificial Sequence
  Description of Artificial Sequence: Synthetic coding sequence
atgaaagggacgtgcgtcattgcatggctcttcagtagtttggggctatggcgcctggcccaccccgaagcacaggggaccacccaatgccagaggaccgaacaccccgtaatcagctataaggaaatcggcccatggctgcgcgagtttagagctaagaacgccgtagatttctcccagctgacctttgatcccggacagaaggaactcgtcgtgggagcgcgaaactatttattccgcttacagttagaggacctctccctcattcaggccgtggaatgggagtgtgacgaggctacaaaaaaggcctgttactcgaaagggaagagtaaagaggaatgtcaaaactacatacgggtcctcctcgttggcggtgacaggctgttcacttgtggaacaaacgccttcactccagtgtgcactaaccgcagcttgagtaacctaaccgagatacatgatcagatatcgggcatggccaggtgcccgtactcgccacaacacaattctacagccctgttgaccgcgggaggcgagttgtatgccgctaccgctatggactttccgggtagggatcctgctatttaccggagcctcggcattctgcccccactgcggaccgcgcagtacaactctaagtggcttaatgagcctaatttcgtaagcagctacgacattggcaattttacctacttctttttcagggagaacgcagtcgagcacgactgtgggaaaaccgtgttctcacgcgctgccagagtttgcaagaacgatatcggcggacggttcctgcttgaagatacatggacaacatttatgaaagcacgcttaaattgttcccgccctggggaggtgccattttactacaacgagctgcagagcacattcttcctacccgagctcgatctgatatacggcatctttaccaccaacgtgaatagcattgccgcttcagctgtgtgcgtctttaatctctcagcaattgctcaggctttcagtgggccatttaaataccaggagaattctcgctccgcctggctgccctaccccaatccgaatcctcactttcagtgtgggacagtcgatcaaggactttacgttaatttgactgagaggaacttgcaagatgcccagaagttcattctcatgcatgaggtggtgcagcctgtgacaaccgttccctcttttatggaagacaactctaggttctcccatgtggccgttgatgtggtgcagggtagagaggccctagtccacattatttacctggccacagactacggaacaattaagaaggtaagggtgcccctaaaccagacatccagctcgtgtttgctggaggaaattgaactgtttcctgaaaggagaagagaacctatcagatcactgcaaattctccattcgcagtcggttctgtttgtgggcttgagagagcacgtggtgaagatccccttgaaacgatgccagttctatagaacgcggtctacttgcatcggggcacaggatccttattgtgggtgggatgtggtgatgaagaaatgtacctcactcgaggagtcgctgagtatgacacagtgggaacagagtattagtgcttgccccacacgaaatctgactgttgacggccacttcggagtgtggagcccctggactccctgtacccatactgatggatcagctgtgggaagttgcctgtgtagaaccaggagctgcgattcccccgctccccagtgcggtggatggcagtgcgaaggccctgggatggagattgccaactgcagccgcaatggtggctggactccatggacctcatggtctccatgtagcaccacctgcggcataggctttcaggtgcgccagaggagttgctccaatcccacccctaggcatgggggacgcgtctgcgttggacagaatagggaggagagatactgcaatgaacacttgctatgcccgcctcatatgttctggacaggctggggtccatgggagcggtgcaccgcacagtgcggtgggggaattcaagccagacgacggatatgcgagaacggtccagactgcgcagggtgcaatgtggaatatcagtcatgtaacaccaatccttgtccggaacttaagaagactacaccctggacaccgtggacccccgtgaatatttccgacaatggcggacactatgaacaacgattccggtacacttgtaaggctagactcgcagacccgaacctcctggaggtggggaggcagcgaatcgaaatgagatattgctcctccgatgggacatcggggtgtagcacagacggcctcagcggcgacttcctcagagcgggtagatactcggcccacaccgtgaacggggcttggagtgcttggacgagctggtcccagtgcagccgcgattgcagccggggaattcggaataggaaaagagtgtgtaacaacccagagccaaagtatggcggaatgccatgcttggggccaagcttggagtatcaggagtgcaatatactgccttgtccagttgacggcgtctggagttgctggtcaccctggaccaagtgtagcgcaacttgtggtggcggtcactacatgagaacaagatcctgtagcaaccctgctccagcctacggcggtgatatttgcctgggccttcacaccgaagaagccttgtgtaatactcaaccctgcccagagtcgtggtccgaatggagtgactggagcgagtgtgaggcatcaggagtccaggtgcgcgctagacagtgtatattactgtttcccatgggttctcagtgctcgggcaatactactgaaagtaggccctgcgtatttgattctaatttcatccccgaagtgtctgtcgcccgaagctcatctgttgaggaaaaacgttgtggcgaatttaatatgtttcacatgatcgccgtgggactgtcttcatcaattctaggatgcctgcttactcttttggtctacacttactgtcaacgttaccagcaacaaagtcatgacgccactgttatccaccccgtatcccccgctccattaaatacatccattaccaatcatatcaacaaactggataagtacgatagcgtagaggccattaaagcgtttaacaaaaacaacctcattttggaagagcgcaacaaatattttaatcctcacctgacgggcaaaacctacagcaatgcttatttcaccgacctgaataactatgacgagtactag

SEQ ID NO: 239919 - DNA, 765 bp, Artificial Sequence
  Description of Artificial Sequence: Synthetic coding sequence
atgaaggggacatgcgttattgcatggctgttttcgagcctcggtttgtggcgcctcgcccaccccgaagcccagggtaccactcagtgccagaggactgagcaccccgtcattagttacaaggagattggcccatggcttcgtgagttcagggctaaaaatgctgtggacttcagtcagctcactttcgatccaggtcaaaaagagttggttgtgggcgcaagaaactacttgttccgtctgcaactcgaagacttgtccctcatccaggccgtggaatgggagtgtgacgaggcgactaagaaggcgtgctatagcaaaggaaagagcaaggaagaatgccaaaactacatccgtgttctcttggtgggcggtgatcgactctttacctgtggaactaacgccttcacacccgtgtgcacaaacagatccttgagtaacctgactgagatccacgatcaaatcagcggcatggcgcgatgtccgtattcgccacagcacaacagcactgcattgcttactgccggtggcgaactctatgccgctactgccatggactttccaggcagggaccctgcaatttacaggtcacttggcatcctacctcccctgaggacggcacagtacaattcgaagtggcttaacgagcccaactttgtgtcatcctacgacataggtaacttcacctacttcttttttagggagaacgccgtggagcacgactgtggtaagactgtattctcccgtgccgctcgggtctgttag

SEQ ID NO: 239920 - DNA, 2001 bp, Artificial Sequence
  Description of Artificial Sequence: Synthetic coding sequence
atgacaccacctccgccaggcagggctgcacccagcgctccgagagcacgggtccccggtcctccagccagattaggcctcccgctccggctccgtctactgctactcctctgggccgctgctgcctccgcccagggtcacctgcgtagtgggccacggatcttcgcagtctggaagggccatgtggggcaggaccgagtcgatttcggccaaacggaacctcacacggttctgttccatgaacccggatcatccagcgtgtgggtgggcggaaggggaaaggtatacctcttcgacttcccggagggaaaaaacgcctctgtgcgcaccgtgaatattggaagcaccaaggggtcatgtctggataaaagagactgtgagaattacattacccttctagagagaaggagcgagggactccttgcttgtggtactaacgcgagacatccatcgtgctggaatctggtgaatggcaccgttgtccccctgggcgaaatgagaggctatgcccctttctctccagacgaaaattccctggtgctgttcgagggcgacgaagtatattctaccattagaaagcaagagtataatggtaaaatcccccgttttcgtcgcattcggggagaaagtgaactatatacatctgacacagtcatgcagaatcctcagtttattaaagctacaattgtgcaccaggaccaggcttacgacgacaagatttattatttctttcgcgaggataaccctgacaagaatcccgaagcccctctgaatgtgagcagggttgcacagctctgtcgcggtgatcagggaggcgaatcatccctctctgtctcgaagtggaatactttcttgaaggccatgcttgtctgttcagatgcagcgaccaacaagaactttaacagactgcaagacgtgtttctcttgcccgatccatctggacagtggagagacacccgcgtctatggagtgttctctaatccgtggaactactctgctgtttgtgtgtattctctgggggacattgacaaggtgttcaggacaagttcgttgaagggctaccactcgtcattacccaaccccaggcccggtaagtgcctgcccgatcagcaacctatcccaacagagaccttccaggtggcagatagacatcctgaggtcgcccagcgagtggagccgatgggtccactgaaaactccactatttcactctaagtaccactaccaaaaggtagctgtccacaggatgcaggcttctcacggcgagactttccatgtgttatatctgactactgaccgaggcaccatccataaggtcgtggaacccggagaacaggaacactcctttgccttcaatattatggagatccagcccttccggcgagccgctgcgatccaaactatgtccctcgacgcagagaggcggaaactgtacgtgagctcccagtgggaagtttctcaggtgccactcgacctttgcgaggtgtatggcggagggtgccatggatgcttaatgtccagagatccctattgcggatgggaccagggcagatgcatctctatctatagtagcgaacgatcagtactgcagagcataaatcctgccgaacctcacaaggagtgtcctaacccaaagccagacaaagctcctctgcagaaagtgtcactggccccaaattcccggtactacctgtcctgcccaatggagagtcgtcatgccacctatagttggcggcacaaagagaatgtggaacaaagctgcgagccaggtcaccaaagccctaattgtatactgtttatcgagaatctgacagcccaacagtacggccactacttttgcgaagctcaggagggatcttacttccgcgaggctcagcactggcagctgttaccagaagatggtattatggcagagcacttgttgggacatgcttgcgctctggccgcatctctctggctgggcgtcctgcccacccttacacttgggctcctggtccattag

SEQ ID NO: 239921 - DNA, 1506 bp, Artificial Sequence
  Description of Artificial Sequence: Synthetic coding sequence
atgaggggttatgctccattttctcccgacgaaaactcccttgtactgtttgagggggatgaggtctactccactatacggaaacaggagtacaacggcaagatacctcgctttagacgcattagaggggagagcgagctgtatacctcggataccgtgatgcagaatccgcagtttatcaaggccaccattgtacaccaggaccaagcatatgatgacaaaatttattatttcttcagagaggacaacccggacaagaaccctgaggcaccactgaatgttagtcgggtggcccagctatgcagaggcgaccagggaggagaatcttctctgagtgtcagtaaatggaacacgtttctaaaagctatgcttgtgtgcagtgatgccgctacaaacaaaaattttaaccggttgcaggatgttttcttactgcctgacccgtccggccaatggagggatacccgcgtctacggagtcttctctaacccttggaactacagtgcagtgtgtgtgtacagccttggggatatagataaggtcttccgcacgtcttctctgaaggggtatcattcttcactcccaaatccaagacctgggaaatgtctgcccgaccaacagccgatcccgacggagacatttcaggttgcagacaggcacccggaggtcgcccagcgcgtggagcctatggggcctctgaaaactcccttgtttcacagtaagtatcactaccagaaagtggccgttcaccgcatgcaggcaagccatggcgagactttccacgtcctttacctcaccacagaccggggaaccatccacaaggtggtggagccaggtgagcaggaacattctttcgctttcaacatcatggagattcagccttttagacgggctgcagctatccagaccatgagcctggacgccgagcggagaaaactgtacgtttcttctcagtgggaggtctcccaggtgccgctggacctgtgcgaagtttatggaggcggttgtcatggttgcctgatgtctcgtgacccttactgcggctgggaccagggtaggtgcatttcgatctactcctccgaacgctcggtgctacagagcatcaatccagcggaaccgcataaagaatgtcctaacccaaaacctgataaagcaccattgcaaaaggtgagcctggcacctaactcccggtattacttgagctgtcctatggagtcgagacacgcaacgtactcatggagacacaaggagaacgtggagcagagttgcgagccgggacaccagagccccaactgcattctgttcatcgagaacttgacagcccaacaatatggccattatttttgcgaggcccaggaaggaagctacttcagggaggcccagcactggcagctactgccagaagatggaatcatggctgaacacttactgggacacgcctgcgccttggcagctagcctctggctaggagtccttcctaccctgactctgggactactggttcactag

SEQ ID NO: 239922 - DNA, 1959 bp, Artificial Sequence
  Description of Artificial Sequence: Synthetic coding sequence
atgaccccccctccacccggtagagccgcaccaagcgcacctcgtgcaagggtccccggaccacctgcgagattaggcctgcctttacgcctccggctgctgctgctgctgtgggctgccgctgcaagtgctcaggggcatctcagatcagggcctcggatattcgccgtatggaaaggacacgtgggacaggacagagtcgactttggtcagaccgagcctcataccgtgctgttccacgaaccgggatcgagctctgtctgggttgggggacggggaaaggtatacctcttcgacttccctgaggggaagaacgcctccgtgcgcacggattgcgaaaactacataacattgctcgagaggcggagcgagggcctgctagcttgtggaactaatgccaggcatcctagctgttggaatctggtcaatggaactgtggtccctctgggtgagatgcggggttatgctcctttttcacccgacgagaacagtctggtcctgtttgagggggatgaagtctatagcaccatccggaagcaagagtataacggcaagatacccaggttccggcgtatccggggagaaagcgagctgtataccagtgatacagttatgcaaaacccacaattcatcaaggctactatcgtgcaccaagaccaagcttatgatgacaagatctactatttctttagagaggataatcccgacaagaatccggaggcacctctgaatgtgtcgcgcgtggcacagctctgtcgcggagatcaggggggagagagctctttgagtgtttctaaatggaatacttttctgaaagctatgttggtgtgcagtgatgccgctacgaacaaaaacttcaataggctccaggacgtgttcttattgcccgatcccagtgggcaatggagagacaccagggtgtatggtgtgttctctaacccttggaactacagcgctgtctgtgtctattctttgggtgacattgacaaggtattccgaaccagttcccttaagggttaccattccagcctgcccaacccacggccaggtaagtgcttgcctgaccagcaacctatccccacggaaacattccaggttgccgatcgtcacccagaagtcgctcaacgagtcgaacctatgggtcccctgaaaaccccattgtttcacagcaagtatcactatcagaaagtggctgttcacagaatgcaagccagccacggggaaaccttccacgtcctctatctgacgaccgaccggggaacaatccataaagttgtggaacccggtgagcaggagcacagcttcgcatttaacattatggagatccaaccctttcgaagggcggcagccatccaaacaatgtccctcgacgcggaaagaagaaaactatacgtgtctagccagtgggaggtgtctcaagtgcccctggatctatgtgaggtatatggaggaggatgccatggctgtttaatgagcagggacccctactgtggatgggatcagggacgctgcatttccatttatagctccgagaggtcagtgctccagtcaattaatcctgcagagcctcacaaggagtgtccaaaccccaagccagataaagcaccgctccagaaagtctctttggcccctaactctcgctactatcttagttgcccgatggagtcgcggcatgccacttacagctggcggcataaagaaaatgttgagcagtcctgtgaaccgggtcaccagagtcctaactgtatcctcttcattgaaaacctcactgctcagcaatacggccattatttctgtgaggcccaggagggctcctacttcagggaggcacaacattggcagctgctgcctgaggatggtataatggctgagcacctcctggggcatgcctgtgctttagccgcatcgttgtggcttggcgttctcccaaccttgacactgggcctcctggtgcattag

SEQ ID NO: 239923 - DNA, 1209 bp, Artificial Sequence
  Description of Artificial Sequence: Synthetic coding sequence
atgaagcccaacataatattcgtcctgagtctcctgctgatactggagaagcaagccgcagttatgggtcagaagggtggcagcaaggggagacttcccagcgaattttctcagttcccccatggacagaaagggcagcactacagcggccaaaaagggaagcagcaaactgagagcaagggctcatttagcatacagtacacataccacgttgacgctaatgatcatgaccagtcccgcaagtcacaacagtatgacctgaatgctttgcataagacaactaaatcacagagacatctaggcggttcacaacaactcctacataataagcaggagggcagagaccatgacaagagcaaagggcactttcatagagtcgtgatccaccataaaggaggaaaggcacataggggtactcagaacccttcacaagaccaggggaatagccctagcggcaaaggcattagcagtcagtacagcaataccgaggaaaggctgtgggtgcatgggctttccaaggagcagacatcagtatcaggggcacaaaagggcagaaaacaaggcggatcccagagcagttatgtcctgcaaacagaggaattggtcgcaaataaacagcaacgggaaacgaagaatagtcaccagaataaaggacactaccaaaacgtggtagaggtgcgagaggaacattcttccaaagttcagacatctctctgtcccgctcatcaggataagttacaacacggtagcaaggatattttctctacccaggatgagctcctggtttacaacaaaaatcagcatcagaccaaaaacctgaaccaggaccagcagcacgggagaaaggctaacaagattagttaccagagcagtagcaccgaagagcgaaggctccactatggagaaaacggtgtgcagaaggacgtatctcagaggagtatctacagtcaaactgaaaaactagtggctggaaaaagccagattcaagctccaaaccccaagcaggagccctggcatggggaaaacgcaaaaggcgaaagcggccagagcactaatcgagagcaagatcttctatctcatgagcagaaaggtcggcaccagcacggctcacatggcggtttggacatcgtgatcattgaacaggaagatgactctgatcgacacctcgcgcaacacttaaacaatgaccggaatccgcttttcacttag

SEQ ID NO: 239924 - DNA, 1389 bp, Artificial Sequence
  Description of Artificial Sequence: Synthetic coding sequence
atgaagcctaatatcatttttgtgctgagtctgctgctcatcttagaaaaacaggccgcagtgatgggacagaaaggaggctctaagggacggctgccgtctgaatttagccagttcccccatgggcagaagggccagcattacagtggacaaaaagggaagcagcagaccgagagcaagggatccttttcaatacagtacacttaccacgtggatgctaatgaccacgatcagagccggaaatctcagcagtacgatctgaacgcacttcacaaaacgaccaaatcgcaaagacacctcgggggttctcaacagctgttgcacaataaacaggaggggagagatcatgataagtccaagggacactttcaccgcgtcgtcattcaccacaagggcggaaaagcacataggggcacgcagaacccatctcaggatcaggggaatagcccttctgggaaaggcatttcttcacaatactcaaacactgaggagcggctgtgggtgcacgggctgtctaaggaacagaccagcgtgagtggggctcagaagggtagaaaacagggaggaagccagagtagctacgtgctccagacagaggagcttgttgctaacaagcagcagcgcgagactaaaaactctcaccagaacaaaggacattaccagaatgtggtggaagtccgggaggaacactccagtaaggtccagacttcactatgtcccgcacaccaggacaagctgcaacacggctcaaaagacatcttctccactcaggacgagttgctggtgtacaacaaaaatcaacaccagaccaagaatcttaatcaggaccaacagcatgggaggaaggccaacaaaatctcctatcaatccagcagcaccgaagagcgcaggctgcactacggtgagaacggagtacagaaagacgtaagccagagttcaatctacagtcagacagaggaaaaggcccagggcaaaagccaaaagcagataacaatccctagccaggagcaggagcattcacagaaggctaacaaaatatcctaccagtcctcctctacagaggagaggcgtctgcattatggagagaatggggtgcagaaggacgtgtcccagcgctcaatatactcccagactgagaagcttgtcgctggaaagagtcagatccaggccccaaacccaaaacaagaaccctggcatggtgagaacgccaagggcgagtctggacagagcaccaatcgggaacaggatctcttgtcacacgagcagaagggcagacaccagcacggctcccatggaggtcttgacattgtaatcattgaacaggaggacgactctgatcgccatctggctcagcatctgaataacgatcggaatcctctgttcacctag

SEQ ID NO: 239925 - DNA, 1749 bp, Artificial Sequence
  Description of Artificial Sequence: Synthetic coding sequence
atgaaatccatcatcctgttcgtgctcagtctgctgctcatcttggagaagcaggcagcagtgatgggacagaagggaggctccaagggacaactgccctccggcagctcccaatttccccatgggcagaaggggcaacattattttggtcagaaagatcagcagcacacgaagtccaagggatccttctccatccaacacacctaccatgtcgacatcaacgatcacgactggaccaggaaaagtcagcagtacgaccttaatgctttacataaggcaactaagagcaaacaacatttgggtggatcacaacaattactcaattataagcaggaggggagagaccatgacaaaagcaaaggccactttcatatgattgtgatacatcataagggagggcaggcccatcatgggactcaaaatcctagtcaagaccagggtaatagccccagtggcaaagggctgtcttctcaatgttcaaacaccgaaaagaggctgtgggtgcacggcctatctaaggagcaggcctcagccagtggggctcagaagggaagaacccaaggtggctcccagtcatcatatgttttacagaccgaagaactcgttgtcaataaacagcagcgagaaacgaagaatagccatcagaacaaggggcactatcagaacgtcgtggacgtacgagaggaacatagctccaagctgcagaccagtctgcatcccgctcatcaggataggctccagcatggccctaaggacatttttactacccaggatgagttgcttgtttataataagaatcaacatcagactaaaaatctcagccaagaccaggaacacggaaggaaggcacacaagatttcttacccatcgtcgcggactgaagaacgtcagctgcatcacggggagaagtccgtacagaaggacgtgtccaagggtagcattagtatccagaccgaggaaaaaatacacggcaaatcccagaatcaagtaaccatccactcccaggatcaggaacacggtcacaaagagaacaaaatctcttatcagtcttccagtaccgaggagaggcacttaaactgtggtgagaaaggtatccagaaaggcgtgagcaaggggagcatctccatacagaccgaggaacagatccacggaaaatctcaaaatcaggttcgcattccatcacaagcacaggaatacggtcacaaagagaacaagataagctatcagtcatcctcaaccgaagaacgcaggctgaacagtggagagaaagacgtgcaaaagggggtcagcaagggtagcatttccattcagacagaagaaaaaatacacggaaagagtcagaaccaggttactattccatcccaggaccaagaacacggacataaggagaataaaatgtcttaccagagcagttcaaccgaggaacgcaggctgaactacggtggaaaaagcacccaaaaggacgtgtcccagtcatccatttcatttcagattgaaaagttggttgaaggcaaatcccagatccagactcccaacccaaatcaggatcagtggtcaggacagaacgctaagggcaagagcggacagagcgccgactcgaagcaagatctgctgagccatgagcaaaagggcagatacaagcaggagtcatctgaaagtcacaacatcgtgatcaccgaacacgaagtcgctcaggacgatcatctgacacagcagtacaatgaggataggaatcccatctcaacctag

SEQ ID NO: 239926 - DNA, 447 bp, Artificial Sequence
  Description of Artificial Sequence: Synthetic coding sequence
atggccgagtcggattgggacacagtgaccgtcttgcgaaagaagggacccacagctgctcaggcaaagtcgaaacaggctatcctagccgctcagcgcagaggcgaagacgtggagacctcgaaaaagtgggccgctggtcagaataaacagcacagtatcacgaaaaacacagcaaagctggaccgagagactgaggagctgcatcacgaccgggttaccttagaagtcgggaaagtcattcagcagggccgacagtcgaagggtcttactcaaaaagacctggccaccaaaatcaacgaaaaacctcaagtcattgcagactatgagtctggtagggcaatccctaataatcaggtgctaggcaaaatcgaacgagcaatcggactgaaactacgcggaaaggatattggaaagccaatcgaaaaggggcctagggcaaagtag

SEQ ID NO: 239927 - DNA, 8120 bp, Artificial Sequence
  Description of Artificial Sequence: Synthetic coding sequence
atgagtacctgctgctggtgtacacccggaggagctagcacaattgatttcctaaaacggtacgcgtcaaacactccttcaggtgagttccagaccgccgatgaagatttatgttactgtctggaatgcgtggccgaatatcacaaggcaagggacgaactgcccttcctacatgaagtactctgggagttagagactctgcgcctcattaatcactttgagaagtccatgaaagcagaaatcggtgacgacgacgagctatatattgtggacaacaacggggaaatgccactgtttgacattacaggtcaagacttcgagaataagctgagagtccccctgcttgaaatcctgaagtatccttaccttctcttacacgagagagttaatgaattgtgcgtagaggctctatgtcgaatggagcaagcgaactgctcttttcaggttttcgacaagcatcctgggatatacctgtttcttgtccacccaaacgagatggtgaggcggtgggccatcctcacagccaggaatctgggcaaggtggaccgcgatgattactatgatctgcaggaggtgctactatgcctctttaaggtgatagagctggggctgctggagagtccggacatttacacatccagtgtgcttgagaagggcaaattaatacttctgccatcccatatgtacgatactacaaactacaaatcctattggctcgggatttgtatgcttctgacaattctggaggagcaggctatggacagtttgctgctggggtccgacaaacagaacgactttatgcagagcattctgcatacgatggaacgggaggccgatgacgactcagtagacccgttctggcccgctctgcactgttttatggttatcctggaccgactaggctcaaaagtgtggggccagctgatggacccaattgtggccttccagacgatcatcaataatgcctcctataaccgggagatcagacatatccggaatagctcagtgagaacaaaactcgagcccgaatcatacttagacgatatggtgacctgctcacaaatcgtgtacaactacaacccagagaaaaccaaaaaagactctggctggaggacagccatctgtcccgattattgtcccaacatgtacgaggaaatggagacacttgctagtgtgttacagagcgacattggacaggacatgcgcgtccacaatagcacattcctgtggtttattccgttcgtccagtcccttatggacctcaaggacctgggagtggcttacattgcccaggtggtgaaccacctctacagtgaggtgaaggaggtgctgaatcagactgacgccgtttgcgacaaagtgacagaatttttcctcctgattctggtcagcgttatagagctccacaggaataagaagtgcctccacctgctttgggtctcctctcaacagtgggtggaggccgtcgtcaagtgcgccaagctccccacgactgcgttcacgagatcctcggaaaaaagctcagggaactgcagtaagggcaccgccatgatttcatcactctctctgcattctatgcctagtaactccgtgcagttggcatacgtgcagctgatcagaagtctcctgaaggagggttaccagcttggtcaacaatcactctgcaagagattctgggataagttaaacctcttcctacgcggtaacctgtcactgggctggcagcttacctcgcaggaaacacatgagttgcagtcctgcctgaaacaaataattcggaacattaagttcaaagccccaccctgcaatacctttgtggatctgacatccgcatgcaaaatcagtccggcaagttacaataaggaggagagcgaacaaatgggaaagacttccagaaaagacatgcactgcttggaggccagctcgccaacctttagtaaggagccaatgaaggtccaggattcagtgctgattaaagccgataacacaatcgaaggcgacaacaacgagcagaattacattaaggatgttaagttggaagaccaccttctggcaggcagttgcctgaagcagtcttctaaaaacatttttacggagcgcgctgaggaccaaattaagatctccactcgtaaacagaagtcagtgaaggaaattagtagctatacccctaaggactgtacctcccggaatggtccggagcgaggttgcgacaggggaataatagttagcacacgtctccttacggattcgtctacagacgctctggagaaagtatcgacttctaatgaagatttttccttaaaagacgacgcactggcaaaaacctctaaacgtaagaccaaagtgcagaaagacgagatctgcgccaaactttcccacgtcatcaagaaacagcatcgcaaaagtactcttgtcgacaacactataaatctggacgaaaacctaacagtgagcaacattgagtcattctacagccggaaggacacaggcgttcagaagggcgatgggttcattcacaatctgagtctggacccatccggtgtgcttgacgataagaatggtgagcaaaaatcccagaataatgtcctccctaaggagaagcagttaaaaaacgaggaacttgtaatcttctctttccacgagaacaattgtaaaattcaggagttccacgtggacggcaaggaactgataccctttacagagatgaccaatgcttctgagaaaaaatccagccctttcaaagacctcatgaccgttcctgagtctcgggatgaggaaatgagtaactctacctcagtgatttattctaacctgactcgggagcaggcgcctgacattagtcccaaatccgatacactaaccgacagccagattgatcgcgacttgcataagttgtccctactggcccaggcttcggtcataacttttccctccgatagtccccaaaactcaagtcagctccagcggaaggtcaaagaggataaaagatgtttcacggcaaaccagaacaacgttggtgacacctctcgcggacaggtgatcattattagtgatagtgatgatgatgatgacgaaaggatactctcacttgagaaactgacaaagcaggacaaaatctgcttagaacgagaacaccccgaacaacacgtgtcaaccgtcaacagcaaagaagagaaaaacccggtcaaggaggaaaagaccgaaaccttatttcagttcgaggaaagtgattcccagtgcttcgagttcgaaagctcttcagaggtattctcggtgtggcaggaccacccggatgataataacagtgtccaggacggtgagaagaagtgtttggctccgatcgcaaataccacaaacggtcagggatgtacagactacgtgtcggaagtcgtaaaaaagggggctgagggtattgaagagcatacacgtccgagatccatctcagtcgaggaattctgcgagattgaggtgaagaagccgaaaaggaagcggtcagagaagcccatggccgaggatcccgttaggccaagtagcagcgttagaaatgaggggcagagtgacacaaataagagggacttagttggaaacgatttcaagagcattgacaggcgaacatcaactccgaatagcagaatacagcgggctacaacagtgtcccagaaaaagtccagtaagctgtgtacatgtaccgagccaatcaggaaggtcccggtgagtaagacaccaaagaaaacccactcagacgctaagaagggccagaatcgcagcagcaattatttgagctgtcgtaccaccccggctatcgttcctcctaagaaattcaggcagtgtccagagcccaccagcactgctgagaaactgggcctgaagaaaggaccaagaaaggcctacgaactgtcccaacgcagcctggactacgtggctcagctgagggatcacgggaagaccgtcggggtagtcgacactcggaaaaaaacaaagctgatctcaccccagaacctgtcagtaaggaacaacaaaaaacttcttactagccaggagttgcaaatgcaaagacagattaggcccaaatcccagaagaatcgcaggagactgagtgactgcgaaagcaccgacgtaaaaagagccggatcacacacagcccagaactccgacatctttgttcccgagtccgatcgctctgactataattgtacagggggaaccgaggtgctcgccaacagtaaccgtaaacagctcattaagtgcatgccatcggagccggaaacaatcaaagcaaaacatggctcccctgccactgacgacgcatgtccattgaatcaatgcgactcagtggttcttaacgggacagtgccaaccaatgaagtaattgtttcaacctccgaggacccactgggcggaggtgaccccaccgcgagacacattgagatggccgctctgaaagagggcgaacctgacagtagcagcgacgctgaagaggacaacctgttcctgacgcaaaatgaccccgaggacatggatctttgtagtcagatggagaacgataactacaagctgatcgagctgatccacggtaaagacactgtggaggtggaggaggattcagtgtcccgtccgcagctggagagtctgagtggtactaaatgtaagtataaagactgcttagaaaccactaaaaatcagggggaatactgtccaaagcacagtgaagtgaaggcagcagacgaagatgtctttaggaagcccggactgccccctcctgctagcaagccattgagacccactaccaaaatattttcatccaagagcacgagcagaattgcagggctgagcaaaagccttgaaacgtcaagcgctctgtccccctcactcaagaataagagtaaaggtattcagtcaatcctgaaggtgccacagccagtgccacttattgctcagaagcccgtgggcgaaatgaaaaattcgtgtaacgtcctgcatccacagtccccaaataacagcaacaggcaaggctgtaaggtcccatttggcgaatcaaaatacttcccaagttcctcccctgtgaacattttgctgtccagtcagtccgtcagtgacacattcgtgaaagaagtgctcaaatggaaatacgagatgtttttaaactttggccagtgcggacctcccgcaagcttatgccagtctatttcccggcctgttcccgtgcgattccataactatggtgattacttcaacgtgtttttcccgttgatggtgctgaataccttcgaaaccgttgcccaagagtggctcaatagccccaaccgagaaaacttctaccaactccaggtgaggaaatttcccgcagactatatcaaatattgggagttcgcagtgtacctggaagaatgtgagctagccaagcaactgtatcccaaagagaatgacctggtgttcttggctcctgagcggattaatgaagaaaagaaagacaccgagcgaaacgatatccaggacttacacgagtaccattccggttatgtgcataagttccggaggacaagtgtcatgcggaacggaaagaccgaatgttacctaagtatccagactcaagaaaacttcccagccaatctcaatgagctagtcaactgcatcgtgatctcatctttggttacaacacagcgcaaactcaaagctatgtctcttctcggttcccggaatcagctggcgagagcagtactgaatccaaatccaatggacttctgtaccaaggaccttttaacgacaactagcgaacgcattatcgcgtacttgagagacttcaatgaagaccagaagaaggctattgagacagcgtacgccatggtaaagcatagcccctctgtcgcaaaaatctgcctcatccacgggccacccggtacgggaaaaagtaagactatcgtgggcctactgtatcgtttgttgacagaaaaccaacggaaaggccattctgacgagaactcaaatgctaagatcaagcagaatcgcgtcctagtgtgtgcaccctcgaatgccgcagtcgacgaattgatgaagaagatcatcctggaatttaaagaaaagtgtaaagataagaaaaatcccttggggaactgcggtgatataaatctagtgaggctagggccagagaagagtatcaactctgaggtcttgaagttcagtctcgactctcaggttaaccaccggatgaagaaggaacttccgtcccacgtgcaggcgatgcacaagaggaaggagtttttggattatcagctggatgaacttagtcggcagagagccctgtgtagagggggtagggagatccaacgccaggaactcgacgaaaacatcagcaaagtctcaaaagagaggcaggagctggcgagcaagattaaagaggtccaagggagaccccagaagacccagtcaattatcattctggagtcccatattatatgctgtacactctcaacatctggcggtctcctgctggagtccgcctttcgtggccaggggggagttccatttagctgcgtaattgttgatgaggctggtcagtcctgtgagatagagacccttacccctctaatccacaggtgcaataagcttatcctggtgggtgaccccaaacagttgccaccaaccgtgatctccatgaaagcacaggagtatggctacgatcaaagtatgatggcgaggttttgcaggctgctcgaggaaaacgtggagcataacatgattagccgcctgcccatcctgcagctgactgtacagtataggatgcatcccgacatttgcctttttccttccaattatgtgtacaatcgaaatcttaagacaaatagacagacggaggctattcggtgttccagtgactggcctttccagccctatttggtcttcgatgttggggatggcagcgagaggcgtgataacgacagctatattaacgttcaggagattaaactagtgatggaaattatcaaactaattaaggacaagcgcaaagacgttagcttccggaatatcggcatcattactcattacaaggcccagaagaccatgatccagaaagatctggataaagaattcgaccgcaagggcccagccgaagtggacacagtcgatgcctttcaaggtaggcaaaaggactgcgtgattgtcacttgcgtaagagccaattctatacagggcagcatcggcttcctggcttccctgcaaagactgaatgtgactattacacgggctaaatattccttgtttattctaggacacctcaggacacttatgcagctcctcccacgcagcttctgcgtgcatgtgaaccactctccctttttttcccccgagcctaagtacttgcactgggcattgaaggaaaaccagcactggaaccagctgatacaggatgcccagaagaggggagcaataatcaagacttgtgacaaaaactatcgacacgatgcggttaaaatcctcaaacttaaacccgttctgcaaaggagcctgactcacccccctacgatcgccccagaaggcagtagaccccagggaggtctcccctcgtctaagttggacagcggattcgcaaagacttccgtcgcggcatccctctaccataccccgtctgactccaaggaaattactttaaccgtaacaagtaaggacccagagcgaccgccagtccatgatcagcttcaggatccaaggctcttgaaaaggatgggaatcgaggtgaaagggggaatctttctctgggacccacagccttcttccccccagcacccgggtgccacccctcctacaggtgaacctgggttccctgtcgtgcaccaagacctgtcccacatccagcagccagccgctgtggtggccgcactctcatctcacaaacctcctgtacgaggcgaaccgccagccgcaagtcctgaggccagcacatgtcagtctaaatgtgacgaccccgaagaggagctgtgccatagaagagaagccagagctttcagcgagggtgagcaagaaaaatgtgggtcggagacacaccacacccggaggaactctagatgggacaaaaggaccctggaacaagaggactctagctctaagaaaaggaagctgttata

SEQ ID NO: 239928 - DNA, 7934 bp, Artificial Sequence
  Description of Artificial Sequence: Synthetic coding sequence
atgtcaacatgctgctggtgcacccctgggggtgcgagtaccatagactttctgaagcgatacgcatctaataccccctccggtgagttccaaaccgccgacgaagatctttgctattgcctggaatgcgtagccgaatatcacaaggcacgggacgagctaccattcctgcatgaagtgctatgggaattagagacattaagactgatcaaccacttcgaaaagagtatgaaggccgagataggagacgacgatgaattgtacattgtcgataataatggcgaaatgcccttgtttgacatcacaggacaggacttcgagaataagttgagagtccccctgttagagatcttaaagtacccctatcttctgctacacgagcgggtcaatgaactctgcgtggaggctctgtgtcgtatggagcaggccaattgttctttccaggtgttcgataaacacccgggtatctacctgttcctggtgcatccaaatgagatggtaaggaggtgggccatccttacagctaggaatttaggaaaggtggatcgtgacgactactatgatttgcaagaggtgttgctgtgtctttttaaggtgatcgaactgggcttactcgagtcccctgatatctatacgagctcagtgttagagaaagggaaattaatcctgctgccttctcatatgtatgacaccaccaattacaaatcttattggctgggcatttgtatgctgctgactattctcgaagaacaggcgatggactcccttctcctgggtagtgataagcagaatgactttatgcaatccattctgcatactatggagcgagaggctgacgatgattcagtggatcctttttggcctgccctgcattgtttcatggtcattctggaccgcctcggttccaaagtgtggggccagcttatggatcctatcgtggcctttcagacgatcataaacaatgccagttacaaccgggagatcagacacatcaggaacagcagtgtccggaccaagctggaacctgaatcctacttggacgatatggtcacttgttcacagattgtctacaactataatcctgaaaagacaaagaaagactccgggtggcggactgccatctgccctgactactgccccaatatgtacgaagagatggaaacactggcttctgtactgcagtctgatattggtcaggacatgagagtccacaactctacttttctgtggtttatacccttcgtgcagtctctgatggatctgaaggacctcggagtggcatatatcgcccaggtggtgaatcatctgtattctgaagtgaaggaggtgttaaaccagaccgacgccgtatgtgataaagttaccgagttttttctattaattcttgtgtccgtgatcgagttgcacagaaataagaagtgcctgcatctgctctgggtctcttcacagcaatgggtcgaagccgtcgtcaagtgcgctaaactgcccacaaccgccttcacccgtagctccgaaaagagttccgggaactgttccaagggcaccgctatgatcagttcactcagccttcacagtatgcccagtaactcggttcagttggcttatgttcagctgatcaggtcgcttctgaaggaggggtaccagctcgggcagcaatctttatgtaagagattctgggacaaattaaacctattcttgaggggcaacctatcacttggctggcaactgactagccaggagacccacgagctgcagtcctgcctcaaacaaattataaggaacatcaaattcaaagctcccccttgcaatacgtttgttgatttgacctccgcctgcaagatttcacctgcctcttataataaggaggaaagcgaacagatgggtaaaacttcacgcaaagatatgcattgtctggaagcctcttcgcctacctttagcaaagagccaatgaaggtgcaggatagcgtgctaattaaggctgacaacaccattgaaggcgacaacaatgaacaaaattacatcaaagacgttaagctggaggatcatttactggcaggcagctgcctaaaacagagctctaaaaacatcttcactgaacgcgcagaagaccagataaaaatctctactagaaagcagaagtcagtcaaggaaatctcaagctacaccccaaaggactgtaccagccgaaatggtcccgagcgcggatgcgaccgcggaattatcgtctctacacgtctgctgaccgattcttccaccgacgccttggagaaagtttccacatccaacgaagacttcagcctgaaggatgacgctctggccaaaactagcaagagaaaaactaaggtgcagaaagatgagatttgtgcaaagctatcccatgtgatcaaaaaacagcatcgcaagagcacgctggtggacaataccattaatctggatgaaaacctcaccgtctccaacattgaatctttttactctaggaaggatactggtgtccagaagggggatggttttattcacaatctgtctctagatccctccggagtccttgatgacaaaaatggcgaacagaagagccaaaataatgtactgcctaaagaaaagcaattgaaaaatgaagaattggtgattttcagctttcatgagaataattgtaagatccaggagtttcacgtggacggaaaggagctgataccgttcaccgagatgaccaacgcctcggagaagaaatcctcaccattcaaagatttaatgactgtacccgaatcacgtgacgaagaaatgtcaaacagcaccagtgtcatatacagcaatttgaccagagagcaggccccagacatttcccctaaatctgatacgctaactgattctcagatcgatcgggacttacataaactttctctccttgcacaagcaagcgtgatcacttttcccagcgacagcccccagaattcctcccagctgcagcgcaaagtcaaagaggataagaggtgttttacagccaaccagaacaatgtgggggacacgtcccgtggacaggtcataatcataagcgactcggacgacgatgatgacgaacgcatattgagtctggaaaaactgaccaagcaggacaagatctgtctcgaacgggaacaccccgaacagcatgtttctaccgtcaattccaaggaggagaaaaaccctgtgaaggaggaaaaaaccgaaacgctattccagttcgaggagtccgattctcaatgctttgaatttgaatctagtagcgaggttttctccgtgtggcaggaccatccagacgacaataatagtgttcaggatggtgagaaaaagtgcctagccccaattgcgaacacaacaaacggacagggatgtactgattacgtatccgaagttgtgaagaaaggtgccgagggtatcgaggaacatacaaggccaaggtccatcagcgtggaggagttctgcgagatcgaagttaagaagcccaagcgaaagcggtcagaaaaacctatggccgaagatccagtgcgaccgagcagcagtgtgcggaacgagggacagtcagacaccaataagcgcgatttggtaggaaacgattttaaaagcatagataggaggacatctactcctaatagtaggatccaacgagccaccactgtctctcagaaaaaaagctctaaactatgcacatgcaccgagcctattagaaaggtgcccgtgtctaaaacccctaagaaaacacatagcgatgctaaaaaagggcagaacaggagcagcaattacctttcatgtaggactacaccagcgattgtgcctcccaagaagttcagacagtgtcctgagcccaccagcactgctgagaaacttggtctcaagaaggggccacgcaaagcctacgagctcagccagcgctctttggattacgtagcgcagctgagagatcacggaaagaccgtcggcgttgttgatactcgaaaaaaaactaaactgataagcccacagaatttatcagtgcggaataataaaaaattattaacatcacaggagttgcagatgcagcggcagatacgaccgaaatctcagaagaaccgcagaagactgtccgattgtgaaagtaccgacgttaaaagagccggttcacacaccgcccagaattctgacatatttgtgccagagtccgacaggtcagattataattgtacggggggaacagaggtgctggctaattctaatcgcaagcaactcatcaagtgtatgcccagcgagcccgaaactatcaaggctaagcatgggtcccctgcgacagatgacgcctgtccactgaatcagtgtgatagtgttgtcctcaatgggaccgtgccaacaaatgaagttatcgtatctaccagtgaagatccattagggggaggggacccaaccgccaggcatatagaaatggctgctctgaaagaaggcgaacccgatagctcgagtgacgctgaggaagacaacctttttctgacgcaaaacgatcctgaggacatggacctgtgctctcagatggagaacgataattataaactcatcgagctgattcacggcaaggatacagtggaggtggaggaggacagtgtatcacgaccacagctggagtcgctttccggcaccaagtgcaagtacaaagattgtttggagacgacaaagaaccagggagagtactgccccaagcacagtgaggttaaggccgctgacgaagatgtgttccgaaaaccaggccttcccccaccggctagcaaacctctgaggccaacaactaagatcttttcctctaaaagtaccagccgcattgcaggactgtcaaagagtctggaaaccagctcagccctcagccccagtttaaaaaacaaatccaagggtattcaaagtatcctcaaagtgcctcaaccagtgccacttatcgcacagaagcccgtgggcgaaatgaagaattcttgtaacgttttgcacccccagagccctaacaattcaaaccgacaggggtgtaaagttccattcggtgagtccaagtatttcccctcctctagccctgtgaacatcttgctctcaagccagagcgtgtccgacaccttcgtcaaagaggtgctgaaatggaagtacgaaatgtttctaaattttggccaatgtgggccaccagcaagcttgtgtcagtcaatcagtcgacccgtgcccgtgaggttccataactacggcgattactttaatgtgttcttcccactgatggtgcttaatacctttgagaccgtggcccaggaatggttaaatagcccgaatagggaaaatttctaccagctgcaagtgcgcaaattcccagccgactatataaaatattgggaattcgcagtttacctcgaggaatgcgaacttgctaagcaactgtatcctaaagaaaacgatctggtgttcctagcacctgaacgtatcaatgaggaaaaaaaggacactgagagaaacgacattcaggaccttcacgagtatcatagcggatacgttcataaattcagaaggacttctgtgatgcgtaacggcaaaacagagtgttatcttagtatccaaacccaggagaatttccccgcaaatctcaacgagctggtgaactgtatcgttatttcttctcttgtcacaacccagcgcaaactcaaggcaatgtctctactcggcagtcggaaccagcttgccagagctgtgctcaatccaaatcccatggatttctgtactaaggatctgctgaccacaacgtcggagcgcataattgcgtatctgagggatttcaatgaggaccagaaaaaggccatcgaaacggcctatgcgatggtgaaacattcaccctccgtggccaagatctgcctgatacacggacctccgggaacagggaagtccaagactatcgtggggctattatataggctgttgaccgagaatcagagaaagggccactccgatgagaactcgaatgccaagatcaaacagaaccgcgttctggtctgcgccccatcgaacgccgctgtggacgagcttatgaagaaaatcatcctcgagttcaaagagaagtgtaaggataaaaagaaccccctgggaaactgcggtgatataaacctggtccgtctgggaccggagaaaagtataaattcagaagtgttaaaattttcactggactctcaggtgaatcatcggatgaaaaaagagttgccatctcatgttcaggctatgcacaagaggaaagaattcctcgactatcagctggatgagctgagtagacagcgcgctctctgccgtgggggtagggagatccaacggcaggagttggatgaaaacatttctaaagtgagtaaagagcgccaggagctggcctccaagatcaaagaagtgcagggccgtcctcaaaagacacagagcatcataatcctcgagagccacatcatctgctgcaccctgagtacttcaggaggtttactcctggaaagcgctttccgtggccaggggggtgttcccttctcctgtgtcattgtggacgaggccggacagtcatgcgagatcgaaaccctgaccccattaatacacagatgtaataaactgatcttagtgggtgaccccaagcagttaccccctacagttatctcaatgaaggcccaagaatacgggtatgaccaatcaatgatggcgaggttctgcagactcctggaggagaacgtagagcacaatatgatctccaggcttcccattcttcagctgaccgtccagtatcgtatgcacccagacatatgtctgttccctagtaactatgtttacaacagaaatttaaagacaaaccgccagactgaagccatccggtgttcaagtgattggcccttccagccatacctggttttcgacgtcggtgacggatccgagagacgagataatgacagctatattaacgtccaggagatcaaacttgtcatggaaattattaagctgatcaaggataaaaggaaagacgtctcctttcggaatatcggcataatcactcactataaagcccagaaaaccatgatccagaaagatttggacaaagaattcgatcggaagggctttttagccagcctgcagcgtctgaacgtgacgattaccagagccaagtattctctcttcatcctggggcatctgcgaactctaatggagaaccaacactggaatcagttaatacaggatgcccagaaaagaggagccattatcaagacttgcgataagaattatcgtcacgatgcagtcaagatcctaaagctcaagcctgttctccaacgaagcctgacgcatcctccgaccatagctccggaagggtctaggccgcaaggaggtctgcccagttctaaactcgactcaggatttgcgaaaacaagcgtagctgcttctctgtaccatacccctagtgatagcaaggagataactctgactgtaactagcaaggacccagagagacctcccgttcatgaccaacttcaagatccgaggctgcttaaacgaatggggatagaagttaagggtggcatttttctgtgggacccccagccatcctcaccgcagcatccaggagccacaccccctaccggggagcctggctttcctgtggttcaccaggatctgtctcatatccagcagccagctgcagtggtggcagccctgtctagccacaaacccccagtacgtggggaacccccagcagcctcacctgaggcttctacttgtcagtcaaagtgtgatgatcccgaagaagagctctgtcatcgcagggaggccagggctttctctgagggcgaacaagaaaagtgcggttccgagactcaccatacccgtcgaaattcacgctgggacaagaggacactcgagcaggaagatagcagctctaaaaagcggaaactgttgta

SEQ ID NO: 239929 - DNA, 2847 bp, Artificial Sequence
  Description of Artificial Sequence: Synthetic coding sequence
gtagcacaggaatggctgaattcccctaatagagaaaacttttatcagttgcaggttagaaagttcccggcagattacatcaagtactgggaattcgcagtttacttggaagaatgtgagctcgcgaaacagctttatcccaaggaaaatgacctcgtcttcttagctcccgaacgcattaacgaggagaaaaaggataccgaacgcaatgacatacaggatctacacgaatatcacagcggatacgtccataagttcaggaggacgtcagtaatgagaaatggtaaaaccgagtgctatttatccattcagacccaggaaaattttcctgccaatcttaatgaacttgtcaactgtatcgtgatctctagcctcgtaactacccagcggaagcttaaggctatgtcactgctgggatctaggaatcaactcgcgagagccgtcctaaaccctaaccctatggatttttgcacaaaggatctgttgaccaccacatcagaacgcattattgcctatctgagagattttaatgaggatcagaagaaggccattgagaccgcctatgcaatggttaaacactcgccaagcgtcgccaagatttgcttgattcacggcccacctggcactgggaagagtaagacaatcgtcggcctactttacagactgctcactgagaatcaacgaaaaggccattcagatgaaaatagcaatgctaaaatcaagcaaaatagagttctggtctgcgctcctagcaatgcagcagtggatgaacttatgaaaaaaatcatattggagttcaaggaaaagtgtaaagataagaaaaatcccttggggaactgcggggatatcaatctcgttcggctgggtcccgaaaaatccattaacagcgaagtactcaaattctctctcgacagccaagtcaatcacaggatgaagaaagagctgcccagccatgtccaggccatgcataaaagaaaagagtttctggactaccagctggacgagctaagcagacaaagggcgttatgccggggagggagagaaatacagaggcaggaactggacgagaacatctcaaaggtctctaaggaacgccaggagctggcctctaaaattaaggaggttcaggggaggcctcaaaaaacacagtccataataatcctggaatcacacattatctgctgcaccctgtccaccagcggcggactcctacttgagtcagccttccggggacaggggggagttcccttctcctgcgtaattgtggacgaggctgggcagtcttgtgagatcgagaccctgacgcccctcatccacaggtgcaacaagctcattctcgttggggaccccaagcaattacccccaacagtgatctccatgaaggctcaagagtacgggtatgaccagagcatgatggcgagattttgtcgcctcctggaggagaatgtggagcataacatgatctctcgccttcccatattgcagcttactgtacaatatcgaatgcacccagacatatgtctgtttccttctaattatgtctacaaccgtaacttgaaaaccaatcgacagaccgaggccatccgctgttctagcgactggccttttcagccttatctggtgttcgacgtgggtgatgggtcagaacgacgtgacaacgactcttacatcaatgtccaggaaatcaagctcgtaatggagatcatcaaactcattaaggataagcgaaaagatgtgagtttcaggaatatcgggatcatcacgcattacaaagcgcagaaaactatgattcagaaagatctggataaagagttcgacaggaaaggaccagcagaggtggacacagtcgacgcctttcagggcaggcagaaagactgcgtcatcgtgacatgtgtgagagcgaacagcatacaaggcagtataggttttttggctagtttgcagaggttgaacgttaccatcacacgcgctaaatacagcctgttcattctgggtcatttgcggacactgatgcagctgctcccgcgaagtttttgtgtgcatgttaaccatagccctttcttctcaccagagccgaagtacctccactgggcactgaaagagaaccaacactggaaccagctgatccaggacgcccagaaaaggggggctatcataaagacatgcgataaaaactacaggcacgatgcagtaaagattttgaaattgaaaccagtcctgcagagatccctcacacacccccctactatcgctcctgaaggcagcaggccgcagggcggtctcccctcctcgaagctggattcaggttttgccaagacaagcgttgccgcatctctttatcatactccgtcagactccaaggagatcacgctaacagtgaccagcaaagatccggagcggcctccagtccacgatcagctccaggacccacgtctgctgaagcgcatgggcatagaggtcaagggtgggattttcctgtgggatccccaacctagctcacctcagcaccccggtgcaactcctcccacgggcgagccaggattcccagtggtgcaccaggacctgagtcacatccagcagccggctgccgttgtcgccgctctgtcttcccataagcctccagttcggggtgaaccaccagccgctagcccggaggcctcaacatgtcagagcaaatgtgacgatcctgaagaagagctctgccataggcgtgaggcgcgtgcatttagcgaaggcgaacaggagaagtgtggctctgagacacatcatacaaggagaaactctcgatgggataagaggacactggaacaggaggattcatcatccaagaaacgaaagctgctgtag

SEQ ID NO: 239930 - DNA, 1269 bp, Artificial Sequence
  Description of Artificial Sequence: Synthetic coding sequence
atgtcgacatcctatggttgtttctggaggcgcttcatccacgggatcggacgttccggagatatcagcgcagtacagcccaaggccgcagggtcatcgttgctcaacaagattaccaactctttggtgctcgacattatcaagttggccggagtacacacagtggcgaactgcttcgtggttccgatggcgaccggcatgtcgttaactctgtgtttcctgacattgcggcacaagaggcctaaggcgaaatacattatctggccccgaattgatcaaaagtcatgtttcaagagcatgataaccgccggattcgagcccgtcgtaatagagaacgtgctggagggagatgagctgcgtaccgatttaaaagctgtggaagctaaggtccaagagctcgggcctgactgcatcctttgtatccactctacaaccagctgcttcgctccccgtgtgcccgaccgtctagaagaactcgccgtgatttgtgccaattacgacatcccacatattgtaaacaacgcttacggggtgcaaagcagcaagtgtatgcacctaattcaacagggggctcgcgtcggcagaatcgacgctttcgtccagtcgctggataagaactttatggttcccgtgggtggggcaattattgccggattcaacgatagctttatccaggagatcagtaaaatgtacccgggaagggccagcgcctcccctagcctcgacgttctaataactttactgagcttgggttcaaacggctacaagaaactgctgaaggagcgcaaggagatgttttcttacctctcaaaccagataaaaaaattatctgaggcttacaatgagagattgctgcacacacctcacaatccaatctcactagccatgactttaaaaacacttgacgaacatcgagacaaagccgttacacagcttgggagcatgcttttcactcgtcaggtgtcgggcgcacgggtggtcccattgggatctatgcagacagtcagcggctataccttcaggggtttcatgagtcacacaaacaactatccctgcgcatacctgaatgccgcttccgctataggaatgaagatgcaggacgtagacttgttcataaagaggctcgaccgttgcctgaaagcagtacggaaagagagatccaaagaatctgatgacaactacgataaaacagaggacgtagacatcgaagagatggcccttaagctcgacaacgtgcttctggacacttatcaggacgcatcatcgtag

SEQ ID NO: 239931 - DNA, 1506 bp, Artificial Sequence
  Description of Artificial Sequence: Synthetic coding sequence
atgaaccgcgagtcatttgccgcaggcgaacgactggtaagccctgcctatgtgagacaggggtgcgaggctaggcgcagtcacgagcaccttattcggttgctccttgagaagggaaagtgccctgagaatgggtgggacgaaagtacgttggagctgtttctgcacgagctggccataatggacagcaacaattttctgggcaactgcggcgtgggcgaacgcgagggcagggtcgcttctgcactggttgcccgtcgacactaccgttttatacatggcatagggagatctggtgatattagtgccgttcagcccaaggccgcagggtcaagtttgttgaataagatcactaatagcctggtcctcgacatcatcaaactcgccggagttcataccgtggcaaactgcttcgtggtccctatggcaacaggaatgtctttaactctttgcttcttaaccctgagacacaagcgccctaaagccaaatatataatttggcccagaatcgaccagaagtcttgtttcaagagtatgattacagccggttttgagccagtggtcatagagaatgtcttggaaggtgatgagctcaggaccgatctgaaggccgtcgaggccaaagttcaagaacttggccctgattgtatactgtgcattcactctactactagctgcttcgcaccacgggttcccgatcgcctcgaggaactggcagtgatttgtgcaaactacgatattcctcacatcgtcaacaatgcctatggcgtgcaatccagcaagtgtatgcacttaattcagcagggagcccgagtaggcaggattgatgcttttgtccagtctctggataaaaattttatggtgcctgtgggcggagctatcatagccggattcaatgacagtttcatacaggagatcagcaagatgtatcctggcagagcttctgcctcccccagtctggacgtcctaatcacactgttgtccttaggcagcaacggttataagaagttgcttaaggagaggaaggagatgttctcctacctctcgaatcagattaagaaactctctgaggcctataacgagaggctactgcatacaccacataatccaattagtctggctatgacccttaaaactctggacgagcatcgcgacaaggctgtgactcaactcggcagcatgttattcacccgccaagtttccggggcacgggtcgtgcctctaggctctatgcagacagtgagcggttacaccttccgcggtttcatgtctcataccaacaattatccctgtgcgtacctgaatgctgcatctgctataggcatgaagatgcaggatgtggacctttttatcaagcgcctggatcgctgtctcaaagcggtgcgcaaggaacggagcaaagaatctgacgataattatgacaaaacagaggacgttgacattgaagagatggcacttaaattagataatgtactgcttgacacatatcaggatgcatccagttag

SEQ ID NO: 239932 - DNA, 903 bp, Artificial Sequence
  Description of Artificial Sequence: Synthetic coding sequence
atggagggcgtgttgtacaaatggaccaattatctgacgggctggcagcccagatggtttgttctggacaacggtatcctgtcatactatgactctcaggatgatgtttgcaagggcagcaaagggtctatcaagatggccgtatgtgagatcaaagttcactctgcagataacacgagaatggagctcattatacccggagagcagcacttttatatgaaagccgtgaatgccgcagaaaggcagcggtggctggtggccctgggatcctccaaagcttgcttaaccgacaccaggactaagaaggaaaaggagattagcgagacctcagaatcgctaaaaactaagatgtctgagctccgcctatactgcgacttgcttatgcagcaggtgcatacaatacaggaattcgtgcaccacgacgagaaccatagcagcccatctgctgagaacatgaatgaggcctcatcactgctcagcgcaacttgcaacacttttatcactaccctggaggagtgtgtcaagatcgcaaacgccaagttcaaaccagagatgtttcagctgcaccatccagatccactggtgagccctgtgtccccctctcctgtgcagatgatgaagcgatccgtctctcatcccggttcatgtagctcagaaagaagtagccactccatcaaggaaccggtttccaccttgcaccgcttgagccaaagacggagacgcacttacagcgacacagactcctgttccgatattccgcttgaggaccccgatcgacccgttcattgttccaaaaatactcttaatggcgatttggcgagcgccacaatcccagaggagtctcggctcatggcaaaaaagcagagtgaatccgaggacactctgcccagcttctcctcctag

SEQ ID NO: 239933 - DNA, 1104 bp, Artificial Sequence
  Description of Artificial Sequence: Synthetic coding sequence
atggacaaggaatatgtagggtttgctgcactgcctaatcagttgcatcgaaagtctgtaaagaaggggtttgatttcaccctgatggtggcaggcgagagtgggctgggcaagtcgacattaatcaactccctgttcctaaccaacctatatgaggaccgccaggtcccagaggcctccgcacgactgacccagaccctcgccatcgagcggcgaggcgtcgagatcgaggagggcggagtaaaggtgaaactcaccttggttgatacccctggatttggcgatagcgtggactgttccgactgttggttaccggtcgttaagttcatagaggagcaatttgagcagtatctcagagatgagtccgggctgaacaggaaaaatatccaggattcgagggtacactgctgtctctactttattagcccctttgggcgtggactcagaccactggatgtagctttcttgagagctgtgcacgaaaaagtgaacataatcccggtgatcgggaaagcagacgctctgatgcctcaagaaacacaagcccttaagcagaagatccgagatcaactgaaagaggaagagatacatatttatcagttcccagaatgcgactctgacgaagacgaagacttcaagcggcaagacgctgagatgaaggagagtatacccttcgccgtggtcggatcttgcgaggtggtgcgcgatggcggtaaccgccctgtgcgtgggaggagatacagctgggggacggtcgaggtggaaaatccccatcattgtgattttttaaatctcaggcgcatgcttgtacagacacacctgcaggatctgaaagaggtgacgcacgatttgctttacgagggctaccgcgctcgctgtctgcagagtctggctcgacccggtgcacgagaccgagccagccgatcgaaattgagtcgccaatccgccacagaaatcccgctgcctatgttgcctctcgctgatactgagaaactcattcgtgagaaggacgaggagctccggagaatgcaggagatgctcgagaaaatgcaggcccaaatgcaacagtctcaggctcagggggaacagagtgatgccttatag

SEQ ID NO: 239934 - DNA, 1104 bp, Artificial Sequence
  Description of Artificial Sequence: Synthetic coding sequence
atggacaaggagtatgtggggtttgctgcgttacccaatcagctgcatcgaaagagtgtgaaaaaagggtttgactttacgctgatggttgcgggtgagtcagggctggggaaaagtaccctgattaactccctgttcctgaccaacttatacgaggaccgccaggtgccagaggccagcgcacgactgacacaaactcttgccatagaaagacggggtgtggagatagaagagggcggagtaaaagtcaaactgaccctggtggatacccccggattcggagactccgttgattgcagcgactgctggcttccagtcgttaagtttatagaggagcagttcgagcagtacctccgggatgagtccgggctgaaccgtaagaacatccaggacagtcgagtccattgttgtctctactttatttccccttttgggaggggactgagacctctcgatgtggccttcttgagggccgtgcatgaaaaggttaatattatccccgtgataggaaaggccgatgcactaatgccacaagagacacaagcactcaagcagaagatcagggatcaactgaaggaggaggagatccacatatatcaatttcctgaatgtgactccgatgaggatgaagactttaagaggcaggatgcggaaatgaaagagagtatacccttcgcggtggttggctcatgcgaagttgtccgtgacgggggtaatcgcccagtacggggacgccgatacagctgggggaccgtggaggttgagaacccacatcattgtgactttctcaacctgcgacggatgcttgtgcaaacgcatctccaggatttgaaagaggtgacacacgatttgctctatgagggctatagagcacggtgcctccagtcacttgccagacccggtgctagagacagggcctcaagaagtaaactttcacgccagagcgccacggagattcctctgcccatgctgccactcgccgataccgaaaagctgattcgcgagaaagatgaagaattgcgcaggatgcaggaaatgctggagaaaatgcaggcccagatgcaacagtcacaggcccaaggcgagcagtccgacgccctttag

SEQ ID NO: 239935 - DNA, 966 bp, Artificial Sequence
  Description of Artificial Sequence: Synthetic coding sequence
atgatgaatcggtattaccaaccaatagttgactatattgacgcccagttcgaggcatacctgcaggaagagttaaagataaaaagaagtctgtttacctaccacgacagtagaatacacgtgtgcttatacttcatttcgcctactggccattccctgaagaccttggacctgttgaccatgaaaaacctcgattccaaagttaacattataccagtgatcgccaaggcagacaccgtatcaaagaccgagctgcaaaagtttaagatcaagctcatgtccgagctcgtaagcaacggtgtgcagatctaccaattccccacggatgatgacaccattgctaaagtgaacgcagccatgaatggtcagctgccattcgcagtcgttggttctatggatgaggtgaaggtgggaaacaagatggtgaaagcgaggcaatatccatggggcgtggtacaggtcgagaacgaaaaccattgtgactttgtgaagttgcgggaaatgctcatttgcaccaacatggaggacttaagagagcagacccacacccgccactacgagctctaccgcagatgcaagttggaagaaatgggatttacagatgtgggcccagagaacaagcccgtgtctgtccaggaaacatacgaggccaagcgccatgaatttcatggggaacgacagcgcaaagaagaagagatgaagcagatgttcgtgcagcgagtgaaagagaaggaggccatcctaaaggaggccgagagagaactgcaggcaaagtttgagcacctcaaacgactgcatcaagaagagagaatgaagctggaagaaaagcgaaggcttttagaggaggagatcatcgccttctccaaaaagaaagctaccagtgaaatatttcattcacaatcgttcctcgctacagggagcaatctacggaaggacaaggatcggaagaattccaacttcctgtag

SEQ ID NO: 239936 - DNA, 954 bp, Artificial Sequence
  Description of Artificial Sequence: Synthetic coding sequence
atgagtgggcacgtgggattcgagtcacttcccgatcagcttgtgaatcgctcaatccagcaaggtttttgtttcaatatactctgcgttggcgaaactggaattggcaaatccactctgatagacaccctcttcaatacaaatttcgaggactatgagtcctcccacttttgtcctaacgttaaattgaaggctcagacgtacgagctgcaggagagtaacgtgcaactgaagctgacaatagtgaatacagtgggattcggtgatcagattaacaaggaggaatcctaccagcccatcgtcgattacattgacgctcagttcgaggcctatctgcaagaggaactgaaaattaagaggagcctatttacctaccatgatagccggattcatgtttgtctttacttcatcagccctaccggtcactccttgaagaccctggacctgttgactatgaagaacctcgatagcaaagtgaatatcatccctgtgattgcaaaggctgataccgtatccaaaacggagctgcagaagtttaagattaagctgatgtccgaattagtgagcaacggagttcaaatctatcaatttcctactgacgacgatactattgctaaggtaaacgccgctatgaacggccaactacctttcgcagtggtggggtcgatggacgaagttaaggtggggaataaaatggtgaaagcaaggcagtatccatggggtgtcgtacaggtggagaacgaaaatcattgcgatttcgtcaaactgcgagagatgctaatatgcacaaacatggaggaccttcgcgaacagactcacacgcggcattatgagctgtaccgccgttgcaagctggaggagatgggatttaccgacgtgggtcctgaaaacaaaccagtgagctataggcccaacctgagtacactccgcgatttcaccaaaaagcgggagtag

SEQ ID NO: 239937 - DNA, 1635 bp, Artificial Sequence
  Description of Artificial Sequence: Synthetic coding sequence
atggcctcaagtgaagtggccagacacctgctcttccagtcccatatggcgactaagacaacctgcatgagttcacagggctcagacgatgagcagataaagagagaaaatataagaagcctcacgatgtcagggcatgttgggttcgaatcactgcctgatcaactggttaacagaagcatacagcagggattctgcttcaatattctctgcgtaggcgagactggcatcggcaagtcgaccctcatcgatactctgttcaatactaatttcgaggattatgagtccagccacttttgtcctaacgtcaagctcaaggcacagacctacgagctccaggaatcaaacgtccaactcaagctgacaatagtgaataccgtgggttttggggatcagattaacaaagaagaaagctaccaacccatagtcgactacattgacgctcagttcgaggcatatctacaggaggagttgaagattaagaggtccctgttcacctatcatgattctcgtattcacgtatgtctgtactttatatccccaaccggacatagcttgaagactcttgacttgctgaccatgaagaatctggatagcaaggtgaacatcatccctgttatagctaaggccgatacagtgtcgaagaccgaactccagaaatttaagattaagttaatgagcgaattggtctcaaacggagtccagatttaccagttccctaccgacgatgacaccatcgccaaggttaacgctgctatgaacggtcagttgccatttgccgtggtgggttctatggatgaggtgaaagtgggaaacaagatggtgaaagcgagacagtatccttggggagtggtccaagtggagaacgagaatcactgtgacttcgtaaagctgagagaaatgttaatctgtacgaacatggaggacctaagggagcagacccacactcggcactatgaactgtatcgacgttgtaagctggaggagatggggtttaccgacgtggggccagaaaataagcccgtgtccgtgcaagagacgtatgaagcaaagagacacgagttccacggagagcgacagcggaaggaggaggaaatgaaacagatgtttgtgcaacgggtcaaagagaaggaggcgatcttaaaggaagctgagagagagcttcaggccaagttcgaacatctgaagcgcctgcatcaggaggaacgtatgaagttagaagagaagcgccgtcttctcgaggaggagattatcgcttttagtaaaaaaaaagccacctcggaaatcttccatagtcagtccttccttgctaccggaagtaacctaagaaaagacaaagatagaaagaaggagcctggatgccgcttcgaactgctgtgcattgacgttagagcctgcgaaacaaacggcggtagaaaagatgccgagaaagctccaattttttgcaagacagaggttcccgagcatcgcaggagctccagccaggccaacttcatcaagaaaaagcttgaggtgtgcttcgacttcgccgttatctgcttcatcacctccatatttggcgagcagcctcaattactgatttttatggagaagtacttccaggttcaggggcagtatatctcccagtctgagtag

SEQ ID NO: 239938 - DNA, 1365 bp, Artificial Sequence
  Description of Artificial Sequence: Synthetic coding sequence
atggcctccagtgaggtggcccgtcacctactcttccagtcccacatggccaccaaaaccacctgcatgtctagccagggcagcgacgatgaacaaatcaaaagggaaaatatcagatcactgaccatgtctggccacgtcggatttgaatccttacccgatcagcttgtgaacagatccattcagcaaggattttgcttcaatatcctttgtgtgggcgagaccggcattggaaaaagcacactcatcgatactctcttcaatacaaattttgaggattatgagagcagtcacttctgtccaaacgtgaagttgaaggcccaaacatatgaattacaggagtcaaacgtgcaattaaagctgaccattgttaataccgtgggctttggagaccagattaacaaagaagaatcttatcagcccattgttgattatattgatgcccagtttgaggcttatttacaggaggagctgaagatcaagcggtccctatttacttaccacgatagtcggatacacgtgtgcctgtactttattagtccaaccggccatagcctgaaaaccttggaccttctcaccatgaaaaacctggacagcaaggttaatatcattcccgttattgccaaagccgacaccgttagcaaaacagagttgcagaaatttaaaattaagcttatgtcggagcttgtgtcaaacggcgtccagatctaccagtttccaactgacgacgatacaattgccaaggtgaacgctgctatgaatgggcagttaccctttgcagtcgttgggtccatggatgaggtgaaagttgggaataagatggtgaaggccagacagtatccttggggggtggtacaggtggaaaatgaaaaccattgcgactttgtgaagttacgggagatgttgatctgcactaatatggaagacttacgcgaacagacccacacccgccactacgaattataccgcagatgcaagctcgaagagatgggctttacagatgtgggaccggaaaataaaccagtctctgtgcaggaaacctacgaggcaaaacgccatgaatttcacggcgagcgacagagaaaggaagaagagatgaagcagatgttcgtgcaacgggtaaaggaaaaagaagccattcttaaggaggccgaacgagaactgcaggccaagttcgaacacttgaagaggttgcaccaggaggagaggatgaagcttgaggaaaaaaggcgactgctcgaagaggagataatcgcgttctcaaagaaaaaagccacctcagagattttccattctcagtccttcctcgccactggttccaacctgcgcaaggacaaagaccggaaaaactcaaactttctctag

SEQ ID NO: 239939 - DNA, 1296 bp, Artificial Sequence
  Description of Artificial Sequence: Synthetic coding sequence
atggctagtagcgaagtagcacgacaccttaagagggagaatattcgaagtcttactatgagtggtcacgtgggcttcgagtccttgccagaccagctggtgaatcggtcaattcagcaaggcttctgcttcaatatcctgtgtgtcggggagactggaataggtaagtccacactcattgataccctatttaataccaactttgaggactatgagagtagtcacttttgtcccaatgtcaagctgaaagcgcagacgtatgaactgcaggagtctaatgtgcaactgaaattaacaatcgtgaacactgtgggattcggagaccagatcaataaggaagaaagctatcagcccattgtggactatatcgacgcccaattcgaagcctacctccaggaggagctaaagattaagcggagtctcttcacctatcacgatagccggattcatgtttgcctttactttatcagtcctactggacattctttgaaaaccctggatctcttaactatgaaaaatctggatagcaaggtgaatattatcccagtgatcgccaaagctgatactgtaagcaagacagagctgcagaaattcaagatcaagttgatgtccgagctggtctcaaatggagtacagatctatcagtttccaacggatgatgataccatcgccaaggttaatgcagctatgaacggccaactgccctttgccgtcgtgggctctatggatgaggtcaaggtcggcaacaagatggtcaaagccagacagtatccatggggagtggtacaggtagagaacgaaaaccattgtgatttcgttaagctgagagaaatgctgatttgcactaacatggaagatctgagagagcagacccacactcggcattatgaactctatcggagatgcaaactcgaggagatgggatttacagatgtcggacccgagaataagcctgtttcggtgcaggagacctacgaagcaaagagacacgaattccacggcgaacgtcagaggaaggaagaggaaatgaaacagatgtttgttcagcgtgtgaaggagaaggaggccattctcaaggaagccgagcgagaattgcaggccaagttcgagcacctgaagcgacttcaccaggaggagagaatgaaactggaggaaaagagacggctgcttgaagaggagattatcgctttctccaagaagaaggccaccagtgagatcttccatagccagagctttctggctaccggcagcaatcttcgcaaagataaagaccgcaagaatagcaatttcttgtag

SEQ ID NO: 239940 - DNA, 1353 bp, Artificial Sequence
  Description of Artificial Sequence: Synthetic coding sequence
atggccagctcagaagtcgcacggcacctcttgttccagtcccacatggcgacaaaaaccacatgcatgagcagccaaggcagtgatgacgaacagatcaaacgagaaaatatccggtccctcaccatgtccggtcacgtgggctttgagagcctgcctgaccagctcgtcaatagatctatccaacaaggattttgctttaacatactctgtgtcggagagaccggaatcggtaagtccaccctcatcgacacgctcttcaacaccaacttcgaagactatgaatcttcacatttttgcccaaacgtgaaactgaaggcgcagacctacgagctgcaggaatctaacgtgcagctcaagctcaccattgtcaacacagtgggattcggtgaccagatcaacaaggaggagagttaccagcccatcgtcgattatatcgatgcccagtttgaagcgtacctccaggaggaacttaagataaagaggtctctcttcacatatcacgatagtaggatacatgtttgcctttattttatatccccaactggacattctctgaaaacgctggatctgctcacaatgaaaaacctggattccaaagtcaacataattccggtcatagccaaggcagatacagtgagcaagactgagctgcagaagttcaaaattaagctgatgtccgagctcgtaagtaacggcgtgcagatctaccagtttccaacggatgacgataccatcgccaaggtgaacgccgcaatgaatggccagctcccatttgccgtggtgggctccatggatgaggtgaaggttggcaacaaaatggtcaaggcccgacagtacccctggggagtcgttcaagtggagaatgagaaccactgtgattttgtaaaactgagggaaatgctgatatgtacaaacatggaggaccttcgagaacagacccatactaggcactacgagttataccggagatgcaagctcgaagagatgggttttacagacgtgggtcccgaaaataaacctgtatccgtccaagagacgtacgaggcaaagcggcatgagttccatggagagaggcagaggaaagaggaagagatgaagcagatgttcgtccagcgagtcaaagagaaagaagccattctgaaggaggcggaacgagaactgcaggcgaaattcgagcatctgaagcgcctgcaccaggaggaacggatgaaattggaggagaagcgtcgcctgctcgaagaggaaatcattgcctttagcaaaaagaaggctacttcggagatttttcactcacaatcctttctggccacgggtagcaacttgcggaaagacaaggatcgcaaaaagtag

SEQ ID NO: 239941 - DNA, 1422 bp, Artificial Sequence
  Description of Artificial Sequence: Synthetic coding sequence
atggccaccaaaaccacatgcatgagcagccagggctcggacgacgagcagatcaaaagagaaaacattaggagccttaccatgtcggggcatgtcggatttgagagccttcctgaccagctggtgaaccgatctattcaacaaggattctgctttaacatcctgtgcgtgggagagacgggcatcggaaagtctacactgatcgacactctttttaacactaacttcgaggactacgagagtagccacttttgccctaacgtaaaactgaaagcccagacttatgaactgcaagagtcaaacgtgcagttgaagctgacaatcgtgaacacggtgggttttggcgatcaaattaacaaggaggaatcataccagcccatagtggattacatcgatgcccagtttgaagcataccttcaagaagaactaaagatcaagcggtcattgtttacataccacgactctcgaatacacgtgtgcctatactttattagtcccactggacattccttgaagacactcgaccttttgacgatgaaaaatctggactctaaggtgaatatcattcctgtgatagccaaggccgatactgttagcaagacagagctccagaagtttaagataaagctgatgtccgagctggtaagcaacggggtccagatttatcagtttcctacagacgatgacacaattgcaaaagtgaatgctgccatgaacgggcagttgccattcgccgttgtgggtagtatggacgaagttaaagtcggcaacaagatggtcaaagccaggcagtacccttggggggtggttcaggtcgagaatgagaatcactgcgattttgtgaaactgagagagatgctgatttgtactaacatggaggacctgcgcgagcagactcatactaggcactacgagctttaccgcaggtgtaagctagaggagatggggttcaccgacgtgggacccgagaataagccggtgagcgtgcaggagacctatgaggcaaaacgtcacgaattccacggggagagacagcgaaaagaagaggagatgaaacagatgtttgtacagcgggttaaggagaaggaagccattttaaaagaggcggagagggaattgcaggctaagttcgagcacctgaaacgcctgcaccaggaggagagaatgaaattggaagaaaaacggaggctgctggaagaagagattatcgcgttttccaaaaaaaaggccacctcagaaatattccattctcagtcctttctggctacagggtcaaatctccgtaaggataaggaccgcaagaaggaacccggatgtcggtttgaattgctgtgtattgatgttcgtgcctgcgaaacaaatggcggaaggaaggatgctgagaaggggagagagggacactctgcaagaggtcagccttag

SEQ ID NO: 239942 - DNA, 852 bp, Artificial Sequence
  Description of Artificial Sequence: Synthetic coding sequence
atggcttcgtccgaagttgctcggcacttgctgtttcaatcacacatggccactaagacgacgtgtatgtcttcacagggctctgacgacgagcaaatcgtgaatattattccggtgatcgcgaaagcagacactgtgtccaagactgagctgcagaagttcaagataaaactgatgagcgaacttgtctccaatggcgtgcaaatttaccagtttcccaccgatgacgatactatcgccaaagtcaacgctgcaatgaatgggcagcttcctttcgcagtcgttgggtcaatggacgaggtcaaggtgggcaataagatggttaaggccagacagtacccctggggagtagttcaagttgaaaatgaaaaccattgtgattttgtgaagctgagggaaatgttaatctgcaccaatatggaggacctgcgtgagcagacccataccaggcattatgaactctatcgccgatgcaagctggaggaaatggggttcaccgacgttggtcctgaaaacaagccagtgagcgtgcaggaaacttacgaggccaagagacatgagttccatggagagagacagagaaaagaagaggagatgaagcaaatgttcgtacagagagtgaaagaaaaggaagccattctgaaggaagccgaaagagaattgcaggctaaattcgaacacttgaagagattgcatcaagaggagagaatgaagctcgaagagaagaggaggctacttgaggaagagattatcgcctttagcaagaagaaagccactagcgagatcttccactcacagtcttttctggcaactggcagtaatttgaggaaagacaaggataggaaaaagtag

SEQ ID NO: 239943 - DNA, 1290 bp, Artificial Sequence
  Description of Artificial Sequence: Synthetic coding sequence
atggctgtcgcggtcggcaggcctagcaatgaggagttgcgtaatctctctctaagtggccatgttggttttgactcactgccagatcagctggtgaataagtcaacatcccagggcttttgcttcaacattctatgcgtcggagagaccggcatcggaaaatctaccctgatggataccctttttaacacgaaatttgagtccgacccggcaacacacaatgaacccggagtgcggctcaaggccaggtcctacgaactgcaggaaagcaacgttcgtttaaagctgacaatcgtcgatactgtcgggttcggcgatcaaataaacaaggacgacagttacaagcctatcgtcgagtacattgatgctcagtttgaagcgtacctgcaggaggaactgaagatcaagcgttctctttttaattatcacgacacccgaatccacgcttgcctgtattttatagcacctacagggcattctttaaaaagtctggatctcgtgacaatgaaaaaattggattcgaaagttaacatcattcccatcatcgctaaggcagacacaatcgctaaaaacgagctccacaagtttaagagtaagatcatgtccgagctcgtgagcaatggcgtgcagatataccaattccccactgacgaagagactgttgctgaaattaacgccactatgagtgtccaccttcccttcgcagtcgtgggatccaccgaggaggtgaagatcggcaacaagatggccaaggcaaggcagtacccctggggcgttgtgcaggtagagaacgaaaatcactgtgacttcgtgaagctaagagaaatgctgatcagggtcaatatggaggatctgcgggagcaaactcatacacgccactacgagctgtatcgcagatgtaagttggaagagatgggttttaaagatacagacccagattctaaacctttctctctgcaagaaacgtatgaggccaagagaaatgagtttctgggagagctacagaagaaggaggaagagatgaggcagatgttcgtcatgcgagtcaaggagaaagaggctgagctgaaggaggccgaaaaggagctgcacgagaagttcgatctattaaagagaactcatcaggaagaaaagaagaaagtcgaggacaaaaagaaggagcttgaagaggaggtgaataattttcagaaaaaaaaggcggctgctcagctgctgcaatctcaggcacagcaaagcggggctcagcagacaaagaaggacaaggataagaaaaacgcttcctttacctag

SEQ ID NO: 239944 - DNA, 1278 bp, Artificial Sequence
  Description of Artificial Sequence: Synthetic coding sequence
atggccgtggcagtgggacggccaagcaatgaggagcttaggaacctatcactctcgggtcacgtgggctttgactctttacctgatcagctagtaaataaatccacctcgcaagggttctgcttcaacattctttgtgttggcgaaaccgggatcggcaaatccacactcatggacactctttttaacaccaagttcgaatcggatcccgctactcacaacgagccaggggtgcgcttgaaagctcgaagctacgagttgcaggagagcaatgtccgtctcaagctgacgatcgtcgatactgttggattcggtgatcagattaacaaggacgactcctataaacccatcgtagagtacatcgacgcacagtttgaggcctacctacaagaggagctcaaaatcaaacgaagcttattcaattaccatgatactcggatccatgcctgcctgtattttattgctccaacaggtcattccctcaaaagtctggacttggtgacaatgaagaagctggactcaaaagtgaatatcatcccaattattgctaaagccgatacgatcgccaagaacgagctccacaagtttaagagcaagatcatgtcagagctggtgtcgaatggggtccagatctatcagtttcctacagatgaggagactgtggccgagatcaacgccactatgagcgtccacctgccctttgcggtagtggggtcaactgaagaggttaagattggcaataaaatggctaaggctcgtcagtacccttggggcgttgtgcaagtggaaaatgagaaccactgtgattttgtcaaacttcgcgagatgctaatccgcgtgaatatggaagatttacgcgagcagacacatacacgccattacgagctgtatcggcgatgtaagctcgaggaaatggggttcaaggacactgatccggactccaagccgttctccctgcaagagacctatgaagccaaacggaacgaattcttgggagagctgcagaaaaaagaagaggaaatgcggcaaatgttcgttatgcgcgtcaaggaaaaagaagccgagctgaaagaggcggaaaaggagcttcacgagaaatttgacctactgaaacgaacacaccaggaagaaaagaaaaaagtcgaggacaaaaagaaggaacttgaagaagaggtaaacaactttcaaaaaaagaaggcagcagctcagctgctccagtctcaggcacagcagtcgggggcacaacagactaagaaagacaaggataaaaagaaatag

SEQ ID NO: 239945 - DNA, 1320 bp, Artificial Sequence
  Description of Artificial Sequence: Synthetic coding sequence
atggaagaacggaagcctgcccacgtcttgaggagctttaaatacgctgctttcatgaatgaggagttgcgaaacctgtcattatcaggccatgtcgggttcgattcactgccggaccaattggtcaacaaaagcacatcacagggattttgtttcaacatcctgtgtgtcggcgagacaggaattgggaaatcaaccctgatggatacccttttcaacacaaaattcgagagcgaccctgccactcacaatgaacccggagtgcggttgaaggcaaggtcttacgagcttcaggaatcaaatgtgcggctgaagctgacgatcgtggacaccgtgggctttggtgaccagattaacaaagatgattcttacaagccgatcgtggagtatatcgatgcacagttcgaggcctatctccaagaggagttaaaaattaaaaggtctcttttcaattatcatgacacccggatacatgcctgtctctattttatcgccccaacaggccatagcctgaaaagcctcgacctggtcaccatgaagaagctcgacagcaaggtgaatatcatcccaatcattgcgaaagcagatactattgctaaaaacgagttgcacaagttcaaaagtaagatcatgtccgaactggtaagtaatggtgtgcaaatctatcagttccctacagacgaggagactgtcgccgaaatcaacgccactatgtctgtacatcttccctttgcagtagtgggctcaactgaggaggtaaagattggtaacaagatggctaaggccagacagtacccatggggggtggtccaagtagagaatgagaatcattgcgactttgtgaagctacgtgagatgcttatccgtgtaaacatggaggatttgagagagcaaacccatacaaggcactacgagctgtatagacgctgtaagctggaggagatgggcttcaaggatacggaccctgacagcaaaccattcagtctccaagagacatatgaggcaaagcgcaatgaattcttaggggaactccaaaagaaagaggaagagatgagacagatgtttgtgatgcgagtgaaggaaaaagaggccgagttgaaagaggctgagaaggagctgcacgagaagtttgatctcttgaaacgcacgcaccaagaggagaagaagaaagtcgaagataagaagaaagagctggaggaggaggtaaataatttccagaaaaagaaagcagctgcccagcttctgcagtcgcaggcacagcaatcaggggctcagcagactaagaaggacaaggacaagaagaacgcaagcttcacttag

SEQ ID NO: 239946 - DNA, 1077 bp, Artificial Sequence
  Description of Artificial Sequence: Synthetic coding sequence
atggatcccttgcgcaggtcgccatccccttgcctgtcctcccagccgtcatccccctctacacccccttgcgagatgttgggccctgtggggatcgaggcagttctggatcaacttaaaatcaaagctatgaagatgggcttcgagtttaatattatggtggtggggcagtcgggactgggcaaaagcaccatggtgaatactctgttcaagagtaaggtttggaaatcaaatccgcctggccttggagtgcctacgccgcagacactgcagctgcacagcctcactcacgttatagaagagaaaggcgtgaagctgaagctgactgtgactgatactccaggttttggagatcagataaacaacgacaattgttgggacccaatattaggctatatcaatgagcagtatgaacagtacttgcaggaggaaatccttattaccaggcagcgacatataccggacacacgggtacactgctgcgtctacttcgtgccccctactgggcattgcctgcgccctctcgatatcgagttcctgcagagactgtgtagaacagtcaatgtggtgcccgttattgctcgcgcagattcactcaccatggaggagagagaggcttttagacgcagaatacaacagaatctgaggacccattgtatcgatgtgtacccacagatgtgttttgacgaggatattaacgataaaattctaaattctaaattacgcgacaggattcctttcgccgtagtgggcgctgatcaggaacaccttgtgaatggacgctgcgttctcggtcgcaagactaagtggggaattatagaggtggaaaacatggcccattgtgagtttccactgttgagggatcttctcatccggagtcacctgcaggacctgaaggatatcacccacaacatccactacgagaattatcgcgtaattagattgaatgagtcacatcttctccccaggggcccagggtgggtcaacttggcacctgccagtccgggacagttgacaacaccgcgaacctttaaagtctgtcgtggtgctcacgatgatagcgacgatgagttctag

SEQ ID NO: 239947 - DNA, 939 bp, Artificial Sequence
  Description of Artificial Sequence: Synthetic coding sequence
atggacccgttaaggcgcagccccagtccctgcctatcatcccaaccctccagtccttcgactccgccttgcgaaatgctcggaccggtggggatcgaagccgtgctcgatcaacttaagatcaaggcgatgaagatgggttttgaatttaatatcatggtggtgggccagtccggcctgggcaagtctacaatggttaacactctattcaagtcaaaggtctggaaatccaatcctccaggtctcggcgtcccgaccccccagactctgcagctgcactcattgacacatgtaatcgaggaaaaaggtgtcaagctgaaactgacagttacagatacaccaggtttcggagaccagattaataatgacaattgcctccgccctttggacatcgagttcctgcagcggctgtgcaggactgtaaacgttgtgcccgtgattgcgagagcagactctctcactatggaagagcgtgaggccttcaggagacgcattcaacagaacctgaggacccactgcatcgacgtgtatccgcagatgtgcttcgatgaagatattaacgacaaaatactgaacagcaagctcagagatcgaatcccatttgcggttgttggtgcggaccaggagcacttggtcaacgggcgttgcgttctggggagaaagaccaagtggggtattatcgaggtagaaaatatggcacattgcgaattcccactcctcagagatcttttgattaggagccatctccaagatttgaaagacattacacacaacatccactacgagaattatcgggtgattagacttaatgagtcccacctgctgccacggggaccagggtgggtgaatctggcccctgcctcgcccggacagttaacaacccccaggactttcaaagtctgcagaggcgcacacgacgattccgacgatgagttctag

SEQ ID NO: 239948 - DNA, 1299 bp, Artificial Sequence
  Description of Artificial Sequence: Synthetic coding sequence
atggcagagcgcactatggccatgcccacccagatccctgctgatggagatacccagaaggagaataatatcaggtgtcttaccactatcggccatttcgggtttgagtgcttgccaaaccagctggtctctagaagcatacgccaggggtttacttttaacattctctgtgtgggcgagacaggtattggtaaatctaccctaattgacacactttttaatacaaatcttaaggataacaagtcctcgcatttctatagcaatgtgggcctgcagattcagacctacgagctgcaggagtctaatgtacagctgaagctgacagtggtggaaactgtgggttatggtgaccagatcgacaaagaagcatcctaccagccaatagtcgattacattgacgcacagtttgaggcctacctacaggaagaattgaagattaagcgttccctatttgaatatcatgattcacgtgtgcacgtgtgcttgtactttatcagtcccacaggccatagcctgaagtccctcgatttactgacgatgaagaacttagactcaaaagtgaacattattccactcattgccaaggccgacactatatcaaaaaatgatctgcagaccttcaaaaataaaatcatgtctgaactgatcagcaacggcatccagatttatcagctcccgactgatgaggagacagctgctcaagccaactcgagcgtgtcaggcttacttcccttcgctgtcgtgggctccaccgacgaagttaaggttgggaaaagaatggtgcgcggacgccactatccatggggcgttttgcaggtagagaacgagaaccactgtgacttcgtaaaactcagagatatgctgttgtgcaccaacatggaaaatcttaaagaaaagactcatacccaacactatgagtgttacagataccagaagcttcagaagatgggatttacagatgtgggcccaaataatcaaccagtcagctttcaggagatcttcgaagccaagcggcaggaattttatgaccagtgccagagggaggaggaagaactgaagcagagattcatgcagagagttaaggagaaggaagctacctttaaagaggcagagaaagagttacaggacaaatttgaacaccttaaaatgatccagcaggaggaaatacgtaaactggaagaggagaagaagcaacttgagggtgaaatcatcgacttttacaagatgaaagccgcaagcgaagccttgcaaactcaattgagtactgacactaagaaggataagcatcggaagaagtag

SEQ ID NO: 239949 - DNA, 1086 bp, Artificial Sequence
  Description of Artificial Sequence: Synthetic coding sequence
atgagcaaacagcagcctacacaattcattaaccccgaaacacccggttatgtaggctttgcaaacctacctaatcaggtgcatcggaaatccgtgaagaaagggttcgaattcacattgatggtggtgggcgaatctgggctaggcaaatcaaccctcataaatagcctgttccttactgatttgtatcccgagagggtcattccaggcgcagccgagaagatagaacgcacagttcagatcgaagcttctacagtggaaatcgaagaacgaggtgtcaaactgcggctcacagtggtcgatacgcccggatatggggacgctattaactgtcgggactgtttcaagacaatcattagttatattgatgagcagtttgaacggtatctgcacgacgaaagcggtctgaatcgtagacacatcattgacaatcgagtgcactgttgcttttattttattagccctttcgggcatgggctcaagccgttggatgtggcatttatgaaggccatccacaataaagttaatatcgtcccagtgattgcaaaggcagacactctgacactaaaggagagagaacggctgaagaagcgcattcttgatgaaatcgaggagcacaacataaaaatctatcacctccccgacgccgaatccgatgaggacgaggactttaaggagcagactagactcctcaaagcatctatcccctttagtgtcgtcggcagcaaccagctgattgaggctaagggcaaaaaagtccgtggacgtctgtacccttggggcgttgtcgaagtagaaaacccagagcacaatgacttccttaagctgcgcaccatgctgatcacacacatgcaggacttgcaggaggtgacccaagacctccattatgaaaacttccgctcggagcgtctgaagcggggaggaagaaaagttgaaaatgaagatatgaataaggaccaaatactactggagaaagaggctgaacttaggaggatgcaggaaatgatcgccaggatgcaggcccagatgcagatgcaaatgcaggggggtgatggtgatgggggtgcgctgggtcaccacgtgtag

SEQ ID NO: 239950 - DNA, 1086 bp, Artificial Sequence
  Description of Artificial Sequence: Synthetic coding sequence
atgtctaagcagcagcccacgcaattcataaatcctgagacccccggatatgtggggtttgccaacctgccaaaccaagtccatagaaagagcgtgaagaagggtttcgagtttactcttatggtggtgggggaatccgggcttgggaagtcaactctgattaactccctctttctgacggatctctaccctgagcgagtaattcctggcgcagctgagaaaatcgaacgaacagttcagatcgaggccagtaccgtcgagattgaggaaagaggcgtcaagttacgccttactgttgttgacacccctggttatggcgacgctatcaattgcagggactgcttcaagaccatcattagctacattgacgaacaatttgagcggtacctgcacgacgaaagtggcttgaacaggagacatattattgacaatcgagttcattgttgcttttatttcatttcaccgtttggacacggcctgaaacctttggacgtggcgttcatgaaggcgatacataacaaggttaatatcgttccagtgattgccaaggcggatacacttacactgaaggagagagagaggctgaagaaacgaatcctagacgaaatagaagaacataatatcaaaatctaccacttgccagacgctgaatccgatgaagacgaggacttcaaggagcaaacacgtcttttgaaagcatctatccccttctcagtcgtgggtagtaaccagctgatcgaggcaaaagggaaaaaggtccgaggtcgcctatacccatggggggtggtagaagtggagaatcctgagcataacgacttccttaagttacgtacaatgctgatcacacacatgcaagacctgcaggaagtgacacaggacctgcattacgagaattttagaagcgagcgccttaagcggggtggccgaaaggtcgaaaatgaagatatgaataaggatcagatccttttggaaaaggaggctgagttacggcgaatgcaggaaatgattgcacggatgcaggcccaaatgcagatgcagatgcagggtggagacggcgacggtggagcgctgggacatcacgtgtag

SEQ ID NO: 239951 - DNA, 1191 bp, Artificial Sequence
  Description of Artificial Sequence: Synthetic coding sequence
atgccctggatttctgagggcagagcaactcgaccgtgcctgagagttccttctgccaggcggggagatgagggcctgcaccaacgcgacgaggctagccaaaagatgtcaaaacagcagcccacccagtttatcaatccagagacaccgggatatgtcgggttcgcgaacctgccaaaccaggtacaccgaaagtcagtcaagaaaggttttgagtttactctgatggtggtcggagaaagcggtctgggcaagagtactttgattaactctctctttctcactgacttgtatcctgagagagttatccccggtgcggctgagaagatagaacgtacagttcagatcgaagcttcaacggtcgaaatcgaagagcgtggggtgaaactacgactaaccgtggtggatacgcctgggtatggagatgccatcaactgccgggattgctttaaaaccatcattagctacattgatgaacagttcgaaagatatctgcacgacgagagcggtctgaaccggcgtcacataatagacaaccgggttcattgctgtttctacttcatcagtcccttcgggcacggcctcaaacctctagacgtagcttttatgaaggccatccataataaggtcaacatcgtaccagtgatcgcaaaggccgatactttgaccctgaaggaaagagagcggctgaagaaacgaattctcgatgagatagaggaacacaatataaagatctaccacttgcccgacgcagagtccgatgaagacgaagacttcaaagagcagacacgactcctaaaggcctccattccatttagtgtcgtaggaagcaatcaactgatcgaggctaaaggcaagaaagtgcgagggaggctttacccttggggggttgttgaggtagaaaaccctgaacacaacgacttcctgaagctgcgtactatgttgattacacatatgcaggatctgcaggaagtgactcaggatttgcactatgagaacttccggtccgagcggttaaagagaggtggcagaaaggtggagaacgaagatatgaacaaagatcaaattctgctggagaaagaagcagagttaaggagaatgcaggaaatgatcgctagaatgcaggctcagatgcagatgcagatgcaggggggtgatggggatggaggggctctagggcatcacgtctag

SEQ ID NO: 239952 - DNA, 1086 bp, Artificial Sequence
  Description of Artificial Sequence: Synthetic coding sequence
atgtctaagcagcagccaactcagtttatcaatcctgaaacacctggatacgtgggcttcgctaacctgcccaaccaggtgcatagaaaatctgtcaaaaagggcttcgagttcaccttaatggtggtcggcgagtccgggcttgggaagtcaaccctgatcaactccctctttttgactgacttgtaccctgagcgtgtgattccgggtgccgcagagaagatagagcgcacagtgcaaatcgaggcgtctacagttgagatagaagaacgcggagtaaagctgcggttgaccgtggtggatactcccggatacggtgatgccattaactgcagggattgcttcaagacaattatcagctacatcgatgagcagtttgagaggtacctccacgatgagagtgggcttaacaggaggcatatcatcgataaccgcgtgcactgttgtttttatttcattagccctttcggtcacgggctgaagccactggatgtcgcttttatgaaggctattcacaacaaagtgaatatcgtgcccgtgatcgcaaaggccgatactctgactcttaaggaacgcgaacggcttaagaagcggatcctggacgagatagaagagcataacataaaaatttatcatctcccagatgctgagtccgatgaggatgaggatttcaaagaacagacaaggctgttaaaggcctctatcccgttttcagtggtgggctcgaaccagcttatagaagccaaaggaaaaaaagtccgcggaagattatacccttggggcgtcgtcgaggtcgagaacccagagcacaatgactttctcaagttgcgaaccatgttgattactcatatgcaggatttgcaggaggttacccaagaccttcactacgagaatttccgctcggagagactgaagagaggcggacgcaaagtggaaaatgaagatatgaacaaggaccagatacttctggaaaaagaggccgaactgcgcaggatgcaagagatgatcgctcggatgcaggcccaaatgcagatgcagatgcaagggggtgatggtgacggcggtgctttggggcatcacgtctag

SEQ ID NO: 239953 - DNA, 1086 bp, Artificial Sequence
  Description of Artificial Sequence: Synthetic coding sequence
atgagcaagcaacaacctacccagtttattaaccccgagacacccggatatgtggggttcgccaacctccccaaccaggtccacaggaaaagtgtgaaaaaaggctttgaattcactctgatggtggtcggagaatccggtcttggcaagtctaccttgataaatagcctcttcctgactgatctgtatcctgaacgcgtgatcccaggagcggctgagaaaatcgaacgtaccgtgcagattgaagcaagtacagtcgagattgaagagagaggagtgaaactaaggctcaccgtggttgacaccccgggatacggagatgccatcaactgcagagattgtttcaagactattattagttacatcgacgaacagtttgaaagatatctgcatgatgaatcaggactcaatcgcagacatatcatcgataatagagtacattgctgcttttacttcattagtcctttcgggcacggactgaagcctctggatgtagcgtttatgaaggcgattcacaataaagtgaatattgtcccagttatcgccaaagctgacactttaacattgaaagaaagagaaagactgaaaaaacgcatactcgacgaaatcgaggaacacaatatcaagatctatcatttacctgacgccgaaagcgatgaggacgaggacttcaaggagcagacccgattgttaaaggcatccattcctttcagcgtggtaggctcaaaccagctgatcgaggcaaagggcaagaaagtgagaggcaggctgtacccatggggcgtagtcgaggtggaaaaccccgagcacaacgattttcttaagctgaggaccatgctcatcacccacatgcaagacctgcaagaggttacccaggatctgcattacgaaaatttcaggagcgaacgccttaagagagggggacgcaaagtcgagaacgaagacatgaacaaggaccagatcctgctggagaaggaggctgaactgcgtcgtatgcaagagatgattgcaagaatgcaagcccagatgcaaatgcagatgcaaggcggagatggcgacggaggcgctctgggccaccacgtctag

SEQ ID NO: 239954 - DNA, 159 bp, Artificial Sequence
  Description of Artificial Sequence: Synthetic coding sequence
atgtctaagcagcaaccgacccagtttatcaacccggagacacccggttacgtgggcttcgccaatctgccaaatcaggtgcatcgcaagagtgtcaagaagggcttcgagtttacactcatggtggtcggggagagcgggttaggaaagagtacttag

SEQ ID NO: 239955 - DNA, 153 bp, Artificial Sequence
  Description of Artificial Sequence: Synthetic coding sequence
atgagcaagcagcaacctacgcaatttatcaatcctgaaacccccggttatgtgggcttcgctaatctccctaatcaggttcaccgtaagtctgttaaaaaaggcttcgagttcacgctgatggttgttggggagtccggtctgggtaaatag

SEQ ID NO: 239956 - DNA, 72 bp, Artificial Sequence
  Description of Artificial Sequence: Synthetic coding sequence
atgtcaaaacagcagcctactcagtttattaatcccgaaacacctggctacgttgggttcgcgaatctgtag

SEQ ID NO: 239957 - DNA, 447 bp, Artificial Sequence
  Description of Artificial Sequence: Synthetic coding sequence
atgagtaaacagcaacccacccaatttattaaccctgagacgcccggttacgtcgggtttgccaatttaccaaaccaggtgcaccggaaaagcgttaagaagggatttgaatttaccctcatggtagtaggcgaaagcgggctaggtaagtccactctgattaatagcttgttcttaacagatctgtaccccgagcgggtgattccaggcgctgccgagaaaattgaaagaaccgtgcagatcgaagcatctaccgttgagatcgaggaacggggtgtgaaacttaggttaacagtggttgacactcctggatacggggatgccattaactgccgcgattgtttcaagacaattatatcttatatagacgaacagttcgagaggtacctgcatgacgagtccggactcaatcgcagacacatcatcgataatcgcgtgcactgttag

SEQ ID NO: 239958 - DNA, 396 bp, Artificial Sequence
  Description of Artificial Sequence: Synthetic coding sequence
atgtccaaacaacaaccaactcagttcatcaatcccgagactcccggatatgtgggcttcgcaaacctcccgaatcaggtgcataggaagagcgtcaagaagggttttgaatttactttgatggtggtgggtgagagtggactcgggaaaagcactctgatcaacagcctgtttctgaccgacctgtatcctgagagggtgatccctggcgcagccgaaaagatagaaagaaccgtccagatagaagcttccacagtggagattgaagagaggggtgttaagctgaggctgacggttgtggacacaccaggctacggcgacgccattaattgcagagactgtttcaagaccattatttcctatatcgacgagcagttcgagaggtatctacactag

SEQ ID NO: 239959 - DNA, 219 bp, Artificial Sequence
  Description of Artificial Sequence: Synthetic coding sequence
atgtctaagcaacagcccacccaatttattaaccctgaaacccctggttacgtgggatttgcaaaccttcccaaccaggtacatagaaaaagtgtgaaaaagggattcgagtttacccttatggtcgtcggggagtctggactggggaaaagcactctgatcaacagcctgtttctgacagatctctatcccgagcgcgtcatccccggagccgcatag

SEQ ID NO: 239960 - DNA, 219 bp, Artificial Sequence
  Description of Artificial Sequence: Synthetic coding sequence
atgtctaagcagcagcccacgcaattcatcaaccccgagacaccaggatacgtcggatttgccaatctccccaatcaggtgcatagaaaatctgtcaaaaagggcttcgagttcacccttatggtagtgggggagtcagggttgggtaaatcgaccctaataaactcattattccttacagacctataccccgagagagtgatccccggagctgcgtag

SEQ ID NO: 239961 - DNA, 522 bp, Artificial Sequence
  Description of Artificial Sequence: Synthetic coding sequence
atgagcaagcagcaacctacacagttcatcaacccagaaacgcccggatacgtgggctttgcaaacctcccaaatcaggtccaccggaaatctgtcaagaaagggttcgagtttaccctgatggtggtgggagaatctggtctgggcaaatctacactgatcaactctctgttcttaaccgatctgtatcccgaacgtgtaattcctggcgcagctgaaaagattgaaaggaccgtccagattgaagcctctacggtggagatcgaagagcggggtgtgaagttgcggctgacagtggtggatactcctggttatggcgatgcaattaattgtagggattgcttcaagacgatcataagttatatcgacgagcagtttgagagatacttgcacgacgaaagtgggttaaacaggcggcacattattgataacagggtgcactgttgtttctatttcatttcgccgttcggtcacgggctcaaacctctggacgttgcgtttatgaaagcaatccataattag

SEQ ID NO: 239962 - DNA, 90 bp, Artificial Sequence
  Description of Artificial Sequence: Synthetic coding sequence
taagagatgatcgcaaggatgcaggcgcaaatgcaaatgcaaatgcagggaggagacggcgatggcggtgccctcggacaccacgtctag

SEQ ID NO: 239963 - DNA, 861 bp, Artificial Sequence
  Description of Artificial Sequence: Synthetic coding sequence
atgtccaaggggcagtctggcttggggaaatcaacacttgtgaatacactgttcaagtctcaggttagtcgcaaggcttcttcctggaaccgtgaggagaaaatccccaagacggtggaaatcaaagccatcggccatgtcatagaggagggcggagtcaaaatgaaactgaccgtcatagatacaccaggattcggcgatcaaattaacaacgagaactgttgggagcctattgaaaagtatattaacgaacagtacgaaaagtttttaaaagaggaggtcaacattgccagaaagaaacgcatcccagacacccgcgtgcattgttgcttgtactttatctcccccacgggccatagtttgcggccattggatttggagtttatgaaacatctctccaaggtggtgaatataattccagttatcgccaaggccgacaccatgactctggaggaaaagagcgagtttaagcagcgagtgaggaaggaattggaggttaatggtattgagttttacccccagaaagagttcgacgaagatcttgaagacaagaccgagaacgacaagattcgtcaggagtccatgcccttcgccgtagtcgggagtgataaggaataccaggtgaacggcaaaagggtactcggcaggaagactccctggggaattattgaagtagaaaatttaaaccattgtgagtttgctctactgagggattttgtgatccgaacccatctgcaggacctcaaagaagtgactcataacattcactacgagacatacagagcaaaaagactgaacgataatggtggcctcccccctgtgtccgtagatacagaggaatcccacgattctaatccttag

SEQ ID NO: 239964 - DNA, 252 bp, Artificial Sequence
  Description of Artificial Sequence: Synthetic coding sequence
atgagcaaagggctgcccgaaaccagaacggacgcagcaatgtctgagttagttccggaacccaggcctaaacctgccgtgcctatgaaaccaatgtccattaattctaacctgctgggatatatcggcatcgacacaatcatcgagcagatgcgaaagaagaccatgaaaacaggcttcgactttaacatcatggtcgtcgccggatctccattacggagcacgagcatgtcaagcactagatccagttag

SEQ ID NO: 239965 - DNA, 1053 bp, Artificial Sequence
  Description of Artificial Sequence: Synthetic coding sequence
atgtcaaaagggctgcccgaaactcggacggacgcagctatgagcgagctcgtccccgaaccaagacccaagcccgcagtgcccatgaagccaatgagtattaatagtaatctgcttggctatatcggtattgatactataatagagcagatgcgaaaaaaaacaatgaagaccgggtttgattttaacattatggtcgttggacaatccggccttggcaagagcaccttggtaaatactctgttcaaaagtcaggtgagccggaaagccagctcctggaaccgcgaggaaaagattccaaaaaccgtcgaaatcaaggccataggacacgttatcgaagagggaggcgtgaagatgaagctgactgtcatcgacactcctggttttggcgaccagattaacaatgagaactgttgggaacccatcgagaagtatataaacgagcagtacgagaaatttctgaaggaagaagtgaatattgctcgtaagaagcgcatacctgatactagggtgcattgttgtctctatttcatctcacctacaggtcattctttgcggcctctggatctggaatttatgaaacatctttccaaggtggttaatataatccccgtcatagcgaaggcagatactatgacactcgaggagaaatctgaatttaaacagcgggtgagaaaggaattggaggttaatggcatagagttctatccgcaaaaggagtttgatgaggacctcgaagataaaactgaaaatgacaagatccgacaggaatccatgccctttgctgtggtggggtcggataaggagtatcaggtaaatggaaaacgcgtgctgggaagaaagacaccctggggcattatcgaagtggagaacctcaaccactgcgaatttgcgctgctaagagattttgtgatccggacacaccttcaggaccttaaggaagtgacccacaacatacactatgagacataccgtgccaagcgtctgaatgataatggaggcctaccgccagtcagcgtggacaccgaagagagccatgactctaacccttag

SEQ ID NO: 239966 - DNA, 1077 bp, Artificial Sequence
  Description of Artificial Sequence: Synthetic coding sequence
atgtctaagggcttgcccgagactagaacagacgcggctatgagtgagctagtgcctgagccaaggcccaaacccgctgtccctatgaagccaatgagcatcaattccaacttattgggatacattggcatcgacaccatcatagaacaaatgcgaaagaagacgatgaagacaggattcgattttaatatcatggtcgtaggtcagtctggtctggggaagtcaaccttggtcaataccttgttcaaatcccaggtgagcagaaaagcgagcagctggaacagagaagagaagattcctaagaccgtggaaatcaaggcgatcggacacgtgatcgaagaaggcggagtgaagatgaagctaactgtgattgacacccccggtttcggggaccaaatcaataacgaaaattgttgggaacccatcgagaaatacatcaatgaacagtacgagaaatttctcaaagaggaggtgaacatcgcccgaaagaaacgaatccctgacactcgggtccactgttgtctctattttattagccctactgggcacagcctgaggcccctggacctggaattcatgaagcatctgtccaaggtggtgaacatcattccggttattgctaaggctgatacaatgaccctggaagagaagagcgaatttaagcaaagggtgaggaaggaattggaagttaatggcattgagttctacccccagaaggagtttgacgaagatctggaggataagacagagaatgacaagatccggcaggagagcatgccatttgcggtggtaggaagcgacaaggagtaccaggtcaacgggaaaagggtgttggggagaaagaccccttggggaattatagaagtagagaacttaaatcactgcgagtttgccctgctcagagatttcgtgatacgcacacaccttcaggatctcaaggaggtaacccacaacatacattatgaaacatatcgtgcgaagcggcttaatgacaacggaggcctgccaccgggagaaggtctgctgggcacagttctgcctcctgtacccgcaacgccctgcccaaccgccgaatag

SEQ ID NO: 239967 - DNA, 885 bp, Artificial Sequence
  Description of Artificial Sequence: Synthetic coding sequence
atgtccaaggggcagagcggattggggaagtccaccttagtcaatacgctcttcaaatcccaagtgtcacggaaagccagtagttggaaccgggaagagaagatccctaaaactgtagagattaaggccattggccacgtgattgaggagggaggagttaagatgaagctcacagtcatcgataccccaggattcggagatcaaattaacaacgaaaattgttgggagcccatcgagaagtacattaatgaacaatacgaaaagtttctcaaggaggaagtgaatatcgcccgaaagaagcggattcctgacacgcgtgttcattgttgcttatatttcatcagccccaccggtcattcactgaggcccttggacctggaattcatgaaacatctaagtaaggttgtgaatattatccccgtcatagcgaaagccgacactatgacacttgaggagaagtctgaattcaagcagcgagtgcggaaggagttggaggtaaatgggatcgagttttatccccagaaagaatttgatgaggaccttgaggacaagaccgagaatgataaaatacggcaggagagcatgcccttcgcagttgtcggcagtgacaaggaataccaggttaacggcaaacgggttttaggcagaaagacaccgtggggtatcattgaagtggaaaatttgaatcattgtgaatttgccctgctaagggacttcgttattaggacccaccttcaggacttgaaagaggtcactcacaacatccattatgaaacctaccgcgctaagcgccttaatgataatggagggctgcctcctggtgaggggctcttgggtactgtgttgcctccggtccccgcaaccccatgccccacagcagagtag

SEQ ID NO: 239968 - DNA, 537 bp, Artificial Sequence
  Description of Artificial Sequence: Synthetic coding sequence
atgtctgagttggttcccgaacccagacccaaaccagctgtcccaatgaaacccatgtctatcaattccaatctgttaggatatataggtatcgacaccataattgagcagatgaggaaaaaaaccatgaagaccggattcgattttaatatcatggtggttgggcagtccggcctgggcaagagcacacttgtgaacactttattcaagtcacaggtatctcgcaaggcatcttcctggaatagagaagaaaaaatccctaaaaccgtggagattaaggctattgggcatgtcatcgaggaaggtggcgtcaagatgaaacttactgtgattgacacaccgggtttcggcgaccaaatcaacaacgaaaattgttgggaaccaatcgagaagtacattaatgaacaatacgagaagtttcttaaggaggaggttaacattgcccgaaagaagcgtatccccgacacaagggtgcactgttgcctatactttatttctcccacaggtcacagtctccggccactcgatctggagtag

SEQ ID NO: 239969 - DNA, 1137 bp, Artificial Sequence
  Description of Artificial Sequence: Synthetic coding sequence
atggacagtctggcggctccgcaagataggctggtcgaacagcttctgtcccctagaacgcaggcccaacggcgtctgaaggacatcgacaagcagtacgtcggattcgccacactgcctaatcaggtgcacagaaagtcggtgaaaaaagggttcgatttcaccttaatggtggccggtgaatccggactgggcaaaagcacactggtgcactctttgttcctgaccgacctctataaggaccgaaagctattatccgccgaggagcgcatatctcagaccgtcgaaatactgaagcacacagtcgatattgaggaaaagggcgtgaagctaaagttgaccattgtggacacccctgggtttggggacgcggtaaataacaccgaatgctggaagccaatcactgactacgtggaccagcaatttgagcaatatttcagagacgaatcagggcttaaccggaagaacatacaggataatcgcgtgcattgctgtctctactttatatcccctttcgggcacggactcagacctgttgatgtcggattcatgaaggcgttacatgaaaaagtcaatattgttcctctaattgccaaagcagactgtctagttccatcggagattaggaagctgaaagagaggatcagggaagaaatcgacaagttcggaattcatgtctaccagtttccagagtgtgatagtgacgaggatgaggattttaaacagcaggaccgcgagttgaaggaaagcgccccatttgcagtcatagggagcaacactgttgtggaagcaaagggccagcgggtgagagggaggttgtatccgtggggaatcgttgaggtggaaaatcaagcgcactgcgacttcgttaaactaagaaatatgttgattaggacccacatgcacgacctgaaagacgtgacgtgcgacgtgcactatgaaaattatcgagcacactgcattcaacaaatgacctctaagctgactcaggattctaggatggagagcccaatccccattcttcctttgcctactcctgatgccgaaacagagaaacttatccgcatgaaagacgaggagctgcgaagaatgcaggaaatgcttcaacggatgaaacagcaaatgcaggatcagtag

SEQ ID NO: 239970 - DNA, 969 bp, Artificial Sequence
  Description of Artificial Sequence: Synthetic coding sequence
atggttgccggagaaagtgggttgggaaaatcaaccctggttcactctttattccttactgacctgtataaagatcgaaaactgctgagcgccgaggaaagaatttcccagaccgtcgagattttaaaacatactgtggacattgaggaaaaaggcgtaaaactcaaactcacaattgtcgacactccaggcttcggcgacgccgtgaacaacaccgagtgttggaagcccatcacagattacgtggaccagcagttcgagcagtactttcgggacgaatctggcttgaaccgcaaaaacattcaagacaacagagtccattgttgtctgtatttcatctcccccttcggccacggactacggcctgtagacgtgggattcatgaaagcgctgcacgagaaagtgaacatcgtgcccctgatagcgaaggccgattgcctggtgccttcggaaattagaaaactgaaagaacgtatccgcgaagagattgataagttcggtatccacgtctaccaatttcccgagtgcgatagcgacgaagacgaggacttcaagcagcaagacagagaactgaaggagtccgccccattcgccgtgatcggctcgaatactgtggtggaggcaaaggggcagcgtgtgcgaggcaggctgtacccttgggggatcgtagaagtggaaaatcaggcccactgtgattttgtaaagctcagaaacatgctgatccgcacacacatgcatgacctgaaggatgtcacatgtgatgtccattacgagaactacagggctcattgtatccagcaaatgacctccaaactgactcaggactctcggatggaatctcctattcccattctgccattaccaaccccagatgctgagaccgagaaactgatccgtatgaaggacgaggagctgcgtcgtatgcaggaaatgctgcagaggatgaagcagcagatgcaggatcagtag

SEQ ID NO: 239971 - DNA, 1041 bp, Artificial Sequence
  Description of Artificial Sequence: Synthetic coding sequence
atggacagcctggcggctccccaggatagacttgtggaacaactcctatccccgaggactcaggcacaacgcaggctaaaggatatcgataaacagtatgtgggcttcgccaccctgcctaatcaggtgcaccggaagtcagtgaaaaagggttttgatttcacactgatggtagctggagaaagcggcctgggcaagtccacgttggtgcactctctttttctgaccgatctatataaagataggaaactcttatccgctgaggagcgcatcagccaaacagtcgaaattctgaaacacacagtggatatcgaagagaaaggggtcaaactgaaactcaccatcgtcgatacccctggcttcggagatgctgttaataataccgaatgctggaagccaatcaccgactacgtggatcagcagtttgagcagtatttcagagatgagagtgggttgaatagaaagaacattcaagataaccgtgtgcattgctgcttgtactttatttcaccgtttgggcacggcttgagaccagtggacgttggatttatgaaagctctgcatgagaaggtgaacattgtgcccctcatagccaaggctgactgtctggtcccaagcgagattaggaaattgaaagaaagaattcgtgaggaaatcgataaattcggaatccatgtgtatcagtttccagaatgtgacagcgatgaggatgaggactttaagcagcaggatcgggagcttaaagagagcgccccttttgccgtgattggcagcaataccgttgttgaagccaaaggacagagggtgagagggcgtctatatccctggggaatcgtggagggcgcactgagactgagagaagccgctcagcatgctcacccccacgcatatgctagacctcagggcagagatgtgagaagagctctgagggaactaccgagggcactccaccctgccgacgaccaacagacggaccctggccagccccacggcgagcctcatcccgacccggcagcagctcatccaggaagacgggactag

SEQ ID NO: 239972 - DNA, 450 bp, Artificial Sequence
  Description of Artificial Sequence: Synthetic coding sequence
cttcctaaccaggtccatcgcaaatcagtgaagaaaggttttgattttactctgatggtggctggggagtctggcctggggaaaagcactctagtgcatagcctgttccttaccgatttatacaaggatagaaagctgcttagcgccgaagaacggatatcacaaacggtagaaattttaaagcatactgttgacatagaggagaagggcgtgaagttgaagctcaccatagtggataccccaggttttggagacgccgtcaataacaccgaatgctggaagccaattacagactatgttgaccagcaattcgagcagtatttcagagatgagagcgggttaaaccgcaagaatatacaagacaatagagtgcactgctgcctgtattttatatccccattcggtcacggactgagacctgtggatggctttcacgaaggcattgcttag

SEQ ID NO: 239973 - DNA, 1110 bp, Artificial Sequence
  Description of Artificial Sequence: Synthetic coding sequence
atgtcaacgggtctgcgttacaagagtaagctcgcgacacctgaggacaaacaggacatagacaaacaatatgtgggttttgccactcttcccaaccaggtgcatcgaaaatctgtgaagaaaggatttgacttcactctaatggttgctggtgaaagcggactggggaaaagtaccctggttcacagcctcttcctgaccgacttgtacaaagaccggaagctacttagcgctgaggagagaatcagccagaccgtcgagattctgaagcacacagtggacatagaggagaaaggcgttaagctgaagctcactatcgtggatacccctggtttcggggatgctgttaacaatactgagtgttggaaaccaatcacagattatgtcgatcaacagtttgaacagtatttccgagatgaatcgggattaaatagaaagaatatccaggataatcgggttcattgctgtctgtattttatctctcccttcggtcatggattaaggcccgtcgatgtggggttcatgaaggcactgcacgagaaggtcaatatagtccccctaatcgcaaaagccgattgtctggtgccctccgagattcgaaaattaaaggagcggattcgcgaagagatagacaagtttgggatccatgtctatcagttcccagagtgtgattcagatgaagatgaagattttaaacagcaggatagggaactcaaagagagcgcacccttcgcggttattgggtctaacaccgttgtcgaggccaagggccaacgtgtgagggggagactgtacccctgggggatagttgaggtggagaaccaggctcactgcgactttgtgaaactgcggaatatgctgattcgaacacatatgcacgacttgaaggatgtaacgtgcgatgttcattatgagaattatagagctcactgcatccagcagatgacgtctaagctgacacaagactcacgcatggagagtcctattccgatcctgccacttcccacacctgacgcggagacagagaagctgattcgcatgaaggacgaagagcttagaagaatgcaggagatgttgcaacgcatgaagcaacagatgcaggaccagtag

SEQ ID NO: 239974 - DNA, 1137 bp, Artificial Sequence
  Description of Artificial Sequence: Synthetic coding sequence
atggatagcctggccgctcctcaagacaggcttgtcgagcaattgctgtctccccgaacacaggcacagcgacgccttaaggacattgacaaacaatatgttggctttgccactttgcctaaccaggttcaccggaaatctgtgaaaaagggctttgacttcacactgatggtcgccggagagtccggattggggaagagcactctagtccactccctgtttctaaccgatctctataaggatcgtaagctgcttagcgctgaagaaaggatttcacagaccgtggaaatcttaaagcatactgtcgacatagaggaaaaaggagtgaagcttaagctgacaatcgtcgatactccaggatttggcgacgccgtaaacaacacagaatgttggaaacccattaccgattacgtcgaccagcaattcgagcagtactttagagatgaaagtggcctgaaccgtaagaacatccaggacaaccgggtgcattgttgcctatacttcatcagtccattcgggcacgggctgcggcctgtggacgttggattcatgaaggccctccacgaaaaggtcaacatcgtgccgcttattgcaaaggctgattgtctggtgccctccgagatcaggaagttgaaggagcgcatcagagaggagatagacaagttcgggatccacgtgtaccagtttccggaatgtgatagcgacgaggacgaggactttaagcaacaggacagggaattgaaggaaagcgcgccttttgccgttattggaagcaacacagtcgttgaagctaagggacagagagtgcggggaagactgtatccctggggcatcgttgaagtggagaatcaggcccattgcgacttcgttaaactccggaacatgctgattcggacccacatgcatgacttgaaagacgtgacatgtgatgttcattacgagaattatcgggcacactgtatccagcagatgacatcaaaattgacacaggactcacgcatggagagtcccatacccatcctccctctacccacacccgacgccgagaccgagaaactcatcaggatgaaagatgaggagctgcggagaatgcaagagatgctccaaagaatgaaacagcagatgcaggaccagtag

SEQ ID NO: 239975 - DNA, 1305 bp, Artificial Sequence
  Description of Artificial Sequence: Synthetic coding sequence
atggcagccactgacattgcccgtcaagttggggaagggtgccggaccgttcccctcgctggacacgtcggctttgattcgttgcccgatcaattggtgaataaatcagtcagccaaggtttttgctttaacattctgtgcgtcggagagactggcctgggaaagagtacactcatggataccctgttcaacaccaaatttgaaggagagccggcaactcatactcaaccaggcgtccaactgcagtccaatacctacgacctgcaggagtcaaacgtacggctgaaactcaccattgtgagcactgtaggtttcggggatcagattaataaggaggactcctacaagccaattgtcgagttcattgatgcgcaatttgaggcctacctgcaggaggagctgaagatccgacgcgtactgcatacatatcacgacagtcggattcacgtttgtctatatttcatagcccctaccggccatagccttaagagtctcgacttagtgacaatgaaaaagttggattcaaaggtgaatattattcctattatagccaaagcagatgcgatttctaagtctgagctaaccaagtttaaaataaagataacatctgaactagtgagtaatggtgttcaaatctaccagtttcccactgatgatgaatctgttgccgagattaatggtaccatgaatgctcatttgccctttgccgtgattgggtctactgaggaactgaaaatcggcaataagatgatgcgggcaaggcagtacccctggggcaccgttcaggttgaaaacgaggctcactgtgatttcgttaaactgcgggagatgcttatccgggtgaatatggaagatcttagggaacagactcacactcggcattacgaactttaccgcagatgcaaattggaggaaatggggtttaaggacactgacccagactctaaaccattttctctgcaagagacatacgaagccaaacgcaacgaattcctgggcgagttgcagaaaaaagaggaagagatgcgccagatgttcgttcagcgggtgaaggaaaaggaggccgaattaaaagaggctgaaaaggagctgcacgagaagttcgaccggctgaaaaaactccatcaagacgagaagaaaaagctagaggacaagaagaagtctctggatgatgaggtgaacgctttcaagcagcgcaagaccgcagctgagctcctgcagagccaggggagccaagctggcggaagccagacactgaaaagggacaaggaaaaaaaaaacaatccatggctatgtacagaatag

SEQ ID NO: 239976 - DNA, 1290 bp, Artificial Sequence
  Description of Artificial Sequence: Synthetic coding sequence
atggcagccacagatattgccagacaggtgggcgaaggctgtcgcactgttcccctagccggacacgtcgggttcgatagtttgcctgatcagctggtgaacaagtccgtgtcgcaaggcttttgtttcaatatcttgtgtgtaggagagactggtctgggaaaatcaacgctgatggatactctgttcaacacaaaattcgaaggcgaacctgccacccacacgcagcccggagtacaactgcagtccaatacctacgaccttcaggaatccaacgtcaggctgaaacttaccatcgtgagtaccgtggggttcggcgaccaaataaacaaagaagatagttacaagccgatagtggaattcatagacgctcagttcgaggcctatttacaggaggaactgaagatcaggagagttctccacacttaccacgatagccggattcatgtgtgtctgtattttatagcccctaccgggcattcactcaaatcactggacctggtcaccatgaagaagttggacagcaaagtgaacattattcctattatcgcaaaagccgatgccattagtaaaagcgaacttaccaagttcaagatcaagattacaagtgaattagtcagtaacggtgtgcaaatctatcaattcccaacggatgatgagagtgttgccgagatcaatggcaccatgaacgcccaccttccctttgccgttattggcagcacggaggagcttaagatcgggaacaaaatgatgagggccagacaatacccctggggaaccgtccaggtcgagaatgaggcccactgtgactttgttaaacttagggaaatgctgattagggtgaacatggaggatttaagagaacagacgcatacccgtcactatgagctctatagaagatgtaagctggaggagatgggattcaaggacacagatccggatagcaagcctttttccttgcaggagacctacgaggccaaacggaatgagtttctgggcgagttgcagaaaaaggaggaggagatgcgccagatgttcgtccaacgggtgaaggaaaaagaggccgagctgaaggaggccgagaaggagctgcacgaaaagtttgatcgacttaaaaaactgcaccaagacgagaaaaagaagctggaggataaaaagaaaagcttagacgacgaagtaaatgcctttaagcaaaggaaaaccgcagcggagctcctccaatcccagggatctcaggcaggagggtctcagactctaaagcgtgacaaagagaagaagaattttttttag

SEQ ID NO: 239977 - DNA, 1296 bp, Artificial Sequence
  Description of Artificial Sequence: Synthetic coding sequence
atggccgctaccgatatcgctaggcaagtcggagagggctgtaggaccgtgccactggccggacacgtgggattcgacagcctgccagatcagctggtcaacaagagcgttagtcagggattctgctttaatatcttgtgtgtcggcgaaactgggttgggtaaatcaactctcatggacactctcttcaatactaagttcgaaggcgaaccagctacacacacccagccgggtgtgcaactgcagtccaacacatacgacctccaggaaagcaatgtccggcttaagttaaccatcgtttcgacagtaggcttcggcgatcagatcaataaggaagattcttacaaaccaatagtcgaattcattgacgcgcagttcgaggcatacctccaggaggagctgaagatcagacgagttctccatacctaccatgattcaagaattcacgtgtgcctttactttatcgctcccactggccatagcctgaagtcacttgatcttgtgaccatgaagaaattggattctaaagtcaacataattccaatcatcgcaaaagccgacgcaataagcaaatctgaacttaccaagtttaagattaaaataacatccgaactcgtgtctaacggtgtgcagatctaccagttcccaactgatgatgagtctgtggcagagatcaacggaactatgaatgcgcacctcccattcgccgtgattgggagtactgaagagctgaagattgggaacaagatgatgcgagccaggcagtacccctggggcacagtgcaggtggagaacgaagcccattgtgactttgtaaagttgcgggagatgttaatccgggtgaatatggaagacctgagagagcaaactcataccagacactacgaattgtatagacggtgcaagttggaggaaatggggtttaaggatacggatcctgactcaaaaccttttagcctgcaagagacgtatgaagccaagcgaaatgagttcttgggagagctccaaaagaaggaggaggagatgcgacaaatgttcgtgcagagagtgaaggagaaggaagctgaactcaaggaagctgagaaggaactccatgagaagtttgatagactgaagaaactgcaccaggatgagaagaaaaaactcgaggacaagaagaagtcgctggacgacgaggtgaacgctttcaagcagcggaaaacggctgcggagctactgcagagccagggttctcaagctggcggttctcaaactttgaagcgggataaggaaaagaaaaacctaggattcttgtag

SEQ ID NO: 239978 - DNA, 1284 bp, Artificial Sequence
  Description of Artificial Sequence: Synthetic coding sequence
atggctgccacggatattgcacggcaagtgggagaggggtgcagaacagtacctctggcgggtcatgttggctttgatagcttgcctgatcagctggttaataagagcgtgagccagggcttctgttttaatatactgtgcgtgggtgaaactggcctgggcaaatcaacactgatggatactctgttcaacaccaaattcgaaggggagccagcaacacacacgcagccaggcgtgcaactgcaatccaatacctatgaccttcaggaaagcaacgtgcggctcaagctgactatcgtaagcaccgttggattcggcgatcagatcaataaagaggatagctataaaccaatcgtagagttcattgacgctcaatttgaggcctacctccaggaggagctgaaaataagaagagtgttgcatacataccatgactcgcggatccacgtttgtttgtatttcattgctcctaccggtcattctcttaaaagtctcgacctggtgactatgaaaaaactggactcaaaagtgaatatcatcccgatcatcgctaaggccgatgctatttccaagtcagagcttactaaatttaaaattaaaattactagtgaactagtgtcaaacggagtgcagatctatcagtttccaacagatgatgagtctgtggcggagattaatgggactatgaatgcgcacctcccttttgcagtgattggatcaaccgaggaactgaaaattggaaacaagatgatgcgggctcggcaatatccttggggcaccgtgcaggtggagaatgaggcccactgcgactttgtcaagctccgggagatgttgatccgggtgaacatggaggaccttcgggagcagacccacacaaggcactatgaactttacaggcgatgtaagctcgaagaaatgggttttaaggacaccgatccagactccaaaccattttccctacaggaaacctatgaggctaaacgcaacgagttcctcggggaactgcagaagaaagaagaagaaatgagacagatgtttgtgcagagggtgaaggagaaagaggccgaactaaaagaagccgaaaaggaactgcatgagaaatttgacaggttaaagaagctgcatcaagacgagaagaagaagctggaggacaagaaaaaatcattagatgacgaggtcaatgccttcaaacagagaaagactgccgctgaactccttcaatcccagggtagtcaggctgggggatctcagactctgaagcgcgacaaagaaaagaaaaattag

SEQ ID NO: 239979 - DNA, 1284 bp, Artificial Sequence
  Description of Artificial Sequence: Synthetic coding sequence
atggccgctaccgatattgcacgacaagtgggcgagggatgtaggaccgtaccattggccggacacgttggatttgactctctgcctgaccaactagtaaataaaagtgtgtctcagggcttttgcttcaatatcttatgtgtcggagaaaccggactgggaaagagtacgctgatggatacactcttcaataccaagttcgagggggaacctgctacccatacacagcccggtgtccagctacagtccaacacatatgatttacaggaatcgaacgtccgtctgaagctcactattgttagcacagtgggattcggagatcagattaataaagaagactcatacaagcccatcgtcgagttcatcgatgctcagttcgaagcctatttacaggaggagctgaaaattaggagagtgcttcatacttatcacgatagtagaatacatgtgtgtctgtatttcatagctccaactggacacagtctgaagtctctggacttggttactatgaaaaagcttgactcgaaggtcaacatcatcccgatcatcgcaaaagctgacgcaatctccaaatcggaactcacgaagttcaagattaagatcacttcggaattggtgtcaaacggggtgcagatctaccagtttccaactgatgatgaaagcgtggctgagattaacggtactatgaacgcgcatctgccattcgcagtgatcgggagtaccgaagaactgaagattggaaataagatgatgcgggctaggcagtatccatggggcactgtgcaagtggaaaacgaggcacactgtgactttgtaaagctgagagagatgttgatccgagtcaacatggaggacttgcgcgaacagacgcatacaaggcattacgaactttatcggcgatgcaagctggaagaaatgggcttcaaagacacagaccccgacagcaagcccttctcactacaggagacgtacgaagcaaagcgaaacgagttcttgggggagctgcagaagaaggaagaagaaatgcgacagatgtttgtgcagagagtgaaggaaaaagaggccgagttaaaggaggccgagaaggagcttcatgaaaaattcgatcgtttaaagaaactacaccaggatgaaaaaaagaagttagaagataaaaagaagtccctggacgatgaggtgaacgcatttaagcagcgcaagaccgccgctgagttgctccagtcacagggatctcaggccggaggcagtcagactctgaagcgggataaagaaaaaaagaactag

SEQ ID NO: 239980 - DNA, 1110 bp, Artificial Sequence
  Description of Artificial Sequence: Synthetic coding sequence
atggacacattgtttaacacgaagttcgagggagagcctgcgactcacactcagcctggcgtgcagctgcagtcaaacacctatgacctccaggaaagcaatgtcaggttgaagctgaccatcgtgtccacggtcggatttggtgatcagatcaacaaggaggacagctataaaccaatcgttgaatttatagatgcccagtttgaggcttaccttcaggaggaactgaaaattagacgggtcctgcacacataccatgattctaggattcacgtgtgcctgtatttcatcgctccaacaggccattccctgaagagtttggatctggttacaatgaagaaattagattccaaggtaaatataataccaataatcgccaaggctgacgccatttcaaagagcgagctgaccaaattcaagatcaagatcaccagcgaattggtctctaacggcgtgcagatttatcaattccctacagacgacgagtcagtggccgaaatcaacgggacgatgaatgctcacctgccgttcgcagtgataggttcaaccgaagaattgaaaattggaaacaaaatgatgagagcccgacagtatccgtggggcactgtgcaggtcgagaatgaagcgcactgcgacttcgtgaaactccgggagatgctgatccgagtgaatatggaggatctgcgggagcagacgcacacaagacattacgaactgtatagacgatgcaagctggaagagatgggctttaaggatacggatcccgatagcaaaccatttagtttgcaagaaacttacgaggccaaaagaaatgagtttttgggcgagctacagaagaaagaggaagagatgaggcagatgtttgtgcagagggttaaggagaaagaggccgagctcaaggaggcggagaaagagctgcacgagaagttcgaccgcctcaaaaagttgcaccaggatgagaaaaagaagctggaggacaaaaaaaaaagccttgacgatgaagttaatgcttttaagcagcgaaagaccgccgctgaacttcttcagagccagggtagccaggccggaggtagccagactctaaagagagacaaagaaaaaaagaagtag

SEQ ID NO: 239981 - DNA, 1374 bp, Artificial Sequence
  Description of Artificial Sequence: Synthetic coding sequence
atggccgctacagacatcgcaagacaggtcttcggccgacgaaggctactcctactcggctttgagactgtcgggttttctgccgcatgtacagaggagggcggacatatgcttcgcaggggcgagggctgccgcaccgtgccactcgctggtcacgtagggtttgacagtctcccagatcaactggtgaataaaagtgtcagccaaggcttttgcttcaatatactctgcgttggtgaaaccggtctggggaagtctaccctcatggacaccctgtttaatactaagttcgagggggaaccagctacgcacacacagcctggtgtgcagcttcagagcaatacctatgacttgcaagagtccaatgtgcgtctcaagctgacgatcgtaagcactgtcggtttcggtgaccagattaataaggaggattcgtataaacctatagtcgagtttattgacgcacagttcgaggcctatctccaggaagagctaaagattagacgggtgctacacacctatcatgactctaggattcatgtatgtctgtattttatcgcgcctactggccacagcctaaagagcctggatctggtaactatgaaaaagctggacagtaaggtgaacatcattcccatcatagcaaaagccgatgctatctcaaagagcgagctcacaaagtttaaaatcaagatcacaagcgagctggtctcaaatggagtacaaatttatcagttccccacagacgacgagtcagtagccgagatcaacgggactatgaacgcacatctgccgttcgcagtcataggctccacagaagaacttaaaatcggaaataagatgatgcgtgcacgccagtatccctgggggaccgtgcaggtcgaaaatgaggcacattgtgattttgtcaaattgagggaaatgctgattcgggtgaatatggaagatctacgtgaacaaacccacaccaggcactacgagctctatagacgatgtaaattggaggaaatgggcttcaaggacacagacccagattccaaacctttcagcctacaggaaacatacgaagccaaacgcaacgagtttctgggagaactacagaagaaagaagaggaaatgagacaaatgtttgtgcaacgggtaaaggagaaagaagctgagttgaaggaagccgaaaaggagctgcatgagaaatttgaccgacttaagaaactgcatcaggatgaaaagaagaagctggaagataaaaagaagtccctggacgatgaggtgaacgcttttaaacagcgcaaaactgccgcagagcttctgcagtctcagggctcccaggccggagggtcccagaccctgaaacgcgataaggagaagaaaaagtag

SEQ ID NO: 239982 - DNA, 1284 bp, Artificial Sequence
  Description of Artificial Sequence: Synthetic coding sequence
atggctgccaccgacattgctcgccaggtcggcgaggggtgtaggacggtgcctctggcaggtcacgtgggattcgactctttgcccgaccagttggtaaataaatcagtatcccagggattctgcttcaacatcttatgtgtgggtgaaactgggctgggcaaatccaccctcatggatacactcttcaacaccaaatttgaaggagaacctgccactcacacacagcccggagtccaactacagtccaacacttatgacctccaggagagtaacgtgagactcaagctcaccatcgtaagtactgtggggttcggagatcagatcaacaaagaggacagttacaagccaattgtggaatttatcgatgcgcaattcgaggcctacctgcaggaagagctgaaaattcgcagggttcttcacacgtatcatgacagcaggattcatgtctgtctttacttcatcgccccaactggtcacagtctgaagtctctcgatctggtaaccatgaaaaagttggactctaaggtcaacatcattcctatcatagctaaggccgacgcaattagcaaatctgagctgacgaaatttaagataaaaatcacatccgagcttgtatcaaatggggttcaaatctatcaatttcccacggacgacgagagtgtcgctgaaattaacgggacgatgaatgctcacctgcctttcgccgttatagggtcgaccgaggaactaaagatcgggaataagatgatgcgggcacggcaatatccttggggtactgttcaagtcgaaaatgaggcgcattgcgatttcgtgaagctgcgtgagatgctgatcagagtgaacatggaggatctcagagagcaaacgcataccagacactatgagctctaccggcgatgcaaactcgaagagatgggattcaaggatacggacccagactcaaagccattctcactccaggaaacctatgaggcaaagaggaacgaattccttggcgagttgcagaagaaggaagaagagatgagacaaatgtttgtgcagagggtcaaagaaaaagaagccgaactcaaggaagccgagaaagaactgcacgaaaaatttgatagactgaagaagctgcaccaggacgaaaagaaaaagctagaggacaagaagaagagtctcgatgacgaagtgaacgcatttaaacagcggaaaaccgcagctgagctgctgcaatcccaaggctcacaggctggagggagtcagacactaaagagggataaggagaagaagaattag

SEQ ID NO: 239983 - DNA, 804 bp, Artificial Sequence
  Description of Artificial Sequence: Synthetic coding sequence
atggccgcaacagacattgccagacaggtaggggaaggatgtcgcactgtaccgctggcgggacatgtcggttttgatagtctgccagaccaactcgtaaataagagcgtgagccaggggttctgttttaatatcctgtgcgtgggcgagacaggactcggcaagagtaccttgatggataccttatttaatacaaagttcgagggcgagccagccacacacactcaacccggagtgcaactgcaatcaaatacctatgatctacaggaatccaacgtgcgactgaagctgacaattgtttctaccgtgggttttggcgaccaaattaacaaggaggatagctataagcccatcgtagagtttatcgacgcccagttcgaagcttacctgcaggaggagttgaagattaggcgagttcttcacacgtatcacgatagcagaattcatgtgtgtctgtacttcatcgcacctactggacactctctgaaatctctcgatctggtgaccatgaaaaaacttgacagtaaagtgaatatcataccaattatagcgaaggccgacgctatcagtaagtcagaacttacaaaatttaaaatcaagatcactagtgagctcgtctctaacggagtgcaaatataccagtttccaactgacgacgagtctgttgcagaaatcaatggcaccatgaatgcccacttgccattcgctgtgataggatctacagaggagctgaaaatcggcaacaaaatgatgcgcgctagacagtatccatggggaacggtgcagggtagtagccaggtttag

SEQ ID NO: 239984 - DNA, 1452 bp, Artificial Sequence
  Description of Artificial Sequence: Synthetic coding sequence
atggctgccactgatttggagagattcagtaacgcggagcctgagcccaggagtttgagtttgggaggccatgtgggcttcgattcactccccgaccagctggtatctaaatccgtcactcaggggttctcatttaacatcttatgtgtgggggagactggtatcggtaaatccacccttatgaacactctgtttaacacaactttcgagaccgaggaggcgtcgcatcacgaggcttgtgttaggctgaggccacagacctatgatctccaggagtctaatgtccaactgaagctgaccatcgtcgacgccgtgggatttggggaccaaattaataaagacgagagctatcgcccaattgtggattacattgacgcacaattcgaaaactacctgcaggaagagctgaaaattcgtcgctccttgttcgattatcatgatacccgaattcatgtctgcctgtacttcattacccctacgggacactctctaaagagtcttgatctggttacaatgaagaagctggacagcaaagtgaacatcatcccaatcatcgcaaaagcagacaccatctccaagagtgagctgcataagttcaagattaagatcatgggggaactggtgtcaaatggcgtgcagatttaccaatttccgaccgatgatgaagcagtggccgagataaatgcggtgatgaacgcacaccttccatttgcagtggtgggctccaccgaagaagtaaaggtgggaaataagttggtgagggctcgtcagtatccttggggagtagtccaggtcgagaacgaaaaccattgcgactttgttaagctgcgtgagatgttgatccgcgtgaatatggaagatctacgggagcagacacactctagacactatgagctgtataggaggtgcaagttggaagagatgggatttcaggactccgacggagattctcaaccgttttcgctccaggaaacctacgaagcaaagcgtaaggagttcctcagcgaactgcagcgcaaagaagaggaaatgaggcaaatgttcgtcaataaggtgaaggagactgagctggagctgaaagagaaggagcgcgagttgcatgagaagttcgagcacctgaaaagggtgcaccaggaggaaaaacgcaaggtcgaggagaagcgtcgggaactggaggaggagactaacgccttcaacagaagaaaggcagcggtggaggctctgcagagccaggccctccatgcaacctctcaacagcccctccggaaggacaaggacaagaaaaataggagtgacatcggtgcccaccagcctgggatgtccctaagctccagcaaagtaatgatgaccaaggcgtccgttgagccgctgaactgctcttcttggtggccagctatacagtgctgcagttgcttggtccgggatgctacttggcgggagggttttttgtag

SEQ ID NO: 239985 - DNA, 1110 bp, Artificial Sequence
  Description of Artificial Sequence: Synthetic coding sequence
atgaacaccttattcaatacaactttcgagacagaggaagcttctcatcacgaggcttgcgttcgtctacgcccacagacctatgatctgcaggagagcaacgtccaactcaaactgacaatcgtggacgcagtgggcttcggcgatcagattaacaaggatgagagctaccgccctatagtcgattacatcgacgctcagtttgagaactacctgcaggaagagctaaagatcaggcggagcctgttcgattatcacgatacccgcatccatgtgtgcctgtattttatcacgcctaccggtcattctctcaagagccttgatctcgtcactatgaagaagctggacagcaaggttaacataattcctatcatcgctaaagctgatactattagtaaaagcgagctccacaagttcaaaatcaagattatgggagaactggtgtccaacggcgttcagatttaccagtttccgacggatgacgaggctgtggcagaaatcaatgctgtgatgaacgcccacctaccattcgcagttgtaggctctactgaagaggttaaagttggaaacaagctggtccgcgcacgccagtacccttggggcgtcgtgcaagtagagaacgaaaaccactgcgatttcgttaaactaagagagatgctgatcagagttaatatggaagacctgagggagcaaacccactcaaggcattacgagctgtatcgcagatgcaagttggaagagatgggtttccaggactctgacggagactcccagcccttttcccttcaagagacctacgaagctaaacgcaaggagtttctctccgagttgcagaggaaagaagaggagatgaggcagatgttcgtaaataaggtcaaggaaaccgaactggagcttaaggaaaaagagcgggagctgcatgaaaagttcgagcacctgaagagagtgcatcaagaggagaagagaaaggtcgaagagaagaggagagaactggaagaggaaactaatgcatttaatcgcaggaaggccgctgtggaggctctacaatcacaggcacttcatgcaacctcccagcagcccctgaggaaggataaagacaagaagaattag

SEQ ID NO: 239986 - DNA, 1290 bp, Artificial Sequence
  Description of Artificial Sequence: Synthetic coding sequence
atggctgccaccgacctggagagattttctaatgcagagcccgagcccagatccctgagcctgggcggtcacgtgggctttgacagtctgcctgaccagctggttagtaaaagcgtgacccaggggttcagcttcaacatactgtgtgttggagagaccggtatcgggaagtcaaccctgatgaacaccttgttcaacacaactttcgagacagaggaagcgagccaccacgaggcgtgtgtcaggctgaggcctcaaacgtacgacctgcaggaatctaatgtgcagctcaagctgacaattgtcgatgctgtggggttcggagatcaaatcaataaagacgaaagttatcgcccaatcgtcgattacattgatgctcagtttgaaaactatctccaggaggaactgaagataagaaggtccctgttcgactaccatgatacaaggatccatgtctgtctttattttatcacccctaccgggcattcactgaaatcgctggatctggtgaccatgaagaagttagactccaaggtcaatatcatacccataattgcaaaagccgataccattagtaagagtgaactgcacaaatttaagatcaaaatcatgggagaactcgtctcaaatggcgtccagatttatcagtttcctacagatgatgaagcagtagctgagattaacgctgtcatgaatgctcatctccctttcgctgttgtgggctctacagaggaggtgaaggttggaaacaaacttgtgagagcccgtcagtacccatggggagtcgttcaggtggagaatgaaaaccactgtgacttcgtcaagctcagggagatgctgatcagagtaaacatggaggacctgcgggagcaaacccacagcagacattacgagctttataggagatgcaagttggaggaaatgggcttccaggacagcgacggagatagccagcctttctccctacaggaaacttacgaggcgaagcggaaggaatttctgagtgaacttcagcgaaaggaggaagagatgcgtcagatgtttgttaacaaagttaaggagactgagttagaactgaaggagaaggagcgagaactccacgagaaattcgagcacctgaagcgcgttcaccaggaggagaagaggaaagttgaagagaagagaagggaacttgaagaggaaacaaatgcatttaaccgaaggaaggcggctgttgaagctctgcagtcacaggccctacatgccaccagccagcagcctctcagaaaggataaggataagaaaaactag

SEQ ID NO: 239987 - DNA, 1329 bp, Artificial Sequence
  Description of Artificial Sequence: Synthetic coding sequence
atggccgctactgacctcgagcgcttctctaacgctgaaccggagccgaggtcgttatccttaggagggcacgtgggctttgattctctgccagatcagctggtgagtaagtcagtaacccagggcttttcgtttaatatcctctgtgttggtgaaactggaataggcaagagtacacttatgaacacattgtttaacacaacttttgagactgaagaggcttctcaccatgaagcttgcgttcggttgcgccctcagacgtatgatctgcaggagagtaatgtgcaacttaagctcactatcgtcgatgccgtaggatttggagatcagataaataaagacgaatcgtaccgtccaatcgtagactatatagacgcacagtttgaaaactacctccaggaagaactaaagatccgccgtagcctcttcgattatcatgacacacggatccacgtatgcctgtattttatcaccccaaccggacattccctcaagagcctggatcttgtgaccatgaaaaagcttgactctaaagtgaatataattccaataatcgctaaagcagacacaatcagtaagtcagagttacacaagttcaagattaaaatcatgggtgagctagtctctaatggcgtgcagatctatcagttccctaccgatgacgaggcagtcgccgagatcaatgccgtgatgaacgcccacctgccctttgcagtggtaggatcaacagaagaggttaaggtgggtaataagctagtcagggcacggcagtatccttggggggttgtgcaagttgagaacgagaaccactgcgacttcgtgaaacttagggaaatgttaattagagtgaatatggaagatctgagggagcaaacccactctcgacattacgagctatatcgcaggtgcaagctggaggaaatggggttccaagattccgatggagactctcagcccttctccctacaggagacatacgaggccaagcgcaaagagttcctttctgaacttcagcggaaagaggaagaaatgagacaaatgtttgtgaataaagttaaagagacagaactcgagttgaaggagaaagagagagagttgcacgagaagttcgagcacctgaaaagagtccatcaagaggaaaaacggaaggtggaagagaagcggcgtgagctggaggaagaaaccaatgcctttaaccgacggaaggcggcagttgaggcgctccaatcccaggccctacatgccacctcacagcaacctctccgcaaggacaaggacaagaagaaggcctctggctggtctagtatttatagcgtcaccatcccatag

SEQ ID NO: 239988 - DNA, 1707 bp, Artificial Sequence
  Description of Artificial Sequence: Synthetic coding sequence
atggagagagaccgaatttcagccttaaaacggagctttgaagtggaagaagtagagactccgaattcaactccacccagacgcgtccagactcccttgctccgagcaactgtggccagctccacgcagaaattccaggatctgggagtcaagaatagtgagccatctgcacgtcacgtcgattcactgtctcagaggagccctaaggcaagtctgagacgcgttgagctgtctggaccaaaggccgcagagcccgtgtctcggaggacagagctgagcatcgatataagctccaaacaggttgagaatgctggagctatcgggcctagcaggttcggcctcaaacgggcagaagtgctaggacacaaaactccagagccggctcctcggaggaccgagatcacgatcgttaagcctcaggagtcggctcataggcgaatggaaccgccagccagcaaagtacccgaagtcccgacagctccagccacagatgctgctccaaaacgcgtcgaaattcaaatgcctaaacctgctgaggcgcctactgctccctcgccggcacagactctcgaaaatagtgagccggcaccggtgtcacagcttcagtcacgactcgagcccaagccacagcctcccgtcgccgaggctacccccagatcccaagaggccactgaggccgcaccctcttgtgtcggagacatggccgacactcctcgagatgccggactaaaacaggccccagcgtcccgcaatgaaaaggcacctgttgattttggttatgtcggaatcgacagcatactggaacagatgcgccgaaaggctatgaaacaaggcttcgaattcaatataatggtggtcggtcagtccggcctaggtaagtcaaccctgattaatacattgttcaagagtaagatatcaaggaaatccgtgcagcctaccagtgaggagcgcattccgaaaactatagaaatcaagtctatcactcatgatattgaagaaaagggggtaagaatgaaactcactgtgatcgatacaccgggattcggggatcacattaataatgagaattgctggcagccaatcatgaaatttataaatgaccagtacgaaaagtatctacaggaggaagtaaacatcaatagaaagaagcggattccggatactagagtgcattgctgcctgtattttatccccgcaacaggtcactctcttcgccctctggatatcgaattcatgaagcgcctgagcaaggtggtcaacatagttccagtcatcgcaaaggccgatactttgactctcgaagaacgagtccacttcaagcagagaataactgcggatcttctttcaaatggtatcgatgtgtacccacaaaaggaatttgatgaggattccgaggacaggttggtaaacgaaaagttcagagagatgatcccttttgcagtagtcggcagcgatcacgaatatcaggtaaacgggaaacggatccttgggagaaagacaaaatggggcactattgaggtggagaataccactcactgtgaattcgcatacttgcgggacctgctcatccggacacatatgcagaatatcaaagatatcacctcctccatccactttgaagcttaccgtgtaaagcggctcaatgagggctcttctgcaatggccaatgggatggaggaaaaggagccagaggcgccagaaatgtag

SEQ ID NO: 239989 - DNA, 591 bp, Artificial Sequence
  Description of Artificial Sequence: Synthetic coding sequence
atggcagacactccacgcgatgctggcctcaagcaggctcccgctagtagaaacgagaaggctcccgtcgatttcggatacgtgggaatcgactccattctcgaacagatgagaagaaaggcgatgaagcagggattcgaatttaacataatggttgtgggccagagtggcctcggcaagtcgactctgatcaacacacttttcaaatccaagatctcccggaagagcgtgcagccaaccagcgaggaacgcatacccaaaacaattgagataaagtcaatcacccacgatatcgaggagaagggagttcggatgaagcttaccgtaatcgacacgcctggatttggcgatcacatcaacaacgagaattgttggcagcctataatgaaatttataaacgaccagtacgagaagtatctgcaagaagaagttaatatcaatcggaaaaaaaggatacctgacacacgcgtgcactgttgtctatacttcattcccgctacaggacattccctgcccctgttagagcagaaggtccctctttctcagccctccgcagattgcctggccagatgcggtgacagactggagtag

SEQ ID NO: 239990 - DNA, 1740 bp, Artificial Sequence
  Description of Artificial Sequence: Synthetic coding sequence
atgagcgaccccgcagttaacgcccagctcgatggcattatcagtgattttgaggccctgaaaaggtcattcgaagtagaagaggtcgagactcctaactctactcctccacgaagagtacaaactccactgttaagagctaccgtggcttcctccactcagaaattccaggacctgggtgtgaaaaattccgaaccatcagcacgccatgtggactctctaagccaacgctccccaaaagcctcattgaggcgggtggagctgagcggccctaaggccgctgagcccgtctcacgccgaacagagctatccattgatattagcagcaagcaggtcgagaatgccggagcaatagggccaagtaggttcgggctcaaacgagctgaagtgctgggacataaaacaccagagccggctcctaggcggaccgaaattactattgttaagccccaggagtccgctcatcgtagaatggaaccacctgcctcgaaggtccctgaggttccaaccgcaccggcaactgacgctgctcctaagagggttgagattcagatgcccaagcccgctgaggcgcctacagccccttcccctgctcagaccctagaaaacagcgagcccgcaccagtgtctcagctccagtccagattggaacccaagcctcagccccctgttgcagaagccacccctcggagtcaggaggccacagaagccgctccctcatgtgtgggagatatggctgacacacctagggacgcgggtctcaaacaggcaccagcttcccggaatgagaaggctccggtggacttcggatacgtgggcattgactctatcctcgagcagatgaggcggaaggccatgaaacaggggttcgagttcaacatcatggtcgtcgggcagtcagggctcgggaaatccaccctcataaacaccctgttcaagtctaagatctcgagaaaatctgttcagcccaccagcgaagaacggatccccaagactattgaaattaagtccatcacccacgatatcgaagaaaaaggggtgagaatgaagcttacagtcatcgacacccccggattcggcgatcatattaacaacgaaaactgttggcagcccattatgaaatttattaatgatcagtacgagaagtatcttcaagaggaggtaaacatcaaccgcaagaagcgtataccggacactcgggtgcactgttgtttgtattttattcctgctacaggacattctctcagaccactcgatattgaatttatgaaacgcctttcaaaagtcgtgaatatcgtaccggtcatcgcaaaggcagacaccctcactcttgaagagagagtccacttcaagcagcgtatcaccgccgacctgctcagcaatgggattgatgtctatccacagaaagagtttgacgaagattctgaggatcgactggtcaatgaaaaattccgagagatgattcctttcgccgtggtagggtccgaccacgagtatcaggtgaatgggaagaggattcttggcaggaagaccaaatgggggactattgaggtagagaacacaacacattgcgaattcgcttatctgagggacctgttgatccgcacccacatgcagaacatcaaggatatcactagcagcatacacttcgaggcatatagggttaaaaggctgaatgagggctctagcgcgatggctaacggaatggaggagaaggagccagaggcccctgaaatgtag

SEQ ID NO: 239991 - DNA, 1761 bp, Artificial Sequence
  Description of Artificial Sequence: Synthetic coding sequence
atgaaaaagagctattctggaggcacaagaaccagctcaggccgactgagacgcctgggcgacagctctggccctgccctgaaaagaagctttgaagttgaggaggtggagactccaaacagcacacctcccagacgcgtgcagacacctttgctccgggctaccgttgcctcttccacccagaagtttcaggacctgggcgtaaagaattcggagccgagcgctcgacacgtagacagcctgtcccagcggagtcctaaagcaagcctgcggcgagtggaattatccggtcccaaagcggcagagcctgtgtccaggagaacagagctgtccattgacatttccagcaagcaagtcgagaatgcaggcgctattggtccctctagatttggactaaagcgcgcagaagttttaggccacaaaacacccgaacccgctccccgacgaaccgaaatcactattgtcaaaccccaggaatccgcgcacagacgaatggagcctcccgcttccaaggttccggaggtgccaactgctcctgccacggacgcagctccaaaacgagtcgagatccagatgcctaagcccgctgaggcccctaccgctccaagtcccgcacagacgctggaaaactctgagcccgctcctgtttcccaactgcagtctcgtctggaacccaagccccagcctcccgtcgctgaggctactccacgctctcaggaagcgacagaggctgctcctagctgcgttggagatatggcagatactccccgagacgctggtctcaaacaggcccctgccagtcggaatgagaaggcccctgtggatttcggctacgttggcattgacagtattttggagcagatgaggaggaaggcgatgaaacagggcttcgaatttaacattatggtggtggggcaaagtggcctgggaaagtccacacttataaacaccctgtttaagagtaagatcagtagaaagagcgtacagccaaccagcgaggaaaggatccccaaaacaattgagatcaagtctatcacccacgacatcgaggagaagggtgtgcgcatgaagcttacggtgatagacacaccagggtttggggaccacatcaataatgagaactgctggcagcctattatgaagtttatcaacgaccagtacgagaagtacctgcaggaggaagtgaacatcaatcggaaaaagaggataccagatacaagagtccactgctgtctatattttatccctgccaccggccattccctacggccactagacatcgagttcatgaagcggctgagtaaagttgtcaacatcgtgccagtcattgctaaagctgacaccttgactctggaggagcgcgtgcacttcaagcaaaggattacagccgatcttctatcaaatgggatagatgtgtacccccagaaggaatttgatgaggacagcgaagatagactcgtgaacgagaaatttagggaaatgataccattcgctgtcgtcggttcagatcatgaataccaggtaaacgggaagagaatcctcgggagaaaaaccaagtggggcactatcgaggttgagaacaccactcattgtgagttcgcctacttgagggacttgctaatccggactcatatgcagaatattaaagatattacttctagcatccatttcgaagcctatagggtgaagcgcctgaacgaggggtcctcagccatggccaatggtatggaggagaaggagccagaggctcccgagatgtag

SEQ ID NO: 239992 - DNA, 1425 bp, Artificial Sequence
  Description of Artificial Sequence: Synthetic coding sequence
atgggatctagcttttgggagggcctacaggtcgcagtgggactgccacaaggttgctggccgcagggcttagatagcggcgaacccgctgaggggggacagttggaagctgccccagtgtgcattgtcacacgtcagagcaaggaaaccgctggtcccactttgggtcgaggtggttggcggcaggggtctctgcgcaggggcaagggcacttcctgcagatgccgccaacttagtcccggacacgggcctgggaggctgacaggctgtggggagtgccatcgactcccttgcaggggcttggtatctggatttactggcctacgcggtcaggaggaggatgacctcgctttttgtctggcaacaattggttctgacagacaggcgactgaggcagctcccagctgtgtgggggacatggcggataccccaagggatgccggactgaaacaggcgccagcaagtcgcaacgagaaagcacccgtggattttggatatgttggtatcgatagtattttggagcagatgcgccgtaaagccatgaagcagggcttcgagttcaacatcatggtggtcggccagtctggcctcggaaagagtaccctcatcaacactctattcaagtctaaaatatccagaaaaagtgtgcagcccacctccgaagaaaggattcctaagaccatcgaaatcaaaagcattacgcacgacatcgaggaaaaaggcgtccgcatgaaactaacagtgatagacactcctggcttcggtgaccacatcaataacgagaattgctggcagcccatcatgaagtttatcaacgaccagtacgagaaatatctgcaggaggaggtgaacatcaacagaaaaaagcggattcctgataccagagtacactgctgcctctacttcatccctgccaccggtcactctctacgccctcttgacatcgaattcatgaagcggctaagtaaggttgttaacatcgtgcccgtgatagccaaggccgatactttgacgctggaggaaagagtccactttaagcaacggattaccgccgaccttctgtcgaacggaatcgacgtgtacccccaaaaggagtttgatgaagattctgaggataggttggttaatgaaaagttcagagagatgatacccttcgccgtcgtggggagtgaccatgagtaccaggtaaatggaaagagaattcttggaaggaaaacaaagtggggaacaatcgaggtcgaaaacaccacccactgcgagtttgcttatttacgcgatttgctgatacgaacccacatgcagaatatcaaggacattacatccagcattcactttgaggcctatcgagtgaagcgactcaacgagggaagttctgctatggccaatgggatggaggagaaagagcccgaggctccagaaatgtag

SEQ ID NO: 239993 - DNA, 1269 bp, Artificial Sequence
  Description of Artificial Sequence: Synthetic coding sequence
atggagccacctgcctcaaaagtgccggaggtccctactgcacccgctacagacgccgctcccaaacgcgttgaaattcagatgccaaaaccagccgaagcccctacagccccaagcccagctcaaacactcgagaatagtgagcccgcacccgtctcccagctccaatctcgcctagagccaaaacctcaaccgccagttgccgaagcgactccacggtctcaagaagctactgaggcagcacccagctgtgttggggacatggccgacaccccaagagatgccggattgaagcaggccccagcgagccgcaatgaaaaggcaccagtggattttggctacgtaggaatcgatagcatactggaacagatgagacgcaaggcaatgaaacaaggcttcgaattcaacatcatggtggtcggccaaagtggattagggaaatcaacccttatcaataccctcttcaaaagcaaaatatcccgcaagtccgtgcaaccaacatcagaggagcgcatccccaaaaccattgaaatcaaaagcatcacacacgacattgaagagaagggggtccgcatgaagctcaccgtaatagatactcccggtttcggagatcatattaataacgaaaattgctggcaacctatcatgaagttcattaatgaccaatacgaaaagtaccttcaggaggaggtcaacatcaatagaaaaaagaggatcccagacaccagggtgcattgttgtctctacttcatcccagctactggtcactctctcaggcccctcgacattgagttcatgaagagattgtcaaaggtagtcaacattgtgcctgtgatagctaaggccgacactcttacgctggaggagagggttcatttcaagcagaggatcacagcagacctgctgagtaacggcatcgacgtgtacccacagaaagagtttgacgaagacagtgaggaccgccttgtaaacgaaaagtttcgagaaatgatcccttttgcagtggtggggagtgatcatgagtatcaggtaaacgggaagcggatcctggggagaaaaacaaaatggggaactatcgaagtggaaaacacaacacactgtgagtttgcgtatctgcgtgatttgctgattcggacacacatgcagaacatcaaggatataacatcgagtatccattttgaggcatatcgggtaaagcgactgaacgagggcagctcagcgatggccaatggtatggaggaaaaagagcctgaggctccggaaatgtag

SEQ ID NO: 239994 - DNA, 1008 bp, Artificial Sequence
  Description of Artificial Sequence: Synthetic coding sequence
atggctgacacgccaagggacgcaggccttaagcaagcacccgcatctcgaaacgaaaaggccccagtggattttggctatgttgggatagactctatcctggaacagatgcgacgcaaggccatgaaacagggattcgagtttaatattatggtggtaggccagtcaggactgggcaaatcgacactcatcaacactctgttcaagagtaagatttctcggaaaagtgtacagcctacttctgaagagagaatccccaaaaccatagagatcaagtcaatcacccacgatattgaggaaaaaggggtacggatgaagttgactgtgattgatacccctggattcggtgatcacattaataacgaaaattgttggcagccaatcatgaaatttattaacgatcagtacgagaagtacctccaggaggaggtgaacattaataggaaaaaaagaattcctgacacgcgtgtgcactgctgtctgtacttcattcctgccaccggccactctctgcgaccactggatatcgaattcatgaaaagactgtccaaagtggtaaacattgtgccagtcatagcgaaagcagataccctgaccctggaagaaagagtgcatttcaagcagaggatcactgctgatttgcttagcaacggaatagatgtataccctcaaaaagagtttgatgaggattccgaagatcgactggtcaacgagaagtttagggagatgatcccctttgccgtcgtggggtctgatcatgaatatcaggtcaacgggaagcgaattttgggcagaaagacaaaatggggaactattgaagtggagaacacaacacattgtgaatttgcctacctcagagatctcttgatccgtacgcacatgcaaaatataaaggatattacaagttccattcacttcgaggcctaccgagtaaagagactgaacgaggggtcatccgcaatggccaacggcatggaagagaaggagcccgaagcgcctgaaatgtag

SEQ ID NO: 239995 - DNA, 1269 bp, Artificial Sequence
  Description of Artificial Sequence: Synthetic coding sequence
atggagccgccagcttctaaggttcccgaggtgcctacagcccctgccactgatgccgctccgaagcgagtcgagattcagatgccaaaacctgccgaggcgccaaccgctccatctcctgcacagacgctggagaattccgagcccgcacctgtcagccagctgcagagtaggctcgaacctaagccgcagccgcctgtggcggaggccacccccaggagccaggaagcaactgaagcagctccctcttgcgtgggagacatggctgacacccccagagacgccggattgaagcaggctccagccagtcgaaatgagaaggcacctgtggactttgggtatgtcggaatagactcaattctggaacagatgcggagaaaggcgatgaaacaggggttcgaattcaacattatggtagtgggccaatctggcttaggcaaatccacgctgattaatactctgtttaagtcaaagatcagtaggaagagcgtgcagcctacttctgaagagcgcatccctaagactatagagattaagtcaatcactcatgatatcgaggaaaagggcgttaggatgaaactcacggttattgacacaccaggttttggtgaccatattaataatgagaactgttggcagcctattatgaaattcattaacgaccagtacgaaaaatacttgcaggaggaagtgaatatcaatcggaaaaagaggattcccgacaccagggttcactgttgtctttatttcataccggcaaccggccattctctccggccactggatatagaattcatgaagagactgtctaaagttgttaacatcgtgcccgtgattgcaaaagccgacaccttgactctggaggaacgagtgcacttcaaacagagaataacggccgatctcctctctaacgggatcgacgtttatcctcagaaggaattcgacgaagatagtgaggatcgtttggtcaacgaaaaattcagagaaatgatcccctttgccgttgtgggtagcgatcatgaataccaggtcaacgggaaaagaatcctcggcagaaaaacaaaatggggaacaattgaagtcgagaatacgacacattgtgagtttgcctatctgagagatctgctgataaggacccatatgcagaatatcaaggacattacctcatccattcacttcgaagcctaccgcgtcaaaagactaaatgagggcagttctgctatggccaacgggatggaagaaaaagagccagaggcccctgagatgtag

SEQ ID NO: 239996 - DNA, 1089 bp, Artificial Sequence
  Description of Artificial Sequence: Synthetic coding sequence
atggccggagctgggtgtaccgggacatggagctggttgtgggggacggcgacagaggcagcccctagctgcgtcggggacatggccgatactccaagagacgctggtttgaagcaggcacctgcctccagaaacgagaaagcccctgttgactttggctacgtaggcatagactccatactcgaacagatgagacggaaagctatgaaacagggcttcgaattcaacattatggtcgtgggacagtcaggcttgggcaaatctaccctcattaacacactctttaaatcaaagatcagccgcaagagcgtgcagccgactagcgaggagcggattcccaagaccatagagattaaaagcattacccatgatatcgaagaaaaaggcgttcgcatgaaactgacagtgattgacactccgggtttcggcgaccatatcaataacgaaaactgctggcagcctataatgaagtttatcaatgatcagtatgagaagtacctccaggaggaggtgaacattaaccgtaagaaaaggatccccgatactcgcgtgcattgctgcctatactttatcccagccaccggccacagcctccgcccactcgacatcgagtttatgaagcgcctgagtaaagtggtaaatatagttcctgtgattgctaaagcagatacactgactcttgaggaaagggtgcatttcaaacagcggatcacagcagacctcctctcgaatggcatcgatgtctacccacaaaaagaattcgacgaagactccgaagacagactagttaacgaaaagttccgcgagatgatccccttcgccgttgtgggtagcgatcatgaataccaggtaaacggaaagcggatcctcgggagaaagaccaagtggggcacaatcgaggtggaaaacactactcattgcgaattcgcatatctccgagacctcttaatcaggactcatatgcaaaatattaaggacatcaccagttctattcacttcgaagcctaccgggtaaaaaggctgaatgaaggtagctccgccatggcgaacggaatggaggaaaaagaacctgaggcacccgaaatgtag

SEQ ID NO: 239997 - DNA, 582 bp, Artificial Sequence
  Description of Artificial Sequence: Synthetic coding sequence
atgaccctgtgtcctcaggcctggctgcctgagggtagcgaagagcagctccggtgcgctgaccacccaagttgtggggtgctgagcgccggaccctggggaggaggacaggcttcgcatcttcagcgaagccccgtaggatgtaccttgccgtcgattccgatcggacccgtgccctggtctgtgagcgagcccagaggcgaatgttccccaccaggagcacccggacctcccgcaaggcacatggtatggcctagtctgtctccctatccctgccccgcacctaagggtcgcaagctgcagggccctttacccccaaccgcacagcctctccaggctccatggcaattgcctctgctagaacaaaaggtgcccttaagtcaaccctctgcagactgctggccagatgccggaacgggatggaacgagggtggtgtcttcatctctcttccttctccctctcacgccacgccagcacctaccggcctgcaggtgctgctcatgcgctgggatcttatcgaagacaaaaaggaaggggagatgacacccacccccagctcaccatcattcgagaaggtctag

SEQ ID NO: 239998 - DNA, 1071 bp, Artificial Sequence
  Description of Artificial Sequence: Synthetic coding sequence
atggctatgtcttacgtcaaggatgatatctttcggatctacattaaggaaaaaaaagagtgtagacgggaccaccgcccaccttgcgcacaagaagcgccacgtaacatggtgcaccctaacgtgatctgcgatggttgtaatgggccagtagttggaaccaggtataagtgtagcgtctgccctgattacgacctttgttcagtgtgcgaaggaaaaggactccaccggggtcacaccaagctggccttcccatctcctttcggccatttgtctgagggattttcccactcacggtggctgcgaaaagtgaagcatgggcatttcggttggcctggctgggaaatgggccctcctgggaattggagtcccagacccccaagagccggagaggccaggcctggaccaacagctgagtccgcgtccggacctagcgaggacccaagtgtcaatttcctcaaaaacgtgggggaaagcgtggctgccgcactgagcccgctcgggatcgaagtggacatagatgtcgagcacggtggcaaacggagcaggttgacccccgtaagtccggagtcaagttcaacagaggagaagtcttctagtcagccttcgagttgttgctctgacccctccaagcctgggggaaacgttgaaggggcaacacagtcactggctgagcagatgagaaagattgccttggaaagtgagggacgccctgaggaacagatggaaagcgataattgcagcggcggtgatgacgattggacgcatttaagctccaaagaggtggaccctagcactggagaactgcagtctctgcagatgcctgaatcggaaggcccttcaagcctggatcccagccaagaaggtcccaccggtctgaaagaagccgctttgtaccctcaccttccgcctgaagctgacccccgactcatcgagtccctttctcagatgctcagtatgggatttagcgatgaaggtggttggctgacccggctgctccagacgaagaactatgacatcggagcagcactggataccatccagtatagtaaacaccccccaccactgtag

SEQ ID NO: 239999 - DNA, 1071 bp, Artificial Sequence
  Description of Artificial Sequence: Synthetic coding sequence
atggccatgtcctatgtgaaggacgatattttcagaatatatattaaggagaaaaaggaatgcagaagggatcatcgccctccttgcgctcaagaggctccaagaaacatggtccacccgaatgtgatttgtgacggctgtaatgggcctgtggtcggtacacgctacaaatgtagtgtttgcccagactatgatctctgtagcgtctgcgagggaaaggggctgcatcggggacatacaaaattagcattcccctccccatttggtcacctgtctgaaggatttagccacagtagatggctgagaaaggtgaaacatggtcatttcggatggccaggctgggaaatgggccctccaggcaactggagcccgagaccacctcgcgctggtgaggccaggcccggtcccaccgccgaatccgcatctggacctagtgaggatcccagcgtgaactttctgaagaacgtcggggagtcggtggcagctgccctgtctcccctgggaatagaggtggacattgatgtcgagcacgggggtaagcgctctagactgaccccagtgtctcctgaaagcagctccaccgaagagaagagctcctcgcagccgagtagttgttgttcggacccgagtaaaccagggggtaatgttgaaggtgcgacgcagtctttagcagaacagatgagaaagatcgcactggaatccgaaggccgaccagaagaacagatggaaagtgataattgcagcggcggagatgatgattggacccatctgagttctaaagaggtggatccaagcacgggagagctacagtctctccagatgcctgagagcgagggcccaagttctcttgatccaagtcaagaaggccctacaggactgaaagaagcggcattgtatccacacctgcccccagaggcagatccaagactcatcgagtcactctctcaaatgctgtcaatgggattctctgacgaaggtggatggctgacccgtcttcttcagaccaagaattacgacatcggggctgctctcgatactatccaatacagcaaacatcccccacccctttag

SEQ ID NO: 240000 - DNA, 1323 bp, Artificial Sequence
  Description of Artificial Sequence: Synthetic coding sequence
atggcatctctgacagtgaaggcatacctgctgggaaaagaggacgccgctcgtgagatacgccgatttagcttttgctgctcaccagaacctgaagccgaggcagaggccgcagccggtccaggaccatgcgaaagactactgtccagagttgctgcgttgtttccagctctgcgaccagggggtttccaggcacactacagagatgaagacggagacctcgttgccttttccagtgatgaggagttaaccatggctatgtcttatgtgaaggacgatatatttaggatatatatcaaagaaaagaaagagtgtcgtcgcgatcatcgtcccccatgcgcacaggaggcgccaaggaacatggttcatccaaatgttatctgtgacgggtgtaatggaccagtggttggcaccagatataagtgctcagtttgtccagattacgacctctgctctgtgtgcgagggcaaaggtcttcaccggggacacactaagctagctttcccgtcaccttttggacatctctccgaaggcttttcccatagcagatggctgagaaaagtgaagcacggacacttcggctggccgggatgggaaatgggtccacccggtaactggtcaccacggccaccaagggccggagaggcgagaccaggacctaccgcggagagcgcatctgggccttctgaagatccttccgtcaatttcctgaagaatgtgggtgaatccgttgcagccgctttatctcctcttggtattgaagtcgacatagacgtggaacacggtggaaagagatctcgcttaacccctgtcagcccggagtcaagcagtaccgaggagaagtccagcagccagccttcatcatgctgttctgacccttcaaagcctgggggaaatgttgagggcgctacacagagtctggctgaacaaatgaggaagatcgcgctggaatccgaggggcgtcctgaggagcaaatggaatccgacaattgttccgggggtgacgacgattggactcacctgagcagcaaagaagttgaccccagtactggcgaactccagtccctgcagatgccagaaagcgaggggccatccagcctcgatcctagccaggaggggccaactggactcaaggaggctgctctttacccgcatcttcccccagaagcagaccctagactgatcgagagcctctctcagatgctgagcatgggcttctccgacgaggggggatggttgactcgtcttctgcagacgaagaattacgacatcggagcagccttggatactattcagtacagcaaacacccgcctcccctctag

SEQ ID NO: 240001 - DNA, 1071 bp, Artificial Sequence
  Description of Artificial Sequence: Synthetic coding sequence
atggccatgtcatacgttaaggacgacattttccgaatctatattaaagagaagaaggagtgtcggcgagaccacaggcctccctgcgcccaggaagcccctcgaaatatggtgcaccccaatgtgatctgcgacgggtgtaatggcccagtagtgggcacaaggtataaatgctcggtatgtcctgactacgacttatgttctgtctgtgagggtaaaggcctccatagagggcacactaagctggcgttcccctcccctttcggccatctttccgaaggattttctcactctagatggctgcggaaagtcaaacatggacactttggctggccagggtgggagatgggccctcctggaaattggtcccctcgccctcctcgcgctggcgaggccaggcccggacctactgcagagtcagctagcggaccttctgaagacccttccgtgaattttctgaaaaatgtgggagagtctgtggcagccgcattgagcccactgggtattgaggttgacatcgatgtggaacatggcggaaagcgcagccggctgacaccagtcagcccagagagcagttctactgaggagaaaagcagctcccagcctagttcttgttgttccgacccttctaaaccaggcggtaatgttgagggtgccacccagtctctcgctgaacagatgcgcaagattgcactggagtctgagggcaggcccgaagaacagatggagtctgacaattgtagtggcggtgatgacgactggactcacctctctagtaaggaggtggatccttcaaccggagagttacagtccctacaaatgcccgaaagcgagggtccttcaagtttagatccctcccaggaaggacctaccgggttgaaagaggccgcactgtacccacacttaccccctgaggcagaccccagactgattgagtctttgagccagatgctgtctatggggtttagtgacgaaggaggctggctgacaaggctgttgcagaccaaaaactacgacattggtgccgctctcgatacaatccagtattctaaacatcctccacctctgtag

SEQ ID NO: 240002 - DNA, 423 bp, Artificial Sequence
  Description of Artificial Sequence: Synthetic coding sequence
atggccatgtcctatgtgaaagacgatattttccgcatctatatcaaggaaaaaaaggaatgtcgtagagatcacaggcctccgtgtgcccaggaagcccctaggaacatggtgcacccgaacgtgatctgcgatgggtgcaatgggcctgtggtgggcacaagatacaaatgcagcgtgtgtcctgactacgatttgtgttccgtgtgtgaggggaaggggctgcacaggggtcacaccaaactcgccttcccctcaccttttgggcacctgagtgagggctttagtcactcccggtggttgagaaaggtcaagcacggtcatttcgggtggcccggatgggagatgggcccacctggcaattggtcacctagacccccacgggctggggaagccaggcccggacccaccgctgagagctag

SEQ ID NO: 240003 - DNA, 891 bp, Artificial Sequence
  Description of Artificial Sequence: Synthetic coding sequence
atgacttcgagcgaaagcacacttaaaagaaaaaaaagtgccggaggaactacggcgcacagagtcctcaggaggcgacctttcgggcatctgagcgagggattctcacacagcagatggttacgaaaggttaagcacgggcattttggctggcccggttgggagatgggccctcctggcaattggtctccaaggcctccaagagcgggtgaggccagaccaggaccgactgcggagagtgcgtcaggtccctctgaggacccaagtgtcaacttccttaaaaacgttggcgaatcagtggcagctgcactatctccattgggtatcgaggtggatattgatgtggagcatgggggtaagaggagccgcctgacccccgtgagccccgagtcatcctctactgaggaaaagagtagcagccagcctagcagctgttgctctgacccatccaaacctgggggaaacgtagaaggggcaacccagagcctggctgaacagatgcgaaaaattgccttggagtcggagggtcgacctgaagaacagatggaaagtgacaactgttccgggggagacgacgattggacccatctgagcagcaaggaagtggacccaagcaccggtgagctccaatcactgcagatgcctgagtccgagggacctagtagcttggatccgtcacaggagggccctacaggactcaaagaagctgctctgtacccacatctccctccagaggcagaccctcgtttgattgaatcactttctcagatgttaagtatggggttttctgacgagggaggttggctaaccagactcctacaaaccaaaaactacgacattggcgcagcactggacacaatacagtactcaaaacatcccccacccctgtag

SEQ ID NO: 240004 - DNA, 504 bp, Artificial Sequence
  Description of Artificial Sequence: Synthetic coding sequence
atggcaatgtcatatgtgaaagatgacattttccgaatctacatcaaagaaaaaaaggagtgtagacgcgatcatagaccaccatgtgcccaggaggctcccaggaacatggtgcaccccaacgtcatatgcgatggatgtaacggacccgttgtggggaccaggtataagtgttccgtatgccctgactacgatctgtgcagtgtttgcgaagggaagggattacatcggggacacaccaaattggcttttccaagtcctttcgggcacctcagtgaaggattctcccacagccgctggcttcgcaaggtaaaacacgggcattttggatggcctggctgggagatgggtcctcccggaaactggtccccacggccaccgagagcgggagaggcacgcccaggtccaactgcagagtctgcatcaggaccgtcagaggacccatccgttaacttcctaaaaaatgtgggagagtctgttgctgcagcccttagtccattatag

SEQ ID NO: 240005 - DNA, 477 bp, Artificial Sequence
  Description of Artificial Sequence: Synthetic coding sequence
atgatgcagaagctgcttaagtgctcaaggctcgtactggcattggctctgatacttgtgctagaatcttctgtgcagggctatcctaccagaagagcacggtatcagtgggtcaggtgcaacccagattctaatagtgccaactgcctggaggagaagggacctatgttcgagctattacctggagaatccaacaagatcccgaggctgcgcaccgacctctttccaaagacccggatacaggacttgaacagaatctttccgttaagtgaagattactccggttccggcttcggtagcggctccggcagtgggagtggatccggaagtggctttctgacggaaatggagcaagattatcagttggtggatgagtccgacgccttccacgataatctgaggagccttgaccggaatctcccgagcgactcacaagacctgggccagcacgggctggaagaggactttatgctctag

SEQ ID NO: 240006 - DNA, 987 bp, Artificial Sequence
  Description of Artificial Sequence: Synthetic coding sequence
atgatgagcggcgaacctttgcacgtgaagaccccaatacgggactccatggcgttatccaaaatggccggaacgagcgtctatctgaaaatggatagcgctcagccttctggcagtttcaaaatcagaggaatcggccatttttgcaagaggtgggccaaacagggatgcgcccacttcgtgtgcagctctgccggtaacgccggtatggcagccgcttatgcagcaaggcagttaggcgttcccgcaacaatcgtggtcccgtcgactacaccagcgcttaccatcgaaaggctgaaaaatgagggcgctacggtgaaagtggtgggggagctattagacgaggcctttgaactcgctaaggccttggccaagaacaatcccggatgggtctatattccgcctttcgacgatcctctaatctgggagggtcatgccagcatcgtaaaagagctgaaagagacactttgggaaaagcccggagcaatagcccttagcgtcggaggcggtggactgctttgcggggtggtacagggattgcaagaagtgggctggggagatgtgcccgtcattgccatggaaacgttcggcgctcatagcttccatgctgctactacagctggcaagctcgtgtcccttcccaagattactagcgttgccaaagccttgggagtgaaaactgtgggcgctcaggcattgaagctatttcaggaacacccaatcttcagtgaggtgatctcagaccaggaagctgtcgccgctatcgagaagttcgtggacgatgaaaaaattttagtggagcctgcgtgtggagcggcactggcagctgtgtactcccatgtcatccagaagctccaactggaagggaatcttcgaactccactgcccagtttggtggtaattgtctgtgggggtagcaacatttctttggcacagctcagagcgttgaaagagcagctgggcatgaccaatagactgccgaagtag

SEQ ID NO: 240007 - DNA, 657 bp, Artificial Sequence
  Description of Artificial Sequence: Synthetic coding sequence
atgatgtctggggaacccctacacgtgaagacacccatccgggacagcatggccctctccaagatggcaggtacctctgtctatctgaaaatggacagtgcccagccttcaggcagttttaagataaggggcatcggccacttttgcaaacgatgggctaaacagggatgcgctcactttgtgtgcagctccgctgggaacgcgggtatggcagctgcctacgcagctcgtcagcttggagtgcccgcaactattgttgttccttccacaacccccgcacttacaatcgaacggctaaagaacgaaggcgctaccgtgaaagtcgtcggagagctgctagacgaagccttcgaattagctaaagctctcgccaaaaataacccgggttgggtgtacattccacctttcgacgaccctctgatttgggaaggtcatgcctcaatcgtgaaagagctgaaggagacactgtgggaaaaacctggagcaatcgccctgtcggtgggaggcggaggtctgctgtgcggggtggtccagggcctgcaggaggtgggttggggggatgtccccgtgatcgccatggaaaccttcggtgcccacagcttccacgcagcgaccactgctgggaaactggttagtttgcccaagataaccaggtag

SEQ ID NO: 240008 - DNA, 1452 bp, Artificial Sequence
  Description of Artificial Sequence: Synthetic coding sequence
atgaccatgcctgtcaatggcgctcacaaagacgctgatctctggtccagtcatgataaaatgctcgctcaacccctcaaggacagcgacgttgaagtatacaacataatcaaaaaggaatccaacagacaacgcgtcggcttggagcttatcgcttccgaaaatttcgcctctagggccgtgttggaggctctgggaagctgtctcaacaataagtatagtgaggggtatcctggccagaggtattatggaggcactgaatttatcgatgaattagagacattatgccagaaaagggccctgcaggcctataagctcgatcctcagtgctggggagtcaatgtgcaaccctactccgggagtccggctaattttgctgtctatactgccctggttgagccgcacggaagaatcatgggactcgacctgcctgatggcggtcacctaacgcacggctttatgaccgataagaagaaaattagcgctacctccatttttttcgagtccatgccttacaaagtgaatcccgatacagggtatatcaattacgaccaactcgaggagaatgctagactcttccacccaaagctgatcattgccggtacctcctgctactcacgaaatctagaatacgccagactgagaaagattgcagatgaaaacggagcataccttatggccgatatggcccacatttcaggactggtcgccgcaggagtggtcccctcccctttcgagcattgtcacgtggtgacaaccacaacccataaaacattaagaggctgccgggcagggatgattttctacaggaaaggcgtgaaaagcgtcgaccctaagacaggaaaggaaattttgtacaatcttgagagtttaataaactccgccgtatttcccggtttgcaggggggaccccacaaccacgccatcgccggagtggccgtggcactgaaacaggccatgactcttgaattcaaagtataccaacaccaggtggtagccaattgtcgtgcactatccgaggccctcacggaactgggatacaagatcgtcacaggtgggtccgacaatcaccttattctggtagatttgagatctaagggaaccgatggcggaagagccgagaaggtcctcgaagcatgttcaatcgcctgcaacaagaatacatgccctggtgaccgctctgccttgcggccttcaggactgcgattaggaactcccgctctcacttctcgcggattgttagaaaaagatttccagaaagtcgctcactttattcaccgaggtatcgagctaaccctgcagatccagtctgacaccggagtgcgagccaccctcaaggagtttaaggagcggctcgcaggagacaagtaccaggcggctgtccaggcactcagggaagaagtcgagagcttcgcctcactctttcccttgcctggcctacccgatttctag

SEQ ID NO: 240009 - DNA, 378 bp, Artificial Sequence
  Description of Artificial Sequence: Synthetic coding sequence
atgcgctatcttctccaagtggctcagttggtgtggttgactgtggactcaaggggcatcgggggtactttggatcacgccggtttctctatctgtatatttaccgtcccacctttgagcttttttgggctgtgcgaagcccagacctttgggctgtcaggaagcaagtctccagcactgcatcgctattacgggggtactgagttcatcgacgaactcgagacattgtgccaaaagagagcattgcaggcctataaattggaccctcaatgctggggggtgaacgtgccaactcaggtcctagtcagctctatctggcccggtgctgcctcatcctgtgcttccccaagagcggatatgcaccaggaggaatcttag

SEQ ID NO: 240010 - DNA, 1212 bp, Artificial Sequence
  Description of Artificial Sequence: Synthetic coding sequence
atgaccatgccggtcaatggtgcgcacaaggacgccgacctctggtcgtcgcatgataaaatgctggctcagccattaaaagacagcgatgtggaagtgtacaacattatcaagaaagagtccaataggcagagagtgggacttgaactgatcgcttccgaaaatttcgcaagtagagctgtgctggaagccctgggaagctgtcttaacaacaagtatagtgagggctatccaggccagcgctattatggtgggacagagtttatcgatgaactggagacactgtgccagaagcgggctctccaggcctacaagcttgatcctcagtgctggggagtgaatgtgcagccatattctggctctcctgcgaactttgccgtatatactgctttggtagaacctcacgggaggatcatgggtctcgacctccctgacggcggacacctgacccatggctttatgacagacaaaaagaagatatccgctacgtccattttctttgagtctatgccttacaaggtaaacccggacactggatatataaactacgatcaactcgaggaaaacgcacggctgttccatcccaaactgatcatcgccggaacgtcttgctactcaagaaaccttgagtatgctaggctcaggaaaatagcagatgaaaacggagcctacttgatggcagacatggcccatatctcaggcctggtggcggctggggtggttccaagcccttttgagcattgccacgttgtcacaacaacaacccataagaccctcagaggctgcagagctggcatgatattttaccggaaggggggttcagataaccacctcatcctggtggacctccgatctaaggggaccgacgggggacgcgctgaaaaggtgctagaggcttgctcaatagcgtgtaacaagaacacatgcccaggcgatagaagcgcgctgcgcccatcggggctgcggctaggaacacctgccctcacctctaggggactgctggaaaaggacttccagaaagtagcacactttattcatcgtggcatcgagcttactttgcagattcagagcgacacaggagtgagagcaacactgaaggagtttaaagagcgccttgccggagataagtaccaggcagcagtccaagcattacgggaggaagtggagtccttcgcaagtctgtttcctctgccgggactaccagacttttag

SEQ ID NO: 240011 - DNA, 1335 bp, Artificial Sequence
  Description of Artificial Sequence: Synthetic coding sequence
atgacaatgcccgtaaacggggctcataaggacgccgacctctggtctagtcacgataaaatgctcgcccagccactcaaagattctgacgtggaggtgtataatattattaaaaaagaatcaaaccgccagcgtgttggacttgaactgattgcatccgagaacttcgccagtcgcgcagttctcgaggccctgggctcttgcctgaacaataagtactctgagggctatcccggacaaaggtactacggaggtaccgagttcatcgacgagctcgaaacactctgccagaagagagctttgcaggcttacaagctcgacccccagtgttggggggtcaacgtacagccctactccgggtcaccggctaactttgccgtctatacagctttggtggagccgcacggccgaattatgggactggacttgcctgacggtggacacctgacccacggcttcatgaccgacaaaaaaaagataagtgctacctctattttctttgaaagtatgccatacaaagtaaaccccgacacagggtacatcaactatgatcagctggaggaaaacgcgagactctttcaccccaaactcatcatagcaggcaccagctgttacagcaggaatctcgagtacgccaggctgaggaaaattgccgatgagaacggcgcatacctgatggcagacatggctcacatctccggcctggtagcggctggagtcgtgccctcacccttcgagcattgtcatgtcgtgactactacaacgcacaagactcttcggggatgtagggccggtatgattttttaccgcaaaggagttgccgtggccctgaaacaggccatgacactggagtttaaagtgtatcagcatcaggtggtggccaattgtcgcgcattatccgaagcactgacagagctgggatacaaaatcgtgactggaggatccgataaccacctgatactggtggacctccgaagcaaagggacggatgggggtagagctgagaaagtgctggaggcctgcagcatagcctgcaataaaaatacatgtcctggcgatcgtagcgccctgcggccaagtgggctcagactgggcacacccgctctgacgagtcggggactgctggagaaggactttcagaaggtggctcattttatacatagggggatcgaactcacactgcaaatccaatctgatacaggcgtgagagcaactctgaaggagtttaaggagaggttagccggagataaataccaggccgctgtgcaggcgctgcgcgaagaagtagagtcctttgcctccctttttcctcttcccggactgcccgatttttag

SEQ ID NO: 240012 - DNA, 285 bp, Artificial Sequence
  Description of Artificial Sequence: Synthetic coding sequence
atgacaatgcctgtgaatggagcacacaaggatgctgacctgtggagctcacacgacaagatgctggcacagccgctaaaagacagcgatgtcgaggtatacaatataattaagaaagagtccaaccgtcagagagtgggccttgaactaatcgcctcagagaacttcgcttcaagagcagtacttgaggcactgggctcctgtctgaataataagtactccgaaggttaccccggacaacgttacgtgaatatcttcaaaggcctggtcctaactcagtcttag

SEQ ID NO: 240013 - DNA, 777 bp, Artificial Sequence
  Description of Artificial Sequence: Synthetic coding sequence
atggcggacatggcacatatctctggactcgtggcagccggtgtcgtgccatccccttttgagcactgccacgtggtgacaacgaccacgcataagacgctgcggggttgtagggccggtatgatcttctatcggaagggggtcaagagcgtcgacccaaagactggaaaggagatcctatataacctggaaagcctgatcaattccgccgtcttcccaggactgcaagggggacctcacaaccacgcaatcgcgggagtggccgtagccctgaagcaagcgatgacactcgagtttaaggtgtaccagcaccaggtcgttgctaattgccgggcactctccgaagcgctaacggagcttggatataagatcgttacgggcggatcagataaccacctgatattagtggacctgcggagcaaggggactgatggaggacgcgctgaaaaggtactcgaggcgtgctctatcgcctgcaataaaaacacatgccctggcgaccggtccgccctgagacctagcgggcttagattgggaactcccgctctcacgtctaggggcctccttgagaaggacttccagaaagtggctcacttcatccatcgcggtatcgagttaaccctgcagatacaatccgatacgggcgttagagcgacactcaaggagttcaaggagcgtcttgcaggcgataagtaccaggctgcagtccaggctctaagggaagaggtggagtccttcgcgtcactgttccctctcccgggattgccagacttctag

SEQ ID NO: 240014 - DNA, 1341 bp, Artificial Sequence
  Description of Artificial Sequence: Synthetic coding sequence
atgaccatgccggtgaacggagcccacaaggatgccgatctgtggagctcccacgataagatgttggcacaacccctgaaggattctgacgtcgaggtgtataatatcatcaagaaagaaagtaaccggcaacgggtcggcttggagcttatagcatctgagaactttgcctctagggccgttctggaagcattgggatcctgcctcaacaataagtattcggaaggctatcccggtcagcgttattacgggggaacagaatttatcgatgaactggagacactgtgtcagaagcgggctttacaggcctataaactcgaccctcagtgctggggagtaaatgtccagccctattcgggaagtcccgcaaatttcgctgtttatactgcgttggtggaaccccatggaagaatcatgggcttggacctgccagacgggggacatctaacgcatggatttatgaccgataagaagaagatttccgcaacatccattttcttcgaatccatgccctataaagtaaatcctgacactggatatattaattatgatcagctggaagagaacgcaaggctcttccatccaaaacttataatagccggaacttcatgctacagccgaaacttggagtatgccaggctgcgaaaaatcgcggacgagaacggcgcttatctaatggccgacatggctcatatctctggcttggtggccgctggagtggtcccctctccattcgagcattgccacgtggtaaccaccacaacgcacaaaaccctgcgcggttgtagagccggaatgattttttaccgcaaaggtgttaaatcggtggaccccaagactggtaaggaaattctttacaaccttgaaagtttaatcaatagtgccgttttccctggcttgcaggggggaccccataaccatgccatcgctggtgttgccgtagccctgaagcaagctatgacactggagtttaaggtctaccagcatcaggtcgtggccaactgccgggcacttagtgaagcactgaccgagctggggtacaaaatcgtgaccggtggcagtgacaaccacctcatacttgttgatcttcgcagcaaggggactgacggtggccgtgccgagaaagtgctagaggcctgcagcatcgcttgtaacaagaatacttgtcccggaatagagctgaccttgcagattcagagcgataccggggtccgagctacactcaaagagttcaaggagcgcttggccggagataagtatcaggctgctgtccaggcattgcgtgaggaggtcgagtcgtttgcttctctgttcccgctgcccggtctgccagacttctag

SEQ ID NO: 240015 - DNA, 1038 bp, Artificial Sequence
  Description of Artificial Sequence: Synthetic coding sequence
atgggccttgacctgcctgacggcggacatctgacccacggttttatgacggataagaagaagatttcagcaacctcaatattctttgaaagcatgccgtataaagtcaaccctgataccggttacataaactatgaccagttggaggagaatgccagactcttccaccccaagttaataattgccggaacttcctgttacagtcgcaacctggaatatgccagattaaggaagattgctgacgagaacggcgcttaccttatggccgatatggctcatatttccgggctggttgccgcaggcgtcgtaccctcaccttttgaacactgccatgtggtcacaaccaccacacacaaaacgctccggggttgcagagccggaatgatcttctaccgaaagggtgtcaaatccgtggaccctaaaaccggcaaggaaatcttgtataatttggagtccttaataaattcagccgtgtttcccggattacaaggaggaccacataatcatgccattgccggagtcgcagtggccttgaaacaagctatgacacttgagttcaaggtttatcagcaccaggtggtggccaactgtagggctctgtccgaggctttgacggaattgggctacaaaatcgttactggcggaagcgacaatcatctcatcttggtggacctgcgaagcaaagggacggacgggggacgggcagagaaggtgctagaggcctgttctattgcctgtaataagaatacttgtcctggggacagatctgccctgcggcctagcggcctgaggctgggcacacccgctttaactagcaggggccttctagagaaagatttccagaaggtcgcacactttatacacagggggatcgagctgacacttcagattcagtccgacacaggggtacgggcaaccctcaaggaatttaaggagagattggccggagacaagtatcaggctgccgtgcaggcactccgagaggaagtggaaagctttgcttctttatttcctttaccaggactgccggatttctag

SEQ ID NO: 240016 - DNA, 1515 bp, Artificial Sequence
  Description of Artificial Sequence: Synthetic coding sequence
atgctttattttagtctcttttgggccgcacgtcccctccaacggtgcgggcaactggtgagaatggccattcgggctcagcatagcaatgcggcacagacccagaccggtgaagccaataggggttggaccggccaggagtccctgtctgatagcgacccagagatgtgggagctcctgcagagagaaaaggacagacagtgcagagggctggagctgatcgcctcagaaaacttctgttctagagccgctctagaggcgctcgggtcgtgcttgaataataaatactccgagggctaccctggcaaaaggtattatggcggagctgaggtcgtggacgaaatcgagctgttgtgccagaggagagccctggaggcatttgaccttgacccagcacagtggggagttaacgtgcagccctactcaggtagtcctgccaacctggccgtgtatacggcccttctccaaccccacgacagaattatgggactcgatttgcccgacggtgggcacctgacccatggatacatgtcagatgtgaagaggatttccgctacaagtatctttttcgaatctatgccttataaactgaacccaaagaccggactgatagattataaccagctggcgctgacagcaaggctgtttcgcccacgattgataatcgccggaaccagcgcctacgcccgactgattgactacgcccgaatgagggaagtctgcgacgaagtgaaagctcatctgctggccgacatggcacacatctccggcctcgtggccgcaaaagtgattccatcgcctttcaaacacgccgatattgtgactaccacgacacataaaacgctgaggggcgctaggagcggtctgatcttctacagaaagggggttaaggctgtcgacccaaaaacgggtcgcgaaattccgtatacattcgaggaccgtattaatttcgccgtgtttccaagtctgcaggggggtccccacaaccatgcaatcgccgcagtagccgttgccctcaagcaggcatgcaccccgatgtttagggagtactcgctccaagtactgaagaacgctcgcgcaatggccgacgctctccttgagaggggatacagtctggtgtctgggggaaccgataatcatttggttctggtggaccttcgcccaaaagggctcgatggtgcaagggcagaacgcgtgttggagcttgtgagcattacggctaataagaacacttgtcccggagacagaagtgccatcaccccagggggattacgcttgggagccccagcactgacctcccgccagttcagagaagacgattttagaagagtggtggatttcatcgacgagggtgtgaatataggtctcgaagtcaaatcgaagaccgccaagctgcaggacttcaagtcattcctgctaaaagatagcgaaacctcgcagcggctagcaaacctacggcagcgcgtggaacagttcgcccgagcttttcccatgccaggtttcgacgagcactag

SEQ ID NO: 240017 - DNA, 1227 bp, Artificial Sequence
  Description of Artificial Sequence: Synthetic coding sequence
atgggtgagcaaagatggtggatgaagctgtcatgttgtgcaagtgctggtccctggaagccactaacctggattttgcatagcggcgagtctatgtccagcccgacgcccggaccccaacctacctggccttctacgcagcctttttgcaacttgaccactggaagctggggctggacttgccctatgggagcaatctcacctactgccacctgtttgacaagctccgggtaccaacctagaccctcaagttcctcactgtgccctatcagttctacggctctggctgtttgtgtgagtgtgcagcccaagacaggcttgatcgactataatcagctggctttgacagctagactttttcgcccacgcctgataatagctggcacctccgcatatgctcgcttgattgattatgctcgaatgcgtgaggtttgtgacgaggtgaaggctcacctgttagctgacatggcccacatatcaggtctggtcgctgctaaggtgattcccagtcccttcaagcacgctgatattgtgactaccacaacacacaagacactcagaggtgccaggagcggtctgatattctataggaaaggagtgaaagccgtggaccccaaaactggcagagagattccgtatacctttgaggaccggatcaactttgccgtgttccctagtctgcagggtggcccacacaaccacgccatcgctgcggttgccgtcgccctgaagcaggcttgcacccctatgttccgggaatatagtcttcaggtactcaagaacgctagggccatggcagacgccctgctcgaacggggatactccctcgtgtctgggggaaccgacaaccacctggttctggtcgacctcaggcctaaagggttggatggagcgagagccgagcgggtgctggagctcgtcagtataaccgctaacaaaaacacctgtcccggagacaggagcgccatcacccccggaggattgagactgggggcacctgctctaacatcacgccagttccgagaggacgacttcagacgggtagttgactttatagacgagggggttaatatcggtttggaggtcaagtctaaaaccgctaaactgcaggacttcaagtcattcttactgaaggacagtgaaacaagccaacgtcttgccaacttgcgacaaagggtggagcaattcgccagggcgtttcccatgcccggtttcgacgagcactag

SEQ ID NO: 240018 - DNA, 1452 bp, Artificial Sequence
  Description of Artificial Sequence: Synthetic coding sequence
atggctatccgggcacagcactcaaacgcagcacagacccagaccggcgaggctaatcgcggatggacaggtcaggagtccttgtcagattctgatccagaaatgtgggaactgctgcaacgggaaaaggacagacaatgtcggggactagaactcattgcttctgagaatttctgcagcagagcagccctcgaggccctgggctcttgtctcaataataagtactcggagggttatcccggaaaaaggtattacggtggagctgaggtagtggacgaaatcgaactgctgtgtcagcgcagggctctggaagcattcgacttggaccccgcacaatggggcgttaacgtgcagccttacagcggatcgcccgcaaaccttgcggtatacactgcgttacttcaaccgcatgatagaatcatgggtctagacctgcccgacggaggccacctgacacatgggtacatgtccgatgtaaagaggataagcgcaacctccattttttttgagtcaatgccctataagctgaatcccaagacaggtttgatagattataatcagctcgctttaaccgcccgtctgtttaggcctcggctgataatcgctggcacatcggcctatgcgaggctgatcgactatgcgaggatgagagaggtttgcgatgaggtcaaagctcacttgctggcagacatggcccacatctcgggactcgtggccgctaaggtgatcccctccccattcaaacacgcagacatcgtgactaccaccacccacaagacgttgcgaggcgcaagatccggtttaatcttttatcgcaagggagttaaagcggtggaccccaaaaccggccgtgaaataccatataccttcgaggaccggatcaatttcgcagtgttcccttcactgcaaggcggtccacacaatcatgcaattgccgcagtggctgtggcgctgaagcaggcctgtacccctatgttcagagagtactctctccaagtcttaaagaacgccagagccatggcagatgcattactggagaggggctactcgctggtgtccgggggtaccgacaaccatctggtcctcgtggatctgcgaccgaagggtctggatggagcgagagccgaaagagtgctcgagctggtgagcattacagccaacaagaatacatgcccaggggaccgctctgcaatcactcccggaggactacggctgggtgcaccagctctgacctcacggcagtttagggaagacgatttcagaagagtggtcgacttcattgacgagggtgtcaacattggactggaggttaaaagtaagaccgccaagctgcaggatttcaagagcttcttgctgaaggattctgaaacatcccagcgcctggcgaaccttaggcagagagtcgaacagtttgccagagctttccccatgcctggctttgatgagcactag

SEQ ID NO: 240019 - DNA, 1452 bp, Artificial Sequence
  Description of Artificial Sequence: Synthetic coding sequence
atggccattcgcgctcaacatagcaacgccgctcaaacacagacaggcgaagctaaccgaggctggaccggccaggagtcactgtccgactcggatccagagatgtgggaacttctgcagagagaaaaggaccgccaatgcagagggttagagcttatcgccagcgaaaatttttgcagtagggccgctttggaggcactgggcagctgcctcaacaacaaatatagcgagggatatccagggaaaaggtactatggcggagctgaggtggttgacgagattgagcttctatgtcaacgcagggcccttgaagcattcgacctcgacccagcgcagtggggcgtgaacgtacagccatattccggtagcccagcaaatctggcggtttatactgccctgctccagccacatgaccgtattatggggttagatttgccagatgggggacaccttacccacgggtatatgtcagatgtcaagaggatatccgcaaccagtatattctttgaaagcatgccttataagctcaacccaaagaccggactcatcgactacaaccagcttgcgctgacagccagactttttcgcccaaggctaattattgctggaaccagtgcttatgcaagattgatcgattacgcccgtatgcgggaagtctgcgacgaggtcaaagcccatctcctggccgatatggcacatatctctggactggtggctgcaaaagtcattcctagccccttcaagcacgcggatatcgttacaacgaccacccacaagacactgaggggagccaggagcggccttatcttctacagaaaaggtgtgaaggcggtcgacccgaaaaccggacgcgagattccttacaccttcgaagaccgtatcaattttgcagtgttccctagtcttcagggtggaccacacaatcacgccattgctgctgtagcagtcgccctgaaacaggcttgtacacccatgtttcgggaatactccctgcaggtgctgaagaatgcccgagccatggctgacgcgctgctggagagaggctattccctggtttccgggggaactgataaccaccttgttctggtcgacctgcggccaaagggtttggacggtgctagggccgaaagagtcctagaactggtttcaattaccgctaataagaacacttgccccggtgatagatctgccatcaccccagggggtctgcggcttggcgctcccgcactgacctctagacagttcagagaggatgactttcgtagagtggttgattttatcgacgagggagtgaatattgggctggaagtcaaatccaaaacggccaaactacaagacttcaagagctttctgctcaaagattccgagacttctcaacggctggctaacctgagacagagagtggagcagttcgccagggcgttcccaatgccaggattcgacgagcattag

SEQ ID NO: 240020 - DNA, 1452 bp, Artificial Sequence
  Description of Artificial Sequence: Synthetic coding sequence
atggctatccgagcccagcactcaaatgccgctcagactcagactggcgaagcgaacagaggctggaccggacaagaatctctctccgattccgacccggaaatgtgggagcttctacaacgggaaaaggacagacaatgcagaggcctcgagcttattgccagcgagaatttctgctcccgtgctgcccttgaagcccttgggtcttgtttgaacaataaatactctgaggggtatcccggaaaaagatattatggtggtgcagaggtcgtggacgaaatcgagctgctttgccagagaagggcccttgaagcttttgatctggatcctgcacagtggggtgtgaacgtgcagccctatagcggatcgccggcaaacctggcggtgtacacagcccttctgcagccccacgacaggattatggggctggatctccccgacgggggacacctgacacatggctatatgtctgacgtcaagagaatcagcgccacctctatcttctttgagtctatgccatacaagctcaaccccaaaacgggccttatagattacaaccagctggccctgaccgcaagactcttccgcccacgcctaatcatcgccggaacaagcgcatatgccagactgatcgactacgctcggatgcgcgaagtgtgcgatgaagttaaggcccaccttctggccgatatggcccatatctctggacttgtcgccgcaaaggtcattccctctccgtttaagcacgctgacatcgtgacgacgacaactcacaaaacgttacgcggtgcgagaagcggcctaatcttttatcgcaagggcgttaaagccgtggaccctaaaactgggagggaaattccatataccttcgaggaccggattaattttgctgtgtttcccagtctgcaaggtgggcctcacaaccacgccatcgctgccgtcgctgtggccttgaaacaggcctgcaccccaatgtttagagagtactcactgcaagtgctcaagaatgccagagccatggctgatgctctccttgaacggggttactccctggtgtccggtggaaccgacaatcatctggtcctcgtagatttgcgccctaagggcctggatggggcacgcgcagagcgcgtgcttgaattggtgagtatcacagctaacaaaaatacttgtccaggtgatcgcagtgctatcacacccggtggactgaggttaggtgcgcctgctcttactagcagacagtttcgggaagatgacttccgtcgagtggttgactttatagatgagggggttaacatagggctggaagtgaagtccaagacggccaaactgcaggacttcaagtctttcttactgaaagatagcgagaccagtcagcgcctggccaaccttcggcagcgtgtagagcagttcgccagggcctttcctatgccgggttttgacgaacactag

SEQ ID NO: 240021 - DNA, 1485 bp, Artificial Sequence
  Description of Artificial Sequence: Synthetic coding sequence
atgctgtatttttcgctgttttgggctgccaggccactgcagcggtgtgggcagctggtgcggatggcaatacgagcgcaacatagcaacgccgcacaaacccagaccggagaggccaaccgcggttggactgggcaagaatcattgagcgatagcgaccctgaaatgtgggagctactgcaacgggaaaaggatcgtcaatgtcggggactggagctgatcgcctcagagaacttttgtagtcgcgctgcgctggaagccctggggtcctgcctgaataataagtatagtgaaggttatcccggaaagcgctattatggtggagccgaagtagtggatgagattgaactactctgccaaagacgggctctggaggccttcgacctcgaccccgcacaatggggtgtcaatgttcagccctactccggttctcctgcaaaccttgccgtgtataccgcactgctgcaacctcacgataggattatggggctggatctgccagacggtgggcacctcacccacgggtacatgagcgatgtgaaaaggattagcgccacatccattttcttcgagtctatgccgtacaagctgaatctggcccttacggcgcgactgtttagacccagacttattatagccggaacgagtgcgtacgcgaggctgatcgattacgccagaatgcgagaggtatgtgatgaggtcaaggctcacctcctggcagatatggcgcacatttctgggttggtggccgctaaggtgatcccctcaccctttaagcacgccgatatcgtgactacgactacccacaaaaccttgcgcggagccagatctggcctgattttctataggaaaggtgtgaaagccgtagatccaaagaccgggcgagagatcccctatacttttgaagatcgtataaacttcgccgttttcccctctctgcaaggagggccacacaatcacgccatcgctgcagtggccgtggcactgaagcaggcctgtacacctatgttcagagagtactccctccaggtgctgaaaaatgcccgagctatggctgatgcgctgctggaacgaggatacagtctcgtatccggcggaaccgataatcacctcgttctcgtggatcttaggcctaaagggttggatggagccagagctgagcgagtcctcgaattggtgagcattacagccaacaagaacacatgtcctggagatcgatcagcgatcacccctgggggtttgaggctcggagccccagcactaacatcacggcagtttcgggaagacgattttcggagagtggtcgatttcatcgacgagggtgttaatattggtctggaggtgaagtctaagacagccaagctccaggacttcaagagcttcctccttaaggactctgaaacaagccaacgcttagccaacttgcgccagcgcgtcgaacagtttgcacgcgcatttcctatgcctggattcgacgaacactag

SEQ ID NO: 240022 - DNA, 1422 bp, Artificial Sequence
  Description of Artificial Sequence: Synthetic coding sequence
atgggagccgttctgggggtgttcagtctcgcctcatgggtaccctgtctttgttcgggggcatcatgtctgctgtgctcttgctgccctaactcaaaaaacagcaccgtcacaaggctaatctacgcttttatactgttgttatcgaccgtggtctcttacattatgcagcgcaaagaaatggaaacctatcttaagaagattcctggattctgcgagggcggattcaagattcacgaggccgacattaacgcagataaagactgtgatgtgctggtggggtacaaagcagtgtatcgcatcagcttcgctatggcaatctttttttttgtgttctcactgcttatgttcaaagtgaagacaagtaaggacctccgcgctgccgtgcataacggtttctggtttttcaagatcgctgccctgattggaatcatggttggctcgttttacattccaggcggatatttttcctcagtctggtttgtagttgggatgattggtgccgcactgttcatcctgatccagctcgtgttactggtggatttcgcacatagctggaacgaaagctgggttaacaggatggaagagggcaatcctagattgtggtatgcagccctcctgagcttcacatccgctttttatatcctttcgatcatatgcgtaggtctcctgtacacgtattataccaaaccggatgggtgcactgagaacaaattcttcatcagcatcaacctgatcctttgtgtggttgctagtatcatcagcatccacccgaagattcaggagcaccagccacggtcgggtctcctccaatcctccctgatcacactgtacactatgtacctgacgtggtcagccatgtcgaacgaaccagacagatcctgcaatcctaaccttatgtcctttatcacacgaattaccgctcccaccctggcgcctgggaattccacagcagtggtgccaacaccaacccccccatctaaaagtggttccttacttgattctgacaacttcatcggcctttttgtttttgtcctgtgcctactttactcctccattcgcacgtcaaccaactcccaggtggataaactgactctcagtggcagtgacagcgttatcctgggggataccactacatcaggggctagtgacgaggaggatggccaacctaggcgggctgttgacaacgagaaggaaggcgttcaatattcgtattctctgtttcatctgatgctttgtctcgcctccctctacatcatgatgaccttgactagttggtacagcccggatgccaaattccagtcgatgactagcaagtggcctgccgtatgggtaaaaatatcctcttcctgggtctgtttactgttgtatgtttggactcttgttgcacctctggtgctgacatccagagacttttcatag

SEQ ID NO: 240023 - DNA, 1422 bp, Artificial Sequence
  Description of Artificial Sequence: Synthetic coding sequence
atgggcgcagtcctcggtgtgtttagccttgcttcatgggtgccctgtctctgtagcggggcttcgtgtcttctttgtagttgttgtccaaattctaaaaatagcactgtgacgaggctaatctacgcctttatactgctgctctctactgttgtgtcctacatcatgcagcggaaagagatggaaacatacttaaagaagattcctggtttttgcgagggcggattcaaaattcacgaggccgacataaatgcagataaggactgcgacgtactggtcggttacaaggccgtttaccgtatcagttttgcgatggcaatcttcttcttcgtattttcactgctcatgtttaaggtaaaaaccagcaaggacttgcgggcagctgtgcacaacggtttttggttcttcaagattgccgcattaatcggtataatggtggggagcttttatatcccagggggttacttttccagcgtctggtttgtagtgggcatgataggcgctgctctctttattctgatacaactggtgcttttggtggattttgcacattcttggaacgaatcatgggttaaccgtatggaagagggaaaccctagactgtggtatgcggcactcctgtcattcacaagtgcattctatatcctctcgataatttgtgtcgggctgctatacacttattacactaagccggacggctgcactgagaataagttctttattagcattaatctgattctgtgtgtcgtcgcgtccatcatcagcattcatcctaaaatccaggaacaccagccaaggtccggacttctacagtctagtttgataaccttgtacacaatgtatctgacctggagcgctatgagtaatgagcctgatagatcttgcaaccctaatctgatgtcattcattacaaggatcaccgctcctacactggctcccggtaatagcaccgccgtcgtgccgactcccactcccccatccaaatctggtagcctgttggactcagataactttattggtctgttcgttttcgtgctatgcctcctctattcttcaatacgaacatcaactaacagccaggtggataagttgaccttatcagggtccgattcggttattctcggcgacacaacgacgtctggcgcatccgatgaggaggacggacaacctcgtcgggctgtcgataacgaaaaagagggcgtgcaatacagctacagcctgtttcacctgatgctctgccttgcgtcactgtatattatgatgacgctgacctcatggtattcccccgatgctaaattccaatccatgacatcaaaatggccagccgtgtgggttaagatctcatcttcttgggtctgtctgctactctacgtgtggacccttgttgcgccactagtgctcacaagcagagacttctcctag

SEQ ID NO: 240024 - DNA, 639 bp, Artificial Sequence
  Description of Artificial Sequence: Synthetic coding sequence
gaacaccaacctaggagtggcctgctgcagagtagtcttattaccctttacacaatgtatctcacatggagcgccatgtccaatgagcctgatcgcagctgcaaccccaacctaatgagcttcattacccgcatcaccgcaccaacgttggcccctgggaactcgaccgccgtggtccctactcccacgccaccctcaaaatccggcagcctactggatagcgataattttataggactcttcgtgttcgtcctgtgtctgttatatagctctatccggaccagcaccaatagtcaggtcgataaacttacactctcagggtctgatagcgtgatacttggtgatactacaacatcaggtgcgagtgacgaggaagacggtcaaccgcgaagagctgtagacaacgaaaaagagggcgttcaatacagctactctcttttccacctcatgctgtgcttggcgtcactgtacatcatgatgacccttacttcctggtatagtcccgacgccaagtttcagagcatgaccagcaagtggcctgctgtttgggttaagatctccagttcttgggtatgcctccttctgtatgtttggacgctggtggctccccttgtgttaacttccagggacttttcatag

SEQ ID NO: 240025 - DNA, 1323 bp, Artificial Sequence
  Description of Artificial Sequence: Synthetic coding sequence
atgccacttcaacgctgcctgatatacgccttcatccttttgttgtctacagttgtatcatacattatgcaacggaaggaaatggagacatacctaaagaaaatacccggtttctgcgagggtggctttaagatccacgaggcagacatcaacgcagacaaggactgtgacgtgcttgtgggctataaggcagtgtatagaatctctttcgctatggccatttttttttttgtcttttcgctccttatgttcaaagtaaagacctccaaggatctgcgtgccgctgttcacaacggattttggtttttcaaaattgccgcactaataggcatcatggttgggagcttctatatccctggtggttatttcagttctgtgtggttcgtagttggcatgattggagcggctctgttcattctgatccagctcgtcttgctggtcgacttcgcgcattcctggaacgagtcttgggtgaacaggatggaagaaggtaacccccgactctggtatgcagcactgcttagctttacgtctgccttttacattctatccatcatctgtgtgggactactgtacacttattacacgaagcctgatggctgcacagaaaacaagttttttataagtattaatctgattttatgtgtggtggccagcatcatcagcatacaccccaaaattcaagaacatcaaccacgctccggacttcttcagagttctctcatcacactatacaccatgtacttgacctggtcagccatgagcaatgagccagatagatcctgcaatcccaatctcatgtctttcatcactcggatcaccgcgcctaccctggcccctggaaattctacagctgttgttcctacaccaactcccccaagcaagtccggatccctgctcgactccgacaatttcatcggcctcttcgtgtttgtgctatgtttgttgtacagttctattcgcaccagcacaaattcacaggtggataagcttaccctctccggatccgactcagtgatcctgggggacactacaactagtggcgcatccgatgaagaagatgggcaacccagaagggctgtggacaatgaaaaagaaggtgtgcagtactcctacagtctttttcatctcatgctgtgtctcgcatcactatacattatgatgacgcttacatcctggtattcacctgacgcaaaattccaatctatgacttccaaatggcccgctgtgtgggtcaagatttccagctcttgggtgtgtctgttactgtatgtgtggaccctggtagcccctctggtcctaacctcgcgtgacttctcatag

SEQ ID NO: 240026 - DNA, 1257 bp, Artificial Sequence
  Description of Artificial Sequence: Synthetic coding sequence
atgcaaagaaaggagatggaaacgtacttgaagaaaataccgggattctgcgagggaggcttcaaaattcatgaggcagatattaatgcggacaaagattgcgatgtgctggtgggctataaggccgtgtatcgtattagcttcgctatggctattttctttttcgtgttttccttgctcatgtttaaagtcaagactagtaaggacctacgcgcagctgtgcataatgggttttggttcttcaagatcgccgctctaatcggtattatggtcggtagcttctatatccccggagggtatttcagctcagtttggttcgtggtcggtatgataggcgcagcactgtttattttaattcagctggtactactggttgattttgcgcactcttggaatgaatcttgggtgaaccgaatggaggagggcaacccacggctgtggtatgccgctctccttagtttcacttccgccttttacatcctgtctattatttgcgtgggattgctgtatacttactacacaaaacccgacgggtgcacagagaacaaatttttcatctccatcaacttgatcttgtgcgtcgtggcctcaattatctctatccaccctaaaattcaggagcatcaacctcgatcaggcctgctgcagagctctctcattaccttatacacaatgtacttgacctggtctgcaatgagtaacgaacccgatcggagttgcaatccgaatctgatgtccttcattacacggattacggcccctactctggccccaggcaattccaccgcagtggtccctactcctacgcccccatctaaatccggcagtctgctcgatagcgataatttcatcggattgttcgtgtttgttctgtgcctgctttactcttcaattcgaacaagcactaactcgcaagtcgacaagttgactctttccggttctgactctgtgattctcggagacaccaccacaagcggagcatcggatgaggaggacgggcagcctaggagggccgtggacaacgaaaaagaaggcgtccagtactcatattccttgttccacctcatgctgtgcctggcttcactgtatataatgatgaccctgacatcttggtattcccccgacgcgaagttccagtcgatgacttccaaatggcccgctgtatgggtaaaaatttcatccagctgggtctgtctcctgctgtacgtgtggacactagtcgcaccactcgtgctgacaagccgcgacttttcatag

SEQ ID NO: 240027 - DNA, 1422 bp, Artificial Sequence
  Description of Artificial Sequence: Synthetic coding sequence
atggccactgcgaccgaacagtgggtactcgttgaaatggtgcaggctctgtacgaggcgccagcgtaccacctcatcttagaggggatcctgatcttatggatcattcggctacttttctcaaagacctataaacttcaggaacgttccgacttgacggtgaaagagaaggaagaactaattgaagagtggcagcctgaacccctggtcccacccgtcccgaaggaccatcctgcgctaaattataatatcgtctctggaccgccaagccacaaaacagtagtaaatggcaaggagtgtataaattttgcatcattcaacttcttagggcttttggacaatcccagagtcaaggcagctgcccttgcctccctcaagaagtatggcgtcggcacttgtgggcctcgtggcttctacggaacctttgatgtacaccttgacctggaagaccgcttggccaagtttatgaagacagaagaagctatcatctactcatacgggttcgctaccatcgcttcagccattcccgcatattctaaacggggagatatcgttttcgtggatagagcagcatgctttgctatccaaaagggtttgcaggccagtcggtctgacattaagctcttcaagcataatgatatggctgacttggagagattactgaaagagcaggaaatcgaagatcagaagaatcctaggaaggcccgagttacgcgccgttttattgtggtggaaggcctgtacatgaacactggtaccatttgcccgctgcctgagcttgtgaagctaaaatacaaatataaggccagaatctttcttgaagaatcattgagttttggagttcttggggagcacggccgaggcgtgaccgaacattatgggattaatatcgatgatatcgatctcatttccgctaacatggagaacgccctggcgtccatagggggattttgctgtgggagatctttcgtgattgaccatcagagactctccggtcaaggatactgttttagcgcaagcctcccgcctctcctagcagctgcagccattgaggcattgaacatcatggaggaaaatcctggcatcttcgccgtgcttaaagagaaatgcggccaaattcacaaggcccttcaaggaatttccggcctgaaagtggtcggcgagtctctgtctcctgcgttccaccttcagctcgaggagtccacaggatccagggagcaagatgtgaggctgttgcaggaaattgtagaccagtgtatgaacagaagcatcgcccttacacaagccagatatctggagaaagaagagaagtgtctccccccaccttccattagagtcgttgtgacggtggagcagacggaagaagagttggagagagcggcttcaaccatcaaagaagtggcccaagctgttctgttgtag

SEQ ID NO: 240028 - DNA, 432 bp, Artificial Sequence
  Description of Artificial Sequence: Synthetic coding sequence
atggctacagctaccgaacaatgggtcctagttgagatggtgcaggcgctgtacgaagctcccgcttatcaccttatcctcgaaggcatcctgatcctctggattattcgacttcttttcagtaaaacttataaattacaggagcgctcagacctgaccgtcaaggagaaggaggagctcatcgaggagtggcagcctgagcccttggtgccacccgtgccaaaggaccacccagcactgaattataacatcgtcagtgggcctccatcacacaagacagttgtgaatggcaaagagtgcatcaatttcgcgagcttcaattttctaggtcttctggataacccacgggtgaaagccgctgctcttgcaagcctcaagaagtacggtgttggtacgtgcggccctagaggattctatggcacctttgaatag

SEQ ID NO: 240029 - DNA, 1017 bp, Artificial Sequence
  Description of Artificial Sequence: Synthetic coding sequence
atggccaagtggggggaaggagatcctagatggatcgtggaggagagggctgatgcgacaaatgttaataactggcactggacagaaagggacgcttccaattggagcacagataaactgaagacgctgtttctggcagtacaggttcagaatgaagagggtaagtgcgaagtcacagaggtgtccaagttggacggggaggcaagcatcaacaaccggaaagggaagctcattttcttctacgaatggtctgtgaaactgaactggactggcacgtccaaatccggtgttcagtataaaggacacgtcgaaattcccaacctcagcgatgagaactccgtggatgaggtcgagatctcagtaagtctggctaaggacgaaccggacacgaatctcgttgcattgatgaaagaggaaggtgtgaagctcttgagggaagccatggggatttacatttcgactcttaagaccgagttcacccagggtatgatcttgcctacgatgaatggcgaatccgtggaccccgtcggccagcctgcactcaagaccgaagagaggaaagcaaaacccgctccttctaaaactcaggccagacctgtgggagtgaagatcccaacttgtaaaatcaccctgaaggaaacgttcctaacctcccctgaggagttatacagggtctttacaacccaggagctggtacaggctttcacccatgccccagcgacactcgaggctgaccgcggaggtaagtttcacatggtcgacgggaatgtaagtggcgaatttaccgatttggtgccagaaaagcacattgttatgaaatggcgatttaagtcctggcctgaaggccactttgccaccatcaccctgaccttcattgacaagaatggcgagacagaactttgcatggagggcagaggcatccccgctccagaagaagagcggacaagacaggggtggcaacgttattacttcgagggcatcaaacaaactttcggctatggtgctcggcttttctag

SEQ ID NO: 240030 - DNA, 990 bp, Artificial Sequence
  Description of Artificial Sequence: Synthetic coding sequence
atggcaaatccaggcggtggcgctgtctgtaatggcaaattacataaccataaaaagcagtcaaatggatcccagtccagaaactgtaccaagaacgggatcgttaaagaggcgcagcagaatgggaagcctcacttttacgataagctgatcgtggagtcctttgaggaggcccctttacatgttatggtgtttacctacatgggatacgggatcgggacgctttttggatacctgcgggacttcctaaggaattggggaatcgagaaatgcaacgcggcagtggagcgcaaagagcagaaagactttgtgcccctgtaccaggacttcgagaacttctacacccgcaacctctatatgcgaattcgcgacaactggaatcggccaatatgtagcgctcccggacctcttttcgacttaatggagagggtgtccgacgattacaattggacgttcagattcacagggagggtaattaaggatgtcatcaatatgggctcctataactttttgggcctggctgcgaagtacgacgagtcaatgcgaaccattaaggacgtgttggaggtgtatggcaccggcgtggccagcacacggcatgagatgggaactctggataagcataaggagttggaggatctcgtcgcgaaattccttaatgtggaggctgcaatggtattcgggatgggctttgccacaaattcaatgaatatccccgctctggtgggcaaaggttgtctgatcttgtctgatgaactcaatcacacaagcctggtcctgggcgcaagactgtccggtgcaaccattcggatatttaagcataacaacacgcagagcctggaaaagcttttgagggacgctgtaatctacgggcagccacgcactcgcagggcctggaagaagatcttgattctggttgagggcgtgtacaggacgtcctggattatatacggcttcacacgcatcgtgctgtttatgctgcacccttag

SEQ ID NO: 240031 - DNA, 1659 bp, Artificial Sequence
  Description of Artificial Sequence: Synthetic coding sequence
atggctaacccgggagggggagccgtgtgtaacggaaaattgcacaatcataaaaaacagtctaatggctcccaatcccgaaattgcacaaagaatggaattgtgaaggaggctcagcagaatgggaagccccatttctatgacaaactcatcgttgaatccttcgaggaagcaccccttcatgtcatggtgtttacatacatggggtacggcatcggaaccctgttcggctatcttcgtgacttccttaggaactggggcattgaaaaatgcaacgctgccgttgaacgaaaagagcagaaggattttgtgcctctgtatcaggactttgagaacttttacactaggaatctctatatgcgaatcagggataactggaatcggccaatctgctctgctcctggccctctcttcgatttgatggaacgcgtgagcgacgactacaattggaccttcaggtttactggccgagtgattaaggacgttatcaatatgggatcctacaatttccttggcttggccgctaagtacgacgaatccatgagaacgatcaaggatgtgctggaggtgtacggaacaggggtcgcctcgacccgtcatgagatgggaacattagacaaacacaaagagctcgaagaccttgtggctaaatttctgaatgtggaagctgcaatggtgtttggtatgggcttcgccacaaactccatgaacattcctgcactggtgggcaagggctgcttgatcttatccgacgagctgaatcacacgtcacttgtgctcggggctcgactttctggagccactatacggatcttcaaacacaacaacacccagtccctggagaagctactccgcgatgccgtgatctacggtcaacctcgaaccagaagagcctggaaaaagattctcatcctggttgagggggtatattctatggaaggatccatcgtgcaccttcctcagattatcgccctcaagaaaaaatacaaggcctacctttacatcgatgaggcccactcgatcggggcagtgggtcccactggccgaggcgtgacggagttttttggcctggacccacacgaggttgacgtcctgatgggaaccttcactaagtcattcggcgcttcgggaggttacattgccggacgcaaagaccttgtcgattacctgcgagtacactcccattccgcggtctacgcatcttctatgagtccacctatcgccgaacagataattcggagtctcaagcttattatggggctcgacgggactacacaggggctgcagcgcgtgcagcaactcgcgaagaatacgaggtatttcagacaacggctgcaagagatggggttcattatctatggcaatgaaaatgcaagtgtggttccgctgctcctctacatgcctggtaaagtggcagcatttgctagacacatgcttgagaagaaaataggcgtggtggtggtcgggtttccagcaacacctcttgcagaggccagagccagattttgcgtgtcggcagcccatacacgcgagatgctggacaccgtgctcgaagcgcttgatgagatgggcgatctgctgcagctcaagtacagtaggcataagaagagtgctagacccgagctgtacgacgaaactagcttcgaactagaggattag

SEQ ID NO: 240032 - DNA, 366 bp, Artificial Sequence
  Description of Artificial Sequence: Synthetic coding sequence
tgatcccctccaatcgcagaacagattatacgtagcctcaaactgattatgggcttggacggcactacacaggggctgcagagggtgcaacagcttgccaaaaatacacgctactttcgccagcggttgcaggaaatgggcttcattatctatgggaatgaaaatgcctccgtcgttcctctgctcctctatatgcctgggaaggtggctgcgttcgctcggcacatgctggaaaagaagatcggagtggttgttgtcggctttccagcgacccctctggctgaggctagagcacgcttttgcgtatcagccgctcacacccgagaaatgctagacactgtgatatgttgtgtgatgaagatctag

SEQ ID NO: 240033 - DNA, 420 bp, Artificial Sequence
  Description of Artificial Sequence: Synthetic coding sequence
atggccaaccccggagggggagcggtgtgtaacggcaaactgcacaaccataagaaacagtccaatggatctcaaagcaggaattgcacaaagaatggcattgtgaaagaagcacagcaaaacggaaaaccccatttttacgacaagctgatcgtcgaatcattcgaagaggctcccctccatgttatggtgtttacttacatgggctatggcattggtactctgttcggctatctgcgggatttcctgcggaactggggaattgaaaagtgtaatgcagccgtggaaagaaaagagcaaaaagacttcgttcctttgtatcaagatttcgagaatttttacacgcgcaatttatacatgcgaattcgagacaattggaatcgaccaatctgttccgcccctggcccactctttgattag

SEQ ID NO: 240034 - DNA, 648 bp, Artificial Sequence
  Description of Artificial Sequence: Synthetic coding sequence
aactgtacaaagaacggaatagttaaggaagcacagcagaacggaaaaccacacttttacgacaaattaattgtggagtccttcgaggaagcccctctgcacgtcatggtattcacatatatgggatatggtataggcacactgtttggctatcttagagactttcttcggaattgggggatcgaaaaatgcaatgccgctgttgaaagaaaagaacagaaagatttcgtgccgctctatcaggacttcgaaaatttttacactagaaacttgtacatgaggatcagagacaactggaataggcctatctgcagcgccccaggcccactcttcgacctgatggaacgcgtgtcagacgactacaattggacattccgctttacaggtcgtgtaattaaagatgtgatcaacatgggaagctataattttctgggactcgcagcaaaatatgacgagagtatgcggactatcaaagacgttcttgaagtctacggcacgggagtggccagcactagacacgaaatgggcgaatttaccagttcctggcagaacgctctgtgtgttggcggagtcctgcaggctgacagtgtgccgcaaggcccaccttggtcatggaaaatgggaagacacagtagcctccttgaatag

SEQ ID NO: 240035 - DNA, 360 bp, Artificial Sequence
  Description of Artificial Sequence: Synthetic coding sequence
atggccctgtctgtcttacggctggctctgctcctcctcgccgtgaccttcgcaggctcagccaggtctggcccaggggagcggggaccacctgagaaatctggcttcggttcccagaccggtgggggaccatgccccgcaccgggaggtctcggggatgcttcgctgatacctcagttcggactcttttctaaataccgtacccccaactgttctcagtatcggctgcccggttgtccacgccactttaatcctgtgtgcgggtctgatatgtctacctacgctaatgagtgcacgctctgtatgaaaattagagaaggagggcacaacattaagataattcggaacggcccttgctag

SEQ ID NO: 240036 - DNA, 405 bp, Artificial Sequence
  Description of Artificial Sequence: Synthetic coding sequence
atggccttaagcgtcctaagactggctctgctgctgctagccgtgaccttcgcaggctccgccaggagcggtccaggcgaaagaggcccaccagagaaatccggatttggctcccagacgggaggcggtccctgccccgctcccggtggtcttggcgacgggacacgcgctcccgtcacaggtggcagccccgaggatcttcctgcaagtcttataccccagtttggactgttttcaaagtataggacgcctaattgtagccaatatagactgcctggttgccctcggcacttcaatcctgtgtgcggatccgacatgagcacctacgctaatgagtgcactttgtgtatgaaaattcgtgagggagggcataatataaagatcatacgaaacgggccatgctag

SEQ ID NO: 240037 - DNA, 240 bp, Artificial Sequence
  Description of Artificial Sequence: Synthetic coding sequence
atgaaggtgactggaatttttctgttatccgctctcgccctcctgtccttatctggaaacactggggctgacagtttgggacgggaagccaaatgctacaacgagctgaacggatgtaccaaaatttacgatcccgtgtgtggtacagatggcaatacctaccccaacgaatgtgtactgtgctttgagaatagaaaacgtcagacgtccatattgattcagaagtctggaccttgctag

SEQ ID NO: 240038 - DNA, 255 bp, Artificial Sequence
  Description of Artificial Sequence: Synthetic coding sequence
atggcactgagtgtactgaggttggcgcttttactgctggctgtcacgtttgcagcgtcactcattccgcaattcgggctttttagtaagtatcgcacgcctaattgttcgcagtacagattgcctggatgccctcggcacttcaaccccgtgtgtggaagtgacatgtcaacctatgccaacgaatgcactctttgtatgaagattcgggaaggtggccacaacataaagattatccggaacggtccttgctag

SEQ ID NO: 240039 - DNA, 261 bp, Artificial Sequence
  Description of Artificial Sequence: Synthetic coding sequence
atggccgtccggcaatgggtcattgctctggccctggccgcacttttagtggtggacagagaggtgccagtagccgcaggtaagttaccgttctctagaatgcctatctgtgagcacatggttgagtctccaacgtgtagtcagatgagcaatctggtctgcggcacagatgggctgacatatacaaatgaatgtcagctgtgccttgcaaggatcaagaccaaacaggacattcagatcatgaaagatgggaaatgctag

SEQ ID NO: 240040 - DNA, 330 bp, Artificial Sequence
  Description of Artificial Sequence: Synthetic coding sequence
atgattctgggaataggcagtagtcctcacctgctttggaccctggaaggcacacacatttggtctctgctgggcgacgcttcacatacagatagactacccgaggcaggtgcaggtaagttactgtccgaggttccggtggccgctgggaagttgcctttctcacgaatgcctatttgcgaacacatggtggagtcaccaacttgttctcaaatgtcaaacttggtatgtggcactgacggactgacctataccaacgaatgtcagctgtgtctcgcaaggatcaagacaaagcaggacatacagattatgaaggacggtaaatgttag

SEQ ID NO: 240041 - DNA, 330 bp, Artificial Sequence
  Description of Artificial Sequence: Synthetic coding sequence
atgattcttggtattggctcttctcctcacctcctgtggacattggaggggacccacatttggtcgttactgggcgacgcttcccacactgatcgtctaccggaggccggagctgggaaactcctcagcgaggtgcctgtggcagctgggaaactgcccttcagcagaatgcctatatgcgagcacatggttgagagtccgacatgcagtcagatgagcaacctggtctgcgggacagacggcctgacttacacaaatgaatgtcagttatgcctagccagaatcaagacaaaacaagacatacaaataatgaaggacggaaaatgttag

SEQ ID NO: 240042 - DNA, 3195 bp, Artificial Sequence
  Description of Artificial Sequence: Synthetic coding sequence
atgaaaatagctactgttagcgtcttactccccttagctttatgccttattcaggacgccgcttcaaaaaacgaagaccaggaaatgtgtcacgaattccaggcctttatgaaaaatgggaagttgttctgtcctcaagacaaaaaattctttcaaagcttagacggaattatgttcatcaataagtgcgccacctgtaaaatgatcctggagaaggaagctaagagccagaagagagcgaggcacctggctagggcgccaaaagctactgcccctactgaactaaattgcgatgatttcaaaaagggcgagagagacggagattttatctgtcccgattattacgaggcagtctgcgggacagatggaaagacgtacgataatcgttgcgcactctgtgcagagaacgccaaaacagggtcacagatcggggtgaaatccgagggagaatgcaagagcagcaacccagaacaggatgtctgctcagccttcaggcccttcgtgcgcgatgggagacttggatgcactcgagagaacgatcctgttctgggcccagacggtaaaacacacgggaacaaatgcgcaatgtgtgctgaactgttcctgaaggaagctgaaaacgccaaacgggagggcgaaaccaggattcggaggaatgccgaaaaggatttctgcaaggagtatgagaagcaggtgagaaacggacggctcttctgcacaagagagagcgatcccgtgcgtggacctgacgggagaatgcacggaaacaaatgcgctctttgtgctgaaatttttaagcagagatttagcgaggaaaattctaagactgatcagaatttaggaaaagcagaggaaaaaactaaggtgaagcgggagattgtgaaactgtgctcccagtaccagaaccaggcaaaaaacggaattctcttctgtacacgtgagaacgaccctatcaggggccctgatggcaagatgcacgggaacttatgttccatgtgccaggcttactttcaggccgagaatgaggagaagaagaaggctgaggctcgcgcaaggaataagagggaatctgggaaagcaacatcttacgctgagctttgctcagagtataggaaactcgtacgtaacgggaaactagcttgcaccagagaaaatgaccctatccaggggccagatggaaaggtgcatggcaacacgtgctcaatgtgtgaggtgttctttcaagccgaagaggaggagaagaaaaagaaggaaggaaagagtcgaaacaagcggcagtctaagtccactgcctcattcgaggaactgtgctcggagtaccggaaaagccgaaagaatggtaggctattttgtactagggagaatgaccccatccagggccctgacggcaagatgcatggaaacacctgttcgatgtgcgaggcattcttccagcaggaagagcgagcacgcgctaaggccaaaagggaagctgctaaggaaatctgttcagaatttcgggatcaggttcgaaatggtaccctcatttgcacgagagagcacaatcccgtgaggggacctgatgggaagatgcatggaaacaaatgtgcaatgtgcgccagcgtgttcaaattagaggaagaagagaaaaagaacgacaaggaggaaaaggggaaggtcgaagcagagaaagtgaaacgtgaagccgtacaggaactgtgttctgagtacagacattacgtgcgaaacggccgattaccctgtacccgcgaaaatgaccctattgagggcctggacggcaaaatacatggcaatacctgttctatgtgtgaggcgttctttcagcaagaagctaaggaaaaggagcgggctgaacccagggctaaggttaaaagagaggccgagaaggaaacttgcgatgagttccgacggctcctgcagaacggaaagctgttctgcacgcgggaaaatgaccccgtgaggggccctgatggcaaaacacatgggaacaagtgtgccatgtgcaaggctgttttccaaaaggaaaacgaggagcgtaagaggaaagaggaagaggatcagcgcaatgccgctggccacgggtcttcgggcggaggaggcggaaatacccaagatgagtgcgccgagtacagggagcagatgaagaatggaagactgtcctgcacgagagagtctgatccggtgagggatgcggatgggaagagctacaacaaccagtgtaccatgtgcaaagctaagctcgagagggaggcagaacgcaagaacgagtacagtcggtcacgaagcaatggcacagggtcagaaagcggcaaagacacttgcgatgaattccgctcccaaatgaaaaacggcaagttgatctgtacgagagagagcgatcccgtccggggacccgacgggaaaacccacggcaataaatgcaccatgtgtaaggaaaagttagaacgcgaagccgcagagaaaaagaagaaggaggatgaggacagatcaaacaccggggaaaggtccaacaccggcgaaagatccaatgacaaggaagatctctgcagggaatttcgcagtatgcagagaaatgggaaactgatctgtacacgggaaaacaaccctgtacgtggaccttatggcaagatgcatattaacaagtgtgctatgtgccagagcattttcgaccgggaggccaacgagaggaagaagaaggacgaagagaaatcttctagcaagccttcaaataatgccaaggatgagtgtagcgagttccgaaattatatccgcaacaacgagttaatctgccccagagagaatgacccggtccacggggcagacggcaaattctacacaaataaatgttacatgtgtcgcgctgttttcctgaccgaggccttggaaagagctaagctgcaagagaaaccttctcacgtccgcgcatcacaggaagaggactctcccgactcatttagctctctggactcggaaatgtgcaaagactaccgggtcctgccgaggatcgggtacctgtgcccaaaagatttgaagcccgtatgtggagacgatggccagacatacaacaacccctgcatgctgtgccatgaaaatcttatacgacagactaacacacacatcagatcaaccggaaagtgcgaggaaagctcgacccctgggacaacggcagcctctatgccgccatctgacgagtag

SEQ ID NO: 240043 - DNA, 3285 bp, Artificial Sequence
  Description of Artificial Sequence: Synthetic coding sequence
atgaaaatcgcaactgtgtccgtcctgctgcccctggctctttgtctgattcaggatgccgcttcaaagaacgaggatcaggagatgtgccacgagttccaggccttcatgaagaatggcaaattgttctgcccgcaggacaagaaattctttcaatccctggatggcatcatgttcatcaataaatgcgcaacttgcaagatgatcctggaaaaggaagccaagagtcagaagagggcacgacaccttgctcgggctcctaaggcaactgccccaacagagcttaattgcgatgatttcaaaaagggggaacgggacggggattttatatgccctgactattacgaggcagtctgcggcactgacggaaaaacatacgataaccgctgtgccttgtgtgcagagaacgcgaaaaccggcagccaaataggagtgaaatcggaaggcgagtgcaagagcagcaaccccgaacaggatgtgtgttctgcttttaggccatttgttcgcgatgggagacttggttgcacaagagagaatgatcccgtcttaggtccagatggcaagacacacggaaacaaatgcgctatgtgcgcagagttattcttgaaagaagcggagaacgcaaagcgcgagggcgagactcggatccgcaggaacgccgaaaaagacttttgtaaagagtatgagaaacaggtgcggaacggacgtttattttgcactagggaaagcgatccagtgagaggcccagacggccgaatgcacggaaacaaatgcgcgctgtgtgccgagattttcaagcagcgattcagcgaggagaacagtaaaactgatcaaaacctgggcaaggcggaggagaagactaaagtgaaacgggaaattgtgaaactgtgctctcagtaccagaatcaggcaaaaaacggcatcctgttttgtacccgggagaacgacccaatccggggacctgacggaaaaatgcacggtaacctctgcagcatgtgtcaggcctatttccaggctgagaatgaggaaaagaagaaagcagaggctagagccagaaataagagagagagcggtaaggcgaccagctacgccgaactttgcagcgagtacagaaagttagtgcgcaacggcaagctggcctgcaccagggaaaacgacccaatccagggccctgatgggaaagttcatgggaacacttgcagcatgtgcgaggttttcttccaggcagaggaggaggaaaaaaaaaagaaagaaggaaagtccaggaataagcgccagtccaaatccactgcgtccttcgaggagctgtgcagcgagtacagaaaatcacggaagaatggtcggcttttctgtacaagggagaacgatccaattcagggaccagacgggaagatgcacggaaacacatgtagcatgtgtgaagccttttttcagcaggaagagagggctcgggctaaggcaaagcgcgaggctgcgaaagagatttgtagtgagtttcgggatcaggtccgaaatggtacactgatctgcacaagagagcataatcccgtgcggggacccgacgggaagatgcacggtaacaagtgtgcgatgtgtgcgagcgtattcaagctcgaggaggaggaaaaaaagaatgacaaagaagaaaagggaaaagtggaagctgaaaaagtgaaacgcgaggccgtacaggaattgtgtagcgaatatcggcattacgtaagaaatggtagactgccttgcactcgggaaaacgaccccatcgaagggctggatgggaagatccatggcaacacctgctcaatgtgtgaagccttcttccagcaggaggcaaaagagaaggagcgcgcagagcctagagccaaggttaagcgggaagccgagaaggaaacctgtgacgagttccggaggctgctgcaaaatggaaagctgttctgcacccgggagaacgatccagtgcgaggaccggatgggaaaactcacggcaacaaatgcgcaatgtgtaaggccgtgttccagaaggagaacgaggagcgcaagcggaaggaagaggaagaccagagaaacgctgccggacacgggagtagcggcggaggagggggtaacactcaggatgagtgcgcagaataccgagagcagatgaaaaatggaagattatcgtgcaccagagagagcgaccccgtcagagacgccgatggaaagtcttataataatcaatgtactatgtgcaaggccaaacttgaacgagaagcagagcgaaaaaacgagtatagccgcagcaggagcaatggcaccggctctgagtccgggaaggacacttgcgacgagtttaggtctcagatgaagaatggtaaattgatttgtaccagggaatccgatccagtccgaggccctgatggtaaaacacacggcaataagtgtaccatgtgtaaggaaaagctcgaaagggaagccgcagagaaaaagaagaaggaagatgaagaccggagcaacaccggcgaacgcagcaacacgggcgaacgatcgaatgacaaggaggatctgtgtagggaatttcggtctatgcagaggaacggaaagctgatttgtacccgagagaacaaccctgtacggggtccatatggaaagatgcatataaacaagtgcgccatgtgtcaatctatctttgatagggaggcaaacgagcggaaaaaaaaggacgaggagaagagctctagcaagcctagcaataatgccaaagatcaatgtcggcaggtgcagaacgaggcggaagatgcgaagttcaggcaacccggacgcagcctggcctccgtcgcgcgtatgagcacagacgagtgtagcgaattccgcaattatattcgaaataacgagctcatttgtccacgcgagaatgatcctgtgcacggcgcagacggcaaattctacacaaacaaatgttacatgtgccgagctgtttttttgaccgaggcccttgagcgagccaaacttcaggaaaaaccttcacatgtgcgggcttctcaggaggaagactcccctgattctttttctagtctggactcagagatgtgtaaagattacagagtgttgccgaggatcggttacctttgccccaaggacttaaaaccagtgtgtggtgatgacgggcagacgtacaacaatccatgtatgctgtgccacgagaatctgattaggcagactaatacccatatccggtcaactgggaagtgtgaggaatcctccacgccaggcacgacagcagcgagcatgcctcctagtgacgaatag

SEQ ID NO: 240044 - DNA, 2751 bp, Artificial Sequence
  Description of Artificial Sequence: Synthetic coding sequence
atgaagattgcgaccgtttcggtgctgctgccgttagctctatgtttgattcaggacgccgcttcaaagaacgaggatcaagagatgtgccatgagttccaagcgtttatgaaaaacggaaagttgttttgcccccaagacaagaaattcttccagtcgctcgatggcataatgttcatcaacaagtgcgccacgtgcaagatgattctggaaaaagaggctaaatcccagaagagagctagacatcttgctagagccccaaaggccacagcccctaccgagcttaactgtgatgacttcaagaaaggtgaacgggatggggattttatctgtccggactattatgaggccgtctgcggaacagacggcaagacctatgacaacaggtgcgccctatgcgctgagaacgccaagaccggcagccagataggagtgaagtctgaaggtgaatgcaagtctagcaaccccgagcaggacgtctgcagcgcctttcggccattcgtcagagatgggagattggggtgtaccagagaaaacgatccagttttgggcccagacggcaaaacccacggaaacaaatgtgcaatgtgcgctgaacttttcctgaaggaggccgagaatgctaagagagagggggaaactcggatcagaagaaatgctgagaaggatttttgcaaggagtatgaaaagcaggtacggaatggacgcctgttttgcacccgcgagtcagaccccgtccggggacctgatggcagaatgcacggcaacaaatgcgctttgtgtgcggaaattttcaaacagaggtttagtgaggagaattctaagactgatcaaaatttagggaaggccgaagaaaaaacaaaggttaagcgcgagatcgtcaagctgtgtagtcagtaccagaaccaggcaaagaatggaatccttttctgtacaagggagaacgatcctatacgcggacccgacggtaaaatgcatggcaacctttgcagcatgtgtcaggcctacttccaagcggagaacgaggagaagaaaaaagcagaggcgcgagcccgaaataaacgcgagagcggaaaggcaacctcttacgctgagctctgctccgagtatagaaaacttgtcaggaacgggaagctggcgtgtactagagaaaacgatcctatccagggaccagatggaaaggtgcacggaaacacatgcagtatgtgcgaagtcttttttcaggctgaagaagaagagaaaaaaaaaaaggaggggaaatccaggaataagcgccagtcaaagtcaacagcatcgtttgaggagttgtgctccgagtaccgcaaatcacgcaagaacggacggctgttttgcaccagggaaaatgatcccattcagggtcctgatggaaagatgcatggcaatacctgctctatgtgcgaagcgttcttccagcaagaagagcgagcgagggccaaagctaaacgcgaagcagctaaagaaatatgtagcgagttcagggaccaggtacgaaatggcaccctaatttgtacccgtgagcacaatcccgtgaggggccctgacggcaagatgcacggcaacaagtgtgcaatgtgtgcatccgtgttcaagttagaggaagaggagaagaagaatgataaagaggagaaaggcaaggtcgaagcggaaaaagtcaaaagggaggccgtgcaagaattatgctcagaatatcgacattacgtgcggaatggcagattgccctgcacccgagagaacgacccgatcgaagggctggatggtaagattcatggcaatacgtgctcgatgtgtgaggccttctttcaacaggaagccaaagagaaagagagggctgaaccacgggctaaggtgaagagggaggctgaaaaggagacctgcgacgagtttcgtcggctcttgcagaatggcaaactgttttgtactcgcgagaatgacccagtgcgcggtcccgacggtaagactcatgggaataagtgcgccatgtgcaaggcagtgtttcaaaaagagaacgaggagagaaaacggaaggaagaggaggatcagcggaacgccgctggtcacggaagctcaggcggaggcggagggaatacccaagatgaatgcgctgaatatcgagagcagatgaaaaacggcaggcttagttgtacgcgcgaatctgaccccgttcgagacgccgacggtaaatcctataacaatcagtgtacaatgtgcaaggccaaacttgaaagagaagctgagcgaaaaaatgagtacagccgttcacgctcgaatggtaccggctccgagtccggtaaggacacttgcgatgagtttcgatctcaaatgaagaatggaaagctgatctgtacaagggaatctgatcctgtccgtggcccagatggtaaaacccatgggaataagtgcaccatgtgtaaggaaaagctcgagcgtgaggcagccgagaagaagaagaaggaggacgaagatcgatcaaatacaggcgaacgctcaaataccggcgagagaagcaacgataaagaggacctgtgccgcgagtttcggagcatgcagaggaatggcaagttaatttgcacaagggagaataatccagttcgaggaccatatggcaagatgcatatcaacaagtgcgccatgtgccagtctatttttgacagagaggccaacgaaagaaaaaagaaggacgaggagaaaagctcatcaaagccgagtaacaatgctaaggttatctattag

SEQ ID NO: 240045 - DNA, 261 bp, Artificial Sequence
  Description of Artificial Sequence: Synthetic coding sequence
atgcgcgctacggccatcgtcctgctgcttgccttgactttggctactatgttctctatcgagtgtgctaagcagaccaaacagatggtcgactgttctcactacaaaaaactgccccctggccagcaaagattctgtcaccacatgtacgacccgatctgtggatcagacgggaagacatacaagaacgattgttttttctgctctaaagttaagaagacggatggaacactgaaattcgtccatttcggcaagtgctag

SEQ ID NO: 240046 - DNA, 759 bp, Artificial Sequence
  Description of Artificial Sequence: Synthetic coding sequence
atggcccagctttgtggcttgcgaagatctagagctttcctggcccttcttggtagcctcctgttgtccggagtgctggcggcagaccgggaaaggtccattcatgatttttgtctggtgtctaaagtagtggggcgatgccgagcatccatgccacgttggtggtacaatgtgacagacggctcctgccagctgttcgtctatgggggatgtgatggtaatagtaataactatcttactaaagaagaatgtctaaaaaaatgcgccacggtgacagagaacgccacgggagatctagccacgagtcgaaacgccgcagactcctccgtgcctagcgcaccaaggaggcaggactccgaggatcacagttctgacatgtttaattacgaggagtactgcactgccaacgccgtaacagggccttgcagagctagctttccccgatggtactttgatgtcgaacgcaattcttgtaataactttatctatgggggttgccgcggaaacaagaactcgtacagatctgaagaggcatgtatgctgcgttgcttcagacagcaggaaaacccaccattgccgcttggcagcaaggtggtggtgttggcaggcctcttcgtgatggtgcttatcctgtttctgggcgcatccatggtttatcttatacgggttgcgcgtaggaatcaggaaagagccctgcgcaccgtgtggtcctccggggacgataaggaacaactggtcaagaatacgtacgtgctgtag

SEQ ID NO: 240047 - DNA, 588 bp, Artificial Sequence
  Description of Artificial Sequence: Synthetic coding sequence
atggcccaactgtgcggccttaggcgcagtagagccttcttggcactcctagggtccttgctcttaagcggcgtactggccgcagaccgagagcgctcaattcacgagaacgcgactggtgacctggccacatcacgcaacgcagccgattcctccgtgccatcagcccctcggagacaggactccgaggatcatagctccgacatgttcaactacgaagaatattgcacagccaacgccgtaacgggcccttgtagggcctctttcccgcgatggtacttcgacgtggaaaggaattcgtgcaataacttcatctatgggggttgtaggggtaataagaattcttataggtcggaagaggcctgcatgctgcgctgttttaggcagcaagagaatccccctctgccactcgggtcgaaggtcgtggttttggccggactgtttgttatggtcctaatactcttcctgggagcatccatggtgtatctcatccgggtggccaggaggaaccaagagcgcgcattgaggacggtgtggagttcaggcgatgataaggaacagctcgtgaaaaacacctacgtgctctag

SEQ ID NO: 240048 - DNA, 1299 bp, Artificial Sequence
  Description of Artificial Sequence: Synthetic coding sequence
atgagcgataagctgccttataaggtggccgacatcggactcgctgcctgggggagaaaagcccttgatattgccgagaatgagatgcctggcctgatgcggatgcgcgagagatacagcgcctcaaaaccgttgaagggcgcacggattgcgggatgtctgcacatgaccgtcgaaaccgccgtgctgattgaaactctggtgaccctgggagccgaggtgcagtggtccagctgtaatatattctcaactcaggatcacgcagctgccgctattgccaaggctggtatccccgtatacgcatggaaaggtgagactgacgaggaatatctctggtgtatagagcaaaccttgtacttcaaggacgggcctctgaatatgattctagacgatggcggtgatctcaccaatctcatacataccaagtatcctcagctgttgcccggaatccggggaatttccgaggagaccaccacgggtgtacataacctttacaaaatgatggcgaacggtatcctgaaggtgcccgcaattaacgttaacgactctgtgacgaagagtaaatttgacaacctgtatggatgccgggagtctctaatcgacggaataaaaagagccacagacgtcatgatcgccggtaaagtcgctgtggtcgccggttatggagacgttgggaagggttgcgctcaggcgttacggggtttcggggcacgagttatcatcactgaaattgatccaataaacgcccttcaagccgctatggaaggatacgaggttacgactatggacgaagcatgccaggagggtaatatctttgtgaccactacagggtgcattgatatcatcctgggacgtcactttgaacagatgaaagatgatgctatcgtgtgtaatatcggccattttgacgtcgaaatcgacgttaaatggttaaacgagaacgccgtggagaaagtcaatattaagccccaggttgaccgttaccgtctgaaaaatggtcggaggattattctgcttgccgagggcagactggttaacctgggctgtgccatgggccacccttcctttgtcatgtccaactcgtttacaaaccaagtgatggcccagatagaactctggacccacccagacaagtatcccgtgggcgtgcactttctgcctaaaaagttggacgaagcggttgcagaagcccaccttgggaagctcaacgtgaaactcactaaactaacagagaaacaggcccaatatctgggcatgtcatgtgacggcccttttaagccagaccactatcggtattag

SEQ ID NO: 240049 - DNA, 1023 bp, Artificial Sequence
  Description of Artificial Sequence: Synthetic coding sequence
atgtgtgcccaatactgcatatcatttgcggatgtggagaaggcccatattaatatcagggatagtatccacttgacacccgtgctgacatcaagcatcctgaaccagttgaccggacgtaatctcttttttaagtgcgaactgtttcagaaaaccgggtcctttaagatcaggggcgctcttaatgcagtgagatccctagtgcccgacgcccttgagcgaaagccaaaggcggtagttacgcattcctccggcaatcacgggcaggcccttacctacgcagctaaactggaaggcatcccggcttacatcgtcgtaccccaaaccgcacctgattgtaagaaactggcgattcaggcatacggcgctagcattgtttattgtgagccatccgacgagtctagagaaaatgttgctaagcgggtgacagaagaaacggaaggtatcatggtgcacccaaaccaggagcccgctgtcatagccggtcaaggtacaattgccctcgaggttctgaaccaagtccccttggtcgatgcccttgtcgtgccagtaggcggagggggaatgctggccggaattgccattactgtgaaggctctgaaaccgagtgtgaaggtgtacgcagccgagccttccaacgcagatgactgctaccagtctaaattgaaggggaaactcatgcccaacctgtacccacctgagacaattgcagatggtgtgaaatccagcatcggcctcaacacgtggcctataatcagggacctggtggacgacatattcaccgttactgaagacgagatcaagtgcgctacacaactggtctgggaaagaatgaaactgttgatagagccaacagccggtgtgggagtggccgcagttctcagccaacattttcaaacagtctcgccagaagttaagaacatttgcatcgttctttccggaggcaatgtcgatctgacaagctctataacctgggtcaaacaagccgaacgcccagcttcttaccagtcagtttcggtgtag

SEQ ID NO: 240050 - DNA, 1638 bp, Artificial Sequence
  Description of Artificial Sequence: Synthetic coding sequence
atggccgagccttcagggagtcccgtccatgtgcaattgccccagcaggcagcacctgtgaccgccgctgccgctgctgcacccgcagccgcaacggctgctcccgctcctgcagcacccgcagccccagctcctgcccctgcacccgctgcccaggccgttgggtggccgatctgtagggacgcctacgaactgcaggaagttatagggagtggcgcaactgcagttgtgcaggcagctctctgcaaaccacggcaggaacgagtcgcaataaagcggatcaatctggagaagtgtcagacgagcatggatgagctactgaaagagattcaagctatgtcgcagtgctcacatccaaatgttgtgacctactacacctcttttgtggttaaggacgagctatggttggttatgaaactgcttagcggtgggtccatgctggacatcattaagtatatcgtcaaccgcggagagcataaaaacggagttctggaggaagccattattgctaccatcctgaaggaagtgctggaagggctggattacttgcataggaacggccagatacatcgggacctcaaggcaggtaatatcttgctgggagaggacggctcagtacaaattgctgactttggcgtgagcgcttttctggctactgggggagatgtaactcggaacaaagtgcggaagacttttgtgggcactccgtgctggatggctcccgaggttatggagcaggtgagggggtatgactttaaggccgatatgtggtcctttggaatcaccgctatcgaactggcaacaggagcagcaccctaccataagtacccgcctatgaaagtgctgatgcttacattgcaaaacgatccgccaacccttgagacaggtgttgaggataaggaaatgatgaagaaatacggcaaaagcttccgcaagctcctgtctctgtgcctccagaaggatccttccaaacggcctacagcagctgaattgctcaaatgcaagttttttcaaaaggccaaaaaccgagagtaccttatcgagaagctgttgacccgcacaccagatatcgcccagcgagcaaaaaaggtccggcgagtgcccggaagctctggccatctccacaaaactgaggacggcgactgggaatggtccgacgacgaaatggatgagaaaagcgaggaaggaaaggcagcattttctcaagagaagtcaaggcgggtcaaagaggagaatccagagatcgctgtcagcgctagcacaattcccgagcagattcagtccctgagcgtgcatgattcgcaggggccacccaacgcaaacgaggactatcgtgaagcttcatcttgcgctgtgaacttggtcttgcggctccgtaacagccgtaaggagctgaatgatataagattcgaattcacgcccggacgtgacaccgctgacggcgtctctcaagagctattctctgcgggactggttgatggccacgatgttgtgatcgtagccgcaaacctgcagaaaatcgtggatgatccaaaagccctcaaaacacttacatttaagctcgcttcagggtgcgatggctccgagattccagacgaggtgaagctgattggcttcgctcagctgagtgtttcctag

SEQ ID NO: 240051 - DNA, 2715 bp, Artificial Sequence
  Description of Artificial Sequence: Synthetic coding sequence
atggatgcgggattttttcgaggaacgtcagcagaacaggataatagattctcaaacaaacagaagaaacttttgaaacagctcaaattcgccgaatgcctggaaaaaaaggtcgacatgtcaaaagtgaatctagaagtaattaagccctggattacaaaacgcgtcaccgagatcttaggttttgaagatgacgtcgtgatagagttcatttttaaccagttggaagtgaagaatcctgacagcaaaatgatgcagatcaatttgactggtttcctgaacgggaaaaatgccagagaattcatgggggagttatggccacttttgctgagtgcccaggagaacattgctggtataccctccgccttcctagagttgaagaaagaggagattaagcagcggcagatcgaacaggagaagctggctagcatgaagaaacaggacgaggacaaagataaacgggacaaggaggagaaggaatcaagccgtgagaagcgagagaggagtcgcagccctcggagacggaaaagccgtagtccctccccaaggcggagaagctcccccgtacgaagagaaaggaagcgctctcactcacggagccccaggcatcgaactaagtcccggagcccaagcccagctcctgagaagaaggaaaagacgcctgaattacccgaacctagcgtgaaggtgaaagagccttccgtccaggaggcaacctccacctcggatatactcaaggtacctaagccggaaccaattcctgagccaaaggaaccctccccagagaagaacagcaagaaagaaaaggaaaaggagaaaactcggccacggagtaggagtagaagtaaaagccgcagtagaacccggagccgaagccccagccacacgcggcctcgccgacggcataggtccaggagccggtcctacagtcctcgaaggagaccgtccccccgtcgacgaccctctccacgacgccgaacaccacccaggcgcatgccacctccccctagacatcggaggtcgcggtcccccgtgcgcagacgcagacgctccagtgcctctctgagcggttcgtccagttcttcctcatcgtccaggagtaggagtcctccaaagaaacctccaaaacgcacttcatccccccctcggaagacgcgccgtttgtctccttctgcctcccccccacgcaggcggcatcgaccatcgccccctgccacccccccacccaagacgcggcacagtccaacccctcaacaatcgaataggactcgtaagtcccgggtgagtgttagtccaggccgtacatccggtaaggtcaccaaacacaaaggaacagagaagagggaaagcccctctcccgctccaaagcccagaaaggttgagctcagtgaaagcgaggaggataaagggggtaagatggcagctgctgattctgttcaacagcgcaggcagtataggcgccaaaatcaacagtcaagcagcgattctggcagttccagttccagcgaggatgagagacccaaacggtctcacgtgaagaacggcgaagtcggtagacgccgtaggcactctcccagccgaagcgcttctccaagcccgcgtaagagacagaaggaaacgtccccacggggtagaagacgacgctcaccaagccccccacctaccagacgtcggagaagtccttcacccgcacctccccctcgaaggcgccgtacacccacccctccacccaggcgccgaactccctctccacctccccgacgtcggagcccgtcaccaagaagatacagccctcccatccagcgtcgttattccccatccccccctcctaaaagacgaaccgcaagcccccctccacctcccaagcgtagagcgagcccgagtcccccacctaaaaggagggtatcccattctcctccaccaaaacagcggagcagcccggtcaccaagaggcgcagcccaagtctgtcttccaaacacaggaagggcagctcaccaagtcggtcaactagagaggcaaggagcccgcagcctaacaagcgacacagccccagccccagacctcgcgctccccagacctcgtcaagtccccctcctgtgcgtcgtggtgctagctcatccccccagcgcaggcagagcccctctcccagcactcggcctatccgacgcgtgtctagaaccccagaaccgaaaaagattaagaaggctgcctcgccctcacctcagtctgtgagacgggtgtcaagtagcagaagcgtgagcggatcccctgagcccgcagcaaagaaacctcctgccccaccgtctcctgttcaaagccagtctcccagcacaaattggtctccagccgtccctgtcaagaaagccaagagcccaacaccctcgcccagcccacctcgtaactccgaccaagagggcggaggtaagaaaaagaagaagaaaaaagataaaaaacacaaaaaggataagaaacataaaaagcacaaaaaacacaagaaggagaaggccgttgccgctgctgccgctgccgctgtcacaccagccgcaatcgctgccgcaactacgacgctggcgcaggaagagccggtggccgcaccggagccaaagaaagagactgagtctgaagcggaggataacctcgacgatctggaaaagcacctgagagaaaaggccctcagatcaatgagaaaggctcaggtttcacctcagtcatag

SEQ ID NO: 240052 - DNA, 2742 bp, Artificial Sequence
  Description of Artificial Sequence: Synthetic coding sequence
atggatgccggattctttcgcggaacgtcagctgagcaagacaacagattcagtaacaagcagaagaaactgcttaaacagcttaaattcgctgaatgcttggagaaaaaggtagatatgagcaaagttaacttggaggttattaagccatggattactaagagggtcacggaaattcttggcttcgaagatgacgtcgtaatcgaatttatttttaatcagctggaggtgaaaaaccctgattccaaaatgatgcagatcaaccttactggttttctgaatggtaagaatgcccgtgaatttatgggcgaactgtggcctctcctgctgtccgctcaggagaacatcgcagggattcccagcgcgttcctggaactaaagaaagaggaaatcaagcagcgacagatagagcaggaaaaattagcctccatgaagaaacaggacgaagataaagacaaacgcgacaaggaggagaaagagtcttctcgtgagaagagagaacgaagcaggagtccacggaggcgaaaaagtcgatctcctagtccacggagaagaagctctccggtgcgcagggagagaaaaagatcccattcacgcagtcccagacaccgaaccaagagtagaagcccgagtcctgctcccgagaagaaggagaaaacacctgagctgccagaaccctctgtcaaggtaaaggagccttcagtgcaagaggctacatcgacgagcgacatactgaaggtgcctaaacccgaaccaatccctgagcctaaggaacccagtcctgagaagaactctaagaaagagaaagagaaggaaaagacaaggcctcgctcccgttctaggtccaagtcacgcagccgaacaaggagcaggtccccatcccataccaggcccagaaggagacacaggagcaggtcacggaggaggccctctcctcgcaggagaccctccccaagaagacgcacacctcccaggaggatgccaccgcctccaaggcaccggcgatccaggtcaccggtccggaggaggagacggagctccgccagcctgtcaggcagctccagctcatcttcttcaagtcgatctaggtcccccccaaagaagccaccgaagcgcacctcttctcctccacgaaagactcggcgattgtcaccatccgcatctccccctaggaggcggcataggccctcacctcccgcaaccccaccacctaaaacccgacatagccctacgccgcagcagagcaatagaacaaggaaaagccgtgtgagcgtgtccccaggccgtaccagtggcaaagttaccaaacacaaaggtaccgagaaaagagaatctcctagcccagcacccaagcctcgaaaggttgaacttagtgagtccgaagaggataaaggtggaaagatggctgccgctgactccgtgcagcagcgtagacagtataggagacagaatcagcagagcagctccgattcaggatccagtagttctagcgaggatgaaaggcctaagagatcacacgtgaagaacggagaggtgggacggaggcgaaggcacagcccctccaggtccgcaagccctagtccacgtaaaagacagaaagagactagtccaagaatgcagatgggcaagcggtggcagtctcctgtcacaaagagtggacggaggagaaggtcccccagtcccccacccacccggagacggagaagccccagcccagccccacctccccgacggaggaggacgcccaccccaccaccaagaagaaggacaccaagtcctccccctaggcgtcgttctccatccccaaggcggtattctccacctattcagagacggtatagccctagtcccccacccaagcggagaactgcttcccctccgcctcccccaaagagacgggctagccccagcccccctccaaagaggagggtttcacacagccctccccctaagcagcgttcatcacccgtcacgaagcgcaggagcccgagcctgtcttcaaaacaccggaaaggcagtagcccttctagatcaaccagggaggccagaagccctcagcctaacaaacgccacagcccttctcccaggccaagggcgcctcaaacctcctcttcccctccacctgttcggaggggcgcttcaagtagtccccagcggaggcagagcccatcgccatcgacgcgccctattagacgggtgtctaggactccggaacctaaaaagatcaagaaagccgctagcccatctccacagtcagtgcggagagtgtcctcatccaggtccgtcagtggctccccggaacccgctgcaaagaagcctcccgctccaccaagccccgtgcagtcccagagcccaagtaccaactggtcgcccgcagtccctgtaaagaaggctaagagcccaaccccttcaccctctcctccccgtaactctgatcaagaggggggaggaaaaaaaaaaaaaaagaagaaagataagaagcacaagaaagacaagaaacacaaaaaacataaaaagcataagaaagaaaaggctgtggctgcagccgctgccgcagccgtgacaccagcagctatcgcggcagccacaaccaccttggctcaagaggaacccgtggcggcacctgagcccaaaaaggagaccgagagtgaggcagaagataacctagatgacctggaaaagcacctgagggaaaaggcactgcgctctatgcgcaaagcacaggtatccccccagtcatag

SEQ ID NO: 240053 - DNA, 2751 bp, Artificial Sequence
  Description of Artificial Sequence: Synthetic coding sequence
atggacgccggtttctttcgtggcaccagtgccgagcaggataacagatttagcaacaagcagaagaagctgctaaagcagctgaagtttgccgaatgcttggagaagaaggtggacatgagcaaggtaaatctggaagtgataaaaccatggatcaccaagcgggttaccgagattctggggtttgaagatgacgtggtcatcgagttcatctttaaccagctagaggtcaagaatcctgacagcaaaatgatgcagattaacctgacgggatttctaaacggaaagaacgcccgagagttcatgggtgagctgtggccgctgctgttaagtgcccaagagaacatcgcaggcatcccctctgcatttttagaactgaaaaaggaagaaattaagcaacgtcagatcgagcaggaaaaactggcctctatgaaaaaacaggatgaggataaggataaacgcgacaaggaggagaaagagtcctcgcgggagaagagagaaaggtcccggtcccccaggagaagaaaatctagatccccctcacctcgcagaagatcatctcctgtgcgcagggaacgcaagcggagccacagccggtcacctcgtcacagaacaaaatctaggtctcccagtcctgctcccgaaaaaaaggagaagacacccgagctacccgaacctagcgtgaaagtcaaagaaccatccgttcaagaggccacttccacaagcgatatcctgaaagtgcccaaacccgaacctattccggagcctaaggaaccttcccctgagaaaaacagtaagaaggagaaggagaaagaaaaaacgcggcctagaagcaggagccggtcaaagtcacgcagtaggacacgctctcgtagccctagccatactaggccacgcaggcggcatcgatctcgctccagatcttacagccctcggagacgtccctctccgagaaggaggccctcaccacgcaggcggacgcctccaagaaggatgcccccaccaccacggcatcggaggtctcgttcacccgtaagacggcgtcggcgatccagtgcttcgctaagtggtagctcttcttcgagttctagttcacgaagccgcagcccacccaaaaagccacccaagagaacctcctcccctcctaggaagacccgaaggctgtcccctagcgcaagcccacctcgcagaagacaccgcccatctccacccgctaccccaccccctaaaacaaggcattccccaacaccacagcagtcgaatcggactagaaagtcacgcgtctccgtctctcctgggaggacatcagttaccaaacacaaggggacggagaagagagaaagtccttctccagccccaaagcctaggaaagtggaattgtcagaatcagaggaggacaagggtggaaagatggccgcagccgattctgtccagcaacggaggcaatacaggcgtcagaatcagcaaagctcttctgattccggctctagctcttccagcgaagatgagcgccctaaacggtcccatgtcaaaaacggggaagttggcagacggaggagacacagtccctccagaagcgcaagtccatctcctaggaaacgccagaaggagacctctccacgaatgcagatggggaagcggtggcagagcccggttacaaagagtggaaggagaagacgatctccttctccaccccctacccggaggaggagatcgccctcacccgcaccaccacccaggcgcagacgcacccccactcctccaccgaggaggaggacccccagcccaccaccccgtagacgcagcccctctccgaggcggtatagccccccaattcagagacgctacagccccagtccaccacccaagaggcggactgcctcgccccctccgccacccaaaaggcgcgcttccccttcccccccacctaagcgccgtgtgtcccacagccctccacccaagcaacgatcaagtcccgtgaccaaacgcaggtccccgagtctgtcatccaagcacaggaaaggtagctcccctagtcgctccacacgagaggcccgaagcccgcagcctaataagaggcactcaccgtcccctagacccagggctccacagacgagctcttcccccccacccgtcagacggggagcaagcagtagtcctcagaggagacagtccccatccccaagcacccgcccaataaggcgggtgtcaaggactccagagcccaagaagatcaaaaaggctgcttcaccaagcccacaatcagtgcgcagggttagctcttcccggagcgtatctggaagccccgagcccgcagctaagaaaccaccagctccaccctccccagtccagtcccaatcacccagtactaactggtccccggctgttccagtaaaaaaggccaagagcccaactccaagccccagccccccaagaaacagcgaccaggaaggcggtgggaaaaagaagaagaagaagaaagacaaaaaacataaaaaggacaagaaacacaagaaacacaaaaaacataagaaagaaaaggcagtggcggcagccgcagcagccgcagttacaccagccgctattgccgcagcaaccaccacgcttgcccaggaagagcccgtggctgcccctgagccaaaaaaagaaacagagagtgaggcagaggacaacctagacgacctggagaaacaccttcgggagaaggctctgcgcagtatgcgtaaggcgcaagtgtctccccagtcttag

SEQ ID NO: 240054 - DNA, 957 bp, Artificial Sequence
  Description of Artificial Sequence: Synthetic coding sequence
atgggtgaattatggccactgctgctgagcgcacaggagaatattgcaggtatcccatcggcatttctcgagctcaaaaaggaggaaatcaagcagcgccaaatagagcaggagaagctcgccagcatgaagaagcaggacgaggacaaggacaagagggacaaggaggagaaggagtcctctcgcgaaaagcgggagaggagcagaagtcctcgcaggacgaagtcccgtagcccctcacctgctccagagaaaaaagagaaaacccctgagctgcccgagcctagcgttaaggttaaagaaccatccgttcaggaggccacatcaacttcagacatactgaaagttcctaagcctgagccaattccagaacctaaggagccgtcgccagaaaaaaattcaaagaaggaaaaggagaaggaaaaaactcggcctcgtagcagaagtcggagtaagtctcgtagtagaaccagaagccgcagtccgagtcacacaaggcccagacgacgacatagaagcaggtcacgcagttattctccccgaaggcgcccttcccctaggaggagacccagcccacgacggcgaacccctcctaggcgcatgcctccgccacccagacaccgacgatctcgaagccccgtgcggaggttctcggggattctgccgcctaaggttaactctgctgaagaggacgtgcgccagcacccctgccttggcgttgcccaccatcccctgcatctggtccatgggcatcatcagcgtagtcttccacgaggacaccctgcacctttgggcaaactcgttgggtatttattacaacaggtgctccagggggaaggaacaggacatcatctgctgcagttgcatcatcccaagttaggtattcccctccacccatcttcacagacagtacaggagaaggtcgtgtttttgtgtcttcagggagaacttcagtag

SEQ ID NO: 240055 - DNA, 8258 bp, Artificial Sequence
  Description of Artificial Sequence: Synthetic coding sequence
atgtacaacggcatcgggctaccaaccccacgcggttcaggaactaatggctacgtacagaggaacctctctctcgtgcgcggaaggagaggggagcgccctgactataagggagaggaggagctgaggcgcctggaggcagccctggttaaacggcctaatccggacatattggatcatgaaagaaagcgacgtgtcgagctgcgttgtttggagctcgaagagatgatggaggagcaaggttatgaagagcaacagatacaggagaaagttgctactttcagactgatgctgttggaaaaagacgtcaacccaggaggaaaggaggagacccccggacagcgtccagcagtgactgagacacatcagctagcagagctgaacgaaaagaaaaatgagcgattgcgagccgcttttggaattagtgattcctatgtggatggcagttcatttgacccgcagcgcagggccagagaagcaaagcagccggcacccgagccccctaaaccctattctttagtgcgtgaaagcagcagcagcaggagccccactcctaagcagaagaagaaaaagaaaaagaaagaccgcggaaggagaagcgagagtagctcacctagaagagagaggaagaagagctctaagaaaaaaaagcatagatctgagtctgagtccaagaagaggaaacaccgcagccctactcccaagtctaagcgcaagagcaaggataagaaaaggaagagatccaggtctaccactccagcacccaagtcccgccgagcacaccgcagcactagtgcagacagcgcctcttcctcggatacctcacggtcaaggtcccgcagtgctgcggctaagacccacacaacggccctggcaggacgaagccccagccctgctagcggcagacggggagaaggcgatgcaccattctcggagcccggaaccacatctacccagcgtccgtcctccccggaaactgccactaaacaaccgtccagcccatacgaggataaggataaggataagaaagagaagagcgccaccagacctagcccctcccctgagagaagcagtactggccctgaacccccagcaccaacccctctgctggctgagcgccacggcggaagtcctcagcctctggctaccactccactatcgcaggagcccgtgaatcccccttccgaggcttcaccgactagagaccgctctcctccaaagtctccagagaaattgcctcaatcctcgtcctctgagagctcacctccgtctccccagcctactaaagtctccagacatgcttctagcagtccagaatcacccaagccagctcccgcaccaggatcacaccgcgagatttcttcctcgcccacgtcgaaaaaccggtcccatggcagggccaagagagacaagagtcactcccatactccatccagacgcatgggccgatctaggtctcctgcgactgcaaagcgcggacggagccggtccagaacccccactaagagggggcatagtaggtcccggagtccacaatggcgtaggtcaagatcagcacagcggtggggccgatcaagatctccacagcggaggggtagatcacgcagcccacagcgccctggttggtcccgcagcaggaacactcaacggaggggacggtcacggtctgccaggagggggagatcccactcccggagccctgccacccgcggacgcagtagaagtcggacacccgcacggcgtggaagatcaagatcaagaactccagcccgacgccgaagccggtctaggacccccactcgaagaaggtcacgctcacgcactcccgcacgcagagggcgaagcaggagtagaactcctgctcgcagacgcagccgcacaagatctcccgttagaagacgctccaggtctcgaagtcccgctagacggtcaggcaggtccaggtctcgaacacccgcacgcagggggagatcaaggtcccgcactcctgctcggaggggtagatctcgcagtcgcacccccgcacgtaggtctggcagatcccgcagccgcacccccgcaaggcggggaaggagcagaagtcggactccccgacgaggcagaagcaggtcaaggagccttgtgcggagagggagaagccacagccggaccccacaaaggcggggacgtagcggaagctccagcgaaagaaagaacaaaagcagaacgagccagcggcgttcacggtctaacagttctcccgagatgaagaaaagccgcatttccagccggaggagtcgtagcctgtcgagcccgagatctaaggctaaatcgcgcctgtcactgaggcggagtttgtccgggagcagcccatgccccaagcagaagtcgcaaacccctccacgtcgcagcaggagtggctctagccagcccaaagccaagtcccgcactccccctagacggagtcggtcgtcctcctcgccgccacctaagcagaagtctaagaccccctcaaggcagtcacacagctcaagcagcccacaccctaaagtaaaatccgggaccccgccacggcagggcagtattacgtcaccccaggccaatgaacaatctgtaactcctcaacgacggtcctgttttgagtcctcacccgaccctgagctgaaatccaggaccccaagtaggcactcatgctctggttcttcgccccctagagtcaaatcttctaccccacctagacagagtccaagcagatcttcatcccctcaacctaaagtgaaagcaataataagtcccagacagcgaagtcacagtggtagctccagtccgagtccaagcagggttacttcaagaacaacacccaggcggagccgaagtgtcagtccgtgctccaatgttgagagccgactgctgcccaggtactctcactcgggctcatctagcccagacacaaaggttaagcccgagactccacctcgacagtcacacagcggctctatatctccgtaccctaaggtgaaggcccagacaccccctggcccttcacttagcggttctaaaagcccatgtccccaggagaagagcaaagacagcttggtccaatcgtgccccggatctctgtctctatgcgctggagtgaaatccagcactccgccaggagaatcgtactttggagtgagctcgctccaactgaaaggccagtctcagactagcccagaccatcggagcgatacatcgagccctgaagttaggcagtctcacagtgaatcaccgtctctgcaaagtaagtcccagacgagccccaaaggaggccgatctagaagttcttccccagttacagaacttgcgtcacggagcccaattaggcaagaccgcggtgagttcagcgcctcacctatgctgaaatcaggaatgtcacccgagcagtcacgctttcagagcgacagtagttcctaccctaccgtagattctaacagtctcttaggccagagcaggctggagaccgctgagtcaaaagaaaaaatggctctgcctccccaagaggacgccaccgcaagcccccctcggcagaaggacaagtttagtccctttcccgttcaggatcgcccagaatcctctctggtgtttaaagatacactccggaccccacccagggagcggtctggcgctgggtcgtcacccgagaccaaggagcagaacagcgccttacccacttcaagccaggatgaggaattgatggaggtggtggagaaatcggaagaaccagccggacaaatcctgtcccacctatcaagtgaactgaaagagatgagtaccagtaattttgagagctccccggaagtagaagagagacccgctgtgtctctcactttggatcagagccaatcccaggcaagcctggaggccgtcgaggtgcccagcatggccagctcttggggcggaccacatttcagtcccgagcacaaagaactgtccaactctccgcttagggagaactccttcggcagccccctcgaatttcgcaactctggcccattgggaacggagatgaatacagggttctcctccgaagttaaagaggatctcaacggaccctttctgaaccagctggagacagatccatcactggatatgaaggaacagtctaccagatcctctgggcactctagttcggagttgtcccccgatgcggttgaaaaagctggcatgtcttctaaccagtcaattagtagtcctgttctggatgctgttccccgaactccttcgcgagaaagaagttctagcgctagcagtcctgagatgaaagacggcctgcctagaacaccctctagacgttcgcggagcggctcaagcccagggttgcgcgacgggagtggcacaccaagccggcacagccttagcggatccagccctggaatgaaagatattcctagaaccccaagtaggggacggtcagagtgtgattcttctcccgaacctaaggctcttccccagacaccacgcccaaggagccggagcccatcttctccagagttaaacaataagtgtctgactcctcaaagggagcgatctggtagcgagtccagcgtggaccaaaagactgtagcccgaaccccattgggacagagaagtagatcagggtcatctcaggagttggatgtgaaaccgtcggcatccccacaggaacgctctgagtccgactcctccccggactcaaaagccaagacccggacccccctgaggcagcggagccgtagcgggagtagcccagaagtcgatagtaagtcacgtctgagtccgcgaaggtctagaagcgggagctctccagaagttaaagataagcccagagctgcacctagagcacaaagcggaagcgactcttcccccgagcctaaagctccggcaccccgtgccttgcccaggcgttctagaagcggcagtagctctaagggaaggggacccagtccggaggggtcttcctccactgaatcgtcgccggaacaccctcctaagtcacgcacagccagacgcggatcgaggagctccccagagccaaaaaccaagagccggactccaccgaggcggaggagttctagatcttctcccgagttgacgaggaaagcccgattatcgcgtcgctccaggagtgcctcatccagtcccgagacaagaagcaggaccccgccacgtcaccgacgttcgccttcagtgagcagccccgagccagccgaaaaatcaaggagctcacggaggaggaggtctgcatcctccccacgtaccaaaaccacctccagaagggggagaagtccaagccctaagcctagaggcttacaaagatctagaagccgatcaaggagggagaagaccaggacaaccagacggagggataggtcggggagcagccagtctacatctcggagacgtcagcggtccagaagtcgctccagggtcacccgcagaagacgaggcggaagtgggtaccactcaaggtctccagctagacaggagagctcccggacttcaagccggaggcgacggggtcggtctcgaacccccccaaccagtcgtaagcggtccaggtcaagaacatcacccgctccgtggaaacggtcaagatccagggcgtccccagcaacccatcggaggagcagatcccgcacaccattgatctccaggcggaggtcccgcagcaggactagtcccgtcagcaggcggcgtagccgtagcaggaccagtgtgactaggcgcaggagcagatctagagctagtcccgtgtcccgcagacggtctaggagcaggacgcctcccgttacaagaagaaggagccggtctagaacccctaccacccgaaggcgatctaggagcaggaccccccctgtgacgcgcagaaggtccagaagcaggacaccaccggtcaccagaagaaggtcacgatcccggacatctcccattacacgaagaaggtctcgtagtcggactagccctgttacacggagacgatctcgaagtcggaccagccctgtgaccagacgccgtagtcgttccaggacgtcaccggttactaggcgccgatcacgaagtcgcacaccacctgccatcagacggcgatccagaagccggaccccacttctgcctcgaaagcgatctcgcagcagaagcccactggctatcagacgccgatctagaagcaggacaccgcgaacagccaggggaaagaggtccctgactcgctccccccctgcaattagaaggaggagcgcctcaggatccagctccgatagatccagatctgctacacctccagccacgcgtaaccactccggctcgcgtacacctcccgttgccttgaattctagccggatgtcttgtttcagccggccttctatgtcaccaacacctcttgatcgatgtcgcagccccggtatgctagagccactgggatcctccagaacaccaatgtctgtgctgcagcaggccggtggttcaatgatggacggcccaggaccccgaattcctgaccatcaacggacctccgttcccgagaatcacgctcagtccaggattgcgttagccttgacagccatcagtcttggaacagcaaggccccctccttcaatgtctgccgctggccttgcagccaggatgagccaagtaccggctcctgttccactgatgtcactcagaacagcacccgcagccaatttagcaagcagaattcctgcagcctccgccgctgctatgaatttggcttccgccaggacgcctgccatacctactgctgtcaatctggccgatagccgaaccccagccgctgccgctgcaatgaatttggctagtcctcgcacagcagtggcgccttcagccgtgaacctggcagaccctaggactccgacagcacctgcggtcaatctggcaggtgccagaaccccagcagccctcgccgcacttagtcttaccggaagcggcacaccccctacagccgctaattatccttcctcaagccggacaccacaggcccctgctagtgcgaaccttgtgggacctaggtcagcccatgctaccgcccctgtgaacattgctggctctaggaccgccgctgctcttgcccctgcttccctgaccagcgctcgcatggcgccagcacttagcggtgcgaatttgacatcccccagggttcccctgagcgcctacgaacgcgtttcaggccgtacgagccctcctctattggaccgtgccagatcaaggactcctccgtcagccccatctcagagcaggatgacaagcgaacgcgcaccttctccatcatcccgcatgggtcaggctccgtcccagtcactgctgccccctgcacaggatcaacccaggtcccccgtcccctctgcttttagcgaccagtcgcggtgcctgatagcacagactacacccgtggcaggatctcagagcctcagcagcggcgctgtggctactaccacatcgtccgcaggtgaccataacggcatgctgtctgtgccagcacccggtgtcccccacagcgatgtcggggaaccacctgctagcacaggtgcccagcagccctctgcccttgcagccctccagcccgctaaggaacgtaggagttcatcttcttcttcaagctcttcctccagctcctccagctcttcctcctctagcagttcttcttcatccagtgggagtagtagctccgacagcgaaggtagctctttgcccgtgcaacctgaggtagcgctaaaacgtgtcccttctccaactcccgctccaaaggaggcagttcgagaaggtaggccaccagagcccaccccagcgaaaagaaagcgcaggtccagctcaagctcttcgtcatccagctcaagttcttcatcatcctcaagctctagctcgtcaagctcctcaagtagctcttctagttcatcatccagttcctcctctagcagcagctctagctctccctctcccgcaaagcctgggccacaggcactacctaagcccgcttctcccaaaaaacctccgccaggtgaacgccgatcccgaagccctagaaagcctatcgactctctgagggactctagaagcttgtcctatagccccgtggaaagacgacgtcctagtccacagccatctccccgagatcagcagtcctcctcaagcgaacgaggttccaggcgagggcaacgcggagactctcggagtccttcacacaagcggagacgagaaacaccttcccccaggccaatgaggcataggtcttctcggagcccata

SEQ ID NO: 240056 - DNA, 702 bp, Artificial Sequence
  Description of Artificial Sequence: Synthetic coding sequence
atgatcagcttcccctcactccaaagaaccgagctcgaggagatggacctcatactccaacaagagggatggcagctggacctgaaacgcaactccctgggctggaaagacctgcagaggtcctctcacccctctccgtgcctgcaagctggcaggccactgccccagcccacatgtacccaccgcggattacccaagctgaggctgagtgaggaaggagattatcccgcatcagcttcaacgccggaaccacgaggcttaatacccccttcaggaacgtttctgcgattcaacttggatcctttgtgttgcggtccacagcccgtagcatctgtgtcaaggggatgggtgagttctcatcactgctcccccgagaactgctggctaacatggttaggcgaattgcccgcacccttcagcggaacccctcctcccacggctgtccctcccggacaaggttcccggtctaggtcaccccgtaagccaatagacagcctgagggatagcagaagtctctcatattctccagtggagcgaaggagaccatctccccagccttccccccgtgaccagcaatcatcgagctcagagcgcggaagccggagagggcagcgcggagatagccgctctccctcccataagaggcgcagagaaaccccaagtcctaggcccatgcgccacaggtctagtcggtccccttag

SEQ ID NO: 240057 - DNA, 7004 bp, Artificial Sequence
  Description of Artificial Sequence: Synthetic coding sequence
atgtataacggcataggcctaccgaccccccgaggtagcggtaccaatggctacgtacaacggaatctttctttggtcagaggtcggaggggggagcgcccagattataaaggggaggaagaacttaggcgattggaagcggcactagtgaagcgacccaaccctgatatactggatcatgaacggaagcggagagtagagctgagatgccttgaattagaggaaatgatggaggagcagggctatgaggagcagcaaatacaagaaaaggtcgcaaccttccgtctgatgctgctggagaaagacgtcaatccaggcggaaaagaggagacacctggccagcgccctgctgtgactgagacacaccaactcgccgaattgaacgagaagaagaacgagcgactacgagctgcttttggcatcagcgactcttacgtggacggctcttcatttgaccctcagcgcagggcccgtgaggccaagcagcccgcaccagagccccctaagccttattcactagtccgcgagtcttcctcttcacgatcacctacgccaaagcaaaagaaaaaaaagaagaaaaaggaccgcggtagaagaagcgagtcttccagcccgagacgggagcgaaaaaagagcagtaaaaaaaagaagcaccggtctgagagtgagtccaaaaagagaaaacaccggagtcctactccgaagtctaaaaggaaaagcaaagacaagaagcgtaaacgatccaggtctactacccccgctcctaagagtcgtagagcgcacagaagtacctctgccgactctgcgtcgtcctcagacacatctcggtcaaggtcaagaagcgctgccgctaagacacacactaccgccctcgccggacgctcacccagtcctgcgtcagggcgacgcggagaaggggacgcgccttttagtgagccgggaactacaagcacacagcgcccttccagtccagagacggctacaaagcagcccagtagcccatatgaagacaaggacaaggacaagaaagaaaaaagtgccaccaggccatcgcctagccccgaacgcagttctaccggacccgaacctcccgcacccacccccctgcttgccgaaaggcatggcggatccccccaacctctagccactacaccgctaagccaggagcctgttaatccaccttccgaagcttcccccacaagagaccggtcccctcctaagagtccagaaaagcttcctcaatcctcttccagtgagagctctcctccttccccccagcccacgaaggtgagcagacacgccagctctagccctgagtctccgaagcccgcacctgccccaggttctcatcgcgaaatttcaagttcgcccacctctaagaaccggagccatggcagagctaaacgcgacaagtcgcacagtcatacccctagcaggcgcatgggtcgcagtagaagcccagctactgctaagcggggtcggagcaggagcaggacacccacaaaacggggtcatagtcgctctcgtagtccgcaatggaggaggagcagaagtgctcagaggtgggggcgatcccgcagcccccagaggagagggaggagccggtctccccagagaccagggtggagccggtccaggaacacacaaagaagggggaggtccaggtcagccagacgcggtaggtcacatagtcgtagcccagccacgaggggcagatctaggagccggacgcccgctcgacggggaagatcaaggtccagaacccccgctcggaggcgttcgaggtctagaacccctactagacgtcgtagtcgcagccggacgccagccagacggggtcgctcaagaagtcggacccccgcacgccgaagatcacggacaagatctcctgttcgaagaagatctcggtctcggtcgcctgcccgtagatctgggaggagccgctcccggaccccggctcggcgtggcaggtcccgtagccgcactccagccaggaggggcaggagtagatccaggactcctgccaggcgttctgggagaagccggagtagaacacctgcccgacgtgggaggtcccgaagcaggacccccaggagaggcagaagccgcagcagatcgcttgtgaggaggggccgtagccactctcggaccccccaaagaagggggaggtctggatctagtagcgagcggaagaataagtcccgcacctcgcaacggagaagccggtcaaactcctctcctgaaatgaagaaaagtcgcatcagcagtaggcgcagccgcagtttgagttcccctcgcagtaaagcgaaatcccgcctctccctgcggaggagtctcagcggatctagcccatgccctaaacagaaaagtcagacgcctccccgacgctcccggagcgggtcatcacagccaaaggctaagtccagaacccctcctcgcagaagccgaagctcgagctcaccaccacctaaacagaagagtaaaactccatcaaggcagtcccattcatcatcatccccacatcctaaagtgaagagcggaacccctccgcgacagggatcaatcacttctccacaggcaaacgagcagagtgtcacgccccagaggaggtcatgctttgagagctcacccgaccctgagcttaaatccagaactcctagcaggcacagctgctcaggctcatctcctcccagggtgaaatcttcaaccccgcctaggcaatctccttccaggagcagttccccgcaaccaaaggtgaaagctatcatctcccccagacagaggtcccacagcggctcatcgtcaccatcgccatccagagtcactagtcggacgactccccgtcgtagccgatcagtctcaccctgcagcaacgtggagagtagactgctgccacggtactcacatagtggcagcagctctccagacacaaaggtgaaaccagagactcctcctagacagagtcactcggggtctataagcccatatcctaaagttaaagcccaaaccccaccgggaccatcactcagcggttctaagagcccgtgcccccaagaaaagagtaaggatagtcttgtccagtcatgtcctggatcactgtccctctgcgccggtgttaagagctctactcccccaggagaaagctattttggtgtgagctcactccagctcaagggtcagtcgcagacctcgcccgaccatcgaagcgatactagtagccccgaggtgaggcagagccacagtgaaagccccagcttacagagcaaatctcaaacttcccctaagggcggacggagtcggagttcaagtcctgtgacagagcttgccagtagaagtccgattaggcaggaccggggagaatttagcgctagccccatgcttaagagcggaatgagcccagagcagtcgaggtttcagtccgactcttcttcctacccgacggtagattccaattctctgttgggacagtcccggctcgagacagcagagagcaaggaaaaaatggctctaccccctcaagaagacgccaccgcctccccccctaggcaaaaagataagttctctccttttcctgtgcaggacagaccagaaagcagtctggtgttcaaagataccttaaggacacccccaagagagagatcaggcgctggaagcagtcctgaaactaaggagcagaatagtgccctccctacctccagccaagatgaggaacttatggaagtcgttgaaaagtccgaagagccggctggacaaattctgagtcacttatcatctgaacttaaggagatgtctacgagcaattttgagagctctccagaggtggaagaaaggccagcagtttccctcaccttagaccagagccagtcgcaagcaagccttgaagccgtcgaagtgcctagtatggcgtcatcatggggcggaccacactttagcccagagcacaaggaactgtcaaattcaccgttacgggagaattcttttggctccccacttgagtttaggaactcgggacccttgggaacagagatgaatacggggttctcaagtgaggtaaaagaggatctcaatggccctttcctgaatcagctcgagaccgatccctctctagacatgaaagaacaatcaactcgctcttcaggacactcttcttcagaactctctcccgatgcggtcgaaaaagcgggtatgtctagtaatcagtccatcagtagtcctgtgcttgatgctgtcccccgaacacccagccgagagcgttcttcgtccgcctcaagtccagaaatgaaggatggacttcctaggaccccttcccgtcggtctaggtcaggctctagtcctggcctgagagacggtagcggaacaccatctaggcatagcctgagtgggtcttcacccggaatgaaggacattcctaggacacccagtagaggaagaagcgagtgcgactcctcccccgaacccaaagctctgccccagactccccgaccgcgatcaaggagtcccagctcccctgagctgaacaacaagtgtttgacccctcaacgcgaacgctccgggagtgagagttccgttgaccaaaagacagtagcccgaactccccttggtcagcgttcacggagcggatcgagccaggagctcgacgtaaagcccagcgcctcgccacaggagaggagcgagtcagactcttctcctgatagcaaggctaagacccggacacctctgagacaacgcagccgcagcggatccagcccggaagttgactccaaatcccggctgtccccgagacgatcgcgctctggtagctcaccagaagttaaagataagccaagagcagctcctagagcgcaatccggctcggacagtagtccagagcctaaggcaccagcacctcgggctctgcctcgcagatcaaggtccggctcttccagcaaaggcaggggaccgtccccggagggttcttcatcaactgagtccagccctgaacatccccctaaaagccgcactgcccgtaggggtagtcggagctcacctgaaccaaaaacaaaatctagaacgcccccaagaagacgttctagccgctcctcccctgagttaactcgcaaagcaaggcttagcagacgatctcgctccgcttcaagctcccccgagacaaggtctcggacccctcctcggcacagacgttcaccgtccgtgtcctctccagaacccgcagagaagtctagaagcagcaggcgtcgtaggagcgccagctcacccagaactaaaacaactagccgcagaggcaggtccccatctccaaagcccagagggttacagcgctctcgatctagaagtcggcgagagaagacgaggaccacaaggaggagagaccgcagcggatcctcacagagtacctcgcgtaggagacagcggtcccgctcaagatctcgtgtgaccagacgaagaaggggtggatctggataccattcaagatcccctgcccgacaggagtcgtcaaggacatccagcagacggagaagaggtagatctcgaacaccccctaccagtcgtaagcggtctcgttcaagaacatcccccgcaccctggaaacggagccgcagtcgggcttcccctgccacacatagaagatcccgatccaggactcccctaatcagccgcaggaggtccagatctaggacaagccctgttagtaggagacgatccaggtctaggacgtcggtaactcgaaggagatcacgcagccgcgcatcaccagtaagcagaaggcgcagcaggtcccgcacaccgcctgtgacgaggcgaagaagccgcagccgaacacctacaacgcgccgacgcagtcgcagtcgcaccccccctgtgacgcgccgacgctctcgctcccgcaccccccctgtgacacggaggaggtctcggagcagaacatcccctattacacgacgccgatctaggagccgcaccagtcccgtcactagaagaagatccaggtcaagaacgagcccggttaccaggcgacggagccgttctagaacaagcccagtcacaagaaggcgatccagatctcgaacccctcccgcacaggatcaacccagatctcccgtgcccagcgccttttccgaccagtcgcggtgtcttatcgcgcagacaactccagttgcgggatcgcaatcattgagttcaggagccgtggctaccaccacctcatctgctggtgaccacaatggtatgctatccgttcccgcaccaggagttccccactccgatgtaggagaacctcctgccagtactggagctcagcagccgagtgccctagctgccctacaaccagcaaaagaaagacggtcttcatcctcgagcagttcttctagctcttcctcatcttcctcttctagttcctcatcgagctccagtagctctggatcaagttcctctgactccgagggatccagtctccctgtgcagcctgaggtcgcattaaaaagagtgcctagccctacgcccgcacctaaggaggcagttagggaaggtagacctcccgagcctacaccggcaaagcgaaagcggaggtccagctcctccagcagcagctcttcgagctcttcaagtagtagcagctcctcatcctcaagttcgtcctcttctagctcctccagttctagctcttcgagttcatccagctcaagtagtagcagtccctcacccgcaaagcccggtccgcaggccttgccaaaacccgcttccccaaaaaaaccccctccaggggaacgtcgcagcaggtcgcctagaaagcctattgactctctgagggatagtcgctcacttagctatagtcccgtggagaggcgacggccatcaccccagcccagcccgcgagatcagcagtcgtctagtagcgaaagaggatccagacgcggacagaggggcgactcgcgcagccccagtcacaaaagaagaagggagactccctctcccagacctatgcgccaccgatccagtcggtcgcccta

SEQ ID NO: 240058 - DNA, 936 bp, Artificial Sequence
  Description of Artificial Sequence: Synthetic coding sequence
atgctgcttgaaaaggatgttaacccaggaggtaaagaagagacccccggacaacgacccgctgttacagaaacacatcagctagcagagttgaacgagaagaagaacgagcgcctgagagctgcgttcggcatctccgattcctatgtggatggtagtagcttcgatcctcagagaagggctcgcgaggccaaacagccagcccctgagccgcctaagccttacagtctagtacgagaaagtagctcgtctagatctcctacacctaagcagaagaagaagaaaaaaaaaaaggaccgcggacgccgaagtgagagttcatcccccagaagagagaggaagaaaagttccaagaaaaagaagcataggtctgaaagtgagtctaagaaacgaaaacacaggtccccaaccccaaaatctaaacggaaatccaaagacaaaaagcggaaaagatctcgctccaccacacctgcaccgaagagtcggagggcccaccgaagcacctccgcggactcagctagtagttcggataccagcagatcccggagccgctcagccgctgccaagacccacaccactgcgcttgcgggacggtctcccagtccggctagcgggaggcggggagaaggcgatgcaccgttttcggagccaggtacgacgagcacacagagacccagttctccagaaacagccaccaagcagccaagctccccatatgaggacaaagacaaggataaaaaggagaaatcggccactcggccttctcctagccccgaaaggtcctccaccggacccgagcccccagcgccaactcccctgctggccgagagacatggaggcagtccccagccgcttgctacaacgcctctttctcaggagcctgttaatccctccccacagttgtttatgtttttaaagggtattctggtgttttag

SEQ ID NO: 240059 - DNA, 2871 bp, Artificial Sequence
  Description of Artificial Sequence: Synthetic coding sequence
cgccgaaggcgactgaggagggccgataggagaggcgaggcagccgcaccgggtcccagagactcgggtgctagagcagctgctgccgcacgccctttacctcttgggggaggcggtcgcagacgcagagttcgaggctacgaggaacagcaaatccaggagaaagttgccacttttaggttgatgctgctggagaaggatgttaacccaggaggcaaagaggaaacgccgggtcagagacccgctgtgacagagactcatcagctcgccgagctgaatgaaaagaaaaatgaaagactgcgcgctgctttcggtatttctgactcatacgtggatggatcctcctttgatccacagcgccgagcgagggaggccaaacagccagcccctgagcctcccaaaccctactccctcgtgcgcgagtctagttcaagtcggtccccaaccccgaagcaaaagaagaagaagaagaaaaaagatcgtggcagacgaagcgaaagttcgagtccccgacgcgagcgcaagaaaagcagcaagaagaaaaaacatcgttcggaatccgaaagcaaaaagcggaaacacaggtctccgactccaaagagtaaaagaaagagtaaggacaagaaacgaaaacgttctcgtagcacgacgccggctcctaagagcaggagggcacatcgcagcacctccgccgactccgcttcatcttcggacacaagtaggagtcgatcccgtagcgccgctgcaaagacccatactacagcactcgccggtcgcagcccatctccagctagcggtcggcgaggtgagggcgatgctcccttttccgagcccggtaccaccagcactcagcgaccctctagtccagaaacggcgacgaagcagccaagctccccatatgaggacaaggataaggataaaaaagagaaatctgcaacccggccatcaccgagtcctgagcggtcttcaacgggtcccgaacctccagccccaaccccattgcttgctgagcgacacggaggcagcccccaacccttagcaactacacctctgtctcaggagccagtgaacccacctagcgaagctagccctactagagacaggtcacctcctaagtcgccagagaaactacctcaatcaagctcttctgagagttctcccccatccccacagccaacaaaagtttcccgtcacgcctcctcgagccccgagagccccaagcctgccccagctccagggtcccatagggagatcagttcatcccctacatccaaaaacagaagccacgggagagctaaacgtgataagagccattctcacaccccctctaggcggatgggcagatctaggagcccggctaccgcaaagagaggccgtagccggtctaggacacccactaaacgcggacactcgaggtcccgctcccctcagtggcggaggtccaggtctgcccagcgctggggccgatcacgtagcccgcagcgtagagggcgtagcagaagccctcagcggccaggctggagtaggtccaggaacacacaacgaagagggaggtcgaggagcgcacggagaggccgatcgcactcccggtcacctgccacccgagggagatcccgatcacggactcccgctagaaggggcaggagtcggtctaggactcctgccaggcgtcggagtaggtcccgaacaccaacacgcagaagaagcaggagccgcacccccgctagacgtgggcgaagccgctctaggactccggcacgtcggaggtcaagaacgcggagccctgtccgcaggcgctcccggtctcgaagccccgctaggcgctccggtagatctcgctctcgcactcctgcacgacggggtcggtctcgctccagaacaccagcaaggcgaggacggagccgatccaggactccagcgagacgctcgggaaggagcagatcgagaactcctgcccgtcggggacgtagtcggtcccgaacgccaagacggggtcgcagcagaagcagatcattagttcgcagaggcaggtctcatagtcggacacctcagcgaagaggacgaagtggatcttcctctgagcgaaagaacaagtccaggacatcccaacgcaggtccagaagtaattccagtcccgagatgaagaagtcccgaatatcaagcaggcggtcgagatccctgtcgtcacccagaagcaaagccaagagcaggttgtctctccgacgcagcctcagcgggtcttcgccttgtcccaagcagaaaagtcaaacacccccacggcgaagtcgatctgggtcttctcagccaaaggcaaagtctcggactcctccacggagatcaagaagcagtagttctcctcctcctaagcaaaagtctaaaacaccctcgaggcagtctcattctagctcatctcctcatcccaaagtcaagagcgggaccccacctaggcagggaagtataacgagcccccaggcgaatgaacagtctgtgacaccacaaagaaggtcgtgctttgaatcatccccggatcctgagctgaagagtcggacaccatcaaggcactcatgtagcgggagctctccacccagagtcaagagctccacacctccacgccaatccccgtccagaagtagcagccctcagcccaaggtcaaagcgattatctcccccaggcagcgatcccacagcggatcctcctcccctagcccaagtagagtgactagcagaacaacacctcgccgaagtaggtcagtttccccctgctctaacgtggagagcaggctgctgccccgatactcccacagcggatcctcatccccagatacgaaggtgaagccggagacacctcctcgacagtcccatagtggctag

SEQ ID NO: 240060 - DNA, 6035 bp, Artificial Sequence
  Description of Artificial Sequence: Synthetic coding sequence
atgaagaaatcacgcatttcatcccggaggagtcgctcgctgtcaagtcccagaagcaaggccaagagcagactcagtcttcgtaggtctctgagtggatctagcccgtgccctaagcagaagagccagactcccccaaggaggtccagatccggttcatcccagcccaaggcgaaatctagaacaccccctagaagaagccgctcttccagttcgccaccacccaaacaaaaatccaagacacccagccgacagtcacactcctcttccagcccacatccaaaggtgaagtccggcacacctcctcgacagggctccatcacgtctccacaggccaatgagcagtccgttaccccacagaggcgttcttgctttgagtctagcccagatcccgaactaaagtcccgcacccctagccgccattcttgcagcgggtcttcaccacccagggtaaagagcagcaccccaccacgtcaaagtccttcacggtcttctagtccccagccaaaagtgaaggccattatcagccccagacagcgatcacatagcggcagttctagcccgagcccaagtagggtgaccagccggacgactccaaggcggtcccgatccgtttccccctgctcaaatgtggaaagccgccttctgccaaggtattcacattcgggtagtagcagcccagacactaaggtgaagccagagactcctcccagacagagccacagcggtagcatcagcccttaccccaaagtgaaagcccagacgccccctggaccgtctctttcaggcagtaagtctccctgcccccaagaaaagagcaaggacagcctggttcagagctgtccaggctctttatctctttgtgctggtgtaaagagcagtacccccccaggagaaagttatttcggagtttcatctttgcaacttaagggacagtcacagacttcacctgatcaccggagtgacacatccagtcccgaggtcagacaatcccatagcgagagcccttccttgcagtctaaatctcaaacttctcccaagggtggcagatctagaagctcaagtcctgttactgaactggcaagcaggagcccaatcaggcaagatagaggcgaattctctgcctctcccatgttaaagtccgggatgtcaccggagcaatctcgtttccagagcgacagtagcagctacccaactgtagatagcaattcactgttggggcagagcaggctcgagacagctgagtcaaaggaaaagatggcattacccccacaagaggatgccaccgcctccccaccccgacagaaggataaattctccccttttcctgtgcaggaccgccctgagtcatccctggtgtttaaagacacccttcggactcccccacgggagagaagcggggctggctcatcacccgaaacgaaggaacagaactccgccctcccaacctcaagccaagatgaggagttgatggaggtggtggagaagtctgaagagcctgccggacagatcctttctcacttgtctagcgagctaaaggaaatgtctacctccaatttcgagagctcccctgaagtggaggaacgcccagcggtcagtctcactctggaccagagccagtcccaggctagtttagaggccgtagaagtgccatcaatggcctctagttgggggggaccacatttctcccctgagcacaaggaattgtctaacagccctctgagggagaatagtttcgggtctccactggagttcagaaactctgggccattaggcacagaaatgaacaccggttttagctctgaggtgaaagaggacctaaatggacctttcctgaatcagctggaaacagatccctctctagacatgaaggagcaatccacccgaagctccgggcatagttcctcggagctttcccctgacgcagtggagaaagccggaatgagtagcaatcagtctatatcaagtcccgtactcgatgccgtaccaagaacaccttcaagggaacgatcaagctctgccagctcaccagagatgaaggacggtctgccaaggaccccttctcggcgatcccggagcgggagttcacctggactgcgggatgggtcagggacaccgagccgtcattccctgtcaggaagtagcccaggaatgaaagatatcccacggaccccatctcgagggagatccgagtgtgacagctccccagagccgaaagctctgccccaaacaccaagacccaggagtagatccccatcctcaccagagttgaacaacaaatgcttgaccccgcaacgtgaacgttctgggtcagagagttctgtggaccagaaaaccgttgcgcgaacgcctttaggccagcggagtaggagcgggagctcacaagaactggatgttaaaccctctgctagcccccaggaaagatcggagtccgactctagccccgactctaaggccaagacacgaacaccccttcgacagcggtcccgctctggaagctcaccagaagtggactccaagtccaggttaagcccacgacggtcccgctcagggagcagtcccgaggtgaaagacaagcctcgcgctgccccacgagcccaatctggcagtgatagttcaccggaacctaaagcccctgcgcctcgcgctctgccaaggcggagcaggtctgggtcctcctcaaaaggtagggggccttcaccagaggggagtagctccacagaaagttcccccgagcatcctccaaagagtcggaccgcccgtagggggagcagaagctcccccgagcctaagactaaatctagaacgcccccacgaagacgctccagcaggagctcccccgagctcaccaggaaagcgaggctttccaggagaagccgctccgcgtccagttcccccgaaaccaggtctaggactcccccacggcatcgacggtcgcccagcgtctcaagtcccgagcctgccgaaaagtccagatcctccaggcgccgaagatccgcatctagccctcgaaccaagaccacgagtcgtcggggtcgaagcccaagtccaaagccgagaggcctgcagagatctcggtcccggagccggagggagaaaacacggaccacacgacggcgagaccggtccgggtcaagccagtccacgagtaggcggaggcagaggagtaggtcccgttctagagttacaaggaggcgtcgaggaggcagtggctaccactcccgatctcccgctcggcaggagtcgtccaggacctcatcacgtcggagaagggggaggagccggactcctcctacaagtagaaagaggagcaggagccggacatcccccgcaccatggaaaagaagcaggtctagagcctccccagcgacacataggagatctcgatctcgcacgcccctgatttcccggcgacggtcccgcagccgcacatcccccgtttctcgacggaggtcgaggtctcggacaagcgttactcggcgaagaagtcgatctcgggctagcccagtgtccagacggaggtcaaggtccaggactcccccagttacaaggcgcagaagcagaagtcgcacccctaccacaaggagacgcagtcgcagccgaactcctcctgtcacccgcaggcggtcccggagccgcaccccgccagtcacccggaggagatcacggagccgaacgagtcccatcacccgacgcagaagcaggtcacgcacatctccagtcaccaggcggagaagccgatccagaacatctcccgttacacgacgccgttcccgatccagaacatccccagtcacaaggcgcagaagtcgttcccgcacacctcctgctatcagaagaaggtcaaggtcgcgcacgcctctgctgccccgaaaaaggtccagatcaagatcacctctggcgattcggcgtagaagtagatcgaggacacccaggactgcgagaggcaagcgctcactgaccagatcccctcccgcaatccgcagaaggagcgcgagcggctcaagctcagataggtcccgcagcgctactccgccagccacacggaaccactcaggttcccgaactccaccagtagcccttaactcttcgcgaatgtcatgcttctctcgaccatctatgtctccaacccccctggataggtgtcgaagtcctggcatgctggagcctctgggctcaagcaggactccaatgagtgtgctgcagcaggcaggaggttcgatgatggacggacccggaccacgtatccccgaccaccagcgcacatccgttcccgagaaccatgcccagtccaggattgccctcgctctcacagccatctccctgggcactgcaaggccacctccctccatgtccgccgctggcttagccgctagaatgtctcaggtgcccgcaccggttcctctcatgtctttgcgtacagcgccagccgcaaatctggcaagccgaatccccgcagccagcgccgctgcaatgaatctcgcttctgccagaacacccgctatcccaactgctgtcaatctcgcagatagccgtacccccgctgccgctgccgcaatgaacctggcctcacccagaacggcagtagcaccaagcgctgtgaacctagctgacccacggacaccaacggcccctgccgttaacttagccggagccaggactccagctgcactggccgcactctctctgactggatccggtactccacctacagccgctaattaccctagtagtagtagaaccccccaagcccctgcatctgctaatttagtcggtccgagatctgcccatgccacagccccagtcaacatcgctggctctagaacagccgcagccttagcccctgcaagtcttacctccgccaggatggctcccgcactgagcggagcaaaccttacatctccacgtgtacctctgtccgcctatgaaagggtgtcaggtaggacaagcccgccactgctagaccgggctcgctcacggacacccccatccgccccatctcaatcacgcatgacctccgaaagagcaccaagccctagctctagaatgggccaggcaccctcccaaagcctgcttccaccagcccaggatcagccacgttcccctgtgccctctgcttttagtgatcagagtcggtgtctgatcgctcaaactacccccgtggccggatcccagtcactctcttcaggggcagtggcaactaccacctcatctgctggcgaccataatgggatgttgtccgtccccgctcctggtgtcccacatagcgacgtgggggaacccccagccagtaccggcgcacagcaaccatccgccttggccgcactacaacccgctaaagagcgcagaagtagcagctcgagctctagttccagctcgagcagctcatcctcttcctccagttctagctcttctagcagtagcggcagcagcagttccgactcagaggggtcatccctgcctgtccaaccagaagtcgctctgaaacgggtgccatcccctacacccgcaccaaaggaggctgtgcgcgaaggacgacccccagagcctacacctgccaagcgcaaacggagaagtagcagtagctctagctctagttcgagctctagctcatcctcctcatcttcatctagtagttcatcctcctcaagctcatcttcttcctcttctagttcaagctccagctcctcaagcagttcgccgtcaccggctaaacctggaccgcaggccctgccaaaaccagcttcgcctaagaagcccccacctggggaaagaagcttacttcccgtatctcctagccccagacattctttaccccatgttgctcgtggaacatttctcaaacgcacttcaggttatttcccaccgcttcataagtccttcgggactccgtgcggcctacaagacaaggcaccaccactgagggagtggagggtgcggcttttcactaacgggccatgccccccttgtgtgctccttctgccagctccaacacacgccctgtgctcgagccacacccagaggctcgctgtcta

SEQ ID NO: 240061 - DNA, 1836 bp, Artificial Sequence
  Description of Artificial Sequence: Synthetic coding sequence
atggcctcggtgcagcagggagaaaagcaactattcgaaaagttttggcggggaaccttcaaagctgtagctacacccagacccgagtccattattgtggccagcattactgccaggaagcctctgccaaggactgagccccagaataatcctgtggttccagcgcaagatggtccttcagagaagctagggcagcatcttgcaacagaaccactgggaaccaacagttgggagagagacaagacatgtagggaacttggagctacacggggacattccgcttctcatgacaaggacctgacacctcctcccagctcccggggtaaaaaaaagaaaaaaaaaagcactaggaagaaaaggcgacggtcctccagttattcgccttctcccgtaaagaagaagaagaaaaagagctctaaaaagcataagaggaggcgctctttttccaagaaaaggcgccattcttcatcctcccccaagtccaaaaggagggacgagaagaggcataagaagcagagccgctcccgccctcgaaaaagccatagacaccgacatcatcggtgtccatcgcgttcacagagctccgagagcagaccttcaagttgcgaaagccggcaccgaggccgatcacccgaggagggtcagaagagccggaggaggcactcacgccgttgtagcaaaactctctgtaaggattcacctgaagcacaatcttcgcgcccaccaagccagcctctccagatgctcgggtaccttagcgcccgaggcgtgatcaccggctccggcagcgcggctgatttgttcactaaaactgcaagcccactgacgacatctcggggtcggtcgcaagaatacgactcaggaaatgacacctcctcacccccaagtacacagacgtcaagtgcaaggagcagaggacaggagaaggggtcaccctctggcggtctttcaaaatcaagggaactgaacagcggcaatacgtcagactctggaaactccttcacaacttcctccccacaaaacaaaggagccatgttggaaaatctgagtccaacgagtaggggtcgcgagtcccggggtttccagagtccatgtctggagtgtgccgaggtgaagaaatcttcactggtaccttccacagcgcgaagcagccctatgaagggttgctcacggtcttcctcgtacgcttctactaggagctcctcccactcttccaggtcacctaacccaagagctagcccaagatatactcaatcacgctcaacgtctagtgaaaagaggagttatagcagatcacccagttacagttctaaaagtggtaaacgctcacctccgtctcggtcgtctcgatctaggaggtctccttcatatagtagatactcccccagtcgggagagggaccctaaatacagcgaaaaagacagtcagcagcgcgagcgcgagcgcgctcgccgtcggaggcggtcatacagcccaatgaggaagcgaaggcgcgattctccttcacaccttgaggcacggaggatcacgtccgcaagaaaacgaccaatcccatactacagaccctctccatcgtcaagcggttctctatcctcaacgtcttcttggtactcttcctcctcttccagaagcgccagccggtcgtacagccgatcacgctcacgttctcgttcgcgtaggcgcagcaggacgaggacaagctcatcctcttctagccgatccccctcccccggaagtcgttctcgctccaggagtcgctctcggtctcgatcgcgttctcggagccagagtaggtcctacagtagtgctgacagctacagcagcacccggaggtag

SEQ ID NO: 240062 - DNA, 747 bp, Artificial Sequence
  Description of Artificial Sequence: Synthetic coding sequence
atgtctggtggtggagtcatccgcggtcctgcaggcaacaacgattgccgtatttatgtcggcaatttgccaccggacatccgcaccaaggatattgaggacgtgttttataaatatggggcaattagagacatcgacctgaagaaccgcagaggcggaccgccattcgcattcgtggagtttgaggatcccagggacgctgaggacgctgtttacggtagagacgggtacgattatgacggctacaggttgcgggtcgagtttcccagatccggaagggggacaggtcgcggaggaggcggagggggaggcggaggggcaccaaggggaaggtatggcccacctagcagacgctccgagaacagagtggtggtaagtgggttaccaccttcgggcagctggcaggacctcaaggatcatatgagggaggcgggagacgtttgttatgctgacgtatatcgagacggtacaggcgtagtggaattcgtgaggaaggaagatatgacatacgccgttagaaagctggacaataccaagttcaggtcgcacgagggcgaaacggcttatatccgggtgaaggtcgatggacccaggagtccgagctacgggagatccagatctcgctctcgctctcggtctagaagccggagtaggtctaactcccgaagccgatcctacagccctcgcagatctcgtggaagccctagatactcacctaggcattccaggagcaggagcaggacctag

SEQ ID NO: 240063 - DNA, 606 bp, Artificial Sequence
  Description of Artificial Sequence: Synthetic coding sequence
atgagtggtgggggtgttattcgtgggcctgcaggcaacaacgattgtcgcatttatgtgggcaacttgccacccgatatccgcactaaggacattgaagacgttttctacaaatatggggcaattcgcgacatagatctgaagaacaggcgtggtggtcccccattcgcatttgtggagtttgaggaccctcgggacgccgaagacgctgtctacgggcgtgatggatacgattacgacgggtacaggctccgagtggagtttccacgctcaggcagaggaaccggcaggggcggtggcggagggggaggtgggggtgctccgcgaggacgttacggccctcccagtaggaggagcgaaaaccgagtggtggtgtccgggctgccgccttctgggtcttggcaggacctgaaagaccacatgcgagaggccggtgacgtgtgctatgccgatgtgtaccgagatggcactggagtcgtggaatttgtgcggaaggaagacatgacatatgcagtaaggaaactcgacaatactaaatttcggagccacgaagtgggatatacacgtatactgttttttgatcagaactggattcagtggtcctag

SEQ ID NO: 240064 - DNA, 786 bp, Artificial Sequence
  Description of Artificial Sequence: Synthetic coding sequence
atgtctcggtacctgcgacccccaaacacgagtctgttcgtcaggaatgttgcagacgatacaaggtcagaggatctgagacgcgaattcggtcggtacggtcctattgtggacgtttatgtccctctggacttctatactaggcgcccacggggttttgcttacgtgcaattcgaagatgtccgagatgccgaagacgctctgcacaacctcgatcgaaagtggatttgcggcagacaaatagagattcaattcgctcagggcgacaggaagaccccaaaccagatgaaggccaaagaaggacgcaatgtgtactctagctcacgctacgacgattacgacaggtaccgcaggtctagaagccgatcctatgaacggagacgtagcagatcgcgctcattcgattataattacagaagatcgtattctccacggaatcgaccaacgggacgcccaaggaggtctcggtcccacagcgacaacgataggtttaagcacaggaaccgcagcttctccaggagcaaaagtaactcccgatcccgatccaaatctcagcccaagaaggaaatgaaggctaagtctcggagtcgaagtgcaagtcacacaaaaaccagggggacaagtaagaccgatagcaagactcactacaagagcggctcccggtacgagaaagaatctaggaaaaaagagccgcctcgttccaaaagccagtctcggagccagagccgctctcgttcaaaatctagaagtagatcatggacctctccaaagagcagtgggcactag

SEQ ID NO: 240065 - DNA, 552 bp, Artificial Sequence
  Description of Artificial Sequence: Synthetic coding sequence
atgtcaagatatcttagacctcccaacacatcattgttcgtaagaaacgtcgccgacgatactcgttcggaggacttacgacgggagttcggcagatacggtccgatcgtggatgtgtatgtgcccctggacttttatacacggagaccacggggtttcgcatacgtgcagtttgaggatgtgcgcgacgcagaggacgcattgcacaatttggatcggaagtggatctgcgggcgtcaaatcgagattcagtttgcccaaggcgacagaaagaccccaaatcaaatgaaggccaaggagggacgcaatgtttattcctcatctcgctacgatgattacgaccgttatcgtcgcagcagaagcagatcttatgagcggagacgcagccggtccaggagtttcgactacaactacaggagatcatacagtccccgtaattcacgacctactggtaggcctcggcgatcacgcagccactctgataatgatcgccctaactgttcatggaacacacagtactcctccgcctactataccagtagaaagatctag

SEQ ID NO: 240066 - DNA, 522 bp, Artificial Sequence
  Description of Artificial Sequence: Synthetic coding sequence
atgtcccgttatctgcggccacctaatacgagtctatttgtgcgcaatgtggcggacgacaccagatcagaagatttgaggagagaattcggacgctatggccctatcgtggatgtatacgtccccctggatttttacacacgccgacctcgcggttttgcttatgtgcagttcgaggacgtgcgcgatgctgaagatgctcttcataacctggatcgcaaatggatatgcggacgccagatagaaattcagttcgcccagggagatagaaaaactcctaatcagatgaaagccaaagagggcaggaacgtctatagttccagccgctacgacgattacgatcgatataggcgctcgaggagccgctcatatgagcgtaggcgtagcaggtctcgaagtttcgactataattatagaagaagctattcgccacgcaacagcagacctaccggtcgcccacgacggtcccggagccattcagacaatgattcccaggtgtctaaaaagaagaatgaacgatag

SEQ ID NO: 240067 - DNA, 519 bp, Artificial Sequence
  Description of Artificial Sequence: Synthetic coding sequence
atgtctcgttaccttcggcctcctaacactagcctttttgtgaggaacgttgctgatgatactcggtcggaggacttacgcagggagttcggccgatatggccctatcgtggacgtgtatgtccctcttgatttttatactcgcaggcccaggggattcgcgtatgtacagttcgaggacgttcgcgatgccgaggatgctctgcacaatttagataggaagtggatttgtggacgccagatcgaaatccagttcgcgcaaggggatagaaaaactcctaaccaaatgaaagcaaaggaaggcagaaatgtttacagttctagtaggtacgacgactacgacagataccgcagatcaagaagtcggagctatgaacgaagacgatctcgctcaaggtccttcgattacaattatcggaggtcttactcccccaggaacaggccaaccgggaggcctagaagaagccgaagccactctgataacgactcacaggtgagcaaaaagaaaaacgagcgttag

SEQ ID NO: 240068 - DNA, 498 bp, Artificial Sequence
  Description of Artificial Sequence: Synthetic coding sequence
atgagtaggtatttgcgcccacccaatactagcctttttgttcgcaatgttgccgacgatacacggagcgaggacctcaggcgcgagtttggcaggtatggcccaattgtcgacgtctatgtgcccctggatttctacacacgcagaccaagggggtttgcttacgtgcagttcgaagatgtgagggacgcggaagacgctttgcacaatcttgataggaagtggatttgcggtcgtcagatcgagatccaattcgcacaaggcgacaggaagaccccaaaccagatgaaggctaaggagggcagaaacgtgtacagcagctcgcgttacgatgactacgatcgataccgacgcagtcgctccaggtcgtacgagagaagaagatctcggagtcgcagcttcgattataattatcgacgctcttatagccctaggaaacccaattgctcctggaacacccagtacagcagtgcctattacacctctcggaaaatctag

SEQ ID NO: 240069 - DNA, 549 bp, Artificial Sequence
  Description of Artificial Sequence: Synthetic coding sequence
atgtcgcggtacttgagaccccctaatacatccttgttcgtgaggaacgtggccgatgacactagatcagaggatctcagaagggagttcggaaggtatggtcccatcgtcgacgtgtacgtgccactggatttctacactcggagacccaggggttttgcctacgttcagttcgaggatgttagagatgctgaggatgcactgcacaatctcgatcgtaagtggatttgcgggaggcagatcgagattcagtttgcccagggggataggaagacaccaaaccagatgaaggccaaggagggtcgaaatgtctacagttcaagccggtacgatgactatgaccgataccgaaggagtagatctagatcctacgaacgacgcaggtccaggtcgcgctcttttgactacaactaccggaggagctattcgcctagaaaccggccaacagggaggcctcggagatccagatcgcattctgataacgaccgcccaaattgctcctggaatacacaatactcttctgcatactacacgtctcgtaagatctag

SEQ ID NO: 240070 - DNA, 789 bp, Artificial Sequence
  Description of Artificial Sequence: Synthetic coding sequence
atgagcaggtatctgcgccctccgaatacatccttgtttgtccgcaacgttgcggacgatactcgaagtgaagatctgaggcgagagttcggccgatatgggcctatcgtggatgtctatgtacccctggacttttatactcggcgtccaagagggttcgcatacgtgcaattcgaagatgtccgggacgccgaggacgctctacataatctggaccggaaatggatctgcggcaggcagattgaaatccagtttgcacagggcgatcgcaaaactcctaaccagatgaaggcgaaggagggcaggaatgtgtacagcagctccaggtacgacgattacgataggtaccgcaggtcgcgctcaagaagctacgaacggagaagatcccgaagccgctcattcgactataactaccggagatcttactccccaaggaattcccgtcccactggaaggccccgtcgctctcgctcccactctgataacgatagattcaaacaccggaataggtccttctcacggtccaagtccaatagtagatcacggtccaagtctcaacctaagaaggagatgaaggcaaagtcaaggagccggagtgcctcgcacacgaagacacggggtaccagcaagacagactctaagacacactacaagagtggatctcgctacgaaaaagagagtcggaaaaaagaaccgcctaggagcaaaagccaatccagatcccaaagccgctcccggtcgaaatcacgctctcgcagctggacgtctcctaaaagttctggacactag

SEQ ID NO: 240071 - DNA, 1275 bp, Artificial Sequence
  Description of Artificial Sequence: Synthetic coding sequence
atgatcaacaaccatcgcaatcaggccctgtacttctctgagcacaagtactttcagcaaacgcaggttgtctaccaaggcgacatattctgggtgtttctgtgtgtattctgcctgaggaaagagtgcgttttgatgcagggctgtttttctgcaggtgtcatccctgacgaggctaaggccctgagcctgctggcgccagcgaatgccgtggccggactgttgcctggtggaggcctgttgccaaccccaaacccactgacccaaatcggagctgtgcctctagctgcactcggagcacccacattggaccccgctctggccgctctcggccttcctggcgctaacctgaatagtcagagtcttgctgcagaccagctgcttaaactgatgagtactgtggaccccaagcttaatcatgtggcagccggacttgtaagcccgtctctgaaaagcgatacgtcatctaaggaaatcgaggaagccatgaaaagagtgcgagaggcacaatccctgattagtgccgcaatcgaaccagataaaaaggaggaaaaaagaagacacagccgtagcaggagccgctcccgacgtcggaggacgccttcctcctctcgacaccgccgttcaaggtccagatcacgtcgaaggtcacactccaaatcacgctctagaaggaggtcaaagtcccctcggcgaagaaggtcccacagcagggagaggggtcgaaggtccaggtctacctccaagactcgggataagaaaaaagaggataaagagaagaagcgcagtaaaactccccctaagtcatacagtactgctagaaggtcccgctcagccagtagggagagaaggaggcgcagaagtcggtctggcacgcggagtcccaaaaaaccgaggtcgccaaagagaaagctaagcagatctccttcacctaggaggcacaaaaaggagaaaaagaaggataaagacaaagaacgatcgagggatgagcgagaaagaagtaccagcaagaagaaaaagtccaaggataaggagaaggacagggagcgcaagagcgagtctgataaagatgtaaaacaggtgacccgggattatgacgaggaggagcagggatacgactccgaaaaggaaaagaaagaagaaaaaaaacccattgaaaccggtagtcctaagactaaagaatgctcagtcgagaaggggactggggactccctgcgggagagtaaggtaaatggcgacgaccaccatgaagaggatatggacatgagcgactag

SEQ ID NO: 240072 - DNA, 1455 bp, Artificial Sequence
  Description of Artificial Sequence: Synthetic coding sequence
atgagcaacacgactgtcgtacctagcactgcaggacctgggccttccggcggacccggtggcggaggcggtggtggcggtggcggagggggaactgaggtcattcaagtaactaacgttagcccttcagccagttctgagcaaatgcgaacactgttcgggttcttaggcaagatcgacgagctgcgtcttttcccccctgacgatagccctttgcctgtcagtagtagggtttgttttgtgaaatttcatgatcccgacagcgcggttgtggcacaacatctcactaacactgtgttcgtcgacagagcacttatagttgtgccttacgccgagggcgtcatcccagacgaagcaaaagctctctcactcttagcacccgcaaatgcggtggcaggattgctccccggaggcggtctcctgcctacacccaatccactgacacagattggggcagtccccttggccgctctgggagctccaactctagatcctgccctggccgcactcggccttcccggagctaatcttaacagccagagcctagctgctgaccaactcttgaagctgatgagcacagttgacccaaagctgaatcatgtggccgcaggtctagtgtccccttccctgaagagtgacacctccagcaaggagattgaagaggccatgaaacgggtccgcgaagcacagagtctgatcagcgctgctatcgaacctgacaagaaggaagaaaaaaggaggcacagccgttcaaggtcaagaagtcggaggcgaagaactccttcaagctcacgacaccgtagaagtcggtcaaggagcagaaggcggtctcacagcaaatcccggagtcggagaagaagcaagagccctcgacggaggcgctcccacagtagagagcggggacgacgatcgagatcaacatccaaaacaagagacaagaagaaagaagataaagaaaagaagagatctaaaacaccacctaagtcatatagcactgcacgaagaagtcgctctgcctccagagagagaagaaggcgtagatcaagaagcggcacacgatcacctaagaagcctcgatccccaaagagaaaactgagtaggtccccttctccccgaaggcataagaaggaaaagaaaaaagacaaggacaaggaaaggagtcgcgacgagcgagaaagaagcacatccaagaagaagaagagtaaggacaaagaaaaagacagagagaggaagtcggaatcagacaaggacgtcaaacaagtcaccagggattacgacgaggaggagcagggctacgacagtgaaaaggagaagaaggaagaaaagaagccgatcgagacaggctcccccaagaccaaggaatgcagcgtggagaaaggaaccggggatagtcttcgtgaaagcaaggtcaacggcgacgatcaccacgaggaggacatggacatgagtgattag

SEQ ID NO: 240073 - DNA, 1452 bp, Artificial Sequence
  Description of Artificial Sequence: Synthetic coding sequence
atgagcaacacgaccgtcgttccgagcaccgcaggccctggcccttcaggaggaccaggcggtggtggtggtgggggaggaggcggaggcggtacggaggtcatccaggtgaccaacgtcagcccctcggcttcttcagagcagatgcgcacactgtttggattccttgggaaaatcgacgagctgcgtctctttccgccagatgattcccctcttccagtttcatcaagggtttgctttgtgaaattccatgatccagactctgctgttgtggcacaacatctgacgaacactgtgtttgtcgacagagccctgatcgtggtgccctatgcggagggtgttatcccagacgaagctaaagcactgtcgctcctcgccccagctaacgccgtcgccggtctgctgcccggtggaggtctgctaccgacccctaacccccttacacagattggtgccgtgccactggcggctttaggggcacctactctcgaccctgcactagccgctcttggtctgccaggcgcaaatctcaattctcagtcgctcgcagcagatcagctgttaaaattgatgtccaccgttgaccctaagctgaatcacgtggcggctgggctggtgtccccaagccttaagagcgatacatcgtcaaaggaaattgaggaggccatgaagcgtgtacgagaggcccagtctcttatctcagccgcaatcgagcccgataagaaagaagagaaaaggcggcactcccgctcgcgttcccgatcccgcagacgtcgcacgccatcatcatcgcgacatcggcgatctagaagtcgctctcgtaggaggagtcattctaagtcgcggtctagaagacgctccaagtcacctaggcgcaggcgaagtcattccagagagaggggaaggaggtccagatccacctccaagactcgagataaaaagaaggaggataaggaaaagaaaaggtccaagacaccacccaagtcctattccaccgcccgaagatccaggtctgcttctcgtgagcgacgcagaagacgttcacggagtggtacccgaagccctaaaaagccccgatcacccaagcgcaagctgagtcggagtccgtccccacgaaggcacaagaaggagaaaaagaaggataaggataaggagagaagcagagatgagagggagaggtcaacctctaagaagaagaaatccaaggacaaagagaaagacagggaacgtaagtccgagagtgataaggacgtgaaggtgacccgggactacgacgaagaggagcagggatatgacagtgaaaaggagaagaaggaggagaaaaaaccaattgagactggatcgccgaagaccaaagaatgttctgtcgagaaaggcacaggcgacagccttcgggagtctaaggttaacggagacgaccatcacgaggaagacatggacatgagcgattag

SEQ ID NO: 240074 - DNA, 1170 bp, Artificial Sequence
  Description of Artificial Sequence: Synthetic coding sequence
atgtctaacacaacagtggtgccatcaacagctgggcctgggccatctgggggtcccggtggtgggggtgggggaggtggcggaggagggggaacagaggtgatccaagtcacgaatgtgagtccatctgcaagcagtgagcagatgcgcaccttgttcggcttcctaggaaagatcgatgaactaagactattccctccggacgatagcccactgccagtctcttccagagtgtgctttgtcaagttccacgacccagattccgcagtcgtggctcagcacttgaccaatacggtgttcgtcgatagggccctgattgttgttccttacgccgagggagttatccccgacgaagccaaagcgttgagtctgctcgctcccgcaaacgccgtcgccggactgcttcccggtggcggattgcttccaacccctaatcctctcacccagatcggagcagtgccgctcgctgctctgggagccccaaccctcgacccagcgctagcagctcttggactgcctggcgcaaatctcaactcacagagcctggctgcagaccaactgctgaagctgatgagcaccgtcgatccaaagcttaaccatgtcgcggctggcctggtgtcaccatccttgaagagtgatacctcctccaaggaaattgaggaggccatgaagcgcgtgagagaagcccagagcctgatttctgccgctatagagcccgacaaaaaggaggaaaagcggagacacagtcggtcccgaagtcgtagccgcagacggagaacacctagtagttcacgacaccgacgttctcgctcccgcagccggcgtaggagtcactctaagagtaggtctagaaggaggagtaaatcgccccgaagacgaagatcacattcccgggagagaggccgacgaagcagatctacttcaaagacaagggacaaaaaaaaagaagacaaggagaaaaaacgttccaaaacaccacccaagtcttatagtactgctagacggtcaaggtccgctagcagccttcacatttgcgattccagagagaggcgcaggcggcgatcaaggtcaggtactcgaagccctaagaaacctcggtcccccaaacgtaagttgtcccggagccccagtcctagacgtcacaagaaggagaagaagaaggataaatag

SEQ ID NO: 240075 - DNA, 1455 bp, Artificial Sequence
  Description of Artificial Sequence: Synthetic coding sequence
atgagcaacacaaccgtggtcccatccaccgccggacccggtccatccggcggacctggtggagggggtgggggagggggagggggagggggaaccgaggttattcaggtgacaaacgtgagcccctcagccagctccgaacagatgcgcacactcttcgggttcctcggcaagattgacgaattgaggctgttcccccctgacgactcgcctctccctgtcagctcccgggtgtgttttgtgaaatttcatgacccggattccgctgtagtcgctcagcacttaaccaatacagttttcgtggatagggcccttatcgttgtgccatacgcagaaggagtcatccccgacgaagccaaggccctgagcctcctcgcaccagccaatgccgtcgccggtctgcttccagggggtgggctgttgcccacccctaacccgctcactcagatcggtgcagtccccctcgctgctctaggcgcacccactctggaccccgcactggcagccctgggactccctggggcaaacctgaattctcagtctctggccgctgaccaactgcttaaactcatgtctactgttgacccgaagctgaatcacgtcgctgctggattagtatctcccagtcttaaatccgacacttcctccaaggagattgaagaggcaatgaagagagtacgcgaggcccagagcctcatatcagcagccatcgagccagataaaaaagaggaaaagcgtcggcactctcggagcagaagccgctctcggaggcgtcgcaccccatcatcatccagacaccgccgatcacggtcccgttcccggagacggtcccacagcaagtcgaggagccggagaaggtccaagtccccgaggcggagacgttcccactctcgggagagaggccgacgctcacggtcgaccagtaagacgagagataaaaaaaaagaagacaaagaaaagaaacgcagcaagaccccgccaaagagctattcaactgccaggcggtctcggtctgcctcccgggagaggcgacggaggaggagtcgctctggcactcggtctccgaaaaagcccagaagccccaaaaggaagctaagccgcagcccttcccctagaaggcataagaaggaaaaaaagaaagacaaagataaggagcgttcccgtgatgagcgtgaacgaagcacatccaagaagaagaagagcaaggacaaagaaaaagatcgggagcgcaagagcgaatctgataaagatgttaagcaggttacccgggactacgacgaggaggaacaagggtacgactctgaaaaagagaagaaggaagaaaagaaacccattgagacagggagtccgaaaaccaaagagtgtagtgtcgagaagggcaccggggatagtcttcgcgaatccaaggtaaacggtgatgatcatcacgaagaagacatggacatgtctgattag

SEQ ID NO: 240076 - DNA, 387 bp, Artificial Sequence
  Description of Artificial Sequence: Synthetic coding sequence
atgtccaacacaaccgtagtgccatctacagccggtcccggaccatccggaggtccgggaggtgggggagggggaggtggtggcggtggcggaaccgaggtaatccaggtgacaaacgtgagcccctcggcctcctcagagcaaatgagaaccctgttcggcttcctcgggaagatcgacgaactccgcctgttccctcccgatgattctcccctgcccgtgagttctagggtgtgctttgtgaagttccatgatcctgactcggccgttgttgcccagcaccttaccaatactgtgtttgtggaccgcgctctgatcgtcgtgccctacgccgaggtgaagcagccaacacgagtcgtggtgcacaagacagcttttgagtcatag

SEQ ID NO: 240077 - DNA, 396 bp, Artificial Sequence
  Description of Artificial Sequence: Synthetic coding sequence
atgagtaacaccacagtagtccccagtacggctggcccaggaccatctggagggcctggcggagggggaggcggaggcggtgggggaggtggaacagaggtcattcaagtcacaaacgtgtctccctctgcctcttcagagcagatgaggactctgttcggcttcctaggcaagattgatgagctgcggctttttccgcctgacgattccccgttacctgtgagcagcagagtgtgcttcgtcaaattccacgaccctgattccgctgttgtggctcagcacctgaccaatacagtgttcgtggaccgcgctttaatcgtggtgccttatgccgaggtcttccacggttcaatcaaggcggcagtgaagaaaattctcctgacccatgagaattag

SEQ ID NO: 240078 - DNA, 630 bp, Artificial Sequence
  Description of Artificial Sequence: Synthetic coding sequence
atgacatctttgaaggtggataacctgacctacaggacatcacctgacaccctgagacgagtcttcgagaaatacggtcgagtcggcgatgtgtacataccacgggatcgatacactaaagaaagccgcggattcgcattcgttagatttcacgataagcgggacgccgaagacgcgatggatgccatggatggggctgttttggatggtcgagaactgagagtgcagatggcacgctacggcaggccacctgatagccatcactcccggcgaggaccccctccccgtcggtatggtggaggaggttatggtcgcagaagccgatcccctcgtaggagaagaaggtctcggtctcgttccagatcaagatcccggtctagatccaggtcacgatactcccgctcgaagtcccgcagtcgaacaagaagccgttcccgctccacctctaagagcagaagtgccagaaggagcaaatcgaagagttcctcggtgtcacgttctagaagtcggtctcgctcgcgaagcagaagtaggtcaccgccaccagtctcaaaacgagagagtaagtcaaggtcacggagcaagtcacccccaaagtcgcccgaggaggagggcgctgtttctagctag

SEQ ID NO: 240079 - DNA, 606 bp, Artificial Sequence
  Description of Artificial Sequence: Synthetic coding sequence
atgtcctatgggcgacccccaccagacgtggagggtatgacatctctgaaggtagacaatcttacttaccgcacgtcaccagacactttgcgaagggtgtttgagaaatacggcagagtgggagacgtgtacattccacgtgaccggtatactaaagagtcacggggatttgctttcgtcagatttcatgacaagagagatgccgaagatgcaatggatgccatggatggagctgtattggacgggagagaacttcgagtacagatggcccgttgtggaggctacgggagaagaagtcgttctccccgacgcagacgcagaagtaggagccggtcacgcagtcgctctcggtcacgtagcagaagcagatacagcagatcaaagtctaggtcccgtactcgcagcagatcccgatcaacttcgaagtcacgatcagcacggcgtagcaagtcaaaatcctctagtgtaagccgaagcagaagcagatcccggagccgcagccgctctcgatcaccccctcccgtgagtaagagagagtccaaaagtcggtcacgctccaaatctcctcccaaaagcccagaggaggagggcgctgtctcctcatag

SEQ ID NO: 240080 - DNA, 666 bp, Artificial Sequence
  Description of Artificial Sequence: Synthetic coding sequence
atgagttacggtcggccacctcccgatgttgaagggatgaccagcctaaaggtcgacaacctcacataccgcacctcccccgataccctcaggcgcgtgttcgagaagtacggaagggttggggacgtgtatatcccaagagaccggtacacaaaggagagcagagggttcgccttcgtacgcttccatgataagagggatgcagaggacgccatggacgccatggatggcgctgttttggatgggcgtgagctgagggtccagatggcgagatacggacgcccaccagattctcatcacagtagacggggaccccctccccgtcggtatggcggtgggggttacgggcgacgcagccgatccccacggagaaggagaagatcccggtcccgatcgaggtctcgcagccgctctcgaagtcgttcacgctacagtcggtccaagtcaaggagccgtactagaagtagatcacgctccacctcgaaatcgagaagcgcccgacgctcaaagtcaaagagctccagcgtatcacgatcccgcagtaggagtaggagccgttccagatcaagatcaccgccacccgtatctaagcgggagtcaaaatccaggagcagatcaaagtctccccctaagtcacccgaggaggagggggctgtctcctcctag

SEQ ID NO: 240081 - DNA, 540 bp, Artificial Sequence
  Description of Artificial Sequence: Synthetic coding sequence
atgtcatatgggaggccccctcctgatgtggaaggtatgacctccttaaaggtagacaacctgacctatcgaacatctcccgacacccttagaagggtgttcgaaaaatacgggcgagtgggagatgtttatatcccccgagaccgctacacaaaagagtctagggggttcgcattcgtcaggtttcacgataaacgcgatgcagaggatgcaatggacgcaatggacggcgcagacccaggcgtcggagttgtcccagggctcgccgcagacttggcaacagctgctcgatctttaggccctgctctcgttctggacctcggcagaccgccatctcccgatccacatgaagggccttccccttctcctcggaggagtcccgatcttgttcgcggtcccggaccagggctcggcccaggtgtcctgccacagtgtccgagaggcaaccctaatcccggaagagaccgccgagtgcccccaagtctcttgaaacgcaaagagagatgccccctaaagaagatgctgagaagtccagtgtag

SEQ ID NO: 240082 - DNA, 669 bp, Artificial Sequence
  Description of Artificial Sequence: Synthetic coding sequence
ccggagagaagaggagtcgcccctcccagagctgaggaggctggtgcctcatctagaggcagtggtcctccactgcgggctatgtcctatggcagaccccctccagatgtggaaggcatgacctctctcaaggtcgacaacctcacctacagaactagccccgatactctgagaagagtcttcgaaaaatacggccgtgtgggtgacgtgtatatcccccgtgatcggtatacaaaggagagccggggttttgcttttgtgcggtttcacgataagagagacgccgaggacgccatggacgcgatggacggggcagtgctggatggccgtgagctacgcgtccagatggctcggtacggcaggccacccgattctcaccattctaggcgtggcccacctcccaggagatacggcggaggaggttatgggaggcgatctcggagccctcgcaggcggcgtcgttcgcgctcaagaagcaggagcaggagcaggagcaggtctcgctcacggtattctcggagcaaaagtcgttcccggacgcggtcaagaagcagaagcacaagcaaaagccgctctgccaggagaagcaagtcaaaatcatccagtgtcagcaggtctcgctccaggtctcgctctcggtcaaggtcccgctcccctccaccggtgtag

SEQ ID NO: 240083 - DNA, 375 bp, Artificial Sequence
  Description of Artificial Sequence: Synthetic coding sequence
atgcaccgggattcctgcccattggattgcaaggtgtacgtaggcaatcttgggaacaacgggaataaaaccgaattggagagagctttcgggtactacgggccacttcggagtgtgtgggtagcaaggaatcccccaggcttcgcgttcgtggagttcgaagacccacgggacgcagccgatgccgttcgggagctcgacggcagaacactttgtggttgtcgggtcagggtggaactgtctaacggcgaaaagcgtagcaggaatcgcggtcctccccctagttggggcaggcggccacgcgacgattatcgaagaagatcccctccaccacggagaagggtgactataatgagcctgctcactaccttatag

SEQ ID NO: 240084 - DNA, 495 bp, Artificial Sequence
  Description of Artificial Sequence: Synthetic coding sequence
atgcaccgagattcttgccccctggactgtaaggtgtacgtaggcaacttaggcaataacggaaataaaaccgaactcgaacgggcttttggctactacggcccattacggagtgtgtgggtcgctcggaatccgccaggattcgcctttgtggaatttgaagatcctcgcgacgcggctgacgctgtccgagagttggacggccgaaccttgtgcggctgcagggtccgggtggaactttctaatggggaaaaaagatcccgcaatcgcggtcctcccccatcttggggtagaagaccaagggatgactaccgcagacgatccccaccaccacgcaggaggtcacctagacgacggagtttttctcggtcacgtagccggagtctcagccgtgacagacggagggaacgctccctctcgcgggaacggaaccataagccgtctcggtctttctctagatcacgttctcgaagtagaagcaacgagaggaagtag

SEQ ID NO: 240085 - DNA, 1485 bp, Artificial Sequence
  Description of Artificial Sequence: Synthetic coding sequence
atgccacgcgtatatatcggtagactgtcgtaccaggcacgggaacgtgatgttgagcgattctttaagggatatgggaagattttagaagttgatctcaagaacggctacggatttgtcgagttcgatgacctcagagacgccgatgatgccgtctatgaactgaacggcaaggatctatgcggcgagcgtgtgattgttgaacacgccagagggcctaggagagatggctcatacgggtcgggccgatctggctatggttacaggagaagcggacgggacaaatatggccctcccacccggaccgagtacaggctcatcgtcgagaatctgagcagtaggtgttcctggcaagacctcaaggattacatgcggcaagcaggcgaggtgacttacgccgatgcccacaagggaagaaagaatgagggcgtaatcgagttcgtgagttacagtgacatgaaaagagctctggaaaaacttgatggtaccgaggtgaatggcaggaagatcagactcgtcgaggacaagcctgggtcacgcagaagacggagctattctcgttcccgttcgcacagcaggtctcgaagccggtccagacatagtagaaagtcccgttctcgtagcggtagctctaaatcttctcacagtaagtcgcgttccagatctcggagcggctcaagatcccgatcaaaatcgaggagtcgctcacagtcgaggtctagatctaagaaagaaaagagtcgcagtccatcaaaggaaaagagccgaagtaggagtcactctgcgggaaaaagcaggtcaaagtctaaggatcaggcagaggagaaaatacagaataacgacaacgtaggaaaaccaaagtccagatcaccttcacggcacaagtccaagagcaagtcccggagtcggtcacaggaacgcagagtagaggaggagaaaaggggttccgtaagcagagggaggtcccaggagaaatccctgaggcagtcacgctcgcgctccagaagcaagggcggatcccggagtcgcagtcgctcaaggtccaagagcaaggacaagcgcaagggccgtaagcgatctagagaggagtcacgctctcgttcccgttctcgcagcaagagtgagcggtcccgaaagagggggagcaagagggattccaaagccggatcctctaaaaaaaaaaaaaaagaagataccgatagaagtcagagcaggtccccttcacgctccgttagtaaggagcgggaacacgccaaatcagagagttctcaacgcgaaggacggggagagagcgagaatgcgggtactaaccaagaaacaaggtcaaggagccgtagcaattcaaagtctaaacccaatctaccatccgagtcccgatccaggtccaaaagtgcaagcaagactcgcagccgaagcaagtcccggagccgaagtgcgtcccgctcccccagtagatctcggtctcggagtcacagcagatcctag

SEQ ID NO: 240086 - DNA, 1221 bp, Artificial Sequence
  Description of Artificial Sequence: Synthetic coding sequence
atgccacgcgtgtatattggaaggctttcctatcaagctagggagcgcgatgttgagaggttttttaaaggatacggcaaaattcttgaagtcgacttaaagaacggctacggcttcgtagaatttgatgacctgcgcgacgcggatgacgcagtgtacgaattaaatggcaaagacttatgcggagagagggtgatagttgaacatgccaggggccctcggagggacggctcttacggcagcgggaggagtgggtacggatacagacggagtggccgagataaatacggcccacccacccggacagagtacagactgatcgtagaaaatctgtcctctaggtgcagctggcaggacctgaaggactacatgcggcaggccggtgaggtgacctacgcagacgcccataagggcagaaagaacgagggagtcatcgaatttgtcagttattctgacatgaagcgagcactggaaaaactggatggcactgaggtcaatggcaggaaaattagactcgttgaggataaacctggcagccgtcgtaggagatcttattcccggagtagaagccatagcagaagccgcagccgctcaaggcacagccgcaagagcagaagtcgtagcggttcctcaaaaagctcacattcaaaatctcggtctaggtctcggtctggcagcagatcaagatcaaaatctaggtctaggagccagagccggtcacgaagtaaaaaggagaaaagccggtcaccgagcaaggaaaagagccgctctagatcccactctgccggtaaatctcgcagcaagagcaaagaccaagcagaggaaaaaattcagaataacgacaacgtcggaaagcccaagtcacggagccctagtagacacaaaagcaagtcgaaaagccgaagcagaagccaggaacggagggtggaagaggaaaaaaggggtagcgtatcccgtggcagatcccaggaaaagtccctgcggcagagcaggagcagatctaggagtaagggcggaagtagatctcgatcccgctctcgttcaaagagcaaagataaaaggaaagggaggaaacgttctcgagaagaatctcggtcgcggtcaagatctcgcagcaagtcagagcgctcgagaaagagaggttccctcgcttttaggcccggtctgagctacagggaattatctaatctagatgggtccaaagcagggatgaccacatag

SEQ ID NO: 240087 - DNA, 477 bp, Artificial Sequence
  Description of Artificial Sequence: Synthetic coding sequence
atgcccagagtctatattggcaggctgagctatcaagcaagagagcgcgatgtggagagattctttaagggctatgggaagatccttgaggtggacttgaaaaacggctacggcttcgttgaatttgacgacctgcgggacgcagatgacgctgtatatgaactgaatggtaaggatctgtgcggagagcgcgtgatcgtggagcacgcgaggggaccacgcagggatggatcatatggcagcgggagatcaggctacgggtataggcgctctggacgggataaatacgggcctccaactcggacggagtacaggctgattgtggagaatctaagcagccgctgtagctggcaggacctcaaggtaggactacccctccctgaacaggaaccggagcccgagcctgaaagcgagcctgaacaggaaagagagaagcaagagccacagcagggcaaagagccccagccacagccttag

SEQ ID NO: 240088 - DNA, 819 bp, Artificial Sequence
  Description of Artificial Sequence: Synthetic coding sequence
atgagcgggtgcagggttttcatcggtcgcctgaaccccgcagccagagaaaaggacgttgagaggttttttaaaggatacgggaggattcgcgatatcgatttgaaaaggggctttggcttcgtagagttcgaggacccgagggacgccgacgatgccgtctatgagcttgacggcaaggagctctgtagcgaaagagttactatcgagcacgcgagagccaggtccaggggaggccgaggtcgtggacggtacagtgatcgattctccagccgacgccctcgcaacgacagaagaaacgctccccctgtacggaccgagaacaggttgatcgtcgaaaatctttcttcacgagttagctggcaggatctcaaggacttcatgaggcaggctggagaagtcaccttcgcagatgcccaccgtccaaagctcaatgagggggtcgtggagttcgcttcttacggggatctcaagaatgctatagagaagctaagcggaaaagaaattaatggcaggaagataaaactcatcgagggctcaaagagacattcccgcagtcgctcccggtctcgatcaaggaccaggtcctctagccggtcccggtccagatctcgctccaggagcaggaagtcatacagccgaagccggtctcggagccggtctcggtctaggtctaagtcccgctcggtctcccgatctcccgtgccggaaaagtcccagaaaagagggagcagttctcggtctaagtctcccgcttcagtagaccgccaaagatcccggagccgctcccggagcagaagtgtcgattcaggaaattag

SEQ ID NO: 240089 - DNA, 417 bp, Artificial Sequence
  Description of Artificial Sequence: Synthetic coding sequence
atgagcgggtgccgtgtttttatcggacgcttgaatccggcagcgcgtgagaaagacgttgaaagattctttaaggggtatgggaggattcgcgacatcgacctgaagcggggattcggattcgttgaatttgaggacccacgggatgccgacgacgcagtgtacgagttagacggcaaggagctctgctcagagcgggttactattgagcacgccagagctcggagcaggggcggacgtggcaggggaagatattctgacaggttcagttccaggaggcccagaaacgacaggaggaatgctccaccggtcagaactgaaaatcgactaattgtggaaaatctatcgtcgcgcgtaagctggcagccagtgtgcgtcgttggcctgatgacacgtagtgcttgcggcctgtcttag

SEQ ID NO: 240090 - DNA, 819 bp, Artificial Sequence
  Description of Artificial Sequence: Synthetic coding sequence
atgagtggctgtcgggtgttcatcggtcgtctgaacccagcagcccgtgagaaagacgtcgagagatttttcaagggctatgggaggataagagatattgacctaaaaagaggcttcggtttcgtggagttcgaggaccctagggacgccgacgacgccgtgtacgagctcgacgggaaagagctctgcagcgaacgtgtcacaattgagcacgccagagccagaagccgcggtgggaggggacggggtagatactctgatcggttctcttctagaagacccagaaacgatcgacgcaatgctccaccagtgaggacagaaaatcgcttaatcgtggaaaacctgagctcccgcgtgagttggcaggatctgaaggacttcatgcgacaggctggcgaggtcacctttgcggatgcacaccggcctaaactgaatgaaggcgtggtcgagtttgcttcctatggggatttgaaaaacgcaatcgagaagctgtctgggaaagagataaacggacggaagatcaaactgatcgaaggctccaaaaggcatagcaggtcccggtcccggtctcgctcgagaactcggtcgagcagtcggtccagatcacggtcacgcagccgaagccggaagagctattctcgcagcagaagtcgatctcggagcagatcgagaagtaagagtcggtctgtgtctagatctcccgtgcccgaaaagtcgcagaaaaggggctcctctagccgttccaagtcccctgcatcagttgatcgccagaggtctcggagccgaagccgctctcggtccgtcgatagtggcaattag

SEQ ID NO: 240091 - DNA, 819 bp, Artificial Sequence
  Description of Artificial Sequence: Synthetic coding sequence
atgagtgggtgtagggtctttatcggaaggcttaacccagccgcaagagagaaggatgtggaacggtttttcaagggttacggccgaatccgcgacatagacctgaaaagggggttcggattcgtggagtttgaggaccctcgcgacgcagacgatgcagtgtacgaactggacggcaaggagctgtgttcggagagagtgacaatagaacatgcccgagcaaggtcaagaggagggagaggaagaggacggtattctgatagattttccagccgccgacccaggaatgataggcggaacgccccacctgtgcggacagagaaccgcctgatcgtggaaaatttgtcaagccgcgtgagctggcaggacctgaaagactttatgagacaagccggtgaggttacttttgcagacgctcatcgacccaagctgaacgaaggtgtggtcgagttcgcaagctacggagacctaaagaacgccattgagaaattgtctggcaaggaaataaacggccgtaagatcaagcttatcgagggaagtaaacgccactcacgatccaggtcacggagtcggtcgcggacaagatcaagctcgcggagtcgcagtcgctcccggagcaggtcccggaagagctacagcagatcccgctctagaagccgcagtagaagtcgtagcaaatcccggtcagtatcacggtcccccgtgccagaaaaaagccaaaaaagaggctcctcatccagatctaagtccccggcttccgttgaccggcagcgctcacgtagcagaagccgatccaggtcagtcgacagcgggaactag

SEQ ID NO: 240092 - DNA, 1035 bp, Artificial Sequence
  Description of Artificial Sequence: Synthetic coding sequence
atgcctagagtgtacattggcagattgagctacaatgtgcgtgagaaagacatccagcggttcttcagcgggtacggaaggctcttagaagttgatttgaaaaacggctacggatttgtagagtttgaagacagtcgggacgccgacgatgcagtctacgagctcaatgggaaagaattgtgcggagaacgggtgattgttgagcacgctagaggaccccgacgtgatagggacgggtatagctatggtagccgatccggtggcggaggttatagctccagacgcaccagcggtcgtgacaagtacggtcccccagtgaggaccgaataccgcctgatcgtggaaaacctgtcctcccgctgttcgtggcaggatctgaaagacttcatgcgacaggccggtgaagtcacctatgccgacgcacacaaggaaagaaccaacgagggagttatcgagtttaggagttacagtgatatgaaacgcgcattggacaaattagatgggaccgagatcaacggcagaaacatacggctaattgaagacaagcctcgcacatcccatcggaggagttactccggatctagatcccgtagtagaagccgccgacgatctcggagtaggagcagacgcagttccaggagtagatcccggagcatctcaaagtcccggagtagatcaagatctcgaagtaagggaagaagcaggagccggagcaagggccgtaagtctagatccaagagtaaatcaaaacctaagtctgatcgcggaagccattcacactccaggtcccgaagtaaagacgagtacgagaagagcaggtctcgatcaaggtctagatcccccaaagaaaacgggaagggcgacatcaagagcaaatctcggagtcgttctcagtcacgcagtaatagccccttaccggtgcccccttcaaaggctagatctgtgtctcccccacccaaacgggcaacatcccgcagccgctccagaagtaggtccaaatcacgcagtagaagtaggagttctagtcgggactag

SEQ ID NO: 240093 - DNA, 717 bp, Artificial Sequence
  Description of Artificial Sequence: Synthetic coding sequence
atgagccggtacgggagatacggaggcgagacaaaagtatatgtcggcaacttgggaacaggtgccggtaagggcgagctcgagcgagccttctcctattacggacccctgcgtaccgtgtggatcgcaagaaacccaccagggttcgcatttgtagagtttgaggaccccagagacgccgaggacgccgttagaggccttgatggtaaggttatttgcggcagccgcgtgcgcgtggagctgtccacggggatgccgcgaaggagtcggtttgatcgcccacctgcaagaagaccctttgatccaaatgatcgatgttacgagtgcggcgagaaaggccattatgcctacgactgtcacagatactccaggagaagaagaagtcgatcaagaagtcggagtcactcccggtcaaggggcaggaggtatagcaggagccggagccgttcccgaggccgacggagcaggagcgccagcccaaggagaagccgatctatatcccttcggcgttcccggagcgcttctctgcgaagaagtagaagtgggtccatcaaaggcagtagatacttccagagcccaagccggtccagatcgcggagccgctcaattagcagaccacggtcttctcggtcaaaaagtcgttccccttcacctaaaaggtcacggtctccctctgggagtccaagacgatctgcctcccctgaaaggatggactag

SEQ ID NO: 240094 - DNA, 681 bp, Artificial Sequence
  Description of Artificial Sequence: Synthetic coding sequence
atgtctaggtacggacggtacgggggagagacaaaggtatacgtaggcaacctgggcaccggcgcaggcaaaggggagcttgagcgagccttcagctactacggaccgctcagaaccgtgtggatcgcgaggaaccctccagggttcgcctttgtagagttcgaggaccccagagatgcggaagatgcagtacgtgggttggatggcaaggttatctgcgggagcagagtacgcgtggaattaagcaccggtatgccacggagatccaggttcgatagaccccctgcacgacggcctttcgatccgaacgaccgctgctacgaatgcggggaaaaaggtcactacgcttacgattgccataggtattctagacggagacgctctagatcgcgttctcggtcacactcccggagcagaggccgaaggtatagccgaagccgatcccgcagccggggaaggcgcagcagaagcgctagcccccgacgcagcagatctatcagtttacgacgtagtagatcggcttccttgcggcgttctcgctctggatcaatcaaaggctctcgatactttcagagcccatctcgatcacggtcccgatcacgcagcattagccgcccacggtctagccggagcccctctgggagcccacgccgaagtgcatctccagaaagaatggattag

SEQ ID NO: 240095 - DNA, 1926 bp, Artificial Sequence
  Description of Artificial Sequence: Synthetic coding sequence
atgaactgggctgccttcggaggctcagagttttttataccagagggcatacagatagactctcgatgccctctgtctcgcaacatcacggaatggtaccattactacgggatagccgtgaaagagtcttctcaatattatgacgttatgtactccaaaaagggcgctgcctgggtgtcagagacaggcaagaaggaagtgagcaagcaaactgtcgcttattccccaagaagcaagttaggaaccctgctgcctgaattccccaatgtgaaagacctcaatttacctgccagtttgccggaggagaaagtcagtaccttcatcatgatgtatcgcacgcattgccagcgtattctagacaccgttattagagccaactttgacgaggtccagagcttcctcctgcacttttggcaggggatgcctccacacatgctgcctgtgctaggctcaagcaccgtggtgaacattgtgggagtctgcgactctattctctataaggcaatctccggcgtgttgatgcccaccgtcctgcaggcccttccagactccctcacccaggtgatccgcaagttcgcaaaacaacttgatgagtggctaaaggtggccctgcacgacctgccagagaatctgcgcaacataaaattcgagcttagtaggcgattctcacagatcctcaggagacagacatcgttgaaccacctctgccaagctagtagaactgtaatacattcggccgacatcacttttcagatgctggaagactggcgcaacgtggatctgaactccattaccaagcagaccttgtacaccatggaagattcccgcgatgaacatcgcaaactgatcacccagctgtatcaagaatttgatcatctgctagaggaacagagcccaatcgaatcatacatcgaatggctggataccatggtggatcgctgcgtagtaaaggtggcggctaagcgccagggttccttgaagaaggtagcccagcagttcctgctgatgtggagttgcttcggcacgcgtgttattcgcgatatgacactccatagcgcgccaagcttcggctccttccatctcattcatttgatgttcgacgattacgtactgtatctgctcgaatccttacattgtcaagagagggccaacgagctaatgcgcgctatgaaaggagagggatccacagccgaggtgcgggaagagataattttaactgaagctgccgctcccactcctagcccggtcccctcctttagccctgctaagagcgctacttcggttgaagtgcccccacctagttcgcccgtttctaatcctagccccgaatatacgggcctctccacaacaggagctatgcagtcttacacatggagcctgacttacacagtgacaaccgctgcgggttctcccgcagaaaatagtcagcaattaccctgcatgagaaatactcacgtcccaagctcttccgttacacataggattcctgtctacccgcatcgagaagagcacgggtacacgggctcttacaattatggcagttatggcaaccagcatcctcatcctatgcagtctcagtacccggcacttccccacgacactgcaatctctgggcctctccattacgccccatatcatagatcgtctgctcagtacccattcaactcccccacttcacgtatggagccttgtctcatgtcatcaacacccagattacatccaaccccagttactcctagatggcctgaggtaccatcagcaaacacatgctacacttccccatcagtgcactccgctaggtatggcaactcctccgatatgtatacaccactgactacccggaggaattcagagtacgagcatatgcagcattttccaggattcgcatatattaatggggaagcttccacagggtgggctaagtag

SEQ ID NO: 240096 - DNA, 2907 bp, Artificial Sequence
  Description of Artificial Sequence: Synthetic coding sequence
atggcatttgctaactttagaaggatcttgaggctgtcgacattcgaaaagagaaagtcacgcgagtacgaacatgtccgccgtgacctggatcccaacgaagtttgggagattgtgggtgagctgggcgacggcgcattcggcaaagtctacaaggcaaagaataaggagaccggcgcactggcagccgcaaaggtaatcgagacaaagtctgaagaagagcttgaagattacatagtagaaattgagattctcgccacctgcgatcacccttatatcgtcaaactgctcggggcttattaccacgatggaaagttgtggatcatgatcgagttctgcccaggcggtgctgtggacgcaataatgttggagctggaccgcggactcaccgagcctcagattcaggttgtgtgccgacaaatgctcgaggccctgaacttcctgcactccaaaaggattattcatcgcgatctgaaagctggaaacgtcctgatgacgctcgaaggagacatccgcctcgcagatttcggagtctccgctaagaacctgaagacgttgcagaagagagactctttcatcggcacaccatactggatggcgcctgaggttgtgatgtgtgagacaatgaaggacacgccctacgattacaaggccgacatttggtctctgggaatcacattgatcgagatggcccagatcgagccaccgcatcatgagctgaatcccatgcgcgtacttctgaaaatcgctaagtcagaccctcctacgctcctgaccccatccaaatggagtgtggagttcagagatttcctcaaaatcgctctggacaagaaccccgagacaagacccagtgccgcacagctgcttgaacatcctttcgtctccagcatcacatctaacaaggcattgagggaattggtggccgaagccaaggctgaagttatggaagaaatagaagatgggagagacgaaggggaagaggaagatgcagtggacgcagcttcgacgcttgaaaatcatacacagaattcatcggaagtctcccctccctcactgaacgcagacaagcctctggaggagagtccttctacacccttagctcctagtcagtcacaggactcagtgaacgaaccctgcagtcagccttctggtgatcggagcctccagacaacctcccctccagttgtggccccaggcaatgagaatggcctcgcagtgcctgtgcctttgagaaaatcacggccagtgtctatggatgctaggatccaggtggcacaggagaagcaggtcgccgagcagggcggtgacctgagtcctgctgctaatcggagccagaaagctagccagtccagacctaactcatccgctttggaaaccctaggaggagagaagcttgcaaatggcagcctggaaccccctgcacaagcagcccctggaccgagtaagagggattcagactgctcttcactgtgcaccagtgaatccatggattatggaaccaatctgtccactgatctgtccctgaacaaagaaatgggttccctctcaataaaggatcccaagctgtacaaaaagaccctgaaacgtaccaggaagttcgtagtggacggtgttgaagtgagcataacaacaagtaaaatcatatcagaagatgagaagaaagatgaagagatgcggttcctcagaaggcaagaactgcgagagctccgcctgctgcaaaaagaggaacacaggaatcagacccagctgtccaacaagcacgagctacagctggaacagatgcacaagaggttcgagcaggagattaatgccaaaaaaaagttcttcgatacagaacttgaaaacttggagaggcagcagaagcagcaggtggaaaagatggagcaagaccatgctgtccgccgtcgggaagaagcccgtcggattaggcttgagcaagaccgggattacacgagattccaggagcagctcaagctcatgaaaaaagaagttaaaaacgaagtagaaaaactcccaaggcaacaaaggaaagaaagcatgaagcagaagatggaagagcacactcagaagaaacagctgctagatagggatttcgtggccaagcagaaggaggatcttgaactggcaatgaaaagactgaccacggacaataggcgcgagatctgcgataaggagcgagaatgtcttatgaagaaacaggagctgcttcgggacagggaagccgcattgtgggagatggaggaacatcaattacaggagaggcaccagttggtcaaacagcagctgaaggaccagtactttttacagcgccacgagctgcttcgcaagcatgagaaggaacgcgagcagatgcaacggtacaatcagcggatgatcgagcagctcaaagtacgacagcaacaagaaaaagcgagactgcctaaaattcaaagatctgaaggtaagacccggatggcaatgtataaaaagtcgctgcacatcaatggcggaggctccgctgccgagcagcgggagaagattaagcagttcagccagcaggaggagaaaagacagaagagtgagcgtcttcagcagcaacaaaagcacgagaatcagatgagagacatgctcgcccagtgcgagagtaacatgtctgagctccagcagctccagaatgagaagtgtcacctgctcgtggaacacgaaacccagaagctaaaagcgctcgacgaatcccataaccaaaacctgaaggaatggcgggataaactgcggcctcgaaagaaggccttagaggaggatctgaatcagaaaaaaagagagcaggaaatgtttttcaagttgagcgaggaggcagaatgccctaacccatcaacgccttctaaagctgcaaaattctttccctattcttccgccgatgctagctag

SEQ ID NO: 240097 - DNA, 2907 bp, Artificial Sequence
  Description of Artificial Sequence: Synthetic coding sequence
atggccttcgcgaacttccgaagaattctgaggttgtcaacctttgagaagcgcaagtctcgggaatatgaacacgtgaggagggacctcgatccgaacgaagtctgggaaatcgtaggcgaactgggagacggtgcatttggcaaggtatataaagccaagaataaggaaacaggcgctttagctgctgccaaggtcatcgaaaccaaaagcgaggaagaactcgaggattacatcgtggagatagagatactcgccacttgcgaccatccctatattgtgaagctcctcggcgcttactatcatgacgggaagctgtggatcatgatagagttctgtcccggtggagctgtggacgctatcatgctggagctagaccggggactcaccgagccgcagattcaggtggtttgtcgacagatgctagaggccctgaatttccttcacagcaaaagaattattcatcgcgacctgaaggctgggaacgtattgatgactctcgagggtgacatccggcttgctgactttggcgtgtcggccaaaaatctcaagacactccagaagagagacagtttcatagggacgccttactggatggcacccgaagtagtcatgtgtgagaccatgaaggatacgccctacgattacaaggccgacatttggtcacttggtataaccctcatcgaaatggcgcagatcgaaccaccgcaccacgaactaaatccaatgcgcgttctgctaaagattgccaagagcgatccgccaaccctgctgacccctagcaaatggtccgtggagttcagggatttcctcaagatcgcactggacaagaaccctgagacgcgcccaagcgccgcacagttattagaacacccatttgtttcttcaattacttctaacaaggctctgcgcgagcttgttgctgaggcaaaggccgaggtaatggaggaaatcgaggatggcagggacgagggtgaagaagaagacgcggtagacgctgcgagcacactggaaaatcatacacagaactctagtgaggtctcccccccatctctgaacgcagacaagcctctagaggagtcaccttcaacgcctctcgccccttcacagtcccaagattcagtgaatgaaccctgcagtcagccgtccggcgatcggagcctgcagaccacatctcctcctgtcgtagctccagggaacgagaatgggttggccgtcccagtaccactgagaaagtcccgtccagtctctatggacgcgaggattcaggtagcccaggagaaacaggtcgccgagcagggcggagatcttagtccggctgctaataggtcccagaaggcctcccagtctcgccctaattctagcgcactcgaaaccttgggaggagagaagctcgccaacggtagcctcgaacctcccgctcaggccgcacccggtcctagcaagcgggattccgattgcagctccctctgtactagtgagagtatggactatggtaccaatcttagcaccgacctgagcctcaataaagagatgggttccctcagcatcaaggacccaaagctgtacaagaagacgctgaagaggactcgcaaattcgttgtggatggggtggaggtgtccatcacaacctctaagatcatctccgaagatgaaaaaaaggatgaagaaatgcggttcctccgaaggcaggaactcagggaactgcgactgctgcagaaggaggagcaccgaaaccagacccagctgtctaataagcacgagctccaactcgagcagatgcataagcgttttgaacaggagattaacgccaagaaaaaatttttcgatacagaacttgagaacttggaaagacaacagaagcaacaggtggagaaaatggaacaggatcacgctgtcaggcgtcgagaagaggccagacgaattcggctggaacaggatcgggattacacaagattccaggaacagttgaagcttatgaagaaagaagtgaaaaacgaagtggagaaattgccacggcagcagaggaaggagtccatgaagcaaaagatggaggagcacacacagaagaagcagttgctcgatcgtgatttcgtcgctaagcaaaaagaggacttagagctggcaatgaagagactgactaccgacaacagacgggagatctgtgataaggagagagagtgcctgatgaaaaagcaggagttgctgagggacagggaagctgccctgtgggagatggaagagcaccagcttcaggagagacaccagctggtcaagcagcagctcaaagaccaatactttctgcagcgtcatgagctccttaggaagcatgaaaaagagagggaacagatgcagcgctataaccagcgcatgattgaacagctgaaagtccggcagcagcaggagaaggctagactgcctaagatacagagatcggaggggaaaacacgaatggccatgtataaaaagtccctgcatattaatggcggagggagtgctgccgaacaaagagaaaaaatcaaacaatttagtcagcaagaagagaaacgacagaagagcgagaggttgcagcagcagcaaaagcatgaaaaccagatgagagacatgcttgcccagtgtgaatcaaatatgagcgaactgcagcagttgcaaaatgaaaagtgccacttgctcgtggaacacgagactcaaaagctgaaagcactagatgagagccacaatcagaacctgaaggagtggagagacaaactgcgccctcgcaaaaaagccttagaagaggacctaaatcagaaaaagcgggaacaggagatgttcttcaaattaagtgaagaggctgagtgtcccaacccctcgactccaagcaaagcggcaaagttttttccttacagttccgccgatgcgtcttag

SEQ ID NO: 240098 - DNA, 3300 bp, Artificial Sequence
  Description of Artificial Sequence: Synthetic coding sequence
cgcttcggtagcgctccacagagacccgtggccatgacaaccgcacaacgcgactctcttctgtggaagttagccggactcctgcgagagagtggagacgtggttttgtcaggctgctccaccctgtccctactgacacccacactccaacagttgaaccacgtattcgaattacacctcggcccatggggcccagggcaaacgggcttcgtggcactaccctcccatcctgcagatagcccagttattctccagctacagttcctgttcgacgtcctccaaaaaacactaagcctgaagttggttcacgtggctggcccaggcccaaccggaccaattaagatatttccttttaagagcctcaggcatctcgaactgcggggtgtgccacttcattgtctgcacggcctgcggggtatctacagccagctggaaaccctgatctgcagccgtagcttgcaggcactggaagaattgctctccgcctgcgggggagacttctgttccgctcttccatggctcgctctgttgagtgccaacttctcttacaatgcgctaactgcgctcgactcttcactgcggctactttctgccctgcggtttctgaacctttctcacaatcaagttcaggactgtcagggttttctgatggacctgtgcgagctgcaccacctggacatcagttataatagactgcatctagtgcccaggatgggacctagtggggcagccttgggggtgctgatcttgaggggcaacgagcttcgcagcttacatgggctggagcagctgagaaatttgaggcatttggacctagcttacaatctgttagagggtcaccgggagctctcccctttgtggctgttggccgagctgaggaagctatatttggaagggaacccactgtggttccatcccgaacaccgcgctgcaacagcccagtaccttagcccacgggcacgtgatgccgctacaggcttcttgttggacggcaaagttctctctttaaccgatttccagacgcacacaagcctggggctatctccaatggggccaccactgccttggcctgtaggatctacccctgagacatcaggaggtcccgatctgagtgattctctgtcttccggcggagtagttactcagccgttgcttcataaggtcaagagccgcgtgcgcgttcgcagggcaagtatcagcgagcccagcgacacggacccagaaccccgtactctcaatccgtcccccgctggctggtttgtgcagcagcaccctgaactggagctcatgagcagttttcgcgagagatttgggaggaactggctgcagtaccgaagtcacctcgaaccaagcggcaatcctcttccagctacacccacaacctctgccccatcagccccacccgcttcctcacaggggcctgataccgccccaagacctagtccccctcaggaagaggctagggggccacaggagagccctcagaaaatgtcagaagaagtgagggctgagccccaggaagaggaagaggaaaaagaggggaaagaagaaaaagaggaaggcgaaatggtcgaacaaggagaagaagaagccggtgaagaggaggaggaagagcaggaccagaaagaggtggaggccgagctgtgccgacccctcctcgtatgtccactcgaagggccagaaggagtgcgcggaagggaatgtttcctgagagtgacttcggcacacctgttcgaggtcgaactccaagcagccagaaccttggagcggttagaactccagagcctggaggcggctgaaattgagcctgaggcccaggcccagcgaagtccacggccaaccggttcagatctgttgcctggggctccgatactatctctacgcttctcgtatatctgtcctgatagacagctgcgcagatatctggtgttggagccagatgcacacgctgccgtgcaggaattattggctgtactgacaccagtaactaacgtcgctcgggaacagctgggagaggccagagatctgttacttggcagattccagtgtctgcgctgcgggcacgagttcaagccggaggaacctaggatgggactggacagtgaagaggggtggagaccacttttccaaaagaccgaaagtccggcagtttgccctaattgtgggtctgaccacgtggtgctgctagccgtttctcgaggaactcctaacagggaaagaaagcagggtgagcagtccctcgccccttcaccgtcagcttcccctgtttgccatcctccaggccacggcgaccacctggatcgggcaaagaattctccccctcaagcgcctagtacaagagatcatggcagttggtcactgtcccctcctcccgagcgctgcggactacggagcgtggatcacagactgcgcctgttcttagacgtagaggtcttctctgacgctcaagaagagttccagtgttgcctgaaggtgccagtcgcattagccggacataccggggagttcatgtgcctggttgtggtctctgacagacgcctgtacctactcaaagtcaccggcgaaatgcgcgaaccaccagcttcatggctgcaactaacactcgctgtaccgctgcaggacctgagcgggatcgaattgggccttgctgggcagagcctgcgcttggaatgggctgctggagccggtcgctgtgtcctgctgcccagagacgcccgtcactgcagagccttcctagaagagctgctcgacgtgctccagtctctgccccctgcttggcgtaattgcgtaagcgccaccgaggaggaagttacgccgcagcacagactttggcccctccttgaaaaggatagctcgttagaggccagacagtttttctatttgagggcattcctggtggagggccctagtacctgcctggtgagcctgttgttaacccccagcaccttattcctgttggatgaggatgccgctggaagtccagctgagcccagcccacccgctgcctctggtgaggccagtgaaaaagtgcccccttctggcccagggccagcagtgcgggtaagggagcagcagccactctctagcctaagctctgttctcttgtatcggtctgcgccagaagatctgcgtcttttgttctacgacgaagtgtccagactcgaatctttctgggcactcagagtcgtgtgccaggaacaactcacagcactgctggcctggatcagggagccatgggaagagctcttttctatagggcttcgcaccgtgatccaggaggcactcgccctggacagatag

SEQ ID NO: 240099 - DNA, 1938 bp, Artificial Sequence
  Description of Artificial Sequence: Synthetic coding sequence
aggtttggctctgcccctcaacggcctgtggccatgactaccgctcagagagattccctgctctggaagttagccggacttctccgggagagcggtgacgttgtcctctctgggtgttctaccctcagcctcctgacaccaacactacagcaactgaatcacgtgtttgagctgcatctggggccatggggccctggccagactggctttgtggcattgccttctcacccagctgactcccctgtaattttgcagttgcagtttctctttgatgtgctccaaaagactctctccctcaaactcgtacacgtcgctggcccaggtccaacgggaccaatcaagatctttccattcaagtcactcagacatttagagttgagaggtgtcccattacactgtctgcacggactaaggggcatctactctcaactcgagacattaatctgcagtcgctcccttcaggctctagaggagctcttgagtgcctgcggcggagatttctgtagcgcactgccttggttggcactgttatctgctaatttctcttacaatgcgctgaccgcgttggactcatcactgaggcttctttctgcgctcagatttctgaatctgagccacaatcaggtgcaagactgtcagggatttttgatggacctctgtgaacttcatcacttagatattagttataaccggctgcacctggtgcccagaatggggcctagcggtgcagcactcggagttttgattctgcgtggtaacgaacttcgcagcctgcacggccttgagcaactaagaaatttaagacacctggacctcgcctataacctgcttgagggtcacagggagttgagtccactatggctactggcggagttgaggaagttcttgttggatggcaaggtcctttctctgacagatttccagacccacaccagtctgggtctgtctcctatggggcctccactaccttggcccgtcggtagcactcccgaaacatccggcggtccggatctgtccgacagcctttcaagtggtggagttgttacacagccactgttgcacaaggtgaagtcacgtgtgcgcgtgcgacgcgctagcatttccgaaccctctgacacagaccctgagccacgaacactgaatcctagtcctgctggctggtttgtgcagcagcatcccgagctggaattaatgagctccttcagagagagattcgggagaaattggttgcaataccggagccatcttgaaccatctggcaatccgctgccggctactcctactacttccgcgcctagtgcacctccagccagcagtcagggcccagataccgcccctagacccagccctccgcaggaggaggccagaggccctcaggaatctcctcagaaaatgtctgaggaggtcagggcggaaccgcaggaggaagaagaggagaaggaagggaaagaagaaaaggaggagggtgaaatggtggaacagggtgaagaggaggctggcgaggaagaagaagaggagcaggaccagaaggaagttgaggccgaactctgcaggcccctcttagtgtgtccactggaggggcctgaaggagtaaggggtcgagagtgttttcttcgcgtgacatccgcacacttatttgaggtggagctccaggctgctaggacattggagagactggagctacagtctctggaagctgccgaaattgaaccagaagctcaagcgcaaaggagcccccgaccaaccggttccgatttactgccgggtgcacccattctgagtctgagatttagttacatttgccccgataggcagctgcgcaggtatctggttttagaacctgacgcacacgcagccgtgcaggttatggctcccagggttggcgctcaagaagctgtgggcatcaaacgcgcaagggggaagtggcaacaggcatag

SEQ ID NO: 240100 - DNA, 1095 bp, Artificial Sequence
  Description of Artificial Sequence: Synthetic coding sequence
atgcagaagtggttctccgcattcgacgatgctatcatccagcgacagtggagggctaacccttctcgtggagggggtggcgtatccttcacaaaggaggtcgatactaacgtcgccactggtgcccctccacggagacaaagggtcccgggacgggcatgcccatggagggaacccatccgcggacggaggggcgctcgccctggcggtggcgacgccggagggacgccgggtgaaactgtacgacattgttctgcaccagaagatcctatttttaggttcagctcacttcactcctatccttttcctggaactattaagtctagagatatgtcatggaaacggcatcacctcatcccagaaaccttcggggtcaaaaggcgacgcaagcgagggcctgttgaaagtgaccccctaaggggggagcctggatctgcccgagctgcagtctctgaacttatgcagctgtttcctcggggtttgttcgaagacgcactgccaccaatcgtcctcagatctcaggtctactctctcgttccagaccgcacagtggcagacaggcaactcaaggagctgcaggagcaaggggagatcagaatcgtgcaactgggcttcgacctcgatgcgcacggaatcatttttacagaggattatcggactcgcgtgctcaaggcctgcgacgggagaccctatgcgggagcagtgcagaagttcctggccagcgtgttgccagcgtgtggcgatctgtcctttcaacaagaccagatgacgcagacattcgggttccgggactctgagatcacgcacttggttaatgcaggggtcctcacggtgcgagatgctggcagctggtggctagccgtccccggtgcgggtcggttcatcaagtactttgtaaagggtcgccaggccgttctgagcatggtcagaaaggccaagtacagagaactcctgctgtcggaactgctggggcgaagagcacctgtcgtggttaggctgggcctgacataccatgtacatgatctgattggcgcacagctagtggactgcatctcaactacaagcggaaccctgctccgtcttccggaaacatag

SEQ ID NO: 240101 - DNA, 1107 bp, Artificial Sequence
  Description of Artificial Sequence: Synthetic coding sequence
atgcagaagtggttcagcgctttcgacgatgcaataatacagcggcaatggagggctaatccttcaagaggcggaggaggggtgtcatttactaaagaagtggacacaaacgtagccacgggtgcgccaccacgcaggcaaagagtgcctggccgagcctgtccctggcgggaaccaatacggggacggagaggcgctagacccggagggggtgacgcaggagggaccccaggcgagacagtccgccactgtagtgcaccagaggaccctatttttcgcttcagctcactgcacagctatccctttcccggaacgattaagagtcgagatatgtcctggaaacgacatcaccttatccctgaaacatttggagtcaagcgccgaagaaagcgcggtcccgttgagtcagatcctttacgcggagagcctggcagtgctcgcgcagcggtgtccgaactgatgcagctgttcccacgcggtctctttgaagatgcactcccaccgattgtgcttcggtctcaggtgtatagcctcgtcccagaccgcactgtggccgataggcagctcaaggagctccaggagcaaggggagattcgtatcgtacagcttgggtttgacttggacgcacacgggattattttcacagaagattacaggacaagagtgtgcgattgtgtgctcaaagcttgcgatgggaggccttatgccggagccgttcaaaagtttcttgcgagtgtgcttcctgcctgcggtgatctttcatttcagcaggaccagatgacgcagacgtttggcttccgggactctgagataactcaccttgttaacgccggagtgctgactgtgcgggacgccggtagctggtggctggccgtgccaggtgccggtagatttataaaatactttgtaaaaggaagacaggctgtgctgtcgatggtgcgaaaggcgaaatacagagagttgttgctcagcgagctgctaggcagaagggcccctgtcgtggttcggctggggctgacctatcacgtgcacgatctgattggagctcagcttgtggattgcatctcaactacgagcggcacactgttgcggctccccgaaacctag

SEQ ID NO: 240102 - DNA, 1107 bp, Artificial Sequence
  Description of Artificial Sequence: Synthetic coding sequence
atgcagaagtggttttccgccttcgatgacgctattatccaacgacagtggcgcgctaacccctcacggggagggggaggagtcagttttaccaaagaggtagacaccaacgttgcaactggagccccacccaggcggcagcgagtgcccggaagggcctgtccatggagggagcccatcaggggacggaggggggctaggcctgggggaggagatgcaggcggaacccccggagagacagtaagacactgctcagcccctgaggacccaatctttcgattctcatctttacattcttacccctttccaggcactatcaagagcagagatatgtcctggaaaagacaccacttgatacctgagacctttggcgtgaagaggcggagaaagaggggccctgttgagtctgatcctctgcggggagaaccaggcagcgctagagcagctgtatctgagctgatgcagttatttcccaggggacttttcgaagacgctctcccaccaatcgttctgcgaagtcaggtgtatagtctggtcccagaccgcacagtcgcagacaggcagctgaaagagttgcaagagcaaggggagataagaattgttcagttaggattcgatctagacgctcacgggattatttttacagaagattacaggacccgcgtgtgtgattgtgtgctgaaggcttgtgacggtcggccttatgccggagcggtccaaaagtttctcgcaagcgtcctgcctgcatgcggggatctgtctttccagcaggaccagatgacgcagaccttcggattccgtgattcagagatcacacatctggttaacgccggtgtcctgaccgtcagggatgccggaagttggtggttggcagtcccaggagcaggtcggtttattaaatattttgtgaagggtcgccaggcggtcttgggaatggttaggaaggccaaatatagagagctcctgcttagtgagctcctcggacggcgagcaccagtagtggtgaggctgggtctgacataccacgtccacgacctcattggcgctcagttagttgattgtattagtaccacatcaggcacacttctgagactgcctgagacttag

SEQ ID NO: 240103 - DNA, 1095 bp, Artificial Sequence
  Description of Artificial Sequence: Synthetic coding sequence
atgcagaagtggttcagcgccttcgacgatgccataatccagcgccaatggcgtgccaatcccagtagagggggaggaggagtgtcattcacaaaggaggtggacacaaatgttgcgactggcgctccccctaggagacaaagggtgccagggagagcctgcccgtggagggaaccaatccggggaagaagaggcgctaggcccggtggtggggacgccggagggactcctggagaaacagtgagacattgcagcgctcctgaagatcccatctttaggttcagctcactgcactcgtaccctttcccagggactattaagagtcgagatatgtcctggaaacgccaccatttgatccccgaaacctttggtgttaaacggcgtcgcaagaggggccctgttgagagcgaccctcttagaggcgagccaggatccgccagagctgcagtgtccgagctgatgcagttgttcccacggggactgtttgaagatgcgctaccgcctatagtgttacgctcccaggtgtacagccttgtgcctgatcgcacggtggcagaccgtcaattaaaggagctgcaagagcagggcgagataaggattgtccagctgggcttcgatttggacgcccacggaattatcttcactgaggactatcgtacccgcgtgctaaaggcctgcgatggtagaccttatgccggagcagtgcagaaatttctggccagcgtcctgccggcttgtggtgacctgtcattccagcaggaccaaatgacgcaaacgttcggcttcagagatagtgaaatcactcatctcgttaacgcgggagtgctcactgtaagagacgccggtagttggtggctggctgtgcccggagccggtcgcttcatcaaatattttgttaagggacgccaggccgtgttaggcatggtgagaaaagcaaagtaccgcgagcttctgctgagcgagctgttgggaagaagagcaccagtggtggtgcgcctcggactgacctaccatgtgcacgaccttatcggagcccagctcgtggattgcattagtacaactagcgggacactactgagactgcctgaaacatag

SEQ ID NO: 240104 - DNA, 1095 bp, Artificial Sequence
  Description of Artificial Sequence: Synthetic coding sequence
atgcagaaatggttctcggctttcgatgacgcaataattcaacgtcagtggagggctaatccttcaaggggcggaggaggcgtgtcgtttacgaaggaggtcgatacaaatgtcgcgacaggcgcacccccaaggcgccagcgagttcccggtagggcctgtccctggcgtgaaccgattcgcggacgtcgaggggcacggccaggcggaggagacgctgggggaacacccggagagactgtaaggcattgctctgcccctgaggacccgatctttaggttttccagtcttcatagttacccatttccaggtaccatcaaaagtcgagatatgagctggaagcgccaccacctcatcccagaaacctttggtgtaaaacgtagacgcaagaggggccctgtggaatcggacccattgcgcggtgagcctggatccgcgagagccgctgtgtctgaactgatgcagctgtttccaaggggcctgttcgaagatgccctgccccctattgttctgcgcagccaggtctatagcctcgtacctgatcgcacagttgcggacagacagttgaaggagctccaggaacagggcgaaatacgcattgtgcaactcggattcgacctagacgcgcacgggatcatcttcaccgaggactacaggactcgcgttctcaaagcttgcgatggacgcccttacgctggagctgtgcagaaatttctggccagcgtacttcctgcatgcggggacttgagttttcagcaggatcagatgactcaaacctttgggttccgcgactcagagataactcacctggttaatgccggagtactgactgtccgcgacgccggttcctggtggttggccgtgccaggagccggaaggtttattaagtattttgtgaaaggccgacaggctgtgctgtctatggtcagaaaagccaaatacagagaacttctcctgagcgaactgcttggcagacgtgctccagtcgtagtccggctgggcctgacctatcatgtgcacgatctgatcggcgctcagttggtggattgtattagcacaacatcaggcaccctcctccggctccccgagacctag

SEQ ID NO: 240105 - DNA, 1095 bp, Artificial Sequence
  Description of Artificial Sequence: Synthetic coding sequence
atgcagaagtggtttagcgcattcgatgatgcaattattcaacgacagtggcgggcaaaccctagtcggggtgggggtggtgtgtcttttaccaaggaggtggacaccaatgtagcgaccggcgcaccacccaggagacaaagagtgcccggacgggcttgtccatggcgggagcctataagaggaagaaggggcgcacggcctggcggaggcgatgccggagggacccccggtgaaaccgtgcgacactgcagtgcccctgaagaccccatctttcgctttagctccctgcactcataccctttccctgggacgatcaaatcccgggatatgagctggaaaagacaccatctcattccagagacattcggcgtcaagcggcgaagaaagagaggtcctgtcgagagcgacccactcaggggcgagcctggtagtgccagggctgccgtatctgagcttatgcagctcttccccagagggctattcgaggatgcgctgcccccaatcgtgctacgctcccaggtttactctctggttccagatcgcaccgtggctgacaggcagctgaaggagttgcaggagcaaggggagatccggatcgttcaacttggctttgatctcgacgcccacgggatcatcttcaccgaagactatcgaactcgagtactgaaggcatgtgacggcagaccctatgcgggagcagttcagaagtttctagcatcggttttgcctgcttgtggggatttgagttttcaacaggaccagatgactcagacctttgggttcagagactcagaaatcactcatcttgtgaacgcaggggtgcttacggtgcgcgacgccggttcatggtggcttgcggtgcccggagcgggacgctttatcaagtatttcgttaaagggagacaggccgttctcagtatggtacggaaggctaagtatagagaattgcttttgtcggaattgttaggaagaagagcaccggtcgtcgtccgcttaggcctcacttaccatgtgcatgatcttatcggtgcccagctcgtagactgcatctcgactactagcggaaccttgctgcgtttacctgagacatag

SEQ ID NO: 240106 - DNA, 1095 bp, Artificial Sequence
  Description of Artificial Sequence: Synthetic coding sequence
atgcaaaaatggttcagtgcgttcgatgatgcgataatccagaggcagtggagagccaatccctccagaggtgggggaggcgtttcctttaccaaggaggtcgacactaacgtagccacgggagcgccaccgcgtcgccaacgtgttccagggcgagcctgtccttggcgcgagccgattcgagggagacgaggggcaagaccaggcggaggcgacgcagggggaacaccaggtgagaccgttaggcattgctcggctcctgaagaccctatcttcaggttcagctccctccattcctaccccttcccgggaactattaagagtcgggacatgagttggaaaagacatcatctgattcccgagactttcggtgtcaagcgcagacggaagagaggccctgtcgagtcggaccccctgcgaggagagcccggatccgccagagctgcagtgagcgaattaatgcagcttttcccacggggacttttcgaggatgcccttcctccaatagtgttgaggagtcaggtctattcgctagttccggatagaacagtggctgatcggcaattgaaagaacttcaagagcagggagagattcgaatcgtccagcttggtttcgacctggacgctcatgggatcatcttcactgaggactataggacgcgcgtacttaaggcctgcgacggccgaccttatgctggggctgtgcagaaattcctcgcatccgtgttgcccgcttgtggggacctctctttccagcaggaccagatgacgcaaacttttggattccgggactcagagattacccacttagtgaacgccggagttctgaccgtgagagacgccggatcatggtggctggctgtccctggcgctgggagatttatcaagtatttcgtgaaaggcagacaggcagtgcttagtatggttcgaaaggcgaaatatcgagagttgctgctctcagaactgctgggtcggagagcccctgtcgtcgtccgcctcggcctgacttaccatgtccacgacctgataggagcccagttggtggattgcataagcacaaccagtggaactctcctgcgactccccgagacctag

SEQ ID NO: 240107 - DNA, 1107 bp, Artificial Sequence
  Description of Artificial Sequence: Synthetic coding sequence
atgcagaagtggttctctgcatttgatgatgccattatccagcggcagtggcgggctaacccatctcggggaggtggtggcgtatcttttaccaaggaggtggacaccaacgtcgcgaccggcgctcctccaagaaggcagcgcgtcccagggagggcatgcccctggcgagagccaataaggggacgcagaggtgctagacctggaggcggtgatgcaggaggtactcccggtgagacagtgcgtcactgttcagccccagaagaccctatctttcgcttctctagtctacattcgtacccatttccgggtaccataaagagccgtgacatgtcctggaagaggcaccatcttatccctgaaaccttcggggtaaagcgaaggcggaaacgtggccctgtggaaagtgatcctcttcgaggcgagccgggtagcgcaagggcagccgtgtcggagctgatgcaactgttccccagaggactgttcgaggacgctttaccacctatcgtattgcgcagtcaggtttattccctggtgcccgatcgtacggtggcggatcgtcagctcaaggagcttcaagagcagggtgagatcaggatcgtgcaactcgggtttgatctcgacgcccacgggatcatatttactgaagactacagaactcgcgtgtgcgattgtgtcctgaaagcatgtgatgggaggccatatgctggtgccgtgcagaaattcctggcgagcgtgttacctgcttgcggagatctaagctttcagcaggatcagatgactcagacattcggctttcgcgatagcgagataacacatctggtgaacgctggagtgctcacagtacgtgacgccggttcttggtggttggccgttcctggagccggaagatttataaaatacttcgtaaaaggccgacaggccgtcctctcaatggttagaaaggcaaagtaccgagaattactgctgtctgaactgctcggacgcagggcacccgtcgtcgtacgactggggttgacgtaccacgtacacgatctcatcggcgctcaattagtcgattgcatttccacaacaagtggtactctgctgcgactgcccgagacatag

SEQ ID NO: 240108 - DNA, 1107 bp, Artificial Sequence
  Description of Artificial Sequence: Synthetic coding sequence
atgcaaaagtggttttcagctttcgacgatgctattatacagcgacaatggagggctaatccaagcagaggtggaggcggagtgagcttcacaaaagaagttgatactaacgtggctacaggcgcaccccctcgtcgtcagcgggtccctgggagggcttgtccctggcgggagcctataagaggacgacgtggcgcacgccctggaggcggagatgccggaggcactcccggagagaccgtcagacactgcagcgcccctgaagaccccatttttcgttttagttccttacactcatatccttttcccggaacgattaaatcccgagatatgtcttggaaaaggcatcatctgatccccgagacctttggtgtaaaacgaagacgcaagcgtgggcctgttgagagtgatcccctaaggggcgaaccaggtagcgcccgagccgctgtttctgagctgatgcagctattccccagggggctattcgaggacgctttgccacccatagttctccgcagtcaggtctactccctcgtcccggatcggacagtggccgatcggcagcttaaagagcttcaggaacagggagagatccgcattgtgcagctgggatttgatttggacgcacacgggatcatatttacagaggactacagaacacgcgtgtgcgattgcgtcttgaaggcctgcgatggtcggccatatgccggagccgtgcaaaaatttctggcctcagtgctgccagcttgtggtgacctgtcatttcaacaggaccagatgacccaaacgttcggctttagggacagcgagatcactcatttggtaaacgccggagtcctaactgtcagagacgcaggttcatggtggctggcggtgcctggcgcagggagatttataaaatatttcgtaaagggtcgtcaggcagtcctgtcaatggtgcggaaggccaagtatagagagctcctgttgagcgagcttctcgggaggcgggcacctgtggttgttcggctgggcctgacctatcacgtccatgacctgattggggcacaactggtagattgtatcagcaccacctccggcacgttgctccgattaccagagacctag

SEQ ID NO: 240109 - DNA, 1107 bp, Artificial Sequence
  Description of Artificial Sequence: Synthetic coding sequence
atgcagaagtggttctcagcctttgacgacgccattatacagcgacagtggcgtgcaaacccttcgaggggtggagggggagtgtcttttaccaaggaggtcgacaccaatgttgcaacgggagcgccaccacggaggcaacgcgtgcccggaagagcttgtccatggagagagccaatcagagggaggaggggcgctcgccctggcggaggtgatgccggtggtacccccggagaaaccgttcgtcattgttccgcccctgaggatcctatcttcagattttcatccctgcatagctaccctttccccggaactatcaagagtcgggatatgagctggaagcgccatcatcttatccctgagactttcggggtgaagcgccgacggaagcggggacccgttgagagcgacccactgcgcggtgagcccggaagtgcccgagccgctgtgtctgaactcatgcagctgtttccgagaggactgttcgaggatgcactgccgccaatcgtgctcagaagccaggtttactctctcgtgccagatagaacagtagcagatcggcagttaaaggaactgcaggaacagggggagattaggatagttcagttgggatttgatctggatgcacatggtataatcttcaccgaggactatcggacccgggtgtgtgactgtgtgcttaaagcctgtgacggaagaccttacgctggagccgtgcagaagttcctcgcctccgtgcttcccgcatgtggcgatctgtcttttcaacaggaccagatgactcaaaccttcgggtttcgtgacagtgagattacccatctggttaatgcaggtgtgctcactgtgcgggatgccggatcgtggtggctcgctgtaccaggcgctggcagattcataaagtactttgttaagggaagacaggctgtcctgtccatggtccgcaaggctaagtatcgtgagttgttgttgtccgaactgctgggccgacgggcacctgtcgtggttcgtctgggcctcacctaccacgtgcacgatctgatcggcgctcagttagtcgactgcatcagtaccaccagcggaacattactgagactgccggagacatag

SEQ ID NO: 240110 - DNA, 1095 bp, Artificial Sequence
  Description of Artificial Sequence: Synthetic coding sequence
atgcaaaagtggttctcggctttcgatgacgctatcatccaacggcagtggagagcaaatccaagtagggggggaggaggcgtaagtttcaccaaagaggtggatactaacgtagccaccggcgctcctcctagacggcaacgggtcccaggcagggcctgcccatggcgcgagcctattcgcggaagaagaggcgctcggcctgggggaggagatgctgggggaacccccggagagacagtccgacattgttccgccccagaggatcccatctttagattcagttccttgcacagctacccatttccaggtaccattaaaagccgagacatgtcatggaagaggcatcacctgattcccgaaaccttcggtgtgaaacgcagacgtaaacgcggacctgtggagagcgaccctctcagaggggaaccagggtctgcaagggctgccgtgagcgagctgatgcagctatttcccaggggcctcttcgaagacgcgttgccaccgatcgtgctgcgctcacaggtgtattctctggtcccagatagaacagtggcagataggcagctgaaggaactccaggagcaaggcgagattagaattgtacaattgggctttgacttggacgcccatggcattatattcacagaggattaccgcacgagagtgttaaaagcttgtgatggtcgcccatatgcaggcgctgttcaaaagtttctggctagtgtgctccctgcctgtggcgacctgagcttccagcaagaccagatgacacagaccttcggcttccgcgactcagagatcacacacctggtcaatgctggggtcctgactgtgcgtgacgcaggtagctggtggctcgccgtgcctggcgcagggagatttattaagtacttcgttaaaggtaggcaagccgtactttctatggtgagaaaggccaagtaccgagagctcttgctttctgagcttctgggacggagagccccagtggtcgtgcggctgggactgacataccacgtgcacgatttgattggtgcccagctggtggactgcatcagcactacgtcaggcacccttctgcgactgccggagacttag

SEQ ID NO: 240111 - DNA, 1107 bp, Artificial Sequence
  Description of Artificial Sequence: Synthetic coding sequence
atgcaaaaatggttttccgccttcgacgatgctattattcagagacagtggagagccaacccttctagaggcggtggtggcgtaagttttaccaaggaagtggacaccaacgtcgcaactggcgctcctccccgacgacagcgagtaccgggacgagcttgtccctggcgtgagcctattcgaggtaggcgtggcgctaggcccggaggcggtgacgccggagggacacccggagagacggtgcgccactgcagcgcgccagaggatcccatctttcggtttagctccctacattcatacccgttcccgggaaccatcaaatctcgcgacatgagttggaagaggcaccatctcattccagagacattcggcgtgaagcgtcgccgaaaaagggggccagtggagtcggaccctttgcggggtgagcccggatcagccagagcggcagtgagtgaactcatgcagctcttccccaggggattatttgaggatgccttgcccccaattgttcttcggtctcaagtgtatagtttggtgccagacaggactgtggctgatagacagctcaaagagctccaagagcagggtgaaattaggatcgtgcagctagggttcgacctcgatgcccacggtattatttttactgaggattaccgtacgcgggtctgtgattgtgtgttgaaagcttgcgatggacgcccttacgcaggagccgtgcagaagttcctcgcgagcgtgctccccgcatgtggggacctgtcatttcagcaggatcagatgactcaaacctttgggtttcgcgactccgagattactcatcttgtgaacgccggtgttctgaccgtgagggacgccggatcgtggtggctggccgtgccaggcgctggtagattcataaaatactttgtgaagggaaggcaggcggttctgagcatggtcaggaaggccaaatatcgtgaactgctactttcagagctgctggggagacgtgcccctgttgtcgtgaggcttgggctcacctatcatgtgcacgatttgataggtgcacagctcgtggactgcatatcaacgacatccggaacactgctgagactgcctgagacttag

SEQ ID NO: 240112 - DNA, 339 bp, Artificial Sequence
  Description of Artificial Sequence: Synthetic coding sequence
atgcagaaatggttttcagcattcgacgatgccatcatccagcgtcagtggcgggcaaatccctctcgtggtggagggggagtgagttttacgaaggaagtggatacaaatgtcgccactggcgcacctcccaggaggcagagagtccccggtcgcgcttgcccttggcgggaacccatcaggggtcgtaggggagcgaggcccggagggggagatgcaggaggcacgccaggcgaaacagtgaggcattgcagcgctcccgaagatcctatcttcaggttctcttccttacatagttacccctttccgggaactattaaatctcgcgatatgtcctag

SEQ ID NO: 240113 - DNA, 966 bp, Artificial Sequence
  Description of Artificial Sequence: Synthetic coding sequence
atgcttgtttgtgcctcacctcctccccttcctgccttaaccggcctacgcgacgacaagctgactcttctcagcagctcacctggactgggtgggacacccggtgagaccgtccgacactgttcagccccagaagaccccatattcagattttcctctctgcacagctatcccttccctggaacgattaaaagcagagacatgagctggaagcgacaccatcttatcccggaaacattcggtgtgaagcggcgacgcaaaagaggccctgttgagagcgatccccttaggggagaacctggtagcgccagggcagctgtgagcgaacttatgcagctatttccacggggtttgtttgaggacgccttgcccccaattgtccttagaagccaggtctattccttggtacctgataggactgtcgccgacaggcagttaaaggagctacaggagcaaggcgaaatcaggattgtgcagcttggttttgacctggacgctcatggtattatcttcacggaagattatcggacccgcgtcctcaaagcatgcgacggcagaccttacgcaggagctgttcagaagtttttggcaagtgtgctgccagcctgcggcgacctaagcttccagcaagaccagatgacccaaactttcggcttccgggattcggagatcactcaccttgttaacgcaggcgttctgaccgtaagggatgctggttcatggtggctcgccgtcccaggggctggccgattcattaagtatttcgtcaagggcaggcaggccgtgctaggcatggtgaggaaggcgaaatatcgtgagttgctcctcagcgagctgctgggacggagggctcctgtcgtagtgagactgggactgacttatcacgtccacgacttaattggggctcagctggtagattgtattagtactacatcaggaaccctgctaagactccctgaaacatag

SEQ ID NO: 240114 - DNA, 966 bp, Artificial Sequence
  Description of Artificial Sequence: Synthetic coding sequence
atgctggtctgtgcctcccctcccccactgcctgcccttactggccttcgggatgataaactgaccctcctgtctagtagccctgggctgggcggaacccccggagaaactgtgcgacactgcagcgctccagaggaccccatttttcgcttcagctccttacattcctatccattccccggaactatcaaatccagggacatgtcttggaaacgccatcatcttatacctgagacatttggagtcaaacggaggaggaaaagaggacccgtcgagtcagatcccctgcggggtgagcccggttccgctagagctgctgtgtcagaactgatgcagctgtttccgaggggactatttgaggatgcactgcctccaattgtcctacgatcccaggtctacagtttagttcctgaccgtaccgttgccgaccgccagttaaaggagttgcaagagcagggcgagatacggatcgtgcagctgggctttgatctagatgctcatggcatcatcttcacggaagattaccgaaccagggtgctcaaggcttgtgatggcagaccttacgccggtgcagtgcagaagttcctcgcaagcgttctccccgcatgtggtgacttaagctttcagcaagaccagatgacccagacctttgggttcagagattccgagattacccatctggtgaacgcgggagtactgacggtgcgagacgctggctcctggtggcttgctgtgccaggagccggtcgctttataaaatactttgtaaagggacgacaggcggtccttagcatggttagaaaggctaaatacagagaacttctgttgtctgagcttttaggcagacgcgcacctgtggtcgtcagactaggcctcacttatcatgtgcatgacttgattggcgctcagctggtcgattgcattagcaccacttctggaacgctactccgcctgcccgagacctag

SEQ ID NO: 240115 - DNA, 966 bp, Artificial Sequence
  Description of Artificial Sequence: Synthetic coding sequence
atgctagtgtgtgcgtccccccctccccttccagccctcacaggcctaagggacgacaaactaacgctgctcagttcctcgcccggtctcggagggactcccggagagaccgttaggcactgctccgcccctgaggacccaatctttaggttctcttcactgcactcctatccattccctggaactatcaaatctagagacatgtcttggaagagacaccacttaattcctgagactttcggagtcaagcgcagacgcaagagggggccagttgaatccgatccactaaggggcgagccaggcagcgccagagcagctgtcagcgagctgatgcaattgttccctaggggactgtttgaagatgctctgccgccaatcgtcctacgaagtcaggtgtactcgctcgtgcctgatagaacggtggccgatcgccaattaaaggagctacaagaacagggagagatcaggatcgttcagctgggtttcgacctggatgcccacggcattatatttactgaggactatcgcaccagggtgctgaaggcttgtgacggcagaccttacgcaggagctgtgcagaagtttcttgccagtgttctgcccgcttgcggagatctctcttttcaacaggatcagatgactcagacctttggatttcgggacagtgagattacccacctggttaatgctggtgtgctgacagtgagagatgctgggagctggtggctggctgtgcctggcgctgggagatttatcaagtacttcgtgaaggggcgtcaggctgttcttagcatggtgcggaaagctaagtaccgggaactattgttgagcgagcttcttggtcgcagagctcccgtggtcgtgcggctgggcctaacctaccatgttcatgatttaatcggtgctcagctcgtcgactgcataagcaccacttcagggacattgctgcggctgccagagacctag

SEQ ID NO: 240116 - DNA, 966 bp, Artificial Sequence
  Description of Artificial Sequence: Synthetic coding sequence
atgcttgtctgtgcctcccctccacctctcccagctctgactggcttgcgtgatgacaaactgaccctactgagctcatcccccggtcttgggggtacacctggggagactgtacgacactgttcggcccctgaagacccaattttccgttttagcagccttcactcttacccctttcctggaaccattaagtcccgcgatatgagctggaagagacaccatttgatccccgagacgtttggagtcaaacgccgacgtaagcgtgggccagtggagtctgaccctttgaggggtgagcccggttctgccagggccgctgtgagcgagcttatgcaattatttcctcgtggcctgttcgaggacgccctccccccaatagttctgcgcagccaagtgtattccctggttccggatagaacagtggccgatcgccagttgaaggagctgcaggaacaaggggagatccggatcgttcagttggggttcgatctggatgcgcacgggatcatcttcaccgaggattatcgcaccagagtcttgaaagcctgtgacggacgcccatacgctggggcagtgcagaagtttttggcctccgtgctgcctgcctgcggtgatttaagtttccaacaggaccagatgacacaaactttcggcttccgggattccgagattacccacttggtgaatgcgggtgtcctgaccgtgcgcgacgcgggttcctggtggctggctgtcccaggggcagggcgttttatcaagtatttcgtgaaggggaggcaagccgttctgtccatggtgcgaaaggctaaatacagggagctactcctgagcgagctgctgggacggagagcccctgtggtggtgaggctagggcttacctatcacgtgcatgatctgattggagcccagcttgtcgattgtatatcaactacatcaggcacactcctccggctaccagagacctag

SEQ ID NO: 240117 - DNA, 966 bp, Artificial Sequence
  Description of Artificial Sequence: Synthetic coding sequence
atgctcgtttgtgcctcccctccacctctccctgccttgacaggattacgcgacgacaagctgaccctgctcagtagctcccccggtcttggagggactcctggagagacggtgaggcattgcagcgcacccgaagaccctatctttcgattctctagcctgcactcatatcccttccctggaaccattaagtcaagggacatgtcatggaaacgccatcacctgattcccgagacattcggagtcaagcggagaagaaagaggggcccagttgaatctgacccattaaggggggaacctggatcagccagagccgctgtctcagaactgatgcagctgtttccacgaggcctgttcgaggatgccctgccgcctattgtgttgcgctcccaggtttattctttagttccggacaggacagttgccgaccggcagctgaaggagcttcaagaacagggagagatccggattgtgcagttaggcttcgatctggacgcccatggcatcatcttcacggaggattacagaactcgggtcctgaaagcctgcgatggcagaccttatgcaggcgctgtccagaagtttctggcgtccgtgcttcctgcctgcggtgatctgtcctttcagcaggaccagatgacacagaccttcggtttcagagatagcgaaattacacaccttgtcaatgccggagtattaacagtgagggacgccggaagttggtggttggctgtccctggggcagggagattcataaagtacttcgttaaaggtcggcaagctgtgttgtcaatggtcaggaaagctaagtatagggaacttctgttatcagagctgctggggaggagagctcccgtggtagtaaggctaggcttaacatatcacgtgcatgatctgattggagcgcagctagtggattgtatatccacaacttccgggacgttgcttaggcttcctgagacttag

SEQ ID NO: 240118 - DNA, 1320 bp, Artificial Sequence
  Description of Artificial Sequence: Synthetic coding sequence
atgcagaacttgaaagcagacccagaagaattgttcacaaagttagagaagataggcaaagggtccttcggagaggtgtttaagggaattgataaccggactcagaaggtagtagcaattaagatcatcgatttggaggaggccgaagatgagatagaagacatccagcaagagatcacagtactcagtcaatgcgactccccctatgttactaaatactatgggtcgtacctgaaagataccaagttgtggattatcatggaatacctcgggggagggtccgccctcgacctgcttgaaccgggacctctcgacgagactcaaatcgccactatcctgcgggagatcctaaaaggcttggattacctgcacagtgaaaaaaaaatccatcgcgacattaaggccgctaatgtgttgctgtcagagcacggcgaagtcaagctagctgatttcggggtggctggccagctaaccgacacacagatcaaacgaaatactttcgtgggaacgccgttctggatggcccctgaagtgatcaagcagagcgcttacgactctaaggccgatatctggtcactgggcatcactgctattgagctggcccgtggcgagcctccccattctgagttacaccccatgaaggttctgtttttgatccccaaaaataatccgcctaccctcgaaggcaattactcaaagccactaaaagagttcgtggaggcctgtctcaataaggaacctagcttccgacctaccgcgaaggagttacttaagcataagtttattttacgaaacgccaagaaaacttcctatctgaccgaacttatcgacagatacaaaaggtggaaagccgagcagtctcatgatgactccagcagtgaagattcagacgccgagactgacggtcaggctagtggcggttctgactcgggggattggatctttacaatacgcgagaaagaccccaagaacttggaaaacggagccctccagccatctgatctcgacagaaataaaatgaaggatataccgaaaaggcccttttcgcagtgcctgtccactataatcagccccttgtttgcagaattaaaggaaaaatctcaggcctgtggcggtaacctcggttccatcgaggaattgagaggagctatctacctagcagaagaagcttgccctgggatatcagacacaatggtggcgcaacttgtccagcgtctccagcgttccatacacggaaaccaagcaccaccggattgtcacctcgctcaggtgcaggctttcggagggtctgggtgcgtgttagggagtagatcagtctag

SEQ ID NO: 240119 - DNA, 672 bp, Artificial Sequence
  Description of Artificial Sequence: Synthetic coding sequence
atggccccagaagtgatcaagcagtcagcgtacgatagtaaagccgacatctggtcgctcggaataaccgcgatcgagcttgctcgcggagagcccccacatagcgaactgcacccgatgaaggtcctgttcctgattcccaaaaataaccctcctaccctagaagggaactactctaagcccttgaaggaattcgttgaagcctgcctaaataaagagccttcctttcggccaacggccaaagagctgctgaagcataaattcattttgagaaacgcgaaaaagactagttatctcaccgagttaattgaccgctataagcggtggaaggccgagcagtctcatgatgattcctcgtccgaggacagcgatgccgaaaccgacggccaagccagtgggggaagtgatagtggggactggatcttcacgatcagagaaaaggaccccaagaatctagagaatggggctctgcagccctccgaccttgatcgtaacaaattgaaggagaagagccaagcatgtggcggaaatctaggctcaatcgaggaactcaggggcgcaatatatctggccgaggaagcatgccctggaatttccgacactatggtggcccaactggtgcaacgactgcagcgctactcgctgtcaggcggaggcactagcagtcattag

SEQ ID NO: 240120 - DNA, 1332 bp, Artificial Sequence
  Description of Artificial Sequence: Synthetic coding sequence
atggacagcagagctcagctctggggcctcgcgcttaataagagacgcgctactctgccacacccagggggttcaaccaatctaaaggcggatccagaggaattgtttacgaagcttgaaaagatcgggaaaggatcgttcggcgaagtattcaaaggcattgataacagaacccagaaagtcgtagctataaagattatagacctggaggaggctgaagacgagatcgaagacatccagcaagaaattactgtgttaagccagtgtgatagcccgtatgtaacgaagtactacggctcttatctgaaagacacaaaactgtggataataatggagtacttgggaggcggtagtgccttagacctgctggagcccggtccactggacgaaacacagatagctactattctgagagagatactcaaaggtctggactacctccatagtgaaaagaaaatccaccgggatatcaaggctgcaaacgtgctgctgagcgaacacggagaggtgaagcttgctgatttcggcgttgcagggcagctcacagatacccagatcaagcggaacacctttgtcggcaccccattctggatggcccctgaagtgattaagcagtctgcatacgattctaaggccgacatttggagcctggggattacagctatcgaactggcacggggagaaccaccccactctgagttgcacccgatgaaggtgctcttcctgatcccaaagaacaatccacccaccctcgagggaaactacagcaagcctctcaaagaattcgttgaggcttgcctcaacaaggaaccttccttcagaccgacagccaaagagctgttgaagcacaagttcattctgcggaatgctaaaaaaacctcttacctgactgagcttatagaccgttataagcggtggaaagccgagcagtcacacgacgactctagtagcgaagactccgacgccgaaactgacggtcaggcctctggcggatccgacagtggtgactggattttcactatacgcgaaaaggatccaaagaacctggagaacggggctctgcagcctagtgacttggaccggaacaagatgaaggatatccctaagcgaccgttctcacaatgcttatccactattataagtccgctctttgccgagttgaaagagaagtctcaagcgtgcggcggtaatttgggttccatcgaggagctgcgaggggcaatctacctggcagaagaggcttgcccagggataagtgacacaatggtcgctcagctggtgcagcggcttcagcgatactctctgagcggcggtggtactagcagccactag

SEQ ID NO: 240121 - DNA, 1296 bp, Artificial Sequence
  Description of Artificial Sequence: Synthetic coding sequence
atggcgcatagcccagtgcagtccggcctaccagggatgcagaaccttaaggccgatcccgaagagctgtttactaaactggaaaagatcggtaaaggctctttcggagaggtctttaaaggtattgataaccggactcaaaaggtcgtggctatcaaaattatagacctagaagaagcggaggacgagatcgaagatatacaacaggaaataaccgtcctgagtcaatgcgactccccctacgtcaccaaatactatgggtcttacctaaaagacactaagttatggataattatggagtatctaggcggagggagcgccctggatctgcttgagccaggccctcttgacgagacacagatagccacaatcctccgggagatcctaaaaggactcgactacctgcatagcgaaaaaaaaattcaccgggacattaaggcggcaaatgtcctgctaagcgagcatggtgaagtgaaactggcggatttcggtgtagccggacaactgaccgacacccaaattaagcgtaacacgttcgtaggcacccccttctggatggccccagaagtcattaagcagtctgcttacgatagtaaggcggacatttggtcacttgggatcacagccatcgaactagccagaggcgagcccccacactctgagctgcaccctatgaaggttctgtttctgatcccaaagaataaccctccaacactggaaggtaattacagtaaacccttaaaagaatttgtggaagcctgtttaaacaaagagccgtcattcaggcccactgccaaggaactgcttaaacacaagtttatcctccgcaacgccaagaagactagctaccttactgagctgatcgacagatataagcgatggaaagctgagcagtctcacgacgacagctcctcggaggactccgatgctgagaccgacggacaggccagtggcggaagcgatagtggagactggatattcaccattcgagaaaaagaccctaagaacctggaaaatggcgctctgcaaccatctgacttggaccgtaacaagatgaaggatatacctaaaagacctttctcccagtgtctctccaccatcatctccccattatttgccgagttaaaggaaaaatctcaggcctgcggcggaaatctcggcagcattgaggagttgaggggagccatttaccttgctgaagaggcatgcccaggcatcagcgacaccatggtggcccagctcgttcagcgtctgcagcgctattcactgtccggcggaggtacctcttcgcactag

SEQ ID NO: 240122 - DNA, 1239 bp, Artificial Sequence
  Description of Artificial Sequence: Synthetic coding sequence
atggcccactcacctgtacagtccggattgccaggcatgcagaatttgaaggccgacccagaagaactgtttacaaagctagagaagattggaaaaggctcgttcggcgaagtgttcaaggggatcgacaataggacccagaaagtcgttgccattaaaatcattgatcttgaagaggccgaggacgagatagaggacatacagcaggagatcacagttctgagccaatgtgatagcccttacgtcactaaatactacggctcatatttaaagctcgaacccggtccgctcgatgaaacacagatcgcaactatcctacgagagatactaaaaggcttggattatctccattcagaaaaaaaaattcaccgcgacatcaaggccgcaaatgtgttattgtccgaacacggtgaggttaaacttgccgactttggagtggctggccaactgactgatacacagataaaaaggaacacattcgttgggacccccttctggatggcccctgaggtcataaaacagtccgcctatgactcaaaggctgacatttggtcactcgggatcacagccatagaactggcaaggggcgagccccctcattctgaactgcaccccatgaaggtcctgtttttgatccctaaaaacaaccccccaacgctggagggtaattactctaagcccctgaaggagtttgtggaagcctgccttaataaagaaccatcctttagaccaaccgcaaaggagcttctaaagcataaattcatcctcaggaatgccaagaaaacctcctacctgaccgaactcattgaccgatataaacggtggaaggccgaacagtctcacgacgatagctcttccgaagactcggacgctgagacagacgggcaagcatctggaggctccgatagcggagactggatcttcacaatccgggaaaaggaccctaaaaacttggaaaacggcgcactgcaacccagtgacctggaccgcaacaaaatgaaggacataccaaaaagacctttctctcagtgcctctctaccatcatttccccattgttcgcggaacttaaggagaagtcgcaagcatgcgggggaaatttgggcagtatagaagagctccgcggagcaatatatctggctgaggaggcctgccctggtatttccgatacaatggttgctcagcttgttcagcgcctgcagaggtacagtttgtcaggagggggtaccagtagccactag

SEQ ID NO: 240123 - DNA, 1029 bp, Artificial Sequence
  Description of Artificial Sequence: Synthetic coding sequence
atggctcatagccctgtgcagtccggtctccctggcatgcagaaccttaaggcagatccggaagagctgttcacgaaactggaaaaaatcggaaaagggtcttttggcgaggttttcaaaggcattgacaaccgtactcaaaaagtcgtagccattaaaatcatcgacttagaagaagcagaggacgagattgaggacatccaacaagaaattacggtcctgagccagtgtgactcaccctacgtgaccaagtactacggcagttatttaaaagacaccaagctgtggatcataatggaatacctaggagggggatctgccctggaccttctcgaaccagggcctctcgatgagacccagatcgctaccatcctgagggaaatcctcaaagggctcgattacctgcactctgaaaaaaagattcaccgagatattaaagccgctaacgtgctgctgtcagaacacggtgaggtcaaattggccgactttggtgtagccggacagctgacggacacgcagatcaagaggaatacattcgtggggacgcctttctggatggccccagaagtcattaaacagagtgcctacgactcaaaagcggacatctggagcctgggaatcacagccattgaactggcgagaggtgagcccccacactctgagctgcaccctatgaaagtgctgttccttatacccaaaaacaatccccctaccctggaaggaaactacagcaagcccctcaaggagttcgtggaggcgtgcctgaataaggaacctagctttcgacctacggccaaggagctcctcaagcacaagtttatcctccggaatgccaagaaaacttcataccttaccgagttgatcgaccgatataagaggtggaaagcagagcaatctcacgatgactcttcgtccgaggattccgatgccgaaaccgacggccaagcaagcggtgggtccgattctggggactggatattcaccatcagggagtggtcgagctctgcgattggcttgggccaaaagtag

SEQ ID NO: 240124 - DNA, 2991 bp, Artificial Sequence
  Description of Artificial Sequence: Synthetic coding sequence
atggacgaggacactcactatgacaaggtggaagatgtcgtggggtctcacattgaagatgctgttaccttctgggcccagagtattaacaggaataaggatatcatgaagattgggtgctcactctctgaggtgtgcccccaagccagttccgtcctcggaaatctagacccaaacaagatctatggtggcttgttctccgaggaccagtgttggtaccgctgtaaagtcctgaagattatttctgtggaaaagtgtttagtcagatacatcgattacggaaatactgagatacttaaccgcagtgacattgtggaaattccactagagctgcagttttcttccgtcgctaaaaaatacaaactctggggcctccacattccatctgatcaagaggtgacgcagttcgaccagggcacaactttcctgggcagtctgatattcgagaaagaaatcaaaatgcgcattaaggcaacatctgaagacggcacagtgatagctcaggctgagtacgggagtgtggacatcggtgaggaggtacttaaaaaggggttcgcagagaaatgccgtctggcatctcgaacagatatctgcgaggaaaagaagttggatccaggccaacttgtccttcgaaacctgaaatctcccatccctctttggggacatcgatctaaccagtcaactttcagccggccaaagggacacctgtctgaaaagatgaccctcgatctcaaagatgagaatgacgctggaaacctcattacatttcctaaggagtccctcgccgtaggcgactttaatctgggtagcaacgttagcctggaaaagatcaaacaggatcagaaactgattgaggagaacgaaaaacttaaaacggaaaaggatgcacttctagaaagttacaaggccctggagctgaaggtggagcagatcgcccaagagctgcagcaggagaaggcggcagccgttgacctaaccaaccacttggaatacactctaaaaacttacatcgacacccggatgaagaaccttgccgcaaaaatggagatacttaaggagatgaggcatgttgatataagcgtcaggttcggcaaggacctttcggacgctattcaggttctggacgaaggatgctttacaacacctgcctcgcttaatggccttgagatcatttgggcggagtactctctcgcacaagaaaacattaagacctgcgagtacgtatccgagggcaacattctgattgctcaacggaatgaaatgcaacagaagctgtatatgagtgtggaggacttcatcttagaagtcgacgaatctagtctgaataaacgtctaaaaacactgcaagacttgagcgtctctcttgaagctgtgtacggccaggcaaaagagggtgccaactcagatgaaatcctaaagaagttttacgattggaagtgcgacaagagggaagaatttacgtctgtccgctcagaaactgatgcaagtttgcaccggcttgtcgcatggttccagagaaccctgaaggttttcgatttgtccgtggaaggatccctgatctctgaagacgcgatggataacatcgacgaaatcctggagaagacagaatctagtgtttgcaaggaattagaaattgccctcgttgatcagggggacgctgacaaagagatcatttcaaacacttactctcaagttctgcagaagatacacagcgaggagcgtctcatcgcaactgtgcaggcgaaatataaggattccatcgaatttaagaagcagcttattgaatatttgaataagagcccttcagttgaccaccttctctccattaaaaagactctcaagagtcttaaggctctgttacggtggaagctggttgaaaagagtaacctcgaggagtctgacgaccctgacggatcccagatcgaaaagattaaggaggaaattacacagctgaggaataacgtgttccaggagatttaccatgagcgcgaggaatacgaaatgctgacctcactggcacagaagtggttccctgagctccctcttctgcatcccgagatcggactactcaagtacatgaactcagggggattgcttaccatgtctctggaacgcgacctgctcgacgctgagccaatgaaggagctgtcatcgaagcgacccctggtgaggtcggaagtaaatgggcagatcattctgctgaaggggtacagcgtcgacgttgataccgaagcaaaggttatagagagagctgccacttatcatagggcctggcgtgaggcagaaggtgactccggactcctccctctcattttcctgttcctttgcaaatcagatcctatggcctacctgatggtgccctattacccccgtgcaaatctgaacgccgtacaggcgaacatgccactgaattctgaggaaacgctgaaggtgatgaaaggagtggcgcaaggcctccacaccctacataaagcagatattatccatggttctctgcaccagaataatgtgtttgcgctgaaccgtgagcagggcatcgtgggcgattttgatttcaccaagtccgtgagccaaagagccagcgtgaatatgatggttggcgatttaagtctgatgagtccggaactgaagatgggcaaacctgcatcacctggttctgatctgtatgcttacggatgtttgctgctgtggcttagcgtacaaaaccaagaatttgagatcaacaaggacggtattccaaaagtggatcagttccacctggacgataaggttaagagcctattgtgctcccttatctgttaccgctcctcaatgacagccgagcaagttctgaatgcagaatgctttctgatgccaaaggagcaaagcgttcccaatccagagaaggatacggagtacaccctttataaaaaggaagaagagataaagaccgaaaacctagacaaatgcatggagaaaacaagaaatggtgaggccaatttcgactgctag

SEQ ID NO: 240125 - DNA, 3060 bp, Artificial Sequence
  Description of Artificial Sequence: Synthetic coding sequence
atgtgggtacaggggcacagttctagggctagcgctaccgaatccgtaagcttttccgggatcgtgcagatggatgaggacacccattatgataaggtagaggacgttgtgggatctcatatcgaggatgctgttactttttgggcccagagtattaaccggaataaggacattatgaaaatagggtgctctctatcggaagtgtgcccgcaggcttcctcggtcctcgggaacctcgatcctaacaaaatctacgggggactgttctccgaagatcagtgttggtatcggtgcaaagtgctcaagatcatttctgtcgaaaagtgtctggtgaggtatatcgactatggtaacaccgagatcttgaatcgctcagacattgttgagatcccattagagctgcaatttagttctgtcgctaagaaatataagttgtggggccttcacattccatcagatcaggaggtcactcagttcgatcagggaacaaccttcctcggatctctgatctttgagaaagagatcaaaatgcggattaaggccacctctgaggacggtacagtgatcgcccaagccgagtacggctctgtagacatcggagaagaggtcctgaagaaaggatttgctgagaaatgtcgcctggcttcaagaactgatatctgtgaggagaaaaagctggatcccggacagttagtcctgcgtaatctcaaatcccctataccactgtggggtcatcgcagtaatcagtccacattttcaagaccaaaggggcatctgtctgaaaagatgacactcgacctcaaagacgagaacgacgctgggaatttaatcactttcccaaaggagtcactggccgtcggtgattttaatctaggctctaacgtgtccctggaaaaaattaagcaggatcagaagcttatcgaagagaatgaaaagcttaagacagaaaaggacgctctgctggaatcctataaggccctcgagctaaaggtggagcagatcgcacaggaactgcagcaggagaaggccgcagccgtggatcttaccaaccatctcgaatataccctgaaaacctatatcgatactcggatgaagaatctagccgcaaagatggagatcctgaaggagatgcgccacgttgatatctctgtgaggtttggcaaggacttaagtgacgctatccaggtgttggatgaaggatgttttacgacacctgcatccctaaatggattggaaatcatctgggcggaatactcgttagctcaggaaaatatcaaaacctgtgagtatgtctccgaggggaatatactaatcgcccaacggaatgaaatgcagcagaaactctatatgtccgtggaggactttatcctcgaagtggatgagagcagcctgaataagagactgaagactctgcaagatttgtcagtaagtttggaagccgtgtacggacaggctaaagaaggcgcaaatagtgacgagatactgaaaaaattctatgactggaaatgtgataaaagagaggagtttactagcgttcggagtgagaccgatgcaagcttgcatcgtctcgtagcatggtttcaacggacactgaaggtcttcgacctgagtgtggaaggaagtctcattagtgaagacgccatggataatattgacgaaatactggagaagacagaaagcagcgtatgtaaggagctcgagattgccttggttgatcagggtgacgcggataaagagattatttccaacacctactctcaggtgttgcaaaagatacacagcgaggaacggctaatcgccacagttcaggcgaagtacaaggattcgattgaatttaagaaacagctcatcgagtatctcaataaatctccatccgtagaccatctgctgtctatcaaaaagaccctgaagagcctgaaagccctactgagatggaagctggtggaaaaatccaatcttgaagagtcagacgaccctgacggaagtcaaattgagaagatcaaggaggaaattacccagcttaggaacaatgtgtttcaagaaatctaccatgaacgggaagaatacgagatgctcacctccctagcgcagaaatggtttcctgaactccctctgttgcaccctgagatcggcctgttaaaatatatgaactccggcggactcctgaccatgtcattggaacgggacttgctagacgctgagcctatgaaagaactgtcttcaaaaaggcccctggtgcggtctgaagttaatgggcagatcattctcctgaaaggctacagtgtagacgtggacacagaagccaaagtcattgaaagagccgctacctaccatcgagcctggagagaggccgagggggattccgggctgctaccattgatttttctattcttatgcaagtctgatcccatggcatacctgatggtcccctactaccctagagccaacttgaacgcagtgcaggccaatatgcccctgaactcagaggaaaccctgaaggtaatgaaaggggttgctcaagggcttcacactttacacaaggctgacattattcacggtagtctacaccagaataacgtttttgccctaaatagagaacaaggcattgttggcgatttcgattttactaagagtgtttctcagcgcgcatccgtaaacatgatggtgggcgatctcagtctgatgagccctgagctcaagatgggcaagccggcaagcccaggctctgatctgtatgcatacggctgtttactcttgtggctgtccgtccagaatcaggagtttgaaatcaataaagatgggattccgaaggttgaccaattccacttggatgataaagtaaaaagcctgctctgttccctgatttgttatcgatcttctatgacggcagagcaggtgttgaacgccgagtgcttcctaatgcctaaggaacagagtgtgcctaacccagaaaaggacaccgagtatactctttacaagaaggaagaggagatcaaaaccgagaatcttgacaaatgtatggaaaaaactcggaacggagaggcgaatttcgactgttag

SEQ ID NO: 240126 - DNA, 2991 bp, Artificial Sequence
  Description of Artificial Sequence: Synthetic coding sequence
atggacgaagacacccattacgacaaagtggaagatgtcgtgggcagccatatagaagacgcagtgaccttttgggctcagtccataaacagaaacaaagacatcatgaaaataggatgcagcctgagcgaagtctgcccacaggcttcgtctgtgctcggcaatttggatccaaacaagatctatgggggtctcttttctgaagatcagtgttggtaccgctgtaaggttttgaagatcatatccgtggaaaaatgtctcgtgcggtacatcgactacgggaacaccgaaatcctgaaccggtcagatatcgtggagattcccttggagctgcagttcagctctgtggctaaaaagtacaagctctggggactccatattccttccgatcaagaagttacacagttcgaccagggaactaccttccttggctctctcatattcgaaaaggagatcaagatgaggataaaagcgactagcgaagacggaactgttattgctcaggccgagtatgggagtgtcgacataggcgaggaggtgctgaagaaggggtttgccgaaaagtgtcgcttggcatctcggacagatatctgcgaggagaagaagctggatcccggacagctggtgctgaggaatctcaaatctccaatccccctgtgggggcatagatcaaatcagtctaccttttccaggcctaaaggtcacttgtcagagaagatgaccttggacctaaaggatgagaatgacgcgggaaatctgattacgtttccaaaggaaagtctggcggtaggggattttaacctggggtccaacgtgagcctcgaaaagattaagcaggatcagaaactcattgaagagaatgagaagctcaagacagaaaaggacgcgctgctcgaatcctataaggcactcgaactgaaggtggagcagatcgcccaggaactccagcaagagaaggccgctgctgtcgaccttacaaaccacctggaatacacactgaaaacctatatcgatacaaggatgaagaatttagctgcaaaaatggaaatcttgaaagagatgaggcacgtggacattagtgtccgctttggaaaggatctctccgacgccattcaggtgctggacgaggggtgctttaccacacccgcatcactgaacggactggagattatttgggccgaatactccctggcgcaggagaacattaaaacttgtgagtatgtgtctgagggcaacattttgatagcccagcggaacgagatgcaacaaaagttgtatatgtctgtggaagattttattctggaggtggacgaaagtagtctgaacaagagactgaaaaccctgcaggatctctctgtaagtctggaggccgtgtacgggcaagcaaaagagggggcaaattccgacgagatcctgaagaaattctacgattggaaatgtgataaaagagaggagttcacatcagttaggagcgagacagatgcgtctctgcatagactggtcgcttggtttcagcgcaccctcaaggtcttcgacctgagcgtagagggctcgctgatttctgaggatgctatggacaatatagatgaaatactagagaagacggagtcctctgtgtgcaaggagttggagattgccctcgtcgatcaaggggacgccgataaggaaataatatcaaacacttacagccaggtgctgcagaaaatccactccgaggaacgacttatcgctaccgtccaggcaaaatacaaggattccatcgagttcaagaagcaactcattgagtatctgaacaagtccccatcagtcgaccatctgctgtctattaagaagaccctgaaatccctgaaggccctgctgcgctggaagctggtggagaaatccaacctggaggaatcagatgatcccgacggctctcagatcgagaagattaaggaggaaatcactcagctgaggaacaacgtgttccaggagatttaccatgaaagggaggagtatgagatgctcacgtctctggcccagaagtggtttcctgagctacctttattgcaccctgagatcggcctgctgaagtacatgaatagcgggggtcttctgacaatgtcactggaacgagatctactggacgccgagcccatgaaggagctctcctccaagcggcctctggtccggtctgaggtcaacggacaaatcatccttctcaagggatatagcgtggacgtcgatactgaggctaaagtcatcgaacgagctgccacttaccaccgagcttggcgcgaagcagaaggggacagcggcctgttgcccttgatcttcctctttctgtgcaaatccgacccaatggcataccttatggtcccttattaccctcgagcaaacctgaatgcagtgcaagccaacatgccactaaattcggaagagacactcaaagtcatgaaaggagtggcacaagggctacacactctgcacaaagcagatatcatacatggttccctgcaccagaacaatgtgtttgcactcaatcgcgagcagggaattgtcggcgacttcgacttcactaaaagcgtcagtcagcgggcatctgtcaacatgatggttggagatctgagcctgatgagcccagagcttaagatgggaaaacctgcttctcccggttccgacctctatgcctacggttgcctccttctgtggctgtctgtacagaatcaagaattcgaaatcaacaaggacggaatacctaaagtcgaccagtttcatttggatgacaaagtgaaatctcttctgtgttcattaatctgttatcgatcttcaatgacagcagagcaggtgctgaatgccgagtgctttttgatgcccaaagagcagagtgtccccaatccggaaaaggacaccgagtatacactgtataagaaggaagaggagatcaaaaccgagaatctcgataagtgcatggaaaaaactagaaacggagaggccaacttcgactgttag

SEQ ID NO: 240127 - DNA, 285 bp, Artificial Sequence
  Description of Artificial Sequence: Synthetic coding sequence
atggacgaagacacacattatgataaagtggaagatgtagtcggctcacatatcgaggatgccgtgacattttgggcccaaagcatcaacaggaacaaggatattatgaagattggctgtagcctgagtgaggtatgcccacaagccagtagcgtgctgggaaatctcgatcctaacaaaatttacggagggctcttcagtgaggaccagtgttggtaccgctgcaaggtgctcaagatcatcagtgtagagaagtgtcttgtgcgttacatcgactacggttag

SEQ ID NO: 240128 - DNA, 132 bp, Artificial Sequence
  Description of Artificial Sequence: Synthetic coding sequence
atggacgaagacacccactatgataaagttgaggatgtagtgggttcacacattgaagacgcggtgacgttttgggcccagtctattaaccggaacaaggacatcatgaagatcggatgcagcctgtcctag

SEQ ID NO: 240129 - DNA, 2991 bp, Artificial Sequence
  Description of Artificial Sequence: Synthetic coding sequence
atgtgggttcaaggacactcctcccgggcttctgccaccgagagcgttagcttctcaggcatcgttcagatggatgaggacactcactatgataaagtcgaggacgttgtcgggagccacattgaggatgccgtgacgttttgggcccaatccataaaccggaacaaggatatcatgaagatcggatgctccctgagtgaagtttgcccccaggcatcctccgtgctcggaaacctggatccaaacaagatttatgggggactgttttcagaggatcagtgttggtatcgctgtaaagttctgaaaattatctctgttgagaagtgtttggtgcgatacatcgattatggcaatacagagatactcaaccggagcgatattgtcgagataccgttggaattacaattctcatcagtggccaaaaaatacaaactgtggggcttacacatcccttctgaccaggaagtgacgcagtttgaccaggggacaacatttctgggctcgctgatatttgagaaggagattaaaatgcggataaaggccaccagcgaggatggcacggtaattgcacaggccgaatacggctctgtcgacattggcgaggaagtgttgaagaagggtttcgccgagaaatgccgcctcgccagccggaccgatatctgcgaggagaagaaactggaccccggtcagctggtgctccgtaacctgaagagcccaatacctctgtggggccacaggagtaaccagtcaaccttctcccggcctaaagggcatctgtccgagaaaatgacattagacctaaaggatgagaacgacgccggaaatttaataacttttcctaaggagtctttggcagttggggactttaacttgggcagtaatgtgtctctcgagaagatcaaacaggaccagaagcttatcgaagagaatgaaaaactgaagactgagaaagacgcgctgctcgaaagctacaaagctttggaactcaaagtggagcaaatcgcacaggaactgcagcaagaaaaggccgctgcagtcgaccttacaaaccacctagagtacacgttgaagacatacatagataccaggatgaaaaatctcgccgctaagatggagatcctaaaagagatgaggcacgtcgatatttccgttcgcttcggcaaagacctgtccgatgctattcaggtgctagatgaggggtgttttacaacccccgcaagcctgaatgggttggagatcatttgggctgagtacagccttgcccaggaaaatatcaagacttgcgagtacgtttccgagggaaatatcctcatcgcacagcggaatgagatgcaacagaaactgtacatgagtgttgaagacttcatccttgaagtggacgagtcttctctgaataagcggctgaagaccctgcaggatcttagtgtgagtttggaggcagtttatggccaggctaaggaaggcgcaaattcggacgagatcctgaaaaaattctatgactggaaatgcgataaacgggaggagttcacctctgtgaggtcagagacagacgcgagtctgcaccgccttgtagcctggttccagcggacactcaaagtgtttgacctgtctgtagaaggctctctcatcagcgaggacgccatggacaacatcgacgagatactcgaaaaaacagaaagcagcgtgtgtaaagaacttgaaattgccttagttgatcagggagacgccgacaaggagattatatccaatacatattctcaggtcctccagaaaatccacagtgaggagcggcttattgccaccgtgcaggctaagtataaggactcaatcgaattcaaaaaacagctgattgagtacctgaacaagagcccttcagtggaccacctgcttagtattaagaagaccctgaagagcttgaaagcccttctcaggtggaagctggtggaaaagtcaaacctggaggagtccgacgaccccgacggatcccagattgagaagatcaaagaagaaatcacccaattgcggaataacgtattccaagagatatatcacgagagggaagagtatgagatgctgacctccctagcacagaagtggtttccggagctccccctgctgcatcccgagatcggcctgctgaagtatatgaactcaggcggactgctgacgatgtcgctcgagcgagacttactggatgccgagccgatgaaagagctgagttccaagcgaccactagtccgaagcgaagtcaatggccagataatactgctgaaaggctactcagtggacgtggacaccgaggctaaggtgattgaacgggctgctacctaccaccgcgcatggcgcgaggcagaaggtgactccggcctgctgcctctgatattcctgtttctgtgcaagtcggatcccatggcatatctcatggtcccctactacccaagagccaatctcaatgccgtgcaggctaacatgcccctgaactctgaagagacactcaaagtaatgaagggcgttgctcagggcctccatacattgcacaaggcagacatcatccatggctctctacatcaaaataatgtgtttgccttgaatagggaacagggcatagtgggtgattttgattttaccaagagcgtgagccagagagccagcgtgaacatgatggtgggagacttatctttaatgtccccggagctgaagatggggaagccagcgagcccaggctccgatctgtatgcctacggttgcctcttgctttgggatgataaagtgaaatctctgctgtgcagcttgatctgctacagaagctctatgaccgcagaacaagttttgaacgccgaatgttttctgatgcccaaagaacagagcgtcccaaatccggagaaagacacagagtacaccctgtacaaaaaggaggaagagattaagacagaaaatctggataaatgcatggagaagaccagaaacggagaggcaaattttgattgttag

SEQ ID NO: 240130 - DNA, 1545 bp, Artificial Sequence
  Description of Artificial Sequence: Synthetic coding sequence
atggccgattcagggctggataagaagtcaacaaagtgccccgattgtagtagtgcgtcccagaaggacgtactgtgtgtgtgtagtagcaagacccgagtgcccccagtcctagtcgtcgaaatgagccaaacaagctctatcgggagcgccgagagcctcatttccctggagcgcaagaaagaaaaaaacataaacagagatatcacttcccgtaaggatttgccctctaggacgagcaacgttgaacgcaaggcttcacagcagcagtggggcagaggcaatttcacagagggaaaggtgccacacatccggatcgagaacggcgctgccattgaggaaatctacacctttggccgaattctggggaaggggagctttggcattgtcatagaggctaccgacaaagaaacggaaactaagtgggcaattaagaaggttaataaggagaaggccggttccagcgccgtgaaacttcttgagcgggaggtgaacattctcaaatctgttaaacatgaacacataattcacttggagcaggtgtttgagacacccaaaaagatgtatttggtcatggagttgtgcgaggacggggagctcaaagaaattctcgaccggaagggccacttcagcgagaatgagacccggtggattatccagagcctggcctccgctattgcctacctccataacaacgatatcgtgcaccgggatcttaagctggagaatattatggtgaaaagctccctcattgatgacaacaacgaaattaacctcaatatcaaggtaaccgatttcgggctcgcagttaagaaacaatctcggagcgaggcaatgctccaagccacatgcggaacgcctatctatatggctcccgaggttatctccgcccatgactactcacaacagtgcgatatatggtctataggcgtagttatgtatatgctcctccgcggagaacccccattcttggcctcgagcgaggagaagctgtttgagcttatacgtaagggcgagcttcatttcgagaacgctgtttggaattcaatctcagattgcgccaaatccgtgctaaaacaattaatgaaggtcgaccctgcccacaggataactgccaaggagcttctggacaaccagtggctgaccggtaataagttatcctccgttagaccgacaaacgtgttggagatgatgaaagagtggaagaacaatccagagtccgtggaagagaatacgacggaggaaaaaaataagccttcaaccgaggaaaagcttaagagctatcagccatgggggaatgtacccgatgccaattacacctcggacgaggaagaagagaagcagagcacagcctatgaaaaacagtttccggcaacttctaaggataactttgatatgtgctcttctagcttcacgtcaagcaagctcctgccagcggagattaagggggaaatggaaaagacccctgtcacaccttctcagggtacggccaccaagtaccccgcaaaatcaggcgctctttcgcgcactaagaagaagctatag

SEQ ID NO: 240131 - DNA, 1545 bp, Artificial Sequence
  Description of Artificial Sequence: Synthetic coding sequence
atggccgacagcggccttgacaaaaagtcgacaaaatgcccagactgcagcagtgcgtcacagaaggacgtgctttgcgtctgcagttccaagacacgtgttccccctgtgctagtcgttgagatgagccagactagctccatcgggtccgcagagagtctcatctctctggagagaaaaaaggaaaaaaatatcaacagggacattacctctcggaaagatcttcccagcaggaccagtaatgtggaaagaaaggcttcacaacaacagtggggtaggggcaatttcacagagggcaaggtgccccatattcggatagaaaatggggctgccattgaagaaatctacacattcggtcgcatactgggaaaaggaagtttcggcatagtaatcgaggcgacagacaaggaaacagaaacgaagtgggccataaagaaagttaataaggagaaggccggatccagtgccgttaaattgctggaaagagaggttaacatcttgaagtccgtcaagcatgagcacattattcatctggaacaagtcttcgagacgccaaaaaaaatgtatttggttatggaattgtgcgaagatggtgaattgaaagagatcctggaccgcaaagggcactttagcgagaatgaaacacgatggataatccagagcctggctagtgccatagcctaccttcataacaacgatattgtgcatcgggacctcaagttagagaatatcatggtgaaaagctccttaatcgacgataacaacgagattaacctgaatatcaaggttaccgattttggcctcgctgttaagaagcaatctaggtctgaagccatgctccaggccacgtgcggaacgcctatttacatggcccctgaggtcattagtgcacacgattattcccagcaatgtgatatttggtccattggagtggtcatgtacatgttactgcgcggtgagcccccatttcttgccagctcggaagagaaactgttcgaactgatccgcaaaggagaacttcacttcgagaatgcagtgtggaatagcatctcagattgcgcaaaatccgtgctgaagcagttgatgaaggtcgatcccgctcatcgaataacggccaaggaactgcttgacaatcaatggttaactggcaacaagctcagttctgtacgaccaaccaatgtgttggagatgatgaaagagtggaaaaacaaccccgaatctgtggaggagaacaccacagaggagaaaaacaagccgtccaccgaagagaaactcaagtcttatcagccttggggaaatgtccctgatgccaattatacatcagatgaggaagaggaaaagcaaagtaccgcgtacgaaaaacagttccccgctacaagtaaagacaacttcgatatgtgcagttcatccttcacctcttctaagctgctgccggcagagatcaaaggcgagatggagaaaactcctgttacaccttctcagggaacagccacgaagtacccagcgaagtccggcgctctgtctcgaacaaagaaaaagttatag

SEQ ID NO: 240132 - DNA, 1347 bp, Artificial Sequence
  Description of Artificial Sequence: Synthetic coding sequence
atggctgatagtggtctagataagaaatccactaaatgccccgattgctccagtgcttcccaaaaggacgtgttgtgtgtctgttccagtaaaacaagagtgcccccagtactcgtggtagaaatgagccaaacctcctctattggtagtgccgagagtcttatatccttggaaaggaagaaagagaagaatatcaatagagatataacttctcgtaaggacctcccatctcgcacctcgaatgtcgagagaaaagcaagccagcaacagtggggtagaggtaatttcactgagggaaaggtcccacatattcggatagagaatggggcagccattgaggagatctacacatttggtaggatactcgggaaaggctctttcgggatcgttattgaggcaaccgacaaagagacggagactaagtgggctatcaaaaaggtgaataaggagaaggctggctcgagcgcagttaagttgctcgaaagagaggtcaatatcctcaagtctgtaaaacacgagcacattatacatctcgaacaggtttttgagactcctaaaaagatgtacctggtgatggaactgtgtgaggatggagagctgaaggaaattttagacagaaagggacactttagcgagaatgagactcgatggatcatccaatcccttgcctctgccatagcataccttcacaacaatgacatcgtacaccgagaccttaaactggagaatatcatggttaagagttcccttatcgatgataataacgaaatcaacttgaatattaaggtgacagattttgggctggccgtcaagaaacagtcccgctctgaagcaatgctccaggcgacatgcggcactcccatttacatggcacctgaggtcatctccgcacatgactactcacagcaatgtgacatctggtccattggggttgtcatgtacatgctgctcaggggcgaacctcccttcctcgcctcctctgaggaaaaactcttcgagcttataagaaagggtgagctccacttcgagaacgctgtttggaactctatctccgactgtgctaagagcgtgttgaagcagctgatgaaggttgacccggctcataggataactgcgaaggaacttttagataaccagtggcttacaagtacggcctacgagaaacagtttccagccactagtaaggataacttcgatatgtgttcttctagttttacctcaagtaagctgctgccggcagaaattaaaggagaaatggagaagacaccggtcaccccaagccaaggcacagctactaaataccccgcaaagtcgggagcactgagtcggaccaagaagaaattgtag

SEQ ID NO: 240133 - DNA, 192 bp, Artificial Sequence
  Description of Artificial Sequence: Synthetic coding sequence
atggccgactctggactggataagaagtcaaccaagtgtcccgattgcagttcagcttctcagaaggacgtactctgtgtatgctctagtaagactcgtgtccctcccgttctggtagtggaaatgtcacagacatcctcgataggttccgccgagagcctcatctctctagagagaaagaaagagaagtag

SEQ ID NO: 240134 - DNA, 1545 bp, Artificial Sequence
  Description of Artificial Sequence: Synthetic coding sequence
atggccgactctggtctcgacaagaaaagcactaaatgtcccgactgtagttctgcaagtcagaaagatgtgctctgcgtttgctcgtccaaaactagggtgccaccagtgctagtagtggaaatgagtcagacctctagtattgggagtgcagaatcgctaatcagtcttgaacggaagaaggagaagaacattaatcgtgacataacctcaagaaaagacctgccctcacgaacttccaatgtcgagcggaaggcttcacagcagcaatggggcaggggcaattttacagaggggaaagtgccccacataaggattgagaacggtgctgcgatagaagagatctacacatttggaagaatcttggggaagggaagctttggaatcgtcatcgaggcaaccgataaggagacagagactaaatgggcaatcaagaaggtcaacaaggaaaaggcaggaagcagcgctgtgaagctgctggagcgggaagtgaacatcctgaagtcagtaaagcacgaacatatcatccatctggagcaagtgtttgaaacaccaaagaaaatgtatttagtgatggaactttgtgaggatggggagcttaaggagatactggaccgcaaaggacatttctcagagaacgaaacccgttggatcattcagtccttagcctctgctatcgcatatctccacaataacgatatcgtccatcgagacttaaagttagaaaacatcatggtgaagagttcactgatcgacgacaataacgaaatcaaccttaacatcaaggtcactgatttcggcttagcggtgaaaaagcagtctagaagcgaagcaatgttgcaggccacctgtggaactcctatttacatggcgccagaagttattagcgcccacgattactcacagcagtgcgacatctggagcatcggcgtcgtgatgtatatgctgctgcggggagagccacctttcctggcaagctctgaagagaagctctttgaactgatccgcaaaggcgaactgcactttgaaaatgccgtgtggaactcaattagtgactgcgcaaagtccgtgctgaagcaactcatgaaagtggaccccgcacatcggattacagctaaagagctattagataatcagtggcttactggaaacaagctgtcaagtgttcggccaaccaacgtcttagagatgatgaaggaatggaagaacaaccccgaatccgttgaggagaacaccactgaggagaagaataagccctccactgaggaaaaactcaaaagttatcagccctggggaaacgtgcccgatgcaaattatacatccgatgaagaagaagagaaacagtccaccgcatacgaaaaacaattcccagccacctccaaagataatttcgacatgtgcagttcatcctttacctcgagcaagctgctaccggcagagataaaaggcgagatggaaaaaacccctgtgacccctagtcaagggactgctacaaaatatccagcgaagtctggagccctaagtaggactaagaagaagttgtag

SEQ ID NO: 240135 - DNA, 114 bp, Artificial Sequence
  Description of Artificial Sequence: Synthetic coding sequence
atggccgattccggcttagataagaagtcaactaagtgcccagactgtagcagcgcttctcagaaggacgtgttgtgtgtctgctctagcaaaacaagggttccaccagtgtag

SEQ ID NO: 240136 - DNA, 516 bp, Artificial Sequence
  Description of Artificial Sequence: Synthetic coding sequence
atggcagatagcggcttggataagaagtctaccaagtgtcctgattgtagttctgcatcacagaaggacgtcctgtgcgtttgcagcagcaagaccagggtccccccagtacttgtcgttgaaatgtcacagacatcttcaataggatccgctgagagcctcatctcactggagcgcaaaaaagagaagaacatcaacagagacatcaccagcagaaaagacctgcctagtcgaaccagcaatgttgagcgtaaggcctcacaacagcagtggggtcgtggcaattttactgaaggaaaagtgccccacatacggatagagaacggcgcagccatagaggaaatttatacattcggtcgcatactggggaagggttcgttcggaatagtaatagaggctacagacaaggagacagaaactaagtgggccatcaaaaaagtaaataaagagaaagccggttcgtccgctgttaaactgctggaacgggaagttaacatcctgaaaagtgtaaagtag

SEQ ID NO: 240137 - DNA, 90 bp, Artificial Sequence
  Description of Artificial Sequence: Synthetic coding sequence
atggccgattcaggattggataagaaaagcactaagtgtccagactgctcgagtgctagtcagaaagatgtgttatgtgtttgcagctag

SEQ ID NO: 240138 - DNA, 1206 bp, Artificial Sequence
  Description of Artificial Sequence: Synthetic coding sequence
atggagaccggcaaggacggtgcgagacgcggaacccagtcccctgaacggaagcggcgttcccccgtgcctcgggcacccagtacaaaacttagaccagcagccgctgctagggctatggatcccgtggctgccgaggcaccgggagaagcatttctggccagacggagaccggagggtgggggaggctctgcaagacctaggtacagcctgttggctgaaataggacgcggatcctacggggtggtttacgaggccgtggccggaagaagtggggcaagggtggccgtgaaaaagatccgctgtgacgcaccagaaaatgttgagttagctctggcggaattttgggcccttactagtttgaagagacggcatcagaatgtcgtgcagtttgaggagtgcgtgctgcaacgaaatggactggcccagcgcatgtcccacggcaacaaatcttctcagttatatctgaggctcgtggaaacatcattgaaaggcgagagaattctcggatacgctgaagagccttgctacctctggttcgtgatggaattctgcgagggaggagatttgaatcagtacgtcttgtctcgaaggccagatccagcaacaaacaaaagctttatgctgcaactcacctcagccatcgcattcctgcataagaaccatatcgtccaccgagatttaaaaccggacaatatcctgattacagagcgcagcggcaccccaatcctgaaggtagcagacttcgggctctctaaggtgtgcgccggactggcccctagaggtaaagagggcaaccaggacaataaaaacgtaaacgttaacaaatattggctgtcatcagcttgtggcagcgatttttacatggccccagaggtatgggaagggcactatactgccaaagctgacatcttcgcactggggatcattatctgggccatgatagagcgaatcacattcatcgactccgaaactaaaaaggagttgctcggaacttacataaaacaaggtacagagatcgtgcctgtgggcgaagctctgttagaaaatccaaagatggagcttcacattccacagaaacgcagaactagcatgtcagaaggcatcaaacaattactcaaggacatgctggcagcaaacccccaggacaggccggatgctttcgaattggagactcgaatggaccaggtgacgtgcgccgcttag

SEQ ID NO: 240139 - DNA, 1605 bp, Artificial Sequence
  Description of Artificial Sequence: Synthetic coding sequence
atggggcaccaggagtcaccactggcaagagccccagctggcggagctgcgtatgtcaagcgcctctgtaagggcctgtcttggcgcgagcatgtggagtctcacggatccttaggtgcgcaggcctctcctgcatccgccgcagccgctgaaggaagcgccaccagacgtgctcgcgcagccactagtagggcagccaggtctcgcagacagcctgggcctggggctgaccaccctcaggccggagcacccggtggcaaacgggctgcacggaagtggaggtgcgccggtcaggtgacaattcagggacccgcacctccgcgacccagggcaggccgacgggatgaagctggtggtgctcgggctgccccattgttgctccctccaccacctgctgcgatggagactggcaaagacggagccaggcggggaacccagtcccctgagaggaaaaggaggtccccagttcctagagcaccaagcaccaaattacgcccagccgctgccgcacgcgctatggatccagtggccgcagaggctccaggtgaagccttcctagcaagacggagacctgagggcggtggcggaagtgcacgaccacggtatagtttactggctgaaattgggagagggtcttatggcgtggtgtatgaagccgtggctggccgaagtggcgctcgcgtggcagttaaaaagatccgctgcgatgcccctgaaaacgtcgagttagctttggccgagttttgggccttaaccagccttaagcggaggcaccagaatgttgtacagttcgaggagtgcgtgctccaaagaaatgggcttgctcagagaatgtcccacggcaataagtcgtcacagttgtacctgagactcgtcgaaaccagcctgaagggggagcggatactcgggtatgctgaagaaccgtgctatctttggttcgtgatggagttttgtgaaggaggcgatctcaatcagtatgtgctgtcacgcagacccgatccagccactaataaatcattcatgctccagctgactagtgccatcgccttccttcacaagaatcacattgtacatagagatctgaaaccagataatatactgattaccgagagatctgggacccctatcttaaaggtggcagattttggtctgtcaaaggtgtgtgcaggactcgcacccagaggaaaagagggaaaccaggacaacaaaaacgttaacgttaataaatactggttgagctctgcctgtggtagtgacttctatatggccccagaggtttgggaggggcattataccgccaaggctgacatttttgcactcggcatcataatctgggccatgatcgagaggatcacttttatcgactctgagaccaaaaaagagctgttaggcacctacattaaacaggggacagaaattgtcccggtgggggaggcactgttagagaacccaaaaatggagctacacattcctcagaaaaggagaacctccatgagcgaagggatcaagcagctgttaaaggacatgctcgcagcaaacccacaggaccgtccagatgcctttgaactggaaactcggatggaccaggttacatgtgcagcttag

SEQ ID NO: 240140 - DNA, 489 bp, Artificial Sequence
  Description of Artificial Sequence: Synthetic coding sequence
atggaccctgtggcagcagaggctcctggagaagcctttcttgctagacggaggcctgaagggggaggaggctccgcgaggccacgttattctcttttggccgaaatcgggcgagggagctatggagtcgtgtacgaggcggtggctggcagatctggtgcgagagtagcagtgaaaaaaatccgctgtgacgccccagagaacgtagaactggccctcgctgagttttgggcacttactagcctcaagaggcggcatcagaatgtggtacagttcgaggaatgcgtcttgcagcggaatggtttggcccagcgaatgtcacatggcaacaagagctcacaattgtacctaagactcgttgaaacatccttgaaaggacgcttcctgggaacccacagcctgaccacatcccctcccgaggacggccgtggttacagatggtggccgggtcgcttggctatctctcggcagttagacccggcaatgtag

SEQ ID NO: 240141 - DNA, 3948 bp, Artificial Sequence
  Description of Artificial Sequence: Synthetic coding sequence
atggagaaataccatgtgctcgaaatgatcggagaagggagcttcggcagggtctataaaggaaggaggaagtatagcgcccaggtcgtcgctctcaaatttatccctaagttgggtcgctccgagaaagagctaaggaacttgcaacgtgaaatagaaataatgcggggactgaggcatccaaacatcgtccacatgctcgatagttttgaaacagacaaggaagtcgtcgtggtgactgactatgccgagggggaactatttcaaattctggaggacgatggcaagttgcctgaagaccaggtgcaggccatagcagcccagctggtgtctgccctctactacctccacagccatcgcatattgcatcgggatatgaaacctcagaacattctgcttgccaagggcggaggtataaaactctgtgatttcggatttgcccgtgccatgtccaccaacacgatggtcctcacaagtatcaagggaacacctctatatatgtccccggagctagtggaggagaggccatatgaccacaccgccgacctttggagcgtcgggtgtatactttatgaactggccgtgggaacccctcctttctacgccacgtcgattttccaattagtgtccttgatcctgaaggatccagtaaggtggccgtcaactatctccccatgtttcaagaactttcttcagggcctgctgacaaaagatccccgtcagcgactgtcttggccagatctgctgtaccacccattcatagccggtcacgtcactatcattactgagcccgctggccctgacctgggcacaccctttacttccagactgccaccagagcttcaggtcctaaaggacgagcaggctcatagactggcccctaagggtaatcagagtcggattctcacacaggcctacaaacgaatggcagaagaggcaatgcaaaaaaagcaccagaacaccgggcctgctcttgagcaagaggataaaacaagcaaggtggcccctggaactgcccctctgcccagactcggtgctacccctcaggagtcttccttactcgccggaatactggcctccgagctaaagagttcctgggccaaaagcgggactggggaggtcccaagcgcaccacgagagaatagaacgaccccagattgtgagcgcgcttttccagaagagagacctgaggtgttagggcaaagaagcacagacgttgtggatctagagaacgaggagcctgatagcgacaacgaatggcagcaccttctggagaccacagaacctgtgcctattcaattaaaggcaccactgaccctgctgtgtaatccagacttctgccagcggatccagtctcagcttcatgaggctggagggcagatcctgaaagggatattggagggcgcatctcacatactgcccgcttttcgggtgctctcaagcctgctctccagttgctcggatagcgtcgctctctatagcttctgccgtgaagccggtctgccaggcctcctcctatcccttctgaggcactctcaggagtcaaacagtctccagcagcagagttggtacggtacttttctgcaggatctgatggccgtgatccaggcatattttgcttgcaccttcaacttggagcgctctcagacctccgattccttacaggtttttcaggaagcagccaacctgttcctggacctgctaggaaagctgttggcccagcctgacgattccgaacagacccttcgcagggactccctgatgtgtttcaccgttttgtgcgaggctatggatggaaactctcgtgctatatccaaagcattctacagctctctgttgaccacacagcaggttgtgctagacgggttactgcacggcttgaccgtgccccagctccccgtccacacgccacaaggagctccacaggtgagtcagcctctaagggagcagtcagaggatattcctggggcaattagttcggccctggcggcaatctgcacggcgcctgtagggttgccagattgttgggacgccaaggaacaggtctgctggcacttggcaaaccaacttaccgaagattccagccaactcagaccctctctgatctccggactgcagcacccaattttgtgtctccacctgctcaaagtcttgtattcatgctgcttggtgagcgagggactttgccgcttgcttgggcaggaaccacttgccctggagtcactcttcatgctgatccagggcaaggtaaaggtggtggattgggaagagtcaaccgaggtgacgctgtatttcctctcactactggtgttccgactccaaaatttaccgtgtggaatggagaagctcggttccgacgttgcaaccctgtttactcacagccatgttgtcagtctcgtgtctgccgctgcatgcctgctcggccagctggggcagcagggcgttacgtttgacctgcagccaatggaatggatggctgccgcaacacacgcactgagcgctcccgctgaggttcgcctgacccctccaggctcctgtggtttctatgacggcttacttatcttgttattgcagttgctcactgaacagggaaaggcttcactcatcagggatatgtcaagctcagaaatgtggaccgtcctatggcaccgtttctccatggtcttgcgccttcctgaagaggcttcagcacaagaaggtgagctgtccctcagtagccctccttctcccgagccagactggacattgatctcaccacaggggatggccgcactcctgtctttagcaatggctaccttcactcaggaaccgcagctttgcctgtcatgcctgagccaacacggctccatactgatgtcaatacttaaacatttgctttgtccatcatttctcaatcaactccgtcaggctccccacgggtccgagttcttgccggtggtcgttctcagtgtctgccaacttctgtgttttcctttcgcgctcgatatggatgccgacttgctgattggggtcctggcagacctacgggatagcgaagttgcagcccacctgcttcaagtgtgttgttatcacctgcctctcatgcaggttgagcttcccatttcgctcttgacacgtttggcactgatggatcctacctccctgaatcaattcgtgaataccgttagtgcctccccaagaacaatcgtgtctttcctgtcagtcgcccttctgtcagaccaacccctgctgacatccgaccttctgtccctgttggctcacaccgccagggtcctgagtccctcccatctcagcttcatccaagaattgctggcaggtagcgacgaatcctataggcctctgaggtccctgctgggacaccccgagaacagcgtacgggctcacacttatcgcttgctcgggcatctgctgcagcactcaatggctttacgaggcgctttacagagccagagcgggcttctcagccttctgctgctagggctcggcgataaagatccagtagttagatgttccgcctcatttgccgtgggaaacgccgcttatcaggctgggcctctcggacccgcattagctgcagccgttccctcgatgactcagctgctgggtgatcctcaggctggcatcaggaggaacgtggcttccgcgctgggaaatctcggccctgaaggcctgggagaggaactcctccagtgtgaagtaccacagagattgttagaaatggcctgcggtgacccgcagcccaatgtaaaggaggctgctctgatcgctcttcgatctctccagcaagaaccgggaatccatcaggtactggtatcactcggtgcttctgagaaactcagtcttctgtcattgggcaatcagtcactgccccactctagccctcgccctgcctcagctaaacactgcaggaaactgatccacctactgaggccagcacatagcatgtag

SEQ ID NO: 240142 - DNA, 3885 bp, Artificial Sequence
  Description of Artificial Sequence: Synthetic coding sequence
atggaaaaataccacgtactcgagatgattggagagggatcgtttggtcgggtgtacaagggcagacgcaaatactctgcccaggtggttgcactcaaatttatacctaaattgggaaggagcgagaaagaattaaggaacctgcagagggagatcgagattatgcgaggcctgcggcaccccaacatcgttcatatgctggactccttcgagacagataaggaggtggtcgtcgttacagactatgccgaaggtgaattgttccagattctggaggacgatgggaagttgcctgaagaccaggtgcaggccattgccgcacaactcgtttccgccctctactatttgcacagtcaccggatccttcacagagatatgaagccccaaaacatcttattagccaaggggggagggatcaagttatgcgactttggctttgcgcgtgcaatgagcacgaacaccatggtcttaacaagcatcaaaggtaccccattgtatatgtctcccgagctggttgaggaaaggccctacgatcatactgccgacctgtggagtgtgggctgcattctgtatgagctagcagtgggaactccaccattctatgccacttctatttttcagctggtgtccctgatactgaaggacccagtgcgttggccatctacaatttctccatgtttcaagaacttcttacaagggctcttgactaaagacccccgtcaacggctgtcatggcccgatcttttgtaccatccatttattgctggacatgttacaatcatcacagagcccgcaggacccgacctggggactccgttcacttccagactccctcctgaactccaggttttgaaggatgaacaggctcaccgactggctccaaagggcaatcagagtcgcatactcactcaggcatataagcggatggcagaggaggccatgcaaaaaaagcatcaaaatactggcccagcacttgagcaggaggataagacctctaaggtggctcctggcactgccccactgccccgacttggagcaacccctcaggagagttcgcttttagcaggaattttggcctcagaactcaagtctagctgggctaagagcggcacaggggaagtcccttctgcccctagagaaaatagaaccacccctgactgcgaacgcgcatttccagaagaacggccagaggtcctgggccaacgctctaccgatgtagtggatctggaaaatgaggagcccgacagcgataatgagtggcagcacttgctggaaactactgaacccgtgccaattcaactgaaggcacccctgacactgttatgcaaccccgacttttgtcagagaattcagtctcaactccacgaggctggcggacagattttaaaagggatcttggagggggcaagccacattctacccgcatttcgcgttctctcgtcgctcctgtcttcctgctcagacagcgttgcactttattccttctgtagagaagcaggattgccaggtctgttgttgtctttactcagacactctcaggaatcaaacagtctgcagcagcagtcctggtacgggacatttctgcaggacttaatggctgtgatccaggcttacttcgcctgcacttttaacctcgagaggagtcagaccagcgacagtttgcaggtctttcaggaagcggcaaacctatttcttgacctgctgggaaaattgctagcccagccagacgactccgaacagacgctgcgtcgagactctctcatgtgctttaccgtgttatgtgaggcaatggatggtaactcgcgcgcaatttctaaagctttttattccagcctgctcaccacccaacaggtagttctcgacggcttgctccacggcttaacagttccccaattgcccgtccacacaccgcagggcgctccccaggtaagccagccattaagagagcagtctgaagatatcccaggggcaatatccagcgccctcgctgccatctgcaccgctcctgtcggacttcccgattgctgggatgcaaaagagcaggtctgttggcatctggccaatcagctaaccgaggacagttcccagttgcggccttcactgatttcaggcctccaacaccccatcctttgcctccatctcctgaaggttctctactcttgctgcctggtctccgagggcctttgtcgcctgttgggtcaggaaccactggcgcttgaaagcctgtttatgctgatccagggaaaagtgaaggttgtggattgggaggaaagtaccgaggtgacactctactttttgtctctgttagtatttagactgcaaaatctgccttgcggtatggaaaagctgggctctgacgtggcaactttgttcactcactcgcatgtggtgtctctggtctctgctgctgcttgtctgctcggtcagctcggccagcagggcgtgacgtttgacctccagcctatggagtggatggcggcagcaacacacgccctctccgcccctgccgaactgctaactgagcaggggaaagcctctcttataagggacatgtccagcagcgaaatgtggacggtcctttggcatagattctcgatggtgttgcgcttgcctgaagaagccagcgcacaggaaggcgaattatcgttgagttctcctccgtcaccggagcctgattggaccctgatcagcccccagggtatggccgcacttctgtcactggctatggcgacctttacacaggaacctcaactttgtctctcctgcctctcacagcatgggtccattttgatgagcattctcaagcatctgttatgcccgagcttccttaatcaactgcggcaggcccctcacgggtctgagttcctgcctgtggtggtcctaagtgtatgtcagctgttgtgtttccccttcgcccttgatatggacgccgatctgctcattggcgtcctagccgatctgagggattctgaagtggccgcacatttgcttcaagtctgctgttaccatctgcctttgatgcaggtggaactgcctatttcccttctgacaagactggccctaatggaccccacttctctaaatcagttcgtaaacactgtctccgctagccctcgcaccattgtctcctttcttagcgtggccctgttgagcgatcagccgctattaaccagcgacctattgtccctgctggctcataccgctagggtgctctcaccaagccatctgagctttatccaagagctactcgctggatctgatgagtcataccgcccattacgtagcctgctggggcaccccgagaatagcgtgagagcccacacatacaggctgctcggccatctattacagcattctatggccctgaggggcgctctgcagtctcagagtggtctattgtccctgctccttcttggccttggagacaaggatccagtggtgagatgcagtgcgagttttgccgtgggaaacgccgcatatcaggccggacccctcggacccgctttggcggctgctgtcccctctatgacccagcttcttggggaccctcaagctggcatccgtaggaatgtcgccagcgctctaggcaatctggggcctgagggcctaggagaggagctgctacaatgcgaagttccccagagactgttagagatggcttgcggtgatccccaacctaacgtgaaggaggcagccctcatagcacttagaagcctacagcaggagcctgggattcaccaggtgctcgttagcctgggcgcatcggaaaaactaagcttattgtctctaggaaaccagtctctgccccacagttcacctagacccgcttctgcaaagcactgtcgtaaactgatccacctgcttcggcctgctcattccatgtag

SEQ ID NO: 240143 - DNA, 3885 bp, Artificial Sequence
  Description of Artificial Sequence: Synthetic coding sequence
atggagaaatatcatgtacttgaaatgatcggagagggttcattcggtagagtatacaaggggcgaaggaagtactctgcgcaggtcgtagccctgaagtttatcccgaaattggggcgatcagagaaagaactgcgtaacctccagcgtgagattgagattatgagaggtttgaggcacccaaacattgtgcatatgctcgattccttcgagactgacaaagaggtggtggtggttacagactacgcagagggcgagctcttccagatactggaagatgacggaaagctgccagaggatcaggtgcaggccattgcagcacaactggtctccgcattgtactatctgcattcccaccgcattctccatcgagacatgaagcctcaaaatattctgttagcgaaagggggtgggatcaaactatgtgattttggctttgcgagagcgatgtctaccaacaccatggtcttaacgtctatcaaggggacacccctgtacatgagtccagagctggttgaagaacgcccatacgatcacacagccgatttgtggagcgtgggctgcatactatacgagctcgctgtcggaaccccgccattctatgcaacgtcgatttttcaactggtgtctctgatcctcaaggatccagtgcgctggccttcaacgatctccccatgtttcaagaactttcttcagggtcttcttaccaaggatccacgccagcggctgtcctggcccgacctgctctatcatccttttatcgcgggacacgtgacgatcattacagagccggcaggtccagacctgggcactcctttcactagtcgcttgccaccggagttacaagttctgaaggacgaacaggcacatcggctagccccaaagggcaaccagagccggattttaacacaggcctataagaggatggccgaagaagcaatgcagaaaaagcatcagaatactggaccagccctggagcaagaggacaaaaccagtaaagtggcgcctgggacagcaccactgcctcgcctcggcgcaacccctcaagaaagtagcttactggccggaatcttggccagcgaattaaagtcttcgtgggccaagtcaggcacaggggaggtgcctagtgctccacgtgaaaatcggactacccccgactgtgagcgagccttcccagaagaacggccagaggtgctcggacagcggtcaacggatgtggtggacctcgagaacgaggaaccagacagcgataacgagtggcagcacctcctggaaactacagaaccggtaccaattcaactaaaggcgcctctaaccctactgtgtaacccagatttctgccagcgtatccagtcacagctccatgaggcaggcggtcagattcttaagggaattctggagggtgcaagccatatcttaccagcttttcgtgttttgtcatccctcttatcgagctgctctgacagtgtggcgctatactccttttgccgcgaggcgggactgcctggactattgctgagtctgcttagacactcacaggagagtaacagccttcagcagcagtcctggtacggaacatttctacaagacctgatggcagtgatccaagcctacttcgcttgcacctttaacctggaacgttcacaaacttccgactcacttcaggtgttccaggaggccgcaaatttgttcctggacttacttggcaaattactcgctcaaccagacgactccgaacagactttaagacgggatagcctcatgtgtttcactgtgctttgcgaggcaatggacggtaattcccgagcgatttccaaggccttctactcatcactattaaccactcagcaggtggtccttgatgggctcttgcatggattaaccgtacctcagctgcctgtgcacacaccacagggcgcaccacaggtgtcccagccactgcgggagcaaagcgaagacatacccggtgcgatttctagtgccctggctgctatttgcactgcacccgtgggcctaccggattgctgggacgccaaggaacaggtgtgctggcacttagccaaccagttgactgaagattcatcccaactgcgcccatcactgattagcggactccaacaccccatcctatgtttgcatctgcttaaggttctttactcttgttgcctcgtgtctgaggggttgtgcagactccttggacaggaacctctggcccttgagtcattgttcatgctgatacagggcaaggtgaaagtggtggactgggaagaatcgaccgaggtgacactgtacttcctctccttgctcgtttttaggctgcagaacctgccttgcggtatggagaaactcgggagcgacgtggcaactttattcactcattcgcatgtggtatcattggtcagcgctgcggcttgcttgctggggcagctcggccagcagggggtaacattcgatctgcaacctatggagtggatggccgcagcgacccacgccctgagtgcaccggctgaaatgtcgtgcgagcagggtaaagccagtctgattagggatatgagctcaagcgagatgtggaccgtgctctggcaccgcttttcgatggtactgaggctgccggaggaggccagtgctcaagagggcgagctgtctctctctagtccaccaagccccgaacctgattggacacttatttctccacagggcatggccgctttactgtcattggccatggcaacatttacccaggagcctcagctctgtctttcttgtcttagtcagcatggctccattttgatgagtatcctaaaacacctgctttgccccagtttcttaaaccagcttaggcaagctccgcatgggtcagagtttctgccagtggtggtgttaagcgtttgccagctcctatgttttccgttcgcccttgatatggatgctgacttattaatcggcgtgctagccgacttgagagacagcgaggttgccgcacatctgctccaggtgtgctgttatcatctgcccttgatgcaggtggagctgcccatctcacttctcacacggctagccttgatggaccccactagcctgaaccaattcgttaacactgtttccgcatccccgagaactatcgtttcatttttatcggtcgccttactctctgatcagcccttactaactagtgatttactgagcctgctggctcacacagcccgagtgctgagtcccagccacctcagctttattcaggagctgctagctggaagcgatgagagctacaggcccctacgctcgctacttgggcacccagagaacagcgtgagggcccacacttatcgactcctgggtcatcttcttcaacacagtatggctttacgcggagctttgcagagccagtcaggcctgctgagcctgctcctgcttgggttaggtgacaaagatcccgtggtaaggtgtagcgcgtcatttgccgtgggcaatgcagcttatcaggccggtcccttaggccctgctctagccgcagctgtgccttctatgactcagttactcggggaccctcaggctggaataaggagaaacgtggcttccgccctgggtaatctcggacccgaaggattaggcgaagagttgctacaatgcgaagtgccacagcggcttctggagatggcctgtggggatcctcagcctaacgtcaaagaggccgcactgattgccctccgctcccttcagcaggagcccggaatccatcaggtcttagtctcgctcggagctagcgagaagctgtccctgctctcactagggaaccagtccttaccccactcaagtccacgtcccgcttctgctaaacactgcaggaagctcatccacctcctgagacctgcgcattccatgtag

SEQ ID NO: 240144 - DNA, 840 bp, Artificial Sequence
  Description of Artificial Sequence: Synthetic coding sequence
atggaaaagtatcacgtactggaaatgattggggagggctcctttggcagagtgtacaaaggccgacggaagtacagcgcacaggtggtggcactgaagtttatccctaaactcgggagaagtgagaaagagctgcgtaatctgcaacgtgaaatcgaaatcatgaggggcctgcgacacccaaatattgtccatatgctagattccttcgaaaccgataaggaggtcgtagtggtcaccgactatgccgaaggggaattattccagattctcgaagacgatggcaagctcccggaggatcaggtgcaggccattgcggctcagctagtgagtgccctgtattacttacactctcatcgaattctgcatagagacatgaagccccagaatatccttctcgcaaagggcggtggcattaaactgtgtgattttggttttgcacgggcaatgtctaccaataccatggtgctaactagcattaaagggactccgctgtacatgtcccccgaacttgtagaggaacgcccatacgatcatacagcagatctctggagtgttggctgcatcctctatgagttggcagtgggtacgcccccattttacgccaccagtatattccagctggtgagccttatcctgaaagaccccgttagatggccatctaccatcagcccatgcttcaagaattttcttcaaggattgctcacaaaagatcctcggcaacgtctctcatggccagatctcctttatcatccattcatcgcaggccacgtcaccatcatcactgagccggctggccctgatttgggtactcctttcaccagccgcctccccccttag

SEQ ID NO: 240145 - DNA, 3948 bp, Artificial Sequence
  Description of Artificial Sequence: Synthetic coding sequence
atggaaaagtatcatgtactcgagatgattggcgagggcagttttggaagagtgtacaaggggagacgaaaatacagcgctcaagtcgttgctctgaagttcatccctaaattgggaaggtccgagaaggagctgagaaacctccagcgggagatagaaatcatgaggggcctgagacaccccaacattgttcacatgttggatagtttcgagacagataaggaagttgtggtggtgacagattatgcggaaggcgaactgttccagatcctcgaagacgatgggaaactccccgaagaccaggtgcaagccatcgctgcccagctggtgtccgccctttactatctgcattcccatagaatcctacacagagacatgaagccacaaaacatcctacttgccaaaggcggaggaataaagttgtgcgatttcgggtttgcacgcgcaatgtcaaccaatactatggtcctcacctccattaaaggcacaccgctatacatgtctcctgaacttgttgaagagagaccctatgaccatactgccgatctgtggagtgtagggtgcatattatacgaactcgccgtagggaccccgccattctatgccacttcaatttttcaactggtgtccctgatacttaaagaccccgttagatggccctcaaccatttcaccttgctttaaaaatttcctgcagggcctgctgactaaggaccctaggcaacggctatcatggccagacctgttgtaccaccctttcatcgctggccacgttacaattatcacagaacctgctgggccagatctgggaaccccgttcacttcgagattaccccctgagcttcaggtattaaaggatgagcaggcccacaggcttgctcccaagggaaaccagagtcgtatcctgacacaggcttataagaggatggcagaggaagcaatgcagaagaaacaccagaataccggcccagcattggagcaggaggacaaaactagcaaagtcgccccaggaacagctcccctgcctcggttgggggctacaccgcaggagagttccttacttgccggaattctggcaagtgaattgaagagcagttgggcaaagagcgggaccggtgaagttccctccgcaccgagggaaaaccgaacaacaccagattgcgaacgagccttccctgaggagagaccggaggttttgggccaaagatcgactgatgtagtcgatctcgaaaatgaagaacctgactctgacaacgagtggcagcacctattagagaccacagagccagtaccgatccagcttaaagcgcctctgacgcttctgtgcaatcctgacttttgccagcgaattcagagccagttgcacgaggctggcggacagatactcaagggaatactggagggtgcgagccacattctgcctgcattccgggtcctgtcttctcttctttccagttgcagcgactctgtcgccctgtattccttttgccgagaagccggtctacctggcttgctcctgtccctcctacgccatagtcaagagtcaaattctctccagcagcagagctggtacggaacatttctgcaggatttaatggctgttatccaggcatacttcgcatgtactttcaacctggaacgttctcaaacctcagatagcttgcaggtgtttcaagaggcagccaatctgtttctggacctgttgggcaagctgttggcccaacccgatgactctgagcagacactgcgccgtgactcgctgatgtgctttaccgtgttgtgcgaagccatggatggtaatagcagagctatcagtaaggccttttacagctcattgcttacgactcagcaggttgttctggatggactgctccatggcctcaccgtgcctcagttgccggtacacaccccccagggggcacctcaggtgtcgcagccactccgagagcaatctgaggacatccccggagcaatctcaagcgcactcgcggctatctgtaccgccccagtaggcctaccagactgctgggatgctaaggagcaggtatgctggcatttagctaatcagctcaccgaagacagcagtcaactgcggccaagcctgatctctggactccaacatcctattctttgtctccatttgttgaaggtactgtatagctgctgtctggttagtgagggactgtgtaggctgctcgggcaggaacctctagctctcgagagcctttttatgctgatccagggcaaggtcaaggtcgtcgattgggaggagtctacagaagtaaccctctactttctgtcactcctcgtgttcagacttcagaacttgccctgcggtatggagaaacttggttccgacgtggccacactcttcactcattctcacgtggtttcgctggttagcgcggcagcctgcctgctagggcagctcggccagcaaggagttactttcgatctccaacctatggagtggatggcagcggcaacgcacgctctgtcagccccagctgaggtgcggctgactccacccggttcctgcggtttctacgacgggctgttaatcctcctcctccagcttcttacggagcagggaaaagcatctttaatacgagacatgtcttcttctgagatgtggactgtgctgtggcatcgtttctccatggtgctaagacttcctgaggaagcaagcgctcaagagggggagctcagcttgagtagcccaccttcccctgaacccgattggactttgatctcaccacaggggatggctgcccttttaagtttggccatggccacatttacgcaagaaccgcagctgtgtctatcttgcctgagccagcatggctcaatattgatgtctatattgaaacatctgttgtgtcctagtttcctgaaccagctgcggcaggctcctcatggctccgagttcctgccggtggtggttctgagcgtgtgtcagctcctgtgtttcccgttcgctctagacatggacgccgacctgctcataggtgtgctggctgacttacgggacagcgaagtggctgcgcatctgctgcaagtgtgctgttatcaccttccgttaatgcaagtggagttgccgattagcctgttgacccggttggccctcatggaccctacctccctcaatcagtttgtcaacactgtcagtgcatcaccacggacgattgtgtctttcctgtccgttgccctgctttccgatcagcctcttctgacctccgatctcctaagcctcctagcgcataccgcgagagtcctgtccccatctcatctaagctttatacaggagctgctcgcagggtcggatgagagttacaggccacttagatcccttctgggccatccggagaattcagtccgagctcacacctataggttactgggccacctcttgcagcactccatggcgctccgtggggcacttcagagtcagtctggcctgttgtcccttctgttgttaggtctgggtgataaggatcctgtggttcgatgcagcgcatcttttgctgtgggcaacgccgcttaccaggccggacctcttggccctgctcttgctgccgcagtgccctctatgacccagctgctcggcgatccccaggccggaatacgtcgtaatgtcgcaagcgcattaggtaacctcgggccagagggacttggagaagagctgcttcagtgcgaggtccctcagcggctgctcgaaatggcttgcggggatcctcaacccaatgtgaaagaagccgctctcattgctttgagatcgttacagcaggagcctggcatacatcaggtcctggtgagcttaggcgctagcgagaagctcagtctgctctccctgggcaatcagtctctgccacactcttccccacgcccagcttcggccaaacactgcaggaagctcatccatttattgcgcccagcccattccatgtag

SEQ ID NO: 240146 - DNA, 1056 bp, Artificial Sequence
  Description of Artificial Sequence: Synthetic coding sequence
atgaggtttaccttccctttgatggcaatagtgctggaaatcgctatgatcgttctgtttggcctgtttgtagagtatgagacagatcagactgtgcttgagcagctgaacattaccaagccaacggatatggggatctttttcgaactgtaccctcttttccaagacgtacacgtgatgatcttcgtgggcttcggttttctcatgacgttcctcaagaaatatggcttttcttcggtgggtatcaatctgctcgttgctgccctcggcctgcagtgggggacgatcgtccagggtattctccagagtcaagggcagaagtttaatatcggcattaagaacatgataaatgctgattttagtgccgcaactgtgctgataagctttggagccgtgcttggcaaaacttctccaacccagatgctcattatgaccatcctggagatagtgttctttgcgcacaacgaatatctcgtgagcgagatttttaaagcttctgatataggcgctagcatgacaatacacgccttcggtgcctacttcgggcttgccgttgccggaatcttgtatcgttcaggactccggaagggccacgagaatgaggagagcgcgtactattccgatcttttcgccatgattgggaccttattcctatggatgttctggcctagttttaatagcgctattgccgaacccggagacaagcagtgtcgggctatagtcaacacttatttctcactcgcagcgtgtgtcctaaccgctttcgccttcagttcattggtcgagcacagaggtaagttgaacatggttcacattcaaaatgccacactggcagggggagttgcagttggcacctgtgccgatatggctatccatccgtttggcagtatgattatcggctccattgctggaatggtgagcgttctgggatacaaatttctcaccgtgtatggccacgcgggatcctgcaccggatttttgtatcggaatagcagttgttggaggtcagacgacaggtttaattccaaagtcgcctccctggggacagccatctag

SEQ ID NO: 240147 - DNA, 1389 bp, Artificial Sequence
  Description of Artificial Sequence: Synthetic coding sequence
atggagactgtccagctgcgcaatccaccaagacgccaactgaaaaagctggatgaagatagccttacaaaacagcctgaggaggtgttcgatgtgcttgagaagctcggcgaaggtagttacgggtctgtgtataaggctattcataaggaaactggacagatcgttgccatcaagcaggtccctgtagagagcgatctccaagagatcataaaagagatctccatcatgcaacagtgtgacagcccccacgtggtaaagtattatgggtcctattttaagaataccgatctctggattgtgatggagtattgtggtgcaggaagtgtatctgacattattaggctgagaaacaagactctgactgaggacgagattgccactatcctgcagagcacactgaagggccttgagtatctgcacttcatgcggaagatccatagggatataaaagcaggtaacattctcctcaacaccgaaggccatgccaaattagctgacttcggcgtcgcgggacaactgactgatacaatggctaaacggaataccgttatcggtacccccttctggatggcacccgaggtgattcaggaaattggctacaattgcgtcgctgacatctggtctctaggcattaccgcaattgagatggctgagggaaagcccccatatgccgacattcatcctatgagggccatatttatgatcccaaccaatccccctcccaccttccgcaaacctgagctgtggtccgataacttcactgatttcgtcaagcagtgccttgtaaaatctcctgagcagagggccacagctactcagcttcttcagcaccctttcgttcgcagcgccaagggcgtgtcaattcttcgtgacctgattaatgaagcaatggacgtgaaacttaaacgtcaagagtcccagcaacgggaagtggaccaagatgatgaggagaactcagaggaagacgagatggactctgggaccatggttcgagccgtgggagacgagatgggaaccgtgcgggtcgcttccacgatgacagatggggctaacacaatgattgaacacgacgatacactgccgtctcaactaggaacaatggtcataaatgcagaggacgaagaagaagaaggaacaatgaagagacgagacgagaccatgcaacccgctaaaccttcgttcttggaatattttgagcagaaagaaaaggagaaccaaatcaattcgtttggcaaatccgtaccaggccctctgaaaaacagttccgactggaagatcccccaggatggggactatgaattcaaaacctcccaggagcagcagagcggcaaagatatttgtatccagaactgtcagggcaaccttctttgcagatatgcattttag

SEQ ID NO: 240148 - DNA, 1464 bp, Artificial Sequence
  Description of Artificial Sequence: Synthetic coding sequence
atggaaacggtgcagttgcgaaatcctcctagacgccagctgaagaaactggatgaggatagcctaaccaagcaacccgaggaagtattcgatgttctggagaaactgggcgaaggtagttatgggtccgtctacaaagccatccataaagagacggggcagatagttgcaattaaacaggtgcccgtggagtccgatctgcaagagataatcaaggagatttccattatgcagcagtgtgatagtccgcatgtcgtcaagtactatgggtcatattttaaaaatactgatctgtggatcgtgatggagtactgcggggctgggagcgtctcagatattatcagattgaggaataaaacgctaactgaagacgagattgcaactattcttcaatcaactctgaagggattagagtaccttcactttatgcgaaagattcaccgtgatataaaggctggcaatattctgctcaatacagaagggcatgctaaactggcagactttggcgtggccggtcagttgaccgataccatggccaagcgaaacacagtcatcggcactcctttctggatggctccagaagttatccaggagattggctataattgcgtggctgatatatggtctttaggcatcaccgctattgaaatggcggagggaaaacccccttacgcagatatacatcccatgagagccatctttatgattccgacaaatcccccaccaaccttcaggaaaccggagctctggtctgacaatttcaccgattttgtgaagcaatgcctcgttaagagccctgaacagagagccaccgctactcagcttctccagcacccttttgttcggagtgcaaagggcgtaagcattctgcgggatctgatcaatgaagctatggacgtaaagctgaagcgtcaggagagccagcaacgggaagtggatcaagatgatgaagaaaactcagaggaggacgagatggacagtgggactatggtccgagccgtgggtgacgagatggggactgtcagagtcgcctccacaatgactgacggagccaatacaatgatagagcatgacgataccctgcctagccaactgggaacgatggttatcaatgcagaggatgaggaggaggagggtaccatgaagcgacgtgacgagacaatgcagcccgcaaagcccagtttcctcgaatactttgagcagaaggagaaggagaaccaaattaactcctttggcaaatccgttcccggtcctctcaagaactcgagtgattggaaaatccctcaggacggcgactatgaatttctgaaatcctggacagtcgaagacctgcagaagcgattgctggccctcgaccccatgatggagcaggagattgaagaaatcaggcagaagtaccagagcaaacggcaaccaattctcgatgctattgaggctaagaaacgaagacagcagaacttctag

SEQ ID NO: 240149 - DNA, 1389 bp, Artificial Sequence
  Description of Artificial Sequence: Synthetic coding sequence
atggagactgtccagctacggaaccctccgcgaaggcagctgaagaagctggatgaggactccctcactaaacaaccagaggaggtatttgacgttttagagaaactgggcgagggctcatacggctccgtatacaaggccattcataaagaaactggccagatcgtagccatcaagcaggtacccgtggagtctgatcttcaggaaattatcaaggagatcagtatcatgcaacagtgtgacagtccccacgttgtcaaatactacggaagttactttaagaacacagatctgtggattgtaatggagtactgcggagctggctccgtgtccgatataatcaggttgcgaaataaaactctgactgaggatgagattgccaccatactgcagagcactctgaaaggcctggagtacttgcacttcatgaggaaaatccatcgcgatatcaaggcaggcaacattttactcaataccgagggacacgccaagttggccgacttcggagtagcagggcagctgacagatacaatggctaaaagaaacacggtgattggcaccccattctggatggcgcctgaggtaatccaagagatcgggtataattgtgtagcagatatctggtccctgggaatcacagccattgaaatggctgagggcaagcctccatacgctgacatccatcctatgagagccatatttatgattccaaccaatcctccgccaacttttaggaaacccgagctgtggtccgataacttcactgatttcgtgaagcagtgcctcgtcaagagtcccgaacagagggccacggcaacccagcttctgcaacacccattcgtgagatctgccaaaggagtgagcatcctgcgcgacctgatcaacgaagccatggacgttaagctgaaaaggcaagaatcacagcagagggaggtggatcaggatgatgaggagaatagcgaggaggacgagatggacagcggaactatggtgcgcgctgtgggggatgagatgggaaccgttcgggtggcaagcactatgacagacggcgctaacaccatgattgagcacgacgacactttgccctcccagttaggaacgatggtgattaatgcagaggatgaggaggaggaaggcacaatgaagcgtagagatgagacaatgcagcctgcaaagccttccttcctggaatacttcgaacagaaggagaaggagaatcaaatcaacagctttggcaaaagtgtccccggacctttgaaaaatagctcagactggaaaataccgcaagacggggactatgagttcaagacgtcccaggaacagcagagcgggaaagatatttgcatccaaaattgccaggggaatctgctttgtcgatacgcattttag

SEQ ID NO: 240150 - DNA, 1299 bp, Artificial Sequence
  Description of Artificial Sequence: Synthetic coding sequence
atggaaaccgtgcagttgcgcaatccaccaaggcggcagttaaaaaagctggacgaggattccctaaccaagcagcccgaagaagtgttcgatgtcttggaaaagttgggcgagggctcatacggttccgtatacaaggccatccataaggaaaccggccagatcgttgcgatcaagcaagtcccagtggaatctgacctgcaagaaattatcaaagaaatcagtatcatgcagcagtgtgattcccctcacgtggtgaagtactatggctcctacttcaagaacacagacctatggatcgtcatggagtattgcggtgccggaagcgtcagcgacattattcgcctccgaaataaaaccgatacaatggcgaaacgaaacactgttatcggcacccctttctggatggcacccgaggtgattcaggagatcggatataactgtgtggcagatatctggagcttaggaatcactgcaattgaaatggcagagggcaaacccccttacgctgacatccatcccatgcgggctatcttcatgatcccaactaatcctcctcctacattccggaagcccgagctgtggtcagacaactttaccgattttgtgaaacagtgtctagttaaatcacctgaacagagagccacagctactcagctgctgcagcacccattcgttcgcagcgcaaagggcgtatccattctgcgggacctaataaatgaggccatggatgtgaagctcaagcggcaggagagccagcagcgcgaggttgatcaagacgacgaagagaattctgaggaagatgaaatggattcaggcaccatggtgagagctgtgggagacgaaatgggtacagtcagggttgccagcacgatgacggacggagctaatacaatgatcgaacatgacgatacgctgccttcacagttaggaaccatggtcatcaacgcggaagacgaggaggaggaagggacgatgaaacgcagggacgaaacgatgcagcccgctaaaccttcattcctggagtattttgaacagaaggagaaagaaaaccagatcaactctttcggaaagagcgttccgggacccctgaaaaactccagcgactggaaaattccccaagatggcgattatgaatttctaaagtcctggaccgtcgaagatctccagaagcgtctactcgccttggaccccatgatggagcaggaaatcgaagagatccgccagaagtaccagagtaagagacagcctatcctcgacgcaatcgaggccaaaaagcggaggcagcagaacttttag

SEQ ID NO: 240151 - DNA, 1254 bp, Artificial Sequence
  Description of Artificial Sequence: Synthetic coding sequence
atgaagcgacgagccagtgatcggggagcgggagaaaccagcgccagagccaaggctctcggctctggaatctctggaaacaatgccaagagagcaggccctttcatccttgggccacggctgggcaattctcccgttccttccatcgtccagtgtcttgctaggaaagatggtacggatgatttctatcagctcaaaatcctcaccttggaagagagaggggatcagggtatcgaaagccaggaggagaggcaagggaagatgctgctccacaccgaatactcccttttatctctgttacacactcaagacggtgtggtccatcaccacggactgtttcaggacaggacatgtgagattgtagaggatactgagagcagccggatggtcaaaaaaatgaagaaaaggatttgcctggtgcttgactgtctgtgcgcccacgactttagcgataaaacggcggatttgataaatttgcagcactatgtaataaaggagaagcggctctccgaaagagaaaccgtcgtgatattctatgacgtagtgcgggtcgttgaggcgctgcaccaaaaaaacatagttcaccgcgatctcaagctgggtaacatggtccttaacaaacgtacacaccgtatcaccattactaacttctgtcttggcaagcacttggtcagcgagggagacctcctgaaagaccagcgcggatcccccgcttacataagcccggacgtgctctctggacgcccataccggggtaagccatcagatatgtgggctctcggggtggtgctctttacgatgttatacggccaattccccttctatgacagcattcctcaggagttgtttcggaagatcaaagccgctgagtatactatcccagaggacggtagggtaagcgagaacacagtgtgcctgattcggaaactgcttgtcttggacccccagcagcgcctggccgctgctgacgttctggaagccctgtccgcaattatagcatcttggcagtccctgtctagcctctctggacctctgcaggtggttccagatattgacgaccagatgtccaatgccgacagcagccaggaagtgtcttggggcggacaaatgggacactaccccgctccaagggacaggctcctgggggctggccgagctcgtgctgaggtagctgccacaagaaggccccagtccttcctgggcctactcccgcagccttggggaggcaaaggtagactgcagagctctgcctag

SEQ ID NO: 240152 - DNA, 1308 bp, Artificial Sequence
  Description of Artificial Sequence: Synthetic coding sequence
atgaaacgtcgagcttctgacagaggggctggggagacctccgcccgtgccaaagccctgggctcagggataagcggaaacaacgccaaacgcgctgggcctttcattctgggcccaagacttggcaattctcccgtgccaagcatcgtacagtgcctagctcgcaaggacggaactgatgatttttaccaattgaaaattctcaccctggaggaacggggagaccagggaatcgagagccaggaggaacgccagggtaaaatgctgcttcatacagaatacagtttgctttccctgttgcacacacaagacggagtagtgcaccaccatgggctgttccaggatagaacttgtgaaatagtcgaggacactgagtcgagccggatggtcaagaaaatgaaaaagagaatctgcctggtgctagattgcctgtgcgcacatgacttctccgataagactgccgatctgattaaccttcagcactatgttattaaagaaaaacggctttcagagcgggaaacggtggtgattttctacgacgtcgttagagttgtcgaagccttgcaccagaaaaatatagtccatagggatttaaagcttgggaatatggttttaaataaacggacgcatcgcatcacaataactaacttttgtctgggcaaacatttggtaagcgaaggggatctgctgaaggaccaaagaggtagtcccgcatacatttcccctgacgtgttgagtggccgaccctatcgtggaaaacctagtgacatgtgggccctgggtgtagttctctttaccatgctatacgggcaatttcctttctacgattccattccccaggaactcttcaggaagataaaggccgctgaatacacgattccggaggacggtagggtcagcgaaaacacggtatgtctgataaggaaactactcgtgctggatcctcaacaaagacttgccgctgctgatgttctggaagctctgagcgccatcatagcgagctggcagagcctgagctccctgagcgggcctctgcaggtcgtgcccgatatcgatgaccagatgtccaacgccgacagctcacaggaagctaaggttactgaagaatgctctcagtacgagtttgaaaattatatgagacaacagctgctgctggccgaggaaaagtcttccattcacgatgcacggagttgggtgcccaagcggcagttcggcagtgcccctcctgtaagaaggttggggcacgatgcgcaacccatgacaagtctggacaccgctatcctggctcaacgttacctccgcaagtag

SEQ ID NO: 240153 - DNA, 1323 bp, Artificial Sequence
  Description of Artificial Sequence: Synthetic coding sequence
atgaaacgcagggctagcgacaggggagctggggaaacttcggcacgcgcaaaggctttaggaagcggcatcagcgggaacaacgcgaaacgtgccggaccgtttatcctggcactttgtgccgtgggaccacggctgggtaacagccccgtcccatccattgtccagtgcttggccaggaaggatgggaccgacgatttctaccagctgaagatcctaacccttgaggagcgcggagatcagggaatcgagagtcaggaggagaggcagggaaaaatgctactacacacagaatactctctgttatctcttctgcacactcaggacggagtggtccaccaccacggactttttcaggatcgcacatgcgaaatcgttgaggatacagaatcttcacgcatggtgaagaaaatgaagaagcgtatatgcctggtcttggattgcctgtgtgctcacgacttttctgataagacagcagacctgataaacttacagcactatgtaatcaaggaaaagagactgagtgagagagagacagtcgtgatcttttatgacgtggttagagttgtagaggctctccatcagaaaaatatcgtgcaccgggatttaaagcttgggaacatggttttaaacaaaaggacacaccggattaccatcacaaatttctgtctggggaagcatcttgtgtccgaaggggacctacttaaggaccagaggggctctcctgcctacataagtcccgatgtgctgtccggaagaccctacaggggaaagccctcagatatgtgggctttgggagtcgtgctatttacgatgctgtacggacagtttccattctatgatagtataccccaggaactattccgcaagattaaagcagctgagtacacaattcccgaggacggacgcgtgagtgagaataccgtctgcctgattcggaagttgctggtgctggatcctcagcagagacttgccgcagcggacgtattggaggctctgtccgcgatcatcgcttcctggcaatccctcagctcactgtccggacctctgcaagttgtcccagacatcgacgaccaaatgtccaacgcggacagttctcaagaggccaaggtcactgaggaatgctcacagtacgaatttgagaattatatgcgacaacaactactcttggccgaggagaaatcaagcattcatgatgcacgcagctgggttcccaaacgtcaattcggcagcgccccacccgtacgtagacttggtcacgacgcgcaacccatgaccagcctggacacggcaattctggctcagcgctacctgcggaagtag

SEQ ID NO: 240154 - DNA, 1308 bp, Artificial Sequence
  Description of Artificial Sequence: Synthetic coding sequence
atgaaacgcagagcatctgacagaggggcaggcgaaacatccgccagagccaaagccctgggttcgggaatctcaggcaacaatgcaaagagagcgggtccgtttatcttgggacctaggctaggaaactcaccagtccccagcatagtccagtgccttgcaagaaaagacggcaccgacgacttttaccaacttaagattctcaccttagaagagcgaggcgatcagggcattgaatctcaggaagagcgacaagggaaaatgttgctgcacactgagtattcactgctctcccttcttcatactcaggatggggtggtgcatcatcatggtctctttcaggatagaacatgtgaaatcgtagaggacactgaatcttcgcggatggtgaagaagatgaaaaagcgcatatgcttggttcttgattgcctgtgtgctcatgacttttctgacaaaacagcagacctgattaatttgcaacactacgtgatcaaggagaaaagattgtccgaaagagaaacggtggtgattttctacgacgtcgttagagttgtggaggcactgcatcagaaaaacatcgtgcacagagacttgaagttggggaacatggttcttaacaaacggactcatcgcataaccattaccaacttttgtctgggcaagcacctggtttcagagggggacctcctgaaggatcagcgcggatctcctgcgtacatttcccccgacgtgctcagtggacggccttaccgcggtaagccatccgatatgtgggcactgggcgtggtgctgtttacgatgctgtatggtcagtttcccttttatgatagcattccacaggagctgtttcgaaagataaaggctgctgagtataccattcccgaagacggcagagtgtccgagaataccgtctgtctcataaggaaactcctggtcttggatccccagcagaggcttgcggcagcggacgtcttggaggccctgtcggccatcatcgccagttggcagagtctcagcagcctgtctggacctcttcaagtggtgcccgacattgatgaccagatgtccaacgctgattcatcccaggaagcgaaagtgactgaggagtgctcccagtatgagtttgaaaactacatgagacaacagctgctgctggcagaagagaaatcctcaatacatgacgctcggtcctgggttcccaagaggcagttcggcagtgctccacctgttcggaggctggggcatgacgcgcaacctatgacttccttagacactgccattctcgcccaacgctacctgcgcaaatag

SEQ ID NO: 240155 - DNA, 1092 bp, Artificial Sequence
  Description of Artificial Sequence: Synthetic coding sequence
atggctatgcgccagactccgcttacatgttctggccatactagaccggtcgtggatctggccttctcaggtattacaccctatggctatttcttaatctctgcatgcaagggtgctgggcagcatcttccccgactcagcgggcaacacgacggcaaacccatgctgcggcagggtgatactggcgactggataggaacctttctcggccataaaggcgctgtatggggcgctacactgaacaaggacgccaccaaagccgcaacagccgctgccgactttaccgcgaaagtgtgggacgctgtctcaggagatgagctgatgacattggcacacaaacatatagtgaagaccgtggacttcacacaggattcgaattatctccttacgggtgggcaagacaagctgctacggatatatgacctgaataagcccgaggccgagccaaaagagatttccggacataccagtggcattaagaaggccttatggtgttccgaggataaacaaatcctaagcgcggacgacaaaaccgtcaggctctgggaccatgcaacgatgaccgaggtgaaatccttaaattttaatatgtccgtttcaagcatggaatatatacctgagggcgaaatcctggtgattacatatggaagatctatcgcatttcactccgctgtgagtctggatcccattaaaagtttcgaggctcccgctacaataaacagcgctagtttacaccctgaaaaagaatttctagtggctgggggagaggattttaagctgtataaatacgactacaatagcggcgaagaattggagagctacaagggccatttcggccctattcactgcgtgcggtttagccccgacggagaattgtatgcttctggtagcgaagatggaaccctgcgcctgtggcagaccgttgtgggaaaaacttacggcttatggaaatgtgtgctgccagaagaggacagcggcgaactcgccaaacccaaaatcggattccccgaaacgaccgaggaggagctggaggagatagcctcggagaactccgactgtatcttcccgtcagctcctgatgtgaaggcctag

SEQ ID NO: 240156 - DNA, 1053 bp, Artificial Sequence
  Description of Artificial Sequence: Synthetic coding sequence
atggccatgcggcagacacctctgacttgctcaggacacacgaggcctgtcgtagacctggccttcagtgggattactccatacggctatttcctgatctctgcgtgcaaagatggaaaacctatgctgcgccaaggcgatacaggagattggatcggtacgtttttaggacacaagggcgctgtatggggggctacccttaataaggatgccacaaaggctgctaccgctgccgctgattttactgctaaggtgtgggatgcggtcagtggtgatgaattgatgaccctggcccacaagcacatcgtgaagaccgtggactttactcaggactccaattacctgttaacaggcggacaggataaattactgcgaatatacgacctcaataaaccagaggccgagcccaaagaaatttccgggcacacatctggcattaagaaggctctgtggtgttctgaagacaagcagatattatctgccgatgataaaaccgtgcgcttatgggatcatgcgactatgacagaggtgaaaagtctgaacttcaacatgagcgtgtcctcaatggaatacatccccgagggtgagattttggttattacatatggcaggtcaattgcctttcactcagctgtgagcctggatcccattaagagcttcgaggcccctgcaacaattaactcagcttccctccaccccgaaaaggagtttcttgttgccggaggagaggacttcaagctgtacaaatacgactacaactctggggaggagctggaatcctacaagggtcacttcggccctatccattgtgtgagattttcacctgacggggaactgtacgcctccggcagcgaggatggcacactccgactctggcaaactgttgttggtaagacttatggcctgtggaagtgtgttttgccagaagaggacagtggggaactggctaaacccaaaatcgggttcccagaaaccactgaggaggagttagaagaaatcgcatcagaaaacagcgattgcatattcccatccgctcccgacgttaaggcctag

SEQ ID NO: 240157 - DNA, 771 bp, Artificial Sequence
  Description of Artificial Sequence: Synthetic coding sequence
atgacactggcccataaacacattgtcaaaacagtagacttcactcaggattcaaactacctgttgacaggcggtcaagataaattgttacggatatacgatctgaacaagcccgaagccgaaccaaaagaaatatcaggccatacttctggcatcaagaaggctttgtggtgctcagaggataagcagatcctgtcagcagacgataagaccgtacgactatgggaccatgccaccatgactgaggttaaatctctgaacttcaatatgtctgttagctctatggaatatataccggagggtgagatacttgtcattacctacggaagaagcattgcttttcactcggccgtgtccctcgatcccattaagtcatttgaggccccagctaccatcaacagcgcgtccctgcacccggaaaaagagttcctggtcgcaggcggtgaagactttaagttatacaagtacgactacaactcaggtgaggaacttgaatcctacaagggacatttcggaccgattcattgcgtgaggttctctcctgatggagagctgtacgcctcgggatcggaagacgggaccctccgcctttggcagactgtggtggggaaaacatacggactgtggaaatgcgtgctcccagaggaggattctggcgagctggctaaaccaaaaatcggctttccagaaactactgaggaagagttggaggagattgccagcgagaatagtgattgcatttttccctctgccccagacgtgaaggcctag

SEQ ID NO: 240158 - DNA, 1707 bp, Artificial Sequence
  Description of Artificial Sequence: Synthetic coding sequence
atgaaaaataaaatccaggtagtggtgctcgaaaacgagggtttgcagcagcagctgaagagccagagacaggaagaaacacttagggagcaaactcttctggatgcctccggtaacatgcataacagctggattactaccggtgaagacagcggcgtaggtgaaacaagcaagcgtcctttcagccatgataacgcggactttgggaaggccgcttccgcaggtgagcagctggaattagagaaactaaagttaacgtatgaggagaaatgtgaaatcgaggagtcccagcttaagttcctaaggaacgatttggccgaataccagcggacatgcgaagatctgaaagagcaactcaagcacaaggagttcctcttagctgccaatacatgcaatcgcgtcggcggactgtgtctaaagtgcgcccaacacgaggctgtgctgtcacaaacccacactaatgtccacatgcaaactatcgagcggttggtgaaggaacgtgatgacctgatgagcgcccttgtatctgtccgctcttctctggctgatacacaacagcgtgaggcttccgcttacgaacaggtcaaacaggtgctgcaaattagcgaagaggccaattttgagaaaacaaaggcgctgatccagtgtgatcagttacgcaaagagctagagcgacaagcggaacggctggaaaaggagcttgcgagtcagcaggaaaagagagccattgagaaggatatgatgaaaaaggagataacgaaagagcgcgaatacatgggctcgaagatgctgattttaagtcagaatatcgcacaactcgaggcccaagtcgagaaagttaccaaagagaagattagtgcaatcaatcagctcgaggaaatacagagtcagctagcatcacgcgagatggatgtgacaaaagtgtgtggggagatgcgatatcagctcaataaaaccaacatggaaaaggacgaagctgaaaaggagcatcgggaattccgggctaagaccaaccgggacctcgagatcaaggaccaggaaattgagaagctccgcatagagttagatgagagcaaacagcacttagagcaagagcagcagaaagccgcactggccagagaggagtgtctccggctgacggagctgcttggagaatctgaacatcaactgcacctgacacgccaggaaaaagattctatccagcagagtttcagcaaggaggctaaagcacaggccttgcaggcgcaacagcgggagcaggagctgacacagaagattcaacagatggaagctcaacacgacaagactgagaacgagcagtacctcctgctgacatcccagaacacattcctcacgaagttaaaagaagaatgctgcactctcgccaagaagctggaacagatctcgcagaagactcggtccgagatagcacagctgagtcaggagaaaagatatacctatgataagttgggcaaactgcagcgcagaaacgaggaactggaggaacagtgcgtgcagcatggaagggtacacgagactatgaagcagagactcagacaactggacaagcactcccaggccaccgcccagcagctcgttcaacttttgagcaaacagaatcagctgctcctagagcgccagagtctcagcgaagaggtagaccgcctgagaactcaattgccctctatgccccagagtgattgttag

SEQ ID NO: 240159 - DNA, 2013 bp, Artificial Sequence
  Description of Artificial Sequence: Synthetic coding sequence
atggcaaagtcccctgagaactccacactggaggagatcctcgggcagtatcagaggtcacttcgcgagcacgcgagccgcagcatccatcaattgacctgtgctctgaaggagggggacgttacaatcggggaagacgcaccaaacctgtctttttcaacatcggtgggtaacgaagacgccaggacagcgtggccagaattgcagcagtcccacgctgttaaccagctaaaggatctgcttagacagcaggctgataaggagtcagaagtgagtcctagtcgcaggagaaaaatgagtcccctccgcagcctggagcacgaggaaaccaacatgcctactatgcatgacctggtgcacacaattaacgaccaatctcagtacatacatcacctagaggcagaggtgaagttctgtaaagaggaactgtcaggcatgaaaaacaagatccaggtggttgtcctggaaaacgagggacttcagcaacagctgaaatcacagaggcaggaggagacactcagagagcagaccctgttggacgccagcgaaaaactaaagctgacgtatgaggaaaagtgcgagattgaggaatcccagctgaagttcttgagaaacgatctagcagaataccaacggacgtgcgaagaccttaaggagcagctgaaacacaaagagttcttgcttgccgctaatacctgtaatcgcgtgggaggactatgtctgaaatgtgcacagcacgaagcagtgttgagtcagacacacacaaacgttcacatgcagacaattgagaggctcgtcaaagagcgggatgacctgatgtccgccctggtctcagtgcggtccagtctagccgatacccagcagagggaggcatccgcctacgagcaagtaaagcaagttcttcaaatttccgaagaggcgaactttgaaaaaactaaggctctcattcagtgtgaccaactaagaaaagaactcgagagacaagccgaacggctcgagaaggaactggcctctcagcaggaaaaacgggcaatagaaaaagatatgatgaagaaggagataacaaaggaaagagaatatatggggagcaagatgctgatactgtctcaaaacattgcacaactagaagcccaggttgagaaggtgacaaaggagaagatctcagctattaatcagctagaggaaatacaaagccagttggcctcacgtgaaatggatgtgaccaaggtctgcggcgaaatgagataccaactgaacaaaacgaatatggagaaagacgaagctgagaaggagcatagagaatttcgggctaagacgaatcgggacctggagattaaggatcaagagatcgaaaaactccggatcgagctggatgaaagtaagcaacatcttgagcaagaacagcaaaaagctgctctcgcacgcgaggaatgcctcagactgacagagctgctcggcgagagcgagcaccaacttcatctgacccggcaggagaaggactctattcagcaatccttctccaaagaggccaaggcgcaggctttgcaagcccaacagagggagcaagaactcactcaaaaaatccagcagatggaggcacagcatgacaaaactgagaatgaacagtacctgctgttgacttcccagaacaccttcctgactaaactgaaagaggagtgctgcaccctggccaagaagttggagcagatctcccaaaagacgaggtccgaaatcgcccagttatctcaggaaaaacgatatacatacgataaacttggaaagctccagcgacgaaacgaagagcttgaagagcaatgcgttcagcatggaagggttcacgaaaccatgaagcagcggcttcggcaactcgataaacattctcaggcgacggcccaacagctagtgcagcttctcagtaagcagaaccagctcctgctcgagcgccaatctctcagcgaggaagtcgatagactgagaacacagctcccatctatgccacagtctgactgctag

SEQ ID NO: 240160 - DNA, 2142 bp, Artificial Sequence
  Description of Artificial Sequence: Synthetic coding sequence
atggccaagtccccagaaaattctacgctggaagagatcttaggccagtatcaacggtctttaagggagcatgcatctcgctcaatccaccagctgacctgcgcactcaaggagggtgacgttactattggcgaagacgctccaaacctttcctttagcacatccgtgggaaacgaggatgccaggacagcctggcctgaactgcagcaaagtcacgccgttaaccagctcaaagacctcctcagacagcaagccgacaaggagtcagaggtgtctccctcgcggagacgaaagatgagcccgctaaggtctctggagcacgaggagactaacatgccgacaatgcacgatttagtgcacacaatcaatgatcagagccagtacatccaccacctggaagccgaggtgaagttctgtaaggaagaactatctggaatgaagaacaagattcaggtggtcgtgcttgagaacgaaggcctccagcagcagctgaaatcacagcgacaggaagagacactgagagagcagaccttgcttgacgcctctggaaatatgcacaattcgtggataacaacaggggaagattctggggtgggagagacaagcaaacgtccctttagtcacgataatgctgatttcggcaaagctgcctcagctggcgagcaattggagctggaaaaattgaagcttacttatgaagagaaatgcgaaatcgaagagtcccagcttaagtttctccgaaatgacctggcagaatatcagcggacatgcgaagacctaaaagaacagctgaagcacaaggagtttttactggctgcgaatacatgtaatagagttggcggtctctgcctcaaatgcgcccagcacgaagcggtgttatcacaaacacacacaaacgttcacatgcagactatcgagcggctcgtcaaagaaagggacgatttgatgtccgctcttgtatccgtcaggtcatccctggctgatacccagcagcgggaagcctcagcatacgaacaagtgaagcaggtccttcaaattagcgaggaggctaatttcgagaagacaaaagccctgattcagtgtgatcagttgagaaaagagttggaaagacaagctgaaagactggaaaaggagctagcaagccaacaagagaaaagagcgatcgagaaggatatgatgaaaaaggaaattaccaaagagcgggaatatatggggagtaagatgctgattctatcccagaatattgctcagctggaggcgcaggtggagaaagtaactaaggagaaaatcagcgccatcaaccagctcgaagagatacagagtcagctggcaagcagagaaatggacgtgaccaaggtctgtggagaaatgcggtaccagctcaacaaaaccaatatggagaaggacgaagccgagaaggagcaccgcgagttccgggcaaagacgaaccgggacttggagatcaaggaccaggaaatcgaaaagcttcgaatcgagttggatgaatcaaagcaacatctggagcaagaacaacaaaaggctgccctagcccgagaagagtgcttgcgactgaccgagctgctgggagaaagcgaacaccagttacacctgacaagacaggagaaagattcgatccagcagtcgttctccaaggaggcgaaggcccaggctctccaagctcaacagcgcgagcaggagctgacacagaagattcagcagatggaagctcaacacgacaaaacagaaaacgagcagtatctattgctgacttcccagaatacatttctgacaaagctcaaggaggaatgttgcactctagcgaagaagctagagcagatctcccagaaaaccaggtctgaaattgcacaactgagtcaggagaaaagatatacttacgataaactcggtaagcttcagaggcgtaacgaggagcttgaagaacaatgcgtgcaacatggacgggtgcatgaaactatgaagcaacgactccgtcaactggataagcactcacaggccactgcccaacagctagtgcagctgttgagtaaacagaatcagcttctgctcgaacggcaatctctgtccgaggaggtggaccggctcagaacacagctcccgagtatgccgcaaagcgattgttag

SEQ ID NO: 240161 - DNA, 1083 bp, Artificial Sequence
  Description of Artificial Sequence: Synthetic coding sequence
atggccaaatcacctgagaatagcactctggaggagatactcgggcagtaccaacggagtctgagggaacatgcatcccgatctatacaccagctgacttgtgccctcaaggagggcgacgtgactataggcgaggatgccccaaatctatcattcagcacctccgtgggaaatgaagatgccagaacagcgtggcctgagctccagcaaagccacgcagtaaaccaactgaaagacctcctccggcagcaggccgacaaagaatccgaggtgagtcccagcagacgacggaaaatgtcaccgctgaggtccctggagcacgaagagaccaatatgccaacgatgcacgacctagtccacaccattaatgaccagagccagtacattcaccatttggaagctgaggtgaagttctgcaaggaagaacttagtggaatgaagaacaagatacaggtagtggttcttgaaaatgaagggctgcaacagcagttgaagtcccagagacaagaagaaacactcagggagcaaacgctgctggatgcttcaggcaacatgcacaacagctggattactacaggtgaagactccggggtcggtgaaaccagcaaaaggccatttagccatgacaacgccgatttcggcaaggccgctagcgccggagagcagctggagttggagaagctgaagctaacctatgaggaaaaatgcgaaattgaagagtcccaactgaagttcttgcggaatgaccttgcggaataccagcgcacttgcgaggatctgaaagagcagctcaagcacaaagagttccttctggctgctaatacatgcaatcgcgttggtggcctgtgcctgaaatgcgcccaacacgaggccgtcttgagtcagacacataccaatgtgcatatgcagacaattgagcgccttgtcaaagaaagagatgatctgatgagcgccctcgtatctgtgcgatcctcattggccgatactcaacagcgagaagcctctgcatacgaacaggtgaagcaggtcctgcaaatcagcgaggaggctaacttcgagaagaccaaacaccctagccagtag

SEQ ID NO: 240162 - DNA, 1245 bp, Artificial Sequence
  Description of Artificial Sequence: Synthetic coding sequence
cttctcgatgcttctgagaagttgaagctgacctatgaagagaagtgtgagatcgaggaaagccaactgaagtttctgcggaacgacctggccgagtaccagagaacgtgcgaggacctgaaggaacagttgaagcataaggaatttctgctggccgctaacacttgcaatcgcgtaggcggactctgcctcaagtgcgctcagcacgaggccgtgctgagtcagacacacactaacgtccatatgcaaacaatagagagacttgtgaaggagcgggacgacctgatgtctgctctcgtgagcgtcagaagctctctagctgacacccagcagagggaggcaagcgcctacgaacaagtgaagcaggtgctgcaaatttccgaggaggcgaattttgagaagacgaaggcactgatccaatgtgatcagttgcggaaagaactggaaagacaggcggagaggctggaaaaggagttggcatctcagcaggaaaagagggcaattgaaaaggacatgatgaaaaaggagatcactaaagagcgtgagtatatgggctctaaaatgctaattctgagccagaatatcgcccagctcgaagcgcaagtggagaaggttaccaaagagaagataagcgctatcaatcagctggaagagatccaaagccagctggcttcccgggaaatggacgttacaaaggtgtgtggcgagatgcgctaccagctcaacaaaaccaacatggagaaggacgaggcagaaaaggagcaccgcgaatttagagctaaaaccaaccgcgatctggaaatcaaggatcaagagatagaaaagcttagaattgaactggacgaatccaagcagcatcttgaacaggaacagcagaaagcagcactggcgcgagaggagtgtctccgcctgacagaactgttgggcgagtctgagcaccagttgcacctgacccgctctgaaatagcacagttgtctcaggaaaaacgctacacttacgataaactaggaaagcttcagaggcggaacgaggaactggaggaacagtgtgtccaacacggtagggttcacgagactatgaagcaacgtctgaggcagcttgacaaacactcgcaggccaccgctcaacaacttgtgcagctgctttctaagcagaaccagttactgctcgagaggcagtccttgtccgaggaagtggaccggctgcggacccagctgccctcgatgcctcagagtgattgttag

SEQ ID NO: 240163 - DNA, 729 bp, Artificial Sequence
  Description of Artificial Sequence: Synthetic coding sequence
atggatgacctatgcgaagcaaacggcacgttcgccataagcctctttaaaatactgggggaagaggacaactcccgtaatgtgttcttcagtcccatgtctattagctctgcccttgcgatggtgttcatgggcgctaaggggagcacagccgcacagatgagtcaggccctgtgcttatacaaggatggggacatccaccggggtttccagtcactcctgtccgaggtgaatcggaccgggacccaatacctcctcagaactgcaaaccggttgttcggagagaagacatgcgactttctgccagacttcaaagagtactgccaaaaattttaccaagccgagctggaggaactctccttcgcagaggatacagaagagtgcagaaagcacattaatgactgggtggccgaaaaaacagaaggcaaaatttcagaagtgctggacgccggaaccgtggatcccctgaccaagttggtcctggtcaatgctatatacttcaagggtaaatggaacgagcagtttgatcggaaatacaccaggggcatgctcttcaaaactaacgaagagaagaaaactgtacaaatgatgtttaaggaggcgaagttcaaaatgggttacgccgacgaagtccatactcaggtgcttgagctgccctacgtcgaagaagaactctctatggttatcctgctgcctgacgacaacactgatttggccgttaaggaatag

SEQ ID NO: 240164 - DNA, 1335 bp, Artificial Sequence
  Description of Artificial Sequence: Synthetic coding sequence
atgaaagttgtacccagcttgctgctcagtgtgctgctggcccaggtgtggctggtgcccggattagctccatcacctcagtctcctgagacgccggcacctcagaatcagaccagcagagtcgttcaggctcctaaggaagaagaggaggatgaacaggaggcttccgaggagaaggcctctgaggaggagaaagcgtggcttatggcctctcggcagcagctcgccaaagagacatccaacttcggattctccctgttgcgtaaaatctccatgcggcacgatggcaatatggtgttcagtcccttcggcatgagcttggccatgacaggactgatgctgggggctactggaccgacagagactcagatcaaacgaggcctccaccttcaggcgcttaaacccacaaagcctgggcttctgccgtcactcttcaaaggcctgcgggaaactctgtcacgaaacttggagctgggcctcacccaaggctcctttgcgttcattcacaaagacttcgatgtaaaggagacatttttcaacctttctaaacggtacttcgacactgaatgcgtcccgatgaacttccggaatgcttcgcaggctaagcggctgatgaaccactacattaacaaggagacgcgcggtaagattcccaagctgtttgacgaaattaaccctgagactaagctaattttggtcgactacatactcttcaaaggtaagtggctgactcctttcgatccggtgttcacagaggtggacaccttccacctcgataaatataaaacaattaaagtccctatgatgtacggcgcagggaagtttgccagcacattcgataaaaacttcagatgccacgttctcaagttgccctaccagggtaatgccaccatgctggtggtgcttatggaaaagatgggtgatcacctcgcgttggaggactacctgacaacagacttagttgagacatggctgcgcaacatgaagacgcgcaatatggaggtcttttttcctaaattcaaattggatcaaaaatacgagatgcacgagctcctaaggcagatgggtatacggagaattttctccccattcgctgatctgtcagagttaagtgcaacaggccgaaatctccaagtttccagggtcctgcagcgcactgtgatcgaagtggacgaaagagggacggaggcggtggcgggaattctgtccgaaattacagcctactctatgcccccagtgatcaaagtggaccggcctttccatttcatgatctacgaagagacgagtggcatgttgctgtttctgggtagggttgtgaacccaactctgttgtag

SEQ ID NO: 240165 - DNA, 1335 bp, Artificial Sequence
  Description of Artificial Sequence: Synthetic coding sequence
atgaaggtggtaccttcccttcttctgagtgttctccttgcgcaggtgtggctggtgccaggcttggccccaagcccccagagcccagagactcctgcaccccagaatcaaacaagccgggtggtccaggctccaaaagaggaggaggaggacgaacaggaggcatccgaggagaaagccagcgaggaggagaaagcctggcttatggcttcaaggcagcaactggcaaaggaaacttcgaactttggcttcagcctgctgcgtaaaataagtatgagacatgacggtaatatggtcttctcaccgttcggaatgtctctcgcaatgaccgggctgatgttgggcgctactgggcctacggagacgcagatcaagaggggcctgcacctgcaggccctgaagcctacgaagcccggtttgcttccatctcttttcaaggggttacgggaaactttatcacggaacctagagttggggttgactcaggggtcatttgccttcatccataaggatttcgatgtcaaggagacgttttttaacctcagtaaacggtattttgacacagagtgcgtcccaatgaattttcggaatgcaagtcaggccaaacgcttgatgaatcattatatcaacaaagaaacgcgcggtaagatccctaaactattcgatgagataaaccctgagacgaaactcatcctggtggattacatccttttcaaagggaaatggctcactccgtttgatcccgtttttactgaggtcgacactttccatcttgacaaatataaaacgatcaaagtaccaatgatgtacggcgctggtaaattcgcttcaacatttgacaaaaattttcgctgccacgtgctgaaactcccttaccaggggaacgccacaatgctcgtagtgctgatggagaaaatgggtgatcaccttgcattagaggattatctgacaaccgacctcgtggaaacttggctgcgtaatatgaagacccggaatatggaggtcttttttccaaagttcaaactagatcaaaagtatgagatgcatgagctgctccgacagatgggcatccgcagaattttctccccattcgccgatctttcggagttgtccgccacaggccgtaacctgcaggtttctcgtgttctgcagcgcacagtgatcgaagtggatgagaggggaaccgaagccgtggccggtattctgtctgagatcacggcatattccatgccaccagttatcaaggtggaccgtccattccacttcatgatctatgaagagacctccgggatgcttctattccttggaagagtggtcaatcccactcttctctag

SEQ ID NO: 240166 - DNA, 1335 bp, Artificial Sequence
  Description of Artificial Sequence: Synthetic coding sequence
atgaaagttgtcccaagcctgctactctcagtgctgctggcccaagtttggctcgtccctggcctcgctccatcaccacaatctccggaaactccggctccacagaatcagacctctcgcgtagtgcaagccccaaaagaggaggaagaggacgaacaagaggctagtgaggagaaggccagcgaagaggaaaaggcctggcttatggccagccgtcagcaactggccaaggagacttcaaacttcggattttcactactgcgaaaaatcagcatgaggcatgatgggaatatggtttttagtccttttggcatgtcgctggcaatgaccggcctcatgctcggcgctaccgggcctaccgagacacaaataaagcgaggacttcacctacaggcactcaaaccaaccaagcccggtctcctcccatccttattcaaaggacttagagaaaccctatcccgaaatctggagttaggattgacacaggggtcgttcgcatttatacataaggactttgacgtcaaagaaacctttttcaacctgtcaaagcgctattttgatacggagtgcgttcccatgaatttccgtaatgccagtcaggcaaagcgactgatgaaccattatatcaataaggagaccagagggaagatcccaaagctgttcgacgaaataaaccccgagaccaagctcatacttgtagactatattttgttcaaggggaagtggctgacccccttcgaccctgtctttacagaggtcgacaccttccatttggataagtataagacaatcaaggtgccaatgatgtacggcgcaggaaagtttgcatctacctttgataaaaacttcagatgtcacgtcctgaaactcccttaccagggaaacgccactatgctggtggtgctcatggagaaaatgggcgaccatcttgcattggaggattatttgaccacagatctggttgagacttggctcagaaacatgaaaactagaaacatggaagtcttctttcctaaatttaaactagatcagaaatacgagatgcatgaactgctacgtcagatgggcatccgaaggatcttctctccatttgccgacctctcagaactttcggccactggaagaaacctgcaggtctccagggttctgcagcggactgtcatcgaggtggacgaacgcggaaccgaggcagtggcaggaattctgtcagagattacagcttatagcatgcccccagtgatcaaagtggacaggccctttcattttatgatctatgaggagacctctggaatgctgctctttctcggaagagtggtgaaccccactctgttgtag

SEQ ID NO: 240167 - DNA, 1455 bp, Artificial Sequence
  Description of Artificial Sequence: Synthetic coding sequence
atgtccaggtcaacacaggagctgctgggatatcactgtagactccaagacaagctccaagagcaggagggatccctcgctgcggagggtcgacacagtctggcaagcgcagccgaccacatgaaggtggtgcctagtctgcttctctctgtattattagcacaggtatggttggtgcccggtctggcgccttcgcctcagtcacctgagacaccagcaccccaaaatcagacttctagagtggttcaggctcccaaagaggaggaggaggatgagcaagaagcctcagaagagaaggctagcgaggaggaaaaggcgtggcttatggcctctaggcagcagctggcaaaagaaaccagcaatttcggattttcattactaagaaaaatttccatgcgccacgatggcaacatggtattttcgccttttggcatgtccctcgcgatgacagggctaatgctcggggcaacaggccctacagagacacagataaaaaggggcctgcacctgcaggctcttaagccgactaaacctgggttactgcccagcctgtttaaaggcctgcgcgagacgctcagtcgaaatctggagctgggacttacccagggctcttttgcttttatacacaaagatttcgatgtaaaggagaccttcttcaacctctcaaaaagatatttcgatactgagtgtgtcccgatgaactttcgcaacgctagccaggccaagaggctgatgaaccactatatcaacaaagagacgcggggtaagattccaaaactgttcgacgaaatcaacccagaaaccaaactgatactagtggactatatcttatttaaaggtaagtggctaaccccctttgatcccgtgttcaccgaggtggacacgtttcacctggataagtataaaactatcaaagtgcccatgatgtatggagccggtaagttcgccagcacctttgacaagaattttagatgtcacgtactcaagctaccctaccaggggaatgcaacaatgcttgtggtgctgatggagaagatgggcgatcatcttgcattggaagattatctgactactgacttagtcgaaacgtggcttcgcaacatgaagacccggaatatggaggtcttcttccccaaatttaaacttgaccaaaaatacgaaatgcatgaactgctgaggcagatgggcattaggaggattttttccccgtttgccgatttgagtgagctgtccgcgactggacgcaacctgcaagtgtctagggtacttcaaaggaccgttatcgaagtggacgaacggggaactgaagctgttgccggaattctaagtgagatcacagcttactcaatgccaccagtgatcaaagtggaccgccctttccacttcatgatttacgaggagacctccgggatgttgctcttcctagggagagtggtaaaccctacactcctgtag

SEQ ID NO: 240168 - DNA, 288 bp, Artificial Sequence
  Description of Artificial Sequence: Synthetic coding sequence
atggaacggatgctgcccctgcttgcattaggactgctcgctgccggtttttgtcccgctgtcctatgtcatcccaattctccgctggatgaagagaatctgactcaggaaaatcaggatcggggaacacatgtggatctgggactggccagcgcaaatgttgatttcgctttttccctctacaagcatccccacagatggtctattcgcctatgtctgatgtacttaagacgggctcagaagcacctgcttcctcagcagtccaagtccccgagctttcttcattag

SEQ ID NO: 240169 - DNA, 1272 bp, Artificial Sequence
  Description of Artificial Sequence: Synthetic coding sequence
atggagcgcatgctccctcttctggccttaggactgctggcagccggtttttgcccagcggtgctgtgtcaccctaacagtcccctcgatgaagaaaacctgacccaggaaaatcaggacagaggaacacatgtggatctcggattagcttcggcaaatgtggacttcgctttcagtctgtataaacaactggtcctcaaagcacctgacaagaacgtcatattctcccctctgtcaattagcaccgcactggcttttctgagcctgggtgcccacaacacaaccctcaccgagatccttaagggactcaagtttaatctgaccgagacatccgaagctgaaattcaccagtcatttcaacatctgttaaggacactaaaccagtccagtgacgagcttcaactgagtatgggcaacgccatgttcgtgaaggagcagctgtctctgctagaccgctttacagaagacgcaaagcgcctctatggcagcgaagcattcgccaccgacttccaagacagcgccgctgccaaaaaactcattaacgactatgtcaagaacgggacaagagggaaaataacagacctgattaaagacttggactcacagactatgatggtgctggttaattacatcttctttaaggccaagtgggaaatgccatttgacccccaggatactcaccagagccgcttttaccttagcaaaaagaagtgggtgatggtgccaatgatgagcttgcaccaccttacaatcccctacttcagagacgaggagttgtcctgtaccgtagtggagttaaaatatacaggcaatgcctcagcactgtttattctccccgaccaggataagatggaagaggtcgaagctatgctgcttcccgagacactgaaacggtggcgcgatagtttggagtttcgggagatcggcgagttgtacttacccaagttttccatctctagagattacaaccttaatgacattcttctccagctgggcatagaggaagcctttacttcaaaagccgacctgtctgggatcactggggcacgtaatctggccgtgagtcaagttgtgcataaggccgttttggatgtgttcgaggaagggacagaggccagcgcagcgacggctgtgaagattacattattatccgccctggttgagacgcggactatagtgcggttcaataggccatttctcatgatcatcgtgcccaccgatacccaaaacatcttctttatgtctaaagtgaccaatcccaagcaagcctag

SEQ ID NO: 240170 - DNA, 1272 bp, Artificial Sequence
  Description of Artificial Sequence: Synthetic coding sequence
atggagcggatgctgcctctgctggcccttggacttctagcagctgggttctgtccggcagtcctatgccaccctaattcccccctggatgaagagaacctcactcaagaaaatcaggaccggggaacacacgtggatcttggtctagcgagtgctaatgttgacttcgcattctctctatacaagcagctcgtcttgaaggcacctgacaagaatgtgatcttttcacctctcagcatctcgaccgcactggctttccttagcttgggggctcacaatactactcttactgaaatactgaagggactgaaattcaatcttaccgagacctccgaggcggaaatccaccaatccttccagcatttactgcgcacccttaaccagagttctgatgagctgcagctgtctatgggcaatgcaatgttcgtcaaggaacaattatctcttctggatcgctttactgaggatgcaaagcggctgtacggcagcgaagcctttgctactgactttcaggactcagcggctgccaaaaagctcataaatgactatgttaaaaatggaacacgcggaaagatcactgatcttatcaaggatctcgactcccagacaatgatggtcttggtgaattacatttttttcaaggccaagtgggaaatgccttttgatccccaggacactcatcagtcccgattctatttgtccaaaaagaagtgggtcatggtgccaatgatgtccttgcatcatctcacaatcccctactttcgagacgaagagctgagttgtaccgtcgtggaacttaaatatacaggtaacgcgagcgcacttttcattctgcccgaccaagataaaatggaggaggtcgaggccatgttgctgcccgagactctaaagcggtggagggatagtttggaattccgggagataggcgagctgtacctcccgaaattctcaatctctagagactataatctcaacgacatcctgctgcaactgggtatcgaggaagcatttactagcaaagcagatctttccgggataaccggagccagaaatctggccgtctcccaagtcgtgcacaaagctgtcctggatgtgttcgaggagggaaccgaagcctcagctgccaccgccgtgaagatcactctcctgagtgcattggtggaaacaagaaccattgtaagattcaaccgtcccttcttgatgatcattgtgccgaccgacacccagaacatcttttttatgtctaaagtaacaaatccaaaacaggcctag

SEQ ID NO: 240171 - DNA, 1272 bp, Artificial Sequence
  Description of Artificial Sequence: Synthetic coding sequence
atggagcgcatgcttccactgctggctcttggtctactagctgccggtttttgtcccgctgtcttatgccatcccaattctccactggacgaggaaaaccttacgcaggagaaccaggatcgcggtacgcatgtcgacctgggactggcttccgcaaacgtcgacttcgcattctcgttgtataagcagctggtgctgaaggccccagacaaaaatgtcatttttagccccctttcaatctctacagctctggcttttctgtctctgggggctcacaacacaacactgactgagatcctcaagggactgaaatttaatctaacggagacatcagaagcggagatccaccagtcatttcagcatctcctcagaactctcaaccaatccagcgatgaattacagctgagcatgggcaatgctatgtttgtcaaggaacagctgtctctgctcgatcgctttaccgaagacgcaaaaaggctgtacgggtcggaggccttcgcaaccgattttcaggattctgccgctgccaaaaaactcattaatgattacgttaagaatggcacccgcggaaaaattaccgatcttatcaaggacttggactcacagactatgatggtcctcgtgaattacatctttttcaaggctaaatgggagatgccgttcgatccccaggatacccaccagagtagattttacttgagtaagaaaaaatgggtcatggtgcctatgatgtctctgcaccatctaacgatcccctactttagggatgaggagttgtcatgcaccgtcgtggaactcaagtacactggaaacgcgtctgcgctattcatcctccccgaccaggataagatggaggaagtggaggctatgctcctacccgaaactcttaaacgatggcgagatagcctggagtttcgggagatcggagaattatacctacctaagttttccatcagccgggactacaatttgaacgacatactgctccaattggggatcgaggaggcattcacttccaaagcagacctttcaggcatcacaggcgcacgcaacctggcagtgtctcaggtggtgcataaggccgtcttagatgtctttgaggagggtactgaagcctccgctgccaccgcagttaagatcactttactctccgccctagtggagacccgaaccattgtgaggtttaatcgaccctttctgatgatcatagtgcctactgatacccaaaacatttttttcatgtccaaggtcacgaatcccaagcaggcatag

SEQ ID NO: 240172 - DNA, 1347 bp, Artificial Sequence
  Description of Artificial Sequence: Synthetic coding sequence
atgaaaatccattatagtaggcaaactgcactcgaatcaacttcttatatccagctccccgaggcggagcttaggatggaacggatgttgcctctcctggcgctaggtctcctggcagctggcttttgtccagccgtgctctgccaccctaattcacccttggatgaggaaaacctgacccaggaaaaccaggaccggggtacacatgtggacctgggcctcgcatcagctaatgtggacttcgcatttagtctttataagcagctggtgcttaaagccccagataagaacgtcatcttttctccactcagtatatccacagctctggcatttctgtcactgggggctcacaacacgacactgaccgaaattctgaagggactgaaatttaacctcaccgaaactagtgaggccgaaatacatcagtctttccagcacctgcttaggactctgaaccagtccagcgacgaactgcagctgtcaatgggtaacgccatgtttgtcaaggagcagctgtcactactggataggtttacagaggatgccaaacgtttgtacggatccgaggcctttgctactgacttccaggacagcgccgcagctaaaaagctgatcaacgactacgtgaagaacgggaccaggggaaagattaccgatctcatcaaagacttagatagccagaccatgatggtactagtgaattatattttttttaaagcgaagtgggaaatgccattcgatccgcaggatactcaccagagtagattttacctgagtaaaaagaagtgggtaatggtgccaatgatgtcgctccaccatctgactatcccgtattttcgtgacgaggagcttagctgcacggtcgtagagctgaaatacaccgggaacgcctcagccctgttcatcctgcctgatcaggataaaatggaagaggtggaggctatgcttctcccagaaacactcaaaagatggagggacagtctggagttcagagaaatcggggaactgtacttgccaaagtttagcatctcacgagactataatctgaacgacatactcctccagcttggaatcgaggaagctttcaccagtaaagcagatctctctggtataacgggcgcaagaaatctggccgtttctcaggtggttcacaaggctgtcctggacgtgttcgaggaagggacagaagctagcgccgctaccgctgtcaaaattacactgctgagcgcgctggtggagacacgcactatcgtccgcttcaatcggccttttctcatgatcattgtcccaactgatacgcagaatatcttctttatgtctaaggtcacaaatcccaaacaagcatag

SEQ ID NO: 240173 - DNA, 918 bp, Artificial Sequence
  Description of Artificial Sequence: Synthetic coding sequence
atggagcgtatgctgcccctgctcgctctggggcttcttgccgctgggttctgccctgccgttctgtgccaccccaactcccctttggatgaggagaatctgacccaagaaaatcaggataggggcactcacgttgatttaggcctcgcaagtgccaacgttgacttcgccttcagcctctataaacagctagtcctgaaggctccagataaaaatgttatcttttctccccttagtatttccaccgcgctggcttttctgtctctaggtgcacataataccactctaaccgagatactgaaagggctcaaattcaacttaactgaaacaagcgaagcggagatacaccaaagttttcagcatttactgaggactctgaaccagtcatctgacgaactgcagttgtccatgggtaacgcaatgttcgttaaggaacagctttctcttctggacaggtttactgaggacgcaaagagactctatggctctgaagcttttgctaccgatttccaggattcagctgctgctaaaaaacttattaacgactacgtcaaaaacggaacccggggaaagatcaccgatctgattaaggacctggattcacagaccatgatggtactggtcaattatatatttttcaaagcaaagtgggaaatgccttttgacccgcaggacacccaccagagtcgcttttatttgtctaagaagaagtgggtgatggttccgatgatgtcgctacaccacctcaccatcccatacttcagagacgaggaacttagttgtacagtcgtggaactgaaatataccggtaacgcatcggctctttttatcctgcccgaccaggataagatggaggaggtggaagccatgctgttgcctgaaactctgaagcgatggcgggactcactcgaattctag

SEQ ID NO: 240174 - DNA, 1284 bp, Artificial Sequence
  Description of Artificial Sequence: Synthetic coding sequence
atgcacctcatcgattatctcttgctgctgcttgtgggtcttctggccctttctcacggacagctccacgtcgagcacgatggggagagttgtagtaacagtagccaccagcaaatcctggaaaccggtgagggttcaccttcattgaagattgcccctgcaaacgccgatttcgctttccggttctattacttaatcgcttcagaaactccgggaaagaacatttttttttccccattgtcaatcagtgcagcctacgcgatgctgagtctgggggcatgcagccattctcggtcacagattcttgaggggttaggattcaacctcaccgagctgagtgaatccgatgttcacaggggatttcagcatctgcttcacaccctgaatttacctgggcacggcctggaaacgagagtcggatccgcacttttcctgagccacaacctcaagtttttagccaagttcctgaacgacaccatggccgtgtatgaggcgaagctgttccacacaaatttttacgatacggtggggaccatacaactgatcaatgaccacgtgaagaaagagaccagaggtaaaatcgtcgacctggtcagtgagctcaaaaaggacgtgttaatggtgctggttaattacatttatttcaaagcgctttgggagaagcctttcatcagctcgcggaccacacccaaggacttttacgtggatgaaaacacaaccgtgagagttcccatgatgcttcaagaccaggagcatcattggtatctgcacgaccggtacttgccctgtagcgtacttcgaatggactacaaaggggacgccacagtgttctttatactgcctaatcagggtaaaatgcgagagatcgaagaagtactaactcccgagatgctcatgagatggaataaccttttgagaaagaggaatttctacaagaaattggagcttcacctcccaaaattcagcatctcaggtagctacgtgctggaccagatccttccaaggctggggtttactgatctgttctcaaaatgggcagatctcagcggtattacgaaacagcagaagctcgaagcttctaagtcatttcacaaagccactcttgacgtggatgaggccggaaccgaggcggctgcggctacttcctttgctatcaagtttttttccgcccagaccaataggcatattctgcgcttcaatagaccgttcctagtggtaattttctctactagtacccaatccgtcttattcttggggaaggttgtggatcccaccaagccatag

SEQ ID NO: 240175 - DNA, 1284 bp, Artificial Sequence
  Description of Artificial Sequence: Synthetic coding sequence
atgcacctcatcgactatcttctactgctgctggtggggctgctcgccctgtctcatggccaactgcacgtggagcacgatggcgagagttgtagtaatagctcccatcagcaaattcttgagactggcgaaggaagcccaagtctcaaaatagctcctgccaatgctgacttcgctttccggttttactatttaatcgcctccgagaccccgggtaagaatattttcttctcccctctgtctattagtgcagcctacgctatgctttccctgggtgcatgcagtcactctaggtcgcaaatcttagaaggcctaggatttaacctgacagagctcagcgagtcagatgttcacagaggctttcagcacctcttacacaccctgaacttgccaggccatgggcttgaaacccgtgtaggcagcgccctgtttctgagccacaatctcaagtttctggcaaagtttctgaatgatactatggcagtgtacgaagcaaagctgttccacaccaacttctatgacactgtgggaactatccaactgatcaacgaccacgtgaagaaagagacacggggaaaaattgtggacctggtgtccgaactcaaaaaagacgtattaatggtactcgtgaattatatctactttaaggcgttgtgggaaaagccattcatctcctctagaacgacccccaaggatttctatgtggacgaaaatacgacggtgagggtgcccatgatgctgcaggatcaggaacaccactggtacttacacgataggtacctcccatgttccgtcctccgaatggattataagggtgatgctaccgtcttctttatcctccctaatcagggcaaaatgcgggaaatagaggaggttctaacaccagaaatgctaatgcgatggaacaacttgctacgcaaaaggaacttttacaaaaaactagagctccacctgcctaagttctctatctccggatcgtacgtgcttgatcaaatcctgccacgcctgggcttcacagatttgttcagcaagtgggctgatctgtccggtataacaaagcagcagaaattggaggcaagcaagtcattccacaaggccaccctagacgtcgacgaggcaggaacagaggctgccgctgccacgtctttcgccataaagtttttctctgcccagaccaatcgacatatcttgcgcttcaaccggccatttttggtggtgatcttctccacttccactcagagtgtcttgttcctggggaaggtggtggacccaacaaaaccgtag

SEQ ID NO: 240176 - DNA, 1284 bp, Artificial Sequence
  Description of Artificial Sequence: Synthetic coding sequence
atgcatctgattgattacctgctcctgttgttggtgggcctgctagctttgagccatggacagttacacgttgagcacgacggagaaagctgcagcaatagttcccaccagcagatactagagaccggcgaaggctctcccagcctcaagatcgctcctgcaaacgctgatttcgctttccgcttctactacttgatcgcaagtgagacaccgggaaaaaacatcttcttttccccattaagtatttccgctgcctatgcaatgctttctttaggcgcatgctctcactcccgctctcaaatcctggaggggctaggcttcaacctgacagagctgagcgaaagcgacgttcatcgtggctttcagcatctgctgcacacccttaacttacccggacatggcctagagactagggtcggatctgcactctttctcagtcacaatctgaagtttcttgccaaatttttgaacgacactatggccgtgtacgaggcgaaactcttccacactaatttttatgacacagttggcaccattcaactgattaatgaccatgtgaagaaagaaacccgtggaaagattgttgatttggtctcagaactgaaaaaggacgtcctaatggtattggtgaattatatttactttaaagcactatgggaaaagccttttatttccagcaggacaactccaaaagatttttatgttgatgaaaatactacagttagagtaccaatgatgttgcaggaccaggagcatcattggtacctgcatgatcgttacctgccatgttctgtcttacgtatggactataagggagatgcgacagtgttctttatattgccaaatcagggtaagatgcgcgaaatcgaggaggtgctgactcccgaaatgctcatgcgttggaacaacctgcttaggaaaagaaacttttacaaaaagcttgaacttcacttgcccaagtttagcatatctggcagttacgtcctggaccagattctgcctaggttaggcttcactgatctgttttctaaatgggccgacctctccggcattacaaaacagcaaaaattggaggccagcaaatcgttccataaagccacgttggatgttgatgaagcaggaaccgaagctgccgcagccacttctttcgctattaagtttttcagtgcacagaccaataggcatatccttagatttaacaggccgttcttagttgtaatcttcagcacttctacacaaagtgtgctctttctgggtaaggtggtcgaccctacaaagccatag

SEQ ID NO: 240177 - DNA, 1218 bp, Artificial Sequence
  Description of Artificial Sequence: Synthetic coding sequence
atgcccctcctgctttacacgtgtttattatggttgccaacctctggcctttggaccgtgcaggcaatggacccaaacgctgcgtatgtgaacatgtccaatcaccatcgcggactcgcatctgccaacgttgacttcgccttctcattatacaaacacttggtcgcgctcagtcctaaaaagaacatctttatctctcctgtaagcattagtatggcactggcgatgctgagtctcggaacctgcgggcatacaagagcccagctcctacaagggctgggttttaatctgacagaacgctcagagactgaaattcaccaaggttttcaacaccttcatcaattgtttgctaagtccgataccagccttgagatgacaatggggaatgccctgtttctggatggttctttggaacttcttgaatctttctcagccgacatcaaacactactatgagtccgaggtgctggctatgaacttccaggattgggctacagcttcacgacagatcaatagttacgtcaaaaataagacacagggcaaaattgtggacctattctccggcctggacagtccagctattttagttctagtcaactatatcttctttaaggggacctggacccaaccctttgacctagctagcactcgcgaggagaatttctatgtggatgagaccactgtggtgaaggtgcccatgatgctccaatcatccacgatttcctacctccacgactctgaactgccctgccagctggtgcagatgaattatgtcgggaacggaacggtgttttttatcctgccggacaaggggaagatgaacacggtgattgccgctctgtccagggacaccatcaatagatggagcgccggattaacttcttcccaggtggacctgtatatacctaaggttacaattagcggggtgtacgacctgggggatgtcctggaagagatgggaatcgccgatctgtttaccaaccaagcaaatttcagtcgcatcacacaagacgcccagcttaagagcagtaaagtagttcataaagccgtgctccagctgaacgaagaaggtgtggacaccgccggatctacaggcgtcaccttaaatctgacaagtaagcctattatccttagattcaaccagcccttcatcattatgatttttgatcatttcacatggtcctccctgtttctggccagagtaatgaaccccgtgtag

SEQ ID NO: 240178 - DNA, 411 bp, Artificial Sequence
  Description of Artificial Sequence: Synthetic coding sequence
atgcccctgcttctgtatacctgtctgctgtggctgcctacatctgggctttggacagttcaagcaatggatccaaacgccgcatacgtcaatatgtccaaccaccatagaggcctggctagtgctaacgtggatttcgccttttccttgtacaagcatttggtggcactatcccctaaaaagaatatttttatctcaccggtgtctattagcatggcccttgcaatgctgagcctcggcacctgcgggcacaccagagctcaactactccaagggctggggttcaacctcacagagaggtctgagacagagatacatcagggcttccagcacctccatcaattgttcgcaaaaagcgacacttcactagaaatgacaatgggcaacgcactttttctagacggttcttag

SEQ ID NO: 240179 - DNA, 1194 bp, Artificial Sequence
  Description of Artificial Sequence: Synthetic coding sequence
atggattctctggccactagcatcaatcagtttgccctggaactcagcaagaaattggccgagtctgcacaagggaagaacatttttttctcaagttggtcgatctcaacttccttaaccatagtgtatctgggggctaaaggaacaactgctgcccaaatggcacaggtgctccagtttaaccgtgaccagggcgtaaaatgtgacccagagtccgagaagaaacgcaagatggaattcaacctttcaaacagcgaggaaattcattccgattttcaaaccctgatatctgaaatccttaaaccaaacgatgactacctcctgaaaacagcgaatgccatatatggggaaaagacctacgccttccacaataaatatctcgaggacatgaaaacgtattttggcgctgaacctcagcctgttaatttcgtggaagcatcagatcagattagaaaggatatcaactcctgggtggagcgtcagacggagggcaagattcagaatttgctccctgatgacagcgtggattccactacacgcatgatcttagttaatgcactctactttaaaggtatatgggagcatcagtttcttgtacagaatacaacggagaagccttttagaatcaatgaaactacctcaaagcctgtgcagatgatgttcatgaagaaaaagctgcatattttccacatagagaagcctaaggccgttgggttgcagttgtactataaatcccgggatctctccctactgatcctgctgccagaagacatcaacggcctggaacagctcgaaaaggctatcacctacgaaaagttgaatgagtggacaagtgctgatatgatggagctgtatgaggttcagttacatctgcctaaattcaaactcgaggactcatatgacctgaagagcaccctgagttctatgggtatgtctgacgcctttagtcagtccaaggccgacttctctgggatgtccagcgcccgaaacctattcttgtctaatgtctttcacaaggccttcgtggaaatcaacgagcagggcacagaggcagccgctggttccgggtctgagatagacatcaggatccgtgttcccagtatcgaattcaatgctaatcatcctttcctcttcttcatcaggcacaacaagacaaacacaatccttttctatgggcgactctgtagtccctag

SEQ ID NO: 240180 - DNA, 1020 bp, Artificial Sequence
  Description of Artificial Sequence: Synthetic coding sequence
atggactccctcggagctgtatctacacgcctgggattcgatctgttcaaggaacttaagaagactaacgacggcaatatctttttttcacccgttggcatcctgacggctatcggcatggtgctcctgggcacacggggagcaacggcatctcagctggaggaggtgttccattcggaaaaggagacaaagtcaagccgtattaaggctgaggagaaagaggtgatcgagaacactgaggccgtgcatcagcagttccagaaattcctgacggaaatcagcaaacttacgaatgactacgagctgaacattactaataggttgttcggcgaaaaaacatacctgttcttacagaagtatttggattacgtggaaaagtactatcacgcctccttggagcccgtggactttgtcaacgccgcagatgaatcccgaaagaagataaattcctgggttgaaagcaaaactaatgaaaaaattaaagatctgttccccgacggatctatctccagctctacgaagttagtgctggtgaacatggtgtacttcaaaggacaatgggatcgggagttcaaaaaagaaaacaccaaggaggaaaagttctggatgaacaaaattattgataaaatctctcccgagaagctggtcgagtggacttcaccagggcatatggaagaaaggaaagtgaacctgcatctgccgcgattcgaagtggaggatggctacgatctggaggccgttctggccgctatgggaatgggcgacgccttctccgaacataaggccgattacagcggtatgtcttctggatccgggctgtacgcacagaagtttctccactcttctttcgttgcagttacagaagagggaacagaggccgctgcagctaccggaatcggatttacagtgacctctgcgcctggtcatgagaatgtgcattgtaatcacccgtttctctttttcatccgacataacgagtcaaattctatcctgttctttgggaggttctcctccccctag

SEQ ID NO: 240181 - DNA, 1176 bp, Artificial Sequence
  Description of Artificial Sequence: Synthetic coding sequence
atggattcactgggtgccgtgtccacccgcctcgggttcgatctgtttaaagagctcaagaagacgaatgatggaaacatcttcttctctccagttggaatcttgaccgcaatcggcatggtactcctcggaacgcgcggagctactgctagccagttggaggaggtttttcacagcgaaaaagagacaaagagcagtaggattaaagccgaggaaaaagaggtcattgaaaacacggaggcggtgcaccaacagtttcagaagtttctgacagagatctccaagctgacgaacgactacgaactaaacataactaataggctcttcggcgaaaaaacctatctgtttttgcagaaataccttgattatgtggagaaatattaccacgcaagcctggaacctgtggatttcgtgaacgcagcggatgaatcacgtaaaaagattaacagttgggtggagtcaaagacaaacgaaaagataaaggatctcttccccgacggttctatctccagcagcactaagctagtgctggttaacatggtatatttcaaagggcagtgggatagagaatttaagaaggaaaacacaaaggaagagaagttttggatgaataagtcaaccagcaagagtgtgcaaatgatgacccagtcccactccttctcatttacattcctggaggatctacaggctaaaatattaggaatcccctacaaaaacaatgatctctccatgttcgttctcttacctaacgatatcgatggccttgagaaaatcatcgataagatctccccagaaaaactagttgagtggaccagcccagggcacatggaagagcggaaagtgaacttgcacctgccccgatttgaagtagaagatggatacgatctcgaggccgtcctagcagccatgggtatgggcgatgcctttagcgaacacaaggccgactactcaggaatgagtagtggatccggactgtacgcccaaaaatttttacactcctcatttgtagccgtgactgaagaaggcacagaggcagcggctgccacaggtattggattcaccgtgacttccgcaccgggacacgagaacgtgcactgcaatcatccgttcctgttcttcattaggcataacgaaagcaattccatactcttttttggaagattcagttctccatag

SEQ ID NO: 240182 - DNA, 930 bp, Artificial Sequence
  Description of Artificial Sequence: Synthetic coding sequence
atggactccctcggggcagtgtccacccgcctcgggttcgatcttttcaaggagcttaagaaaaccaatgacgggaacatcttcttctctccagtggggatcctgaccgcaatcggtatggtcctcctgggaacaagaggagcaaccgccagccaactggaagaggtttttcattctgaaaaagaaaccaagagctcccgcataaaggctgaggagaaggaggttgaaaaaataaaagatctcttccctgacgggtccatcagttcttctactaagctggttctcgttaatatggtttatttcaagggccagtgggatcgcgagttcaagaaagaaaataccaaggaggagaaattttggatgaataagtctacctctaaatctgtgcagatgatgactcagagtcactcattttcctttaccttcctcgaggacctccaagctaagatcctgggtattccttataaaaataatgatcttagcatgtttgttctgctgcctaacgatattgacgggctggagaagataattgacaaaataagccctgaaaaactggtcgaatggacctcacccggtcatatggaagaacgcaaagtgaacttacatctcccgaggtttgaggtagaagacggttatgatctcgaagctgttcttgccgctatgggcatgggtgacgccttttctgaacacaaagctgattactctggcatgtctagcggaagcggactgtacgcccagaagttcctgcacagctcctttgtcgctgtaacagaggaaggaacggaggcagctgcggctactggtattggatttaccgtgacctccgccccaggtcacgaaaacgtgcactgcaatcatccattcttatttttcataaggcacaatgaatcaaactccattctgttctttgggcgattcagttccccatag

SEQ ID NO: 240183 - DNA, 1173 bp, Artificial Sequence
  Description of Artificial Sequence: Synthetic coding sequence
atgaattccctctccgaagccaacaccaagttcatgttcgacttgtttcagcagtttcgtaagtcaaaggagaacaacatcttctacagcccaataagtatcacatccgccctgggaatggtgctgctgggcgcaaaggacaacacagctcagcagatcaaaaaagtcctgcattttgatcaggtgactgagaataccacagggaaggcagcaacctatcacgtcgacaggagcggtaatgtgcaccaccagtttcagaaactgcttactgaattcaataaaagcactgatgcctacgaactcaagatcgctaacaagctgttcggcgagaagacctatctgtttctccaggaatatctcgatgcgatcaaaaaattctatcagacttctgtggagagcgttgactttgcgaatgccccagaggagagtcgtaagaagatcaactcgtgggtggaatcacagacgaatgagaaaattaagaatctaatccctgaggggaacatcgggagtaatacaactctggtgcttgttaatgccatttactttaaaggtcagtgggagaaaaagtttaataaagaagacactaaggaggagaaattctggcccaacaagaacacctataaaagtatccagatgatgagacaatatacttcatttcatttcgcctccctggaggacgtccaggccaaggtgctggagatcccatataaaggcaaggacctgtcaatgatcgtccttctgcccaacgagatagatggattacaaaagctcgaggagaaactgacagcggagaagctcatggagtggacatcattacagaatatgagagagacaagggtggatctgcatttgcccaggttcaaagtggaggagtcctatgacctgaaagacacactgagaaccatgggcatggtggacatcttcaatggagacgccgacttatccgggatgacagggtcccggggattagtcttgagcggcgtcctgcacaaagccttcgttgaggtgacagaggagggcgcagaagctgctgcagctacggcggtggtagggtttggtagtagccccacatccaccaacgaagaatttcactgtaatcatccctttctatttttcatcaggcagaataaaaccaattccatcctgttttacggccgattcagttcgccgtag

SEQ ID NO: 240184 - DNA, 1173 bp, Artificial Sequence
  Description of Artificial Sequence: Synthetic coding sequence
atgaatagtctgagtgaagccaatactaagttcatgttcgatttgttccagcaattccgaaaatcaaaagagaataatatattttattcacccattagtattactagcgcattaggtatggtactgctaggcgcaaaggacaatacggctcagcagatctctaaggtactgcacttcgaccaagtgactgagaacactactgaaaaagccgctacataccatgtggacaggtcggggaatgtacatcaccagtttcaaaagctacttaccgagtttaacaagagtacagacgcatacgaactcaaaatcgccaataagttatttggggagaagacgtatcagttcctccaagagtacctggacgccataaaaaagttctaccagaccagcgtagaaagtaccgacttcgccaatgctcctgaggagtccaggaagaaaatcaatagctgggtggagtcacagacgaacgagaaaatcaaaaacctcttcccagacggcacaattgggaatgataccactctggtcctggttaatgctatttactttaagggacagtgggagaataagttcaagaaggaaaataccaaggaagaaaagttctggccgaacaaaaacacatacaagagcgtccaaatgatgcgacagtataattcctttaattttgccctcctggaggacgtccaggcgaaggtgcttgaaattccctataagggtaaggatctttccatgattgtgctgctccccaacgagatcgacggattgcagaagctggaggaaaaactgacggctgaaaaactgatggaatggaccagcctgcagaatatgagagagacttgtgtagacctccacctgccacgctttaagatggaggaaagctacgatctgaaggacactttacgcacaatgggtatggtcaacatttttaacggggatgcagatcttagtggcatgacttggtctcacggcctcagcgtctctaaagtgctccacaaagcatttgttgaggtgacggaggagggcgtggaggccgctgctgccacggcagtggtggtcgttgagctgagctctccttctacaaacgaggagttttgttgcaatcacccctttctgttttttataagacagaataagactaacagtatcctgttttatggacgatttagttctccctag

SEQ ID NO: 240185 - DNA, 1017 bp, Artificial Sequence
  Description of Artificial Sequence: Synthetic coding sequence
atgaattccctgtctgaagccaacacaaagttcatgtttgacctctttcagcaattccgcaaatctaaggaaaataacatcttttacagtcccatctcaatcacatcagctctgggaatggtcttattgggtgcgaaggataacacggctcagcagataagtaaggtcctgcatttcgatcaggtgacagaaaatactacagaaaaagccgcaacttaccatgtggaccggagcggcaacgtgcaccaccaatttcagaagctgcttacagagtttaataagtcaacggatgcatatgaactcaagattgccaataagcttttcggcgaaaagacgtaccagtttcttcaggagtatctggacgcgataaaaaagttctaccagacctctgtcgagtccaccgatttcgcaaacgccccagaagagtcccggaaaaaaatcaactcctgggtcgaatctcagaccaacgaaaagatcaagaatctcttcccggacggcactatcgggaacgacactaccttagtgctggtcaacgccatctacttcaagggccagtgggagaacaagtttaaaaaggagaatacaaaagaggagaagttttggccaaacaaactggaggagaagttgaccgcggaaaaattaatggaatggacctcgttacagaatatgagggagacctgcgtggatctacacctacccaggtttaagatggaagaatcctacgacctcaaggatacgcttcggacgatggggatggtcaacatttttaatggcgacgccgatctgtcgggcatgacgtggagccacggcttgtccgtttccaaggttcttcacaaagcattcgttgaggtgactgaagaaggggtggaggccgctgcagcgaccgctgtggtggtggtggaactatcttctccaagcacaaatgaggagttctgctgcaatcacccctttttattctttatcagacagaacaagacaaatagcattctgttttatggtagatttagcagcccctag

SEQ ID NO: 240186 - DNA, 1128 bp, Artificial Sequence
  Description of Artificial Sequence: Synthetic coding sequence
atggatgccctgcaattagccaattctgccttcgccgtggacctgttcaaacagctctgcgaaaaggaaccattggggaacgtgttgtttagccctatttgtttgagtacctctttatcactagcacaggtgggggctaagggcgacaccgctaacgaaatcggacaggttctgcacttcgaaaacgttaaggatgtaccatttggatttcagactgtgacctcagacgtgaataagctctcttctttctatagcctgaaactgataaagaggctatatgtggacaaaagtctgaatctttctactgaatttatctctagtactaagaggccatacgccaaagagctggaaactgtcgactttaaggataaactagaggaaaccaaggggcaaatcaataatagcattaaagatctgacggacggacacttcgaaaacatactagccgacaattcggtgaacgatcagactaagattttggtggtgaatgccgcatattttgtgggtaagtggatgaagaagttctcagagtccgagaccaaagaatgtcctttcagggtgaacaagacagacaccaaacctgttcagatgatgaacatggaggccacattttgtatggggaacatcgatagtattaactgtaaaataatcgagctgccgtttcaaaataagcatcttagtatgtttatactgttacccaaggatgtcgaagatgagagtactgggttggagaaaattgagaagcagctcaactctgagtctctctctcaatggactaacccgtctacaatggctaatgctaaggtcaagctgtctataccgaaattcaaagtggaaaaaatgattgatccgaaagcgtgcttggagaatctgggtctgaaacatatcttcagcgaagatactagcgactttagtggcatgtctgaaaccaaaggggttgccctttcaaatgtgattcacaaagtgtgtctggagatcaccgaggacggcggagacagcattgaagtgcctggcgcacgtatactgcagcacaaagacgaactcaacgcagaccacccattcatctatatcattcgccataataaaaccaggaatatcatcttctttggcaagttttgttccccatag

SEQ ID NO: 240187 - DNA, 390 bp, Artificial Sequence
  Description of Artificial Sequence: Synthetic coding sequence
atggacgctctccagctcgctaacagcgcttttgccgtagacctttttaagcagctgtgcgaaaaagagccactggggaatgttttgttctcccctatctgcttatctacaagcttatccctggcccaggtgggtgccaaaggggatactgcgaacgagatcggccaggtgcttcatttcgagaatgtaaaggatgtcccatttggattccaaaccgtcactagcgacgtgaataagctctcttccttttactcactcaagttgattaagcggctgtatgtggacaagtccctcaacctatccaccgagtttatctcatcaaccaagaggccctacgcgaaagaactggagacagttgattttaaagacaagcttgaggaaactaagtag

SEQ ID NO: 240188 - DNA, 1131 bp, Artificial Sequence
  Description of Artificial Sequence: Synthetic coding sequence
atggacgttttggcggaggcgaacgggacctttgctctgaatttgctgaaaaccctggggaaagacaattctaagaatgtgtttttttcccccatgtctatgtcctgcgcattagcgatggtgtatatgggtgcgaaggggaacaccgctgcccaaatggcgcagatcctgtctttcaacaagtccggtgggggaggcgatattcaccaggggttccagtccctgctgactgaggtcaacaagaccggaacccagtatctgttaaggatggccaaccggttgttcggagagaaatcctgcgatttcctgagtagtttcagagatagctgccaaaagttttaccaagccgagatggaggagctggatttcatcagtgctgtggagaagtcccgcaagcatattaatacctgggtggccgaaaagactgaagggaaaatcgccgagcttctctctccagggtcggttgaccctctaacccgtctcgtgttggttaacgccgtctacttccgcggtaactgggacgagcagttcgacaaggaaaacactgaggagcggctgttcaaggtaagcaaaaatgaggagaaaccagtgcagatgatgttcaaacaatctactttcaagaaaacatatattggggagatattcactcagatactcgtgctgccctacgtgggcaaggaactgaatatgatcattatgcttcccgacgagaccacggatttaagaacagtcgaaaaggagctgacctacgaaaagtttgtggagtggacacgcttagatatgatggacgaggaagaagtagaggtctccctgcctcggttcaagctcgaggagtcatacgacatggagtccgtgctcagaaacttgggcatgacggacgccttcgagctcggtaaagctgacttttccggcatgagtcagaccgacctaagtttgtctaaggtagtgcataagtcatttgtggaggtgaatgaagagggtactgaggcggcagctgcaaccgctgcgattatgatgatgagatgtgctagatttgtcccccgtttctgcgcagaccacccgtttctgtttttcatccagcattccaagacaaacggtatcctcttctgcggacggttcagttctccctag

SEQ ID NO: 240189 - DNA, 546 bp, Artificial Sequence
  Description of Artificial Sequence: Synthetic coding sequence
tgactgaatctcttgaaaactctgggcaaggataattccaagaacgtctttttttcgccaatgtcgatgagctgtgctctcgctatggtgtacatgggcgctaaaggcaacacagccgctcagatggctcagattctgtcttttaataaatccggtggagggggagacatccaccaagggttccagagcttgctgaccgaggtcaataagactggaacccaatacttactccgcatggcgaaccgcgaaagttatgatatggagtctgtactgagaaatctggggatgaccgacgcttttgaactgggcaaggcagatttctcggggatgagccaaaccgatttatctctgagcaaagtggttcacaaatcattcgtagaggtgaatgaagaggggacagaagccgctgccgctaccgccgcaatcatgatgatgcgctgtgctagatttgtgccacggttttgtgccgatcatcctttcctctttttcatacagcactccaagactaatggtatacttttttgtggtcgtttttcaagcccgtag

SEQ ID NO: 240190 - DNA, 1131 bp, Artificial Sequence
  Description of Artificial Sequence: Synthetic coding sequence
atggacgttcttgcagaggcaaacggtacattcgctctgaatctgctgaagactctgggaaaagacaatagcaagaacgtgttcttttcgcccatgagcatgtcttgcgcactcgccatggtgtacatgggagcaaaaggaaataccgctgcgcagatggcccagatcctcagcttcaataagtctggaggagggggtgacattcatcaaggtttccagagcttactgacagaagtaaacaaaaccggcacacagtatcttcttagaatggccaatcggctgttcggggagaaaagctgtgattttctgtcttccttccgcgactcttgtcagaagttttatcaggctgagatggaagaactggattttatttctgcagtcgagaaaagtagaaagcacattaacacgtgggtcgctgagaagaccgaagggaagatcgccgaacttctgtctccagggagtgtcgacccccttactcggctggtcctcgtgaacgccgtttacttcaggggcaattgggatgaacagttcgataaggaaaacacagaagaaagactgttcaaggtgtccaagaatgaggaaaagcctgtgcaaatgatgttcaaacagtctacttttaagaaaacgtacattggtgaaatctttacacagattcttgtactcccctatgtcgggaaagagctcaacatgatcataatgctgccagacgagacaaccgatctccggactgtagaaaaggagcttacatacgaaaaatttgtggagtggaccagattggatatgatggatgaggaggaggtggaggtgtcccttccgagattcaaactcgaggagtcctatgacatggaaagtgtactccgaaacttgggtatgacggatgcctttgagctcggaaaagctgacttttctggcatgtctcagactgatctctcgctgtccaaagtcgtacacaagagctttgtggaagtgaatgaggagggcactgaggcagctgccgctacagctgctataatgatgatgcgatgcgccaggttcgtgcccaggttttgtgcagatcatccctttctcttctttattcagcacagcaaaaccaatggtatactattctgcggccgattcagcagcccctag

SEQ ID NO: 240191 - DNA, 1131 bp, Artificial Sequence
  Description of Artificial Sequence: Synthetic coding sequence
atggacgtgttagcggaggcgaatggaactttcgccttaaaccttcttaaaactttgggcaaggataactcgaaaaatgtgttcttcagcccaatgagtatgagctgtgccttggccatggtctacatgggcgctaagggaaacaccgcagcccagatggctcagatcctcagttttaataagtcaggcggagggggagacatccaccaaggttttcaatcactgctgacggaggtgaataaaaccggcactcagtatctcttgcgcatggcaaaccgcctgttcggtgagaaatcttgcgattttctgtcttcctttcgcgactcttgccagaaattttatcaggcagagatggaggagctcgactttattagtgcggtggagaagtcaaggaaacatatcaatacatgggtagccgaaaagactgaggggaaaatcgctgagttgctttcaccaggcagtgttgatccccttactagactggttttagtgaacgctgtgtatttccgcggaaactgggacgaacagtttgacaaagaaaacaccgaagaaagactttttaaagtttcaaagaatgaggaaaagcctgtgcagatgatgttcaaacagtccaccttcaaaaaaacttacatcggtgagatttttacccagattctggtccttccctacgtggggaaggagctgaatatgataatcatgctgcctgatgaaactaccgacctgcgcacagttgaaaaggagctcacctacgagaagtttgtagagtggactagacttgatatgatggatgaagaggaagtcgaagtgtctctgcctagattcaagcttgaagagtcctacgacatggagtctgtcctccgcaatctggggatgacagatgcattcgagttgggtaaggccgatttctccggaatgagccaaaccgatctctccctctcaaaagtggttcacaaatcctttgtagaagtgaacgaggagggtacggaggccgctgccgctaccgctgccataatgatgatgcgttgcgccaggtttgtgcctaggttttgcgctgaccacccttttctgtttttcatccagcattccaaaaccaacggcatcctcttttgcgggagattcagttccccatag

SEQ ID NO: 240192 - DNA, 1131 bp, Artificial Sequence
  Description of Artificial Sequence: Synthetic coding sequence
atggacgttttggcggaagcaaacggaacttttgcccttaacctcttgaagactttagggaaagataatagtaagaacgttttctttagtcctatgtcgatgagttgcgcacttgcaatggtgtacatgggagccaaaggcaacacagctgctcagatggctcagatcctgtcctttaacaagtctggaggcggaggagacatccatcagggtttccagtcactccttaccgaggtgaataagactgggactcagtacctgctacggatggccaatagactcttcggcgaaaagagttgcgatttcctttcttctttccgcgacagctgtcaaaaattttaccaggcggagatggaagaactggactttatctcggcggtggagaaaagccggaagcacattaacacatgggtggctgaaaaaacggaaggcaagatcgcagaactgctaagcccaggcagtgtggacccgctcacacgcctagtgctcgtgaatgctgtttactttcgaggcaactgggatgagcaattcgataaggagaataccgaagagcgcttattcaaagtgtcaaagaatgaagaaaaaccagtgcagatgatgtttaagcagtccacattcaaaaagacctacattggggaaatttttacccagatcttggtgttgccatacgtgggtaaggagttgaacatgattattatgctccctgacgaaacgactgatctgcgcaccgtggagaaagagctgacgtacgaaaagttcgtcgagtggacaaggcttgatatgatggacgaggaggaggtcgaagtgtcactccctagatttaaactggaagagtcatatgacatggaatccgtgctgagaaacctcggcatgacagacgccttcgagctgggaaaggccgacttcagcggcatgagtcagaccgacctgtctctcagcaaggtcgtacataagagtttcgtagaggtcaacgaagagggcacggaggctgccgcagcgaccgcagcaattatgatgatgcggtgcgctagattcgttccaaggttctgtgctgatcaccctttcctttttttcattcagcacagcaaaactaacggcattctgttttgcggacgtttctcttccccatag

SEQ ID NO: 240193 - DNA, 1131 bp, Artificial Sequence
  Description of Artificial Sequence: Synthetic coding sequence
atggacgtactggctgaggccaacggcactttcgccctcaatctgttgaagactttaggaaaagataatagtaaaaatgtttttttttctccaatgtctatgagctgtgctctggcaatggtgtatatgggtgcaaagggcaataccgctgcccagatggcacaaattctgtcgttcaataagagcgggggagggggagatatccaccaggggtttcagtcgctgctgactgaagtcaacaagactggcacccagtatctgctccgcatggcaaacaggttgtttggggagaaaagctgcgactttctctcatcctttagggactcttgccagaaattctaccaggctgagatggaggagttagattttatctccgcagtagagaagagccgtaagcacatcaacacttgggtggccgagaaaactgaagggaagattgccgagttgttgtcccctggctccgtagaccctttgacccgtttggtgctcgttaacgccgtgtacttccggggtaactgggacgaacagttcgacaaggaaaatactgaagagcgactgtttaaggtgtctaagaatgaggagaagcctgtgcagatgatgtttaagcagagcacctttaagaagacctatattggagaaatttttacccagatcctggtgttgccctatgtgggaaaggagctgaatatgatcatcatgctgccggacgagacgaccgatctgcggaccgtggagaaggaattgacctacgagaagttcgttgaatggacccgtcttgacatgatggacgaggaagaggttgaagtgtcactcccgaggtttaaattggaggaatcctatgacatggaaagcgttttgcggaatctgggcatgactgacgcctttgaactgggcaaagccgacttttcagggatgagccagactgacctttccctaagcaaagtagtgcataagtcctttgtagaggttaatgaggagggcactgaagcagccgcagccacggcagccataatgatgatgagatgtgcgaggttcgttcccaggttctgtgccgatcatccgttcctctttttcatccagcatagtaaaaccaatggcattctgttctgcggtcgcttttcttctccctag

SEQ ID NO: 240194 - DNA, 1131 bp, Artificial Sequence
  Description of Artificial Sequence: Synthetic coding sequence
atggacgtgttggctgaggccaatggcaccttcgctctgaatctgctgaaaacgctggggaaggataactccaaaaatgtgttcttcagccccatgtcgatgtcatgtgcattggccatggtctacatgggagctaaaggcaacaccgccgctcaaatggcccagatcctctcattcaacaagtccggaggcggaggcgacatccaccaaggcttccagagcctgttgaccgaagtgaacaaaactggtacccagtacctactccgcatggccaaccgcctgttcggcgaaaaaagctgcgattttttgtctagttttagagattcctgtcagaaattctatcaggcagaaatggaagagctggattttatatccgcagtggaaaagagtcgcaaacacataaacacctgggtcgcggagaagacagagggcaaaattgctgagctcttatctcctggctctgttgaccctcttaccagacttgtcctggtgaatgcagtgtactttcgcggaaactgggatgagcagttcgacaaggaaaatactgaggagaggctatttaaagtgtctaaaaatgaagagaaaccagtgcagatgatgttcaagcagagtacattcaaaaagacctatataggggagattttcacccagattcttgttctgccgtatgtcgggaaagagctgaacatgattatcatgctgcccgacgaaaccacggaccttagaactgtggaaaaagagctgacttatgaaaaattcgtcgagtggacaaggttagatatgatggacgaggaagaggtagaagtgtcccttccaaggtttaagctggaggagagttacgacatggagtctgtgctgaggaatctcgggatgacagacgcctttgaactggggaaagctgatttttcggggatgagtcagacagatttatccctgagtaaggttgtccataaatcttttgtcgaagtcaacgaggagggaacggaggcagctgccgcaaccgccgctattatgatgatgcggtgcgcgcgtttcgtgcctaggttttgcgcagaccaccccttcttgtttttcatccagcacagcaagaccaatggaatcctattctgcgggagatttagttctccatag

SEQ ID NO: 240195 - DNA, 579 bp, Artificial Sequence
  Description of Artificial Sequence: Synthetic coding sequence
atggacgtcttggcagaggccaacggcacatttgctctgaaccttctgaaaacgctgggtaaggataacagtaagaacgtgtttttttctccaatgtccatgagttgtgccctggccatggtttacatgggtgcgaagggcaacaccgccgctcaaatggcccaaatcctgtccttcaataagagtggcggaggtggcgatattcaccagggtttccagagcttgttgaccgaggttaataagaccgggacccagtacctactgcggatggcaaatcgagagagctatgatatggaaagcgtgcttcgcaacttgggaatgaccgacgcatttgagttgggaaaggctgacttttccggcatgtcgcagaccgatttgtctctgagtaaagtcgtacataagtccttcgtggaagtcaatgaggagggcacagaggcggcagcagccacagccgctataatgatgatgcggtgtgcacgttttgtcccgcgattctgtgctgatcaccccttcttattttttatccaacactccaagacaaatggaattctgttctgtggcaggttttcttctccctag

SEQ ID NO: 240196 - DNA, 1143 bp, Artificial Sequence
  Description of Artificial Sequence: Synthetic coding sequence
atggcgtctctggcagcggctaatgcagaattttgtttcaacttattcagggagatggacgacaaccagggaaatggaaacgtgttcttctcctctctcagtctcttcgccgcactagctttggtgcggctgggcgctcaggacgactccctgtcacagatcgacaaactcctgcacgtgaacaccgcatctggttacggtaacagctctaactctcagtccggcctgcagtctcagctcaaacgcgtgttctccgatatcaacgccagtcacaaagattacgatttgagcatcgtgaacggactatttgccgagaaagtgtatggcttccataaagattacatagaatgcgcagaaaagctctacgacgccaaagtggagcgtgtggacttcacaaaccacctagaggatacacgaagaaacatcaacaaatgggtggagaatgagacccacggcaagatcaaaaatgtgattggggaaggcggaatctctagctctgctgtaatggtccttgtgaacgcagtgtacttcaaaggcaagtggcagagtgcattcactaaaagtgagacgataaattgccattttaagagccccaagtgcagcgggaaggccgtcgccatgatgcaccaggaacgaaagtttaatcttagcgttattgaggaccccagcatgaaaatcctggagctaaggtacaatgggggtattaatatgtacgtcctacttcccgaaaatgatttatctgagattgaaaataagctgacatttcagaatctcatggagtggacgaatccaaggcgaatgacctcaaaatacgtcgaggtgttcttcccacagttcaaaatcgaaaaaaactacgagatgaagcagtatctgagggcactgggcctgaaggacatttttgacgaaagcaaggccgacctgtccggaatcgcctctggtgggcgtctgtatatctccaggatgatgcacaagtcctatattgaagtgaccgaagaggggacagaagctacggccgctactggctctaatatcgtggaaaagcaactgccccagtccaccctgttcagagccgaccacccttttctttttgtgattcgcaaggatgacatcattcttttctcagggaaagtcagttgtccctag

SEQ ID NO: 240197 - DNA, 1143 bp, Artificial Sequence
  Description of Artificial Sequence: Synthetic coding sequence
atggccagcttggcggcagcgaacgcggagttttgctttaacctgtttagggaaatggatgataatcagggtaacggcaatgtcttttttagttctctcagcctgtttgctgctctggcgttggtgcgcctgggagctcaggacgacagcttatcccagatcgacaaactgcttcatgtaaacaccgccagtggctatggaaactcgtctaacagccagtccgggctgcagagtcagctcaagcgagtattctccgacattaatgcgtcccacaaagactacgatctgtctatcgtaaacggcctgttcgcagagaaggtgtacggattccataaagactatatcgaatgcgcggagaaattatacgacgctaaagtggagagggtagacttcactaatcatcttgaggacacccgaaggaacatcaacaagtgggtcgagaacgagacccatggtaagataaagaacgttatcggtgaggggggaatttcttcatcggccgtaatggttctggtgaatgccgtgtattttaagggtaaatggcagagtgccttcaccaagagcgaaacaatcaactgtcacttcaaatcccctaaatgctctggaaaagcagtggcgatgatgcaccaggaacgaaaatttaacctcagtgtgatagaggatcccagcatgaaaattctcgagctgcgatacaatggagggattaatatgtacgtgctcctgcccgagaatgatctgtcagagatagagaacaaactgacctttcagaacctgatggagtggactaacccccgacggatgactagtaagtacgtcgaagtcttttttccgcagtttaagatcgaaaaaaactacgaaatgaaacagtacctgagagctttaggtttgaaagacatatttgatgaaagcaaagccgacctgagcggcattgctagcggagggaggctgtacattagccggatgatgcacaaatcatacatcgaggtgacagaggagggaacagaagccacagcagctactgggtctaatattgtcgaaaaacaattgccacagtctacgctgtttcgagccgaccatccctttctgtttgtgattcgcaaagacgatatcatcctgtttagtggaaaggtcagctgtccttag

SEQ ID NO: 240198 - DNA, 387 bp, Artificial Sequence
  Description of Artificial Sequence: Synthetic coding sequence
atggcctccctcgcggctgccaacgctgagttttgtttcaacctgttcagggagatggacgataaccaaggaaacggaaacgttttttttagctcattgtccctttttgccgctctggcgttggttcggcttggggcacaggatgactctctgtcccagattgacaagctgttacatgtgaacactgcaagtggttacgggaattctagtaacagccagtccggcctgcagtcacagttaaagcgcgtgtttagcgacatcaacgctagtcacaaagattacgatctcagtatcgttaatgggttattcgcggaaaaggtgtatggcttccataaagactacatcgaatgtgccgagaagctgtacgatgccaaggtggagcgctag

SEQ ID NO: 240199 - DNA, 387 bp, Artificial Sequence
  Description of Artificial Sequence: Synthetic coding sequence
atggcctctctggccgctgcaaatgccgagttctgttttaatttattcagggaaatggatgacaaccagggaaatgggaacgtctttttttctagtttaagtctgttcgctgctctggctttggttcgtcttggcgctcaggatgactcgctctcccagattgataagctgcttcatgtgaatacggcatcaggctacgggaatagtagcaactcgcagtcaggccttcagagtcagctaaagagagtgttctcagatatcaatgccagccataaggattacgacctgtcaatcgtgaatggtttgttcgcggagaaagtgtacggttttcataaggactacatcgaatgcgccgaaaaactctacgatgctaaggtggaacgctag

SEQ ID NO: 240200 - DNA, 498 bp, Artificial Sequence
  Description of Artificial Sequence: Synthetic coding sequence
atggctagtttggctgccgcaaatgctgaattctgcttcaacctctttagggaaatggatgataaccaaggaaacggcaacgtgttcttctcttctctttcacttttcgctgctctggccctggtgcgccttggagcgcaggacgacagcctctctcaaattgataaattgctgcatgtcaataccgcctcaggttacgggaactcatccaactcacagagcggactgcagagccagttgaaacgcgttttctccgacatcaacgccagtcacaaggactacgacttaagcatcgtcaatgggctgttcgctgagaaggtttacggttttcataaagactatatcgaatgcgcagaaaaattgtacgatgccaaggtggagcgcgtggattttactaaccacctggaggacacaaggcgcaatattaacaagtgggtggaaaacgagacccacgggaaaatcaagaacgtcatcggagaaggaggcattagtagttag

SEQ ID NO: 240201 - DNA, 1092 bp, Artificial Sequence
  Description of Artificial Sequence: Synthetic coding sequence
atggcgtcactggcagcagcaaacgctgagttttgttttaatcttttccgcgagatggacgacaatcagggtaacggaaacgtcttcttttctagtctatcactgtttgcagcgctggctttggtgagattgggagcgcaggatgacagcctaagtcagattgacaagagtggcctacagagccaattaaagcgcgtgttttcagacataaacgcctcccataaggattacgacttgtctatcgtcaatggcctgttcgcagaaaaggtgtatgggtttcacaaagactacatcgaatgcgcagagaagctctacgacgcgaaggtggaacgcgtcgacttcacaaaccatctggaggacactagacggaacatcaataaatgggttgaaaatgagacacacggtaagattaaaaatgttattggcgaggggggaatcagttcaagcgccgtgatggtgctagtgaacgctgtgtatttcaaaggcaagtggcagtcagcatttacaaaatcagagacaattaactgtcattttaagagccctaagtgctcggggaaggcggtggctatgatgcatcaggaaaggaaattcaacctgagcgtaatcgaagatccctctatgaaaattctcgaacttaggtataacgggggtatcaacatgtacgtcctcctcccagagaacgatctaagcgagatcgaaaacaaactaaccttccaaaacctaatggaatggacaaatccccgacgcatgacttctaaatacgtcgaggtttttttccctcaatttaaaattgagaagaattatgaaatgaagcagtaccttagagctctgggactcaaggatattttcgatgagtccaaggcagacctcagcggaatagcatcgggagggcgtctgtatatttcacgtatgatgcacaagtcatatatcgaagtgactgaagagggcaccgaagccactgctgccacagggtccaacatcgtggaaaaacagctcccacagagcacactgttccgtgctgatcacccctttctcttcgttatccgcaaggatgacatcatcttgtttagcgggaaggtgtcatgtccgtag

SEQ ID NO: 240202 - DNA, 1143 bp, Artificial Sequence
  Description of Artificial Sequence: Synthetic coding sequence
atggctagtttggctgcggcaaatgcagaattctgttttaaccttttccgagaaatggacgacaatcagggtaacggtaatgtctttttttcatcgctgtccttgttcgccgctctcgcattagtgcgcctgggtgcccaggatgattctttgtcacagattgacaagctgctgcacgtgaatacggccagcgggtacggaaactcttctaattctcagagcggactgcagtcgcagctcaagcgcgtgttcagtgacattaatgctagtcataaggactacgacctgagcatcgtgaatggtctgttcgccgagaaggtttatggatttcacaaggactacattgaatgcgccgaaaaactttatgatgcaaaagtcgagagggtagatttcaccaatcacctcgaagatacacggagaaacattaataagtgggttgaaaacgagacgcacggcaagattaaaaatgtgattggggagggtgggatcagttcttcggcagtgatggttctggttaatgccgtgtatttcaaagggaagtggcaatctgcattcactaagtccgagacaatcaactgccatttcaaatctccgaagtgtagtggaaaagctgtggcaatgatgcaccaggagcggaagttcaatctgtccgtgatcgaggaccctagcatgaagatcctagagctgcggtataatggcggaatcaacatgtacgtcctcctccctgagaacgacctctctgaaatcgaaaacaagctcactttccagaacctgatggaatggacgaaccccaggcggatgacaagcaagtacgttgaggttttcttcccccagtttaagatcgagaagaactatgaaatgaaacagtatctgagagctctggggctgaaagatattttcgatgagtccaaggcagacttgtctgggatcgcatccgggggtaggctctacattagccggatgatgcacaagtcgtatattgaggtgactgaagaagggactgaggctactgctgccaccggatccaatattgtggaaaaacagctgcctcagagtactctgttccgagctgaccaccccttcctcttcgttatacgcaaagatgatatcatacttttttccgggaaggtgagctgcccttag

SEQ ID NO: 240203 - DNA, 1125 bp, Artificial Sequence
  Description of Artificial Sequence: Synthetic coding sequence
atggatgacctttgtgaggcaaacgggaccttcgccattagcctattcaagattctcggggaggaggataatagtcggaacgtgttcttttctcccatgtctatctcaagcgcgctcgctatggttttcatgggggctaaggggagcaccgccgctcagatgagtcaggccctttgtctctataaagacggggacatccatcggggttttcagtcgctgttatccgaggtgaatagaacaggcacccagtacctcttgcgtactgcaaaccgactattcggcgagaaaacctgtgatttcttgccagatttcaaagagtattgccagaaattttaccaagccgagttggaagagctttctttcgccgaggataccgaagaatgccgcaagcacatcaacgattgggtcgccgagaaaacggagggcaagatttcagaggtgctcgacgctggtacagtcgatccactcacgaaattggtcctggtcaacgccatatacttcaagggaaaatggaatgagcagttcgacagaaaatatacaaggggaatgttgtttaagacaaatgaagagaaaaagaccgtacagatgatgtttaaagaagccaaattcaaaatgggctacgcagacgaagtgcatacccaggtgctcgagttaccatatgtggaggaagaactgagtatggtgatcttactgccagacgacaatacagaccttgccgtagtagaaaaagctctgacgtacgaaaagttcaaggcctggacgaacagcgagaaactgaccaaaagcaaagttcaagttttcctgccacgcctcaaacttgaagagtcctacgacctggaacctttccttcgaagacttggtatgattgatgcatttgatgaagccaaagcagactttagcggcatgtcaaccgaaaagaatgtgcctctatctaaggtagctcacaagtgttttgttgaggttaatgaagaaggcactgaagctgcagctgcaactgcggtcgtgcgtaactcccggtgttctaggatggagccaagattctgtgcggatcatccttttctgtttttcattcgccatcataagaccaactgcatattattctgtgggcgttttagtagtccttag

SEQ ID NO: 240204 - DNA, 1125 bp, Artificial Sequence
  Description of Artificial Sequence: Synthetic coding sequence
atggacgacctatgtgaagccaacgggacattcgccatttccctgttcaagattttgggggaggaggacaattcccgaaacgtctttttttcaccgatgtcaatatcctctgcactggcaatggtgtttatgggtgctaaggggagcacagccgctcaaatgagtcaggccctttgtctgtataaggacggggatattcatcgcggtttccaatccctgttgtccgaagttaatcgaacaggcacacagtacctgctgaggaccgctaataggctgttcggcgagaagacttgcgatttcttacccgattttaaggagtattgtcagaagttctaccaggctgaactagaggaactttcatttgccgaagatactgaagaatgccggaaacacatcaacgactgggtcgcagagaagacagagggtaaaatcagtgaagtccttgacgccggtacggtggacccattaaccaagttagttttggttaatgctatttactttaagggaaaatggaatgaacaattcgatcgaaaatacacccgcggaatgttattcaagacaaatgaagaaaagaagaccgtccagatgatgtttaaagaagctaagtttaaaatgggctacgccgacgaagtgcacacgcaagttctcgaactcccttacgtcgaggaggaacttagcatggtgatactgctgccggatgataatactgatctcgcagttgtcgaaaaggcccttacctatgagaaattcaaggcctggactaactctgaaaagttgacgaagtcaaaagttcaggtctttctgcctcggttgaaactggaagagtcatacgatctggagccatttctacgtcgcctcggtatgatcgatgctttcgacgaagcaaaggccgatttctcaggaatgagcaccgaaaagaacgtgccactatctaaagtggcccataagtgcttcgtcgaagtgaacgaggagggtacggaagcagctgcagcgaccgctgttgttcggaactccagatgcagccgcatggagcctaggttctgtgcagatcatcccttcctatttttcatccgccaccataagactaactgcattcttttctgtggtcgcttttcctccccatag

SEQ ID NO: 240205 - DNA, 495 bp, Artificial Sequence
  Description of Artificial Sequence: Synthetic coding sequence
atggatgacttgtgcgaggcaaacggaacctttgcaattagcctgttcaagatcctgggagaggaagacaattctcgcaatgtgtttttctcccctatgtctatttcctcggcactagccatggtgttcatgggtgctaaggggtcgactgcggctcagatgagtcaggcattatgtctatataaggacggtgacatccatcggggattccagtctcttctcagcgaagtaaatcgaacgggcacccagtacctgttgcggaccgccaacaggttatttggtgaaaaaacctgcgacttcctccctgacttcaaggagtactgtcagaaattttaccaagcagaactggaggagttgagtttcgccgaagatacggaagaatgccgtaaacacatcaatgattgggtggccgaaaaaactgaggggaaaataagcgaagtgctcgatgctggcacggtcgaccctctcacaaagttggtcttagtgaacgcctag

SEQ ID NO: 240206 - DNA, 375 bp, Artificial Sequence
  Description of Artificial Sequence: Synthetic coding sequence
atggatgacctttgtgaggccaatggtaccttcgctatctcgctttttaagattctgggtgaagaggataactccaggaacgtgtttttctctcccatgtctataagcagtgccctggccatggtatttatgggcgcaaaagggagtacagcagcccaaatgagccaggctttgtgtctgtataaagacggcgacatccaccgcggatttcagtccctactgtcagaagtgaatcggaccggtacgcagtatctgctgagaactgccaaccgtttattcggtgaaaagacctgtgatttcctcccagatttcaaggagtactgtcaaaagttctaccaggccgagctggaagagctgtcatttgcagaggactag

SEQ ID NO: 240207 - DNA, 579 bp, Artificial Sequence
  Description of Artificial Sequence: Synthetic coding sequence
atgctattcaagaccaacgaggagaaaaagaccgtgcagatgatgtttaaggaggccaaattcaagatgggctatgccgacgaggtgcatacgcaagtccttgagctgccttacgtagaagaggagctgtctatggtgattctgcttcccgacgataacaccgacctagcagtcgtggagaaggctttgacttacgaaaaatttaaagcctggactaatagcgaaaagcttactaagtcaaaagtgcaagtgttccttccaagacttaaacttgaagagtcttacgatttggagccgtttctgaggcggctggggatgatcgacgctttcgatgaagctaaagccgacttttctggtatgtctaccgagaagaacgtgccgttatcaaaagtggctcataagtgcttcgtggaggttaatgaagaagggacagaagccgctgccgcaactgccgtggtgcgaaactccagatgttcaagaatggagccgagattttgtgcggaccaccccttcctcttttttatcagacatcataagactaattgtattctgttttgcggaaggttcagttccccctag

SEQ ID NO: 240208 - DNA, 1131 bp, Artificial Sequence
  Description of Artificial Sequence: Synthetic coding sequence
atggaaacactcagcaatgcttccggcacgttcgccataaggctcctgaaaatcctgtgtcaggataatccctcccacaacgtcttctgcagcccagtctccattagtagcgccctcgccatggttttgctgggcgcaaaaggaaatacggccacccaaatggcccaggccctttcccttaacaccgaggaggacattcacagagctttccaatcgctcttgacagaggtgaataaagcagggacacaatacctcctgaggacagcgaatcggctgttcggagaaaagacctgccaatttttaagcacatttaaggaaagctgcttgcagttttaccatgccgaactgaaagaattgagttttatccgcgctgccgaggaatcacggaagcacatcaacacatgggttagcaagaaaactgaggggaagattgaggaattacttcctggctctagtatagacgccgaaacacgcttagtgctggttaacgctatttatttcaagggtaaatggaacgagccgttcgatgagacatacacgcgcgagatgccctttaagataaatcaagaggagcagcgacctgtacagatgatgtaccaagaggccaccttcaaattagcgcatgttggtgaggtccgcgcacagctactggaactcccttacgcgcgtaaggaactgagcctacttgtgctgctccctgatgatggcgttgagctgtccacggtcgagaagtcactgacattcgaaaagctgaccgcctggactaaacctgactgcatgaagtccactgaggtggaagtgctgctacccaagttcaaactccaagaggactacgacatggagtcagtgctaaggcatcttggcattgtggacgcatttcagcaaggaaaagctgatctgagcgcaatgtctgccgaacgggacctttgcctgtccaaattcgtccacaagagctttgtggaggttaacgaagaaggtacagaagcagccgctgcctccagctgttttgtggttgcagagtgctgcatggagtccggccctagattctgtgcagatcatccttttttgttctttattaggcacaacagagccaacagtatcctgttttgtggccgtttctcctccccgtag

SEQ ID NO: 240209 - DNA, 1104 bp, Artificial Sequence
  Description of Artificial Sequence: Synthetic coding sequence
atgtcctccccccctcccgcacgaagtggcttttaccggcaggaggtgacgaagaccgcatgggaagtgcgggctgtctatagggaccttcaacctgtcggtagcggcgcttacggcgctgtatgttccgccgttgacggcaggacaggggcaaaagtcgctatcaagaaactctacaggccctttcagagcgagcttttcgctaaacgggcataccgggaactccggctgcttaagcatatgcgccatgagaacgttatcggccttttagatgtgtttactccagatgagacactggacgatttcacagacttttacctagttatgccattcatgggtaccgacttagggaagttaatgaagcacgagaaactaggggaggatcgcatccaattcttagtgtatcagatgcttaagggcctgcgctatatccacgccgcaggcatcattcaccgggacttaaagccagggaacctcgccgtgaacgaggactgtgagttaaagattttggacttcggactagcaaggcaagccgattctgagatgacaggctacgtggtcacacgctggtacagagccccagaggtgattctaaattggatgcggtatacgcagaccgtggacatatggtccgtgggctgtatcatggccgagatgatcaccggtaaaaccctatttaagggttcggaccacctggaccagctgaaagagattatgaaggtgaccggtactcctcctgcggaattcgtccagcgcctgcaatcggacgaggccaagaactatatgaagggtcttcccgaattagagaaaaaagatttcgctagtattctgaccaacgcctctccgctggccgtgaacttgcttgagaaaatgttggtgctggacgctgagcagcgggtgactgccggagaggcactggcccacccttatttcgaatccctgcacgatactgaagatgagccacaagtgcagaagtatgatgattccttcgacgacgttgacaggactctggatgaatggaagcgggtcacatacaaggaggtgctgtcctttaagcctcctagacaactgggagctcgtgtatctaaggagacacccctgtag

SEQ ID NO: 240210 - DNA, 1500 bp, Artificial Sequence
  Description of Artificial Sequence: Synthetic coding sequence
atgaagcattcccttaacgcgctcctaatcttcctcattataacaagcgcttggggcggttccaaaggaccactcgatcagctcgaaaagggcggagagacagcacaatctgcagatccccagtgggaacaactgaataataagaatttgtccatgccactgcttcctgcagactttcataaggagaacactgttacaaacgattggatccctgaaggtgaagaagacgatgactatcttgatttagagaagatctttagtgaggatgatgattacatagatatagtggacagcctgagcgtaagccctactgactctgatgtttctgctggaaacatacttcagttgttccacgggaaaagtaggatccagaggctcaacattctgaacgctaaattcgcgttcaatctgtaccgcgtactaaaggaccaagtgaacactttcgataacattttcatcgccccagttgggatcagtacagcgatggggatgatctctttgggattgaagggggaaacacacgaacaagtccatagcattctgcattttaaagatttcgtgaacgcttcctcaaaatacgagattaccacaatccacaatctgttccgtaagctcacccacaggctgttccgcagaaacttcgggtataccctaagatctgttaacgacctgtacattcagaaacagttccccattctgttggatttcaaaaccaaagtgagggagtactatttcgcagaagctcagatcgccgatttctctgacccagcatttatcagcaaaaccaataaccacattatgaagttaactaagggcctcataaaagatgctttggagaatattgaccccgcaacacagatgatgattctgaactgcatttacttcaagggatcctgggtgaacaaatttcctgtcgaaatgacgcacaaccacaactttcggttaaatgaaagagaggtcgtgaaggtttctatgatgcagactaagggaaacttcctcgctgccaatgaccaggaacttgactgtgatatcctgcagttagaatatgtggggggaataagcatgctgattgtagtgccacacaagatgtccgggatgaagacgctggaagcccaactcaccccaagggttgtcgagagatggcagaagagcatgacaaaccggactcgagaggtcctgctccccaagttcaagctcgaaaaaaattacaacttagtcgaatccttgaaactcatgggcataagaatgctgtttgataagaatgggaatatggcgggtatctcggatcaaaggattgcaatagacctcttcaagcaccaggggaccatcacggtgaacgaagaaggaacgcaggccactacagtaacaaccgtgggtttcatgccactgtcaacacaagtgagattcactgtggaccgccctttcctgttcctgatctatgagcataggacaagctgtcttctcttcatggggagagtggcgaacccctctcggagctag

SEQ ID NO: 240211 - DNA, 1197 bp, Artificial Sequence
  Description of Artificial Sequence: Synthetic coding sequence
atgaactggcacctccctctgttcttactggcttctgtgacactgccttccatttgtagccactttaacccactgagcctcgaagaactgggttctaatacaggaattcaagtgtttaaccagatcgtgaaatcacgacctcacgacaacatcgtcatttcacctcacggcattgccagcgtactcgggatgctgcaactgggcgctgatggacgcacgaagaagcagctcgcgatggtgatgcggtatggggtcaatggcgtaggcaagatactcaagaaaatcaacaaggcaattgtcagcaagaagaataaagatatagttaccgtggctaacgctgtttttgttaagaacgctagtgagatcgaggtccctttcgtcacccgtaacaaagatgtgtttcagtgcgaagtgcgcaacgtgaattttgaggaccctgcctccgcatgcgactctatcaatgcctgggtaaaaaatgaaacgcgagacatgatcgataacttattgtctccggacctaatcgacggagtcttaactaggctagtattagtgaatgctgtgtattttaaaggcctgtggaagagtcgttttcagcccgagaatacaaagaaaagaacctttgtggccgctgacggcaagagctatcaggtgcccatgcttgcccaactgagcgtgtttcgctgcgggtccaccagtgcccctaacgatctctggtacaacttcatcgagcttccttaccacggtgagtcaattagtatgctaatcgccctgcccacagagtctagtactccattgtccgcaatcatacctcatatctcaactaaaacaatagattcctggatgtcaatcatggtccccaagcgcgtgcaagttatactgccaaaattcaccgctgttgcgcagacagacctgaaggagccccttaaggtcctaggaataaccgatatgttcgatagtagcaaggccaatttcgcgaagatcactacgggctccgaaaacttacacgtatctcacatcctgcagaaggccaagattgaagtgagcgaagacggaaccaaagctagcgcagctaccactgcgattctcatcgcgcgaagttccccaccctggttcattgtcgatcgtccattcctcttcttcattcgacataaccctactggcgctgtgttgtttatgggccaaataaataagccctag

SEQ ID NO: 240212 - DNA, 1194 bp, Artificial Sequence
  Description of Artificial Sequence: Synthetic coding sequence
atgaactggcacctgcctttattcctcctggccagcgtgacccttccctctatttgttcacactttaatcccctcagcctcgaagagctggggtctaacactggcatccaggtctttaaccagatcgttaagtcccggcctcacgataacatagttatctctccacacggtatagcctccgttttgggaatgttacagttgggcgcagatggacgcaccaagaaacagctggcaatggttatgcgatacggcgttaatggcgtcggtaaaatactgaaaaagataaacaaagcaatcgtttcaaagaagaataaagatatcgtgacagtcgcaaatgccgtattcgtaaagaatgcctctgagattgaggtcccatttgtaacccggaataaggatgtgtttcagtgcgaggtgcgcaacgttaactttgaagaccccgcaagcgcctgcgactccattaatgcctgggtcaagaatgaaacccgggacatgatcgacaatctgctgtcccctgacttgattgacggagttcttaccagactggttctggtcaacgctgtgtactttaagggcctttggaaatcccggtttcagccagagaatactaagaagaggacatttgtagccgctgatggcaagagctaccaggttcctatgctggctcagctcagtgtttttaggtgcggatccaccagtgctcctaatgacctgtggtacaattttatcgaactcccttatcatggagaatcgatctcaatgttgattgccctccccacagagagctcgacccctctttcagctatcattcctcacatttccactaagacaatcgacagttggatgtcaatcatggttcccaagcgtgtgcaggtgatcctgccaaagtttacagctgtggctcagaccgatttgaaagagcctctgaaggttcttgggattaccgatatgttcgatagcagcaaagcgaacttcgcaaagattacacggagtgagaatctgcatgtgagccacatactgcagaaggctaaaattgaggtgtccgaggacggcaccaaagccagcgctgctaccacagctatcctaatagcgaggtccagcccaccctggtttatagtagatcgaccctttctgttcttcatccgtcacaacccaacgggcgctgtgttgtttatgggccagatcaataaaccctag

SEQ ID NO: 240213 - DNA, 1194 bp, Artificial Sequence
  Description of Artificial Sequence: Synthetic coding sequence
atgaattggcacctgcctctgtttctgctcgcgagcgtaaccttacctagtatttgttctcactttaacccactttcacttgaagaattgggctccaatacggggatccaagtgtttaaccaaatagtaaaatctcgccctcacgacaacattgttatcagtcctcacggcatcgcgtccgtcctgggaatgttacagctgggagcagacgggcgaactaaaaaacagttagctatggttatgaggtacggggtcaatggggtgggcaaaatactgaaaaaaattaataaggccatcgtgagtaaaaagaacaaggacatcgtgactgtggctaacgccgtttttgtgaaaaacgcctcagagatcgaggtgcccttcgtcactcgcaacaaagatgtttttcagtgtgaagtaagaaacgtcaacttcgaggatccagcgagcgcctgcgactctatcaacgcttgggtaaagaatgaaactcgggacatgatagacaacctgcttagcccagaccttattgatggagtgttgacccgcctggtgttagtaaatgcagtttacttcaagggcctatggaagtcacgctttcaaccagaaaataccaagaaaagaacgtttgtagccgcagacggtaaatcataccaagtaccgatgctggctcagctgagtgtttttaggtgtggttcaacgagcgcccctaatgatctatggtacaactttatcgaactgccttatcacggagagtcaattagcatgctgatcgcactgcctacagaatccagtacacccctatctgccatcataccacacatttctacaaagaccatcgattcttggatgtcaattatggtgcccaagagagtgcaggttattctgccaaaatttacagctgtggcccagacagatctgaaagagcccctgaaagtgctgggcattaccgacatgtttgacagcagcaaggcgaatttcgccaagattacaaggtccgaaaatctgcacgtcagtcacatacttcagaaagccaaaattgaggtatcagaggacggcaccaaagcctctgctgcaaccactgcaattctgatagccagaagcagtcctccgtggttcatcgtggaccgccctttcctcttctttatccgtcacaaccccaccggtgccgtactgttcatggggcagattaacaagccttag

SEQ ID NO: 240214 - DNA, 129 bp, Artificial Sequence
  Description of Artificial Sequence: Synthetic coding sequence
atgaactggcacctaccacttttcttactggcaagtgtgacccttccgagtatctgctcccacttcaaccccttaagcctggaagagttgggcagtaacacagggattcaagtgttcaatcaaatctag

SEQ ID NO: 240215 - DNA, 831 bp, Artificial Sequence
  Description of Artificial Sequence: Synthetic coding sequence
atgaactggcatctgcctctgtttttgcttgcctccgtgacactgccaagtatctgttcacattttaaccctctaagtctggaggagctcggctctaacaccgggatccaggtatttaaccaaatcgtcaagagtcggcctcatgataacatcgttatctctccccatgggattgcgagtgtcttaggaatgttgcagctcggagccgacggaaggaccaagaaacagctcgcaatggttatgcggtacggagtcaatggggtgggcaagattctcaagaagataaacaaggctatcgtgagcaagaagaacaaagacattgttacagtcgcgaatgcagtctttgtgaagaacgcatccgagattgaggtcccctttgtcacaagaaacaaagacgtcttccagtgcgaagtacggaatgttaactttgaggatcctgcaagtgcatgtgacagtattaatgcatgggttaaaaatgagacccgagatatgatcgacaacctattgagccctgatctcattgacggcgtgctgactcgcctcgtgctggtaaacgccgtgtactttaagggtctgtggaagtcaaggtttcagcctgagaacacaaagaagcggaccttcgtagcagccgacggcaagagctatcaggttccgatgctggctcagctctccgtgtttaggtgcggatccactagtgctcctaacgatctgtggtacaattttatcgaactgccctaccacggtgagtcgatatctatgttgattgctttaccgaccgaatcaagcacccccctgtccgcaatcatcccccatatctctaccaaaacctag

SEQ ID NO: 240216 - DNA, 1230 bp, Artificial Sequence
  Description of Artificial Sequence: Synthetic coding sequence
atgtccgactgccgatccagcttagtggaaggcactatgaactggcacctaccactgttcctcttagcttccgtgacactccccagcatctgctctcacttcaacccgctgtcgttggaggagcttggctcaaacaccggtattcaggtttttaatcagatagttaaatcccgaccacacgataatatcgtgatctccccccacggtatcgccagcgtcttgggaatgctccaattaggcgcagacggcaggaccaaaaagcagctggctatggtgatgagatacggcgtaaacggcgtggggaaaattctaaaaaaaattaacaaggccattgtatccaagaaaaacaaagatattgtaacagtggccaacgccgtgtttgtaaaaaatgcatctgaaattgaggttccattcgtcacgcgcaacaaggacgtgtttcagtgtgaggtccgcaacgtgaatttcgaagaccccgcttctgcatgcgactccatcaacgcttgggttaagaatgaaaccagggacatgatcgataatctccttagcccagaccttatcgacggagtccttacaagattagtccttgtgaacgccgtgtactttaaaggattgtggaaatcacgcttccagcctgagaacaccaagaagcggacattcgtcgccgctgacggcaagtcataccaggtgcctatgttggctcagctgtccgttttcagatgcggcagcacctctgctcccaatgacttgtggtataactttatagagcttccctatcacggtgaaagtatcagcatgctgatagctctacccacagagagctcaacccctttaagtgcgattatcccgcatatctcgacaaaaactatcgattcttggatgtcaatcatggtcccaaaacgtgtgcaggtcattttgcccaaatttactgctgtcgcccagaccgacctcaaagagcctctgaaggtcttgggaatcacggacatgttcgactcgtcgaaggcaaactttgccaaaataactcgttctgagaatcttcatgttagccatattcttcagaaggccaaaatcgaggtgtctgaggacggcacaaaagctagcgctgccaccactgccatactgattgcacgtagttcacctccatggttcatcgtcgacagaccattccttttcttcattaggcataacccaacaggggctgtattgtttatgggccagatcaataagccttag

SEQ ID NO: 240217 - DNA, 264 bp, Artificial Sequence
  Description of Artificial Sequence: Synthetic coding sequence
atgaactggcatctgccactctttctgctggcctctgttactttgccaagcatttgcagccacttcaacccactgtccctagaagaactcggaagtaataccggaatccaggtgttcaatcagatcgtgaaaagtaggccacacgacaatattgtaatctcacctcacggaatagccagtgtgctcggcatgttgcaactaggcgcagacggacggaccaaaaagcagctggccatggtgatgcggtacggcgtgaacggctag

SEQ ID NO: 240218 - DNA, 1257 bp, Artificial Sequence
  Description of Artificial Sequence: Synthetic coding sequence
atgcaggctttagtgctgctgctctgcattggcgctttgcttggtcattcctcgtgtcaaaaccccgcttcgcccccagaagagggttccccagacccggattctaccggggcactcgtagaagaggaagatcctttctttaaggttcccgtcaacaaacttgcagcagccgtctctaacttcggctatgacctgtacagggtgcggagttctaccagcccaacaacaaacgtgttgttatctccactgagcgttgcaactgcacttagtgctctctcacttggcgcagaacagagaaccgagtctattatccacagggccctgtactacgatttgatcagttcacctgacattcatggcacatataaagagcttctcgacacagttacagctcctcagaagaacttgaagtcggccagcagaatcgttttcgagaaaaaactgcggattaagagcagttttgtagcgccactggaaaaaagctatgggaccaggccgcgagtcctgacaggcaacccgagacttgacttgcaggaaatcaacaactgggtacaggcgcagatgaaggggaaacttgcaagatcaacaaaggagatcccagatgaaatcagtatccttctgcttggggtggctcatttcaagggccagtgggtcaccaagttcgattcccggaaaacaagtctcgaagacttttatcttgacgaggagcgcacagtgcgcgttcctatgatgtcggaccctaaagctgtgctgcgatacgggctcgacagcgacttgtcatgtaaaatcgcccagctacctctgacaggcagtatgtcaattatcttcttcctgcccctcaaggtgacacagaatctgacattaattgaggagtcattgactagtgagttcatccatgatattgacagggaactgaagacagtgcaggctgttttgactgtccctaaactgaaactttcatacgaaggcgaggtcactaaaagcctccaggagatgaagctgcaatctttgtttgactcacctgacttcagcaaaattaccggcaaaccgataaagctgacacaggtagagcatagggcgggattcgagtggaacgaggacggtgccggtacaactcccagcccgggtctgcaacccgcacacctcacattcccactcgactatcacctgaaccagccttttatctttgttctgcgggacacagataccggagcgttactgtttattggtaagatcttggatccgagaggaccttag

SEQ ID NO: 240219 - DNA, 1233 bp, Artificial Sequence
  Description of Artificial Sequence: Synthetic coding sequence
atggcgttcctcggacttttttcacttctcgtcttgcagtcaatggctactggcgctacatttccagaggaggctattgctgacctgtccgtcaatatgtacaacagactgcgtgcgacgggagaagacgaaaatattctgttctctcctctatccatagctctggcaatgggcatgatggagcttggggctcagggctccacacaaaaggaaatacggcactcaatgggctacgactctctgaagaacggagaagagttttcattcctgaaggaatttagtaatatggtcacggccaaagagtcacagtacgtgatgaagatagctaattcattgttcgtgcaaaatggattccatgttaatgaggagttcctacaaatgatgaagaagtactttaatgcagccgttaaccacgtggattttagccaaaacgtggccgtggctaattacatcaacaagtgggtggagaataacaccaataatctcgtgaaagatctcgtgtcccccagagactttgacgctgccacctatctggctctgattaatgcagtttacttcaaaggtaattggaaatctcagttcagacctgaaaacactagaacgtttagcttcaccaaggacgatgaaagtgaggtccagataccaatgatgtaccagcaaggcgagttttactacggggaattctctgacgggtcaaacgaggcaggcggaatctatcaggtactggaaatcccttatgaaggcgatgaaatcagcatgatgttagtgctatcccgccaagaagttccccttgccacgctggaacccctagtgaaggcgcagttggttgaggagtgggcaaattccgtcaagaagcagaaagtggaagtttatctgcccaggtttacagttgagcaggaaattgatctgaaggacgtccttaaggctttgggcatcaccgaaatttttatcaaggatgccaatcttaccggactctctgacaacaaggagatcttcctgtcaaaagctattcacaaaagctttctcgaggtgaatgaggagggttcggaggcggctgctgtctctggaatgattgccattagtcgcatggccgtactatatccccaggtcatagtggaccacccatttttttttctcatcagaaatagacgaacgggtaccatcctttttatggggagggtgatgcatcccgagactatgaacacctctggacatgactttgaagaactgtag

SEQ ID NO: 240220 - DNA, 1233 bp, Artificial Sequence
  Description of Artificial Sequence: Synthetic coding sequence
atggcttttcttgggttgtttagtctgctcgtgttgcaatccatggctacgggagctacctttcctgaggaggcgatcgccgatcttagtgtgaacatgtataacaggctccgagcaacaggggaggacgagaacatcttgtttagccccctctctatcgcgttggctatgggtatgatggagctgggagcccaggggtcaactcaaaaagaaatcagacactctatgggatacgacagtctgaaaaacggcgaggagtttagttttcttaaagagttttctaacatggtgacagctaaggagtctcagtacgtaatgaagatagcaaatagtttgttcgttcagaacggtttccatgtgaacgaggagttcctccagatgatgaaaaagtactttaatgcagcagtgaaccatgttgacttctcccaaaatgtcgctgtggctaactacatcaacaagtgggttgagaacaataccaataacctcgtcaaagatctggtatcaccacgcgacttcgacgccgctacatatctggccctgatcaatgcagtttatttcaagggaaattggaagtcgcagttccgccctgagaatactcggacctttagttttactaaggatgatgaatctgaagtccagatccccatgatgtatcagcaaggcgaattctattatggagaatttagcgacgggagtaatgaggccggaggtatttaccaggtgctcgagatcccgtacgagggggatgagatcagtatgatgcttgtcttatcaaggcaggaggtgccactggcgaccctggaacccctggtgaaagcccaactcgtggaggaatgggctaacagcgtgaaaaaacaaaaggttgaagtgtacctacctcggttcaccgtcgagcaagagattgacctgaaagatgtgctgaaagctcttggcatcacagaaatcttcatcaaggacgccaatctgaccggcctgtcggacaacaaggagatatttttatctaaagctattcacaagtcgtttctggaagtcaatgaagaaggctctgaagctgctgcggttagcggcatgatagcaatctccagaatggccgtgttatatccgcaggttatcgtagaccacccctttttcttcctgatccggaatagacgtactggaacaatcctctttatgggacgggtgatgcaccctgaaactatgaatacaagtgggcatgatttcgaggagctctag

SEQ ID NO: 240221 - DNA, 738 bp, Artificial Sequence
  Description of Artificial Sequence: Synthetic coding sequence
atggctttccttgggctgtttagtcttctggtcctgcagagcatggccactggagcaacttttcctgaggaagctatagccgacctgtctgtaaacatgtacaatcgactgcgcgctaccggcgaggacgagaatatcttattctccccactgagcatcgctttggcaatggggatgatggaattgggcgctcaggggtcaactcaaaaggaaatccgtcactcaatgggttacgatagtttgaaaaacggcgaggagttctccttcctgaaggagtttagcaacatggtgactgcaaaggaatcacagtatgtgatgaaaattgcaaactccctcttcgtgcagaatggttttcatgtgaatgaagaattccttcagatgatgaaaaaatactttaatgctgctgtgaaccacgttgactttagccagaatgtcgccgtcgcaaactatatcaacaagtgggtcgagaataatacaaacaatttagtgaaagacctggtaagccccagggactttgacgcagcaacctaccttgccctcattaatgccgtgtactttaaggggaactggaagtcacaatttagaccggagaacacaagaacatttagtttcactaaggatgacgagtccgaggtgcagattcccatgatgtatcagcaaggtgagttttactatggggagttcagtgatggaagcaatgaagccggtgggatctaccaagtactggaaatcccgtag

SEQ ID NO: 240222 - DNA, 483 bp, Artificial Sequence
  Description of Artificial Sequence: Synthetic coding sequence
atggcattcttgggcctgtttagcctgctggtgctgcagtcaatggccaccggcgctacattcccagaagaggcaatagccgacctctccgtaaacatgtacaatagattgcgcgctaccggggaagacgaaaacattctgttctcccccttgagtatcgccctggccatgggcatgatggagcttggagctcagggcagcacccagaaagagattagacactctatgggatatgactcacttaaaaatggcgaggagttctcattcttgaaggagttctccaatatggtcacggctaaagagtcccaatatgtgatgaaaattgccaactccctattcgtgcaaaacggcttccatgttaatgaagagtttttacagatgatgaaaaaatacttcaacgctgctgtgaatcacgtcgacttttctcagaatgtggcagtggcaaattacattaataagtgggtcgagaacaacacaaactag

SEQ ID NO: 240223 - DNA, 591 bp, Artificial Sequence
  Description of Artificial Sequence: Synthetic coding sequence
atggtagggggactgaagaggaaacattccgatctggaagaggaggaggagcgctgggaatggtctccagccggattgcagagttatcaacaagcactcctaagaatttccctcgataaggttcagcgcagtctgggtcccagagctccgagtttgcgtagacacgttctgatccataatacccttcagcagctacaggccgcattaaggttagctcctgcacctgctctgcccccagaaccgcttttcctgggggaggaggacttttccctgagtgccaccatcggatccatcttgcgggagctggacacatccatggatggtactgagcccccacagaaccctgttaccccccttggactccagaacgaagtgccccctcagccagatcccgtttttctggaggccctcagttctaggtacctgggtgattctggactagacgatttttttctggatatcgatactagcgcagtcgaaaaggaacccgcaagggccccacctgaacctcctcacaacctattctgcgcgccaggatcctgggagtggaatgaactggaccatattatggaaatcatccttggttcatag

SEQ ID NO: 240224 - DNA, 591 bp, Artificial Sequence
  Description of Artificial Sequence: Synthetic coding sequence
atggttgggggtttaaagagaaaacatagcgacctggaagaggaagaggagagatgggagtggtcaccggctggcctgcagtcttatcagcaggctcttctccggattagcctggacaaagtgcaaaggtctctcggcccaagagcccctagtctgagacgacacgttctgattcataacactctacagcagttgcaggccgctttgaggctcgcccctgccccagccctcccaccagagccactattcctaggtgaggaggacttctctctgagcgctacaataggcagtatcctgcgggagctcgacactagcatggacggtactgagcctccccaaaatcctgtgacacccctcggactgcagaatgaggttccacctcagcctgacccggttttcctcgaggccctgtcctcgcgatatctcggcgacagtggtcttgacgatttttttctagatatcgatacaagtgccgtcgagaaagagccagcccgtgcccctcccgagccacctcacaacctgttttgcgcacccggaagttgggagtggaacgagctcgaccatatcatggaaattattctcggttcctag

SEQ ID NO: 240225 - DNA, 369 bp, Artificial Sequence
  Description of Artificial Sequence: Synthetic coding sequence
atgaagctgctaacagggctcgtcttttgctctttggtcctgggcgtctcatccaggagctttttttctttcctcggggaagcctttgacggcgctcgcgatatgtggcgcgcatattctgacatgagagaggctaattacattggtagcgacaagtattttcatgctaggggtaactacgacgctgctaaaagaggtcccggaggggcatgggcagccgaggtgatcactgatgcccgagaaaacatccaaaggttcttcgggcacggagctgaggactctctcgctgaccaggcagccaatgaatggggaaggtctggcaaggaccctaatcactttaggcctgcagggctgccggaaaagtattag

SEQ ID NO: 240226 - DNA, 369 bp, Artificial Sequence
  Description of Artificial Sequence: Synthetic coding sequence
atgaagctccttactgggttggttttttgctcgttagtacttggcgtgtctagtcggtccttcttcagcttcctgggagaggcttttgatggggctcgcgatatgtggcgcgcttacagcgatatgagggaggctaactatataggatcggacaaatatttccacgcccgtggcaactatgatgccgctaagcgcggacccggaggagcatgggctgctgaggtcattaccgacgctcgcgagaacatacagagatttttcggtcacggggcagaggattcattagctgatcaagcagcaaacgaatggggtcggtctggaaaggatcctaaccacttccggccagccggtttgccagagaagtattag

SEQ ID NO: 240227 - DNA, 369 bp, Artificial Sequence
  Description of Artificial Sequence: Synthetic coding sequence
atgaagctcctgacaggcttggtcttttgctcactggtgttgggggtaagctctcgctccttcttttctttcctcggcgaggcttttgatggcgctagagacatgtggagggcgtattccgatatgcgcgaagctaactatattggatcggataaatattttcatgccagaggaaattacgacgccgctaagcgcggaccgggaggggcttgggctgcggaggtgatcaccgatgcacgtgaaaatattcagagattttttgggcacggtgcggaggactcgctggctgatcaggcggcaaacgaatggggcaggagtgggaaagaccccaatcactttaggcctgctgggttaccggagaagtattag

SEQ ID NO: 240228 - DNA, 369 bp, Artificial Sequence
  Description of Artificial Sequence: Synthetic coding sequence
atgaagctgctgaccggcctggtgttctgctccttagtgctctctgtgtcctcacgatctttttttagctttctgggcgaggcctttgacggggctagagacatgtggcgggcatatagcgatatgcgagaagctaattatataggatcagacaaatattttcatgccaggggcaactatgacgcagctaagaggggtccaggaggcgcttgggcggctgaggtgattagtaacgctagagagaacatccaacggttaactggcaggggggcagaggacagcctggccgatcaggccgctaataagtggggcaggtccgggagggacccaaaccacttccgcccagcagggctccccgagaagtattag

SEQ ID NO: 240229 - DNA, 252 bp, Artificial Sequence
  Description of Artificial Sequence: Synthetic coding sequence
atgaagttgctgaccgggttggtgttttgctccctcgttctctctgtcagcagccggtctttcttttcttttttgggagaagcgtttgacggcgctcgggacatgtggagagcctactccgatatgagggaggccaattatatcggttcagataaatacttccacgccagaggtaattacgatgccgctaaacgcggtcctggaggagcttgggcagccgaggttattagtctgttcagcgctgagctgtag

SEQ ID NO: 240230 - DNA, 369 bp, Artificial Sequence
  Description of Artificial Sequence: Synthetic coding sequence
atgaagctgcttactggactcgtcttttgctcactggtgctgtcagtgagcagtcgatccttcttctcctttcttggagaggccttcgacggtgcgagggatatgtggcgtgcctatagcgatatgcgcgaggctaactatattggttctgataagtactttcatgccagaggaaactatgacgccgcaaaacggggtcccggtggtgcatgggccgcagaagtaatctccaatgcaagagaaaatatccaacgcctgactggccgaggcgcagaggatagcctcgccgatcaggccgctaacaagtggggacggtctggcagggatccgaatcacttccgccctgctggtctgcctgaaaaatactag

SEQ ID NO: 240231 - DNA, 369 bp, Artificial Sequence
  Description of Artificial Sequence: Synthetic coding sequence
atgaagctgctaaccggcctagtgttttgtagtctggtgctatcagtgtctagtcggagttttttctctttcctcggagaggcattcgacggtgctagagatatgtggagggcgtactccgatatgcgcgaggccaactatattggctcagacaaatacttccacgcgaggggcaattatgacgctgctaagcggggtccgggaggtgcttgggctgcagaggtcatctctaacgcgagagagaacattcaaaggctgactggtaggggcgcagaggattctctggcggatcaagcagcaaataaatggggtcgttcgggtagagatcccaatcacttcagacccgcagggctgccggaaaaatattag

SEQ ID NO: 240232 - DNA, 393 bp, Artificial Sequence
  Description of Artificial Sequence: Synthetic coding sequence
atgaggttatttaccgggattgtgttctgcagcttggtcatgggagttacatcagaatcatggcgctcattctttaaagaggccctccagggtgtgggcgacatggggagggcttactgggacattatgatctctaatcaccagaattccaatcgctatttgtatgccagaggcaattacgacgccgcacagagaggccctgggggtgtgtgggcggctaaactgatttcaagatcccgcgtataccttcagggcctgatcgattgttacttgtttggtaattccagcaccgtgctggaggacagtaagtctaatgagaaggccgaagaatggggtcgatctggaaaagaccccgaccgcttccggcctgacggcctgcccaaaaagtactag

SEQ ID NO: 240233 - DNA, 1278 bp, Artificial Sequence
  Description of Artificial Sequence: Synthetic coding sequence
atgggtgaagacgcggctcaggctgaaaagttccaacaccctgggtcggatatgcggcaagaaaagccgtcatctccttctccaatgccatcatccacaccttcacctagccttaacctgggcaataccgaagaggccattagagataattcccaagtaaacgcggttacagttctgacgctgctggacaaattagtgaacatgctcgacgcggtccaggagaaccaacacaagatggagcagaggcagatctccctggaggggtcagtgaagggaattcaaaacgatttgacaaaattaagcaagtaccaggcgtcaaccagcaatactgtgagcaagctgttagaaaagagcagaaaggttagtgcccatacacgggctgtaaaagagagaatggacaggcaatgtgcccaggttaaacgcctggagaacaaccatgcccagctcctgaggcgcaaccattttaaagtactgatattccaggaggaaaatgaaatcccagcatctgtgttcgtgaaacagccagtgtcgggagcggtcgagggcaaggaggagctgccagacgaaaacaaaagtctggaggagacactgcatactgtggatctttcatcagacgatgatctacctcacgacgaggaggctttggaggacagcgctgaagagaaggtggaggagtcaagagccgagaagatcaagcgctcctcactgaagaaggttgatagcctgaagaaagctttttcacggcagaatattgagaagaaaatgaacaaactcgggaccaaaattgtctctgtggaaaggcgcgagaagattaaaaaatctttgaccagcaatcaccaaaagatttcctcgggcaaatcttcacccttcaaagtgtcccctttaacattcggtagaaaaaaggtacgcgaaggcgagtctcacgcagagaacgagacgaagtccgaggatctgccttcgtctgaacagatgcccaatgaccaggaggaggaatcgttcgctgaggggcatagcgaggcgtctctagcttccgccttggtagagggggagattgctgaggaggctgctgagaaggcaacatctcggggttctaacagtggaatggactctaatatagatctgactattgtggaagacgaagaagaggagtccgttgcgctggagcaggcccagaaggtgcggtatgagggcagctacgcactgacttctgaggaggctgagcgaagcgacggagatccagtgcaacctgcagtgcttcaggtccaccagaccagctag

SEQ ID NO: 240234 - DNA, 1290 bp, Artificial Sequence
  Description of Artificial Sequence: Synthetic coding sequence
atggctcagccaggcacactgaacctaaataatgaagtggtgaagatgcgaaaggaggttaaaaggattagagtgcttgtgatcaggaagcttgtgcggtctgtgggccgactgaaatccaagaaaggaacagaagatgccctattgaaaaaccagcgaagggcccagcggctattagaggaaatccacgccatgaaggagctcaagcccgacattgtcaccaagagcgccctcggcgatgatataaattttgagaaaatattcaaaaaaccagattcaactgccactgaacgcgctatagccaggctagccgtgcaccctctcctcaaaaagaagattgatgtcttgaaggccgctgttcaagcgttcaaagaggcgaggcagaatgtggctgaagtagagagctcgaagaacgcatccgaggacaaccattccgagaacaccctttactctaacgataatggcagcaacctgcagcgcgaggcgacggtgatcagcgaacagaaagtgaaggaaaccaagattcttgccaaaaagcctatccacaactctaaggaaaaaattgcaaagatggagcacggaccaaaagccgtcactatcgccaacagtccctcaaaaccttccgagaaggattctgtagtgtcacttgagtcccaaaagacacctgccgaccctaagctgaagaccctatcccaaacaaagaaaaataaaggaagcgattcttcattgagcgggaattccgacggcggtgaggaattctgcgaggaggaaaaagaatatttcgatgattccaccgaggaacggttctacaaacagtcatccatgtctgaagactcagactcaggggacgattttttcattggaaaggttaggcgcacgagaaaaaaggagtcatcttgccactccagcgttaaagagcagaagcccctggaaaaggtgtttctaaaagaggacacgggagagacccacggcgatacaagaaacgacaagatcaagcctagtactgagacacgcaagctggagtccgtcttctttcactctttgtctggctcaaaaagcagtagaagaaatttcaaagagcaggctcctaaaactagatccttggacttcccccaaaatgagcctcagataaaaaaccagttcaataagaaactgtcaggtcgattagagaacacaaagcagcagttgcagctcccgctgcacccaagctgggaggctagcagacgccgtaaagaacaacagtcaaatattgcggtctttcaaggtaagaagattactttcgatgattag

SEQ ID NO: 240235 - DNA, 1296 bp, Artificial Sequence
  Description of Artificial Sequence: Synthetic coding sequence
atgacggtgaagactgaagccgctaaaggcacactgacatattctcgtatgcggggaatggtcgccatcctcatagcttttatgaaacagcgtaggatgggcctaaatgacttcatccagaagattgccaataatagctacgcctgcaagcacccagaggtccagagtattttgaagattagtcagccgcaggaaccagaattgatgaacgccaaccctagccctcccccatcaccgtcccagcagattaatcttggtcccagcagcaatccgcatgctaagccttccgacttccacttcttgaaagtcatcgggaaaggctcattcggaaaggtgctcctggctaggcataaggcggaggaggtgttctacgcagtgaaagtactacagaaaaaggcaattctgaagaagaaagaggaaaaacacataatgagcgaacgtaacgttctattaaagaacgtcaaacatccattcttagttggactgcatttcagtttccagaccgcggataagctgtactttgtccttgattatattaacggaggggagctattttaccatctacagcgggagaggtgtttcttggagccacgggctcggttttatgccgcagagattgcctcagccttaggctacctccactccctgaacatcgtttacagagatctaaagcccgaaaatatccttttagatagccagggccatatcgtgttgactgacttcgggctgtgcaaggagaatatcgaacataattctacaacctccacattttgtgggacgcccgaatacctggctccagaggttctgcataaacagccctacgaccggactgtggactggtggtgcctgggcgcagtactgtatgagatgttatatgggctgccccctttctactccaggaatacagccgagatgtatgataacattttgaataaaccgcttcagctgaaaccgaacatcacaaattcagctagacatctgttggaggggcttcttcagaaagacaggaccaaacggctgggagccaaagacgatttcatggagatcaaaagccacgtattcttctctcttattaattgggatgatctgattaataagaagatcacaccgccttttaatccaaatgtaagtgggcctaacgatctgagacattttgaccccgagtttaccgaggagcctgtccctaactcaatcggcaagagccccgattctgttctggtcacagcatcagtgaaggaagctgccgaggccttcctagggtttagctacgctcccccaacagattccttcctttag

SEQ ID NO: 240236 - DNA, 1266 bp, Artificial Sequence
  Description of Artificial Sequence: Synthetic coding sequence
atgaaaccatccaagcggttcttcatctcccccccttcgagtaccgctttcatgaagcagaggaggatggggttgaatgactttatacagaaaatagcaaacaatagctacgcgtgtaagcatccggaggtccagtccatattaaaaatctcccagccccaagagcccgagctaatgaatgcaaacccaagcccacccccatctccaagccagcagatcaatcttggcccttcctcaaatcctcacgccaaaccgtccgattttcacttcctcaaagtcatcgggaagggctcctttggaaaagtgctgcttgctcgacacaaggcagaggaagtattttatgcagtcaaagtgttacaaaaaaaagcaatattaaagaaaaaggaagaaaagcatataatgtctgagagaaatgtcctactcaagaacgtgaaacatccattcttggttggcctccatttctcctttcagacagccgataagctctacttcgtgctggactatatcaacggtggcgaactattttatcatctgcagcgtgagaggtgctttcttgagcctcgggcaaggttttacgccgcagaaatcgccagtgcgctcggttatctccactctctgaatattgtttatcgggatctcaagcctgagaatatcttgctggatagccagggccacatcgtgctgacggatttcggcctttgtaaggaaaacattgaacacaattctacaacatccactttctgtgggacaccagagtacttagctcctgaggttttgcacaagcaaccttacgatcggactgtcgattggtggtgtctgggagctgtgctgtacgaaatgctctatggcttgcccccattctacagtaggaacacagcagaaatgtacgacaacatcctgaacaaaccactacagctgaagccaaatataactaattctgcacggcacctcctcgagggcttgttgcagaaagaccgcaccaagagactaggggctaaagatgatttcatggaaatcaagtcgcatgtcttcttctctttaataaactgggatgatttgataaataaaaagattacaccacctttcaatcctaacgtgtcagggcctaatgatctgaggcattttgatcccgaatttaccgaagaacctgttcccaactcaatcggtaagagtcctgattctgtgttggtgacagcttctgtaaaggaagccgcagaagcttttctgggttttagttacgcaccgccaactgatagcttcctttag

SEQ ID NO: 240237 - DNA, 1581 bp, Artificial Sequence
  Description of Artificial Sequence: Synthetic coding sequence
atggtaaataaagatatgaacggatttcctgtgaagaagtgttccgcgttccaattcttcaaaaagcgcgtccgacggtggataaagagcccaatggtgtccgtagataagcatcagagtcccagcctcaaatacacaggaagctctatggtgcatattccccctggcgagccggatttcgagagtagcctgtgtcaaacatgcctgggggaacacgcatttcagcgcggtgtgcttccccaggaaaacgagagttgctcatgggagacgcagtctgggtgcgaagtgcgggagccgtgtaaccacgctaatatcttaaccaagccagaccccagaaccttctggacaaacgacgatccagcctttatgaagcagcggcgtatggggctgaatgactttatacagaaaattgcaaacaacagctatgcttgcaaacaccctgaagtccagagcattcttaagatctcacaacctcaggaacctgagctaatgaatgcaaacccttctcccccaccaagtccaagtcagcaaatcaatctggggccatctagtaatcctcacgccaaaccatctgatttccactttctaaaagtgattggaaaaggatcttttggtaaggtgctcctggccagacacaaggccgaggaggtattctatgccgtgaaggtgttacagaagaaagcgatcctcaaaaaaaaggaagaaaagcatattatgagcgagcgcaatgtgcttctaaagaacgtcaagcatccctttctggtgggtctgcacttcagctttcagacagcagacaagctgtatttcgtcctggactatataaatggcggagagctgttctatcacctccagcgggagcgttgctttctggagcctcgcgcacggttttacgctgccgagatcgcaagcgctctcggatatttgcactcactgaatattgtgtaccgcgacctcaagcctgaaaacatcctgctcgactctcagggccacattgtcctgactgattttggtctttgcaaagagaatatcgagcacaactcgacaacctccaccttctgtggcacccctgagtacctggcccctgaggttctgcacaagcagccttatgaccgaacagtagattggtggtgtctaggtgccgtgctgtatgaaatgctgtacggcctgcctcctttctactcccgcaacacagccgagatgtacgacaatatcctgaataagccgctgcaactcaagcctaatattaccaatagtgccagacacctcctcgaaggtttactgcagaaggataggaccaagcgccttggcgctaaggatgacttcatggagatcaagagtcacgtttttttctcgctgatcaattgggatgacctgatcaacaaaaagatcacgccaccgttcaaccctaatgtgtccggtcccaacgatctgcgccactttgaccccgaattcactgaggaacccgtgccgaactctatcgggaaaagtccagatagcgtgctcgtgaccgccagtgtgaaagaagcagcggaagccttcctgggctttagctatgctccccctaccgactctttcctttag

SEQ ID NO: 240238 - DNA, 1338 bp, Artificial Sequence
  Description of Artificial Sequence: Synthetic coding sequence
atgggggagatgcagggcgctctggccagagctcgcctcgaatctctcctcagaccacggcataagaaacgagccgaagcacagaagaggtcagaaagctttctgctctctggcttggcctttatgaaacagcgtagaatggggcttaatgactttattcagaagattgctaataattcctacgcatgcaaacatcccgaggtccagtccatcctgaagatctctcagcctcaagaacccgagttaatgaatgccaatccctcacctccaccttctccttcacagcagatcaatctcgggcctagttctaatccacacgcgaagccgagcgacttccactttcttaaagtgatcggtaaaggaagcttcggaaaggtgctgcttgctcgacacaaggctgaagaggtgttttatgccgtgaaggtactgcaaaaaaaagctattctcaaaaaaaaggaggagaagcacatcatgtctgaacggaatgtgctgttaaaaaatgttaaacacccgtttcttgttggcctgcatttttccttccagaccgcagataagctatacttcgtactcgactatattaacggcggtgagctcttctaccacctccagagagaacgatgcttcttggagccaagagcgcgattctacgccgcagagatcgcaagtgctctcggttatctccacagccttaacatcgtgtacagggatctcaagccagaaaacattctactggattctcaaggccacatagtactcaccgactttggcctgtgtaaggagaatattgaacataactctacaacgagtactttctgcgggacacccgaatacctggccccagaagtccttcacaaacagccgtacgaccggaccgtcgattggtggtgcctgggcgctgttctctatgaaatgctctacggtctccccccattttacagcagaaacactgcggaaatgtacgataacatcctgaacaaacccctgcaactgaagcccaatatcaccaactctgctagacatctgctagaaggcttgttacagaaggaccgaacgaagagattgggagccaaagacgatttcatggagataaaatcgcacgtcttcttcagtctcataaattgggacgacctgatcaacaagaagataactcccccatttaatcccaacgtgtcgggcccaaatgatctcaggcatttcgaccctgagttcacagaagagcccgtgccaaactctattggcaaaagccccgactctgtcttggtgacagccagcgtcaaggaggcagctgaggcctttctgggcttctcttacgctccccctaccgatagtttcctttag

SEQ ID NO: 240239 - DNA, 435 bp, Artificial Sequence
  Description of Artificial Sequence: Synthetic coding sequence
atggtctcagtggacaagcatcagtccccttccctgaagtataccggcagttcaatggtgcacattcctccaggggagccagacttcgagagctctctctgccagacgtgcctcggagaacacgccttccagagaggggttcttccacaggagaatgagtcatgttcttgggagacacaatctgggtgtgaggtgagggaaccgtgcaatcatgccaacatccttacaaagcccgacccccgaacgttctggactaatgatgacccggcattcatgaaacagcgtcgaatggggctgaacgattttatacaaaagattgccaacaattcatacgcatgtaaacaccctgaggtgcaaagcatcctaaagatttcccagccccaggagcccgaactgatgaacgcaaatccaagtcctcccccttccccaagctag

SEQ ID NO: 240240 - DNA, 1380 bp, Artificial Sequence
  Description of Artificial Sequence: Synthetic coding sequence
atgtcatctcaaagctccagcctgtcagaggcctgcagccgagaggcgtactctagtcataattgggcactccccccagcgtcccgatcaaatccacagcctgcatatccgtgggctacacgcagaatgaaagaggaggccataaaaccccctctgaaagcctttatgaagcaacgtagaatgggccttaatgattttattcagaagatcgcaaataatagctacgcctgcaaacaccctgaagtccagtccattctcaagataagtcagccgcaggagcccgaacttatgaacgcgaatcctagtccgccaccttctcccagccaacaaatcaacctgggaccaagttcgaatccccacgctaagcctagtgatttccatttcttgaaagtgatcggaaaggggagctttggcaaggtactgctcgctcgccataaggccgaagaggtgttttacgccgtgaaagtgctgcagaagaaagcaatcctgaaaaagaaagaggagaagcacatcatgagcgagaggaatgttctcctgaaaaatgtcaaacacccatttctcgtgggccttcacttctcattccagaccgcagataaactgtacttcgtcctggactacattaatggtggagaactgttctatcatcttcagcgagagagatgcttcctagaacccagggcgcgattctatgccgctgaaattgctagtgccctgggatacctgcacagcctaaatatcgtatatcgcgacctaaaacccgagaacatcttgctggattcccaaggacacatcgtcctgaccgatttcgggctgtgcaaggagaacatcgagcacaatagcaccacctccacattctgcgggactcccgagtacctggcaccagaggttctgcataagcagccttatgatcgcacagtggattggtggtgcctcggggcagtgttgtatgagatgttatacggattaccgccattctacagtcgcaacacagccgaaatgtacgataatatactgaacaaacccctacagctgaaacctaacattacaaactccgctagacacctcctggagggcctgctccagaaggaccggaccaaacggcttggagccaaagatgattttatggagattaaatcccacgttttcttctctctcatcaattgggacgaccttattaacaagaaaatcacccctccctttaaccccaatgtgtctggtcctaacgatctgaggcatttcgatcctgaattcacagaggaacctgtgccaaacagcattggaaaaagcccggattccgtactggtgacagccagcgtcaaagaggctgctgaggccttcctgggattctcgtacgctcccccaacagactccttcctctag

SEQ ID NO: 240241 - DNA, 183 bp, Artificial Sequence
  Description of Artificial Sequence: Synthetic coding sequence
atggtgaacaaggacatgaatggatttcctgtgaagaagtgttcagcattccaattttttaagaaacgggtgcggagatggatcaaatcccccatggtttctgtcgacaagcaccagtcaccttctctgaaatataccggctcctcgatggtgcacatcccacccggagagcccgacttttag

SEQ ID NO: 240242 - DNA, 1284 bp, Artificial Sequence
  Description of Artificial Sequence: Synthetic coding sequence
atgcagggcctgctcacgtcaggaaggaagcccagcggtggaggacgctgtactggcagaggcggatggcgcggacaatggtgtctcaaaccctggatggggggagccgatcccccaactccaaccctgtcctgcctgttgcttcccgttccacctgagctccctgatcactgctataggatgaattcatctcccgctgggacgcctagtccgcagccatctcgtgctaacggcaatattaaccttggcccaagtgcgaaccctaacgcacagcccaccgattttgattttcttaaagtgatcggaaagggcaactacggcaaagtgctgctggccaagagaaagtccgacggggcattctatgccgtcaaagtcctccaaaagaagagtatcctcaaaaaaaaggaacagtcccacattatggcagagagatctgtcctcctgaagaatgtgcggcatcccttcctagtcggccttcgctatagcttccaaactccagaaaagttatactttgttcttgactatgtgaacggcggtgagctattctttcatcttcagagagaaaggcgcttcttggagcctagggcccgtttctatgcagctgaggtagcttccgcaatagggtacctgcacagtctcaacattatttacagagaccttaaaccagagaacattctgcttgactgtcaggggcacgtcgtgcttacggatttcggactgtgtaaggaaggcgtggaaccagaagacacgacatcgactttttgcggtaccccagaatatcttgcccctgaagttcttcggaaagaaccgtacgatagggctgtggattggtggtgtctgggtgctgttctgtacgagatgcttcatggactgccaccattttacagccaggacgtctctcagatgtatgaaaatatccttcatcagccactgcaaatccctgggggacgcaccgttgccgcttgtgacctgctccaatcactgttgcacaaggatcagcgacagcggcttggcagtaaggctgattttctcgagattaaaaaccacgtgtttttctcgcccattaattgggatgacctgtaccacaagcgtcttacacccccttttaaccccaatgtgactgggcctgccgatctgaaacacttcgatcccgaatttactcaggaagccgtgtctaagagcattggttgtacacccgataccgtggcctcaagctccggggcatcgtccgcctttctaggattttcatacgcccctgaggatgatgatatcctggactgttag

SEQ ID NO: 240243 - DNA, 1101 bp, Artificial Sequence
  Description of Artificial Sequence: Synthetic coding sequence
atgaatagcagccccgcagggacaccaagcccacagcctagccgtgcaaacggaaatattaatctggggcctagcgcgaaccctaacgcccagccaacagatttcgattttctgaaagtcatcggcaaggggaattacggtaaggtcctcctggccaaacgaaagagtgacggtgccttttatgctgtgaaagtcttacagaagaagtcaattttgaaaaaaaaggagtcccacatcatggctgagcggtctgtgctcttgaaaaacgtgaggcacccattcctagtgggcctccggtactcttttcaaaccccagagaagttatatttcgtgcttgactatgtaaacggaggagaactgttttttcacttgcagagggagcgacgttttctggagccaagggcaaggttttacgcagctgaagtcgcgtctgctataggctacctgcacagtttgaatatcatctatcgggatcttaagcctgagaacatcctcttggattgtcagggtcacgtcgtgctcaccgatttcggcctctgtaaggaaggggtggagccagaggacactacctcgacgttttgtggcacccctgagtacttggccccagaggtcctcaggaaagagccctacgaccgagcggtggattggtggtgtctgggagccgtactctacgagatgttgcacggcctgccgcctttctactcacaagacgtgtcccagatgtacgagaacatcttacatcagcctctgcagatcccaggagggaggaccgttgcggcttgcgacttgctgcaatctctactccataaggatcagagacagcgcctgggaagtaaagctgacttcctggaaattaaaaaccacgtgtttttctcccccatcaactgggacgacctgtaccataaaaggttaacccccccattcaatcccaacgttacgggaccagccgatctgaaacattttgatcccgagttcactcaggaggctgtcagcaaaagtatcggctgtacgcctgacactgtagctagctcgagcggggcatcctcggcattcctaggattttcctacgctcctgaagacgatgacatcctggactgctag

SEQ ID NO: 240244 - DNA, 1104 bp, Artificial Sequence
  Description of Artificial Sequence: Synthetic coding sequence
atgaactcttccccagccggaaccccatccccccagccctcccgggctaacgggaacattaacttgggtccatcagcaaaccctaatgcacagccgacggactttgacttcttgaaggtgataggcaagggcaactatggaaaagtcctgctggccaagcgcaagtccgatggcgctttctatgctgtaaaagtcttgcagaagaagtcgatactgaagaagaaggagcaatctcatatcatggccgagcggtccgttctcttaaaaaacgtccggcacccttttttggtgggactgaggtacagctttcaaacacccgagaaactatacttcgtcttagactatgtcaacggcggtgaactgttctttcacctccaacgagaaagaaggtttctggagcccagggctaggttttatgctgccgaggtggcgtccgctataggctacctccattcgcttaacatcatttatcgggacctgaagcccgagaatattctcctagactgccaggggcatgttgtgctgactgatttcggcctgtgcaaggagggagtggagcctgaagatacaacttccactttttgtggtaccccagaatatttggctcctgaagtcttgcgcaaagaaccttatgacagagctgttgattggtggtgtttgggtgctgtgctctatgagatgctccacggactgcctcccttctactcacaagacgtctctcagatgtatgagaatatcctacatcaaccactgcagatcccaggcggaagaacggttgccgcttgcgatctgctgcagtccctcctgcataaggatcagaggcagagactgggctctaaggcggacttccttgaaatcaagaaccacgtgttcttttcccctattaactgggacgatctgtaccataagcggctaacccctccttttaaccccaacgtcactggcccagccgacttaaagcatttcgatcctgagtttacacaggaagcagtgtcgaagtccatcggttgcactccggacacggttgcgtccagctccggagctagctcggccttcttgggcttttcatatgctcccgaagatgacgatattttagactgttag

SEQ ID NO: 240245 - DNA, 1104 bp, Artificial Sequence
  Description of Artificial Sequence: Synthetic coding sequence
atgaatagctcacctgccggtacccctagccctcagccatctagagctaatgggaacattaatctgggaccctctgcaaacccaaacgcccagccaactgacttcgatttcctgaaagtgataggcaaaggcaactacggtaaagtgcttctcgcaaaacggaagagcgatggagctttctatgcagttaaagtgcttcagaaaaaatctatcctcaaaaagaaggaacagtcacacataatggccgagagatctgtgctgctgaaaaacgttagacacccattcctggtgggcctgagatactcttttcaaactcccgaaaaactgtactttgtcctcgattacgtcaatggtggtgaactgttctttcatctgcagcgcgaaagaagattcctcgagcctcgggctcgtttctacgccgctgaggttgcctccgctattgggtatctgcacagtctgaacatcatctatcgggatctaaaacctgaaaatatcttgcttgattgccaaggccatgtcgtgctcaccgattttggtctgtgcaaggagggtgtggagcccgaggacaccactagcaccttctgtggaacacccgaatacctagccccagaggtgctgagaaaggagccttacgaccgggctgttgactggtggtgtctaggtgccgtgctttacgagatgcttcatggcctccccccattctactctcaggacgtgtctcagatgtatgaaaacatacttcatcagccgctccagattcctggcggacgcaccgttgcagcttgtgacctactccagtctctgctgcacaaggaccagaggcagagactgggctcaaaggctgacttcttagagatcaaaaaccacgtcttcttctccccgatcaactgggatgatctatatcacaagcggctcaccccccctttcaatccgaatgtcaccggtccagcagacctcaaacattttgaccccgagttcacccaagaggcagtatctaagtcaatcggatgcacaccggatacagttgccagcagcagtggagcctcatcagcctttctgggattttcctatgcgccagaagacgacgacattctcgactgctag

SEQ ID NO: 240246 - DNA, 597 bp, Artificial Sequence
  Description of Artificial Sequence: Synthetic coding sequence
atgaactcctccccagctggcacgccttcgccacagcccagcagagcaaatggcaacatcaatctgggacccagcgccaacccaaatgcccaaccaaccgactttgatttcctgaaagtcatcggcaaggggaactacgggaaggtcctactggccaagaggaagagcgatggtgccttttacgcagtcaaagtgttgcagaaaaagagcattctcaagaaaaaggagagccacatcatggccgagagaagcgttttactcaagaacgtgaggcatccattcctcgtcggcctcaggtactcattccaaacgcctgagaagctttatttcgtcctcgattacgtcaacggcggtgaactgtttttccacctgcagagggaaaggaggtttctggaaccaagagccagattttatgcggcagaagtggctagcgccatcggttacctccatagcctaaacatcatctatagagacttgaaacccgagaacatcctgctggactgccagggtcacgtggtcctgacagacttcgggctgtgtaaggagggcgtagaacccgaggacaccacctccacattttgtggtacgcctgagtag

SEQ ID NO: 240247 - DNA, 1104 bp, Artificial Sequence
  Description of Artificial Sequence: Synthetic coding sequence
atgaactcttcacccgcaggcaccccatcaccacagcctagcagagccaatggaaacatcaacctcggaccctccgcgaatcccaacgcccaacccaccgatttcgattttttgaaagtcatcggtaagggcaattatggcaaagtcttgctcgccaaacgtaagagcgacggagccttttacgctgtgaaagtgttacaaaagaaatccatactcaaaaaaaaggagcagagccacatcatggcagagaggtcagtgttacttaaaaatgtccggcacccgtttttggtcgggctccgatattcgtttcagacaccagaaaaactgtattttgtgctggactacgtgaacggtggcgagctgttctttcatcttcagcgcgaaagacgcttcctggagcctagggcccgattttatgccgctgaggtggcctccgccataggatacctgcatagcctgaatatcatttatagggatctgaagcctgagaacattctgctggattgccagggccacgtagtccttactgatttcggactttgtaaggaaggggtggaaccagaggatactacgagtacattttgtggcaccccggaatatctggctcctgaagtcttgaggaaggagccatacgaccgcgctgtcgactggtggtgcttgggcgcagtcctgtacgaaatgttgcacgggctccctccgttctacagccaggatgtctcacagatgtatgagaatatcctccaccagcccctacagatccccggagggagaacagtcgctgcctgcgatctactgcagtctctgctacacaaggatcagcggcagaggttgggttctaaagcggattttttagaaatcaaaaaccatgtgtttttcagcccaatcaactgggatgatctataccacaagaggctgactccaccctttaaccccaacgtgacaggcccagcagatctaaaacactttgatcctgagtttacccaggaagccgtgtcaaaatctatcggttgcacccctgataccgtggcatccagcagcggagctagctcagccttcctagggttcagctacgcaccggaggacgatgacattctcgattgctag

SEQ ID NO: 240248 - DNA, 1182 bp, Artificial Sequence
  Description of Artificial Sequence: Synthetic coding sequence
atgcagggcctcctgacatcaggaagaaagccctcgggtgggggtcgctgtactgagctcccggaccattgttatcgcatgaacagctctcctgcaggaacccctagccctcaaccttcccgggcaaacggcaatattaacctgggaccatccgccaatcctaacgcccagccgaccgacttcgacttcctgaaggtgatcggaaagggaaactacggaaaggtcctgttagccaaacggaagtctgatggcgcattttacgctgtaaaagtactgcagaagaagtctattctcaaaaagaaggaacagtcccatatcatggctgaacgctctgtcctgcttaagaatgtgagacacccctttctggtcggcttgagatactcatttcagaccccagaaaaattatatttcgttttggactacgtgaacgggggtgagttgtttttccatctgcaacgcgagaggcgtttcctcgagcccagagctagattctacgccgctgaggtcgccagtgccatcggatatctccattcccttaatataatatatagagacctgaagcccgagaacattctcctggactgccagggccacgtcgtcctaactgattttggcctttgcaaagagggagtggagccagaggatacaacctcgactttttgtggaacccctgaatacctcgcacctgaagtgctcaggaaggaaccgtacgacagagcagttgattggtggtgcctgggtgccgtcctttacgaaatgctccacggtttgccaccgttctacagccaggatgtcagtcagatgtatgagaatatccttcatcagccccttcaaatcccgggaggtcgaaccgtcgcggcttgcgacctgttgcagagcttacttcacaaagatcaaaggcagcgcctcggttcaaaagctgattttctcgaaatcaaaaatcacgtgttcttttcacctatcaattgggacgatctgtatcacaaacgcctcacgcccccattcaaccccaatgtcaccgggccagcagacctgaaacacttcgaccccgaatttacccaggaggccgtgtctaagtctatcggctgcactccagatacagtggcctcctcctcaggagcttcatccgcattcctcggctttagctacgcgccagaggacgatgatatattggactgttag

SEQ ID NO: 240249 - DNA, 1491 bp, Artificial Sequence
  Description of Artificial Sequence: Synthetic coding sequence
atgcagcgggaccatacaatggattacaaagagtcatgtccgtccgtgtccatacctagctccgatgaacacagggaaaagaagaagagattcacagtgtataaggtgctggttagcgtaggcagaagcgaatggtttgtttttcgccgatatgcagagttcgataagctgtataacacgctgaagaagcagttccctgcaatggccctgaagatcccagcaaaaagaatatttggagataatttcgatcccgacttcattaaacagagaagagccggattgaacgagttcattcaaaacctagtccggtatcccgaactctacaatcatccggatgtgagagcctttttacagatggattctccaaagcaccagtcggacccaagcgaagacgaagatgagcgctcttcacagaagctgcattccacctctcagaacattaatctggggccttccggcaacccacacgccaaacccacggacttcgacttcctgaaggtgattggcaaggggtcctttggcaaagtgctcctagcaaagaggaaactggatggaaagttttacgcagttaaggtgctgcaaaaaaagattgtgcttaaccgtaaggagcaaaaacatattatggccgagcgcaatgtgctacttaagaacgtcaagcatccgtttttggtgggacttcactacagcttccaaactactgagaagctctacttcgtgctggacttcgtgaacggaggagagttatttttccacctgcagagggaaagatccttcccggagcaccgtgctcgcttctacgccgcagagatcgcctctgcattggggtaccttcacagtatcaaaatcgtctacagggatctgaaacccgagaacatcttgcttgacagtgtcggccatgtggtactgactgactttggactgtgcaaggaaggcattgctatttctgataccaccacaacattctgcggcacgcctgaatacctcgctcccgaggtgatccgaaaacagccctatgataacaccgtcgattggtggtgtctaggcgctgtgctctacgagatgctctatgggctgccacctttctactgcagagatgtggccgagatgtacgataatattttgcataaacctttgtcacttcgtccgggtgtgagcctgacggcttggtctattctcgaggagctgctcgaaaaggatagacaaaatcggttgggagctaaggaagattttctggagatccagaaccatccattctttgagtcactgtcgtgggccgaccttgttcagaagaaaatccccccacctttcaatccgaacgttgccggacccgatgatattcgcaacttcgacacggcatttactgaagaaactgtaccatatagcgtctgtgtgtccagcgactactctattgtgaacgcttccgtgctcgaagctgacgacgcattcgtcggattctcatatgcgccaccttcagaggacttgttcctgtag

SEQ ID NO: 240250 - DNA, 1491 bp, Artificial Sequence
  Description of Artificial Sequence: Synthetic coding sequence
atgcaacgcgatcacactatggactataaggaatcctgtccctcggtcagtataccttcctctgatgagcaccgagagaagaaaaaaaggtttacagtctataaagtcctggtcagtgtggggagatctgagtggttcgtgttcagacgttacgctgaattcgataaactctataatacactgaagaaacaattccctgcaatggcccttaaaatcccggcaaagcggatttttggcgacaactttgacccagacttcatcaaacaacggagagctggattgaacgaattcatccagaatttggtgaggtaccccgaactgtataaccacccagacgtgagggcattccttcagatggattccccgaaacaccagtcggatcccagcgaagatgaggacgagaggagcagccagaagctgcactctacatcccagaacataaaccttgggccttcggggaatcctcacgcgaaaccaaccgacttcgactttctgaaggtcattggaaaggggtcttttgggaaggttttacttgccaaaagaaagctcgacgggaagttctacgcggttaaagttctacagaagaaaatagtgctcaacaggaaagagcaaaaacacattatggccgagagaaatgtcttgctcaagaacgtaaaacacccatttctcgtgggactccactattcttttcagaccactgagaagctctacttcgtccttgactttgtgaacggcggagagcttttttttcacctccagcgcgaacgcagttttcccgagcacagagcgcgtttttacgccgcagaaatcgcctccgccttaggttatctacactctatcaagatagtatatcgggatttgaagccagaaaacattctcttggatagtgtgggacacgtagtcctcactgattttgggctctgcaaggaaggcattgctatctcagatactacgaccacattctgtggaacacctgagtatctcgcccctgaggtgatacgaaagcaaccctacgataacaccgttgattggtggtgtttaggggctgttttgtatgaaatgctgtacggcttaccacctttctattgccgcgatgtcgctgagatgtacgataacattctgcataagccactgtcactacggcctggggtttctctaaccgcttggtctatcctcgaggaactgctcgaaaaggaccgccagaaccgcctgggtgccaaagaggatttcctggagattcagaatcatccgttcttcgaatctctctcctgggctgacttggtccagaagaagatccctcccccatttaaccccaatgtagctggccctgatgatatccgcaactttgacaccgcatttaccgaggagaccgtaccatactcagtttgtgtgtccagtgattactcaatcgtgaacgcaagcgtgctcgaagcagacgacgccttcgtgggcttctcctacgccccaccgtcagaggacctgttcctgtag

SEQ ID NO: 240251 - DNA, 1491 bp, Artificial Sequence
  Description of Artificial Sequence: Synthetic coding sequence
atgcagagagaccacactatggactacaaggagtcttgtccatcggtgagtattcccagtagcgatgaacatagagaaaagaaaaagcgctttaccgtgtataaagtgctagtgtcagtcggcagaagtgagtggttcgttttccgtagatacgcagaatttgacaaactgtataacacgctgaaaaagcagttccccgctatggcccttaagattcctgccaagcggatattcggagataacttcgaccctgatttcattaaacagcgaagagccggtctgaacgaattcatccagaacctcgtccgttaccccgaactgtacaaccatcccgatgttcgagcattcctgcagatggactctccaaaacatcagtctgatcccagtgaggatgaggacgaaagatcaagccagaaactccatagtactagccagaatatcaatctgggaccatcgggcaacccgcatgccaaacctactgactttgacttccttaaggtgatcggcaagggcagtttcggtaaagtcctcttggccaagcggaagctggacggaaagttctacgccgtgaaggtcctccagaagaaaatcgtccttaacagaaaagagcaaaaacacattatggccgaaaggaacgtgctcctaaaaaacgtcaagcacccttttttggttggattgcactattcattccagaccaccgagaagctatacttcgtgttggatttcgttaacggaggagagttattcttccatttgcaacgcgaaagatccttcccagaacatcgagcccgtttctacgcagccgagattgcttcggccttgggttatttgcactcaattaagatagtgtacagggatctgaagcccgagaacatcttattggacagcgttggacacgtcgttctgactgactttggcctgtgtaaggaaggcatagccatatcagatacaactacaactttctgcggcaccccagagtatctcgctcctgaggtgatacgaaaacaaccctacgacaacacagtggactggtggtgccttggagccgtgctgtatgagatgctgtacggcctgcccccattctactgccgcgatgttgcggagatgtacgataatattttgcacaaacccttgagccttcggcctggcgtatccctaactgcctggtccatcctagaggaacttttggagaaagacaggcagaacaggctcggggcaaaagaggacttcctcgagatacaaaaccatcccttttttgaatctctgagttgggccgacctggtccagaagaaaatccccccaccgttcaatcctaacgttgccggaccagacgatattaggaactttgacactgccttcactgaagagacagtcccctattccgtctgcgtatcaagtgactactccatcgtcaacgcctcggtgctagaggcagacgatgctttcgtcggtttctcatacgctcccccatctgaggacctttttctttag

SEQ ID NO: 240252 - DNA, 1491 bp, Artificial Sequence
  Description of Artificial Sequence: Synthetic coding sequence
atgcagcgtgaccatactatggattataaggagtcatgtccctctgtttcgattccctcctccgatgaacacagggagaagaaaaaacgctttaccgtctataaagtattagtgagcgttggaagaagcgaatggtttgtatttcgtcgctatgccgaatttgataagttgtataacaccctcaaaaaacaattccctgctatggccctgaaaatcccagctaaaaggatcttcggggacaactttgatccagactttatcaagcagagaagagctgggttgaatgaattcattcagaatctcgtcaggtaccccgagctgtacaaccaccctgatgtaagagccttcctacagatggacagtcctaagcaccagagtgatccgagcgaggacgaggatgaaaggtctagccagaagctacactctacgagccagaatattaacctaggccctagcggcaatccccacgccaagccaacagactttgactttctgaaggttattggaaaggggagttttgggaaagtgctgttggccaaaagaaaactcgacggaaaattttatgccgtgaaggttctacagaaaaaaatcgtgctgaataggaaagaacagaagcatatcatggccgaaaggaatgtgctgttaaagaatgtgaagcatccctttctcgtcgggttgcactacagcttccagactacggagaagctttattttgtgctggattttgtaaatggtggggagctgttcttccacttacaacgcgaaaggtcttttcctgagcaccgagcgaggttctacgcagccgaaatcgcatctgctcttggatatctccacagcattaaaatcgtctatcgagatctgaaacccgaaaacatcctcttagattctgtgggtcacgtggtcctcacagactttggtctgtgcaaagagggcatcgcaatctccgataccacaactaccttttgcggaactcctgagtacttggctcctgaggtcatcagaaaacaaccttacgacaataccgtggactggtggtgtctgggagccgtgctatatgagatgttgtatggattgccaccgttctactgtagggatgttgcagagatgtacgacaacattctccacaaacccctgtctctgaggcccggtgtcagtctaactgcgtggtccattcttgaggagctgttagagaaggatcgccagaaccgactgggtgcaaaagaggacttccttgaaattcagaatcaccccttctttgaaagcctcagttgggccgacctggtccaaaaaaagatccctccaccgttcaaccctaacgtggcaggacccgacgacatccggaacttcgatactgcctttactgaggaaaccgtgccttattccgtttgcgtctcttccgattactcaattgtgaatgcctcagtcctggaggccgatgacgcatttgtcggtttttcatatgcaccccctagcgaggatctgtttctgtag

SEQ ID NO: 240253 - DNA, 1395 bp, Artificial Sequence
  Description of Artificial Sequence: Synthetic coding sequence
atgcaacgagaccacaccatggattacaaagagagctgtccctcagtgagtatccccagctcagatgagcatcgtgagaagaaaaaacgttttaccgtctacaaagttctggtgagcgtcggaagatcggagtggttcgtttttcggaggtatgccgagttcgataagctctataataccctgaagaagcagttccctgcaatggccctcaagatccccgctaagcgaatctttggggacaactttgacccggactttatcaagcagcgcagggccggtctcaacgagtttatacaaaatctcgtgagatacccagagttgtacaaccacccagacgtgcgagccttcctccagatggacagccccaaacaccaatctgatccctccgaagacgaagacgagaggagtagccagaaattgcattctacatctcaaaatattaacctgggaccaagcgggaatccccatgctaaacctacagactttgatttcctcaaggtaatcgggaaaggatctttcggaaaagtattactggcaaagcgcaagctagacgggaagttctatgcagtaaaagtactccagaaaaagatcgttttgaatcgcaaagagcagaagcacatcatggctgaacggaatgtcctattgaaaaatgtcaaacaccctttcttagtaggcctgcattattcctttcagaccaccgaaaagctgtattttgtgctggatttcgtgaacggaggtgaactgttctttcacctacaacgagaaagatcttttcctgagcaccgggctcgattctacgccgcagagattgccagcgcactgggttatctgcactcaattaagatcgtgtacagagaccttaaacccgaaaatatactgctcgattctgtcggtcatgtggtcctgaccgactttggcctgtgcaaggaagggatagcgatctcagacaccaccaccacattttgcgggacccctgagcctccgttttattgccgcgacgtggccgagatgtacgataacattctgcataaaccattgtcgctgcggcctggagtgtctctgactgcctggtcaatactggaggagctcctggagaaggaccgacagaaccgacttggtgctaaggaggacttcctcgagattcagaatcaccctttcttcgagagtcttagttgggcggatctggtccagaagaagattcctcccccttttaacccaaatgtggccggtcctgatgacatcagaaacttcgatacagctttcacagaagaaacggtgccttacagtgtatgcgttagcagcgattacagcatagtgaatgcttccgtcctggaagctgacgatgcgttcgttggctttagctacgcaccgccatcagaagatctttttctgtag

SEQ ID NO: 240254 - DNA, 1491 bp, Artificial Sequence
  Description of Artificial Sequence: Synthetic coding sequence
atgcagagagatcatactatggactacaaagagtcgtgccccagcgtttcaatacccagctcagatgaacaccgcgagaaaaagaagagatttacagtgtataaagtgctggtctcagtgggcagaagcgaatggttcgtgtttcgcagatatgccgagttcgataagctgtacaacacgctaaaaaagcagttccctgccatggctctcaagatccctgccaaaagaatttttggcgacaatttcgaccccgattttattaaacagaggagagcaggcctgaatgagttcattcagaatctggtccgctacccagaattgtataatcatcctgacgttagggcttttttgcagatggacagccccaaacaccagagcgatcctagcgaagatgaggacgagagatccagccagaagctacacagtacttcacagaacattaacctgggcccttcaggcaatcctcatgccaaacctaccgacttcgactttctcaaggtgataggtaagggcagcttcgggaaggtccttcttgcaaagaggaagctcgacgggaagttttatgcggtcaaggttctccagaagaagattgtccttaaccggaaggagcagaagcacatcatggctgagaggaatgtgctgctaaagaatgttaaacatccgtttctggtggggctccactactcatttcaaacgacagaaaaactctattttgtactagacttcgtgaacggcggagaattgttctttcacttacaaagggagcgttccttcccagagcatcgagcgagattttacgcggcagaaatcgcatcagctctgggctacttacattctattaaaattgtgtatcgtgatttgaaaccggagaatatcctcttagatagcgttggccatgtggtactgactgattttggcctctgtaaggagggaattgccattagcgacacgacaacaacattttgcggaacaccggaatatctcgcaccagaagtgataaggaagcaaccctacgacaacaccgtagattggtggtgtctgggagcagtgctatacgagatgctttatgggctgcctcctttctactgccgagatgtggccgagatgtacgataatatcctgcacaaacccctgagcctgaggccgggagtctctcttaccgcttggagcatcctggaagagctcttagagaaagataggcagaatcggcttggcgctaaagaggatttcttggagattcagaaccatcccttcttcgaatcccttagctgggcagatctagtgcagaagaagatccccccaccctttaatcctaacgtggctggccctgacgatatacgcaattttgataccgcgtttaccgaggagacggtgccctactcagtttgtgtctcctcagattacagtattgtcaatgcgtcggtactcgaggccgatgacgcattcgtcggattctcctacgctcctccaagtgaggacctctttttgtag

SEQ ID NO: 240255 - DNA, 1491 bp, Artificial Sequence
  Description of Artificial Sequence: Synthetic coding sequence
atgcagagagaccacactatggattataaagagagctgtccttctgtgagcatcccttccagcgatgagcaccgggagaagaaaaagagattcactgtctataaggtgctcgtaagcgttggtagaagcgagtggttcgtttttagaaggtatgctgagtttgataagctctacaatacattaaaaaagcaatttcctgctatggcattgaagatcccggctaaacggatcttcggggacaacttcgatcccgacttcattaagcagcggcgagcagggttaaatgagtttatccagaaccttgtgagataccctgagctatataatcatccagacgtcagggccttcttacagatggatagccccaagcaccagagcgacccaagtgaggatgaagatgaaaggagttcacaaaagctgcactccacgagccagaacatcaatttaggccctagcgggaacccacatgccaaacccactgattttgacttccttaaagtcataggcaaaggatctttcgggaaggtgctgctggccaagcgaaagctggacggaaagttctacgctgtgaaagtgcttcagaaaaaaatagtactgaacaggaaggaacagaagcatattatggccgagagaaacgttttactcaagaatgtcaagcaccctttcctggttgggctccattactcatttcagacaaccgagaagctatacttcgtattagactttgtcaatggcggtgagctgtttttccatctgcaacgtgaaagaagttttccagagcatagggccaggttctacgccgctgagattgcttcagccttgggatacctgcattctattaagatcgtttatcgtgacctgaagcctgagaatattcttctggatagtgttggtcatgtggtgctcacagatttcgggctttgcaaggaaggaatagcaatttcagacacaacgaccacgttctgcggcactccagagtaccttgcgcctgaagtgatacggaaacaaccatatgataatactgttgattggtggtgtcttggagccgtcctctatgagatgctgtatgggctgcctccattctactgtcgcgacgtggccgaaatgtatgataatatcctgcacaaacctttgtccttacgccctggcgtatctctgacagcctggtctatacttgaggagctactcgagaaagaccgccaaaacaggctgggggcaaaggaagacttcctggaaattcagaatcatccttttttcgagagcctgtcatgggctgacctggttcagaaaaaaatacctcccccattcaacccaaacgtggctggccctgatgatattcggaattttgacacagcctttactgaggagacagtcccgtatagcgtgtgcgtatcgtccgactactctatagtcaacgcctctgtgctagaagccgacgacgccttcgttggtttttcttatgctcccccatcggaggatctctttttgtag

SEQ ID NO: 240256 - DNA, 1725 bp, Artificial Sequence
  Description of Artificial Sequence: Synthetic coding sequence
atggaggcttctctgggcattcagatggacgagccaatggccttctctccgcagagagacagattccaggccgaagggtccttaaagaaaaacgagcagaatttcaaacttgcaggggtcaagaaagatatcgagaaactgtacgaagccgtgccccaattatccaacgtttttaagatcgaggataagataggagagggtacattttccagcgtgtatctggccaccgctcagctgcaggtcggccctgaagagaaaatcgccttgaagcatctaatccctacaagccacccaataagaattgcagcagaattacagtgccttacggtggccggtggacaagacaacgtgatgggagtgaaatattgtttccgcaaaaacgaccacgttgtcatcgcaatgccatatttggaacacgagtctttcttggacatcttgaacagcctgtcatttcaggaagtgagggagtatatgctgaacctttttaaagcactgaagcgtatccaccagttcggaattgtacatcgagacgtgaagccctccaattttctgtacaatagaaggctgaagaaatacgccctcgtggatttcgggctcgcacagggcacacatgatacaaaaattgaattgctgaaatttgttcagagcgaagcacagcaagaaagatgtagccagaacaagagccatataatcacaggaaacaaaatcccacttagcggcccagtgccaaaggagttagatcagcagagcactaccaaggcctctgtcaaaagaccgtacaccaacgctcaaatacagatcaagcagggcaaggacggaaaagaaggtagcgtaggtctgagtgtgcaacgcagcgtgttcggtgaaaggaatttcaacatacactccagtatatctcatgagtcacctgcagtgaaattaatgaagcaaagcaagaccgtcgacgttttgagtcggaaacttgccaccaaaaagaaagctatatcaacaaaagtgatgaacagcgctgtcatgagaaaaacggcatcatcttgtcccgcatcactcacctgcgattgttatgcaaccgataaggtctgctcaatttgtctctctaggcgccagcaggtggctccacgcgctggaacgccaggcttcagggccccagaggtactgactaaatgccctaaccagactacggctattgatatgtggtctgcaggtgtgatttttttgtctctcctttcaggccgttacccattttacaaggcctccgatgaccttaccgccctggctcagatcatgacaatccgtggctcacgcgagaccatccaggccgctaagacctttggaaagtccatcttgtgcagcaaagaggtgcccgctcaggatctgcgcaagttatgcgaacgtctacggggaatggactctagcacccccaagctcacctccgatattcaggggcatgcatcccatcagccagcaatctcagaaaagaccgaccacaaggcctcttgcctcgtacagaccccacctgggcagtatagcggcaattcattcaaaaagggagatagcaactcctgcgaacactgcttcgacgagtacaacaccaacctcgagggatggaatgaagttcctgatgaggcctacgatctcctagataaattgctcgatttgaatcccgctagcaggatcactgcagaggaggcactattgcaccctttctttaaagatatgagcttgtag

SEQ ID NO: 240257 - DNA, 1611 bp, Artificial Sequence
  Description of Artificial Sequence: Synthetic coding sequence
atggttctggatcttgacctcttcagagttgataaaggcggtgacccggctctgatccgtgagacccaggagaagcgatttaaagaccctggattggtggaccagctggttaaggccgactctgaatggaggcgctgtagattcagggccgacaacttgaacaagcttaagaatttgtgttctaaaactatcggagaaaaaatgaaaaagaaagagcctgtcggggacgacgaatcagtccccgagaacgtcttgagtttcgatgatttgacagccgacgccctggctaacctcaaggtgtcgcagataaagaaggttcggctcctcatagatgaagcaattttaaagtgcgatgcagaacggattaagctagaggctgagcggttcgagaatcttcgtgagattggcaatctattgcatccctccgtccccatcagcaatgacgaagacgtggacaacaaagttgaacgaatatggggggactgcactgtgcgcaaaaagtacagccatgtggacttggtcgtcatggtcgacggattcgaaggggagaaaggggcagtggttgcaggtagccgcggatatttcctgaaaggagtgctggtcttcctggagcaagcccttatacagtacgctctgcggacactgggatcacggggttacataccaatctacacaccattcttcatgagaaaagaggtgatgcaggaagttgcgcagctgtcccagtttgacgaggagctttataaggtcattggaaaaggttccgagaaatccgacgataattcctatgatgagaagtatctaatagccactagcgaacaacccatcgctgcattgcacagagacgagtggctacggccagaggatctgccaattaagtacgccggattaagtacttgttttcgtcaggaagtggggtcacacggtcgtgacacccgaggcatattccgagtgcatcaatttgagaagattgaacagttcgtgtatagtagtccacatgataataaaagctgggagatgttcgaagagatgatcactacagcagaagagttttaccagtcactcggaatcccttaccacattgtcaatatagtgtcgggcagcctgaaccacgccgctagcaaaaaactggacctcgaggcctggtttcctggatcaggcgcattcagggaactggtttcttgcagtaattgtaccgactatcaggcccgtaggctgcgaattagatatggtcagactaagaagatgatggataaacggaaaaataaccttcacctcagcacacaaaacaaactggaagccagcctgttcagccccaaaaaggtggaattcgtgcacatgctcaatgctaccatgtgcgctactacccgtaccatttgcgctatactggagaattaccaaaccgaaaagggcatcaccgtccccgagaagctgaaagagttcatgcccccagggttgcaagagctcatcccattcgttaagccagcccctatcgaacaggaacccagcaagaaacagaagaagcagcatgaaggttccaaaaagaaggcagcagccagggacgtcaccttggaaaacagactccagaatatggaggtaacagacgcttag

SEQ ID NO: 240258 - DNA, 1563 bp, Artificial Sequence
  Description of Artificial Sequence: Synthetic coding sequence
atggcagcctcaatggctagacgtctctggcctctcctgacccgcaggggatttcgaccaaggggtggatgtattagtaacgattctccacggaggtctttcactacagagaagcgcaaccggaatctcctctacgaatacgctcgcgagggctactccgccttgcctcagctggatatagaaaggttttgcgcctgccccgaggaggcggctcatgccctggaattgcgcaaaggcgaactgcgttctgctgacctccccgcaattattagtacatggcaggagctcaggcagttgcaagagcaaatccgctccttggaagaggaaaaggccgcagtgactgaggccgtgcgcgcattgctggccaatcaggattccggcgaggtgcaacaggttagactggaccccggtgctggcagtatttttgggccaacattcttgcctttccctggtcagctaagcctgctggtggaagcccaactggaggagcagttttatctgcaggcactcaagcttcccaatcagacacaccctgacgttcccgtaggggacgagagccaggctcgcgtgctgcatatggttggcgataagcccgtattctctttccagccgaggggtcacctggagattggagagaagctggatatcatccgccagaaacggttgtcacacgtgtctggccatagaagctattacctgcgaggagctggcgctctgctccagcatggactagtgaatttcacttttaacaaactactgagacggggtttcactcccatgacagttccggacctgcttcgtggcgctgtctttgaggggtgcggtatgacccccaatgcaaacccctcccagatttacaacatagatcccgcacgcttcaaggacctaaatctagcgggaactgctgaagttggtctcgccggatacttcatggatcatacggttgcgtttcgcgaccttcccgtgaggatggtgtgcagttctacgtgttatcgggcagaaactaacacaggacaggagcctcgtggcctttaccgggtgcatcactttaccaaggtggagatgtttggggttaccggcccaggtctcgaacagagcagtcagttgctcgaggaattcctgtcacttcagatggagatactgacggagctgggtcttcacttcagagtacttgacatgccaactcaggagttgggtctcccagcttacagaaagtttgatattgaggcctggatgccaggaaggggacggtttggagaagttactagcgcgagcaattgtacagattttcaatctaggcgattgcatatcatgtttcagaccgaggcgggagaactgcaattcgctcacacagtgaacgccacagcttgcgcagtgcccaggctcctaatcgctctgctcgagagtaaccagcagaaggacggaagtgtgctcgtacccccagccctccaatcatatctgggcactgaccggatcactgcccctactcatgttcctctccagtacatcggacctaaccagcctcgaaaacctgggctgcccggacagcctgcagtgagttag

SEQ ID NO: 240259 - DNA, 426 bp, Artificial Sequence
  Description of Artificial Sequence: Synthetic coding sequence
atggagatgctgcagggcctccttctccttctgttgttgagtatgggaggggcatgggcgtcccgggagcctctgcgtccttggtgtcaccccattaatgcaatactggcagttgagaaggagggttgcccagtgtgcattacggttaacaccacaatatgcgcagggtactgccccaccatgatgagggtattgcaagccgttctgcctcccctgccacaagttgtttgtacgtaccgcgatgtgcggttcgagtctatccgcctacctggttgccccaggggagtagacccggttgtttcctttcccgttgcgctctcttgcaggtgtgggccatgcaggaggtcgacttcagactgcggtggacctaaagatcacccactcacatgtgaccacccccagctttccggtcttctgttcctctag

SEQ ID NO: 240260 - DNA, 837 bp, Artificial Sequence
  Description of Artificial Sequence: Synthetic coding sequence
atgggggcacgccttagtagacgccgactgccggctgatccttccttggcccttgatgcgctgcccccagaactgctggtccaagtgcttagccatgtgcccccacgttctctggtgactcggtgccgtccagtttgcagagcatggagagacattgtggatgggccaaccgtgtggttgttgcagctcgcccgtgaccgcagcgccgaaggcagggccctgtatgccgtggcacagagatgccttcccagtaatgaagacaaggaggaattccctttatgtgctctggctagatattgtttgcgagcgccattcggtaggaacctgatcttcaactcgtgcggcgaacagggctttagaggctgggaagtagagcacggtggaaatggctgggcgattgaaaagaatttgacacctgtgcctggtgcgccttctcagacttgtttcgtcacttctttcgagtggtgctcaaaaagacagcttgtggatctggttatggaaggggtgtggcaggagctgcttgattctgctcaaatcgaaatctgtgtcgccgattggtggggagctcgtgagaactgtggctgcgtttatcaactgagggtacggttactggacgtatacgaaaaggaggttgttaagttctctgcatcccccgatccggtacttcagtggaccgagcggggttgccgtcaggtgtctcatgtgttcacgaactttggtaaaggtatcagatacgtgagtttcgaacagtacggccgagacgtgtcttcttgggtcgggcattacggcgcactggttacccacagtagcgttagagtacggataagactgtcctag

SEQ ID NO: 240261 - DNA, 864 bp, Artificial Sequence
  Description of Artificial Sequence: Synthetic coding sequence
tttaagcaggggctgtggttgctggagatgggcgcaagactcagccgccgacgcctccccgcagacccctctttagctcttgacgccctacctcctgaactgctcgtccaggtccttagccacgttccccctcgctcattggtgacccggtgtcggcctgtgtgccgtgcttggcgcgatatcgtcgacggccctacagtttggctgttgcagctggcaagagatcgtagtgccgaggggagagccttgtacgccgtggctcagagatgtcttccatccaatgaagataaagaagaatttcctctgtgcgcacttgcacgctactgcctccgtgccccattcggacggaaccttatctttaacagctgtggcgaacagggcttcaggggttgggaggttgaacatgggggtaatggctgggctattgaaaaaaacctcacccctgtgccaggggcacccagccagacttgtttcgttacaagtttcgagtggtgcagcaagagacagttggtcgatcttgttatggagggcgtctggcaagagcttctggactccgcccagattgaaatctgcgtggcagactggtggggggcacgagaaaattgtggttgtgtttaccagcttcgggtccgtcttctcgatgtgtacgagaaagaagtcgtgaaattttcagcaagtccagaccctgtgctgcagtggacagaaagaggctgccggcaggtctctcatgtgttcacgaatttcggcaaaggtatcaggtatgtgagctttgaacagtacggcagggatgtgagctcttgggtgggacattatggggcactcgtgacacattcttctgtgcgcgtcagaattaggctaagttag

SEQ ID NO: 240262 - DNA, 1563 bp, Artificial Sequence
  Description of Artificial Sequence: Synthetic coding sequence
atggccgcttcaatggctcgacgcctgtggcccctgctaacccgtcgcggattcaggccaaggggtggttgcataagcaacgactcccctaggcgcagctttacgacagagaaacggaacaggaacttgctttacgaatatgcacgtgaaggctatagtgccctgccccagcttgacattgaaagattctgcgcctgccccgaagaagccgcacacgccctggaactccggaagggagaactcagatcagcggatctgcccgctattatcagtacttggcaggaattgaggcagctgcaagagcaaattcgttcgctcgaggaggagaaagctgcagtgaccgaagcagtcagggccctgcttgccaaccaggattcaggagaggtccagcaggttaggctggaccctggcgctggatctattttcgggccaactttcctccccttccccggtcagcttagcctccttgtggaggcccagctggaggagcagttctacctgcaggctttgaagctgccaaatcagacgcacccagacgtccccgtgggagacgagagtcaagcaagagtccttcatatggttggggacaagccagtattctccttccaaccacgcggacacctcgagatcggagagaaactggacatcattcgacagaagagactgtcacacgtgagtggtcatcgatcttattatctgcgaggagcaggtgcactcctacagcacggcttggtgaacttcacgtttaacaaactgttaaggcggggattcacacccatgacagtgcccgacttgctgaggggtgctgttttcgagggttgcggaatgaccccaaacgctaacccctcgcagatatataacattgaccccgcacgattcaaagacctgaaccttgctggtacagctgaggtcggcctcgctgggtacttcatggatcatacggtcgcctttagagacctgccagtacgcatggtttgttcctccacatgctatcgcgctgaaaccaataccgggcaggagccacggggtctataccgagttcaccactttactaaggtggagatgtttggcgtgactggccctggcctggaacaatcctctcagctgctggaggagttcctctctctacagatggagattctgactgagctggggctccactttagggtcctcgacatgcccacgcaggaattggggctgccggcttaccgtaagtttgacatcgaggcgtggatgcctggtcgtggacggttcggggaggttaccagcgcctcaaactgtacagactttcagagccgtcggctccacatcatgtttcagaccgaggccggtgagctgcagttcgcccatacagttaacgccactgcctgcgcggtcccacgccttctcatcgcattgctggagagcaaccagcagaaggatggctctgtgctggtgcccccagcgctgcagtcttatctcgggacagaccggattactgcgcctacccacgtccccctgcaatatatcggacccaaccaacctagaaaacccggtctgcctggtcagcccgctgtgagctag

SEQ ID NO: 240263 - DNA, 1557 bp, Artificial Sequence
  Description of Artificial Sequence: Synthetic coding sequence
atggagggtgtgtggcaagagctgctagactccgcccagattgagatctgtgtggcagactggtggggcgctcgggagaattgcgggtgcgtgtaccagctgagggttcgtctgctcgatgtttatgagaaggaggtcgtgaagttctcagcctctcccgaccctgtactgcaatggaccgaacgaggatgtaggcaggtaagccacgtattcaccaacttcgggaaaggaatccgctacgtgtccttcgagcagtacggcagagacatttccacttggcaggaactcaggcagctgcaagaacagattcgatccctcgaagaagagaaggccgctgtgacggaggctgtgcgcgcattgctggcgaatcaggattccggcgaagtccagcaggacccaaaatatcagggcctaagggccagaggcagagaaattagaaaagagcttgtccacttgtacccccgtgaggcccagctggaagagcaattctatctgcaggctctcaagctgccaaaccagactcacccggatgtccctgtaggggacgaatcccaggctagagttctccatatggttggagataagcccgtattttcatttcaacctcgcggtcacctcgaaatcggagaaaaactagacatcattaggcagaaaaggctcagtcatgtgtccggtcataggtcgtactatctgaggggtgcaggcgcactccttcagcacggtctggtgaatttcacctttaataagctgctccgtaggggatttacaccaatgacagtgcccgatctgctgcgaggcgcagtcttcgagggatgcggaatgacacccaatgctaacccctcccaaatttataacatcgaccccgcaagatttaaggatctgaatctggctgggacagcggaggtcggcctcgctggctactttatggaccacaccgtggcatttagagatctcccagtgcgcatggtatgctcctccacctgttatcgggcagagaccaataccggacaggagcctcgtggcctatacagggtccatcatttcaccaaggttgagatgtttggagtgactggccctggactcgaacagtcctcgcaactgcttgaggagttcttgagtttgcagatggagatcctgactgaacttggccttcactttcgggtccttgacatgcctactcaggaactcggactgccagcctaccgcaagttcgacatcgaggcctggatgcccggtcgagggagatttggggaggtgacatccgcgtcaaattgtactgactttcagagcaggaggctgcatattatgtttcagacagaggccggtgagctgcagtttgcccacaccgtgaatgccacagcatgtgccgttcccaggttattgatcgcactgctggagtcaaaccaacagaaagacggcagtgttttggttccccctgctctgcaatcttacttgggcaccgaccgaattacagcacccacccacgtacctttgcaatatatcgggccaaaccaacctcgcaaacctggactgcctggacagcctgctgtcagctag

SEQ ID NO: 240264 - DNA, 711 bp, Artificial Sequence
  Description of Artificial Sequence: Synthetic coding sequence
atggctgcctctatggcgagacggctttggccactcctgactcgcaggggttttagaccaaggggagggtgtataagtaatgatagcccccgtagatcattcactaccgagaagcgcaaccgcaaccttctctatgagtatgctagagagggatattcagctctgccgcagctggatattgagaggttctgtgcatgtcctgaggaggctgcgcacgccctggaactgcgcaagggagaattgaggtctgctgaccttcccgctatcatctcgacatggcaggaactgcgccagctccaggagcagattaggagcttggaggaggagaaagccgctgtgaccgaggccgttagagcactgttagccaatcaggactcaggggaagttcagcaggacccaaagtatcagggcctgcgcgcacggggtagggagatccgcaaagagctggtgcatctttatccacgcgaggcccagctggaggaacaattctatctgcaggccctgaaattgcccaaccagacccatcccgacgttccggtgggcgatgagagccaggctcgtgtgcttcatatggtaggagataagcctggagcttgcccgacttgcttggccaccggtcccatcacgtgtgcaggcctagagccttcctgttccactgcatggtctaccagccactccacatccttctccgcaggcgcttccccaccttag

SEQ ID NO: 240265 - DNA, 1281 bp, Artificial Sequence
  Description of Artificial Sequence: Synthetic coding sequence
atgcatgctctttttgcagactctttcgcggcacttggcaggctggataacattacactggtcatggtcttccacccccagtatctggagtccttcctcaaaacacaacattaccttttgcagatggatgggcctttgccactccactatcggcactacataggaatcatggccgctgctcggcaccagtgctcttatctggtcaatttgcacgttaacgatttcctgcacgtgggaggggacccaaaatggctgaacggtctggagaatgctccccaaaagttgcagaacctgggtgagttaaacaaagtacttgctcacagaccatggctcatcaccaaggagcatattgagggcttgctgaaggctgaggagcattcatggagcctcgccgagctggtgcatgcagttgtgctgctgacacactaccatagtctcgccagctttacatttgggtgcggaatttcccctgaaatacactgtgacggtggacacacctttcggccaccatccgtgagtaattactgcatttgcgacataactaacggaaatcatagcgtggatgagatgccggtaaattcagcagagaacgtgtccgtatctgattctttctttgaagtggaggccttaatggagaagatgagacagctccaggagtgccgggatgaggaagaagcctcgcaagaagagatggcttctaggttcgagattgagaaacgcgaaagcatgttcgtcttcagttccgatgacgaggaagtcactcccgcacgggctgttagtagacacttcgaggacacgtcatatggctacaaggatttttcaaggcacggcatgcatgttcctaccttccgcgtccaggattactgttgggaagatcacggctacagtctggtaaatcgcctgtatcccgatgtgggacaactgattgacgagaaattccatatagcttataacctaacttacaataccatggccatgcacaaggacgttgacacttcaatgctgcggagagcaatttggaactacatccattgtatgttcgggataagatatgacgattacgattacggtgagatcaatcagttgctagaccgctcctttaaagtgtatatcaagacagtggtttgtaccccagagaaggtgacgaaacggatgtacgattcgttttggcggcaattcaagcacagcgaaaaagtgcacgttaacctactcttgattgaggccagaatgcaggctgaactcctctatgcactccgcgctatcaccagatacatgacctag

SEQ ID NO: 240266 - DNA, 1479 bp, Artificial Sequence
  Description of Artificial Sequence: Synthetic coding sequence
atgaggctggccgctgcggcaaacgaagcatatacagccccactggccgtgagcggactgctgggttgcaagcagtgcggcggtggtagggatcaagatgaggagcttggcatacgcatccctagaccactgggacagggccctagtaggtttatcccggaaaaagagattctacaggtggggtctgaggacgcccagatgcacgctttgttcgccgacagttttgctgccctcggccgattagataacatcacattggttatggtattccacccacagtatctcgaatcattcctgaaaacccaacactacctcctgcagatggatggccctctacccctgcactaccgtcattatataggtatcatggcggcagcaagacaccaatgttcataccttgtgaaccttcatgtgaacgattttttgcacgtgggcggagatccaaagtggcttaacggactcgagaatgccccacaaaaactgcagaacctaggcgagctgaataaggtgctagctcataggccatggttgatcactaaagaacacatcgaaggattactgaaggcggaggagcatagctggagcttagcagaactggttcatgccgtcgtccttttgacacactatcattctctggcatcctttacttttggctgcggaattagcccggagattcattgtgatggcggacacacattcagaccaccatctgtgtccaattactgtatttgcgacatcaccaacgggaaccattccgtggatgagatgccagtgaactctgcagagaacgtatctgtatctgactcattctttgaggtagaggcattgatggaaaaaatgcggcagttgcaagagtgtagagatgaggaggaggcgagccaggaagagatggcatccagatttgaaatcgagaaacgagaatccatgttcgtgttctccagtgatgacgaggaggtgactccggctagggcagtcagccggcattttgaagacactagttatggttataaagacttcagtaggcacggcatgcatgtgcccaccttcagagtccaggattactgctgggaggaccacggatattctctggtgaaccgactctatcctgacgtcggccaattgatagacgaaaagttccacatagcctataatctgacctacaacacaatggctatgcataaggatgtcgacacatccatgcttaggcgagccatctggaactatatccactgcatgtttggcattagatacgacgattatgactatggggagatcaaccagcttttggatcggagtttcaaggtctacatcaaaacagtggtgtgcacccccgagaaggtgaccaagcgtatgtacgacagcttctggagacagtttaagcattctgagaaggtccacgtgaatcttctcctgattgaggctagaatgcaagccgaactgctgtatgcactgcgtgccattacaagatatatgacatag

SEQ ID NO: 240267 - DNA, 1656 bp, Artificial Sequence
  Description of Artificial Sequence: Synthetic coding sequence
atggctgaaggggagaacgaggtgagatgggatgggctgtgctccagagattccacgactcgagaaactgctctagaaaatatcagacagactatactccggaaaacagagtacctgagaagcgtgaaggaaaccccccatagacccagcgatggcctgagcaacactgaatcttccgacggtcttaataagctattagcccatctgctgatgctgagtaaacgatgcccttttaaggatgtgagggagaaatctgaatttatcctgaaatctatccaggagttaggcatccgtatccccaggccccttgggcagggcccatctcgtttcataccagaaaaggagatccttcaggttggctctgaggatgcccagatgcacgccctctttgctgacagctttgccgcactgggaaggttagacaacattactctggtgatggtgtttcacccgcagtatctggaatcgtttctcaagactcaacactatctcctacagatggacggcccactcccacttcattaccggcactatattggcatcatggccgcagctagacaccagtgcagctacctggtgaacctgcatgtgaacgactttctgcacgtggggggagatcctaaatggctcaacggactggagaatgctccccagaagctccagaacctcggagaactgaacaaggtactggcgcaccggccatggttgattaccaaggagcacatcgaggggctgctcaaagcagaggaacactcctggagcttggcagagctcgtacatgccgtggtattgctgactcattaccactccttggcgtcgttcactttcggctgtggcatctcacccgagatccactgtgacggaggacatacgtttcggccaccaagtgtctccaactactgcatatgcgacatcaccaacggcaaccattcagtggatgagatgcctgtcaattccgccgaaaacgtgagtgtatcagattctttcttcgaggtggaagctctgatggagaaaatgaggcaactacaggagtgccgggatgaagaagaggcttcacaggaggagatggcctctaggtttgaaatcgagaaacgggagtcaatgttcgtgttctcttccgacgatgaggaggtgactcctgcccgtgcagttagccggcacttcgaggatacctcctacgggtataaagatttctccaggcacggaatgcatgtccccacctttagggtacaggattattgctgggaagaccacgggtatagcctggtgaatagattgtatcccgacgtggggcagctcattgacgagaagttccatattgcttacaacctcacctataataccatggccatgcataaggacgttgatacctccatgctgaggcgggcaatttggaactacatccactgcatgttcggcatccgctacgacgactacgactatggcgagattaaccaactactggatagatcttttaaggtctatataaaaactgtggtctgtacacccgagaaagtcacgaagaggatgtatgactcattctggcggcaattcaagcacagcgaaaaggttcacgtaaatctcctgctgatcgaagctaggatgcaggcagagctcctgtacgcactcagagctatcacaaggtatatgacatag

SEQ ID NO: 240268 - DNA, 1302 bp, Artificial Sequence
  Description of Artificial Sequence: Synthetic coding sequence
atgagggccgaagggctgggcggactcgagcgcttttgtagccctggaaagggaaggggcctgagagctttgcagccattccaggtgggcgatctcctgttcagttgcccggcttatgcctacgttctgaccgtaaacgagagaggtaaccactgcgagtattgttttacacgcaaggaaggactgagtaagtgcggccgatgtaaacaggctttttattgcaatgtggagtgtcagaaggaggattggcctatgcacaaactggagtgttcccctatggtggtgttcggagaaaattggaatccttctgagacagtgcggctcaccgctcggatcctagccaaacagaaaatacatccagagcgcactccgtcagagaaactcctggcagttaaagagtttgaaagccatctcgataagctggacaatgagaagaaagatctgattcaatctgatattgccgctctgcaccacttttactccaaacatttgggcttcccagataacgactcactcgtggtcctgtttgcccaggtcaattgcaatggattcaccatcgaggacgaggagctgagccatcttgggagtgccatctttcccgacgtggccctgatgaatcattcatgctgccctaatgtgatcgtgacatataagggcacccttgccgaagtgagagccgtacaggagatcaaacccggagaagaggttttcacatcttatattgatctcctgtacccaaccgaggatagaaatgacagactgagggacagctacttttttacctgtgaatgccaggaatgtacaacaaaggacaaggacaaggcaaaagtggaaatccgaaagctgagcgatccccctaaggcagaagcaatccgggacatggtcagatatgcccgaaacgtcatcgaagagttccgacgagcaaaacattacaagtcaccctctgagttactagaaatttgcgagctgtcccaagaaaagatgtcatcagttttcgaagacagcaatgtgtatatgttacatatgatgtaccaggcgatgggtgtttgcttgtacatgcaggactgggagggggcactgcagtatggccaaaaaattattaagccctattccaaacattatccactctactccctgaacgtagcgtcaatgtggctgaaattaggtcggctgtatatggggctcgagcacaaggccgcaggtgagaaggccctgaagaaggctatcgcgatcatggaagtggctcacggaaaggaccatccttacatcagcgagatcaaacaggaaattgaatcacattag

SEQ ID NO: 240269 - DNA, 819 bp, Artificial Sequence
  Description of Artificial Sequence: Synthetic coding sequence
atgagagccgaagggctcggagggctggagagattctgcagcccgggtaaaggcagagggctaagggccctccaaccattccaggtgggggacttgttgttcagttgccccgcatatgcctatgtgctgacagtgaatgagaggggcaatcactgcgagtactgtttcactaggaaggagggtctgagcaaatgcggacgttgtaagcaggccttttattgtaacgtggaatgtcagaaggaggactggcctatgcacaagctcgagtgctcccctatggtggtctttggtgaaaactggaatccctcggagaccgtgagactgaccgccaggatcttggccaaacagaagatccatcccgaacgaacccccagcgagaaactgctggctgtgaaagagttcgagtcacatctggataagttggataacgagaaaaaagacctgatccagagtgacattgccgctttacatcacttttactcaaaacacctgggatttccggataacgactcccttgtggtgctttttgcccaggtcaactgtaacggttttactattgaagatgaggagttatcccatctcggctccgccatattccccgacgtagctttaatgaatcattcttgctgcccaaacgtgattgtcacctataaaggaactttggccgaggtgagggccgtgcaggaaatcaagcccggagaagaggtttttacttcatatatcgatctgctgtaccctacagaggataggaacgatagactgagggatagctatttctttacatgtgaatgccaggagtgcaccacaaaggataagtag

SEQ ID NO: 240270 - DNA, 5711 bp, Artificial Sequence
  Description of Artificial Sequence: Synthetic coding sequence
atggccgcaggcacctgggccgctgccgctgcagcagccgctgccgactacttcgttttggttgcattcggcccacaccctcgagggagtggggaagggcaagggcagatcctgcaacgcttccctgaaaaggattgggaagacaaccccttccctcaggggatcgagctcttttgtcagcccagcggatggcagctgtgcccagaaagaaatcctccaacgttctttgtggcagtgctcactgacatcaactctgaaagacactattgtgcctgcctcacattttgggaaccagctgaaccaagccaggagactaccagagtggaggatgctacagagagggaagaggaaggagacgaggggggacaaactcatctctcaccgacggctccagccccatctgcacagttgtttgcccctaaaaccctggtattagtgagcagattagatcatacagaagtctttcgaaattcactcggcctgatttacgctatccatgttgaaggtcttaacgtatgtttagaaaacgtgattggtaacctgttaacgtgtacagtgcctctcgccggaggttctcagcggacaatttcacttggggctggagatcgccaggtgatacaaaccccactggcggacagcttaccagtgagccggtgcagcgttgcactactgttccgccaattagggatcaccaacgttcttagtctgttttgcgccgctctgacagagcataaggtgctttttctgtccaggtcttaccagcgcctcgccgacgcctgcagaggcctgctggcgctgctgttccccttgagatattcttttacctacgtccctattctgcctgcacagttgttagaagtgctgtccacaccaaccccattcattattggggttaacgctgctttccaggcggagactcaggagctcctggacgtcatagtggccgacctcgacggcggaaccgttacgattcccgaatgcgtgcacattccccctctcccagagcctctccaaagccagactcatagcgtacttagtatggtgcttgacccagaactggagctcgccgacttggcgtttccgccacccaccacctccacgtcatcactcaaaatgcaagataaggagctgagggctgtctttcttcggctctttgcgcagctgctccagggctatcgatggtgtcttcacgtcgtgagaattcatccagagcctgtgatccgcttccacaaagccgcatttttgggtcagagaggcttggtggaggatgatttcctgatgaaggtactggagggaatggctttcgcaggctttgtgtctgaaagaggagttccgtatcggccaacagatctgttcgatgagctcgtggcacacgaagtagccagaatgagagccgatgaaaatcatccccagcgcgtgctcagacacgtgcaggagcttgcggagcagttgtacaagaatgagaatccataccccgctgttgcgatgcacaaagtgcagaggcctggtgaaagctcccatctgcggagggtacccagaccctttccaagattggatgaggggacagtccaatggatcgttgaccaagctgccgctaagatgcagggggctccacccgcagtgaaagcggaacggcgaacaacagtaccctctggacctccgatgacagctatactggaacggtgcagtggcctccatgtaaattccgcacgccgtttggaagtcgtccggaactgcatttcttacgtgttcgaagggaagatgctggaggcaaaaaaactcctccctgcagtcctaagggcactcaaggggagggcggcacggagatgccttgcacaagaactacatctgcatgtgcagcaaaatcgggctgtcttagatcaccaacaatttgactttgttgtcagaatgatgaactgctgcctgcaggactgtacaagtctagacgagcacggcatcgcagccgctttactgcctttggtcacggctttctgccggaagttaagcccaggggtcacacaatttgcatacagctgcgtacaagagcacgtggtgtggtctacgccacagttctgggaagccatgttttacggagacgttcagactcacatccgcgcactttacctcgagcccacggaagacctggctcccgctcaggaagtcggagaggccccttcccaggaggacgaacgctcggcattggatgttgcctcagaacagcgtaggttgtggcccaccctctcacgggaaaagcagcaggagctcgttcagaaggaggagagcacggtatttagtcaggccatccattacgctaacagaatgtcttaccttttgctgccactggatagctccaaaagccgtctcttgagggagagagccggactgggggatttggaatcagcctccaattcacttgtcaccaactctatggctgggtccgtcgccgagagctacgataccgagagcggattcgaagacgctgagacttgcgatgtggctggagcagtggtgaggttcattaaccggttcgtcgataaggtttgcaccgaatccggggtcacttctgatcaccttaaaggcttacatgtaatggtgccagacatagtgcagatgcatattgaaacgctggaagctgtgcagagagagagcaggagactgccaccaatacaaaaaccaaagctccttaggcctcgtttattgcccggtgaggagtgcgtgctcgacggtttaagagtctatctgctccctgatgggagagaggagggcgcaggcggaagcgcaggcggaccggctctgctgccagcagagggggctgtgttcctcacgacatatcgcgttatcttcaccggtatgccgacggaccccctcgtgggcgaacaggtggtggtacgcagctttcccgtcgcagccttgacgaaggaaaagcgcataagcgtccaaactccggtcgaccagctgttgcaggacgggctgcagttgcgttcttgcacattccagctgcttaaaatggcattcgacgaggaagtgggctctgattccgctgaactgttccgcaaacagttgcataagcttagatacccaccggatatacgggctaccttcgccttcacccttgggagcgcccacacacctgggaggcctcccagggtcaccaaggacaaggggcctagcctcaggaccctctctcgcaacttagttaaaaatgccaaaaaaacgatcgggaggcaacatgtgacacgaaagaaatataatccacccagctgggaacaccgagggcagcctcctcccgaggatcaggaggatgaaatctctgtgagcgaggagcttgagccgtcgacactcactccttcaagcgctttgaaaccatctgaccgcatgacaatgtcaagtctggtcgaacgggcttgttgccgagattaccagcgcttgggtctgggcacgttgtctagcagcctttctcgggctaagtcggagccttttcgaatcagccccgtaaacagaatgtacgctatctgtagaagctatccaggcttattaatcgttcctcaatccgttcaggacaacgcgctccaacgagtctcacgttgctatcgccagaacaggttccccgtcgtctgttggcgcagtgggagatccaaggctgtgttgctaaggtctggtggcctgcatggtaaaggggtggttgggctcttcaaggcacagaacgccccatccccaggccaatcacaggccgattcttctagtttagaacaggagaaatatcttcaggcggtggtgtcttccatgcccaggtacgcagacgcctctggcagaaacacgctcagcggcttctccagcgctcatatgggcagtcatgtgccttcaccacgcgcaagggtcaccacactgagtaaccccatggctgcaagcgcctccaggcgcacagctcctagaggaaaatgggggagtgtgcgaacgtctggtcgcagttctggactggggaccgacgtgggaagtcgcctggcaggtcgcgatgcgctggctcctccccaagccaacggcggacccccagatcccggtttcctacggccacagagggcagcactatatattttgggagacaaagcccagctgaaaggagtaaggagtgacccgttacagcagtgggaactggttcccatcgaagtgttcgaggccagacaagtgaaggcctcctttaagaagctgctcaaggcatgcgtgcccggatgccctgctgctgaaccttctcctgcttctttcctgcgtagcctcgaggactctgaatggctcattcagatccacaaacttcttcaagtgtcagttctggtagtcgagctgctagattccggctcatcagtccttgtgggactggaggacggttgggatatcaccacccaagttgtcagcctggtccagcttcttagtgaccctttttacagaacccttgagggtttccgcctgttggttgagaaggagtggctctccttcggccatcgcttttcccacaggggagcgcatacactggccggacaatcttcgggtttcacacccgtgtttcttcagtttctggactgtgtacatcaggttcacctccagttccccatggaatttgagttctctcagttctaccttaaatttctgggctaccatcatgtctcccgcagatttagaactttcctgttggatagcgattacgaacgcatcgagttgggtctgctgtacgaagagaagggagaacgaagaggacaggtgccatgcaggagcgtctgggagtacgtggatagactgtccaaacgaaccccagtatttcacaactacatgtacgccccagaggatgctgaggtgctgcgcccatatagtaacgtgtcgaacttgaaggtgtgggatttctacaccgaggagacactggccgagggcccaccctacgactgggagcttgctcagggaccaccggaaccgccagaagaagagagatccgatgggggtgctccgcagagcagacggagggtggtttggccatgctatgactcctgccctcgggctcaacccgacgccatctcacgcctactggaagagctgcagcgcctagaaacagagttggggcagcccgctgagaggtggaaggatacctgggatcgtgtgaaggcggcacagagactggaaggtcggcctgatggcagggggacgccctcctctctgctggtctccacggctccacatcaccgacgatctctgggcgtgtacttacaggagggcccagtcggatctactctgagtttgtctcttgattccgaccagtccagcggatctacaacatccggctcaagacaggctgcaagacggtctacatccaccctgtactcccagttccaaactgccgaatcggaaaacagatcatatgagggaacactgtacaaaaaaggagcgtttatgaagccttggaaggcaaggtggttcgtgctggataagacaaaacatcagctcagatactatgaccaccgagttgacacagaatgtaaaggtgtaatcgacctagctgaggtggaagccgtggctcctggcacccccaccatgggagcccctaagacagtcgatgagaaggccttcttcgacgtcaagacaacaaggagggtgtacaatttctgtgctcaggacgtgccaagcgcgcagcaatgggtggaccgtattcagtcatgcctgtcagatgccta

SEQ ID NO: 240271 - DNA, 2697 bp, Artificial Sequence
  Description of Artificial Sequence: Synthetic coding sequence
atggcagcgggtacatgggctgctgctgcagccgcagctgcggcagactacttcgtcctcgtagccttcgggcctcaccctcgaggttccggggaagggcagggccaaattctccagcggtttcctgaaaaagattgggaggataatcctttccctcagggaatcgaactgttctgtcagccgtctggctggcagctgtgccccgagagaaacccacccactttctttgtggccgttctgacagacatcaactctgagcgtcactattgtgcctgcctaacattctgggaaccagcggagccctcccagcaggaaacaacaagagtggaagatgcaactgagcgtgaagaagagggggacgaaggcggacaaacacatttaagccccactgcgccagcgcctagcgcacagctcttcgctccaaaaactctggtgttggtctcccgtttggatcataccgaggtgttcagaaattccctcgggctaatctatgctattcatgttgaaggcttaaatgtctgtctggaaaacgtcattggtaacctgctgacttgtaccgtgcccctggccggtgggtcacagcggactatatcattgggggctggagatagacaggttatccagactcccctcgccgattccctacctgtgagcagatgttccgtggcccttctgttccggcagctgggcatcaccaatgtgctgagcctattttgtgcggcacttaccgagcataaagtactcttcttgtccaggagttaccagaggttggccgatgcatgcaggggactgctcgccctgttatttccactgcgatactcctttacgtatgtgcctattttgccggcacagttgctcgaggttttgtccacacctacccctttcattattggagtgaacgctgcctttcaggcagagacacaagaacttctggacgtgatcgtcgctgacttggacggaggaaccgtcaccattcctgagtgtgtgcacattcctccgctgcctgagccactgcaatcgcagacccatagcgtgctgtcaatggtcctggatcctgaactagaactcgctgacctggcctttccaccgccaacgaccagcaccagctctttgaaaatgcaggataaagaacttcgggcagtctttctgagattgttcgcccagctcctccaaggctaccgctggtgtttgcacgtggttagaatccaccccgaaccagtgatcaggtttcataaagccgcttttctaggacagaggggcctggtggaggacgatttcctgatgaaggtgctcgagggtatggcatttgccggttttgtcagtgaaagaggagtcccctaccgccctaccgatttgtttgacgaactggttgctcacgaggtcgcccgtatgcgggcagatgagaaccacccccagagggtcttgaggcatgtgcaggagctcgcagagcagctttataagaatgagaacccttacccagctgtggccatgcacaaagttcagcggcctggtgagagtagccacttaaggcgcgtgcccagacctttcccaagactcgatgaggggaccgttcagtggattgtggaccaggccgcagctaagatgcagggagcaccgcctgctgttaaggcggaacggagaaccacggtcccctccgggccacccatgacagccattcttgaaagatgtagcggcttgcatgtgaactcagcacgccgtctcgaagtggtgaggaactgcatctcctacgttttcgaggggaaaatgctggaagccaaaaaactgctgcctgctgtccttagagcgttgaaggggagggctgccagacgttgccttgcccaggagctgcatctgcacgtgcagcagaatcgcgctgtcctggatcaccagcaatttgatttcgtggtgcggatgatgaattgttgcctccaggactgcacatccctcgatgagcacgggattgcagccgcattattaccccttgtcactgccttctgtcgcaaactgtcccccggagtgactcagtttgcctactcctgcgttcaggagcatgtcgtatggtccacacctcaattttgggaggctatgttctatggagatgtccagacacacattagggccctctaccttgagcccaccgaagacctggccccagctcaggaggtaggagaggcgcctagccaggaagatgagcggtcagccctggatgtcgccagtgaacagaggcgcctgtggccgactttgtctcgggaaaagcaacaggaacttgtccagaaggaggagtctaccgtcttctctcaggccattcactacgctaacagaatgtcttacctgttacttccgctggacagtagcaagtccaggcttcttcgggagagggctggactgggggacttggaaagcgcttccaactcacttgtcacaaactccatggccggatctgtcgcagaatcctatgacactgaaagcggcttcgaagacgcagagacatgcgacgtggcgggtgcggtcgtgaggtttataaacagattcgttgataaagtttgcaccgagagtggcgtgacgagcgatcacctaaaaggcttgcacgtgatggttccagacatcgtccaaatgcacatcgagaccttggaagccgtgcagcgcgagagcagacggctgccaccaattcagaaacccaagttactgcgcccttag

SEQ ID NO: 240272 - DNA, 5681 bp, Artificial Sequence
  Description of Artificial Sequence: Synthetic coding sequence
atggcccgtctggcagattattttgttttggtggcgtttggccctcatcctagggggtccggcgagggacagggtcagatactccaacgattccccgaaaaggattgggaggacaatcccttcccccagggtatcgaactgttttgtcagcctagtgggtggcagctgtgtcctgagaggaatcctcccactttctttgtggcggtgctgaccgatatcaactccgaacgtcattactgcgcttgtctgacattctgggagcctgccgagccatcccaagagactacccgcgtggaagatgccaccgaaagagaagaggaaggagatgagggtggtcagactcacctcagtccgaccgctccggctcccagtgcacagctcttcgcccctaagactttggtgctagtcagcaggctcgaccatacagaggttttcagaaactcactcggtcttatctacgcgatccatgtagaaggcctcaatgtgtgcctcgagaatgtgattggcaacttgctaacgtgcacagtgcctctcgctggtggtagccaacgcactatttcactgggggctggagaccgccaggtgattcagactcccctggccgattcacttccagtgtctcggtgctcggtggccttgttgttccgccaactgggtatcacaaacgtgctgagcctgttctgcgcagcattgaccgagcataaagtcctgtttctatcgagatcctaccagcgcctcgcggacgcttgtcggggtctgttagccctgttgtttccgctgcgttacagttttacttacgtgcctatcctcccagcccagctgttggaagtgctttccactcccacaccatttattattggggtcaacgcagcttttcaggctgagacccaggagcttctggacgttatcgtggccgatctggacggcggtacagtgacgatcccagaatgtgtgcacatcccacctctaccggaacctttgcagagtcagactcacagcgtgctgtcgatggtgctggatcccgagttggaactagccgacctggcctttccaccacctaccacctcaacgagtagcttaaaaatgcaggacaaggagctccgagcggtgtttctcagacttttcgctcaattgctacaggggtatcgctggtgcctccatgtagtgcgcattcacccagaacccgtcatccggttccataaggccgctttccttggtcagagggggctggtggaagacgactttctgatgaaagtcctagagggcatggcctttgctgggtttgtatctgagaggggggtgccataccggccaacggatctatttgatgaacttgtcgcccacgaggtggctagaatgagagccgatgagaaccacccccagcgggtcttacggcacgtacaggagctggcagagcagctgtataagaacgaaaatccataccctgctgttgcaatgcataaggttcaacgacccggtgaaagcagtcatcttcggagagtcccacgcccttttccgcgactcgatgaaggcacagtgcaatggattgtagaccaggccgctgccaaaatgcaaggagctccacccgctgtgaaagccgagcgaagaacgacagtgccatcggggccacctatgactgcaatactcgagagatgttccggcctgcacgtcaattcagctcggaggctggaagtagtgagaaattgtatatcatatgtgttcgagggcaaaatgctggaggctaagaaactgttgcccgcagtgctcagggctttgaagggtcgggcagcacgcaggtgtttagcacaggagctgcaccttcacgtacagcaaaaccgcgctgtgctggaccatcagcagttcgatttcgtggtgcggatgatgaattgctgcctgcaggactgtacgagtctcgatgagcatggaatcgcagcagcactgctaccgctggtgacggccttttgccgcaaattgagccccggtgttacccaattcgcctacagttgcgttcaggaacacgtcgtgtggtcaacccctcagttctgggaagccatgttctacggagatgtgcagacccatatccgcgctctatatttagagcccacggaggatctggcgccagcacaagaggtcggcgaagccccatctcaggaggacgaacgctcagccctggatgtggcgtcagaacagagacgcctgtggccgactctatctcgggagaagcagcaggaactggtgcagaaggaagagtccacggttttctcccaggctattcactacgcaaataggatgtcctacctgctactgcctctggactcctcgaagtcccggctgttacgggaaagggctgggctcggcgacctcgagtccgctagtaactcactggtcaccaactcaatggccggttccgtggctgagtcctacgacactgaaagcggcttcgaggacgcagagacatgcgatgtggcaggggctgttgtgcgcttcatcaaccgcttcgtagataaggtgtgcaccgaaagtggggtgacatctgatcacctgaaaggcctacatgtgatggtgccagacatcgtacagatgcatatagaaacactcgaggctgtgcaacgcgaatccaggagactgcccccaatccagaagccaaaactgctaaggccaagactgctgccaggagaggaatgtgtgttggacggactgcgagtatacctgctgccagatggacgcgaagagggcgctggcggtagcgctggaggcccagctctcttgcccgcagagggtgctgtgttcctgactacttatcgcgtgattttcactggaatgccaacagaccctctcgtaggggagcaagtggtagtgagatcatttcctgtagccgctctgaccaaggagaaaaggatcagtgtgcagacaccagtcgaccagctgttgcaggatggcctgcagttacgcagttgtactttccagctcttgaaaatggctttcgacgaggaggtcggctcagactctgctgaactgtttagaaagcagctccataagttgaggtatccaccggatatccgcgcaacctttgcattcacactcggcagtgcacacaccccaggacgcccacctagagtaacaaaggataagggacccagcctccgaaccctttcacggaacctcgtaaaaaacgctaagaagaccatcggacgacagcacgtgaccagaaagaagtataatccaccatcatgggagcaccggggacagccaccaccggaggaccaggaggatgaaatctccgtgtctgaagaacttgaaccctcaacactgactccatcttccgccctgaagccctccgaccgaatgacaatgagctccctggtggagcgcgcatgttgtcgcgattatcagcgcctcggcctggggacactttcaagctccctctctcgggcaaagagcgaaccctttcgaatatcccccgttaaccgtatgtacgccatctgccgttcttaccccggactactcattgtgccgcagtcagtccaggacaacgctttacagagggtgagcaggtgctataggcaaaatagattccccgtggtgtgctggaggagcggcaggagtaaggcggtcctgctccgttccggaggtctccacggcaaaggggttgtgggcctttttaaagcgcagaacgcacccagccctggccagtcacaagccgattcttctagcctcgagcaggaaaagtatttgcaggcggtagtgtcgagcatgcctcggtacgccgatgctagcggccgtaatacattatcggggttctcctccgcgcacatgggatcccacgtgccctctccccgtgcaagagttaccactctgtcaaatccaatggccgctagcgcctctagaaggaccgcacccagggggaagtggggatctgtcagaacaagcggtcgatcatccggcttggggactgacgtgggaagccgcctggccggaagagatgccctggcccctccacaggcaaacgggggtccccctgatcccggatttctcaggccccagcgagctgccttgtacatcctaggcgacaaggcgcagttgaaaggggtgcgatctgacccgctacagcagtgggaacttgtgccaatcgaggtattcgaagccagacaggttaaagccagtttcaaaaagctcctcaaggcgtgcgttccagggtgcccagccgcagaacccagccccgcaagcttcctgagatccctggaagactctgaatggttgatccagatccacaaactgctgcaggtcagcgtactggttgtcgagctcctagactcaggcagcagtgtgttggtgggcttggaagatggctgggatataacgacccaggtggtgtcgctggtgcagctgttgagtgatcccttctacagaacactcgagggcttccgccttctggtggaaaaggagtggctctcttttggtcatagattctctcatcggggagcccataccttggctggtcagtcaagtggctttacgccggttttcctccaatttctcgactgcgtgcaccaagtgcacctgcaattcccaatggagtttgagttcagtcagttttaccttaaatttttgggttatcatcacgtatcgcgtcgttttcgcacctttctgcttgacagcgattacgaacgcattgaacttgggctcttgtacgaggaaaaaggggagcgcagggggcaggtgccatgtcgaagtgtttgggaatacgtagatagactctccaagaggacacctgtgtttcataattacatgtatgcacccgaggacgcagaggtactccggccatactccaacgtaagcaatttaaaggtgtgggacttctatactgaggagactcttgcagaggggcctccctacgattgggaactcgcccaaggccctcccgagccccctgaagaagaaagaagcgacggtggggctccacaaagtcgacgcagagtagtttggccatgttatgactcatgcccacgggcacagcctgacgccatatctcgactattggaagagcttcagcgtctggagactgagctcggccagcccgcagagcgatggaaagacacatgggaccgcgtcaaagcagcccagcgactggaaggtcggccagacgggagggggacacctagctccttgctcgtgtccaccgcccctcaccaccgcaggtccttgggcgtgtacttgcaagaagggccagtggggtcaactctttctctctcactggacagcgatcagagcagtggtagcaccacttccgggtctcgtcaggctgcaagaaggtccacaagtacactgtacagtcagttccaaaccgccgagtcagagaatcgatcttacgagggcaccttgtataaaaaaggggcttttatgaagccttggaaggcgagatggttcgtgctcgataagaccaaacatcagcttagatactacgaccatagagtagatacagaatgtaagggggttatagacttggcagaggttgaggccgtggcacctggcacacccactatgggagcccctaaaactgtagacgagaaggcatttttcgatgtcaaaacaacacgaagggtgtataatttttgcgcacaggacgtcccttctgcacaacagtgggtagaccgtatacaatcttgtctgagcgatgctta

SEQ ID NO: 240273 - DNA, 5603 bp, Artificial Sequence
  Description of Artificial Sequence: Synthetic coding sequence
atggctcgcctggccgattactttgtgctggtggcgtttggaccccatcctcgaggatccggggaaggccagggtcagatacttcagagattccctgagaaagactgggaggacaacccgttccctcaaggtatcgagttgttttgtcagccatcaggatggcagctgtgcccagagaggaaccctcctacattcttcgtggcggtgctcaccgacatcaattcagaacggcattactgtgcctgtcttacattttgggaacctgcagagccgtctcaggagaccacccgagtggaagatgctactgaaagggaggaagaaggagacgagggtggacagacccatctgtcacccaccgcgccagcccctagcgctcagctttttgctcctaagaccctcgtgctcgtcagcagattagaccatactgaagtgtttagaaacagtctcggtctcatctatgcaatacacgttgaaggcttgaatgtctgtttggaaaacgtcatcggtaatctcctgacctgtactgtgcctctcgccggaggatcacagcggacaatatcgctcggcgcaggtgatagacaggtcattcagacacccctggccgattcactaccggtttcacgctgtagtgtggcactgctcttcagacagctgggcatcaccaatgtgttaagtctgttctgtgctgccctgacagagcacaaagtgctgtttctctcccgtagctaccaacgtttagccgatgcctgcaggggactcctcgctctgctgttcccgttgcgctacagcttcacgtacgtcccaatattgccggctcaattgctagaagtgctgagcacccctaccccgttcatcatcggtgtgaacgctgctttccaggctgagacgcaggaactgctggatgtgatcgtcgcagacctggatggcggaaccgtaacaatacccgagtgcgttcatatccctccacttcccgagcctcttcagtcacagacacatagtgtcctatccatggtattggaccctgaactggaactggctgatttagccttccccccaccaacgacaagcacctcctctctcaagatgcaagataaggagcttagagctgtgttcctgcgtctgtttgcccagcttctccagggctaccggtggtgtctgcatgtagtccgcatccaccctgagccagttattagatttcataaagccgctttcctcggacaacggggtttggtggaagacgactttctcatgaaagtgctggagggcatggcctttgctggatttgtgagcgaacgcggagtcccctatagacctactgacctgttcgatgagctggtcgcccacgaggtggcacgcatgcgggctgacgaaaatcaccctcagcgtgtcttgcgccacgttcaggagttagcagaacaactctataagaatgaaaatccctatcccgcagttgccatgcacaaggtccagaggccaggcgagtcttcacatctccgaagggttcctagacctttcccccgactggacgaaggcaccgtgcaatggatcgtggaccaggctgccgcaaagatgcagggtgcgccaccagccgtgaaggcagagcggagaactacggtgcctagtggtcctcctatgacagctattctggaacgttgttctggcctgcacgtgaactcagccagaagactggaggtggtccgcaactgtatctcctatgtgtttgaggggaagatgctcgaggccaaaaaactgcttcctgctgtcctcagggcactaaaaggcagagcagcgaggagatgcctggcccaagaactgcatctccacgtccagcagaacagagcggtgttagatcatcagcagttcgacttcgttgtgcgcatgatgaactgctgcctgcaggattgcacttccctggatgagcatggcatagccgctgccttactccccctcgtaacagctttttgtcgcaagctcagtcccggtgtcacacagttcgcatatagctgtgtgcaggagcacgtggtgtggagtaccccccaattttgggaagccatgttctacggcgatgtccagactcacatcagggcgctgtatttggaaccaactgaagacttggctccagcacaggaggtgggtgaagccccttcccaggaggacgagcgaagcgcgctggatgtggcctccgagcaacgtaggctctggccaacactctcccgggaaaaacagcaagagctggtgcaaaaggaggagtccaccgttttttcacaggccatccactatgctaatagaatgagttacctactcttgccgctggactccagtaagagccggttgctgagggaaagagctggactgggcgatttggaatctgcctcaaacagtttagttaccaattccatggccggaagcgttgcagaaagctatgataccgaaagcggattcgaggacgccgaaacttgtgacgtggcgggtgctgttgtgagattcatcaatcggtttgtcgataaggtttgtactgaaagtggagtgacaagcgaccatctaaagggtctccacgtcatggtcccagacatcgtccagatgcatatagaaactttggaggctgtgcaacgggagtctagaaggttgccccctatacaaaaacccaaacttttgcgcccacgactgctccctggggaagaatgcgtgctggacgggctccgtgtatatctgctccccgatggccgtgaggaaggagccggaggcagtgccggaggacccgctctgctccccgctgagggcgcagtgttcctgactacgtacagggttatcttcaccggcatgccaacggaccccctggtgggagagcaggtggttgtcagaagcttcccagtggcagcacttacaaaggagaagaggatcagtgtacagacacctgtggatcaacttttacaagacggtttgcagcttaggtcctgcacgttccagctcttaaagatggctttcgacgaagaagtggggagcgacagtgctgagctgtttagaaagcagctccataagctgagatacccccctgatataagagcaacctttgcattcacactggggtctgcccataccccagggagacctcccagagtgaccaaggacaaggggccaagcctgagaacactctctcggaacctggtcaagaatgccaagaagacaattggcaggcagcacgttacacgaaagaaatacaatcccccatcttgggaacataggggtcagcctcccccagaggaccaggaggacgaaatttctgtgtctgaagaactggagcccagtaccctcacacccagtagtgccctgaagccctccgaccgcatgaccatgtcatcactggtagagcgagcttgctgccgggattaccagcgtctcggcctgggcaccctttcttcttcgctttccagagcgaaatcagagcctttcaggatcagtccagtgaaccggatgtatgctatctgtaggtcatacccaggcctgctaattgtgccccagagcgtgcaagacaatgcgttgcaaagagtgagtcgttgttacaggcagaatcggtttcccgtggtgtgctggcgctcaggcagaagtaaggcagtgttactgagaagtggcggattgcacggaaaaggtgtggtgggacttttcaaagcacagaacgcaccgtcaccaggccaaagtcaggctgatagttcttctctggaacaggaaaaatatctccaagccgtggtatcaagcatgcccaggtatgcagatgcatcaggacggaatactctgtctggcttcagcagtgcgcatatggggtcccacggcaaatggggtagtgttagaacgtctggaagatctagtggactcgggacagatgtggggagcagactggccggtcgagacgctcttgcgcctcctcaggcgaatggaggaccccctgaccccggatttctgcgccctcagcgggctgctctttacatccttggagataaagcccaactcaagggcgtgagatctgaccctctccaacagtgggagcttgttccaatcgaggtgtttgaagctcggcaagtaaaggcctcttttaaaaagctactgaaggcatgtgtgccaggatgccctgccgctgaaccttcacctgctagctttcttaggagtttagaggacagcgagtggctgatccagatccacaagctgctgcaggtgagtgtgttagtcgtggaactgctagactccggtagtagtgtgctcgtcggtctggaggatggatgggacataacaacccaggttgtcagcttggtgcaactgctgagcgatcccttttatcgaacccttgagggatttcggcttcttgttgagaaggagtggttatcattcggacacagattctcgcacagaggagcccacaccctggccggtcaaagtagcggttttactccagtgtttctccaattcttggattgcgtccatcaagtgcacttacaattcccaatggagttcgagttttcacaattttacctgaaatttttgggttaccaccacgtttctaggagatttagaacattcctgcttgactcagactatgaacgcattgagttgggtcttctttacgaggagaaaggagagcggcgaggccaggtcccctgccgatccgtatgggagtacgtggacagactctccaagaggactcctgttttccacaattatatgtacgcccctgaggatgccgaggttctccgcccttactccaacgtttccaacttaaaagtctgggatttctacaccgaagagacactagctgagggacccccatacgattgggaactagctcagggtccacccgagccgcctgaagaggaacggtctgacggtggcgctcctcagtccaggcggagagtcgtctggccgtgctatgatagttgtccacgcgctcagcccgacgccatctcgcgtctgctcgaagaactccagcgtctggagaccgagttagggcagcccgcagagcggtggaaggacacctgggaccgggtaaaggccgctcagaggttggaaggccgacccgacggcagaggtactccgtcctctctgctggtgtctaccgcccctcaccataggcggtccctgggggtctatctccaagagggacccgtgggctcgacactgtctctgagtctcgactctgatcagtcctcaggcagcacaacatccggctctcgtcaggctgctcgcaggtcaacaagtaccctgtatagccaatttcagacggccgaatcagagaatcgctcctacgagggaacgctgtacaagaagggtgccttcatgaaaccatggaaagcgaggtggttcgtgctcgacaaaacaaaacatcaacttagatattatgaccatcgcgtggacactgagtgtaagggggtgatcgacctggccgaggtggaagcggtggccccaggcacccctacgatgggtgctcccaagaccgttgatgagaaggccttcttcgatgttaaaaccactaggagagtgtacaacttctgtgcccaggatgtaccaagtgcccagcaatgggtcgatcggatccagtcttgccttagtgatgctta

SEQ ID NO: 240274 - DNA, 5550 bp, Artificial Sequence
  Description of Artificial Sequence: Synthetic coding sequence
atggccaggctcgccgactactttatagtcgtgggctacgaccacgaaaagcccggatctggcgagggcctggggaagataatacagcgctttccacagaaagattgggatgacaccccgttccctcagggtatagaactattctgtcagcccggagggtggcagctgtcaagagagaggaagcagccaacattcttcgtggtggtgttaaccgacatcgactcagatagacattactgtagctgtttgactttctacgaagccgagatcaatctgcagggcacaaagaaggaggagatcgaaggtgaagccaaggttagcggactgatccagcctgccgaggtgtttgccccaaagtccttggtgctggtgagcaggttatactatcctgaaatttttcgtgcatgcctgggccttatctatacagtgtacgtggacagcttgaacgtgagtctggagtcattgatcgcaaatctctgcgcttgtctcgtcccagccgcaggtggttcccagaaactcttttctctgggcgcaggagacagacaactcattcaaacccccttacatgatagtctgcctatcactggtacgtccgtagcactgcttttccagcaactagggatccaaaatgtgctctccctgttttgcgcggtgctcacagaaaacaaggttctgtttcatagcgcctcatttcagcggctctctgacgcctgcagggctcttgaaagcttaatgttccctctcaaatactcatacccatacatccccatcctgcctgcccaactgctggaggtactctccagccccactccctttatcattggcgttcacagcgtgtttaagacagacgttcatgagttactcgacgtgataattgcagatctggacggtggcaccataaagatccctgaatgcattcatctatcaagcctgcccgaacctctcctgcatcagacccagtcagctttatcactgatcctccaccccgaccttgaggtcgcggatcacgcgttcccaccaccacggaccgcgctaagccactcaaaaatgctcgataaggaggtccgtgccgtttttctgcggttatttgcccagctctttcagggatatagatcctgccttcagctgatccgaatccacgcggaaccagtgatccacttccacaaaaccgccttcctggggcaacgaggtttggtggagaacgattttttaaccaaggtcctctccggtatggccttcgctggctttgtctctgaacgaggccctccctatcgctcatgcgatctgttcgacgaactcgtcgccttcgaggttgagcggataaaggttgaagaaaacaatcccgtgaaaatgattaagcatgtgcgagaattggccgagcagctgtttaaaaatgagaaccccaatccacacatggccttccagaaagtcccacggccaactgagggtagtcacctccgcgtgcacatcctcccattccccgaaataaacgaagcccgtgtgcaagagttgatacaggaaaacgtcgccaagaaccagaacgccccaccggcaacccgaattgagaaaaaatgcgtggttcccgctggaccccctgttgtatccattatggataaggttactactgtgtttaactccgcacagcggctggaggttgtgcgaaactgtatctcttttatttttgaaaataaaatccttgaaaccgagaaaactctcccagctgctctgagggccttgaagggaaaggccgctagacagtgcttaaccgacgagctgggcctccatgtgcagcagaacagagctatactggatcatcagcaattcgattatataattcgtatgatgaactgtacactgcaggattgctcatccctggaggagtataatattgctgctgccctcctgccccttacctcagcattctacagaaagctggcccctggtgtgtctcagtttgcctacacttgcgtgcaagatcaccccatttggacaaatcagcagttttgggagacaacattttacaatgctgtgcaggagcaggtccgatctctatatctgtcggccaaagaggataaccatgcaccacaccttaaacagaaggataagttaccagatgaccattaccaggaaaagacagctatggatctggccgctgagcagctgagactctggcccacccttagtaaatccacccagcaagagttggtgcagcacgaagaatctactgtgttttcccaggctatacattttgccaacctgatggttaacttactggtcccactggatacgtcaaagaacaaacttctcaggacttctgctcccggtgactgggagtcgggctccaactctattgtcaccaactccatcgcaggatctgtggctgaaagctacgacacagaatctggctttgaggacagcgaaaacaccgacattgccaactcagtggtgcggttcatcacccggttcattgataaggtttgtactgaatctggggtgacacaggatcacataaaaagcttgcactgtatgataccaggtattgttgcgatgcacatcgagacactcgaggccgtccatagagaaagccgcaggctgcctcccatacaaaagccaaaaatcctccgacctgccttgctccccggtgaagagatcgtgtgtgaaggtctgcgagtcctgctcgacccagatggccgtgaagaagcgactggcggactcctgggcggtccccagttactgcccgcagaaggtgcgctcttcctcactacataccggatcctgtttagaggaactccccatgaccagctggtcggggagcagactgtggtgcggtccttcccgatcgccagcattaccaaggaaaaaaagattaccatgcagaaccagcttcagcagaacatgcaggagggacttcagatcacaagcgccagcttccagcttattaaggtggcctttgatgaggaggtatcccccgaagtcgtcgaaatattcaagaagcagctcatgaagtttcgttacccgcagtctattttcagcacgttcgctttcgctgctgggcagaccactccccagattatcttgcccaagcaaaaggaaaaaaatacctccttcagaacattctcaaagacaatcgtcaagggagctaagagagctggaaagatgactatcggcagacagtatctcctgaaaaaaaaaaccggaacaatcgttgaggaacgagtcaacagaccaggatggaatgaagacgatgatgtaagtgtatccgacgagagcgaattgcctacctctacaacgctcaaggcttctgagaagtcaactatggagcagttggtcgaaaaggcttgtttccgggactaccagagattggggctagggaccattagtgggagcagttctaggagccgacccgagtatttccggatcaccgcatcaaaccgcatgtacagcctatgccgatcctatccaggactattggtcgttccccaagccgttcaggattcctccctgcccagagtcgctcggtgttacaggcacaatcgcctgcccgtggtatgctggaaaaatagtaggtcaggcaccttgctgttacggagtggcggttttcacgggaagggtgtggtgggactctttaagtcacagaacagcccccaggctgccccaacttcttccctcgaatctagtagttctatagaacaggagaaatacctccaggcgctgctcaacgccgtgtcggtgcatcagaaattgagaggaaactccacactgaccgtgcgtccagccttcgcccttagcccaggcgtgtgggcttccttgcgttctagtaccaggttgatttcgagtcccacttcatttatcgatgttggtgcccgtttggcaggtaaagaccactccgcgtcattttccaattcatcctacctgcagaatcagctcctgaagcggcaggctgcattgtatatcttcggagaaaagtctcagctgcgcaactttaaagtcgagttcgctctgaactgcgagtttgtgcccgtcgagttccatgagatccgtcaggtgaaggcgtcttttaagaagctcatgagggcgtgcattccttccacgatacctacggactccgaggtgacatttctaaaggctctcggggacagcgagtggtttccacagttgcacaggataatgcaacttgccgttgtcgtcagtgaagtattggagaatggcagctccgttctggtgtgtttggaagagggctgggacattaccgcgcaggtgactagcctggtccagctcctttctgacccattttacaggactcttgagggtttccagatgctcgtcgagaaggagtggctctcctttggacacaagttttctcaaaggtcaagcctaaccctaaactgccagggctctgggtttgcccctgtattcctccaatttctggattgtgtgcaccaggtgcacaaccagtaccccacggaattcgagtttaacctgtattaccttaaattcctggcgttccattatgtgagtaatcgatttaaaaccttcctactcgactccgactatgaacgccttgaacatggtacgctcttcgacgataaaggcgagaagcacgctaaaaagggcgtctgcatttgggaatgcatcgatcgaatgcataaaaggtcgcccatatttttcaattatctttattctcctctcgagattgaagctctcaaaccaaatgtaaacgtctcttcgttgaaaaagtgggattattacattgaagaaacgctgagcacaggtccatcctatgattggatgatgctgacacctaagcatttccccagcgaagattctgatctggcaggagaggccggtcctaggtcccagaggaggaccgtttggccatgctatgatgatgtgtcttgtacacagcccgatgctctcacatcgctcttttcagagatagagaaacttgagcataagctgaaccaagctcctgagaagtggcaacaactttgggagagagtaacggtcgacctgaaagaagagcctcgcacagatagatcccagcggcacctttctcgctcccctggcatcgtcagtacgaatctaccatcatatcagaagagatcattattacacttacccgactcgtctatgggggaagaacagaacagcagtattagtccctccaacggggttgagcgacgggctgccacattgtactcccagtacacttctaagaacgatgaaaatcggagtttcgaaggaactctctataaacggggtgccctcttgaaaggctggaagccgcgttggtttgtgctggacgtgacaaaacatcagctgcgctactacgatagcggggaggacacatcctgtaaaggtcacatcgatcttgccgaggtcgaaatggtcatacctgcaggacccagcatgggcgctcctaaacacactagtgacaaggcttttttcgatctcaagacatcgaagcgagtctacaatttctgtgcacaggatggccagtcagcacaacagtggatggacaagattcagagttgcattagcgacgcataa

SEQ ID NO: 240275 - DNA, 4791 bp, Artificial Sequence
  Description of Artificial Sequence: Synthetic coding sequence
atggagagccgggagactctgagctcttcccgtcagagaggaggagagagcgactttctgccagtctcgtcagccaagcccccagcagcccctgggtgtgccggtgagccgctgctcagcactccgggtcccggaaaaggcataccagtggggggtgaaaggatggagccagaagaagaggatgagttaggttccggtcgtgatgtcgactccaattccaatgcagacagcgagaaatgggtagccggtgacggattggaggagcaagaatttagtattaaggaagcaaattttacagaaggatctttgaaactgaagattcaaactaccaagagagccaagaagcccccaaagaatctggagaattatatctgccctcccgagattaaaatcacaataaaacagtccggggatcagaaggttagcagggccggtaagaatagcaaggccactaaagaggaggagcgcagccacagcaagaaaaagctcctaactgcttctgacttggccgctagcgatctaaagggcttccaaccccaggcttatgaacgaccccagaagcattcaaccctgcactatgacactggtttaccacaggatttcaccggggatactttgaaaccaaaacaccagcagaagagctccagtcagaaccacatggactggagtactaactccgatagcggacccgttacacagaactgtttcatttcacccgagtctggcagggaaaccgcctctacttctaagattccagccctggagcccgtggcatctttcgccaaggcccagggtaagaaaggctctgccggaaatacttggagccagctcagcaataataataaggatttgctgctagggggtgtcgcaccttccccttcgagccatagctccccagcgcctccctcgtcctcggctgagtgcaacggcttacagcctcttgtggaccaggatggcggaggcacaaaggaaccccctgagcccccaacagtggggagtaagaagaaatcctccaagaaggatgtgatcagccagacaatccccaatcctgacttagattgggtgaaaaacgctcagaaagcattcgacaacaccgagggcaagagggaggggtactctgctgacagcgcccaagaggcttcccccgctcggcaaaacgtttcctccgctagcaaccctgagaacgattcgagccatgtgaggattaccattccaataaaagcccctagcctggatcctaccaaccacaagagaaaaaagcggcaatctataaaggcagtggttgagaagatcatgcctgagaaggcgctggcatcaggaataacgatgagcagtgaagtggtgaatcgcattctgagcaatagcgagggcaacaagaaggatcctagggttcccaaattaagtaagatgattgagaacgagagtccatcagtcggactcgaaaccgggggtaatgccgaaaaagtaatccccggtggcgttagtaagcctagaaagccccctatggtgatgacgccacctacctgcacagatcattccccttcaagaaaactgcccgaaattcagcaccccaagttcgccgctaagcgtagatggacgtgctcaaaaccaaaacccagcaccatgttgcgggaggctgttatggctacatcagacaaactcatgctggagcctccgagcgcctaccctatcactcctagtagtcctctctatacaaacaccgactccctcaccgttattactccagtgaaaaaaaaacggggtcggccaaagaagcagccacttcttactgtggagactatccatgagggtacgtcaacttctccagtaagtcccatctctagggagttccctgggactaaaaagcggaagaggcgaaggaacctcgccaagcttgcccaacttgttcccggagaggataagccaatgtccgaaatgaagttccataaaaaagttgggaagctgggggtgctggataagaaaactatcaagaccattaacaaaatgaaaaccctgaagaggaagaacatccttaatcagatacttagctgctccagcagcgtggcactgaaggctaaggcccctccagaaactagcccaggagccgctgctatcgaaagtaagctaggtaagcagatcaacgtgtccaagagaggcactatctacattgggaagaagcgcggtcgcaaacctcgggctgaactgccacctccgagcgaggagccaaaaaccgccattaaacacccacggcctgtttccagccagcctgacgttccagccgtcccctcaaactttcaatctctagtggcctcgtcccccgctgcaatgcatccccttagcacccaactgggaggcagtaatgggaacctgtctcccgcatctacagagacaaacttctctgaactgaaaactatgcccaaccttcaaccgatttctgcccttccgactaaaacgcagaagggaatacactccggcacttggaagctgagccctccacgactcatggctaatagcccttcccacctctgcgaaattggcagcctgaaggagatcaccctaagtcccgtatccgagtcacattctgaggaaactattccttctgacagcggtatcggtaccgacaataattccacatcggatcaggcagagaaatcctctgaaagccgtagaagatattcttttgacttttgctcattggataatcctgaggccattcctagtgatacgtccaccaagaatcggcacggacaccggcagaagcatctgattgttgacaatttcctggcccacgagagcctcaaaaagcctaagcataaacgtaaaaggaagagtctccaaaaccgcgacgatttgcaattccttgcagacctggaggagctaatcactaaatttcaagtcttcagaatctcacaccgctcatacaccttctaccatgaaaacccttacccttctatttttaggatcaactttgatcattattatccggtgccttatatccagtatgatcctctcctgtacttaaggcgaacctccgaccttaagtcgaagaagaagagaggccgacccgcaaaaaccaatgacacaatgaccaaggtcccattcctccagggcttcagctaccctataccctcgggcagttactacgccccttacggtatgccatataccagcatgcccatgatgaacctcgggtactatggccagtatcctgctcctctgtatctgagtcacaccctgggtgctgcaagcccgtttatgcggccaaccgtgccacctccacaattccatacgaactctcacgtcaagatgtctggtgccgctaaacataaagccaagcatggcgtacatttgcaggggccagtgagcatgggactgggggacatgcaacccagtctgaaccctccaaaagtgggatctgcctctctctcaagcggccgtcttcataaacgcaaacataaacacaaacataaacacaaagaagacaggattcttgggacccacgacaatctgagtggactctttgcaggcaaagcaactggttttagctcgcatatcctgtctgagaggctatcaagtgcggataaagagctccctctggtttccgagaaaaacaaacataaggagaagcagaaacatcagcatagcgaggccggtcataaagcctcaaaaaacaactttgaagtggatactctgagtactttatctctctcggacgctcagcactggacccaagccaaggaaaaaggggacctcagctccgaacctgtggattcatgtactaagcggtattccggcagcgggggagatgggggtagcacgcggtctgagaatctcgacgtgttctcggagatgaacccttccaacgacaaatgggatagtgacgtctctggctcgaagcggagatcctacgagggcttcggaacctatagggaaaaagacattcaggcctttaagatgaatagaaaggagcggtctagctatgacagttcaatgtctcctggaatgcctagtcctcacctcaaggtagatcagaccgctgtccatagtaaaaacgagggatcagtgcctacaatgatgacccgtaagaagcctgccgcagtggactccgtgaccatacctccagccccagtgctgagccttctcgctgcttccgccgcaacatccgatgcagtcggttctagcctcaaaaaaagattcaaaagaagagaaattgaagccattcagtgtgaggtgcggaaaatgtgcaactacacaaagattctgtcaactaagaaaaacttggaccatgtgaataagattctcaaggctaaacgcctccagcgccagagcaaaactggcaataacttcgtgaagaagagacgtggcaggccaagaaaacagcctacgcagttcgatgaggacagcagggatcaaatgccggtgctggagaagtgcatcgatctccccagcaagcggggtcagaagccaagcctgtctcccttggtgctggagccagccgcaagtcaggatactatcatggcgacaatcgaggccgtcatccacatggctcgcgaagccccacccctgcctcccccaccgcctccaccacttccaccgccaccccctccaccgcttcctccaccgccaccgctccccaagacccccaggggtggtaaacgcaagcataagccacaggcacccgcacagcctccgcagcaatcaccgcctcagcagccactaccccaggaagaggaggtgaaagctaagagacagaggaaatctagaggtagcgagagcgaggtgctgccgtat

SEQ ID NO: 240276 - DNA, 729 bp, Artificial Sequence
  Description of Artificial Sequence: Synthetic coding sequence
atggagagtcgagaaaccctatcatcaagcaggcagcgaggcggagagagcgattttctacccgtgagttccgcaaaacctcctgctgcccctggctgtgcgggagaacctctgctgagcacccctgggccaggaaagggcattccggtgggcggtgaaaggatggaacctgaggaggaggatgagctgggctccggcagggacgtcgattctaacagtaatgccgattccgaaaagtgggtggctggagacggcctggaggagcaggagtttagcataaaagaagcgaattttactgaaggctctctcaagctcaaaatccaaaccactaaacgggctaagaagccaccgaaaaacctggagaattacatctgtcccccagagataaagatcaccattaaacagtctggggaccagaaggtcagccgggcaggaaagaatagcaaggcaacgaaggaggaagaacggagccactctaagaaaaaactgctaacagccagtgatctggctgcaagcgatcttaagggcttccaaccacaaatcaaagacagttccaaagaggaggtgtggaagagacgcggaggccaaggcatcccttttaagaaacagtttctatcccaggagagggctatgtgcttttcttgtcccaggaacccttttcccgctaagcctggatcacttacattgcccttccattctgaaccagccgtctgggcccaggaagtgtag

SEQ ID NO: 240277 - DNA, 414 bp, Artificial Sequence
  Description of Artificial Sequence: Synthetic coding sequence
atggagtcccgcgagacactgtcttcaagtagacagagggggggagagtcagactttctgcccgtcagctctgctaaaccccctgccgcacctggttgtgcgggagagccactattgagcactcccggtccgggaaaaggcatccctgtcggcggagagaggatggagccggaggaggaagacgaactgggttcaggaagggacgtggactctaactctaacgcggatagcgagaaatgggtggccggagatggattggaggaacaggagtttagcataaaggaggcgaactttacagaaggctccctcaagctcaagatacagacaactaagcgggctaagaaaccacccaaaaacctcgagaactacatctgcccgccagagattaaaataacaattaagcaatcaggctag

SEQ ID NO: 240278 - DNA, 2055 bp, Artificial Sequence
  Description of Artificial Sequence: Synthetic coding sequence
atgttcgcagaggccgctaagacgacgcgcccatgtggaatggccgaattcaaggaaaaaccagaggctccaacagaacagttagacgtggcgtgtgggcaggaaaatttgcccgtgggcgcatggcccccaggagccgcaccagcgccttttcaatatacacccgatcatgttgttggacctggggctgacattgatcctacacagatcacatttcctggttgtatttgtgtcaagacaccgtgtctcccaggaacatgctcttgtttgcggcacggagagaattatgacgacaactcatgccttagggatatcggtagcgggggtaaatacgcagagccagtcttcgagtgtaatgtactctgtaggtgcagcgaccactgtagaaacagagtggtgcagaaggggctccagttccacttccaggtgtttaagacccacaaaaaaggctggggcctccgcacgcttgaatttattcccaagggacggtttgtgtgcgagtacgctggcgaggtgctgggattttccgaagtccagaggagaattcatctccagactaaaagtgactcgaattatattatcgccatcagagaacatgtgtacaatggacaggtaatggagactttcgtcgatccaacatatattggcaacatagggcgatttcttaatcatagctgtgagccaaatctgctcatgatcccggtaagaattgactctatggttcctaaacttgcacttttcgccgctaaggacattgtcccggaagaggaactgtcatacgactattctgggcgatacctcaacctaaccgtctccgaggataaagagcgcttagatcacggaaaactcaggaagccatgttactgtggggcaaagagctgtacagcttttttgcctttcgattctagtctgtattgccccgtggagaaatccaatatctcctgcggcaatgagaaagaaccaagtatgtgtggctccgctccttccgtgttcccatcatgtaagagactgacccttgaaacgatgaaaatgatgctggacaaaaagcagatacgggctatctttctttttgagttcaagatggggagaaaagcagctgaaaccaccagaaatataaacaatgcctttgggccaggtactgccaatgaacggaccgtacagtggtggtttaagaaattttgcaagggagatgaatcgctggaagacgaggagcgctcaggcagaccgtctgaagtagacaatgatcagttgagagccattatcgaagctgatcccctgacaactacccgggaggtggcagaagagctaaacgtcaaccacagtaccgtggtcaggcatctcaaacagatagggaaggtaaagaaattggacaaatgggtaccacacgagctgactgagaatcagaaaaaccgtcgatttgaagtctcgtccagtctgatcctcagaaatcataatgaaccctttttggacagaatcgtgacctgtgacgagaagtggatcttgtatgataaccggcgacgttcagcgcagtggttggatcaagaggaagcacctaagcacttccctaagccaattctccaccccaagaaagtgatggtaaccatctggtggtccgccgctggcctcatccattatagtttcttgaaccctggggagaccatcacctcagaaaagtatgctcaagagattgatgagatgaatcagaagctgcaaagactacaattggccttggtcaacaggaaggggcctatcctacttcacgacaatgctcgccctcatgtggctcagccgactcttcagaagttgaacgagctgggctacgaggtgttgcctcaccccccttactcgcctgatctcctgcctactaattatcatgtattcaaacacctcaataactttctgcaggggaagcgctttcacaaccagcaggatgctgaaaacgcattccaggaattcgtggaaagtcagtccaccgatttttacgcgacaggcatcaaccagctgatttctcggtggcagaaatgcgttgactgcaatggatcctacttcgactag

SEQ ID NO: 240279 - DNA, 1098 bp, Artificial Sequence
  Description of Artificial Sequence: Synthetic coding sequence
atgttcgctgaggccgcaaagacaacacggccttgcgggatggcagaatttaaagagaagccagaggcccctacagagcagttggacgtggcatgtgggcaggagaatctcccagtcggagcatggccacctggcgctgcacctgccccatttcagtacacaccagatcatgtggtcggtccaggagcagatatcgacccaacccaaatcacattccctggctgcatctgtgtgaagaccccatgcctgcccggtacctgctcgtgcttgcggcatggcgagaactatgatgataatagttgcctcagagatatcgggtccgggggtaaatacgcggagcctgtgtttgagtgcaacgttctctgtcgatgctccgatcactgccggaacagggtggtgcaaaagggtctccagtttcacttccaggtctttaagacccataagaagggttggggactgcggacgctagagttcattcccaaaggacgctttgtatgtgaatacgccggagaggtcttgggattttcagaagtacagcggagaatccatttgcaaaccaagtctgatagcaactatatcatagccatacgggagcacgtgtacaacggtcaggtgatggaaacatttgtcgacccgacatatattgggaacatcggcagattcctcaaccacagttgcgagcccaatttactgatgatccccgtgaggatcgattctatggtgcccaagctagcactgttcgccgctaaggatatagtcccagaagaagagttatcatatgattattccggccgttatttgaatctcaccgtgtctgaagacaaagagagactggatcacgggaaactgcgaaaaccctgttattgcggcgctaaatcttgcactgccttcctgcccttcgatagctcactctactgccccgtggagaagagcaacatcagctgcggtaacgagaaggaacccagcatgtgtgggtccgcacccagcgtgttcccatcctgcaagcgtctgacactcgaggtcagtctcttcagtgataagcagctggctcctccttattccggaaggcagtggcttgcgagcttcacaagcgcatag

SEQ ID NO: 240280 - DNA, 516 bp, Artificial Sequence
  Description of Artificial Sequence: Synthetic coding sequence
atgttcgccgaagcagccaagactaccaggccttgtgggatggcagagttcaaagagaaacctgaggccccaaccgaacagctggacgtcgcttgtggacaagaaaatctgcccgtgggagcctggccacccggtgctgcccctgctcctttccagtatacacctgatcacgtggtggggccaggtgctgatattgaccctactcaaatcacattcccagggtgcatttgtgtcaagactccctgcctgccgggaacctgctcttgtctcaggcacggagagaattatgacgacaatagctgtctgagggatatcggtagcggagggaaatacgcagagccagtctttgaatgcaacgtcctttgtcgctgctctgaccattgtaggaacagggtggtacagaaaggtctccaattccactttcaggtattcaagacccacaaaaaggggtggggtcttaggacgctggagtttatccctaaagggcgtaaagttgagcaccagctttggaagtag

SEQ ID NO: 240281 - DNA, 1101 bp, Artificial Sequence
  Description of Artificial Sequence: Synthetic coding sequence
atggacagcgacgatgaaatggtggaagaagccgtcgaaggccacctggacgacgatgggctcccacatggattttgtaccgtgacctacagcagtaccgacagatttgagggaaactttgtacacggggaaaagaacggccgtgggaaattctttttcttcgatggctcaacactcgagggctattacgtcgacgacgccctgcaggggcagggggtgtatacatacgaggatgggggagtcctgcaaggcacatatgtcgacggagaacttaatggccctgcacaggaatatgataccgacggcaggctaatttttaagggccagtataaagataatatcagacatggcgtgtgttggatttattaccccgatggcggatctttagtgggtgaggttaatgaagacggcgaaatgacaggagaaaagatagcatatgtctaccctgatgagcgcactgccctgtacggaaagttcattgacggtgagatgatcgaaggcaaattagcaacattgatgtcaactgaagagggtcgccctcacttcgagctcatgcctggcaattccgtgtaccactttgataagtctaccagctcttgcatctccacaaacgcacttctgcccgatccttacgagtccgagagagtttatgtcgccgaatccctgatcagttcagccggagaggggctgttcagtaaagttgctgtgggacctaacactgtgatgtccttttacaacggagtgaggatcactcaccaggaagtggactcacgcgactgggcgctgaacggcaacaccctgtcactggatgaggaaacagttattgacgtgcccgagccctacaaccatgtgagcaagtactgtgcatcactggggcacaaggcgaaccacagcttcaccccaaattgtatttacgatatgtttgtgcatccacgatttggaccaatcaaatgtatacgcactctccgcgctgtggaagctgacgaggaattgacggtcgcctacggctatgaccattcccccccaggaaagtctggacccgaagccccagagtggtatcaggttgagctgaaggcttttcaggccacgcagcaaaagtag

SEQ ID NO: 240282 - DNA, 5124 bp, Artificial Sequence
  Description of Artificial Sequence: Synthetic coding sequence
atggatcaggagggtggaggcgatggtcagaaggctccgagctttcagtggcgaaactataaactgatagtggatccagccctagaccctgccctgcggaggccctcccagaaggtgtataggtacgatggagttcattttagcgtcaatgacagcaaatacatcccggtcgaggatctccaagaccctaggtgccacgtgcgatctaaaaatcgagattttagcttgcctgtgcctaaatttaagctggatgaattctacatcggccagattcccctgaaggaggtcacttttgcccgtctcaacgacaatgtgagagaaacgttcctgaaagatatgtgccgcaaatatggcgaggtagaagaggtagaaatcctgctacacccccgtacaagaaaacacctcggtctagcgcgtgttctctttacttctacaaggggggcaaaggaaaccgtcaaaaatctgcaccttacctctgtgatgggcaacatcatccacgcccaattggacattaagggacagcagcggatgaagtattacgaactgattgtaaatggcagttataccccacagacggtccccacaggagggaaagccttgagcgagaaattccaggggagcggtgccgcaactgaaaccgcagaaagccggcgaaggtcgtctagcgacactgcggcatacccggctggtacaaccgccgtcggaacacccggaaacggcacaccgtgcagccaggataccagtttttcctcgtccagacaggatacgccttcgtcctttggccagttcacccctcagtcctcccaaggaacaccctacacatctaggggcagtactccatattcccaggatagtgcctacagctcatctaccacctcaaccagctttaaacctcggcgatccgaaaactcttaccaggatgcatttagccggcgtcattttagcgcctcaagcgcgtcaactacagcctcaaccgccattgccgcaacgactgctgccacggcatcatcatccgcctctagttcctccctaagctcatccagctccagttcatcttccagctcatcttcacagttccgaagctctgacgctaattatcctgcctactacgagtcttggaaccggtatcagcgccacacgagctacccccctcgccgtgccaccagagaggagcctccgggtgccccattcgctgagaacaccgctgagcggttcccgccttcatatacctcatacttaccgcctgagccgagcagaccaaccgaccaggactacagacccccagcaagtgaggccccacctcccgagcctcctgagcccggaggaggaggagggggagggggacccagccctgagcgcgaggaagttcgcacatctcccagacccgcatcacccgctcggtccgggagtccagccccagagaccacaaatgagtctgttcccttcgctcagcacagctcactagacagtaggatcgagatgctcctgaaagagcagcgatccaagttctcatttctggcctccgacacagaggaggaggaagagaactcttcaatggtgctaggcgcacgggacacaggttctgaggtcccgtcgggttctgggcatggcccttgtacccctcccccagcccctgctaattttgaagacgtggccccaacggggagcggggagcccggtgccactcgggagagtcccaaggcaaacggccagaaccaggcaagtccctgttcctccggtgacgatatggagatttctgacgatgatagggggggttctccaccccctgcccctaccccaccacagcagcccccaccgccacccccaccaccccctccccctccaccttatctcgcatccttgccgcttggatatcccccacatcaaccagcttatctgttgccaccccgaccagacggaccgcctccccctgaatacccacccccaccaccccctccgcctcacatctatgactttgtgaactccttggagctaatggatcgcctgggcgctcagtgggggggaatgccaatgtcatttcagatgcagacacagatgctgactcgtttgcatcagcttcgccagggtaagggtctgatcgctgcttcagctgggccacctggtggcgctttcggagaggccttcctgccattcccccctccacaggaggctgcttatggactcccctatgcgctatacgcccagggacaggaaggcagaggcgcatatagccgagaggcttaccacttgcccatgcccatggctgcggaacctctcccctcatcatccgtgagcggcgaggaagcacggctccccccaagagaggaggcagaacttgccgagggaaagactttaccaacggccggaaccgtggggagagtgcttgctatgttagttcaggagatgaagtccataatgcagcgggacctgaatagaaagatggtcgaaaatgtagcgttcggcgcatttgaccagtggtgggagtccaaagaggagaaggccaagccgttccagaacgctgccaagcagcaagcaaaggaagaagacaaagagaaaacaaaacttaaagagcctgggcttctcagcttagttgactgggcgaagagtggtggaacaaccgggatagaggcctttgctttcggatccggcctgaggggagccctccgactgcccagctttaaggtcaagcgcaaagagccttcagagatatctgaagcctccgaggaaaaaaggcccaggccctctacccccgcagaggaggatgaagatgatccagagcaagaaaaggaagctggcgaacccggtcggcctggtacgaagccgcctaagagagatgaggagcgcggaaagacccagggtaaacaccgaaaatccttcgccctggactctgagggtgaagaagcctcccaggagagttcttctgagaaagacgaagaggatgatgaggaagacgaggaagatgaagatcgagaggaagcggtcgacacaaccaagaaggaaaccgaggtctcggatggcgaggatgaggaatctgatagctcctccaaatgtagtctgtacgccgactctgatggagagaacgatagcacatccgattcagagagctcttcctctagctcaagtagttctagtagcagctcttcaagttcctcctcttcctctagttcttcttcggagtccagtagtgaggacgaagaggaagaagagcgccctgccgcacttccctccgccagccccccacctagagaggtgcctgttcccacacctgcgcctgttgaagtccctgtccctgaacgggtcgcaggcagtccagtaacccctctcccagagcaagaggcttcccctgccagaccggctgggccaactgaggagagccccccttctgcccctctgcgacccccagaacccccagcaggaccccctgcgcctgctcctagaccagatgagagaccgtcaagtccaatcccgctccttccgccaccaaaaaaacgccgaaagactgtgagcttctccgcaatcgaggttgtgccagccccagagcctcctcctgccacacctccccaggccaaatttccaggacccgcttctcgaaaggcccctaggggggtagagagaaccattcgcaacttgcctttagatcatgcctcactagttaagagttggccggaggaagtctcccgcggaggcagaagtagggcaggcggtcgcggaaggcttacagaagaggaggaggccgaacccggtacagaagtagacctcgctgtgctggctgacttggcactgacccctgcgaggagggggctgccagccctgcctgcggtggaggattctgaggcgacagagaccagtgatgaagccgagcgccctaggccattgctgtcgcatatcttattggagcacaactacgcattggccgtcaagcccaccccacccgctcccgctttgcggccacctgaaccggtgcctgctccagccgctctattttcgagccctgccgacgaggtcttagaggcgcctgaggtagtggtggctgaagcagaggagcctaagcctcagcagctgcagcagcagcgcgaggagggcgaggaggaaggcgaagaggaaggtgaagaagaggaagaggaaagctctgattctagcagctcaagcgatggcgagggcgctctgcgacggagaagtctcaggagccacgctagaagacggcgtccccctccgccaccaccacccccacccccacgtgcatacgaacccagaagtgagttcgagcagatgaccatcctgtacgacatctggaacagcggtcttgacagcgaggacatgtcctacctccggttaacatatgagagattgttacagcaaacctccggagctgactggctcaacgatactcactgggtacatcacacaatcactaatttaacgaccccaaagaggaagaggaggccacaggatggacctcgggaacaccagacggggtccgccagatctgaaggctactatcccatctctaagaaggaaaaggacaagtatttagatgtttgccccgtcagcgcccgacagctggagggagtggacacacagggcaccaatagagtactttcggagagacggtccgagcaaaggaggcttctgtccgccatcgggacctccgccattatggactcggatctcctgaaattaaatcagctcaaatttagaaaaaaaaagctgcgcttcgggagaagccgaatacacgaatggggactgtttgctatggagcccatcgccgctgatgagatggtgattgaatatgtggggcaaaatatccgacagatggtagccgatatgcgcgagaagcgctatgtccaggagggcataggatcctcctacctgtttcgagtggaccacgatacaattattgacgcgactaagtgtgggaatttggccaggttcatcaatcactgttgcacccctaattgctacgctaaagtgatcactatagagtcgcagaaaaagattgtaatttacagtaagcagcccatcggcgtcgatgaggagataacgtacgactataagttcccacttgaagacaacaagataccctgcctctgcgggacggaatcctgcagagggtcacttaactag

SEQ ID NO: 240283 - DNA, 213 bp, Artificial Sequence
  Description of Artificial Sequence: Synthetic coding sequence
atggaccaagaagggggtggagatggacagaaggccccaagcttccagtggcggaactacaagctcattgtcgaccctgcactggatcccgctctccggagaccaagtcagaaagtgtaccggtacgatggagttcacttctccgttaacgattctaaatacattcccgtggaggacctccaggatcccaggtgtcatgtgcgaagtaaatag

SEQ ID NO: 240284 - DNA, 744 bp, Artificial Sequence
  Description of Artificial Sequence: Synthetic coding sequence
atggaccaggagggtgggggtgatggccagaaggcaccgtcttttcagtggagaaactataaactcatcgtggacccagcgcttgatcctgctctcagacgtccatctcagaaagtgtatcggtacgacggggtgcatttctctgtaaacgattccaagtacattcccgtggaagatcttcaggatcctcggtgtcacgttagaagtaagaatcgtgacttttctctgccagttccaaagtttaagttggacgagttttatataggtcagatccctctcaaggaggtgacattcgcccgtctaaatgacaatgtacgcgagacttttctcaaggacatgtgtaggaagtacggagaggtggaggaagtggaaatactgttgcaccccagaacccgaaagcatttaggcctagccagagttctcttcaccagtacaagaggggctaaggagaccgtgaagaacctccatctcactagcgttatgggtaatataatacatgcccaactggatattaagggtcagcagcgtatgaagtattatgagttaattgtgaacggatcatatacaccccaaaccgtccccactggcggtaaggcattgtcagagaaattccagggctcaggagccgctaccgagacggccgagagtagaagaaggtcctccagtgacaccgctgcataccccgctgggacaaccgcggtcgggactcccggtaacgggactccatgcagtcaagacacttag

SEQ ID NO: 240285 - DNA, 5771 bp, Artificial Sequence
  Description of Artificial Sequence: Synthetic coding sequence
atggagaactcccaccctccgcatcatcaccaccagcaacctccccctcagcctggcccttctggagaaagaagaaaccaccactggcgcagttacaaactgatgatcgaccccgctctgaaaaaaggacatcataagctgtataggtacgacggccagcattttagtctcgctatgtccagcaatcgcccagtcgagatagttgaggaccctcgggtggtgggaatttggactaagaataaggaactggagctttctgtgcccaagtttaaaatagatgagttttatgttggtccagtgcctcctaagcaggtgactttcgccaaactgaacgataacatccgagagaacttcctcagagatatgtgtaaaaaatacggggaagtggaagaagttgagatcttgtataacccgaagacaaagaaacacttgggtattgctaaggttgtgtttgccaccgttagaggcgctaaagacgctgtacagcatctacactcaacaagcgtgatggggaacattatccacgttgagttggacactaagggcgagacccgcatgagattctatgagctcctggtcactgggaggtacactccacagactctgcctgtcggggaactggatgcagtctccccaatcgtcaatgagacccttcaactgagcgatgctctgaaacgcctgaaggatggaggtttgtcagcaggttgcggcagcggaagctcttctgtgacgcccaattcagggggaacacccttctctcaggataccgcctacagttcctgtaggttggatacccctaacagctatggtcaggggacacccctgaccccccgactgggcactccttttagccaggacagttcatactcaagcaggcagcccaccccatcatacctttttagccaggaccctgccgttacatttaaagccaggcgtcacgagtcaaaattcacggacgcctataataggcgccatgagcaccattacgtgcataactccccagccgttaccgccgtagcaggtgccactgctgcatttcggggtagctctgacctcccatttggcgctgtgggcggtacgggcggatcaagcggcccaccattcaaggcccagcctcaggactcagccacatttgcacacactccacctcccgcacaggccacaccggcacccggtttcaaaagtgctttctccccgtatcagacacccgtggctcatttcccccctccacctgaagaaccaacagccacagctgcattcggtgccagggactcaggtgagtttagacgcgctcccgcaccccctccacttccgccagcagaaccactggctaaagagaagcctggcaccccaccagggccacctccgcctgatactaatagtatggaattgggcggtagacccacttttgggtggtcaccagaaccctgcgattctcctggaactcccactctagaatcaagccctgcaggccctgagaagccccatgattcgctggatagccggattgaaatgctgcttaaggaacagagaacgaagctcctgtttttacgggagcccgattcagatacagagttgcagatggagggaagccccataagcagctccagctctcagctctccccactggctccgtttgggaccaatagccaaccaggattcagaggccctacacccccatcatcaaggccaagcagtaccgggctagaggatatcagtccaacccccctaccggatagtgatgaggacgaggagctcgacctgggtctggggcctcgcccaccccctgagcctggcccacccgaccctgccggattgctgtcccagacagccgaggttgcactggatctcgtgggggatcgaacccctacatctgagaagatggatgagggccagcagagctcaggagaagacatggaaatcagtgacgatgagatgcccagtgctcctatcactagcgctgactgtccaaagcctatggttgtgaccccaggtgccgctgctgttgccgcacctagcgtcctggctccaactctgcctctcccccctccccctggctttcctcccctcccccctccccctccgccacctccaccccaaccaggttttccaatgcctcccccactcccaccccctccacctcccccacccccagcccaccctgctgtgaccgtccctccacctcctctgcctgctcctccaggcgtgcctccacctcccattctgccgcctctgcctcccttcccccctggtctcttccccgtaatgcaagtggacatgagccatgtgcttgggggtcagtggggagggatgcccatgtcattccagatgcaaacccaagtgctcagccggctgatgacagggcaaggagcttgcccttacccaccatttatggctgccgctgccgctgccgcttccgccggtttgcagttcgtcaacctgccaccctacagaggccctttttccttgtctaacagtggtcccggtaggggacagcattggcctcccttgccaaagttcgatcctagcgtcccccctccaggctacatgcccaggcaggaggacccccacaaagccaccgtcgacggcgtcctattagttgtactgaaagaactaaaggctataatgaaacgggatctgaacaggaaaatggtcgaagtcgtcgcttttcgggctttcgatgaatggtgggacaagaaggagcgcatggctaaggcctccctgactcccgtgaagagcggcgagcataaggatgaagaccgtcccaagccgaaagaccgcatagcttcgtgcttactggaaagttggggcaaaggggaaggcctgggctacgaaggcctgggtctagggattggtctgcggggagcaatcaggctccctagctttaaggtgaagcgcaaggagcctccagacacgacatcttcaggagatcagaaacgcttgaggccttccacaagtgtcgacgaggaggatgaggagtcagagcgggagcgggacagagatatggctgacactccttgtgaactggctaaacgcgatcctaaaggcgtcggggttcggagacgaccggctaggccgctggaacttgacagtgggggagaggaggacgagaaggagtctctgtccgaggaacaagagtccactgaagaagaggaagaggctgaagaggaggaggaagaagaggacgacgacgacgacgattctgacgaccgcgatgagtccgagaacgatgacgaagacaccgctctgtccgaggccagcgaaaaagatgagggagacagcgacgaagaagaaactgtatctatcgttacgagcaaagcggaggccacttcatcaagcgaatcatctgagtcgtccgagttcgagtcctcctctgaatcatcaccctcatcctccgaggacgaggaggaagtggtggccagagaggaagaggaggaggaagaggaggaggagatggttgccgaagagtctatggcttcagccggacccgaggacttcgaacaggacggcgaggaggctgcacttgcgccaggagcccctgccgtggactccctgggcatggaggaagaagtggatatcgagacagaggccgtggctcccgaagaaagaccctccatgttagatgagccaccacttccggtgggcgtggaagagcctgctgatagccgtgagccaccagaagagcccggactctctcaggagggcgctatgttgctgtctccagaacccccagccaaagaggttgaagcaagaccgccactaagtcccgagcgagcacctgagcacgatctggaagtcgagccggaaccccctatgatgttgccgcttcccttgcagccaccattaccccctcctagacccccaaggcccccaagcccacctcctgagccagagacaacagacgcctcacatccgagtgttcctcctgaacctctggccgaggaccatccaccgcacactccaggtctgtgcggcagccttgccaaatcacaaagcacagagacggttcctgccacaccgggaggtgaaccgcctctcagcggagggtcatctgggttatccctgtcgtctcctcaggtccccggttcaccgttttcttacccggctccctctcccagtctgtctagtggtgggctgccgaggactcccggaagggatttctctttcacaccaacattctctgaacccagtggccctctgctgctgcctgtttgtcccctgccaacaggcaggagggatgagaggtccggacctcttgccagcccggtgctcctggaaaccggactgccactgccactcccactgcctctaccattaccgctagcattgcctgcagtcctccgggctcaagcccgagctccgacccccctaccacccctactccccgcacccctggccagctgtcccccacccatgaaaagaaaacccggaagaccaagacgctctccgccatcaatgctgagtcttgacggtccactggtacgacctcctgccggtgccgcacttggtcgggagctgctgcttcttcctggacagcctcagacacctgtctttccaagcactcatgatcccagaactgtaacactcgacttcagaaatgccggtatccccgcacccccacctccacttccccctcagccaccccctccaccgcctccccctcctgtagaaccaacaaagctccctttcaaggagcttgacaaccagtggccatctgaagcaataccccctggcccaagggggagagatgaggtgactgaagaatacatggaattggctaaatctcggggaccttggcggaggcctcctaaaaaacgtcacgaagacctggtgcctccagccggaagtcccgagttatcccctcctcagccgctttttcgaccacggagcgagttcgaagagatgactatcttgtacgacatatggaacggtggcattgacgaagaagacatcaggtttctgtgtgttacctatgagaggctgctccagcaggataacggcatggattggcttaacgacaccttgtgggtataccaccctagcaccagtctcagctccgccaagaagaaaaagcgcgacgacgggatccgcgaacatgtcaccgggtgtgccagaagcgaaggattttacactatcgataaaaaggataagttaagatatctgaattcctcacgcgcttcaaccgatgagcctccagctgacacccagggcatgtctatccctgcacaaccacatgcctccactcgagctggcagcgagagacggtcagagcaaaggcggttattgtcatctttcacaggctcctgcgactcagatctcctaaaattcaatcaactgaaattcagaaagaagaagctgaagttctgtaagtcgcacatacatgactggggattattcgctatggaaccaatagcagcagatgagatggtgatcgaatatgtgggacagaatataaggcaggtgatagctgacatgagagagaagcggtacgaggacgaaggaatcggttcctcttacatgtttcgcgtggaccacgataccataattgatgcaacaaagtgtgggaactttgcacggtttatcaaccacagttgcaacccaaactgctacgccaaggtgataacagtggaatcccagaaaaaaattgtgatttatagcaagcagcacattaatgtcaatgaagaaataacctatgactataagtttcctattgaggacgttaagatcccatgtctatgtgggagtgagaattgccgcggtaccctcaatta

SEQ ID NO: 240286 - DNA, 5771 bp, Artificial Sequence
  Description of Artificial Sequence: Synthetic coding sequence
atggaaaacagccaccccccacaccaccatcatcagcagcctcctccacaacctggaccctccggtgagcgcaggaaccatcactggagatcttataaacttatgatagatcctgctctcaagaaggggcaccataagctgtatcgctacgatggacagcacttctctctcgctatgtcatctaaccggccagtggagatcgtcgaagaccctcgagtcgtgggcatttggaccaagaataaggagctcgagctaagcgtaccaaaattcaagatcgatgagttctacgtagggccagtgcccccaaaacaagtgacattcgccaaactgaacgataacatcagagagaattttctcagagacatgtgtaagaagtatggcgaggtggaggaagtcgaaattctttacaaccccaaaacgaagaagcatctgggaatcgccaaagtggtatttgcaacagtgcgcggagctaaggatgcagttcagcacttacatagcacgagcgtaatggggaatatcatccatgtcgaactggacaccaagggggagactagaatgagattctacgaactcctggtgacaggacggtacactccccaaactcttcctgtcggagagctggatgcagtgagccctatcgttaacgagacactccaactcagcgacgctctgaagagactgaaagacggcggactgagcgctggatgcggatccgggtcttcttccgtgactcctaattcaggtgggacgccgttttcccaagatactgcatactcttcatgtcgcctagatacccctaactcgtatgggcaaggtaccccgctgactccacgcttaggaactcctttcagtcaagattccagttacagttcccggcagccaaccccaagctacctcttttctcaggacccagcagtgacttttaaagcacgccgacacgagagcaagttcaccgacgcatataaccgacgccacgagcatcactacgtgcacaactcgccagcagtgacggcggtagcaggcgcaaccgccgcattccgaggaagctcagatttgcccttcggcgctgtggggggaacaggcggtagttccggccctccatttaaagcccaaccacaggactcggcgacgtttgcccacactcctcctcctgcgcaggcaactcccgcaccaggtttcaagtccgcctttagcccataccagaccccagttgcacatttccccccacccccagaagaacctactgcgacagccgctttcggggcaagagacagcggagagtttaggcgagcccctgctccacccccattaccccctgccgaacctctggccaaggaaaagcccggaaccccacctgggccacctccccctgataccaacagtatggagctgggaggacggccaacgtttggatggtcccccgaaccctgcgactcccccggaactcctaccttagaaagcagcccagccggtcctgaaaagcctcacgacagtttggatagcagaattgagatgctgttgaaggagcagcggacaaaactgctgtttctcagggagccagattccgataccgagctgcagatggaaggctcccccatcagttcatcttcctctcagttgagcccattggctcccttcggtaccaacagtcagccagggttcagggggccaaccccaccctcatcacgaccctccagcacggggctggaggacatctctccaacaccactgcccgacagcgacgaagacgaagaactcgacctcggcttgggcccaaggcccccaccggaacctggacccccagatccggctgggctgctctcccagactgctgaggtggcgctggatctggttggcgaccgcactcccactagtgaaaagatggatgagggacaacagagcagcggcgaggacatggagattagcgatgatgaaatgccaagcgcccctatcacttccgccgactgcccaaagcctatggttgttacccccggtgccgctgccgttgccgctccctcagttctcgccccaacgctaccccttccaccacctccaggctttcccccattgcccccacccccacctcccccaccaccacagccaggttttccaatgccccctcctctgcccccacccccaccccctcctcctcctgcacaccccgctgttaccgtcccacccccaccactgcccgctccaccaggagtgcctcctccgccaatcttgcctcctctgcctccctttccccctggattgttccctgtcatgcaggtggacatgagccacgtgctgggcggacaatggggcggaatgcctatgtctttccagatgcaaactcaagtcctgagtcgccttatgactgggcaaggtgcttgcccctatccccctttcatggctgcagccgctgccgctgcatcagcagggctacagtttgtgaacctgcccccttatagaggaccattttcactgtcaaactcaggccctggcaggggacagcactggcccccactgccaaaatttgacccctcagtaccccctccaggttatatgcctaggcaagaggatcctcacaaggcgactgtggacggcgtgcttctggtcgtccttaaggagctgaaagccataatgaagcgggacctgaaccggaaaatggtggaagtcgtggcttttcgggcattcgacgaatggtgggataagaaggaaagaatggctaaggcgtcattaacccctgtgaagagtggtgaacacaaagatgaggacaggcccaagcctaaagataggattgcttcttgtctgttagagtcatggggtaagggcgagggtctcgggtacgaagggttgggacttggaattggtctcagaggggctatccgcctgccctcgttcaaagttaaaaggaaagaaccgcctgacactacctcttctggcgatcagaagcgactgcgaccctctacctcggtcgacgaagaggatgaggagtctgagcgagaacgggacagggacatggctgatacaccttgtgagctcgccaagcgcgacccgaaaggagtgggcgtgaggcggagacctgcaaggcccctggaactggactctgggggagaagaggatgagaaagagagcctctcggaagaacaggagagcacagaagaggaagaggaggctgaggaggaggaagaagaggaagatgatgacgacgacgattcagatgatagagacgagtcagagaacgatgatgaggatacagccttaagcgaagcgagcgagaaggacgagggcgactccgacgaggaagagacggttagcattgtcaccagcaaggcagaagcaacatctagttccgagagtagcgagagctctgaattcgagtcttctagtgaatcctccccttccagcagcgaggacgaagaagaggtggtagccagggaggaggaggaggaagaggaggaggaggaaatggtggctgaggaaagcatggcctcagctgggcctgaagatttcgagcaagacggagaagaagccgcattggcgccaggtgcccctgccgtcgatagtctggggatggaggaagaagtggacatcgagacagaggccgttgcccctgaggagaggccttccatgctggatgaaccaccccttcccgttggcgtcgaagagcccgctgattctagagagcctccagaggagcctgggctctctcaggagggggcaatgctattaagccctgagcccccagcaaaggaggtggaagcacgaccaccattgagcccggaacgggcaccagagcatgacctggaagtggagcctgagccacccatgatgctccccttgccactgcagccaccccttccccctccaagaccccctagaccaccgtccccaccaccggagcctgaaacgacagatgcatctcatccttcggtgccccctgaacccctggccgaagatcatcctccccacacaccaggcctgtgcggcagtctggccaagtcccaatcaaccgaaactgtccctgcaacaccagggggagaacccccactcagtggaggcagctcagggctgtcccttagttccccccaagtgccgggatccccttttagctaccccgcaccttctccgagtttatcctcaggagggttgcctaggacaccgggaagagatttctcttttactccaacattctctgaaccatccggccctctactgctccccgtctgtcccctccccaccggtcgacgagacgaaagatctgggccactggcaagtcccgtgctcttggaaacaggcttgcccctgccactgccactgccgctgccgctacccctggctctgccagctgtactgcgcgcacaagcgagggccccaactcctctgccaccactgctccctgccccattggccagctgtcctccccctatgaagcgaaagcccggaagacctagacgctctccgcctagtatgctcagcctggatggtcccctggtaagaccaccggctggagcagctttaggacgcgaattgctgctcctgcctgggcaaccacaaactcccgtctttccttccactcacgacccaaggaccgtaacactggatttcagaaatgccggaatccccgcacctcccccaccgctgccaccacagcctcccccaccacctcccccacctcccgtcgagcccaccaagctcccttttaaagaactcgacaaccagtggccctcggaagccatcccacccggaccacgaggacgggatgaggtcacagaagaatacatggagctcgcaaaaagcaggggaccctggagacggcctcctaagaagaggcatgaagacctcgttcccccagctggcagtccagagttgtctccccctcagccactgttcaggccaagatcagaattcgaagaaatgactatattgtacgatatctggaacggcggaatagatgaggaggacatcaggtttctttgtgtcacctatgaacgactcctgcagcaggataatggaatggactggctgaatgataccctctgggtgtaccaccctagcacctccctctcttcggcgaagaaaaagaaacgggatgacgggatccgcgagcacgtgacaggatgtgctcggagcgagggtttctacactatcgataagaaggataagttgagatacctcaacagtagccgtgcctcaactgatgagccccctgccgacacacaggggatgtctattcccgcacaacctcacgcaagtacccgggcaggcagcgaaaggaggtctgagcagaggcgtttgctctctagcttcaccggtagttgcgattccgacctgctcaagtttaaccaacttaaatttaggaaaaagaagctcaagttctgcaagtcccacatccacgattggggacttttcgctatggagccaatagccgcagacgagatggtgattgagtatgttggccagaacattcgccaggtaatagcggatatgagagagaagaggtatgaggatgaaggcattggatcctcgtatatgttcagggtggatcatgatactataatcgatgccactaagtgcggcaacttcgcacgctttattaaccacagttgcaatcccaactgctatgctaaggtgataaccgttgagtcacagaagaagatagtgatctacagcaagcaacatatcaacgtcaacgaagagataacttatgactacaagttcccaatagaggacgtaaaaataccgtgtctgtgtgggtccgagaactgccgtggcacacttaacta

SEQ ID NO: 240287 - DNA, 7694 bp, Artificial Sequence
  Description of Artificial Sequence: Synthetic coding sequence
atgaagcagctgcaaccccagccaccccctaaaatgggagacttttatgacccagaacacccgacacccgaagaggaagaaaacgaggcaaagattgagaacgttcagaagacaggcttcattaaaggtccaatgtttaaaggggtggcatctagcaggtttctgccaaaaggcaccaagacaaaggttaatctcgaggagcaggggagacagaaggtcagtttcagtttcagcctcactaagaaaacattgcagaatcggttcctgacggcactgggaaatgagaaacagagtgatactcctaacccccctgctgtgcctttacaggtggacagcactccaaagatgaaaatggaaattggagataccctctctaccgcagaggaatcatctccccctaagtcccgggtggaactcggcaagatacatttcaagaagcatcttctgcatgttacatccagacccctgctggctacaaccaccgcagtagccagcccccctacccacgcagcccctttgccggctgttattgccgaatccaccacagtcgattctccaccctccagtcccccaccaccccctcccccagctcaggcaactacgctgtctagtccagctcccgtgaccgaaccagtcgctctgcctcacactcccatcactgtgttaatggccgctcccgtgcccctccccgtggacgttgctgtcagatcccttaaggaaccacctatcattattgtgcccgagagcctggaggctgataccaagcaagataccattagtaactctctggaggagcatgttactcagatcctcaacgagcaggctgacataagcagtaaaaaggaagacagccatataggtaaagacgaggagatcccagactcatcgaagatttcactgagttgcaaaaagacaggaagtaagaaaaagagtagtcagtccgagggaatctttctgggcagcgaaagcgacgaggactccgtacgaacatcgagctcacaaagatctcacgacttaaaattctcagcatccattgagaaggagcgcgacttcaagaagtcctccgctccccttaagagcgaggacttgggtaaaccctcccgctccaagaccgacagagacgacaagtatttcagctattccaagttagagcgggatacccggtatgtgtcaagtcgatgtcggtccgagcgagaacggcgacgttcaagatctcactctcgctctgaacgcggttctcgtaccaacttatcctactctcgctcagagcggagtcactactatgacagcgaccggcgataccaccgttcgtctccctacagggagagaacacggtattctcgcccatacacggacaatagggcacgggagagctctgatagtgaagaggagtataagaaaacctatagtcggcgaaccagctcgcactcctcctcatatcgagacttaagaacatcatcgtactcgaagagtgacagggactgcaagaccgagacatcttacctggaaatggagcggagagggaagtacagctcaaagttggagagggagtccaagcgtactagcgaaaatgaagctatcaaacgttgctgttcaccgcctaacgagttgggctttcggagaggcagctcttacagcaaacatgactctagcgcttctagatacaaaagtaccctgtcaaagcccatccctaagtctgataagttcaagaacagtttttgttgcactgaattgaatgaggaaattaaacagagtcactcgttcagtctgcaaacaccctgtagtaagggtagtgagctcaggatgataaacaaaaaccctgaaagggaaaaagctggcagcccggcaccgagcaaccgcctgaatgactcccccaccttgaaaaagctagatgagttgcctatttttaaaagcgagtttatcacccacgacagccatgactctataaaggaactagatagtctcagtaaggtaaagaacgatcaattgcgtagcttctgcccgattgagctaaacattaatggctcacctggtgcagaatctgaccttgcaactttttgcacatcgaaaacagacgcagttcttatgacgtcagacgactctgtcacaggatctgagctgagccctctggtgaaggcatgcatgctgtcttccaacggttttcaaaacatctccaggtgtaaggagaaggacctcgatgacacctgcatgctccataaaaaatcagagtctccttttcgggaaactgagcccctggtttcaccacaccaggacaagttaatgtccatgcccgtaatgacagtcgattattctaagaccgttgtcaaagagcccgttgatacacgagtgtcatgctgcaagaccaaagatagcgatatctactgtacacttaacgattcaaacccatctctgtgcaacagcgaggcggagaatatcgaaccatctgtgatgaagatctcttctaatagtttcatgaatgtgcacctggagagtaaacccgtcatctgcgacagtcgaaacctgactgaccactctaagttcgcatgtgaggagtataagcaaagcattggatctacatccagcgcctccgtgaatcactttgacgacctttatcagcctatcggcagctctgggattgcttctagtctgcagtctctgcctcccggaatcaaagtggattctctgactctgcttaagtgcggcgaaaatacttctcccgtcctggacgccgtactcaagagcaaaaaatcctcggagttcctgaagcacgcgggaaaggagaccatcgtggaggtcgggtccgatcttcccgatagcgggaagggttttgcaagcagagaaaatcgccgaaacaatggactgagcggcaaatgcctccaggaggcacaggaggagggtaactccattctgcccgagcgaagaggtcgccctgaaatctctctagatgagcgaggtgagggcggacatgttcacaccagcgacgactctgaggtggtgttctcctcctgcgacctaaacctgactatggaggacagtgacggagtgacctacgctctaaaatgtgattccagtggacatgcaccggagatcgtgagcactgtgcacgaggattacagcggctcgagcgaatcgtcgaatgacgagagcgactccgaggacactgattccgatgatagtagtatccctaggaatagactacaaagcgtggtcgtggtacccaagaacagcacattaccgatggaagagacctcgccctgctccagtcgcagttcccagagttataggcactattctgatcactgggaggatgagcggctagagagtaggcgacacctctacgaagagaagttcgagtcgatcgcctccaaagcctgtccccagacggacaaattctttcttcacaagggtactgagaaaaatccagagatctcattcactcagtcaagccggaagcaaatcgataatagactcccggagctgtcccatccacagtccgacggagtggacagtacgtcccatacagatgttaagtcggacccactcggacaccctaacagtgaggaaacggtcaaggctaaaatcccctcccggcaacaagaagaacttcccatctattcctctgactttgaggacgttcctaacaagtcatggcagcaaacaactttccagaaccggccagattctcgactgggtaagaccgagctcagtttcagtagcagctgcgagatcccacatgtggatggcttgcatagttccgaagagctgcggaatttgggatgggatttctctcaggaaaagccttctactacataccaacagccagattccagctacggcgcatgtggtggacacaaatatcagcaaaacgccgaacagtatggcggaacaagggactattggcaagggaacgggtattgggatccgcgatcaggtaggccaccagggactggcgtggtgtacgatcgcactcaaggacaggtaccagactcactgaccgacgatagagaagaggaggaaaattgggaccagcaagatggctcgcatttctccgaccagtcagataaatttctcctgtccttgcagaaggacaaaggctctgtacaggcgccagaaatatcgagtaattccattaaagacacccttgcagtcaatgagaaaaaggacttcagcaaaaatcttgagaaaaacgatatcaaggaccgtggcccactgaaaaagcgacgtcaggaaatcgagtccgacagtgagtccgatggagagcttcaagatcgcaaaaaagtgcgggtagaggtcgaacagggagagaccagcgtgccccctggcagcgctctggtgggcccttcctgcgtaatggacgatttcagagacccccagcgctggaaagagtgcgccaagcagggtaagatgccttgctatttcgacctcatcgaagaaaacgtttatctgaccgaaaggaagaagaataagagccatagagatatcaaaaggatgcagtgcgagtgcacccccctgtcaaaggatgaaagagcccagggagagatagcgtgtggcgaggactgtctaaatcggcttctcatgatcgagtgtagttcccgctgccctaatggcgactattgctctaaccggaggtttcagcgcaagcagcatgctgatgtagaagtcatactcacagaaaagaaaggctgggggcttagagctgcaaaggacctcccctcaaataccttcgtactcgagtattgtggggaagtgctggatcacaaggagttcaaagcaagagtgaaggaatatgctaggaacaagaacattcactattacttcatggcactgaagaatgacgagattatagatgctactcagaaaggaaactgctcaagattcatgaaccactcatgcgagcctaattgcgaaacccagaagtggaccgtgaacggtcagctccgcgtgggcttcttcaccactaagctcgtcccgtccggctcggagctgacattcgactaccagttccagcgttatggaaaggaggcccagaaatgtttttgtggctctgcgaactgccggggatatttgggcggtgagaaccgcgtgtccatccgggcagctggtggtaagatgaagaaagaaaggagtaggaagaaggatagcgtggacggggaactagaggccttaatggaaaacggagaaggccttagtgacaaaaatcaagtattaagtctctccaggctcatggttagaattgagacgctggagcagaagcttacatgcctggagctcatacagaacacacatagccaatcatgcctgaaatcctttctggagagacatggcctgagtctactatggatctggatggccgagctaggagacggcagagaaagcaaccagaagctccaggaggagatcataaaaactctggaacacttacccatccccaccaaaaacatgctcgaggagtcaaaggttctcccgatcattcagcggtggtcacagacaaaaaccgcagtgccccctctgagtgagggcgatggttattcatctgagaatacctctcgggctcataccccactgaatacgccagatccttcaactaagcttagcacagaggccgacacagacacacccaagaaactcatgtttcggaggctaaaaatcatttctgaaaactctatggattcagccattagtgatgccacaagcgagctcgaaggcaaggacggaaaggaagatctggatcagctcgaaaacgtacctgtcgaggaggaagaggaactgcagagtcagcagttgcttccccagcaactccccgaatgtaaggttgacagcgaaaccaacatcgaagcatctaagctgcccacatccgagcccgaagcggatgcagaaatcgaacccaaggaaagtaacggcactaagctggaggagccaataaacgaggaaacacctagccaggatgaggaagagggcgtatccgacgtggagtctgaaaggagccaggaacagcccgacaagacagtggatatcagtgatcttgctacaaagctgctggacagctggaaggatctcaaagaagtgtataggatccctaagaaaagccaaacagaaaaggagaatacgacaacggagagagggcgagatgcggttgggttccgcgaccagaccccggcaccaaaaaccccaaacagatcaagagaacgcgatccagacaagcagacacagaataaggagaagcgaaagaggcgttcttctttatccccgccttcctccgcctacgagagaggcaccaagcggccagacgataggtacgatacccccacttctaagaagaaggtgcggattaaggacaggaataagctctccaccgaggaaaggcgcaaactttttgaacaagaagtagcccagcgtgaggcccagaagcagcagcaacagatgcagaacctgggaatgacaagcccactgccttacgactcgctggggtacaatgcccctcatcatcctttcgccggatatccgccaggatacccaatgcaagcctacgttgaccctagtaaccctaacgccggtaaggtcctgcttcccactcccagcatggatcctgtctgctcccccgctccgtacgatcatgctcagcctttagtaggtcatagcactgagcccctgtctgcgcctccacccgtgcccgtcgtgccacatgtcgcagccccagttgaggtcagctcatctcagtatgtcgcccagagtgatggcgtggtgcaccaggattcatcggtggccgtcctgccagtgcccgctcccggacccgtccagggacaaaactactcagtctgggattccaaccagcagtctgtcagtgtccaacagcaatactctcccgcacagagccaagctacaatttattaccagggccaaacatgcccaacagtgtacggcgtcacttcgccatactctcagacaacacctcccatcgtgcagagttatgctcagccatctctccagtacatacagggtcagcaaatcttcacggcccatcctcaaggagtggtagtgcagccagcggcagcagtgactactatcgtagctccaggtcagccccagcccctccagcccagcgagatggttgtgacaaataaccttcttgacttaccacccccaagcccccctaagcccaagactatagtgttaccccctaattggaagacagcgcgagaccccgagggaaagatttattactatcacgtcatcacccgtcagacacagtgggacccccctacgtgggagtcaccgggagacgatgcctccctggaacacgaagcagagatggatctcggaacccccacctacgatgagaacccaatgaaggccagcaaaaaaccgaagacagcagaggcagacacaagttctgagctggctaagaagagcaaagaagtgtttagaaaggaaatgagtcagttcatcgtccagtgcctcaatccctatcgcaagcctgattgtaaagtaggcaggataactacaacagaagactttaagcatctggccaggaagctcacacatggcgtaatgaacaaagagctgaaatattgtaagaatcccgaagatctggagtgcaacgaaaacgtgaagcacaaaactaaagagtacatcaagaagtacatgcagaagttcggcgcagtttacaaaccaaaagaagacacagagctagaata

SEQ ID NO: 240288 - DNA, 7694 bp, Artificial Sequence
  Description of Artificial Sequence: Synthetic coding sequence
atgaagcagctgcagcctcagccgcctcccaagatgggagatttttatgatcctgagcaccctacaccggaagaacaggaacccgaggcaaaaatcgaaaacgtacagaagaccggcttcatcaaagggcctatgttcaaaggggtggcttcatcccgtttcctccctaaaggcacaaaaaccaaggtgaatcttgaagaacagggtcgccagaaagtctccttcagtttttccctgacaaagaagaccctccagaatagattcttgaccgccctcggaaacgaaaagcagagcgatacccccaatccccctgcagtccctttacaggtcgactctacaccaaaaatgaaaatggagattggggacactctaagcacagcagaagagagttctcctcccaagagccgggttgagctgggcaagatccacttcaaaaaacacttgctgcacgttaccagtcggcctttgctggctactaccacggccgtcgcctccccccctactcacgcagcccctctccctgccgtcatcgccgagagcactacagtcgattcgcccccatccagcccgccaccaccgccaccaccggctcaagccacaacgttaagcagcccagcgccagtgaccgaaccagtggccctcccccacacaccaattaccgttctgatggcagctcccgtgccccttccggtggatgttgcggtgcggtcactgaaagaacctcccatcattatcgtgcctgaatctctcgaagccgatacaaaacaggacacaattagcaattctttggaagaacatgttacacagattctcaatgagcaggccgacatcagctctaagaaggaagacagccacatcgggaaggatgaagagatcccagattcaagcaaaatcagtctttcttgtaagaagactgggagcaaaaagaaatctagccagtcagaaggcatctttcttgggagcgagtccgacgaggactcggtacgcaccagctcaagccaacggagccatgacctgaagttcagcgcctctatcgagaaggagagagatttcaaaaagtcttcagctccgctgaagagcgaggacctggggaagccaagtcgctctaagaccgatcgtgatgacaagtattttagctactctaaactcgaaagagacacccgctatgtctcaagtcgatgcaggtctgaacgcgagcgacgtaggtcccggtctcattcacgctccgaaagggggtcacgaactaacctgtcttacagccgttctgagcggtcccactattacgactctgatcgccgataccatcgttcttcgccttacagagaacgtacaagatactctagaccgtataccgacaaccgagcccgtgagagcagtgactccgaggaagagtacaaaaagacatattccaggaggacaagttctcactctagttcataccgtgacctgcggacctccagctacagcaagtctgaccgggattgcaaaacggagacaagctacttggagatggagagacgcggaaaatacagctcaaagttggaaagggaatcaaagaggacctctgaaaacgaggctataaaacggtgctgcagtcctccgaatgagttaggatttcggagaggcagctcttattccaaacacgacagctctgctagtagatataagagcactctgagcaaacctataccaaaaagtgataagtttaagaatagcttttgctgtaccgaacttaatgaggaaatcaagcagagtcattcgttcagtcttcaaacaccatgcagcaaaggctcggagctgcgcatgattaataagaatccagagagagagaaggccggaagccccgctccgtctaacagactgaacgacagccctaccctgaagaaactagatgaattacctatcttcaagagtgagtttattactcatgattctcatgattcgataaaggagcttgattcgctgtccaaggtgaaaaacgaccagctgcggtccttctgtcccatagagctcaacatcaacggatccccaggcgctgaaagcgaccttgcaactttctgtacatctaagaccgacgccgtgttaatgaccagtgacgactctgttaccgggtcagagttgagcccgctggtgaaggcctgcatgctgtcctccaatggatttcaaaacatttccaggtgcaaggaaaaggatcttgatgacacatgcatgctccacaaaaagagtgagtcaccctttagggagactgagcccctggtgtcgcctcatcaggataagctgatgtccatgcccgtgatgaccgtggattacagtaaaactgtggtgaaggaacctgtagatactcgtgtatcctgttgtaaaaccaaggattccgacatctattgtacactgaacgatagcaacccatcactctgtaattctgaggcagagaacatcgaaccctcggtcatgaagatctcatccaacagctttatgaatgttcaccttgaaagcaagccagtaatttgtgattctcgcaatctaactgatcactctaagttcgcatgcgaagaatataagcagtccatcggctccacaagctctgccagcgtgaatcactttgacgacctgtatcagcctatcggctcgtctggaatagcttcaagcttgcagagtcttcctccgggtattaaggtcgacagtctcaccttactgaaatgcggtgaaaacacttcgcctgtgctggacgccgtcctcaaatctaaaaaatccagtgaattcttaaaacatgctgggaaggaaactatcgtggaggttggctccgacctcccagattcaggcaaaggatttgccagtagagagaatagacgcaataatggactgtctgggaagtgcctgcaagaggctcaggaggaaggcaactccattctgcccgagcgacgtggaaggccagaaattagccttgacgagaggggggagggagggcacgttcatacgtccgacgatagcgaagttgttttcagtagttgtgacctaaacctgaccatggaagattcagacggcgtgacctatgctctgaaatgtgactccagtggccatgcaccggagatcgtctcgactgtgcatgaggactattctgggagctctgaaagtagtaatgatgagtcagattctgaggacaccgattccgacgattcctccattccgcgaaatcggctgcaaagtgtcgtggtggtgcccaagaactctactttaccaatggaggaaacatcaccctgctcctcccggagtagccagtcataccggcactattcagatcattgggaggatgagcgactggagagtcgaagacacctatacgaggaaaagttcgagagcatcgccagcaaagcctgcccccagacggacaaatttttcctccataaagggacagagaagaaccccgagattagctttacgcaaagttctcggaagcagatcgacaataggctgcctgaattgtcacacccccaatctgatggcgtcgactcaacttctcataccgacgtaaagtctgaccccctgggtcatccaaattccgaggagacagtaaaggcgaaaatccccagccgccagcaagaagagttacccatatacagttcagactttgaggatgtccctaacaagtcctggcagcaaaccacgtttcaaaatcgcccagatagccgtctgggaaaaacggaactgtcattctcgtccagttgtgagattccacacgtggatggcttacactcatcagaggaactgcggaatctaggctgggatttctctcaggaaaaaccaagcacaacttaccaacaaccagatagtagctacggcgcttgtggcggacacaagtaccaacaaaatgctgagcagtacggtgggacgcgggactactggcaaggcaatggctattgggacccacggagcggccgaccgccaggcacaggggtcgtgtacgaccgcactcagggccaggtaccagattccctgaccgacgatcgtgaggaggaagagaactgggatcagcaggatgggtcccacttctccgatcagagcgacaagtttctgcttagtctgcagaaagacaagggcagtgtccaggccccagagatcagcagcaattcgattaaagatactctggctgtgaacgagaaaaaagacttttccaagaacctcgagaaaaacgacatcaaagaccgaggcccactcaagaagcgcagacaggagatagagagcgattccgaatctgatggggaactacaggaccgcaaaaaggtacgcgtggaggtggaacagggagagacgagtgttccccctggatccgccctggtgggccctagctgtgtcatggacgatttccgcgacccacagcgttggaaggagtgtgctaagcagggaaagatgccatgttattttgacctgatcgaagagaacgtataccttactgagcgaaaaaagaataaatcccaccgcgatataaaacgcatgcaatgtgagtgcacaccactgtctaaagacgagagagctcagggagagatcgcttgtggagaggattgcttaaaccggttgctgatgattgaatgttcgagccggtgccccaacggcgactactgttctaatcgcagatttcagcgtaagcagcatgccgacgtggaggtgattttgacagaaaagaagggctggggactgcgagccgctaaagacctgccttcgaacacatttgttctcgagtattgcggagaggtccttgaccataaggagttcaaggcccgagtgaaggagtacgcaagaaataagaatattcattactacttcatggctctgaaaaacgatgagatcattgacgctactcagaagggtaattgttcacgcttcatgaatcactcctgcgaacctaactgtgaaactcagaagtggacagtgaacggccaactgcgcgtcgggttttttaccacaaagctagtgccctctggatctgaattgaccttcgattaccagtttcaaagatatggcaaagaagcacagaaatgtttttgtgggagcgccaactgcagggggtatctgggaggagaaaaccgcgtgagcattcgggcagccggaggcaagatgaagaaggaaagaagcaggaagaaagacagcgtagacggtgaactggaagctctaatggaaaacggagagggcctaagcgacaagaaccaggttctgtccctgtcccgcttgatggtgcgcatcgagactctcgagcagaagcttacctgcctcgagctgattcagaacactcacagccagtcttgccttaagtccttcctggagcggcacgggttgtctctgctctggatctggatggctgagcttggggacggtcgggagtctaaccagaaactacaggaagagatcattaagacactagagcacctgcctatcccgacaaagaacatgcttgaagaaagtaaggtgctacctattatccagaggtggtcacaaacgaagaccgcggtcccccctttgtccgaaggagatggctattcttctgagaacaccagtagggcccacactcccctcaacacccctgatccgagcacaaagctctctaccgaagctgacaccgatacaccgaagaagctaatgtttagaagacttaagatcatctccgaaaacagtatggattcagccattagcgatgcgaccagcgaactcgagggtaaagatggcaaggaagacctcgatcaattggaaaacgttccggtggaggaagaagaagagttacagtcccagcaactgttacctcagcaactgccagaatgcaaggttgactctgagacaaatatcgaggcaagcaagctgcctacatctgagcccgaggctgacgccgagatcgagcctaaagagagcaacgggacgaaactggaggaaccgatcaacgaggagacaccttcccaggatgaagaggagggggtaagtgacgtggagtcagagagaagccaggagcagcccgacaagacggtggacatttctgaccttgcaaccaaactgctggattcatggaaagatctgaaggaggtttatcggatccccaaaaagagtcagaccgaaaaggagaacacgacaacagagcgcggtagagacgctgtgggattccgcgaccagacacccgcacctaaaacacctaaccggtccagggagcgcgatcctgacaagcagacacagaataaggagaagagaaaacggaggtccagcctgtcaccacccagcagcgcatacgagcggggtaccaagcggccagacgaccggtacgacacccctacctctaagaagaaagtgcggatcaaggacaggaacaagctctctaccgaagaaaggcggaaactgttcgagcaggaagtggcacaacgcgaagcacagaaacagcagcagcagatgcagaatctcggaatgactagcccacttccttacgactcactcgggtacaacgcccctcaccacccttttgcaggttaccctcctggctaccccatgcaggcctatgtcgacccaagcaacccaaatgctggtaaggtgttgctgcctaccccctccatggacccggtgtgttcgccggctccatacgaccatgctcagccgctagtgggccacagtacggaaccactgtcagctcctccgccagtgcccgttgtgccacacgtggcagccccagtagaggtctcttcttctcagtacgtcgctcagagtgacggggtagtgcaccaagattcttcagtagccgttctacccgtgcccgcacccggtcccgtgcagggacaaaattattcagtctgggacagcaaccaacagtcagtttctgtgcagcaacagtactccccagcccaatcacaggctacgatatactaccagggacaaacatgtcccaccgtgtacggtgtgacatccccttactcacagaccacacctcccatcgtccaatcttacgctcaacctagtctgcagtatatacagggacagcagattttcaccgcacatcctcagggtgtggttgtccaacctgccgctgcggtgactacaatcgtggcaccaggccagccacagccactgcagcccagcgagatggtagttacaaataatcttttggatctgccaccaccttctcccccaaaacctaaaacaatagtactgccacctaactggaaaaccgctcgggatcccgagggaaagatctactattatcatgttataacaaggcagacgcagtgggaccctcccacatgggagtccccaggcgacgacgcttctctggaacacgaggccgagatggatttaggtacgcctacctacgacgagaatcctatgaaagccagcaaaaaaccgaaaaccgccgaagcagatacgtcaagcgagctggccaagaaaagtaaagaggtcttccgaaaagaaatgagtcaattcattgtgcagtgcttgaatccatatcgaaagccagactgtaaagtagggcgaatcacaactacagaggattttaaacatctcgcacgtaaactgacacatggcgtcatgaataaggagctgaagtactgtaagaaccctgaagacctggaatgcaacgagaatgtaaagcataagactaaagagtatattaagaagtatatgcagaaattcggcgcagtgtacaaaccgaaagaagacacggagctagagta

SEQ ID NO: 240289 - DNA, 5144 bp, Artificial Sequence
  Description of Artificial Sequence: Synthetic coding sequence
atgaagcagttgcagcctcagccaccgccaaagatgggcgacttctatgatcctgaacatccgactcccgagaagaaggagcgggaggctaaaatagaaaatgtccaaaaaacgggctttatcaaaggaccaatgttcaaaggggtagcatctagtcgattcttgccaaaaggtaccaagacaaaagtgaacctagaggagcagggacggcaaaaagtatctttctctttttcactcactaaaaaaacattacagaacaggttcctgaccgcgctcgggaatgagaagcagagcgatacccctaacccacccgctgtcccgctgcaggtcgattccaccccaaagatgaagatggagatcggggacaccctgagcactgccgaggagtctagtccacctaaaagccgggtggagctcgggaagatccactttaaaaaacacctgttgcacgtgacttcacgtcctcttcttgcaactacaacagccgtggcgagtcccccaacccacgccgcacccctgccagcagtcatcgcagagagcactacggtggactctccgccatcgtcaccccctcctccccctccacccgctcaagctacgacgctttcctccccggctccagtgactgagccagttgcactgccacacacgccaataacggtgctgatggccgcacctgtcccgcttcctgttgacgtggccgtaaggagcctgaaggagccacctataattatagtgcccgagagcctggaggcagatacaaaacaagacaccatctccaattccctcgaggaacacgtaactcagatcttaaacgaacaggcagacatatcatcgaaaaaggaagacagtcacatcggtaaagacgaggagattccagacagtagtaaaatcagtctctcttgtaagaagactggctccaaaaagaaaagctcacagagcgaggggatcttcctggggagcgagtctgacgaagactcagtaagaactagcagctctcagagatcacacgatctcaaatttagcgcctcaatagagaaagagcgggattttaagaaaagctccgcccctctgaagagcgaggacttgggaaaaccctcccggagcaagactgatcgcgacgataaatatttctcatacagcaaactggagcgcgatactaggtacgtctcgagtcggtgtaggtccgaacgggagcggagacgcagtcggtcacatagccgctcagaacgcggatccaggacaaacttgtcatactcacggtcggagcgcagccattattatgactcagatcgcagatatcaccgcagttcaccttacagggagcgtacccgttactctcggccatataccgataatcgtgcacgagagtcttccgattcagaggaagaatataaaaaaacatacagccgaagaacgtcttcccattcgtcttcctatagggacctccgaacaagcagttattctaagtctgaccgagactgtaagaccgaaacttcctacctcgaaatggaacgccgtggtaagtattccagcaaactggagagagagtcaaagcgtacctcagagaacgaagcaatcaaaagatgttgttctccacctaacgagcttggattccgccgagggagtagttattccaaacacgactcaagtgcctctcgatataaatcaacattaagtaagcctatcccaaaaagtgacaagttcaagaatagcttttgctgcacagaacttaacgaggagattaagcaaagtcattcatttagtttgcagacaccctgttctaaaggttctgagctgcggatgatcaataaaaatcccgaaagagaaaaagccggatctcctgcacccagcaataggcttaatgattcaccgacccttaaaaagctcgatgaactgcctatttttaaatccgagttcattacacatgactcccacgacagcatcaaagagttggactccctgtcaaaggtgaagaatgaccaactgaggagtttctgtcccattgagctgaacattaatgggtcacctggggcagagagtgatcttgcaacgttctgcacatcaaaaaccgacgccgtactgatgaccagtgatgacagcgtaaccggctcagagctgagcccattggttaaggcctgcatgttgtcctcaaatggattccaaaacatcagccgatgtaaagagaaggatctcgacgacacctgcatgctccataaaaaatccgaatcaccctttagagagaccgagcctctcgtttccccacatcaggacaagttaatgtcaatgccagtgatgactgtggactattctaaaacggttgtgaaggaacccgtcgacaccagggtaagctgctgcaaaactaaggattctgatatctactgcaccttgaacgatagtaacccgagcttgtgtaactcagaggcagagaatatcgagccttcggtgatgaaaatcagttccaattccttcatgaatgtacacctcgagtccaagcctgtgatctgcgattctcggaacctgacagatcattctaagtttgcctgtgaggagtacaagcagagtattgggagcaccagctcagcctctgtcaaccacttcgatgatctgtaccaaccgattggatcatctggaattgcctccagtctccagtccttgccccctggcatcaaggtcgactctctgactctactgaaatgcggcgagaacacatcgcccgtgctggacgcggtgctgaaatcaaagaagagctcagaattcctgaaacatgctggtaaagaaaccatcgttgaggtgggctctgatctgcccgacagcggcaaaggatttgccagccgagagaaccgcagaaacaacgggctgtctgggaaatgcctccaagaggctcaggaagaaggaaattccattctgcctgagagacggggacgaccagaaatcagcctcgatgaacgcggtgaaggtggccatgtccacaccagtgatgattccgaagtggtcttctccagctgcgacctgaatctgacaatggaagactcggacggagtcacttacgccctcaagtgtgacagctctggccatgcacctgaaattgtatctactgttcatgaagactattccggcagctccgagagcagtaatgatgagtctgactcggaggatactgactcagatgacagttcaattcccaggaacagactgcagtcagtggtcgtcgtgcccaagaatagcactctccctatggaggagacctcgccgtgcagctcacgtagtagtcagagctatcgacactattctgatcattgggaagacgagcgcctggaaagccgcagacacctgtatgaagaaaaattcgagagcatcgcatcgaaagcttgcccacagacagacaaattttttttgcacaagggcacggaaaagaaccccgagattagcttcacacaaagcagcagaaaacagatcgataacagactgccagaacttagccaccctcaatccgacggcgtagactcaactagccacacagacgttaagagcgatcctctcggtcatcccaattccgaagaaactgtgaaagccaaaatcccctcccggcagcaagaggagctgccaatttacagcagcgattttgaggatgtgcctaataagtcatggcagcagaccacctttcagaatcgaccagattcaaggctcggtaaaacagaactgtccttcagttcgtcttgcgagattccccatgtagacggcttgcactccagtgaagaactgcggaatttgggctgggacttttctcaggagaagccctcaaccacctaccaacaacccgattccagctacggcgcatgtggaggtcacaaatatcagcagaatgccgagcagtacggaggcacacgagactattggcagggaaacgggtattgggacccaaggagcggacggccaccagggaccggggtggtgtatgaccggacccagggtcaggtcccagatagcctcacagatgaccgggaagaagaagagaattgggatcagcaagacggaagccattttagcgaccaatccgacaaatttttgctctcactgcagaaagataaaggatccgtccaggccccagagatctcttcaaactcgatcaaagacactctcgccgttaacgagaagaaggatttttccaaaaatttggagaaaaacgacatcaaagacagaggccctttgaaaaagaggaggcaggaaatcgaatccgacagcgaatccgacggcgaattgcaagaccggaagaaggtcagggtcgaggtggaacaaggggagacttcagttcctcccggatcggcactagtgggccctagctgcgtgatggatgacttcagggacccacagcggtggaaggaatgcgctaagcagggaaagatgccatgctactttgatttaattgaggagaatgtgtatctcacagaaagaaagaaaaataaatcccacagggacataaaacgcatgcagtgtgagtgtactccgctgtcaaaggatgagcgggctcaaggagaaatcgcttgtggcgaagattgcctcaatcgcctcttgatgatcgagtgctcctcgaggtgccccaacggggactattgcagcaaccgccgatttcaacggaaacagcatgctgacgtcgaagtaatattgactgagaagaagggatgggggttgagggcagcaaaagatctgccatccaatacctttgtgttggaatactgcggggaagtattggatcacaaggaattcaaagccagagttaaggagtatgccagaaacaaaaacattcactactatttcatggccctcaagaacgacgagataatcgatgctacccagaaggggaattgtagcaggtttatgaatcactcttgcgaaccaaactgcgagacccagaagtggacagttaatgggcagttacgcgtcgggttcttcacaaccaagctagtaccctccgggtccgaattaacgttcgactatcaatttcagcggtacggtaaggaggctcagaaatgcttctgcggcagtgctaactgcagggggtatctggggggagaaaacagagtgtcaatccgggctgccggaggtaagatgaaaaaggaacggtcacgaaaaaaggactctta

SEQ ID NO: 240290 - DNA, 3876 bp, Artificial Sequence
  Description of Artificial Sequence: Synthetic coding sequence
atgtccagccttcctgggtgtataggcttagacgctgctacagccaccgttgagtcggaagagatcgctgagctacaacaggctgtagttgaagaattgggaatctctatggaggagttgcgtcattttatagatgaggaactcgaaaagatggactgcgtgcagcagcgaaaaaagcaactcgccgagctggagacctgggtgatccaaaaggaatctgaggtggcacacgtggatcagctgttcgacgacgccagccgggctgtcactaattgtgaatcgcttgtgaaagatttttactcgaagctcggactacagtatcgggatagttcaagcgaggacgagagctctaggcccaccgagattatcgagatccccgacgaggacgatgacgtcctgtctatcgatagtggggacgccggatctagaactccaaaggaccagaagcttagggaggccatggcagcgctaagaaagagtgcccaggatgtccagaaattcatggatgctgtgaacaagaagtcatcatcccaggatttgcacaaaggaacgctgtctcagatgtcaggcgagttgtctaaagacggagatctcattgtgagcatgaggatcctcgggaaaaagcgcaccaaaacttggcataagggtaccctcattgcaatccaaaccgtgggcccaggaaagaagtataaggtgaagtttgacaacaaggggaaatccctgttatccggcaatcatatcgcttacgactaccatccgcctgcagataagctctacgtgggatctagagttgtagccaagtacaaggacggtaaccaggtgtggttatatgctggaattgtggccgaaacccctaacgttaagaataaattgaggtttctgatctttttcgatgatggctacgcctcatacgtgactcagagtgaactgtacccgatctgccgccctttgaagaagacgtgggaggatattgaggatatatcttgtcgggactttatcgaggaatacgtcacggcgtatcccaatcgtcctatggttctgttaaaatcgggccagctcataaaaacagagtgggaaggcacctggtggaaaagtcgcgtcgaagaggtcgatggcagcctggtgcgtattctttttctggatgataagaggtgtgagtggatatataggggctcaacaagactggaaccaatgttctccatgaaaactagttcagcttctgccctcgagaaaaaacaaggccaactaaggacaagaccaaatatgggcgctgtccgctcaaaggggccagttgtgcagtacactcaggacttaaccggtaccggcacccagttcaagcctgtggaaccccctcagcccacagcacctcccgctcctccttttccgccagcgccacctctgagcccccaggccggagatagtgacttagagagtcaactcgcccagtcaaggaagcaagtcgctaagaagtcaacttctttccgacccggttccgtcgggtcgggccatagctcccctaccagtcctgccctttccgagaacgtgagtgggggaaaaccaggtataaaccaaacgtaccgatcccccctgggctccaccgcctccgcccctgctccttccgccctgccagcccctccagctccgccagtcttccatggaatgttagaacgtgcacctgctgagccctcttaccgtgccccaatggaaaaactgttttatctaccacatgtttgctcctatacatgcctcagtcgggtgagaccaatgcgcaacgagcagtatcgcggaaagaatcccctccttgtccccttgctgtatgactttcgccgaatgacggcaaggagacgggttaaccgtaaaatgggttttcacgtaatttataagaccccatgtgggttgtgtttgcgcaccatgcaggaaatagagcgctatctgttcgagactgggtgtgatttcctgttcctagaaatgttctgtctcgatccctatgtgcttgtggaccgcaaatttcagccttacaaaccattttattacatcttggatataacatacggtaaggaggacgtgcccctcagctgcgtgaatgagattgataccaccccaccaccacaggtggcctattctaaggagcggattcccggtaaaggcgtttttatcaacacagggcctgagttcctggttggatgtgattgcaaagatgggtgcagagacaagtctaagtgtgcctgtcatcagcttactatccaggccacggcctgtaccccaggcggtcagattaatccgaattccggttatcagtacaaacgtctggaggagtgtctcccaaccggggtgtacgagtgtaataagaggtgcaagtgcgaccctaacatgtgcaccaatagactggtgcaacacggcctgcaggtgaggctgcagctatttaaaactcaaaacaagggatggggtatacgatgcctcgatgacatagccaagggctcctttgtgtgtatatatgccggtaagatcctgactgacgattttgccgataaagagggattggaaatgggggatgagtacttcgccaatctggaccacatcgaaagtgtggaaaacttcaaagaggggtacgagagcgatgcaccatgcagttccgattcctcaggcgtagacttaaaggaccaggaggatgggaatagcggcaccgaggatccagaagagagtaacgacgacagcagtgatgataacttctgtaaggatgaggacttcagtaccagttccgtttggcgtagctacgcaacccggagacagactaggggacagaaagaaaacggcttgtccgagaccaccagcaaggatagccatcctccagatctgggaccaccccacatcccggtcccaccaagcataccagtcggtgggtgtaaccctcccagtagcgaagagacacctaaaaataaagtcgccagctggctctcctgtaattccgtgtcagagggaggttttgcggattctgactcacattcatctttcaagactaacgaggggggagaggggagggccggtggctctcggatggaggccgagaaggccagcacaagtggtctcgggattaaagatgagggcgacattaagcaggccaaaaaagaagataccgacgacaggaacaagatgtcagttgtgacagagtcatcgcgcaactatggatataatccttcccccgttaaaccagaggggcttaggaggccaccatcaaagacttcaatgcaccagtcacgtcgcctaatggcctccgctcagtcaaaccctgatgacgtcttgacgctctcctcctctaccgaatcagaaggcgaatctggcacaagtcgtaaaccgaccgccggacagacttccgctaccgctgtggattctgatgatatacagactatttccagcggatctgagggcgatgatttcgaggataagaaaaacatgacagggccaatgaaaagacaggtggctgtgaagagcacgcggggatttgccctcaaatcaacacacggaatcgcaatcaagagcacaaacatggcttctgtagacaagggagaatcagcccctgtcaggaagaatactaggcagttctatgacggggaggaatcttgctatatcatcgatgcaaagctcgaaggcaacctgggcagatacctgaatcactcttgtagccctaatctcttcgtccaaaacgtgtttgtggacactcacgacctccggttcccttgggtggccttttttgcttccaagcgcattagagcgggaacggagctcacttgggattacaactacgaggtcggcagcgtcgaaggtaaggagctactctgctgctgcggagcaatcgagtgtcgtggtagactcctgtag

SEQ ID NO: 240291 - DNA, 1194 bp, Artificial Sequence
  Description of Artificial Sequence: Synthetic coding sequence
atgagttctcttcctgggtgtatcgggctcgacgctgcgaccgcgaccgtcgagtccgaggaaatcgcagagctgcagcaggctgtcgttgaggagttaggtatcagtatggaggaactgcgacacttcattgacgaggagcttgagaagatggattgtgtgcaacagcgcaagaaacagctggcagaactggaaacatgggtgattcagaaagaatcagaggtagcacacgtggaccagctatttgatgatgcttcgagagccgtgactaattgcgaatccttagtgaaggacttttactctaaactcggtctgcagtaccgcgattcctctagcgaggacgagagttcccggcctaccgagattattgaaatccccgatgaagacgacgacgtactgtctatcgattctggagacgccggaagccgtacaccgaaggatcagaagctgcgcgaggcaatggctgccttgaggaaatccgcccaggatgtgcagaagtttatggacgccgtgaacaaaaaaagtagctcgcaagatctgcataagggaaccctgtcacagatgtcaggcgaattgagcaaagatggggacctcattgtttcaatgcggatacttggaaagaagagaaccaaaacttggcataagggaacactgatcgccatccaaaccgtcggcccaggaaagaaatataaggttaaatttgacaacaagggcaagtcattgctcagcggaaatcatatcgcttacgactatcacccacccgctgacaagctttacgtggggtcccgggtggttgccaagtataaagatgggaatcaggtgtggctgtatgccggtatagtggctgaaacaccaaatgtcaagaataagctgagattcctcatttttttcgatgatggctacgcaagttacgtgacccagtcagagctttaccctatttgcagaccacttaagaagacttgggaagatatcgaggatatcagctgccgagacttcatagaagagtatgtcacggcttatccaaatcggcctatggtgcttcttaagagtggacagctgattaagaccgagtgggagggaacgtggtggaagagtcgcgtggaggaggtcgacggctccctagtcagaatccttttcctggtactgttcttctctacaatcctggaagcagaggtgggcggaggcggaacttag

SEQ ID NO: 240292 - DNA, 750 bp, Artificial Sequence
  Description of Artificial Sequence: Synthetic coding sequence
atgtcatcactcccagggtgtatcggccttgatgcagcaacagcgactgttgaaagtgaagagattgccgagcttcagcaggcggttgtggaggagctagggattagcatggaagaactgcgtcacttcattgatgaggaactggaaaaaatggattgcgtgcagcaacgcaaaaagcagctggcagagctagagacctgggtaatccagaaagaatcggaggtggcccatgtggatcaactgtttgatgacgcttcgcgagctgtaaccaattgtgagtcgcttgtcaaggatttctacagcaaactgggcctgcaatacagagattccagtagcgaggacgagtcttcccgcccaaccgagataattgaaatacccgatgaagatgacgacgtcctatcaatcgactctggcgacgcaggtagccgtactccaaaagaccagaaactccgcgaagcaatggcagccctgaggaagtccgcgcaggacgtccagaaattcatggacgctgtgaataagaagtcctcctctcaggatttgcacaaaggaactctgtcccagatgtcaggcgagctgtccaaggacggagatctcattgtgtcgatgcgaatcctcggcaaaaagcgcacgaaaacctggcataagggtactcttattgccatccagaccgttgggttctccttctcactcatgatggcaatgttaccaatgagtcattcccggaattgcataccttttgctggccactag

SEQ ID NO: 240293 - DNA, 3873 bp, Artificial Sequence
  Description of Artificial Sequence: Synthetic coding sequence
atgtccagtctccctggctgcattggactggatgcagccaccgctacggtagagagcgaagagatcgcagaactccaacaggccgtcgtggaagaacttggtatcagcatggaggagctgaggcattttattgatgaagagttggagaagatggactgcgtgcagcagcgaaaaaagcagctggccgaactagaaacctgggtgatccagaaagaatctgaggttgcacacgttgatcagctgttcgacgacgccagtagggccgtgaccaactgcgagagcctcgttaaggatttttacagtaagctgggcttacaatatagagacagttcttccgaagacgagtcatccaggccgaccgagatcattgagatcccggacgaagatgacgatgtgctgtccatcgacagtggcgatgcaggtagccggactccaaaggaccaaaagctgagagaagctatggcagcgctgcggaaaagtgcccaggacgtgcagaaattcatggatgctgtcaataaaaaatcctcttcacaggatttacataagggcaccttgtcacagatgtctggagaactctctaaggacggcgacctaatcgtgagcatgcgcattctgggcaaaaagcgaactaagacttggcataagggcaccctgattgccatccagacagttgggccaggaaagaagtacaaagttaagtttgacaataaggggaagtctctgttgagtggcaatcatattgcttacgattaccatcctcccgctgacaaactgtatgttgggtctcgggtggttgctaagtataaggatggcaatcaggtttggctctatgcgggaatcgttgccgaaacccctaacgtgaaaaacaagctgcgcttccttatcttctttgacgatgggtatgcttcatacgtgacacaatccgagttgtatccaatttgtcgcccactgaagaagacctgggaggacatagaggatatctcctgtagagactttatagaggaatacgtcaccgcctaccccaatagacccatggtgcttctgaagtccggtcagcttatcaagactgagtgggagggaacatggtggaagagcagggtcgaggaggtcgatggctccctggtgcgaatactgtttcttgacgataagaggtgcgaatggatttacagaggctcaacccggctggaacctatgtttagtatgaagacctcatccgcctccgccttggagaaaaagcaggggcagctccggacccgcccaaacatgggagcagtgagatctaaagggcctgtggtacagtatacccaagatttgacgggcaccggaacacaatttaaaccggtcgaacctccccagccaactgccccaccagcccctccatttcctcccgcaccccctctctcccctcaggctggtgactccgacctcgagagtcaacttgcgcagtctagaaaacaggttgccaagaaatcaacaagcttccgaccagggagcgtgggttctggccattccagtccaactagtcctgccctaagcgaaaacgtcagcggtggcaagcctggcatcaaccaaacctatagatccccccttggaagcactgcctctgcccctgcgccaagcgcccttcctgctccacctgctcctcccgtctttcacggcatgttggagagagcgcctgccgaaccatcttaccgcgcaccaatggagaaactgttttatcttccccacgtgtgctcatacacctgcctgtcaagggtacggcctatgagaaatgagcagtatcggggaaaaaatcctttgctggttcccctcctttacgactttagaaggatgacagccaggaggcgagtgaatcggaaaatgggtttccacgtgatctacaagaccccctgtgggctgtgcctaaggacaatgcaagaaattgagagatatctctttgaaactgggtgtgattttttatttctggaaatgttctgtttggatccctatgtgctggtcgaccgaaagttccagccctataaacctttctactacattctggacataacatacggcaaggaagacgttcccctatcctgcgtgaacgagattgacacaacacctccaccgcaagtggcttattcaaaggagcgcattccaggcaagggcgttttcatcaatactggacccgaattcctggtagggtgtgactgcaaggacggctgtagagataagtcaaaatgtgcttgccatcagctgaccattcaagctaccgcatgcacgcccggagggcaaattaacccgaattccggctatcagtacaagagactggaagagtgtctccccaccggagtgtacgaatgcaataaacgatgcaaatgcgatcccaacatgtgtaccaaccgcttagttcagcatggccttcaggtccgactgcagttgtttaaaacacagaacaaaggctggggaatccgttgtctcgatgatattgcgaagggctcctttgtatgtatctacgctgggaaaattcttacggacgattttgccgataaagagggattggaaatgggagacgagtattttgccaatctggaccacatcgagtccgtggaaaattttaaagaaggttacgaatccgacgctccctgttcttctgacagctccggggtggacttgaaagatcaggaggacggcaactcagggacagaggatcctgaagagtctaatgacgattcctccgatgataacttctgcaaggacgaggacttctctacctcctctgtgtggagaagctatgccactcgcagacagactcgagggcagaaagagaacggcctctccgaaacgacatcgaaagatagccatcccccagacctgggacctccgcacatcccagtcccccctagcataccagtaggaggctgtaacccaccgagttcagaggagacacccaagaacaaggtggcctcatggctgtcctgcaactcagtgtctgaaggaggcttcgccgattccgactctcattcctccttcaagaccaatgagggaggagaaggtcgcgcaggcggaagtcggatggaggccgaaaaggcaagcacgagtggactaggtattaaggacgaaggagatattaaacaagctaagaaagaagacaccgatgaccgaaacaagatgagtgtggtaactgaaagctcacggaactacggatacaatccttctcctgttaagccagaagggctgcgacggccaccctccaaaacctccatgcaccaatcaaggcgcctgatggcctccgcccagtctaatccagacgacgtgttgactctttcaagttctaccgaaagtgaaggcgaaagtggcacatctcgtaagcctactgcaggacagacgtccgccacggccgtagacagcgatgacatacagacgattagctcaggatcagaaggcgacgacttcgaggacaagaagaacatgacggggcctatgaaaaggcaggtggccgttaagtctacccggggtttcgctcttaaatcgacgcatgggatcgccatcaagagcacaaatatggcctctgtggacaaaggcgaaagtgctcccgtaaggaagaacacccggcagttctatgatggcgaagaatcatgctacatcatagacgctaagctggaggggaatcttggcagatacctgaaccactcatgcagtccaaacctatttgtgcagaatgtgttcgtcgacactcacgacctgcggttcccgtgggtcgcattcttcgcaagcaaaatccgtgccggaaccgaattaacctgggactataattacgaagtcggatcagtggagggcaaggaacttttatgttgctgtggggctatcgaatgtagaggccgactgctctag

SEQ ID NO: 240294 - DNA, 504 bp, Artificial Sequence
  Description of Artificial Sequence: Synthetic coding sequence
atgtcgtctctaccgggatgcatcggacttgacgccgcaactgctaccgtggagtccgaggagatcgccgagttacagcaggcggtcgttgaggagcttgggatatcgatggaggagctacgacactttatcgatgaagagctcgaaaagatggattgcgttcagcaacggaaaaagcagctggctgagctcgaaacagtaggaccagggaaaaagtacaaagtgaaattcgataacaaagggaagtcactcctgtccgggaatcacatcgcttatgattaccaccccccagccgacaaattgtacgttggaagcagagtagttgccaaatataaggacggcaaccaggtgtggctgtatgccggaattgtagccgagactcctaatgttaaaaacaagctccgattccttatattcttcgatgatggatacgccagttacgtaacccagtccgagctgtaccccatatgcagaccccgtgagtgtttcagtctaatcccgtag

SEQ ID NO: 240295 - DNA, 471 bp, Artificial Sequence
  Description of Artificial Sequence: Synthetic coding sequence
atgagtagtttacctggatgcatcggcctggatgccgctaccgccacagttgagtcagaggaaattgcagagctacagcaggcagttgtagaagagctcggtatttccatggaagaactaagacacttcatagatgaggagctggaaaaaatggactgcgtccagcagcggaaaaaacagctcgcagagctggagacatgggtcattcaaaaggagtcggaagtcgctcacgtcgaccagctcttcgacgatgcatctcgcgctgtaaccaactgtgagtccctggtcaaagacttctatagcaagctgggattacagtaccgcgactctagttcagaagatgagagttccaggcccacggagatcattgaaattccagatgaggatgacgacgtgcttagcattgatagcggagacgcaggttctcggaccccaaaggaccaaaagctcagggaagcaatggcagcgtag

SEQ ID NO: 240296 - DNA, 3780 bp, Artificial Sequence
  Description of Artificial Sequence: Synthetic coding sequence
atgtcatctcttccaggatgtatcggtctggacgctgcgaccgccaccgtggaaagcgaagaaatagccgaactccaacaggcagtagttgaagagctcgggatttcaatggaggagctgaggcatttcattgacgaggagctggaaaaaatggactgcgtacagcagagaaagaagcagctggcagagctggagacctgggttattcaaaaagaatccgaagtcgcacacgtcgaccagttgtttgatgacgcctcccgcgcagttacgaattgtgagagtctggtcaaggacttctactcaaagctgggtctccagtaccgggactcctcgagtgaggatgaatcttcaagaccgactgagataatcgagattccagatgaagatgacgacgtgctgtctatcgatagtggagacgcagggtcccgaaccccgaaggatcagaaactgagggaggccatggcggcactcaggaaatccgctcaggatgtccagaagttcatggatgcagtcaacaagaagagctcttctcaggatctgcataaaggaacactgagtcaaatgtccggtgaactgtccaaagacggtgatctcatcgtttctatgagaatcttgggaaagaagcgaaccaaaacttggcacaagggaacattaatcgcaattcagactgtgggccctgggaaaaagtacaaggtgaagttcgataacaaggggaagtctcttctctctggcaatcatattgcttatgattatcacccccctgcggacaaactctatgttggaagccgcgtggtggcaaagtacaaggatggcaaccaagtctggttgtatgccggtattgtcgctgaaacacctaatgtcaagaacaaacttcgcttcctgatattttttgacgacggatacgcaagctatgtaacacagagtgagttatatcccatatgccgccctttgaagaagacgtgggaagacatcgaagacatcagctgtagggatttcatagaggagtacgtgacagcctaccctaataggcccatggtgctgctgaaaagcggacaactgattaagaccgagtgggaaggaacttggtggaaaagccgagttgaggaagttgacgggtctctggtccggatccttttccttgatgataagcggtgcgagtggatataccgcggttcgacaaggttggaaccaatgttttctatgaaaacctcttccgccagcgcattagagaagaagcaggggcagctacgcacccgacctaatatgggggcagtcagaagtaagggcccagtggtgcagtatacgcaagacctgactggcaccggaacccagtttaaacccgtggaacccccacaaccaacggcacccccagcccctcccttcccaccagctcccccactgtctcctcaggcaggtgattccgacttagaaagccagctcgcccagagcaggaaacaggtagctaaaaaatcaacaagcttccggcctggatccgttggctccggacacagctctcctacatctcctgccctgagtgaaaatgtgtctggcggaaagccgggtatcaatcagacctacaggagcccactcggcagcactgcctctgcccctgctccctccgcgctgccagcgcctcccgctccacccgtttttcacgggatgctagaaagagctcctgctgagcctagttacagagccccaatggagaaactgttctacctgccgcatgtttgtagctacacgtgtctttctcgggttaggcccatgcggaatgagcagtacagaggcaaaaacccactgttggtcccacttttatacgatttccggaggatgaccgcccgtcgaagggtgaaccgaaagatgggcttccatgttatttataagactccatgtggactgtgtctgcgtacaatgcaagagatcgaacgttacctctttgagaccggatgtgactttctgttcctggaaatgttctgcctggatccgtacgtgcttgtggatcgtaaattccagccatataagccattctactatatcctggatatcacgtacgggaaagaggacgtcccactgagctgtgtcaatgagatcgacaccacccccccaccgcaggtggcatatagtaaggagcgaattccaggaaagggcgtgttcattaatactggccctgagtttctggtgggctgcgactgcaaagacggctgccgggacaaatcaaaatgtgcatgtcatcagctgacaatccaggccactgcttgcacacctgggggacagattaacccgaactctggataccagtataaacgcctggaggaatgtctgcctaccggggtgtatgagtgtaacaaacgatgcaaatgcgacccgaatatgtgcaccaacaggttagtgcagcacggactgcaagtgaggctccagttattcaagactcagaataaaggatgggggattagatgcctggatgatatcgccaaagggtctttcgtgtgtatttacgcaggtaagatcctcacagacgattttgccgacaaagagggactggaaatgggcgatgagtactttgccaacctggatcacatagaaagcgtcgagaatttcaaggaagggtacgagagtgatgcgccatgctcatccgattcatccggagtagacctgaaagatcaggaagatggcaacagtggcaccgaagatcccgaagagagtaatgacgatagctccgatgacaacttctgtaaggacgaggacttttcgacctcaagcgtgtggcggtcctatgcaacaaggagacaaacaaggggccagaaggagaacgggctaagtgagactacttctaaggactctcatccgcctgaccttggccctccacacatcccagtgcctcccagcatcccagtcggtgggtgcaaccccccatcctccgaggagacccccaagaacaaggtggcctcctggctctcctgtaatagcgtcagcgaaggtggcttcgcagactctgactctcacagctctttcaaaacgaatgagggaggagagggcagggctggagggtcaaggatggaggctgaaaaggcgagtactagcggccttggtatcaaggatgaaggcgatataaagcaagccaaaaaggaggataccgacgacaggaataagatgagtgtggttactgaatcctctaggaactacggatataatccttcccccgtaaagcccgagggactgcggagaccacccagcaaaacctccatgcaccagagcagacggctcatggccagcgcacagagcaatcccgacgacgttcttaccttatcatcaagcacagaatccgaaggagagagcggcacgtccaggaagcccacagccggtcagacatctgccacggctgtcgattccgatgacattcaaactatatcatcaggaagtgagggcgacgatttcgaagacaaaaagaatatgactggtccaatgaagcgtcaggtggctgtgaagagcacccgtggcttcgccttaaaatcaactcacggcatagcaataaagagcaccaacatggcgtctgtggacaagggagagtccgctcctgtccgcaaaaacactcggcaattttatgacggtgaggaatcttgctacatcattgatgccaagctggagggcaatttggggcgatatctcaatgttcgccctctgtcgcctcccctggatgcaggcctgtcacatgggcctcagatctcatttaacatcctgtacaaacccttctcatgctataaacttctgattagcaaatag

SEQ ID NO: 240297 - DNA, 492 bp, Artificial Sequence
  Description of Artificial Sequence: Synthetic coding sequence
atgtctagcctgccaggttgcatcggactggacgccgcaacagcgactgttgaaagcgaagagatcgcagagctccagcaggcagtggttgaagaactgggaatctctatggaagaactgcgacattttattgatgaagaattggaaaagatggactgtgtgcagcaaagaaagaagcagctggcagaacttgagacatgggtgatacagaaggaatcagaagtggcccacgttgaccagctctttgacgacgcctcgcgagccgtgactaattgcgagtctcttgtcaaagacttctactcaaagttaggcttgcagtatagagactcatcaagcgaggatgaatcctctcgccctactgagatcattgagattccagatgaggatgatgatgtgctcagtatcgacagcggagatgccggttcccggacgccaaaagaccaaaagctgcgcgaggctatggccgctcttaggaaatctgcccaggattag

SEQ ID NO: 240298 - DNA, 1911 bp, Artificial Sequence
  Description of Artificial Sequence: Synthetic coding sequence
atgtccagtctgccaggatgtattggactggatgctgcgactgcaactgtcgagagtgaagagatcgctgagttacagcaggccgtcgtagaggagctgggtataagtatggaggagctgcgccatttcatcgacgaggaactggagaaaatggactgtgtgcagcaaaggaaaaagcagctggccgaactcgaaacatgggttatccagaaggaatccgaagtagctcacgtcgatcagctcttcgatgatgccagcagagccgtcaccaattgcgaaagcctggttaaagacttttatagcaaactgggcttacagtacagggacagctcaagtgaggatgagagctctagacccaccgagataatcgaaatccccgatgaggatgatgacgttctctccattgactctggggacgccggatcccgcacacccaaagaccagaaattgcgggaggcaatggctgcattgcgcaagagcgcccaagatgtgcagaaattcatggacgccgtgaataagaaatcaagctcacaggatcttcataaaggcactctgagccaaatgagcggcgagctgtctaaagatggggatttgatcgtgtccatgcgaattttgggaaagaaaaggaccaaaacctggcataagggcacattgatagcaatccagacagtggggcctggcaaaaagtataaagtgaagtttgataacaaggggaaaagcttattgtcaggcaatcatatagcttatgattatcaccctccagcggacaagttgtacgtgggaagccgggtggtcgcgaagtataaggacggcaatcaagtatggctgtatgccggaattgtcgcagagacaccaaatgtgaaaaataaactgcgtttcctgatcttctttgatgacggatacgcaagttatgtgacccagtcagagctatacccgatatgtcggcctctcaagaagacctgggaggatattgaagatatttcttgtagggattttattgaggagtacgtgactgcctaccccaatcgtccgatggtgcttttgaaatctggtcagctcatcaagactgaatgggagggcacttggtggaaaagccgcgtcgaagaggtcgatggaagcctagtcagaattctgtttctggacgacaagcgctgcgaatggatctaccgtggctctacaaggctggaacctatgttctctatgaaaacctccagcgcctccgccctggaaaagaaacaggggcagctgagaacccggcctaatatgggagctgtaaggagtaaaggcccagtggtacagtacacccaagacctcaccggaacaggaacgcagttcaaacctgtcgaacccccacagccaactgccccacccgctcccccattccctccggcacctccgctgtccccacaagccggtgactccgagtcactagagtcccagctcgcccagagccgcaagcaggttgctaagaaatcaaccagctttaggcctggtagtgtggggagcggccattcttcccctacctcccccgctttgtccgaaaacgtgtccggtggtaaacccggaattaatcaaacttacaggtcacccttaggctctacagcgtccgcccctgcacccagtgcattgccagcacctccagcgcctccagtgttccacggcatgctcgagagagcaccagcagagccaagctatagagcaccaatggagaaattattttatctcccacacgtctgctcatacacctgcttgtcacgcgtacgtcctatgcgcaacgagcaataccgcggaaaaaaccctctgttggtacccctgctctatgacttccgtcgcatgaccgcacgtaggcgggtaaacaggaagatgggattccacgttatttataaaacaccatgcgggttatgtctttag

SEQ ID NO: 240299 - DNA, 2160 bp, Artificial Sequence
  Description of Artificial Sequence: Synthetic coding sequence
atgggcgagaagaatggggacgccaaaaccttttggatggagctggaggacgacggaaaggtcgattttattttcgaacaggtacagaacgtattgcaatcactgaaacagaagatcaaagacggatctgctactaacaaggagtacatccaggccatgatactcgtgaacgaagccacgattatcaactcctcaacctccatcaagggcgcttcccagaaagaggtgaatgcccaaagctctgaccctatgccggtgactcaaaaagagcaggagaacaaaagcaacgcttttccaagcacctcgtgcgagaatagttttccggaagactgtactttcttgacaaccgagaacaaggagatcttgtctctggaagataaagtggtggattttcgggagaaggatagttcttccaacctttcctatcagtcacatgattgctccggagcctgcctgatgaagatgcccctgaacttaaagggagagaatcccctccagttgcccattaaatgtcactttcagcgaagacacgcaaagacaaacagccactctagtgccctgcacgtctcatacaagaccccttgcggtcggagtctgcgcaacgtggaagaggtgttccgctaccttctcgagaccgaatgcaattttttattcaccgataacttctctttcaacacttacgtgcaactggctagaaattacccaaagcagaaggaggttgtttcagacgtcgatatatctaatggggtcgagagcgtcccaattagtttttgtaacgagattgactcacgcaagctgccacagttcaagtaccgcaaaacagtttggccacgcgcttataacctcaccaacttttccagtatgtttaccgattcatgtgattgctccgaggggtgcatagatatcacgaaatgcgcctgtctgcagctgacagctaggaacgccaagacaagtccgctcagctccgacaagatcacaaccggctacaaatataagcgactgcagaggcagattcccactggcatttatgaatgcagtcttttatgcaagtgcaaccggcagctgtgccaaaatcgagtagtccagcacggcccacaagtacgcctccaggtttttaaaacagagcaaaaggggtggggtgtaagatgtctcgacgatatcgaccgcggtaccttcgtttgtatctactcaggtcgcctgctttctagagcaaatacagaaaaaagttacggaatcgacgagaacggacgcgacgaaaatactatgaaaaacattttctctaagaagcgtaagttggaggtcgcctgcagcgactgcgaggtagaggtgctgcctctgggactagaaacacacccgaggacagctaaaactgaaaaatgtcctcccaagttctctaacaatccgaaggaactcaccgttgaaaccaagtacgacaatatctcacggattcagtatcattcagtcatccgagatcctgagtccaagaccgcaattttccagcacaatggcaaaaaaatggagttcgttagttctgagagtgtaactcctgaggataacgacggatttaagccccctagggagcacttgaactctaagactaagggggcacaaaaagattcttcttcaaaccacgtagatgagttcgaggataacctgctgatcgaatccgacgttatcgacattacaaagtatagggaggagactcctcccaggtctcggtgtaaccaagccaccacgcttgacaaccagaacataaaaaaagcaattgaggtgcagatccaaaagcctcaggaaggacggtccaccgcgtgtcagaggcagcaggtattttgcgatgaggaactcctttccgagacgaaaaatacctccagtgacagtttgacgaagtttaacaaaggtaacgtattcctacttgacgccacaaaagaaggaaacgtgggacgcttcctaaaccatagctgctgccctaatctgctcgtgcagaacgttttcgtggagacacacaatcgcaactttccgctagtcgcattttttactaaccggtacgtgaaagctcgcaccgaactcacttgggattatggttatgaggcgggtacggtcccagaaaaagagatcttctgccagtgcggggtgaacaaatgtagaaagaagatactgtag

SEQ ID NO: 240300 - DNA, 2124 bp, Artificial Sequence
  Description of Artificial Sequence: Synthetic coding sequence
atgggagaaaaaaacggtgatgcaaaaactttttggatggagctggaagatgacgggaaggtggatttcatctttgagcaagtccagaatgtactgcaaagtctgaagcagaagattaaagacgggtccgctaccaataaggagtatatccaggccatgattttggtgaacgaagcaacaatcatcaactcatctactagtatcaaagacccaatgcccgtcactcagaaagaacaggagaataagagcaatgcttttccatctacttcctgtgagaattccttccctgaagattgtaccttccttacaactgaaaacaaagagatcctttctctcgaggataaggtagtcgatttccgcgagaaagactccagctcgaacctctcctaccagagtcacgattgctcgggcgcttgtttgatgaaaatgcctctcaatctgaaaggagagaatccactgcagctacctatcaagtgtcacttccaacgcaggcacgctaaaaccaactcgcacagctccgcactgcatgtgagctataagaccccgtgcggccgaagcctgagaaatgtcgaagaagtatttaggtacctgcttgaaacagaatgcaacttcttgtttacggataatttttcctttaatacctatgtgcaacttgcccgaaactatccgaagcagaaagaagttgtgagtgatgtcgatatctcaaatggagtggagagcgtgcctatctctttttgcaacgaaattgacagccggaagttgcctcaatttaaatatcggaaaactgtgtggcccagggcctacaatctgacaaatttcagctccatgttcacagatagctgcgactgttctgagggctgtatcgacatcaccaaatgtgcctgcctgcaactgaccgcgagaaatgccaagacaagcccactgtcttctgataaaatcaccacagggtataagtataaaaggctgcagagacagatccctaccggaatttatgaatgcagccttttgtgcaaatgtaatcgacagttgtgccagaatcgtgtcgtgcagcatgggccacaggtgcgtctacaggtttttaagacagagcagaagggctggggggttcgctgtctggacgacatagaccgcggtaccttcgtgtgcatatacagcggtcgactgctcagcagggcaaacactgagaaatcatacggaattgatgagaatggaagagatgagaacaccatgaagaacatcttttctaaaaagcggaaactcgaagtggcttgttcagactgtgaagtggaggtgctacccctcggccttgagacccacccacgaactgctaagaccgagaagtgtcccccaaaattcagcaacaatccaaaggagcttacagttgagaccaagtacgataatatcagccgtatacagtatcactccgtcattcgcgatccagagagtaaaacagccatttttcaacataacggaaagaagatggagtttgtctcttcagagtcggtcacacctgaggacaatgatggtttcaagcctccaagagaacacttgaatagcaagactaaaggtgctcagaaagactctagctcaaaccatgtcgatgaatttgaggacaatttgctgattgaaagtgacgtgattgacattaccaaataccgtgaggaaaccccgcctcggagtcgctgcaaccaggctacaaccctggataaccaaaacataaagaaggcaatcgaagtccagatacaaaaaccccaggagggcaggtccactgcctgccagcgacaacaggtcttctgcgacgaagaactgttaagcgagacaaaaaacaccagctcagactccttgaccaaattcaacaaaggcaacgtgttcttgctggatgctaccaaagaaggcaacgtagggcgtttcttgaatcatagctgctgcccaaacctgctggtgcagaacgttttcgtggagacccacaaccgtaacttccccctggtcgccttctttaccaatagatatgtgaaggctagaactgagctgacatgggactatggatatgaggccggtaccgttccagagaaggagattttctgccagtgtggcgtgaacaagtgccgtaagaagattttgtag

SEQ ID NO: 240301 - DNA, 975 bp, Artificial Sequence
  Description of Artificial Sequence: Synthetic coding sequence
atgagtaggccctcatccacaggtccttccgctaataagccatgttccaaacagccacctccgcagccccagcacacacctagcccggcagcaccgcctgccgcagcaaccatctccgccgcagggccaggcagctctgctgtgcccgcagccgcagctgttatctccggtcctggcggtggcggtggcgcagggcctgtttccccccagcatcacgagctcacctctctgtttgaatgtccagtttgcttcgattatgtcctcccacctatcctgcagtgccaagccggacacctggtctgtaatcagtgccggcagaagctctcctgttgccccacttgtcggggagccttgacccccagcattaggaacctcgctatggagaaggtggctagtgccgtgcttttcccatgcaaatacgccacaaccggctgtagcctgaccctacaccacacagagaagcccgaacatgaagatatctgtgagtataggccctactcgtgtccttgtcctggggctagctgcaagtggcagggttcattggaagccgtaatgagtcatctcatgcacgctcacaagagtatcactaccttgcagggggaggacatcgtgttcttggcaaccgatatcaatttgcctggagccgtggactgggtcatgatgcagtcctgcttcggacatcactttatgctggtcctggagaagcaagaaaaatatgagggacatcagcaattttttgcaatcgtcctacttattgggacgaggaaacaagccgaaaacttcgcttatcggctggaacttaatggtaatcgcaggcggcttacatgggaggcaacccctagatccattcacgacggtgtcgctgctgctatcatgaactcggattgcctggtttttgacactgcgatcgctcatttgttcgctgacaacggcaatctcggaataaacgtgacaatttccacctgctgcccttag

SEQ ID NO: 240302 - DNA, 990 bp, Artificial Sequence
  Description of Artificial Sequence: Synthetic coding sequence
atgatgtcgaactcttcttccgaaatcgacgtcatcaagaccagaatacccacctatgatgaggatgacaataccatactatatgcttacgaaaccaagcccgaattcgttaacaaggagcctaacatagtgtctgatgcctcttgcaatacagaggaacagttaaaaactgtagatgacgtcctgatacactgccaggtcatctacgacgccctgcagaacctggataagaaaattgatgtcattcgaaggaaagtaagtaagatccagaggttccacgcacgaagcctgtggactaatcacaagagatatgggtataagaaacactcttaccgcctggtgaagaagttaaaattgcagaagatgaagaaaaatgaagtttatgagactttctcttaccctgagagttattctcctactctgcctgttagccgaagggagaacaactctcctagcaacctgccgagaccatcgttttgcatggaggagtatcagcgggcagaactggaggaagatccgattctttcgcggactcctagcccagtgcatccctctgactttagcgaacataattgtcaaccctactacgcgtccgatggcgctacatatggatcttcttctggactctgtctcggcaaccccagagcagatagcattcataatacttattctactgaccacgccagtgctgcccctcctagcgtcacaaggagccccgtggagaatgatggctatattgaggagggttccattacgaagcatccaagcacttggtctgtcgaagcagtcgtgctcttcctaaagcagactgacccattggccctttgtccactcgtcgacctgtttcgttcccacgaaatcgacggtaaagcactcttgttactgactagcgacgtgctcctaaagcacctgggggtgaagctgggcaccgccgtgaagctgtgctactacattgacaggcttaaacagggcaagtgttttgagaattag

SEQ ID NO: 240303 - DNA, 909 bp, Artificial Sequence
  Description of Artificial Sequence: Synthetic coding sequence
atgatgtctaatagcagtagcgaaattgatgtgcaagagcccaacattgtgtcagacgcttcctgtaatacagaggaacagttgaagaccgtggatgacgttctgatccactgccaggtcatttatgatgctctgcagaaccttgacaaaaagatcgacgtgatccgacgcaaggtgtccaaaatccagagattccacgcgagaagcctgtggaccaaccacaagagatacggctacaagaaacatagctaccggctggtgaaaaaactgaagctgcagaagatgaagaagaacgaagtatacgaaacattctcttatcccgagagctactcacccactctgcccgtcagcaggagagagaataacagcccctccaacctccctagaccaagtttttgcatggaggagtaccaacgcgcagagctcgaggaagaccccattctttccagaacacctagcccggttcacccctcagacttctccgaacacaactgtcagccttactacgctagcgacggcgcaacatatgggtccagctctgggctgtgccttggcaacccaagggctgattccattcacaatacatattcaaccgatcatgcatccgccgctcctccttctgtgacccggtcgccagtggagaacgatggctacatagaagaaggttccatcacgaagcatccctctacttggtccgttgaggctgttgtgctgttcttgaaacaaaccgatcccctggctctttgcccgcttgtggatctgtttaggtctcatgagattgatggtaaagcccttctgctgctcacctctgatgtgctgttgaaacaccttggggtgaagctgggcactgcagtcaagctgtgctattatatagacagactcaagcagggcaaatgctttgagaactag

SEQ ID NO: 240304 - DNA, 627 bp, Artificial Sequence
  Description of Artificial Sequence: Synthetic coding sequence
atgaaaaagaacgaagtgtacgagaccttctcgtaccccgagagctattcaccaacacttcctgtgtcaagacgagaaaacaatagtcctagtaacctgcctcggcctagcttttgtatggaggagtatcagagggctgagctcgaggaggatcctatcctgagccggactccttcccccgtacaccccagcgatttttctgaacataactgccagccttactatgcctcagacggagctacatatggtagctcatccgggctgtgtctgggcaatcctcgcgcagatagtatccataatacatacagcactgatcacgcatctgccgctcccccaagcgttacaagaagtcctgtggaaaatgatggctacatcgaagagggctccattacaaagcaccctagcacgtggtccgttgaggcagtcgtcctattcctgaagcaaacagatccgcttgcactttgccccctcgtcgatttgttccggagccacgagatagatggaaaggccctgctcctccttacttctgatgtcctgttgaagcacttaggcgtcaagcttgggactgccgtgaaactttgctactatatagacaggctcaaacaggggaagtgcttcgagaattag

SEQ ID NO: 240305 - DNA, 627 bp, Artificial Sequence
  Description of Artificial Sequence: Synthetic coding sequence
atgaagaagaacgaagtgtacgagacgttctcctaccccgaatcatatagccccacgttacccgtgagccgtagggaaaataatagtccttccaatttaccaagaccttccttctgtatggaggagtatcagagagccgagctggaggaggacccaatcctcagcagaaccccaagccccgtgcatccttctgacttctcagaacacaactgccagccatactatgcttcggatggggcaacatatggcagtagctccgggctctgtttgggtaacccccgagccgactccatccataacacatatagtactgatcatgcttcagccgcacccccttcggtgacccggagccccgttgaaaacgatggatacattgaagaaggatctatcaccaagcacccatccacctggtctgttgaagccgtggtgctgttcctcaagcagaccgatcccctggccctatgtcccctggtggatctgttccggtcccatgaaatcgatggaaaggctcttctgctgctgacttccgatgtgcttctgaagcatctgggagtaaaactcggaacggctgtcaaactctgctactacatcgatcggctgaagcagggcaagtgcttcgagaactag

SEQ ID NO: 240306 - DNA, 447 bp, Artificial Sequence
  Description of Artificial Sequence: Synthetic coding sequence
atgatgtcaaatagctcctcagagatcgatgtccaggagccgaatatcgtgtccgacgccagctgcaataccgaggaacaactgaagacggtggatgatgtgttgatccattgccaagtaatctatgacgccctgcagaatctcgacaaaaagatcgatgtgattcgcagaaaagtgtctaagatccagaggttccacgctcggagcctgtggactaatcataaacgctacggatataagaagcactcataccgactcgtgaagaaactcaagttgcagaaaatgaagaaaaatgaagtctacgaaacattctcttatcctgagagttactcacccactttgcccgtgtccaggcgcgagaacaatagccccagcaacctccctagaccttcattctgcatggaggaataccagcgagccgaacttgaggaggaccccattttatag

SEQ ID NO: 240307 - DNA, 2103 bp, Artificial Sequence
  Description of Artificial Sequence: Synthetic coding sequence
atgggccagacggtcaatgaggactccatggacgtgaaaaaggaaaaccaggagaagacaccccagagctctacatcatccgtgcaaagagacgactttcactgggaagagtacctgaaagaaacaggatcaatcagtgccccatcagagtgcttcaggcagtctcaaatccctcctgtaaacgattttaaggtgggaatgaagctcgaggctcgcgatccacgaaacgcaacatccgtgtgcattgccacagtgattggtattaccggcgctagattgcggctacgcctggatggtagtgataacaggaatgatttttggaggctcgtggacagccctgatatacagcctgttggaacatgtgagaaggaaggcgatctcttgcagcctccgctcggataccaaatgaatacttcttcatggccaatgttcctgctgaagactctcaacggctctgagatggctagtgccaccttatttaagaaggaacccccaaagccccctctcaacaattttaaggtcggaatgaagctggaggcaatagacaagaaaaacccttacttaatatgcccagctactattggcgacgtcaagggcgatgaggtgcacatcacattcgatggatggagcggcgcatttgactactggtgcaaatatgattcacgcgacattttccccgcaggctggtgcagacttaccggggatgtgctccagccaccaggaacctccgtgccaatcgtgaagaatattgcaaagacagagtcgtccccatccgaagcttcccagcattctatgcagagccctcagaagaccactctgatcttacccactcagcaggtgcgcagatcaagccgcataaagcctcctgggccaacagcggttccgaagagaagttcctccgtgaagaatatcactccacgaaagaagggccctaattcgggcaagaaagagaagcccttgcccgtgatctgctccacctccgccgcttccctgaaatcactcacccgagaccgtgggatgctctataaggatgtggcgtccggtccctgcaaaatcgtcatgtctaccgtgtgcgtatacgtcaacaagcacgggaattttggccctcacttagacccaaaacgcatccagcaactgcccgatcacttcggacccggaccggtgaacgtcgttctgagaagaatcgtgcaagcgtgcgtggactgcgcgctcgagacaaagacagttttcggctacctgaaacccgataatcgaggaggtgaggtcataacagcatcttttgacggtgagactcacagcatccaactgccccctgtgaattcggcctcatttgcgctgcgctttttagaaaacttttgtcactcgctacagtgcgacaatttactgtcctcccagccattctccagtagcagagggcacacccacagtagtgccgagcacgataagaaccagtcagctaaagaagacgtcactgagcgtcagagcaccaaaaggtccccgcagcagaccgtgccatacgtcgtgcctctctcgccaaagctgcctaagaccaaggaatatgcgagcgagggggagcccctctttgccggtgggtctgctatccctaaggaagagaatctgagtgaggacagcaagtccagttccttgaattcagggaattatttgaatcctgcttgtcgcaatcccatgtacattcacacctcagtaagccaagacttctctcggagcgttccaggcactacgtcatcaccactcgtgggagacatctcccccaagtcctcacctcacgaagtcaagttccagatgcagcgcaagtccgaggcaccaagctacatcgcagtcccggacccatcagttctaaagcagggcttctccaaagatccatctacatggtctgtggatgaggtcattcagtttatgaagcacacggacccacagatcagcgggcctttagcagatctcttccgccaacacgagattgatggtaaggccctgtttctattgaaaagcgatgtgatgatgaaatacatgggattaaagctggggcctgctctcaagctttgctattatatagaaaaattaaaggagggtaagtactcttag

SEQ ID NO: 240308 - DNA, 1038 bp, Artificial Sequence
  Description of Artificial Sequence: Synthetic coding sequence
atgcaatctcctcagaagaccactctgatcctgcccactcagcaggtccgccgtagttcacggatcaaaccgcctgggccaaccgccgtgccaaagagaagttctagtgttaagaatatcaccccccgaaaaaaagggcctaactccggcaaaaaggaaaagcccctgcctgtgatctgctcaacaagtgccgcttcactgaagtccctgacgagggataggggcatgctctacaaggatgtcgccagtgggccttgcaagattgtcatgtccaccgtgtgcgtgtacgttaataagcacggcaactttggccctcacctagaccccaaacggatccagcaactgcctgaccatttcggcccagggcctgtgaatgtcgtgctgaggagaatcgtccaggcttgcgtggactgtgccctagagaccaaaaccgtttttgggtatttgaagcctgacaaccgtggaggcgaggtgattaccgcctcatttgatggggaaacccacagcattcagctcccaccagtcaacagtgcgagtttcgcactgagatttctcgagaacttttgtcattccttgcagtgtgataatctgttgtcgtcccagccattctccagttctcgcggtcatacccattcaagtgccgaacacgacaaaaaccaaagtgcgaaagaggatgtgacagagagacagtctactaagcggagcccgcaacagaccgtcccctacgtggtacctctcagccctaagttgcctaagacaaaagaatacgcatcggagggcgaacccctctttgccggagggtcggccattcctaaagaagaaaacctgagtgaagattccaaatcgtcctctcttaattctggcaattacctgaatccggcttgccggaatccgatgtatattcatacgtctgtctcacaggacttcagtcgctctgttccgggaacgaccagctcgcccttggtgggagacatatcgcccaagtccagtccacacgaagtcaagtttcagatgcagcgtaaaagtgagggtaactag

SEQ ID NO: 240309 - DNA, 378 bp, Artificial Sequence
  Description of Artificial Sequence: Synthetic coding sequence
taagcaaaagaagatgtcacggagcggcaatccactaagaggtcaccacagcagaccgtcccctatgtggtgcccctatctcccaagcttcctaagactaaggagtacgccagcgaaggggagcctctgtttgccggtggatcagcgatccccaaagaagagaacctgtccgaggattcgaaatcatcctccttgaattctggcaactaccttaatcccgcttgcagaaacccaatgtatatccatacaagcgtatcccaggacttctcaaggagcgttcccggtactacatcgagtcccctcgtgggcgacatctctcccaaatcaagcccccacgaagtgaaattccagatgcagaggaaaagcgagggcaattag

SEQ ID NO: 240310 - DNA, 1734 bp, Artificial Sequence
  Description of Artificial Sequence: Synthetic coding sequence
atgggccagacagtgaatgaggattctatggacgtcaaaaaggagaaccaagagaagacacctcagtcccaaatcccacctgttaatgacttcaaggtgggaatgaaactggaagccagagacccacggaatgctacgtccgtctgtatcgctaccgtcatcggaataactggggctcggctgagactgaggctggacgggagcgacaatagaaacgatttttggcgcttagttgattcgccagatatccagcctgttggcacttgcgaaaaagaaggggatctcctgcagccaccccttggataccagatgaacacaagttcctggccaatgtttcttttgaagacgctgaacggaagcgagatggcatccgccaccctttttaaaaaggaaccacctaaaccccctctcaacaatttcaaggtgggtatgaaattagaggccatcgataaaaagaacccctacctcatttgccctgcaacaatcggggacgtaaagggggatgaggtccacatcacttttgacggatggtcaggcgcatttgactattggtgcaaatacgacagtcgggacatcttcccagctgggtggtgtcggttgactggagacgtccttcagccacccggtacatctgtgccaatcgtgaagaatatcgcaaagaccgagagctcccctagcgaggcgtcccaacatagcatgcagtccccccaaaaaaccaccctcatcctgccgacgcagcaggtacggagatcctcgcggatcaagcctccaggcccaaccgcggtccccaaacgatcgtcttcagtcaaaaatattacaccacgcaaaaagggacctaattccggcaagaaggagaagcctctccctgtgatatgctcgacaagcgcggcaagtctgaagtctctgacacgtgatcggggtatgctgtacaaggacgtggcgagcggcccttgcaaaatcgtaatgtcaacagtgtgtgtgtatgtgaacaagcacggcaactttgggcctcatctggacccaaagcgcatccagcagctccctgaccactttggccctggccctgtgaatgtggtcttgcgccgaattgtgcaggcatgtgtggattgtgcactcgaaaccaagactgtctttgggtaccttaagccagataatcggggaggtgaagtcattacggccagtttcgacggtgaaacccacagtattcaactcccacccgtaaacagcgcctcttttgctcttaggtttctggagaatttctgccacagtttgcagtgtgacaatctgctcagttcccagccttttagtagctcacggggacacactcacagctcggccgaacacgacaaaaaccaatctgcaaaggaggatgtaaccgaaaggcaatctactaaacgcagcccacagcagactgttccatatgtagtgccactgtctcccaagttgcctaagactaaggaatatgccagtgagggagagcccctgtttgctggagggtccgctattcctaaagaggagaatctttcagaggactctaaatccagcagcctgaacagcggcaattatctcaaccccgcttgccggaaccccatgtatatccacaccagtgtgtcacaagactttagcagaagtgtcccgggaacaacatcttcccccttggtgggagacatatctcccaagtcttcacctcacgaggttaaatttcaaatgcagagaaaaagcgagggtaattag

SEQ ID NO: 240311 - DNA, 615 bp, Artificial Sequence
  Description of Artificial Sequence: Synthetic coding sequence
atgcagtcctatgctagtgctatgctgagtgtgtttaattcagacgactacagtcctgctgtgcaagagaacatccccgcactcaggaggtcctcttcctttctgtgtaccgagagctgcaattccaaataccaatgtgaaacaggcgagaatagtaaggggaacgtgcaggatcgtgtgaaacggccaatgaatgcttttatcgtgtggagccgggatcaacgacgaaaaatggctctggaaaacccacggatgagaaactctgagatatcgaagcaactaggctaccagtggaagatgctcacagaagccgaaaagtggccatttttccaagaggcccagaagctccaggcaatgcacagagagaaatatcccaattataaatatagacctcgcaggaaggcgaaaatgctcccaaagaattgttctctgctgccagctgatcccgctagcgtgctgtgctctgaagtgcagctggataaccggttataccgagacgattgtaccaaagcaacccattcacggatggaacaccagctcggacatttgcccccaattaatgctgcatcgagcccacagcagcgggatcgctattcacattggacgaaattgtag

SEQ ID NO: 240312 - DNA, 594 bp, Artificial Sequence
  Description of Artificial Sequence: Synthetic coding sequence
atgcaaagttatgcttctgcaatgttgtcagtttttaattcagatgattattccccagccgttcaggagaatattcccgcactgcggagatctagtagtttcctttgcaccgaatcctgtaactctaagtatcagtgcgagaccggagagaactctaaggggaacgtgcaggatagagtgaaaagacctatgaacgcttttatagtctggtcccgggatcagaggcgcaaaatggcccttgagaatcccaggatgcgcaacagtgaaattagcaagcaattaggctatcagtggaagatgctgactgaggccgagaaatggccattctttcaagaagcccaaaaactgcaggccatgcaccgagagaaataccccaattacaagtaccgccctcggcgaaaggctaagatgctgcccaagaactgttcactgctccctgcggatcccgctagcgtattatgctccgaggttcagttggataatcgtttatatagggacgactgcaccaaagcaactcactctcgcatggagcaccaactggggcatctgcctcctatcaacgccgctagtgcagctacgggccctttgcagtag

SEQ ID NO: 240313 - DNA, 498 bp, Artificial Sequence
  Description of Artificial Sequence: Synthetic coding sequence
atgcaatcatacgccagtgcgatgctgtctgtctttaacagcgacgactacagtcccgcagtgcaggagaacattcctgccctaagaaggagctcttccttcctgtgcaccgagagttgcaattcgaaatatcagtgcgaaactggtgaaaatagcaagggtaatgttcaagatcgcgtgaaacgcccaatgaacgccttcatcgtttggtcccgagatcagcggcgtaaaatggcgctggaaaatcctaggatgcggaattcggagattagcaagcaattgggataccagtggaagatgttgaccgaggccgagaaatggccgttcttccaagaggcccagaagcttcaagccatgcacagagagaaatatcctaactacaagtatcggcctaggagaaaagctaagatgctcccaaaaaactgctcattgctcccggcagaccctgccagtgtattatgcagtgaagttcaaggccaacaggtcgtccagggctag

SEQ ID NO: 240314 - DNA, 3729 bp, Artificial Sequence
  Description of Artificial Sequence: Synthetic coding sequence
atgaaaaatctgcttactgaaaagtgcatctctagtcataattttcaccagaaggtgataaagcagcgaatggaaaaaaaggtggactctagatacttcaaagatggagcggtgaaaaagccctactcagccaagacattatctaataagaaaagttcagcttctttcggcatcaggcgcgaactaccaagcacctcccatctggtgcagtataggggcacccacacctgcacacgccagggacgtctgagagaactcagaattaggtgtgtagctcggaaatttctgtacctctggatccggatgacattcggtagagtatttcccagcaaagcacgattctactatgagcagaggctattgaggaaggtctttgaggagtggaaagaggagtggtgggtgtttcagcatgagtggaaactatgtgtgcgagcagattgccactacaggtactacctttataacttgatgttccaaacctggaaaacctacgtgcggcagcagcaggaaatgcggaacaaatacatcagggcagaggtacatgacgctaagcagaaaatgcgccaggcttggaagtcctggctgatatacgtcgttgttcggaggaccaagctccagatgcagactaccgctttggagtttaggcagagaattattctccgggtttggtggtctacttggaggcagcgcctcggacaagtccgcgtgtccagagctttgcatgctagcgctctgaaacacagagctctctcattacaggtgcaagcctggtcccagtggcgcgagcagctcttgtatgtacagaaagagaaacaaaaggtggtgtccgctgtgaaacaccatcagcactggcaaaagaggaggtttctgaaggcgtggttggaatacttgcaggttagaagagtcaagcgccagcaaaatgagatggcggagcggtttcaccatgtgaccgtgctgcagatctatttttgcgactggcaacaggcgtgggagcgcagggaatcactgtatgctcatcacgctcaggtggaaaaactggctcggaagatggctctacgcagagcgtttacccactggaagcattacatgttactgtgcgccgaggaggccgctcagtttgaaatggccgaagaacaccatcgacatagtcagctctacttctgcttccgggctttgaaggacaacgtgacacacgcgcatttgcaacagattcgccgtaacctagcgcaccagcagcatggggttacgttgttacaccgtttttggaatttgtggagatctcagattgaacaaaagaaagagagagagctcctgcccctcctgcatgccgcatgggatcactacaggattgccctactttgtaaatgtattgagctctggctccagtacactcagaagaggaggtacaaacagctccttcaggctagagccgatgggcacttccagcagcgggctctgcctgcagcattccacacatggaatcgactgtggcgctggcggcatcaggaaaacgtcctctctgctcgcgctacgcggttccacagggagaccctcgaaaagcaggtcttttccctgtggcgccagaagatgtttcaacatcgggagaaccgtcttgccgagaggatggccatcttgcacgctgaacgccagctactgtataggagctggttcatgtggcaccagcaggccgcagccagacaccaggagcaggaatggcaaacagtcgcatgtgcccatcaccgccacggcagactgaaaaaagccttctgtctctggagggagagtgcccaggggcttcggaccgagagaaccgggcgagtccgagcagctgaatttcacatggcgcagctgctccgctgggcatggtctcagtggagggagtgtctggccctgcggggagccgagcgccaaaaattgatgagggctgacctgcatcaccaacactcggtgctgcaccgcgcacttcaggcttgggtgacctaccaggggcgtgtgagaagtattttaagggaagtggccgcacgagagtcacagcacaatagacagctactgaggggcgctctgaggaggtggaaggaaaacaccatggcccgtgtggacgaggcaaaaaagacattccaggcatcaacacactatagacggacaatttgctccaaggtgctagtgcagtggcgcgaagctgtgagcgtccagatgtactacagacagcaggaagattgcgcaatttgggaggctcagaaggtgctcgacagggggtgccttcggacctggtttcagcggtggtgggactgcagccgcagatcagctcaacaacgccttcagctagagagagccgtgcagcatcaccacaggcaattgctgctcgagggcctggccaggtggaaaacacatcacctgcagtgcgtacggaagcgcctgttacacaggcaaagtactcagttattagcacaaagactgagccggacctgtttcagacaatggcgccagcagctcgcagcacgtcggcaggagcagcgcgctaccgttagggccctatggttctgggctttcagccttcaagccaaagtgtgggcgacatggttagccttcgtgcttgaaaggcgaaggaaaaaggccaggcttcagtgggcactgcaggcatatcagggccaactcttgcaggagggggctacaagactgcttcgcttcgctgcaagtatgaaggcgagtagacagcagcttcaggctcaacagcaggtccaggccgctcacagcctccacagggctgtccggaggtgtgcgacattatggaagcagaaagttcttggccgaggtggaaagccgcaaccgcttgctgccattgcgccttccaggaaggtcactttcgaaggccctctgcttaaccgcatcgcagccggagccggagatggaacactcgaaacaaaaagacctcaggcaagccgtcccctcggcgctctcggaaggctggccgcagaagaacctcatgctcttgagctgaacaccgcccatagcgccagaaagcagcctcgcagaccccactttttgcttgagccagcccagagccagagaccccaaaagccgcaggaacacgggttgggcatggctcagccagcagccccaagcctgactagacctttccttgccgaggctcccaccgcactggtcccgcactccccattacctggtgccctcagttctgcaccgggtcctaagcagccgccaacagccagcactgggcctgaactccttttgctccctttgtcctctttcatgccctgtggagccgcagcccctgctagagtctctgcccagcgcgcaactcccagagataaacccccagtgcccagctccctcgcttcagttcctgatccacacctgttgctaccaggagacttctcggctacaagggccggtccagggctctcaactgccggatcacttgacctggaagctgaattggaagagatccagcagcaattactccattaccagaccaccaagcagaacctttggtcatgtcgaagacaagcttctagcctccgtcggtggcttgaattaaacagagaggaaccgggacccgaggaccaagaggttgaacagcaagtgcaaaaagaactagagcaggttgaaatgcaaatccagttattagccgaagagcttcaggcccagcggcagcccatcggggcatgtgtggcgagaatccaggctctgcgccaggccctgtgctag

SEQ ID NO: 240315 - DNA, 3483 bp, Artificial Sequence
  Description of Artificial Sequence: Synthetic coding sequence
atgaagaacctgctgacagagaaatgcatcagctcacacaattttcaccagaaggttattaagcagagaatggaaaagaaggtggactcacggttttattacgaacagaggctgctgcggaaggtgtttgaagagtggaaagaggagtggtgggtctttcagcatgagtggaagctgtgcgtgagagctgactgtcattatcgatactacctttataacctaatgttccagacatggaaaacttacgtgcgtcagcagcaggaaatgcgcaataaatacatcagggccgaggttcacgacgcaaagcagaagatgcgacaggcttggaagtcttggctaatctacgttgttgttaggagaactaaactgcagatgcagactacagctctcgaattccggcaacgaatcatcctccgggtgtggtggagcacgtggagacagcggctgggacaggtaagggtaagtcgcgctctgcacgctagcgccctcaaacatagggcactgtcactccaagtccaggcatggtctcagtggcgggaacagcttctttatgtccaaaaggagaagcagaaggttgtgtccgccgtaaaacaccaccagcactggcagaagcggaggtttctgaaagcctggctcgagtatctccaagttagaagggttaagagacagcagaacgagatggcagagcgtttccatcatgtgacagtgctacagatatatttctgcgattggcagcaggcctgggaacgacgtgagtccctttatgctcaccacgcacaggttgagaagttggctcgcaaaatggccctgcgcagggcgttcactcattggaagcactatatgctcctgtgcgccgaggaggccgctcaatttgagatggccgaagagcatcacaggcacagccagctttacttttgcttccgggcactgaaagataacgtcacacatgcccatctacaacaaatccgacgaaatctcgctcaccaacagcacggagttaccttactgcacagattctggaatctctggagaagccagatcgagcaaaaaaaggagcgggagctactgccactgctgcatgccgcttgggatcactaccgcatcgccttgctttgcaagtgtattgaattatggctacagtatacacaaaaacggagatacaagcaacttttacaggcgcgagctgatggtcacttccaacagagggccttgcccgctgcctttcacacttggaaccggctgtggcgatggcggcaccaggagaatgtgctctccgccagagctacaagattccaccgtgagaccctcgagaaacaagtgttcagcctatggaggcagaagatgtttcagcacagggagaatagattggccgagaggatggcaatattgcacgctgaaagacagctgctgtacaggtcttggtttatgtggcatcagcaagccgctgccagacatcaagagcaggaatggcagacagtagcctgcgcccatcataggcacgggagactaaagaaagcattttgcttgtggcgagaaagcgcgcaggggttgcgcacggagagaactgggcgagtgcgcgctgcagagtttcacatggcccagctgctgaggtgggcttggtcacaatggagagaatgcctagccctgaggggagctgagcgccagaagctcatgcgagcagatttgcaccatcaacatagcgtattgcacagagcactccaagcgtgggtcacgtaccagggcagagttaggagtatcttacgagaagttgctgctagggaatcacaacacaatcggcagttgctgagaggtgccctccgtcgatggaaggaaaacacaatggccagagtcgacgaggcgaagaagacatttcaggcaagcacacactatcgaagaacaatatgttcgaaggtgctagtgcaatggcgggaggcagtctctgtacagatgtattacagacagcaggaagattgtgcaatttgggaggcccagaaagttcttgacagagggtgcctgcggacctggtttcaacgttggtgggactgcagccgcagatcagcccagcagcgccttcagctggagcgggctgttcagcaccatcaccgccaactcctgttggagggcttggcacggtggaaaacacaccacctgcagtgcgtccggaagcgcctactgcaccgtcaatcaacgcagcttctggctcagcgtctgagccggacgtgttttcggcaatggagacagcaacttgctgcaagaaggcaggagcagcgcgctactgtccgggctctctggttttgggcattttcactgcaggcgaaggtatgggctacatggttagcattcgtcctggaaagaaggcgcaaaaaggctcggctgcaatgggcattgcaagcttatcaaggccagttacttcaggagggtgcgacccggctattgcgtttcgctgcctcaatgaaggcctctaggcaacagctgcaagcacaacaacaggtgcaggctgctcatagtcttcacagggcagtccgacgttgcgccacattgtggaaacagaaggtcctgggccgagggggaaagccacagccgcttgcagcaattgcccctagtaggaaggtgacgttcgaaggccctttgcttaatcgtatcgccgcaggggcaggcgatggcactctggaaacaaaacgtccccaggcaagtaggcccttgggagcactcggtcgtctggccgctgaggagccacatgctctagagttgaatactgctcactccgccaggaagcagcctaggagaccacactttctgttagaaccagcccagtctcaaaggccccagaaacctcaggagcacggcttgggcatggcccagcccgctgcaccctccctcactcgcccttttttggccgaggcaccaaccgctctcgtgcctcattcccctctgccgggagctctttcttctgccccaggccctaagcagcctcccaccgcgtcaaccggaccagaattgctgttgctgcccctgagttctttcatgccatgtggcgcagctgccccagccagggtctccgctcagcgagccacaccaagggataagcctcccgtgccttccagtttggcgtctgtgccggatccgcatttactgctgcctggggatttcagcgcaactagagcaggcccaggcctgtccaccgccggttccctcgatctcgaggctgaattggaggaaatacagcagcaactgttacactaccagactactaagcagaacttgtggagctgcaggcgacaggcctcctctttgaggaggtggctggagctgaatagggaggaacctgggccagaggatcaggaggttgagcaacaggtgcaaaaggaactagagcaggtggagatgcagatacagcttctagccgaggaacttcaagcccagcgccagcccattggcgcttgtgtggccagaatacaggcactgcgtcaggccctctgttag

SEQ ID NO: 240316 - DNA, 3096 bp, Artificial Sequence
  Description of Artificial Sequence: Synthetic coding sequence
atgaagaaccttttgacggagaagtgcatttcttctcacaacttccatcagaaggtaataaagcagaggatggagaaaaaagtggattctaggttctactatgagcagaggctactgcgtaaagtgtttgaagagtggaaggaggagtggtgggtgttccagcacgaatggaagttatgcgttcgagccgactgccactatcgggtttggtggtctacctggcgccaaagactcggtcaggtacgcgtgagcagagcactccatgctagcgcactgaaacatcgagcgcttagcctccaggtgcaggcctggagtcagtggagggaacagctgctgtatgtacagaaagagaagcagaaggtggtgtctgctgttaaacatcatcaacattggcagaagcgtagattcctgaaagcgtggctcgaatacctccaggtccggagggtcaaacgccagcagaatgaaatggctgagcgcttccatcacgtcactgtgctccagatttacttttgtgattggcagcaggcatgggagcgtcgtgagtcgttatatgcccatcacgcccaagtcgagaaactagctagaaaaatggccctgcgcagggcttttacacactggaagcactacatgttgttgtgtgctgaggaagccgcacagtttgagatggcagaagaacaccatcggcactcccaattatacttctgcttcagggcacttaaagacaatgtcacccacgctcacctccagcaaatcaggaggaacctagcccatcagcagcatggagtgaccttattacacaggttttggaatctgtggaggtcacagattgaacagaaaaaagagcgcgaactgctgccattgctccatgcggcttgggaccactaccgcattgcactgctttgtaaatgcattgagctttggttgcagtacacacaaaagcgaagatataagcaactgctacaagcgagagctgacggtcacttccaacagcgagctctgcctgccgcattccatacatggaatcggctctggagatggcgacaccaggaaaacgtgctgagtgcgagggctaccagatttcaccgcgagacactggagaagcaggtattctcgctgtggcgccagaagatgtttcagcaccgagaaaatagactcgcagaacgtatggccattcttcacgcagagcggcagctgctctacaggtcttggtttatgtggcaccagcaggcagctgcccgacatcaggaacaagagtggcaaactgtcgcttgtgcacatcatagacacggtaggcttaaaaaagctttttgcctgtggcgggagtccgcgcagggtttgagaactgagcggaccgggagggtgagagccgctgagtttcacatggcgcagctactcaggtgggcttggtcccagtggcgcgagtgcctggctctgaggggggcagaaaggcagaagctaatgcgagccgacctccatcaccagcactccgtgctccatcgggctctgcaggcgtgggtcacgtaccagggcagggttagaagcattctgcgcgaggtggcagcccgagagagccaacataaccgccagctgctcagaggagctcttcggcgttggaaggaaaacaccatggcaagggtggacgaagcaaagaaaaccttccaagcgagcactcactatcgaagaaccatatgcagcaaggtgttggtacagtggcgcgaggcggtgtctgttcaaatgtattataggcagcaagaggattgcgctatttgggaagcccagaaggttctggatcgcggatgtttaaggacttggtttcaacgctggtgggattgtagtagacggtcagctcagcagcggctccagttggagagggccgtgcagcatcaccaccggcaactgctactggagggactggctcgctggaagacgcaccatttacagtgcgtcaggaagcggctcttgcaccggcagtctacccagcttcttgctcaaagacttagcaggacctgttttcgccagtggaggcagcaactagcggcaaggagacaggagcagcgggcaacggttagagccctgtggttctgggccttcagcctccaggctaaggtttgggcaacatggttggcattcgtgctggagagaaggcgcaagaaagccaggcttcaatgggctcttcaagcttatcagggccagttacttcaagaaggggctacaaggctgctccgcttcgcagccagcatgaaggcctctaggcagcagttgcaggcccagcagcaggtgcaagccgctcactccttgcatagagctgtccgaaggtgtgctaccttgtggaagcagaaagtccttgggaggggcggaaaaccccagccacttgccgcaatcgccccaagtcggaaggtaaccttcgagggtccgctgttgaacaggatcgcggctggcgctggagacgggaccctggaaacaaagagaccgcaggcaagcagaccacttggggcactgggacgactagcagccgaagagccccacgcattggaattaaatactgctcacagtgcaagaaaacagccaaggagaccgcactttctgctggagcctgcacaatcacaacgacctcagaagccccaagagcatgggttgggaatggcacagcctgcagcgccaagtctgacaaggccttttcttgctgaagcacccacagctttagtccctcatagccctttacctggagccctgtcaagcgcaccaggtcccaagcagccccctaccgcgtcaaccggtcccgagctcctcctgcttccactttctagttttatgccatgcggcgctgcagcccctgccagggtgagtgcacagagagccacccctagagataagccacccgtgccatcctccctcgcatccgtgcccgacccacacctgctgttaccaggcgacttctcagccacgcgcgcaggaccaggattgtccaccgcagcttggaccctcagactgaacctgagacgcagtagcagcaattattgcacaactcgcccaccctctcgaacgtcggggcctgtgggcggaaagagggcagcctgcgcaggaggctggtcctag

SEQ ID NO: 240317 - DNA, 2976 bp, Artificial Sequence
  Description of Artificial Sequence: Synthetic coding sequence
atgaagaacctgcttacagaaaaatgcatcagttcccacaatttccatcagaaggtcatcaaacaacggatggagaagaaagtcgactccagatacttcaaggacggggcagtaaaaaaaccttactccgcaaaaacattgtcgaacaaaaagagctcagcgtcgttcggaattcggcgagagctgccctccacctcccacttggtgcagtatagaggtactcatacctgcactcgccagggcagacttagggaactccgcattcgcttttactatgaacaaaggcttctgcgaaaggtctttgaggaatggaaggaagaatggtgggttttccagcacgaatggaagctgtgcgtgcgcgctgattgtcattacagatattacctctacaatctgatgtttcaaacgtggaaaacatatgtccgccaacagcaagaaatgagaaacaagtatataagagccgaggtacacgatgcaaagcagaaaatgcggcaggcctggaagagttggctcatttatgtcgtagttaggcggacaaagctgcagatgcaaactactgccctggaattcagacagcggattattttacgggtatggtggtcgacctggaggcaaagacttggacaagttcgcgtttcaagagctttgcacgcgagtgccctgaaacaccgtgcgctgagcttgcaggtgcaggcttggtcccagtggagggaacagctattgtatgtacagaaggaaaaacagaaagtggtgtctgccgtcaaacaccatcagcattggcagaagcgcagattcttgaaagcatggcttgaatatctccaagtgcgccgtgttaaacgtcagcagaacgaaatggccgagcgatttcaccatgttaccgtcctccaaatctacttctgcgattggcagcaggcctgggagcgaagagagtccctgtacgcacatcatgcccaggttgagaaactggctcgcaaaatggctctgaggcgcgcatttacccactggaagcattacatgttactgtgcgctgaagaggctgcccagtttgagatggcagaggaacaccatagacattctcagctctacttctgcttcagagccctaaaagacaacgtaacacacgcccacctgcagcagattcgcagaaacttggcacaccagcagcacggggtgaccttgcttcatcgcttttggaacctgtggcggtctcagatcgagcagaaaaaggagcgtgagttgcttcccttgctccatgcagcatgggaccactatagaatcgctttgctgtgtaagtgtatagaattgtggctccagtacacacagaaacgcaggtacaaacagctgctgcaggcccgagcagacggacactttcagcagagagctttacccgctgcttttcatacttggaaccggctgtggagatggcgtcaccaggagaatgttctctctgctcgcgctactcgcttccacagggagactctagaaaaacaggtattctcgttatggcggcagaagatgttccaacatcgagagaataggctagcagagcgcatggccatcctgcatgcagagaggcaacttctgtaccgaagttggtttatgtggcatcaacaggctgctgcaaggcaccaggagcaagaatggcaaactgtcgcatgcgcccatcaccggcacggccgtcttaagaaggctttctgcttgtggagagaatctgcccagggtttgcggaccgagcgcaccggcagggtccgagcagctgagtttcacatggcacagctgctaagatgggcctggtcccagtggcgtgagtgtctcgctctgagaggcgctgaacgtcagaaattgatgagagctgatctccaccatcagcacagcgttctccatcgggctctccaggcatgggtcacctaccagggtcgcgtgcgcagtattctgcgagaagtagcagcacgtgaaagccagcagctccaagcccagcagcaagtgcaggccgcacacagcctccatcgtgccgtgcggaggtgtgcgacactttggaaacagaaggtgctaggtaggggcggtaaaccccaaccgctggcagcgatcgcacccagccgaaaggtaacgttcgagggtccactgcttaatcgcatcgccgcaggcgctggcgacgggaccctggagactaaacgcccacaggccagtcgtccactgggcgcactgggacgcctagcagccgaggagcctcacgcgttggagctgaacacagcacattccgctagaaagcagcctaggcgaccccacttcttgcttgaacctgctcagtctcaacgccctcagaaaccacaggagcatggcctgggtatggctcagccagccgcaccatctctgaccagaccctttcttgccgaggcccctactgccttagtgccacacagtccccttcccggagctcttagctccgctcctggccctaagcagcctcccacagctagcaccggtcctgagctcctgctgctaccactgtccagttttatgccatgtggtgcggctgcacccgcacgggtgagcgctcagcgcgcaacaccacgggataagccgcctgttcctagttcgctcgcaagcgtgcccgaccctcacttgctcttgcccggtgatttcagtgcaaccagagccggaccaggactgtcaacggccggaagtctcgatctagaggcggagctggaagagattcagcagcagttacttcactaccagactacgaagcagaacctatggtcttgcaggcggcaggcttctagcctgcgcagatggctcgagcttaatagggaagagcccggtcctgaggatcaggaagtggagcagcaggtgcagaaagagttagagcaggtcgaaatgcagattcagttgttagctgaggagctacaggcacaacggcagcccatcggggcttgtgttgcgagaatccaggccctgagacaggccctctgctag

SEQ ID NO: 240318 - DNA, 3636 bp, Artificial Sequence
  Description of Artificial Sequence: Synthetic coding sequence
atgaagaatttgctgactgaaaaatgcatcagttcccataattttcaccagaaggtcatcaagcagagaatggaaaaaaaggtcgatagccgatacttcaaagatggtgccgtcaaaaagccatattcagctaagaccttgtccaataagaaaagttctgccagcttcggaatccggagagagttgcctagcacgtcccatctcgtgcagtatagaggcactcacacttgcacgaggcagggtcgactccgagagctgaggattcgctgcgtagcccgaaaattcctctatttatggatccggatgacctttggacgagtatttccgtcaaaggcacggttctattatgaacagcgcctacttagaaaggtcttcgaggagtggaaggaagaatggtgggtttttcagcatgaatggaagctttgcgttagagccgattgccactaccgctactacctctataatttgatgttccagacctggaaaacctacgtgagacagcagcaggagatgaggaacaagtatatacgggctgaagttcatgatgcaaagcagaaaatgaggcaagcctggaagagttggcttatctacgtggtggtcagaaggacaaagctacagatgcagacaacagctctggaattccgacaacgtatcattctcagggtttggtggtctacgtggcgtcagcgcctgggtcaggtacgagtgtcaagggcgctgcacgctagcgctcttaaacacagagctctctctctccaggtccaggcatggtcccagtggcgagagcaactcttgtatgtacaaaaggaaaagcagaaagtagtgtccgccgttaagcaccaccagcattggcaaaaaaggcgcttcctgaaagcctggttagaatacctccaggtgcgccgtgtgaaacgtcagcagaacgaaatggctgaacggtttcatcacgtaaccgttctacagatctatttctgcgattggcagcaggcctgggaaagacgcgaatccctgtacgcccaccatgcccaggtagaaaagttggcccgtaagatggccttgcggcgagcgttcacacattggaaacactacatgctgctgtgcgccgaggaagccgctcagtttgagatggccgaagaacaccatagacattcccagcttcttctccacaggttctggaacctttggaggtcccaaatagaacaaaagaaagagcgggaactgctccctttactgcacgcagcgtgggatcactatcgaatcgcactattgtgtaagtgtatagagctctggctgcagtacactcagaaaaggcgctacaagcagttactgcaggctcgggcagacggccattttcaacagcgtgccttgccagctgctttccacacatggaacaggctgtggcgatggcgccatcaagagaacgtgttatctgcgcgtgctactagatttcatcgggagacgctcgagaagcaggtattctccctgtggcggcagaagatgttccaacaccgggaaaatcgcctcgccgagcggatggccattcttcatgccgaaaggcagctgctgtatcggtcatggtttatgtggcaccaacaggctgcagcacggcatcaggagcaggagtggcagaccgtcgcttgcgcacaccaccgacatggccgactgaaaaaggccttctgcttgtggagagaatctgcccaaggcttaaggaccgaaagaacgggcagagtgcgggcagcagagttccacatggcccagttactcaggtgggcttggtcccagtggcgcgagtgtttggctctaagaggcgctgaaaggcagaagctcatgagggccgatctgcatcatcagcacagcgtgctacatcgggctcttcaggcctgggtgacctaccagggaagggttagatctattctccgggaagtcgctgcccgtgagtcccaacataacagacaactcctccgcggagcactccgaagatggaaggaaaacacaatggccagagttgatgaggctaagaaaaccttccaggcctctacccactaccggcgaactatctgctcaaaggttctggtgcagtggcgtgaggccgtctctgtccagatgtattacagacaacaggaagattgcgcaatctgggaggcgcagaaggtgctcgacaggggatgtttgagaacatggtttcaacggtggtgggactgtagcagacggtccgcacagcagcgactgcagttagagagagctgtgcagcaccaccacagacaacttctcctggagggccttgccagatggaagacacaccacctgcagtgcgtccggaagagactgctgcacagacagtctacgcagctgctcgcgcaacggctgagtcgaacatgtttcagacagtggagacagcagctggccgcaagacgacaggagcaacgggcaaccgtgcgtgccctttggttttgggctttctctctgcaggctaaagtatgggccacatggctcgcctttgtactggagcggaggcgcaagaaagccaggcttcaatgggctctccaggcctatcaaggacagctgctgcaggagggggctacaagactcctgcgattcgcagccagcatgaaagcctccagacagcagctgcaggcccagcagcaggtccaggccgctcatagcctgcatagggccgtgcgcagatgcgccaccctgtggaagcagaaggtcttgggccgtggtggcaagccgcagcccttggcagctattgcaccttctaggaaagtgacttttgaaggccctctcttaaatcgcattgccgctggggctggcgatggcactctcgaaactaagagaccgcaagcaagccggccacttggggctttaggcaggttagctgcagaggagccacacgcacttgagcttaataccgcacattctgccaggaagcagccacgcaggccccatttcctgctggaaccagcacagtcccagcggccacagaaaccccaggaacacggtttgggcatggcccaacccgcagcaccaagcctgactcgcccttttctcgccgaagcccctactgcacttgtgccccactctcccctccccggagctttgtcaagtgcaccaggccctaagcaaccaccaaccgcctcaactggccctgagctgctgctgctgccgctatcctccttcatgccttgtggggctgcagctccagccagagtgtctgcccaacgtgccactccaagggataagcctcctgtgcccagtagcctggcctccgtgcctgatccacacctactgctcccaggagatttctctgctaccagagccggtcccggactatcgacagctgggagcctggacctggaggctgagctcgaggaaatccagcagcagcttttgcactaccagacgactaaacagaacctgtggtcctgccgccgtcaagcgtcctctctgcgcagatggctggagctgaatcgcgaggagcctggacctgaagatcaggaggtagagcagcaggtgcagaaggaactggagcaggttgaaatgcagattcagctgctagcagaagagctgcaagctcagaggcagcctattggtgcgtgcgtcgcaaggatccaagctttgagacaagccctgtgctag

SEQ ID NO: 240319 - DNA, 3483 bp, Artificial Sequence
  Description of Artificial Sequence: Synthetic coding sequence
atgaaaaacttgctaactgaaaaatgtatcagtagccataatttccaccagaaagtcattaagcaaaggatggagaagaaagtggactcccgattttactatgaacagagactgttgcgaaaagtattcgaggagtggaaggaggagtggtgggtcttccagcacgagtggaagctttgcgtccgagcggactgccactatcgttactatctctataatctgatgtttcagacctggaaaacctatgtgcggcaacagcaagagatgcggaacaagtacattcgcgcagaagtgcatgacgctaagcagaagatgcgacaagcttggaagtcatggctgatttacgtcgtggtcaggaggaccaaattgcagatgcagaccacagcgctggagtttaggcagcgtatcatacttcgcgtctggtggtctacatggagacagcgtctgggacaggtgcgggtgagtagggccctacacgcctccgcactgaaacatagagccctgtctctccaggtccaggcatggagtcaatggagagaacagctgctgtacgttcagaaggagaaacagaaggtggtgtccgcggtcaagcaccatcagcactggcagaagagaagatttttgaaagcttggcttgagtacctgcaggtgaggagggtgaagaggcagcagaatgaaatggcagaacgtttccatcacgtcaccgtgctccagatctacttttgcgactggcagcaggcctgggaacgacgggaatctctctacgctcaccatgcacaggtggagaagctggccagaaagatggccctccgacgagctttcacgcactggaaacactatatgctgctgtgcgcggaggaagcggcacagttcgagatggccgaggaacaccacaggcactcccaactctatttttgttttcgggcattgaaagacaatgtcacgcacgcacatctgcagcagattaggcggaatctggctcaccaacaacacggggtgacactgctccatcgcttctggaacctttggcgcagtcaaatcgagcaaaagaaggagcgggagctcctgcctctccttcacgctgcctgggatcattaccgcatcgctctgctgtgtaaatgtatcgagctctggcttcaatatactcaaaagcgaaggtacaaacaactcctgcaggcacgcgcagacgggcactttcagcagagggcactgccagccgctttccacacctggaaccgcctgtggagatggagacatcaggaaaacgtcctgagcgccagggctacgagattccatcgcgagacgctggagaaacaagtgttttccttgtggaggcagaaaatgtttcagcatcgcgaaaacagactcgcggagcggatggccatcctccatgcagaaaggcaactgctgtatcgcagttggttcatgtggcaccaacaggctgctgccaggcaccaggaacaggaatggcagactgtggcttgtgctcaccacagacacggacggctcaaaaaggccttctgtctttggagagagtccgcacagggcttgaggacagagagaaccggcagggtgagagctgccgagttccacatggctcaactacttcggtgggcgtggagccagtggcgtgagtgtctggctctgcgcggagccgaaaggcaaaagcttatgcgtgctgaccttcatcaccagcactcggtattacacagggccctccaagcttgggttacctatcaggggagggttcggtctatcttgagggaggtcgcggctagggaaagccaacacaaccgtcagctcctgcgaggggctcttcgaagatggaaggaaaataccatggcccgagtagatgaggctaaaaaaaccttccaggccagcactcactataggcgaacaatatgcagcaaggtgctagtgcagtggagggaggcggtgagtgttcagatgtactacaggcagcaggaagactgtgccatctgggaggcccagaaagttctggaccggggatgcttgcgcacctggttccagaggtggtgggattgtagtcgtcgtagcgcccaacagaggctgcagctggaaagggccgttcagcaccatcatagacagcttctactggagggcttggctcgctggaagacacaccacttacagtgcgtgcgcaagagactgttgcacaggcagtcgacccagctgttggctcagagactgtccaggacttgctttcgccagtggcgccagcagctagccgcacggaggcaggagcagagggctacagtgcgggcactttggttctgggccttctcactgcaggcgaaggtgtgggccacgtggctcgcctttgtgctggaacgcaggcgaaagaaggcacgccttcaatgggcattgcaggcctaccagggacagctactgcaggaaggagctacaagactgctacgcttcgccgcatccatgaaggctagtcgtcagcagctgcaggcccaacaacaggttcaggcggctcacagcttgcacagggccgtccgccgatgtgctaccctctggaaacagaaggtgctcggccgaggtgggaagccacagcccctggccgcaattgctccaagccgcaaggtgacattcgagggacctttattaaatagaatcgctgctggggctggcgacggcactttggagacaaagagaccacaagcctcccgacccctgggcgctctaggaagacttgctgctgaagagcctcacgccctcgaactgaacactgcccacagtgcacgcaaacagccgagacgccctcatttcctcctcgagccagcccagagccagcgtcctcagaagcctcaggagcatggactcgggatggcacaaccagcggctccatctcttaccaggcccttcctcgccgaagcccctacagcgttggtgccccactctccgttgccaggcgctctgtccagcgcacctggcccaaaacagcctcccacagcttcaaccggcccagaactgcttctgcttccgctttccagttttatgccttgtggagctgctgccccagcacgtgtgtcggcccagcgggctaccccacgggataagcctcccgtgccatcctcactggcgtctgtgcccgatccgcacctcctgcttcccggagacttctccgccaccagggctgggcctggactctccacagctggtagcctggacctagaggcagaattggaagagatacagcagcaactgctgcattaccagacaactaaacagaacctgtggtcctgcagacggcaggcctcgagcctccggagatggctggaactcaacagagaggagccgggacccgaggaccaggaagtcgaacaacaggttcagaaggagcttgagcaggtcgagatgcaaatccagctcctcgccgaagagcttcaagcacagaggcaaccaatcggtgcctgtgtggcgagaatacaggccctcaggcaggcgctgtgttag

SEQ ID NO: 240320 - DNA, 240 bp, Artificial Sequence
  Description of Artificial Sequence: Synthetic coding sequence
atgaaaaacttgctgactgaaaaatgtataagctcccacaatttccatcagaaggtcattaagcaacggatggaaaagaaagtggattctcggtactttaaagacggcgctgtcaaaaagccatactccgcaaagacactatccaataaaaaaagcagtgccagctttggtattcgcagggagctgccttccacgtcccacctcgtgcagtatcggggaacacatacctgtacgcgttag

SEQ ID NO: 240321 - DNA, 3564 bp, Artificial Sequence
  Description of Artificial Sequence: Synthetic coding sequence
atgaagaacctactaacggaaaagtgcattagctctcataacttccaccagaaagttattaagcagagaatggaaaaaaaggtggatagtagatatttcaaagacggcgcagtcaaaaagccctatagcgccaagacactgtccaataaaaaaagctccgcctcgtttggcatcagacgggagctgccgtcaactagtcacttggtgcagtacaggggaacccatacatgtactcgccaggggaggttgagagagttgaggatcagattttactacgagcagaggctgctgcgcaaggttttcgaagagtggaaggaagaatggtgggtgttccagcacgagtggaaactttgtgtgcgggctgactgccattatagatattatctatacaatcttatgttccagacatggaaaacgtatgtgcgccagcagcaggagatgaggaacaagtatatcagggccgaggtccacgatgccaagcaaaaaatgcggcaggcgtggaagagttggcttatttacgtcgtggtaagacggacgaaactgcagatgcagaccaccgccctcgaattcagacagaggatcatccttcgtgtatggtggtccacatggcggcagaggcttggccaggtgcgggtctcgagagccctacacgcctccgcgcttaaacaccgcgctctctcactgcaggtccaggcctggagccagtggcgagaacaactactgtatgtccaaaaagagaaacaaaaggtagtgtctgccgtgaagcaccaccagcattggcagaaaaggcgtttcctgaaggcttggctcgagtacctccaggtgcggagagtgaaacgccagcagaacgagatggccgagaggtttcatcatgttaccgtcctgcagatctacttctgcgactggcagcaggcctgggaaagaagagaatcgttgtatgcccatcatgctcaggtggagaagcttgccaggaaaatggccttaagaagagcattcacccactggaagcactatatgctgttatgcgctgaagaggcagcccaatttgagatggccgaagagcatcacaggcatagtcaactcctacttcatagattttggaatctgtggcggtctcagattgaacagaaaaaggagagggagcttttgcccctccttcatgcagcatgggatcactatcgaattgctcttttatgtaaatgtatcgaactgtggctgcaatatacccagaaacggagatataaacagctgctgcaagcccgtgccgatggtcacttccagcagcgtgctcttccagcagctttccacacctggaatagattgtggcgatggcggcatcaagagaacgtgcttagcgctcgggctaccaggtttcaccgagagacacttgagaaacaggtgttttccttatggaggcagaagatgtttcagcacagggagaaccggctggcggagcgcatggccatcctccacgcagagagacaattgctgtacaggtcttggttcatgtggcaccaacaggcagcagccagacatcaggagcaagagtggcagacagtcgcctgtgctcaccacagacatggacggttaaagaaagctttctgcctgtggagggagtctgcacaaggcctaaggaccgagcggactggtagagtaagggcggcagaatttcacatggctcaactgctgcgctgggcttggtcccagtggcgcgagtgccttgctctgcgaggcgctgaaagacagaaactaatgcgagccgacctgcatcaccagcattccgtgctgcatagagcccttcaagcctgggtcacttaccagggaagagtccgctctattttgcgggaggtggctgctcgagagtctcagcacaatagacagctgttgcgtggcgctcttagaagatggaaggagaataccatggctagggtggacgaagcgaagaagactttccaggcttcaacccactatcggagaacgatctgctcaaaagtgctggtgcagtggcgggaggccgtgtctgtccagatgtattataggcagcaggaagactgcgcaatatgggaagcccaaaaggtgcttgataggggatgcctgcgaacatggttccagcgctggtgggactgctcacgccgatcagcccagcaacggctccagctcgagcgtgcagttcagcatcaccacagacagttgctactagagggccttgccagatggaagactcatcacctgcagtgtgtgcggaaacgtctcctgcaccgacagagtactcaactcctggcccagcggcttagccggacatgttttcgacaatggcggcagcagctcgccgcacgacgccaggagcagagagctacagtgcgggctctgtggttttgggccttttcccttcaggccaaagtgtgggctacctggttggccttcgtgcttgagaggaggcgaaagaaggctcgacttcagtgggcgctacaagcttaccagggacagctcctgcaagaaggcgctactaggctgttgcggttcgccgctagcatgaaggcaagccgacaacagttgcaggctcagcagcaggtccaagcagcccactcccttcatagggcagtaagacggtgcgccacactttggaagcaaaaagttttggggaggggcggtaagccgcaaccactggcagccatcgcccctagccgcaaagtcacctttgaagggccactgctaaatagaatcgctgctggcgctggcgacggcacacttgagaccaaacgcccacaggccagcagaccattaggagcgttggggagactagcggctgaggagcctcacgcccttgagctgaacacagcccattcagccagaaagcagccgagaaggccccacttccttctggaacctgctcaatcacagcgcccacaaaagccccaagagcacggcctaggcatggcccagcctgccgcaccgtcccttacccgaccattcctggcggaggctcctactgccctggtcccgcatagtcctctgccgggtgcactttcatcagcccctgggcctaagcagcctcctacggcttccaccgggccagaactgttgttgctgcctctttcatcctttatgccttgcggcgcagcagcccctgccagggtgtccgctcagcgcgctaccccaagagacaaaccccctgtgcccagctctctggcctctgttcccgacccacatctgcttttacctggagattttagtgcaacaagagctggcccaggtctgtctaccgccggttccttagatcttgaggccgagctggaggagattcagcaacagcttctccactaccagacaaccaagcagaatctctggagctgtcgcaggcaggctagcagcctccgccgttggctggagttaaatcgggaggagccagggcctgaggaccaggaggtcgaacagcaggtgcaaaaagagctcgagcaggtcgagatgcagattcagctgttggccgaggagttgcaagctcagaggcaacctatcggggcatgtgtcgcaagaattcaggcactgagacaggccctttgttag

SEQ ID NO: 240322 - DNA, 378 bp, Artificial Sequence
  Description of Artificial Sequence: Synthetic coding sequence
atggatgccgtggcggtgtatcatggcaagataagtcgcgagaccggagagaaactattgctggccacagggcttgacggctcctacctcttgagggatagcgagtcagtcccaggggtgtactgcctgtgcgtgctgtatcatgggtacatttatacataccgagtgtcacagactgagacaggatcctggtccgcagagaccgcacctggggtacacaagcggtacttcagaaaaattaaaaacctgatttcggcattccagaaacccgaccagggcatcgtgatccccctacagtaccctgtcgagaaaaagtccagcgcacgttccacacagggaattagagaagacccagacgtctgtctgaaggctccctag

SEQ ID NO: 240323 - DNA, 387 bp, Artificial Sequence
  Description of Artificial Sequence: Synthetic coding sequence
atggacgccgtcgcagtctaccacggaaaaataagcagagaaactggggaaaaactactactagcaaccggacttgacggctcttatctgctcagagattccgaaagcgtgcctggtgtgtattgcctttgcgtgctgtaccatggctacatttatacctacagggtctcacagactgaaacgggttcctggtcagccgaaacggctcccggagtgcacaagcggtacttccgcaaaatcaagaacctgatcagcgcgttccagaagccagaccaaggtatcgtcatccccctgcagtatcccgtggaaaagaaaagctctgccaggtcgactcagggcactaccggtattcgcgaagaccctgatgtgtgcctcaaagcgccatag

SEQ ID NO: 240324 - DNA, 177 bp, Artificial Sequence
  Description of Artificial Sequence: Synthetic coding sequence
atggacgctgtggctgtgtaccacgggaaaataagtcgggaaacaggggagaagctcctactggccactggtctcgatgggagttatctgttgcgggattcggagtccgtccccggtgtttactgcctttgtgtcctccatcactgggggtacatcaagtttattaacaagctatag

SEQ ID NO: 240325 - DNA, 234 bp, Artificial Sequence
  Description of Artificial Sequence: Synthetic coding sequence
atggatcttccatattaccatgggagactcactaagcaggactgcgagacgctgcttctgaaggaaggtgtggacgggaactttctgctacgcgacagtgaatcaatacctggggttctgtgcctgtgtgtgtcattcaaaaatatcgtatacacttacagaatctttcgcgagaagcacggatactatcgtatacagaatagcaattccgactatgtggacgtgcttccttag

SEQ ID NO: 240326 - DNA, 399 bp, Artificial Sequence
  Description of Artificial Sequence: Synthetic coding sequence
atggacctcccatactaccacggcaggctgacaaaacaggattgcgagaccttgctcttgaaagaaggcgtcgatggcaattttctcctgcgcgactccgagtcaatccctggcgtgctgtgcctatgcgtgagctttaaaaatatcgtgtacacttacagaatttttagagagaagcacgggtattatagaatccagaccgcagaaggctcgcccaagcaagtctttccaagtcttaaggagctcatatccaagtttgaaaagcctaaccaaggaatggtcgttcatttgctgaaacctatcaagcgcacctccccgtcactgcgttggcgagggctgaagctcgagctggagacattcgtgaatagcaattccgattacgtcgacgttctgccctag

SEQ ID NO: 240327 - DNA, 2271 bp, Artificial Sequence
  Description of Artificial Sequence: Synthetic coding sequence
atgaatggagctccttcgcccgaggatggagcctcaccctcctctcctcccctcccgccaccacccccaccctcctggagggagttctgcgagtcccatgctagggctgcagccctggatttcgcacgtcgcttcagactgtatttggctagccatccacagtacgctgggcctggtgcagaagctgcttttagtcggagatttgccgaattgtttctgcagcatttcgaagctgaggtagccagggcttctggaagtctgagtccaccaatccttgcccctctgagccctggtgcagagatcagcccgcatgatttatctctggagagctgtcgggttgggggacccctcgcggttctgggcccttcccgcagttctgaagacctcgccggacctttaccctcgagcgtgtcttcatcctctacaactagctccaagccaaagctgaaaaaaaggtttagtttaagatcagtggggaggagtgtccgcggatctgtgaggggaatattgcaatggcggggaaccgtggatcctccttcctcagcaggcccattagagacctcctcagggcctccagtcctggggggaaattctaacagcaatagctcaggcggtgctggcacagttggccgaggactagtgtccgatgggacgagtcccggagagcgttggacacacagattcgagcgtttgagactcagcaggggcggaggggcactaaaagacggcgctgggatggtgcagagagaagaactgctcagcttcatgggcgcagaagaagcggcaccggaccccgcaggagttggcagaggcggaggagtggccggtccacctagcggtggtggagggcagccacagtggcagaagtgccgtctgctgttgcggagtgagggggaggggggaggcggttccaggctagagtttttcgtgccacccaaggcctcgcgacctcgcctctccataccctgctcttcgatcactgatgtccgaactaccaccgccctggaaatgccggatagagagaacaccttcgtcgtaaaggtcgaaggaccatctgagtacattatggagacagtggatgctcaacatgtaaaggcctgggtgagtgatatacaggagtgtctttccccgggaccttgtcctgccacgtctcctaggccaatgactctgcccctcgccccagggacaagctttctgaccagggaaaatactgactccctggagttaagctgcctgaatcattcagaatcactgcctagccaggacctgctcctgggaccatccgagtcaaacgatagactgagccagggcgcttacggtggcctgagcgatagaccctctgcctctatatctccctccagtgcctctatagccgctagccatttcgacagtatggaattactgcctccagaattaccacctaggatcccaatagaagaagggcctcctaccggcacagtccatccgctgagtgctccgtatccgcctctcgacactcctgaaacggctactggttcatttctatttcagggcgagcccgagggtggcgaaggggaccagcctttatctggatatccctggttccacgggatgctaagccgcctaaaggctgcgcagttggtgctcactggcggaactggaagtcacggtgtgtttttagtgcgccaaagtgaaacccgccgaggcgagtacgttctgacgtttaactttcagggtaaggccaaacacctgaggctgtccttaaatgaggagggacagtgcagggttcagcatctctggtttcaatccatcttcgacatgcttgagcacttcagggtgcatcccatccccctagagtctgggggttcatctgacgtagttctggtgtcctatgttccaagttcacaacgtcaacaggagcctacaaccagtcacgacccgccacagcctccagaacccccatcttggactgaccccccacagcctggcgctgaggaggcatcgagagccccagaggtcgcagccgcagccgcagcggcagcaaaagaaaggcaggaaaaagagaaagccggtggaggtggagtgcctgaagagttggttcctgtagttgagcttgtgcccgtcgtggaactcgaggaggcaattgccccaggatccgaagctcagggggcagggtcaggaggcgatgctggagtgcctccaatggtgcaactccagcaatcgcctctcggaggagacggcgaagaaggaggtcaccctcgggcaattaacaatcagtactccttcgtttag

SEQ ID NO: 240328 - DNA, 2016 bp, Artificial Sequence
  Description of Artificial Sequence: Synthetic coding sequence
atgaacggcgcaccatctcccgaagacggtgcttcgccttcatcacctccgctcccgccaccaccacccccaagctggagggagttttgcgaatctcacgccagagcagccgctcttgattttgccagaagatttcggttgtacctcgcaagtcacccccaatacgctgggcctggtgccgaagcagcattctcaaggcgatttgcagagctgtttctgcagcattttgaggcagaggtcgcccgagcttcagggagcctgtcccccccaattcttgccccactgtctccgggtgcagagatcagtccccacgatctctcacttgagtcgtgccgggtaggcggacccctcgccgttctgggcccatcgagaagcagtgaggacctggccggtccgcttcccagcagcgtttcctcttcttcaacaacttcgagcaagcccaaactgaaaaagcgtttttccctccgctccgtaggaaggagtgtaagagggagtgtgcgaggtattctgcagtggcgaggcacggtggatccaccgtcatccgcaggaccactggagacatcgagtggcccaccggtgctggggggaaactcaaattctaacagctccggtggggctggaactgtggggagaggacttgtgtccgatggaacctcccccggtgagcgatggacccatcgcttcgaacgattgagattaagcaggggcggaggagcgctcaaggacggggcaggcatggttcaaagggaagagctgctatcttttatgggggcagaggaagccgctcccgatccagcaggggttggccgaggcggaggagtggctggcccaccaagcggtgggggaggtcagccacagtggcagaaatgtcgcctacttctcagaagcgagggtgaggggggtggcggttccagactcgagttctttgtgccgccaaaggctagcaggccacgcctctcgataccctgctcaagcataaccgatgtgcgtactacaacagccctagagatgccagatcgggagaatacgttcgttgtaaaggtggaaggccctagtgagtatattatggagactgtggatgctcagcacgtgaaggcttgggtgtcagacatccaggaatgcctctcacccggaccttgcccagccacttccccgagacctatgacgttgcctctggcacctgggacgtctttcctgacgcgggagaacaccgattccctcgagctcagctgtctgaaccacagtgaatctttacccagccaggatctcctgttaggacctagtgagtccaatgacagactgtctcagggagcatatgggggactttcggacaggcccagtgctagcatatcaccctccagcgcctcaatcgcagcctcacacttcgattctatggagctacttcctccagagctgcccccacgaatacctattgaggaaggaccccctactggcacagtgcatcccctctccgccccttatccccctctcgatacgcccgaaacagctacaggatccttcctgtttcaaggagagcccgagggtggagagggcgatcagccactgagcggttatccctggttccacggcatgctgtctcgactgaaagccgcacagttagtgcttaccgggggtacaggctctcacggggtctttctcgtgagacagagtgagactaggaggggggagtacgttctgacctttaacttccagggtaaagccaaacacctgcgcttgagcctgaatgaagaagggcagtgcagggtgcagcatctttggtttcaatctatattcgacatgttagagcatttccgcgttcatccaattccactggaatctggagggagctctgatgtcgttctggtctcttatgtgccctctagccagcgccagcaggggagagagcaggcaggctcacacgccggagtttgcgaaggagatggatgtcacccagatgcctcttgcacactgatgcccttcggagcctccgactgcgttacggatcatttaccctag

SEQ ID NO: 240329 - DNA, 2052 bp, Artificial Sequence
  Description of Artificial Sequence: Synthetic coding sequence
atgaacggagccccatcgcccgaagatggcgcatcacccagttctcctcctctgccaccaccccctcctcctagctggagggaattttgcgagtctcatgccagggccgctgcccttgattttgcaaggcgatttcggctgtacctcgcctctcatccccagtatgctggccctggggcagaggctgccttttcccgacgattcgccgagctatttctccagcatttcgaagccgaggttgcacgtgcgtcgggctctcttagcccccctatcctggcgccactctctcctggagcggagatcagtcctcacgatctctcccttgaaagttgccgggtaggcggacccctggctgtgctcggacctagcagatcatccgaggatttagcagggcctcttccctctagcgtctcatcttcctctaccacctctagcaaaccaaagctgaaaaaacggttttctttgcggtccgtgggacgcagtgtcaggggttctgttcggggtatcctgcagtggcggggaaccgtcgatccgccaagcagcgcaggcccactggaaaccagcagcggtcctccagtactgggcggtaatagtaattctaactcgagcgggggagcaggtactgttggtcgtgggttagtcagtgatggcactagccctggagagaggtggactcacagattcgaacgactacggctgtcaagaggaggaggcgcactgaaagatggggcagggatggtccaaagggaggagttgctgtcttttatgggcgctgaagaagcagctcccgaccctgctggggtaggacggggtggaggagttgctggaccgccttccggcggaggaggtcagccccaatggcaaaagtgtcggctgcttctacgctccgagggcgagggcggtggtgggtccaggttggagtttttcgtgcctccaaaggcgtctcggccacgattgtcaattccttgctcatctatcactgacgtgcggacaacgacagccctcgagatgccagaccgagaaaacacctttgtggttaaggtcgagggtccgagtgagtatataatggagactgtcgatgcacagcacgtgaaggcctgggtgtctgatatacaagagtgtctgtcccccggtccatgccccgctacgtctcctaggcccatgacgttgcccctggcaccagggacttcattcttgacccgcgagaacactgactccctggagctcagctgcctgaaccacagtgaatcactcccatcgcaggacctcctgctaggccctagtgaatctaatgaccggctgtctcaaggggcttatgggggactctcagaccggccatccgcctccatctctcccagctctgcctccatcgcagctagtcatttcgattcgatggagctcctccctcccgaactccctcccaggatccccattgaggaaggcccacctactggcacggttcacccgctctctgcaccgtatccccctctggatacacctgagaccgcgacaggctccttcctgtttcagggcgagcccgagggcggagaaggcgaccagccgctgagtggatacccctggttccacggaatgctgagcagacttaaagccgctcagctggtgctgaccgggggaaccggctctcacggagtgttcctcgtacggcagtccgagacacggcgtggagaatacgtcttaacctttaacttccagggcaaagcaaaacatctccggctgtccttgaacgaggaaggacagtgcagggtccagcatctttggtttcagtctatctttgacatgctggaacacttcagggttcacccaatccccttagaaagcgggggttcgtcagatgtggttctggtgagctatgtgccatcctcccagcggcaacagggtgaacagagcagatctgcgggagaggaagtaccagtgcatcccagatctgaggccggttcccgcctaggcgctatgagaggctgtgcgagggaaatggacgctacacccatgccccctgcgccttcatgtccatcggaaagagtgaccgtgtag

SEQ ID NO: 240330 - DNA, 2016 bp, Artificial Sequence
  Description of Artificial Sequence: Synthetic coding sequence
atgaacggcgcaccttctcctgaggatggcgcatctccgtcctctcctccactgccaccgcctccaccccctagttggagggaattctgcgaaagtcatgccagggccgctgccctggactttgcgaggcgattcagactctacttagcttcacatcctcagtatgccggtccaggcgcagaggccgcattcagtcggcgattcgctgaactattccttcagcatttcgaggcagaggtggcacgtgcgtccggatctttgagcccaccaattcttgcccctctttcccccggtgctgaaattagcccacacgatcttagcttagagtcatgccgggttggcggtcccttggctgtcctggggcctagcagaagcagcgaagatctggcgggtcctctgccctcctccgtgagttcatccagtactacatcttcaaagcccaaattgaagaaaagattctctttacgctcagtgggacgcagtgttcgcggatcggtgagaggcatcctgcagtggcggggaactgttgacccaccctccagtgccggtccactggaaacctcgtctggacccccagtcctagggggaaattccaattctaacagttcaggaggcgcaggcacagtcggacgagggctagtttcagacggcacatcccccggagaaaggtggactcatcggttcgagcgcctccgccttagtaggggaggaggtgctctgaaagacggggcaggtatggttcaaagagaggaactgctcagcttcatgggggcagaggaagctgcaccagatccagccggtgttgggagaggcggtggcgtcgccggtcccccatccggcggtgggggacagccacagtggcagaaatgcaggttgcttctgagatctgagggcgaagggggtggcggaagcaggctggaatttttcgtgccgcctaaagcatctagaccccgactgtccatcccatgcagcagcatcacagatgtacggacaactacggctctggagatgcctgacagagagaacactttcgtggtgaaggtggagggaccttctgaatatataatggaaactgtggacgcccagcacgtcaaggcctgggtctcagatattcaagagtgcttgtctcccggtccgtgccctgccacttccccgaggcctatgacactgcccctggccccagggacaagcttcttaacgcgcgagaataccgacagtctagagctgagctgccttaaccactctgagagcctgccctctcaggacctcctattgggcccaagtgagagtaatgaccgattatctcagggcgcatacggtggcctgagcgaccgaccaagcgccagtattagtccttcaagtgctagcattgctgcttctcactttgatagtatggaactgctccctcctgagctaccaccacgcataccaattgaggagggccctcccactgggaccgtgcacccattatcggccccatatccacccctggataccccagagacagcaaccggcagtttcctgtttcagggtgagcctgaagggggagagggtgaccaacccctgtcaggctatccatggttccatggcatgctttcccgactaaaggcagcccagctggtgctgaccgggggaacaggaagccatggtgtgtttttagtaagacaatccgaaacgcgcagaggggagtatgttctgaccttcaacttccagggaaaggccaaacatcttagactgtctctcaatgaggagggccagtgccgcgtgcaacacctctggtttcagtccatatttgatatgctggagcacttcagggtgcatcctattccactggagagcggcggaagctcagatgttgttcttgtgtcatatgtgccaagttctcagaggcaacagggcagagagcaggcaggcagtcacgcaggcgtgtgtgaaggcgacggctgtcaccccgacgccagctgcacacttatgcctttcggggcaagcgattgcgtcaccgaccacctgccctag

SEQ ID NO: 240331 - DNA, 1008 bp, Artificial Sequence
  Description of Artificial Sequence: Synthetic coding sequence
atgcctgacagagaaaatacattcgtggtgaaggttgaaggacctagtgaatacatcatggagaccgttgacgctcagcatgtcaaggcatgggtctcagacattcaggagtgcctttccccgggaccctgtccagccaccagcccgcgtcctatgacgcttccattggctcccggaacaagtttccttaccagagaaaatacagattcactggaactgagctgcctcaaccattcagagtccctcccgtcgcaggacctcctattggggccaagcgagagtaacgatagattgtctcaaggtgcctatggcggtctgtccgatcggccttccgcttctatcagcccctcctcagcatccattgcagcttcacattttgactctatggagctgctgcctcctgagctgcctccaagaattcccatcgaagaaggcccaccgacgggcaccgtccaccccctgagtgctccatatccgcctcttgataccccagagaccgcaacaggttccttcctgttccagggggagccagagggtggggagggtgaccagccactgagcggttatccctggttccatggaatgctcagcaggctcaaggccgcacagctcgttcttacgggcggaacgggatcgcacggagtattcctggtgcgtcaaagcgagacacgtagaggagagtatgtgctaacctttaactttcaaggaaaagcaaaacatctacgattgtccctcaatgaggagggacagtgccgcgtgcagcacctgtggtttcaatccatcttcgatatgctggagcattttagggtgcatcctattcctctcgaaagcgggggttcttccgatgttgtgttggtatcttacgtgcctagcagtcagcgccagcagggtagggagcaggcaggctcccacgccggtgtctgcgagggagatgggtgtcaccccgatgcgtcctgcactctgatgcccttcggcgcaagcgactgcgtcactgatcatctcccctag

SEQ ID NO: 240332 - DNA, 1122 bp, Artificial Sequence
  Description of Artificial Sequence: Synthetic coding sequence
atggccgaggccagtcgtccacgcctgagcatcccttgcagctccattacagacgtgagaaccacaacagctcttgagatgccagaccgagagaatacctttgtcgtaaaggttgagggtccaagcgagtatatcatggagacagtcgatgcccagcatgtcaaagcctgggtgtccgatatccaggagtgtttgtctccaggtccgtgccccgcaacgtcaccaaggccaatgacacttcctctggcacccggaaccagcttcttgacccgggaaaatacggattctctggagctgtcatgcctcaaccatagcgagtcattgccctctcaggatctgcttctggggccttccgaaagcaatgatagactgagtcagggcgcatatgggggtctgagtgataggccttcagcctctatcagcccatcgagtgcctccatcgcagcgagccattttgacagcatggagctgctaccccctgagttgccacctcgcattcctatcgaggagggacctcctacgggtaccgtgcaccctctctccgctccatacccaccgctggacactcccgagacagccaccggttctttcttatttcagggcgagccagaagggggagagggcgaccagcccttgtctggctacccctggttccacggtatgctctctcgactcaaagcggcacagttggtgctgactggcggaacaggctcccacggggtgtttctcgttagacagtcagaaacccggagaggagaatatgtgctgacttttaacttccagggcaaggccaaacatctgcgcctttcactcaatgaagaaggacaatgtcgtgtgcagcacctgtggttccagtcgatttttgatatgttggaacactttcgcgtacaccccatacctttagaaagcggaggatccagtgatgtggtgctcgtaagctatgttccaagctcgcagcgccagcagggagagcagtcacgttctgccggtgaggaagttccagtccatccccgatctgaagctgggtctcgactaggcgctatgaggggctgtgccagagagatggacgctaccccaatgcctcctgctccatcctgtcctagtgagcgagtcacagtatag

SEQ ID NO: 240333 - DNA, 1728 bp, Artificial Sequence
  Description of Artificial Sequence: Synthetic coding sequence
atgaacggcccagcactccagcctagctccccttccagtgccccaagcgccagcccagctgccgctccacgcggttggtcagagttctgtgaactccatgccgtagcagctgcaagagagctcgccagacagtactggctcttcgcaagagaacatcctcagcatgctccgttgagagccgaactggtgagcctgcaatttacggacttattccagcgctatttttgccgggaggtgcgcgacggccgagctcccggacgtgactacagggatacaggtagaggaccaccagccaaggctgaggccagcccagaacctggtcctggcccagccgctcctggcctgcccaaagcgaggtcaagcgaggaactggcccctccaaggcctccaggcccatgctcctttcagcatttcaggaggtctctgcgtcatatctttcgtcgcagatcagccggagagctacccgcagctcacaccgccgctgccccaggcacccctggtgaagccgctgagactcccgcacggcctgggcttgctaagaagttcctgccctggtccctcgcgcgagaacctccacctgaagccttgaaggaagcagtcctaagatactctctcgccgacgaagcctctatggatagtggtgcaagatggcagagaggcaggttagctttgaggcgagccccaggtcccgacggtcctgaccgtgttctcgagctcttcgacccccctaagtcctctcggccaaagctacaggcggcttgttccagcattcaggaagttcggtggtgtacccggctcgagatgcctgacaacttatatacttttgtccttaaagtgaaagacagaactgatatcatctttgaggttggcgacgagcagcagctaaactcgtggatggctgagctgtccgagtgcactgggagaggactggagtctactgaagcggagatgcacatcccatcagcactcgagcctagtacgtcctcatcacccagaggctccaccgatagcctcaaccagggagcgtcacctggcggactgctggatccagcctgtcagaagactgaccacttcctctcttgttacccatggttccacggcccaataagtagggtcaaggccgctcaactagtccaactgcaggggcctgacgctcacggtgtgtttctggtgagacaaagcgagactagacggggagaatatgttctgacgtttaactttcagggcattgcaaaacacctgaggttgtcactcaccgagcgcggacagtgtagagtgcagcaccttcatttcccatcagtggtcgacatgcttcaccatttccaaaggtcccctatccccttggagtgcggtgcagcctgtgatgttaggctttcctcatacgtggtggtcgtgtctcaaccccctggctcctgtaatacagttttgtttcccttttctctgccacattgggattctgaaagtctgccccactggggaagcgaactcgggcttccccacctttcaagttcggggtgtccacgcggactctcgcctgaaggcctacccggtaggtcatcacccccagagcagatatttcacctggtgcccagtcccgaagaacttgctaacagcctccagcacctggagcatgaaccagtgaacagagcacgcgattccgattacgagatggattcatcttcacggtcgcacctgagagccattgataaccagtataccccactctag

SEQ ID NO: 240334 - DNA, 1122 bp, Artificial Sequence
  Description of Artificial Sequence: Synthetic coding sequence
atgggattccccgtgctatgcagggggtggagacgcacctggcctggatgcgcttcttggctgggcgctccacctccgcagaaacccttactgagtcccctgcttctcaaccaccggtcctcaaagtcatcaagacccaaattgcaggccgcatgctcgagcatacaggaagtgcgatggtgtactcgtcttgaaatgccggataacctctatacctttgtccttaaagtaaaggatcggacagatatcatcttcgaggtgggagatgagcaacagttgaatagttggatggcagaactgagcgaatgcaccggtaggggactggagagcaccgaagcagagatgcatattcccagcgccctggaaccttctacctcatccagccctcggggaagcaccgattccctcaatcagggggcttcccccggtggactgctcgaccctgcctgtcagaaaacggaccacttccttagctgttatccttggttccacggccctatatcacgcgtgaaggccgctcaactggtgcagctacagggccctgatgcccacggagtgtttctagttcgtcagtccgaaacccggagaggcgagtatgtactgacattcaacttccaggggatcgccaaacatttgagactttccctgactgaacggggacaatgtcgggtccagcatttgcactttccctcagtggtggatatgttgcaccatttccaaagatcccctattcccctggaatgcggggctgcctgcgacgtccgtctgtccagttatgttgttgtggtatcgcagcccccaggtagttgtaacacagtactgtttccatttagtcttccccattgggattctgagtctctcccccattggggctcagaactgggcctgccacatctgtcaagcagcggctgcccgagggggctgtccccggaagggctgcccggtcggagcagcccacccgagcagatctttcatctggttccctcaccagaggagcttgccaattcactacaacacctggagcacgagccggttaatcgcgcaagagattctgactacgaaatggacagttcaagcaggagccatcttagagctatagacaatcaatatacacccctgtag

SEQ ID NO: 240335 - DNA, 1209 bp, Artificial Sequence
  Description of Artificial Sequence: Synthetic coding sequence
atgataccacccagtagtcctagagaggatggagtcgacggcctgcccaaggaggcagtgggggcagaacagccgccaagccccgcttcaacaagctcccaggaaagtaagcttcagaagctgaagcggagcctatcgttcaaaaccaagagtctccgaagtaaaagtgccgacaacttttttcaacggaccaattccgaagatatgaaactccaagcgcacatggtggccgaaatttctccctcctctagtcccctaccagcccctggatcgcttacctccacacccgctagggctgggctgcaccctggtggaaaggcacacgcatttcaggagtatatcttcaaaaagcccacattctgtgacgtgtgcaatcatatgatcgtggggaccaatgccaagcacggactccggtgtaaagcatgtaaaatgtcaatacatcataagtgtacagatggtcttgccccacagcggtgcatgggaaagttacccaaaggattcagacggtactatagtagcccgttgctgatccatgagcaatttggctgtataaaggaggtcatgcccattgcctgcggtaacaaagttgaccctgtctacgagactttaagatttggaaccagtctggctcagaggaccaaaaaaggatcctctggttccggttcagactccccacacaggacatctaccagcgatctagttgaagtccccgaagaggccaatgggcctgggggagggtatgacttgcgtaaacgatcaaattcggtgttcacgtatcccgagaatggcacagacgacttccgggatcctgctaagaatatcaaccatcagggcagtctgtcaaaggaccccctgcagatgaacacctatgtggcactgtacaaattcgtgccccaggaaaatgaagacctggaaatgagaccaggggatattatcaccttgctggaggacagtaacgaagattggtggaaggggaaaatccaagacaggattgggtttttcccagctaattttgtccaaagacttcaacagaatgagaaaatttttcgttgcgtcagaacattcatcggctgtaaagaacaaggccagataacactgaaggaaaatcagatctgcgtgtccagcgaggaagagcaggacggtttcatccgagttctgtcaggaaagaaaaagggcctaatccctctggatgtcttagagaacatttag

SEQ ID NO: 240336 - DNA, 1005 bp, Artificial Sequence
  Description of Artificial Sequence: Synthetic coding sequence
atgaaacttcaggcgcatatggttgctgagattagccctagtagtagcccgctccctgcccctggatccctgacgagcactccagctagggctggtctgcaccctgggggaaaagcccacgcttttcaagagtacatttttaaaaagccaacattctgcgacgtgtgcaatcacatgattgtaggaaccaatgcaaagcacggcctgagatgcaaagcatgcaagatgtccatacaccacaaatgcacagatgggcttgcgccacagcggtgtatgggaaagctgcccaagggatttcgtcgctactattcatcacctctcttgatacacgagcaattcgggtgcatcaaagaggtgatgccaattgcgtgcggaaataaggtcgacccggtatacgagacgctgcgatttgggacatcccttgcacagcggacaaaaaagggatcaagtggtagcggatcggattcgccgcacaggacaagcacgtctgatctggtggaagtgcccgaagaagccaacggtcctggagggggttacgacttgcggaagcgatctaattccgtcttcacataccccgagaatgggactgacgattttcgggaccccgcaaagaatattaaccaccaggggtccctctccaaagatccgctccaaatgaacacctatgtggctctgtacaagttcgtgcctcaggaaaatgaagatctggagatgagaccgggtgacatcattactcttttggaggacagtaatgaggactggtggaagggaaagatacaggacaggataggatttttccctgccaacttcgttcagagactccagcagaatgagaagatattccggtgtgtgaggaccttcatcggttgtaaggagcagggccagataacactcaaggagaaccagatttgcgtcagctctgaagaggaacaggacggtttcattagagtgttgagcggcaaaaaaaagggcttaattcctctcgatgtgctagaaaacatttag

SEQ ID NO: 240337 - DNA, 4422 bp, Artificial Sequence
  Description of Artificial Sequence: Synthetic coding sequence
gtggccattattgctggaaattttgaactcgcagaatatattaaaaatcataaggaaacagatattgtgccttttcgcgaagcacccgcttatagcaacaggagacgcaggcctcccaatacattagcagcacccagggtactgctgcggagcaattcagataacaatctcaatgcatctgcccctgattgggcagtctgctcaacggcaacaagccatagatctctatctcctcaactgttgcagcagatgccgtcaaaacctgagggggctgccaagactattggaagctatgtgccaggacccaggagcaggagcccttctcttaataggttggggggagcaggcgaggacgggaagcgtccgcaaccactttggcacgttgggtctcccttcgcattaggtgcgaacaaggatagtttgagcgccttcgagtaccccggtcccaagcggaaactctactccgctgtgcctggcagactctttgtggcagtaaagccgtatcagccccaagtggatggcgagatcccactgcacaggggagatagggtgaaagtgctatccataggtgaggggggattttgggagggaagtgctagagggcatatcggatggtttcccgcagagtgcgttgaggaggttcagtgcaaaccaagggacagccaggccgagactcgggctgatagaagtaagaaattgttccgacactatacagtgggcagctatgatagttttgacacctcaagcgattgcattatcgaggagaaaacagtggtcctgcagaagaaggacaacgaaggcttcggattcgtgctccggggagccaaagccgacacacccattgaagagttcactccaacacccgcttttcctgcattgcaatatctggagagcgtagatgaagggggtgtagcttggcaggccggtctcagaacgggcgactttctaattgaggtgaataacgaaaacgtggtgaaggtagggcacaggcaagtcgttaacatgatcagacaggggggtaaccaccttgtgttaaaagtggtaaccgtaacccgcaacctggaccctgacgatactgccagaaagaaggcaccgccacctcctaagcgagcacccactaccgctctcacgctccggagcaagtccatgacatccgagctggaagaactcgtcgataaagataaacctgaagagattgtgccagcttctaagcctagccgagctgccgaaaatatggctgtcgaaccgcgtgtcgccactatcaagcaacgtcctagttccaggtgttttcctgcaggatccgacatgaactctgtttacgagcggcagggaatcgccgtaatgacccccactgtacccggtagcccaaaggcacccttccttggcattccccgaggaacgatgagaaggcagaaaagcattgacagccgcattttcctctccgggatcacagaggaagaaagacaattcctggctccacccatgctgaagtttactagaagtctcagcatgcccgacactagcgaggatatcccacctcctccccaatccgttccccctagtccacctccgcctagcccaacaacatataattgccccaagtcacctacacctcgggtgtatggaaccatcaaacccgcattcaaccagaactcagccgctaaagtatcccccgcaactagatctgacaccgtcgctactatgatgagagaaaaaggcatgtattttcgcagggaactggatcgttattccctggacagtgaagacctgtacagtcgcaacgcagggcctcaggccaacttccgtaacaagcggggacagatgccagagaatccttactctgaggtcgggaaaatcgcatcgaaagccgtgtatgtccctgcaaagcctgctcgtagaaaaggaatgctcgtcaagcagtctaatgtggaagactctcctgaaaagacgtgcagcataccaattcctactatcatagtgaaagagccttcgacctcctctagcggtaaatcctcacaaggttcgagcatggagatcgatcctcaggcccctgagcccccatctcagctgcgtcctgacgagtcactgacggttagtagtccttttgctgctgctatcgcaggggcagtaagggacagggaaaagcggctggaagctaggagaaattccccggcatttctatctacagacttgggtgacgaggacgttggacttggccctcccgcaccaagaaccaggccttcgatgtttcccgaagagggagactttgcagacgaggattccgccgagcaactctcatccccgatgccatcagccactcccagagagccggagaaccacttcgtcgggggagctgaagccagcgccccaggtgaagccggaagacctcttaattcaacgtcgaaggcccagggccctgagagcagtcctgcagtccctagcgctagctccggtacggcgggtcctggaaattatgtccatcctctcactggcagactcctcgaccccagctctcccctggctctggctctttccgccagggatcgcgcaatgaaggagagccagcagggtcccaagggcgaggcgccaaaagccgacctgaataagcctttgtacatcgataccaaaatgaggccttctctggatgctggcttccctactgtgacaaggcaaaacacaagaggtcccctccgccgtcaggaaactgagaacaaatacgaaacagatctcgggagggaccggaagggcgatgataaaaagaatatgctaattgacattatggatacttctcagcaaaagagcgctggtctacttatggtccatactgtggacgctacgaagcttgataatgcacttcaagaagaggacgagaaggccgaggttgaaatgaagcccgattccagcccaagcgaggtgccagagggcgtcagtgaaacggagggtgcccttcagattagtgctgccccagaacccaccacagtgccagggaggaccattgtcgcagtcgggagcatggaggaggcagtaatcctgccatttcgtatcccccctccccctttagcctcagtggatctggacgaggattttatatttaccgaaccgttgccccctcccttagaattcgctaacagctttgacatacccgacgatagggccgcatctgtgcctgctctctcagacctcgtcaaacagaaaaagagcgacacaccccagtccccatctttaaattcatcccagcccactaattctgccgactcaaagaagccagctagtctttcgaactgcctccccgcatccttcctgcctcctcctgaaagtttcgacgcagtagccgattcgggaattgaggaagtcgatagccgtagttcatctgatcatcacctggagacgacaagcaccatttccacagtctcgtcaatctctacactcagctccgagggcggagagaatgtggacacttgtactgtctatgctgatgggcaggccttcatggtcgacaagccacctgtgccacctaagccaaagatgaagcctatcatccataaaagtaacgcattataccaagacgcccttgtggaggaggatgtggactcctttgtgatcccccctcctgcccctccccctcctccagggtccgcccagcccggaatggccaaagtcctccagcctcggacttctaagttgtggggggatgtcacggaaatcaaatcacctatcctgagcggcccaaaagctaacgtgatttccgaacttaattctattctgcaacagatgaatcgagagaaactagccaaaccaggggaaggtctggattctccaatgggcgctaaaagtgcctctctcgctccacgtagcccagagataatgtccactatctcaggtaccagatcaaccacagtgacctttacagtacggcctggcacctcgcagccaatcactctgcagagtcgcccacccgactatgagtccagaacctccggaactcgacgtgccccttcccctgtcgtgtcgccaacggagatgaataaagaaaccctgccggcaccgctgagtgccgcaacggcctctccatcacccgcactctccgatgtgttcagtctgcccagccagcccccttcaggggacctatttggcctaaatcccgcaggccgtagccgcagcccgtcccctagcatattacaacagccaatttccaataagccctttacgacaaaaccagtgcacctttggaccaagccggatgttgcagactggctggagtcccttaatctgggtgagcataaagaagccttcatggataatgagatcgatggctcccacttgcctaacctccagaaggaggacctcatcgatttgggggtgactagggtgggacacagaatgaatatcgaacgggcattaaaacagctgcttgaccgttag

SEQ ID NO: 240338 - DNA, 5552 bp, Artificial Sequence
  Description of Artificial Sequence: Synthetic coding sequence
atgccccgttcaccgacctctagcgaggatgaaatggcacaatcgttcagcgattactccgtgggaagtgagtcagatagttctaaagaagagacaatctatgatacgattagggctaccgctgagaaacctgggggagcacggactgaggaaagccaggggaacacactagttattcgcgtggtgatccacgatctgcagcagacaaaatgcatcagatttaaccccgatgctaccgtttgggtcgccaaacagcggattctatgtacactgacccagtcactaaaagatgtattaaattatgggctcttccagccggctagcaacgggagggacgggaagttcctggacgaagagagactgttgcgggagtatccacagcctgttggcgaaggcgtaccctctcttgagtttaggtataagaaacgtgtgtacaagcaggcaagtctcgatgagaaacagctcgctaagctacacacaaaaacgaacctcaagaaatgcatggaccacatccaacacaggctggttgagaaaattaccaagatgctggatcgcggtctcgatcctaattttcacgatcctgagactggggaaacgccactcacactcgccgcacaactcgatgattctgtggaagtgatcaaggccttaaagaacggcggagcacacctggactttcgcgctaaagacggcatgaccgctcttcacaaagcagctcgtgctagaaaccaagtggcgttgaaaactctgcttgaactgggtgcgtcccccgactataaggatagctacggcctgaccccactttatcatacggcaatagtcggtggcgacccttactgttgcgaactgctgctccatgaacacgcaaccgtctgttgtaaggacgagaatggctggcatgagatccatcaatcaaggtgctggggccacatatcagagccccaccacaccttactgagtgggagcgcgaggtctcagcagtcaagaagtgcctcgtctgctctccatgtgtgcgctatgtattcttcctttagctgcgttagaatcagcctcttgttccatggccgtatcacagaattaaaacagtacaagaagtcaacaccattccaagtcgccatcatagccggtaactttgaactggccgagtacattaagaaccacaaagaaaccgacatcgtaccatttcgagaggcaccagcgtattcgaacagacgccgacgccctccgaacacattggcggcacccagggtcttgcttagaagtaacagcgacaataatttgaatgctagcgcccctgattgggcggtttgtagcactgcaacatcacatcgctctctgtcccctcaactgctacagcagatgccatccaagcctgaaggtgccgctaagacaatcggtagttatgtgccagggccacgtagccgatctcctagcttgaataggctcgggggtgccggagaagatggcaagcggccacagcctctgtggcacgtgggttctccattcgcgctcggtgccaataaggactcgctctccgcattcgagtacccgggacccaagaggaagttatattccgctgtgcctgggagactcttcgtggcagttaagccctatcagccccaggtagacggcgaaataccactccatcgcggagaccgcgtcaaggttctcagcataggtgagggaggcttctgggaagggtccgctcggggtcacatcggctggtttcccgcagaatgtgtggaggaagtgcagtgtaagccgcgagattcgcaggccgaaacgcgcgctgacaggagtaaaaaactctttagacattataccgtcggctcttacgatagctttgatacctcatcggactgcatcatcgaggagaagacagtggtcctacagaaaaaagataacgagggttttggtttcgtgttacgcggtgccaaggcagatacgcccatcgaagagtttacgcctaccccagcatttcctgcgttgcagtatcttgagtctgtggatgaaggcggtgttgcctggcaggctggattacgtactggagacttcctcatcgaggtgaacaatgagaacgttgtgaaggtgggacatcgccaggtagtaaacatgattcggcaagggggaaaccacctggtgttgaaagttgttacagtgacgagaaatctggatcctgatgacactgctcgcaagaaggcccctccgcctcccaagagggcacctacgaccgcactaaccctgcggtcaaaaagcatgacatccgaattagaagaattagtggacaaaggtgtgattcggaaagttagcgataagccagaggagatcgtgccagcttcaaagccaagcagggctgctgagaacatggctgtggaaccccgtgtggctactatcaagcagcgcccttcttcccggtgcttcccagcgggatcagatatgaacagtgtgtacgaacggcagggaatcgccgtgatgacccccacagtgcctggtagtcccaaggcaccctttctgggtatacccagggggacaatgcgcaggcaaaagtccatcgatagtaggatcttcttgagcgggatcaccgaggaagagcgacagttccttgccccaccaatgttgaaattcacccggtccctcagcatgcctgatacatctgaagatattcctccaccaccccaaagtgtacccccttcacctcccccaccatcaccaactacgtataactgcccaaagtccccaaccccaagagtatacgggactattaagcccgcatttaaccagaattctgccgcaaaagtttcccccgcaacccgcagtgatacagttgctaccatgatgagggagaaggggatgtacttccgcagggagctggaccggtattctctggactccgaagatctatatagtaggaatgcaggtcctcaggccaatttccgcaataagcgcggacagatgccagaaaatccttatagtgaagtggggaagattgcctcaaaggctgtttatgtgccagctaagcctgcaaggcgcaaaggtatgttagtgaagcaatcgaatgtggaggactctcccgaaaagacctgtagtataccaatccccacaattatcgtgaaggagccatcaacaagcagttcagggaaatcctctcaggggtccagcatggagattgatcctcaggcaccggaacctccgtctcagctccgaccagatgaatctctgacagtgtccagtccatttgcggctgcaattgccggagcagtgcgggacagggagaaacgtttggaagccaggcgcaactctcctgcttttctgagtactgatttgggggatgaggatgtggggttgggcccacccgcacccaggaccagacccagtatgttccctgaagaaggggactttgctgacgaggactccgccgagcagcttagctcccccatgccatctgcaaccccgagagaacctgaaaatcacttcgtcgggggagccgaggcaagcgctcctggcgaggccggacggcctttgaatagtacgtctaaggcccagggtcccgagtcttccccagcagtcccatctgctagctctggtaccgccggacccggaaattatgtacatcctcttaccggcagactcctcgatccctccagtccacttgctttggctctgtccgcgagagacagggccatgaaagaatctcagcagggcccaaagggggaagctccgaaggcggatctaaataagcccctgtatatagacactaagatgcggccttctctggatgcgggattccccacggttacgaggcaaaataccagagggcctctgcggcgtcaggagaccgaaaacaaatacgagacagacctcggcagggatcggaaaggggacgataaaaagaatatgctgattgatattatggacacatcccagcaaaagtctgcaggattgcttatggtacacaccgtggatgccacaaagttggataacgctctgcaggaggaagatgaaaaagctgaggttgaaatgaaaccagatagtagcccatctgaggtcccagaaggcgtgagtgaaaccgagggcgctttgcagataagcgcggctcctgagcccaccaccgtgccaggccgaacgatagtcgcagtgggctcaatggaggaagctgttattctgcctttcaggatcccgccacctcctctggcctccgtggacctcgatgaagattttatcttcaccgagcccctgcctccacctcttgagttcgccaactccttcgacataccagatgatcgggctgctagcgtgccggcactttctgacctggtgaagcagaaaaagtcagatactccacagagtccaagcctaaatagttcacagcccaccaatagcgccgattctaaaaaaccagcctcactgagcaattgtctgcccgcttcttttttgccgcctccagaatcatttgatgctgtagcagacagcgggattgaggaggtagattcccgctcttcaagcgatcatcacttggaaacaacttctacaataagtaccgtctcctctatctctaccttgtccagtgaagggggtgagaatgtggatacttgtaccgtctatgcggacggccaggcgttcatggtcgacaaacccccagtgccaccgaagcctaagatgaagccaattatccataagtccaacgctctgtaccaagatgcactcgtggaggaagacgtggattctttcgtcattcctcctcccgcacctccccctccaccaggctccgcccagccaggcatggcaaaagttttgcagccgcgaacttcaaagctgtggggtgatgtcacagagattaaaagccctatcctatcagggcctaaagctaatgttatatccgaacttaactccatccttcagcagatgaaccgagagaagctggctaagcctggcgagggactggacagtcccatgggggctaagagcgcctctctcgctccccgaagccccgagatcatgtctaccatcagcggaacgcgatccactacagtcacatttactgttcggccaggcactagccaaccgattactctccagagtaggccccctgattatgaatctcgcaccagcggaacgcgcagagctccttccccagtggtgagtccaacagagatgaataaggaaacgcttcccgcacccctgtccgctgccactgcttccccaagccccgcacttagtgatgtttttagcctgccatctcagcccccaagtggcgatctttttgggctgaatcctgctggcagaagtcgatctccatctccctctatcctccagcagcctatctccaacaagcccttcactaccaaacccgtccacctctggactaaaccagacgtcgcagactggttggaaagcctgaatctcggagaacacaaggaggccttcatggataacgagatcgacggatcacacctgcctaatctccagaaagaagatctgattgatcttggggtgacaagggttgggcatcgtatgaacatcgagagagctttgaagcagctcctggaccgtta

SEQ ID NO: 240339 - DNA, 846 bp, Artificial Sequence
  Description of Artificial Sequence: Synthetic coding sequence
atgatgatgaatgttccaggagggggagccgcagccgttatgatgacagggtataacaacgggaggtgcccacgtaactccctttactcagactgtattattgaagagaagacagttgtcctacagaaaaaggataacgaaggattcgggtttgttctgcggggagcaaaggcagataccccaatcgaggagtttactcccactcctgcttttcccgcactgcagtatttagaaagcgtagatgagggcggagttgcatggcaggccggattacggactggggactttttgatcgaagtcaataacgaaaacgtggtgaaagttgggcaccggcaggttgtgaacatgatccggcagggaggcaaccatttagttctgaaggtggtaaccgtcacacggaatttggacccggacgacacagctcgcaaaaaagccccaccgcctccgaagcgggcacctactacagccttgacgttgagatctaagagtatgacctcggaacttgaagaactggtggacaaaggcgtgatacggaagggaaaagacaagcctgaggaaattgtcccagcttcgaaaccttcaagggccgctgagaacatggctgtggagccacgggtcgcgaccatcaaacagcgccctagcagccgctgtttccctgcaggctctgacatgaatagcgtgtacgaacgccaaggaattgccgtaatgactcctaccgtgcccggaagccctaaagccccatttctgggcataccgcgaggaacaatgaggcgccaaaaaagtataggcaagaaatgcggaactcctccacaaaagctcccgctgggttttcagacgcaaccttag

SEQ ID NO: 240340 - DNA, 3762 bp, Artificial Sequence
  Description of Artificial Sequence: Synthetic coding sequence
atgatgaatgtgccaggaggtggggctgctgcagtgatgatgaccgggtacaacaacggacgatgcccaaggaactccctctactctgactgcatcatcgaggaaaaaactgtggtgctgcagaagaaagataatgagggtttcggattcgttctacgcggtgctaaggctgacactccaattgaagagtttactcccacacctgccttcccagctttacagtatctggagagcgtggatgagggtggcgttgcatggcaggcagggctcaggaccggagactttcttatcgaggtgaacaatgagaatgtggtcaaggtaggtcacaggcaggtggtcaacatgatccgccaaggtggcaatcatctagtgctgaaggtggtgactgtcactagaaacctggatcctgacgacactgcacgtaagaaagcccctccccctccgaaacgggctccgactactgctctcaccttgagatcaaaatccatgacttcagagctggaagagttagtggataaggataagcccgaggaaatcgtccccgcatccaagccttccagggcagccgaaaatatggctgtcgaacccagggtggcgacgataaaacaaaggccttcatcaagatgtttccctgctggaagcgacatgaactctgtttacgagcggcaggggatcgctgtaatgaccccaacagtcccgggtagtccaaaggcacccttcttggggattcccagagggaccatgcgtaggcagaaaagcattgattcgaggatcttcctgagtgggattaccgaggaggaacgacaattcttagcacccccaatgctgaagttcacacgttcgctgtctatgccagacacgtccgaagacattccccctcccccacagagcgtgccaccatctccccctccccctagcccaacgacgtataattgcccgaaaagtcctacgccccgagtgtatggcaccattaagcccgctttcaatcagaactcggctgcgaaggtctcacctgcaacacgctctgacacagtggcaaccatgatgcgcgagaaagggatgtattttcgacgcgagctagacagatattccctggatagcgaggatctctattctcgaaacgccggacctcaagctaactttagaaacaagcgaggtcagatgcccgagaacccatacagtgaagttggtaagatagcatccaaagcagtctacgttccggcaaaacctgctaggcgtaagggtatgctagttaagcaaagcaacgttgaggattcccctgaaaaaacatgttccattcccatccctaccatcatcgtcaaggagccttccacctcttcctcgggcaagtcctctcaggggagctcgatggaaattgatcctcaggctcctgagcccccttcccaactgcgtccggatgaaagcctgaccgtgtcctccccatttgccgctgcaatcgctggggcagttcgagaccgcgagaagagacttgaggcacgccgtaactcccccgcttttttaagcaccgatctcggagacgaggacgtgggacttggtcctcccgctcccagaacacgccctagcatgttccccgaggaaggtgactttgctgacgaagactccgctgagcagctgtcctcaccgatgcccagtgcaactccccgtgagcctgagaatcacttcgtcgggggtgccgaggctagtgctcctggcgaggccggtcgaccgctgaatagcacgagtaaagcacagggtcctgagtcatccccagctgtgccttcagcttcaagtggcactgcaggccctggaaattacgtccatcccttgactggacgtctgctggaccccagcagcccgcttgccctcgctttaagcgctcgcgatcgggcaatgaaggagagtcagcaaggcccaaaaggcgaagcccctaaggcggacttgaataagccgctctatatcgatacaaaaatgagacccagcctcgacgctggtttccccactgtgactagacaaaacactcgcggacccctgcggagacaggagaccgagaataaatacgagaccgacctgggtcgagacaggaaaggcgacgacaagaagaacatgctcatcgatattatggacacaagccagcaaaagagtgccggactcctcatggtacacacagttgacgctactaagttggataatgccttgcaggaggaagacgagaaggccgaagtggagatgaaacctgattcgtccccgtccgaagtgccagagggagtgagcgaaactgaaggtgccctccagataagtgcagcccctgagcccaccaccgtcccgggaaggaccattgtcgcagtcgggtccatggaggaggctgtgatcctcccattcaggattccccctccccctctagcaagcgttgacctcgatgaggatttcattttcacagagccacttccaccccctctcgaatttgcgaattcattcgacattccagatgatagggccgcttcagttcctgctctgtctgacctggtcaagcagaaaaaaagcgacaccccgcagtctccttcactcaactcttcgcaacctacaaattccgctgactccaaaaagcccgcttccctctccaattgccttcccgcttcttttttgcctccaccagagtcattcgacgcagtcgctgactctggaattgaggaagtggactcacgaagttccagtgatcaccacctggagacaacgtcgaccatcagcacagtttcatcgatcagtactttgtctagcgagggtggggaaaatgtggacacctgtaccgtgtacgcagatggccaagcgttcatggtagacaagccacctgttcctcctaagccaaaaatgaaaccaataatccataagagcaatgcactgtatcaagatgccttagtggaggaggacgtcgattccttcgttatcccgccaccagccccacctcccccacctggtagcgctcagcccggaatggctaaagtcctacagcctcggacctccaaactgtggggcgatgtcacagaaattaaatctcctattctgtccggcccaaaagctaacgtcatcagcgaactgaattcaatattacagcagatgaatcgtgaaaagctggccaaaccaggggaaggcctcgattctccgatgggagccaagagtgcatctctggctccccgaagtcctgaaatcatgagtactatcagtggaacccgttctacaacagtcacctttaccgtgcgccctggcacgtcacagcctattacattgcagtcgcggcctcctgactatgaatctcggacgagcgggaccagacgggctccaagcccagtggtttcacccaccgagatgaacaaggaaacattgccggcaccacttagcgcagctaccgcatctcccagtccagccctgtcagacgtgttctcactgcctagccagccacctagtggggacctttttggcttgaaccctgccggtcggagtagatctccctccccatccatcttgcaacaacctatcagcaacaagcccttcactactaaaccagtgcacctgtggactaaacccgacgtcgctgactggctggaatccctgaatttgggggagcataaggaggccttcatggacaacgagatagacggtagccacttgccaaacctccagaaagaggacttgattgatttaggagttacacgcgtaggacacagaatgaatattgagcgcgctctaaaacaactcctagaccgttag

SEQ ID NO: 240341 - DNA, 843 bp, Artificial Sequence
  Description of Artificial Sequence: Synthetic coding sequence
atgatgaacgtgccaggaggcggtgccgcagcagtgatgatgactggatataataacggccgatgcccgcgaaatagtctatacagcgactgtatcattgaagagaaaaccgtcgtcctgcagaagaaggataacgaaggatttgggtttgtcctcagaggagccaaggctgatacccccatcgaggaatttacccctacccccgcatttcccgcactgcaatatctggaaagtgtggatgagggcggagtggcctggcaggccggactgcggacaggggactttctcatcgaggtgaacaatgaaaacgtcgtaaaagttgggcacagacaggtagtaaacatgatccgccagggcggaaatcacctggttcttaaagtggtgactgttactcgcaatctagaccccgacgacactgctagaaagaaagcgcctcctccacctaaaagggccccaacaaccgcgctgaccctgagatcaaagagtatgacttcggagctcgaggaactggtcgataaagcttccgtgcgcaaaaagaaggacaaaccagaagaaatcgtgcctgcttccaaaccttctagagctgctgagaacatggccgttgaacctcgtgtggctaccattaaacaacgcccatcctcaagatgttttcctgctggaagcgatatgaattccgtttacgaacgtcagggaattgccgtgatgacacctacggtccctggttctcccaaagcgcctttcctcggaatccctcgcggaactatgagaagacaaaagtcgataggcaaaaagtgcggaaccccccctcagaaactcccgctggggttccagacccaaccctag

SEQ ID NO: 240342 - DNA, 4413 bp, Artificial Sequence
  Description of Artificial Sequence: Synthetic coding sequence
atgaaatcccttctgaatgctttcacgaagaaagaggtgcccttccgggaagcccctgcatattcaaaccggaggcgcaggcctcccaacaccttggccgctcctcgggtcctgcttcgctctaactccgacaataatctgaatgcttcggccccagactgggcagtttgcagcacggcaacatcacaccgcagcctgagccctcagctcctacagcagatgccttccaagcctgagggcgcagctaagacgattggatcctacgtgcctggaccacggagccggagcccaagcctgaaccgcttagggggtgccggagaggatgggaaacgtccgcagccattgtggcacgtgggatcgccgtttgccctcggagcgaacaaagattccctttccgcgttcgaataccccggaccaaagcggaagctgtactccgcagtaccgggacgcctgtttgttgcggtgaaaccataccagccccaagtcgacggagaaatacccctgcaccgcggtgatcgggtgaaagtgcttagtattggggaaggaggcttctgggaaggctctgcgcgtggacacataggatggttccctgccgaatgtgttgaagaagttcagtgtaaaccgcgagacagtcaggccgagactcgtgcagaccggtcaaagaagttgtttcgtcattatactgttggctcatacgacagcttcgacacctccagcgactgtataattgaggaaaaaacagttgtcctacagaaaaaagacaacgaagggtttgggtttgtcttaagaggagctaaggcagacacccctattgaggaatttacaccaacccccgctttccccgctcttcagtatttagagtctgttgatgagggcggagtggcatggcaggccggtttgagaacaggcgacttcctcatcgaggtgaacaatgaaaacgtagtgaaagtcggacaccgccaggtcgtgaacatgatcaggcagggcggtaaccacctggttctcaaagtggtgacagtgaccagaaatttggacccagatgataccgcccgaaaaaaagctcctccgccaccaaaacgcgctcccactacagcgctaaccctacgcagcaagtcaatgaccagcgagcttgaggagttggtcgataaggcatccgtcaggaagaagaaggacaagccagaggaaattgtgcctgcctccaagccttcacgggcagctgagaatatggcggtggaaccaagggtggccactatcaagcagcggccatcaagccgttgcttccctgccggatcagacatgaactcggtctacgaacgtcagggtattgcggtaatgactccgaccgtgcctgggagcccaaaggctccatttctggggattccgcgagggacaatgcgaagacagaaatccatcgacagtcggatcttcctgtctggcataacagaggaggagaggcaatttctcgcacctcccatgctcaagttcactcgctctctcagcatgcctgacacttctgaggatatcccccctccccctcaatccgtcccgcctagccctccccctcccagccctactacgtataactgtccaaagagccctacacccagagtgtatggcaccatcaaacccgcttttaaccagaactctgccgctaaagtgtcccccgcaacacgcagtgacacagtggcaacgatgatgcgggagaaagggatgtacttcaggcgggaactcgatagatactcgctcgacagtgaggacctgtacagtagaaacgccggtccacaagcgaattttcgtaataaacgtggtcagatgccagagaacccatatagtgaggttggaaaaatcgcttcaaaggccgtttatgttccagccaagcccgcacgacgcaaaggcatgctggttaagcagtctaatgtcgaggattcaccagagaagacatgctccattccaatcccaacgatcatcgtgaaggaaccatccacctcgtcgagcggaaaaagttctcagggcagttcaatggaaatcgacccccaggcccctgagccacccagccagctgcgcccagatgaatccctgacagtctctagcccttttgccgcagccattgccggagccgtccgcgacagggaaaagagactcgaggcaaggcgaaatagtcccgcattcctctctactgatttaggcgacgaagatgttgggcttgggccaccggcaccacggaccagaccctcaatgttcccagaggaaggcgatttcgcagatgaggatagcgccgagcaactttcctcacccatgccctcagccactccccgagaacctgagaatcattttgtagggggtgctgaagcttctgcaccaggtgaggcaggtcgccctttaaattctacatccaaagcacaggggccagagtcctctccagcagtccccagcgcctcctcaggcacagctgggccaggaaactatgtgcatccgttgacggggagactactggatccctcgtcccccttagcgttagctctgtctgcgcgagaccgtgccatgaaggaatctcagcaggggccaaagggggaagctccaaaagcggacctaaacaagccgttgtatatcgataccaaaatgcgtccaagtctcgacgccggttttccaaccgtgacccgtcagaacactcgcggaccactgcgtcgacaggaaaccgaaaacaaatatgagactgatcttggccgagatagaaagggcgacgataagaagaatatgttgattgatattatggacacctcccagcaaaaatctgcagggctcctgatggtacatactgtggatgctaccaagctagacaacgcactccaagaggaagacgaaaaggccgaggtcgagatgaaacccgactcgtccccaagtgaggttcctgagggcgtgtctgagacagaaggagcgctccagatttcagccgcaccagagcctacaaccgtgccaggacggacaattgtagccgtgggctcaatggaggaggccgtaattctgcctttccgcatcccgccaccccctctggcttcagtcgatttagacgaagactttatttttacagaacctctgccaccccctctcgaatttgccaacagctttgacataccagacgaccgtgccgcttcagtgcccgcactcagcgatttggtgaaacagaagaaatctgatacgcctcaaagcccatctttgaactctagccaaccaacaaactcggcagattcaaagaaacctgctagcctgtcaaattgccttcccgcaagtttcctgcccccacctgaaagcttcgacgcggtggccgacagtgggatcgaagaggttgattcccggtcctcatccgaccatcacctagagacaacttccactatttcaacagtctcctctatcagcactttgagcagtgaaggcggagaaaacgtggatacctgtactgtctatgccgacgggcaggctttcatggtggataagcccccagtgccgcctaagcctaaaatgaaaccaataatccataaaagtaatgcattgtaccaagacgctttagtggaggaagacgtggactctttcgtgatccccccacccgctcccccaccacccccaggctccgcacagcccggaatggccaaggtgttgcagcccagaacctccaaactgtggggcgatgttactgagatcaaatcaccaatcctatctgggcctaaagccaatgtaatttccgagctgaattccatcctccaacagatgaaccgtgaaaaacttgctaaacctggggagggccttgacagtcccatgggcgctaagtcagctagccttgcaccacggagtcccgagatcatgtcgaccatatctgggacacgtagcaccactgtcaccttcacggttcggccaggcacaagccagcctataacgctacagtctcggccacctgactacgagtcccggacctcgggtacgaggagagccccatccccagtcgtaagccctacagagatgaataaagagacactgcctgctcccttgagtgcggcaacagcctctcccagccctgctctgagcgatgtcttttctctcccaagccagcccccatccggcgatctcttcggactcaatcccgcagggaggtcccgtagtcctagccccagcatcttgcagcaacccatcagcaataaaccatttaccaccaagcctgtgcacctgtggacaaaacccgacgtggccgactggttagagtcccttaatctgggggagcataaggaggcgtttatggataatgagattgatggcagccatctccccaaccttcagaaggaggacctgatagacctcggtgtgactagagtggggcacagaatgaatatcgagagggcactaaaacagcttcttgacagatag

SEQ ID NO: 240343 - DNA, 816 bp, Artificial Sequence
  Description of Artificial Sequence: Synthetic coding sequence
atgatgatgaatgtccccggagggggagcggcagcggtgatgatgaccggttataacaacggcagatgtccacggaatagcctgtactctgattgtattatcgaagagaaaactgttgtgttgcagaaaaaggataatgaagggttcggattcgtgcttcgcggagcaaaagcagatacaccaatcgaggaatttacccccactccggcattcccggctctccaatatctggagtcagtggacgaggggggagtggcatggcaggccggtctgaggacaggcgactttttgatcgaggtaaacaatgagaacgtggtgaaagtgggacatcgtcaagtggttaacatgattcgtcaggggggaaaccacctggtcctcaaggttgttaccgttacgagaaatctggaccccgatgacactgccaggaagaaggccccaccaccaccgaagcgcgctcccacgactgctttaaccttgcgctcaaaaagtatgacgtccgagctcgaggaactggataaacctgaagagatcgtacccgcttctaaaccgtcaagagcagccgagaacatggcagtggaacccagagttgctacaataaagcagcgaccgtcctcacgctgctttcccgctgggtcagatatgaactcagtttatgaacggcagggcatcgccgttatgacccccactgtgccgggatcccccaaggccccttttttgggcattcctcgagggactatgaggcgccaaaagtctatcggcaaaaagtgtggaacacccccacagaagctgccacttggctttcagacacagccctag

SEQ ID NO: 240344 - DNA, 3765 bp, Artificial Sequence
  Description of Artificial Sequence: Synthetic coding sequence
atgatgatgaacgtcccgggaggtggggctgcagccgtgatgatgactgggtataacaatggccgttgtccaaggaatagtctctattctgattgtatcatcgaagaaaaaactgtggtgttacaaaaaaaagataacgaggggtttgggtttgtgctgcgaggagccaaagctgatacacccatcgaagagttcacccccaccccagccttcccagcgctgcagtacctggagagcgtggacgagggaggcgttgcttggcaagccggactgcggactggagacttcttaattgaggtgaacaatgagaatgtcgtcaaggtgggccaccgtcaggtggtgaacatgattaggcagggcggaaatcatctggtgctcaaggtcgtgacagtcacgagaaacttagaccccgatgatacagcaagaaagaaagctcccccacctcccaaacgcgctccaacaacagcccttactctgcgaagcaagtccatgactagcgagttggaagaactggtggacaaagataaacccgaggagatcgtgccagcctccaagccttctcgtgctgctgagaacatggccgtggaacccagagttgcaactattaagcaacggccaagcagtcggtgctttcccgctgggtccgatatgaactctgtctatgaacgtcaggggatcgctgtgatgaccccaacggtcccaggatctcccaaggccccttttttgggaatccctagagggactatgcggcgacagaaatcaattgacagccggatattcctgtctggcataaccgaggaggaacggcagttcctagccccacccatgctgaaattcacacgttcactctcgatgccagacacgtccgaggacatacctcccccaccacagtcggttcctccatccccccctccaccgagccccaccacatacaactgccccaagagccctaccccacgggtttatgggactatcaagcctgcctttaatcagaactctgccgctaaagtgtcacctgccacgcggagcgataccgttgctaccatgatgcgggagaaaggtatgtatttcagacgcgagctggaccgatactcgctagactcagaagatctgtacagtcgcaatgcaggacctcaggccaactttcgtaacaaaagaggccagatgcctgagaacccatacagtgaggtgggcaaaatagcctcgaaagctgtgtacgttcctgctaagcccgctcggaggaaaggtatgcttgttaagcagtccaacgtcgaagactcacctgagaaaacttgttccattcccattcctaccattatcgtaaaagaacctagcacaagtagctccggtaaaagctcacaaggctcatcgatggagatcgatccccaagctccagaacccccaagccagttgcgccctgatgagagtctcactgtgagctcgccgttcgccgcagccatagctggggctgttagggaccgggagaagcggctggaagctcggagaaatagtcctgcgtttctttcaacggatttaggtgatgaggatgttgggctaggaccccctgccccaaggacaagaccgtccatgtttcccgaagagggcgactttgcggacgaggactcggctgagcagctctctagcccaatgccgtcagctacacccagagagcctgagaatcacttcgtgggcggagccgaggcaagcgctccaggtgaagcaggacggcctcttaatagcacgtcaaaagcccaggggcctgagagtagcccagcagtgccttctgcttcctccggcactgcaggccctggcaactatgtccaccccctgaccggccgactgttggacccatcatctccacttgccctcgccctttctgccagggacagggcaatgaaggagtctcaacaggggccaaaaggtgaagccccaaaggcagacctgaataaaccgctctatatcgatacaaaaatgaggcccagtctggacgccggttttccaaccgtgacgcggcagaacaccaggggccctctgaggcgacaggaaactgaaaacaaatatgaaaccgacctggggagggatcggaaaggggacgataagaaaaacatgctgattgacatcatggacacgtcccagcaaaaatcagctgggctgcttatggtgcacacagtcgacgccaccaaactggacaacgccttacaggaggaagatgaaaaggccgaagtggagatgaagccagacagtagcccgtccgaagtaccagaaggcgtgagcgagactgagggagctcttcagatttcggccgctcccgagcccacaaccgtccccggacgtacaattgttgccgtcggttccatggaggaggcggttattctgccatttcgcatcccaccaccaccactggcctcggtcgacctcgatgaggattttatttttacagaacctctccctccgccactcgagttcgctaactcctttgacattccagacgaccgggctgcgtcggtgccagctctcagtgatcttgtgaagcaaaaaaaaagcgatacgccccagtccccctccttgaactcttcgcagccaaccaactcggctgactctaagaagcccgcatccttgagtaattgcctacccgctagttttctcccaccaccggaatccttcgatgctgttgccgacagtgggattgaggaggtggattcacgcagttctagtgatcaccacctggagactacctccactattagcacagtgtcttctatttctaccctctctagtgaaggtggcgagaatgtggatacttgcacagtatacgccgacggacaggcgttcatggttgacaagccccctgtgccccctaaacctaagatgaagcccattatccacaagtcaaatgctctctatcaggatgcactggtcgaggaggacgtggattccttcgttatacctccacccgctcctcccccaccccctggatcagcccaacctggcatggccaaagtacttcagcccagaacatccaaactatggggtgacgttaccgaaatcaaatcaccaattctctctggaccaaaggccaacgtcatctctgaattgaactccatcctgcaacagatgaaccgggaaaagctggcaaaacctggtgagggtcttgactctcctatgggagcgaagtctgcatctctcgccccaagatcccccgagattatgtctaccattagcggcacaagaagtacaacagtcacttttacagtgagaccgggaacatcgcagccaattacgctccagagtaggcctcccgactacgagagccgcacctctggcacccgcagagcgccatcacccgtggtgagcccgaccgagatgaacaaggaaactctgccagcccctctttccgcagccacagcgtctccttcacccgcactctcagatgttttctcactaccatctcagcccccatctggcgacttgttcgggcttaatcccgcaggtcgaagtcgctccccctctccgtccattctccaacaacccatctcaaacaaaccattcactacgaaacccgtgcatctctggacaaagcccgatgttgctgactggctggagagcctcaacttaggggagcacaaagaggctttcatggataatgagatcgacggatcacacctcccaaatctccagaaagaggatttaattgatttgggcgtgacaagagtgggacaccggatgaacatagagagagctttgaaacagctcctggatcggtag

SEQ ID NO: 240345 - DNA, 915 bp, Artificial Sequence
  Description of Artificial Sequence: Synthetic coding sequence
atgccacgtagcccgacctcttctgaggatgagatggcccagagcttcagtgattattctgtgggatccgaatctgacagttccaaagaggaaacgatttatgatacaattcgggctactgctgagaagcctggtggtgccaggaccgaagagagccagggcaacacactcgtcatccgggtcgtgatccatgacctccaacagactaaatgcatcaggttcaatccggacgcaactgtgtgggtggcaaagcagcgaatcctctgcaccctcacccagagcctaaaagacgttttgaactatggccttttccagccggcttctaacggcagggatggcaaatttctcgacgaggaacgactgcttcgcgagtaccctcagcctgtgggagaaggtgtgcccagtctggagtttagatataagaaaagggtgtacaaacaagcttctctggacgagaaacaactcgccaaattgcacactaaaacgaatctgaaaaagtgtatggaccatatccagcaccgactggttgaaaagattacaaagatgctcgacagggggcttgacccgaactttcacgatcctgagaccggtgaaacaccactcactttggccgcacagttggacgactcagtggaagtgatcaaggccctaaagaatgggggagcccacctcgacttcagagctaaggacggcatgactgctttacacaaggcggcacgggcacgtaatcaggtggctcttaagactctgctggagctgggagcctcacccgattataaagatagctacggcctgactccactctaccatactgccattgtgggcggtgatccctattgttgcgaactgctgctacatgagcacgctaccgtctgttgtaaagatgaaaatggatggcacgaaattcaccaatag

SEQ ID NO: 240346 - DNA, 5244 bp, Artificial Sequence
  Description of Artificial Sequence: Synthetic coding sequence
atggacggcccaggggcaagcgcagtggtagtccgggtggggattccggatctccagcagaccaagtgcctgcgccttgacccggcagcccctgtgtgggcagctaagcaacgggtactgtgtgccttgaatcacagcctgcaggacgccctcaactatggcctgtttcagccacccagccggggaagagccggaaagtttctggatgaggagcggttgcttcaagagtaccccccaaacttggatacacccttgccgtacctcgaattcaggtacaagcgccgagtctacgcccagaatctgatcgatgataagcagttcgccaaactccacaccaaggccaatctgaagaaatttatggattatgtccagctgcacagcactgataaggtagctcggttgctggacaaaggactggaccccaatttccacgatcccgacagcggggagtgtcccctctccttggccgctcaactcgacaacgccaccgacctgctcaaggtactcaaaaatggaggagcccacctcgacttcagaactcgcgatggcttaacggctgttcattgcgctacacggcagaggaacgctgctgccttgacaaccttactggacctgggggcatcgcccgattataaggacagccgcggactaacgccactctaccatagtgccctgggcggtggtgatgcactgtgttgcgaacttctcctccatgaccatgctcagctggggattacggacgagaacgggtggcaggagattcaccaggcctgtcgctttggacacgttcagcacctcgagcatctcctgttttacggagctgacatgggcgcacaaaatgcttcgggtaatactgccctgcatatttgtgccctttacaaccaagagtcctgcgcccgagtcctgctgttccgcggtgctaatagggatgtcaggaactacaacagtcagactgcatttcaggtcgctatcatagcgggaaacttcgaactggccgaggtgattaaaactcataaggattctgatgtcgtgccattcagggagacaccctcgtacgccaagcgcaggagactagctggtccatccggcctcgccagcccaaggccacttcaacgctccgcctcagatattaacctgaaaggagaagcacaacctgccgcatcaccaggtccctccttgcgttctctgccccaccagctgctgctgcagaggcttcaagaggagaaagatcgggaccgtgatgctgaccaggaaagtaacatctcagggccattggctggacgagccggacaatctaagatctccgatccaggtcccggaccagggggagttggaggggcaccattgccccctcctggagctcccagatcgtgtattcgcattcgcgctcgctttcctgccccacccgctccccctgctcctccgcctcgtgggccaaagcgtaaactgtattccgctgtgccgggtagaaagtttatcgcagtaaaggcccactccccccagggcgaaggtgaaatacccttacatcgtggggaagcagttaaagtactttccataggtgaggggggtttttgggaaggtacagtgaaggggaggaccggctggtttcccgcagattgtgttgaagaagttcagatgaggcagcacgatacccgccctgaaacaagagaagatagaacaaagcgactatttcgacattacactgtgggaagctatgattctcttacctcccattctgactatgtgatagacgacaaggtggccgtgctgcagaagagagatcacgagggcttcggttttgtgctgcggggagcgaaagctgagacgccaatcgaagaatttacacctaccccagcttttcctgcgctgcaatatctagagagtgtcgacgtggaaggtgtcgcttggcgggctggcctgcgcaccggggacttcttgattgaggttaacggcgtcaacgttgtgaaagtggggcataagcaggtcgtcgcccttatacggcagggaggcaatcggctcgtcatgaaggttgtgtcagtgactagaaagccagaagaagacggtgcccgtaggagggctcctcctccacctaagcgggcaccttctaccaccttaacactgagaagcaaatcaatgaccgctgaactggaagaacttgcttctattcggaggagaaagggggagaaacttgatgagatgctggccgcagcagccgaaccaacactcagaccagacattgcggacgccgactccagggcagcgaccgtgaaacagcgacctacatctagaagaatcacccctgccgagatttcctcactttttgaacgtcaggggctgcctggcccagagaagttgcccggtagccttcggaaagggattccaagaaccaagtctgtcggggaagacgaaaaattggcctcattactcgagggccgttttcccagatcgacctcgatgcaggatcccgttcgagaaggtcggggaatcccaccgcctcctcagaccgcccctccccctcctccagcaccatattattttgacagcggtccccctcccgcattctctcctccaccaccgccaggtagggcctacgacaccgtgcgctcgtcattcaagcccggtctcgaagctcggctcggcgctggagctgccggtttgtatgaaccaggtgccgcactcggccctcttccatatcccgagcgccaaaaacgcgctcgtagtatgatcatactccaggactccgctcccgagtccggggacgctccccgtccacccccagcagctacacctcctgaacgaccaaaaaggcgccctaggccgcctggtcctgatagtccatatgccaatctgggggctttttctgcttctttatttgctccctctaagccccagcggaggaagtctccactggtgaagcagctgcaagtggaagatgcccaagaacgggcagctctcgccgtagggagtcccggacctggcggagggtccttcgctcgggagccttctccgacacacaggggccctcgaccgggtggccttgattatggggctggggatgggcctggtcttgccttcggaggacccggtcccgcaaaggaccggaggctggaggaaagaaggaggtctaccgttttcctgagtgtcggtgctatcgaaggctcagctcctggggctgacttgcctagtctgcagccaagcaggagcattgatgagaggctcttggggactggtcccactgccggacgagatcttctccttcctagccccgtgtctgccttgaagcccctagtctccgggccatctcttgggccatctggaagtacgttcatacaccccctcactgggaagccccttgacccgtcctctccgctggctcttgcactggccgctcgagaacgagctctggcaagtcaggctccctctaggtcaccaactccggttcactctcctgatgcagaccggccaggaccactttttgtagatgtgcaggccagggaccccgagagaggtagcctggctagtccggctttttccccacggagtcccgcatggatccctgtgccagctcggagggaagctgaaaaagtgccccgtgaggagcgcaagagtccagaagacaagaagagtatgattctcagcgtgcttgacacttcgctccaacgcccagccggactgatcgtggtccatgccactagcaatggccaggaacccagcagactggggggtgctgaggaggaacgacctggcactcctgaattagcgccagctcccatgcagtcagctgccgtcgctgagccccttccctcccccagggcgcagccacccggagggacccccgcagatgctggtcccggacaggggtcttcagaggaagagcctgagctcgtatttgccgttaatctacctccagcccagctcagctcttcagatgaggaaaccagggaagagctcgcgagaatcggcttggtgccgcctcccgaggaattcgcaaatggcgtgctgctcgccacgcctctggcagggcctggcccttcaccgacaacagtgcctagtcccgcatccggtaaacccagctctgagccgccaccagcaccggagagcgcagccgactccggcgtagaagaggctgataccaggtcatccagcgacccacatctggaaacaacctctaccatctccaccgtatcctcgatgtctactttgtctagcgaaagcggcgagctgactgacacccatacttcgtttgcagatggtcacacgtttctactcgaaaagccgcctgtcccaccaaagccaaagctgaaaagcccactgggcaagggcccagtgacatttcgcgacccgttgctgaaacagagctctgattcagaacttatggctcagcaacaccatgccgcatccgccggactcgcctccgccgctggtccagcccgtcctcgctacctgtttcaaaggcggtccaagctgtggggcgatcctgtggagtctcgcggtctgcccggaccagaagacgacaaaccaactgttatttccgagctgtccagccgactgcagcaactgaacaaggacacccggagcttgggagaggaacctgtagggggtctcgggtccctgctggatccggcaaagaagagccctatagccgctgcaagactgtttagttccctgggcgagctcagtagcatttccgcccagcggtccccagggggtcctggtgggggagcctcctactctgtcaggccctccggtcggtatccagtcgcaagacgcgcaccctcgccggtgaagcctgcctccctggaaagagtggaaggactcggcgctggagccggtggggcaggacggcctttcggtcttacaccacccaccatcctcaagagttcttctctgagtattccccacgaacccaaggaggtgaggttcgtggtgcgcagcgtaagtgccagatccaggagtccctccccttccccccttccatctccggcttcagggccaggcccaggcgcaccgggaccgaggagaccctttcagcagaaacctcttcagttgtggtcaaaatttgacgtcggtgactggctcgaatctatccacttgggtgaacatagagaccggtttgaggaccacgagatcgagggtgcccacttgccggctctcacgaaggacgatttcgtggagttaggtgtgacaagagtgggccacaggatgaacatcgaacgggcactgagacagctcgacggctcctag

SEQ ID NO: 240347 - DNA, 5228 bp, Artificial Sequence
  Description of Artificial Sequence: Synthetic coding sequence
atggatgggccaggggcatcggcagtggtggtcagggtcgggatcccagatctacagcaaacaaaatgcctcagattagatcctgccgcaccggtttgggccgcaaagcagcgggtcttatgcgccttgaaccactctttgcaggacgctctgaactatggattattccagcctccttcccgtggcagagccggaaagttcctggatgaggaaaggctgctccaagagtaccccccaaaccttgacaccccactgccgtacttagagtttcggtacaagcgcagagtttacgctcagaaccttatcgatgataagcagtttgcaaaacttcatacaaaggcgaaccttaagaagtttatggactacgtccagcttcattccactgataaggtagcccgtcttctcgataagggcctggacccgaatttccatgatccagatagcggtgagtgcccactcagcttggcagcgcagttggataatgcgactgacctgctgaaggtgttgaagaatggcggtgcccatctggattttcgaacaagggatggtttaacagccgtgcattgcgccacccgccaaaggaacgctgccgcattgaccacgctcttggacttgggagcgtcccccgactataaagattcccggggtttaacacctttgtatcattctgctctgggcggtggcgacgctctgtgctgtgagcttcttctgcatgaccatgctcagttaggcatcaccgacgaaaacggctggcaggaaatacatcaggcatgtcggttcgggcatgtgcagcacttagagcatctgctgttctatggcgcagacatgggtgctcagaatgccagcggcaatacggccttacacatatgcgctctctacaaccaggagagttgcgctagagttctgctgttccggggtgccaaccgggatgtgaggaactacaattcccagacagcttttcaagtggcgatcatcgccggaaattttgaactggcagaagtaattaaaacacataaagactccgatgtggtgccctttagggagactccttcatatgctaagcggcgaagactcgcaggcccatcagggctggcgtctccacgaccactgcagcggtcggcatcggatattaacttgaaaggggaagctcagcctgctgctagcccaggcccttctttgaggagtctgccccaccagctcctcctccagagattgcaagaggaaaaggacagagaccgcgatgcagaccaggagtccaatatttccgggccactagccggaagggcgggacagagcaaaatcagcgagcctggagctcctcgaagctgtataaggattagagctcggttcccagcgccacctgcccctcccgctccaccaccgagaggtcctaaacgaaaactgtacagtgctgtgcccggtcgtaaattcatagcagtaaaggcacattctccccagggagagggggaaattccgttgcaccgaggggaagctgttaaagtcctttcaattggtgaaggcggattttgggaaggcaccgttaaaggaagaacaggttggttcccggcagactgcgttgaggaggtgcagatgcggcagcacgacactcggcctgaaacccgcgaggaccggaccaagcgacttttcaggcactacaccgtgggaagctacgacagcctcacatcgcactccgattacgtgattgacgataaggtggccgtgctgcagaaaagagaccacgaaggttttggattcgtcctcaggggagctaaagctgaaacacccattgaggagttcactcccacgccagccttccccgctctccaatatctcgaaagcgtcgacgttgaaggagtcgcatggagggcagggttgcggaccggagatttcctgattgaggtcaatggcgtgaatgtcgtgaaagttggacacaagcaggtggtcgctctgatcaggcagggcggtaatcgcctggtgatgaaagttgtgtctgttacaaggaagccagaggaggacggcgcaaggagaagagccccacccccaccgaagcgggcaccttctactactctgacactcaggtccaagagtatgacggctgagttggaggagctgggggagtggagggggagggaagggagcgaaaaactcgatgaaatgttagccgctgccgctgagcccacccttaggcccgacattgcggacgctgatagccgggcagctaccgtgaaacagaggccaaccagccgtcgcattactcccgctgagatatcaagtttgttcgaaagacaggggttgccgggacccgagaagctgcctggatccctgcgtaaaggcattccgagaactaaaagcgtgggagaagatgagaaactcgctagcctcctggaagggaggttccccagaagtacgtcaatgcaggatccggtccgagaagggagaggtattccaccaccgccacaaactgcccctccaccccctcccgcaccctattacttcgactcgggaccgcctcctgccttctcccctcctcccccaccaggtcgtgcatacgacaccgtgagatccagcttcaaaccgggactggaggctcgacttggggctggggcagctggcctctatgagcccggagccgctctcgggccactcccctatcctgagcgacagaaacgagctaggagcatgattatattacaggactccgctcctgaatcaggggatgcaccgaggcccccacccgcagctactcctcctgagagaccaaaacgcaggccaaggccaccagggcctgactcaccctacgcaaatctcggcgcatttagcgcctcattgttcgcacctagtaaaccacagcggaggaaaagcccactcgtgaagcagttgcaggtggaggatgcacaggaaagagctgcactcgcggtgggctcccctggtcctgggggaggctcctttgcaagagaacctagtcccacccataggggccctaggcccggaggactcgattacggtgctggagacggtcctggcctggcttttgggggaccgggtcctgctaaagataggcggctggaggaacggagacgctcaaccgtctttctgtccgtcggcgctatagaaggttctgcacctggcgctgacttgcccagcctgcagccttcccggtctatcgacgagaggcttttgggaacaggcccaacagccggaagagaccttctgctgccctcaccagtgtccgccctcaagcccctggttagcgggccttccttaggcccttcaggatccaccttcatacacccattgaccgggaagcccctggaccccagctcccccctcgcactggctctcgcagcacgtgaaagagcgctggccagccaggccccatcacggtctcctacccccgtccactctccagacgcagacagaccaggcccactgttcgtggacgtgcaggccagagatcctgaacggggttcactggcctcacctgcttttagcccacgctctcccgcatggataccagtgccggctcgtagggaggccgagaaagtgccacgcgaagagagaaaatcccccgaggataagaaaagcatgatcctctccgttttagacaccagcctccagcgccctgcaggcctcattgttgttcacgcgacatcaaacggtcaggagccaagccgactgggtggcgctgaggaagagaggccaggaactcctgagctggcccctgcccctatgcaatccgccgctgtggctgagcccctgccctctccccgagcccaaccgcctggtggcactccagccgacgccggacctggtcaagggtcttctgaagaagagccagaattggtgtttgctgtcaacttgccgcctgcccaattatcaagtagcgacgaggaaaccagagaggagctcgctaggatcggcctggtgccacccccagaagagttcgctaacggcgtcctcctcgccacacctttagcaggacctggtccctcccctaccacagtgccgtcccctgcatctggcaaaccatcctcagaaccaccccctgctcccgagagcgccgcagactccggcgtggaagaagcagacacgcgcagttcaagcgatccccaccttgagacaacatctactatctcaacagtctcaagcatgtcaactctgtcctctgaatcgggtgagctcaccgacactcatacaagcttcgccgacggccataccttcctgctggaaaaaccccctgtacccccaaagcctaagctcaagtcccctctgggaaaaggcccagtcacgtttcgcgatcctttgctgaagcagtcttctgactcagaactcatggcacaacaacaccatgccgcttctgccggtctcgctagtgctgcgggacccgcacgtcccagatatctctttcaacgccgaagtaagctatggggcgaccccgtggaaagtaggggtctgcctggccctgaagacgacaagcctactgttatttctgagctgtcatcccggctgcagcagcttaataaggacaccaggtcattgggcgaggaaccagtggggggactgggttccctactggatccagcaaagaaatctcctattgcggctgctagatgccgtagccctatggtgggactccggcttttctcgagcttgggcgagctctcctcaatctccgctcagcgaagcccagggggacctggtgggggagctagttactcagtgaggccctcaggacgataccctgtcgccaggcgagccccaagtcctgttaaaccagcgagcctcgaaagggtggaaggtctgggcgctggcgcaggaggcgctgggagaccatttggcctaactccgccaacgattctgaagtcctccagtttgagcattcctcacgagcccaaggaggtacgcttcgttgtccggagcgtgtccgctaggtctagatctcctagcccttcgcctcttcctagtccggctagcgggcctgggccaggagcccctggcccacggcgtcctttccagcagaagcctttacagctctggagtaaatttgatgttggcgactggctggagagcatccacctaggagagcatcgagacaggtttgaagatcatgagatagaaggcgctcatcttcctgcactaacaaaggacgacttcgtagaattgggcgttactagggttggccacaggatgaacatcgagagggcacttcggcaactggacggctccta

SEQ ID NO: 240348 - DNA, 2736 bp, Artificial Sequence
  Description of Artificial Sequence: Synthetic coding sequence
atgcctcccaggcggtctatcgtggaagttaaagtgctcgatgtgcaaaaacggcgtgttcccaataagcactacgtgtatatcattagagtaacctggtcctctggctccaccgaggctatctacaggcggtatagtaagtttttcgatctgcaaatgcagatgttggacaagtttcctatggaagggggacagaaggatcccaagcaaaggatcattccttttctccctggtaagatcctgttcaggcggtctcacatcagggatgtggctgtaaaaaggctgatcccgattgacgagtactgtaaggcgcttattcaattgcctccttatatcagccaatgcgatgaggtgctacagttcttcgagaccaggccagaggacttaaacccgcctaaagaagaacacattgggaaaaagaagtccggtggggatcagacctctgtggaccctatggttttagaacagtacgtagtcgtcgccaattaccagaaacaagagagtagcgagatttcactgagtgtggggcaggttgtggatattatcgagaagaacgagtccggctggtggtttgtgagtactgcagaagagcaaggttgggtgcctgccacgtgtttggagggccaagacggagtacaggatgagttctctttacagcctgaggaagaggaaaaatacactgtgatctacccatacactgcaagagaccaggatgaaatgaatctcgaaaggggcgcagtggttgaggtcattcaaaaaaacctagagggatggtggaaaatccgttaccagggaaaagaaggttgggctcctgcatcatatctgaagaaaaactctggagagcctctgcctccaaagccaggccctggtagcccctcccatccgggagcacttgatctcgatggagtttccaggcaacagaatgctgtgggtagggaaaaggaactgttgtccagtcaaagggacggaagatttgaggggcgaccagtccccgatggggacgcaaaacagcgaagtcctaaaatgagacagcgtccgccacctcgcagagatatgactatccctagagggctgaaccttccaaagccccctatacctccccaggtggaagaggaatattacactatagccgagtttcagaccactattcctgacggcatctctttccaggcgggacttaaggtcgaagtcatagaaaagaacctcagcggttggtggtatatccagatagaagataaggaaggctgggccccagccacctttattgataagtacaaaaagacttcaaacgcctcacgccctaactttctggccccactaccccatgaggtgactcagctccgtttaggtgaagcggcagcgctggagaacaacactgggagtgaggccaccggacccagcaggcccctcccggacgccccacatggagtgatggacagcgggctgccctggtccaaggactggaaaggcagcaaagacgtgctgaggaaggcctccagtgacatgagcgccagtgccggttatgaggagatcagcgaccccgatatggaagaaaagccttctcttcctcctcggaaagagagtattatcaagagtgagggcgaactgctcgagagggagcgagaacgacagcggaccgagcaactgaggggcccaaccccgaagccgccaggtgtcatactgcctatgatgcccgcaaagcatatccctcctgctagagactcccgtaggcccgaaccaaaaccagacaagtcacgcctcttccaacttaaaaacgacatgggactggaatgtgggcataaagtgctggcaaaggaagtgaaaaaacctaacctgaggccaatatcaaaatctaaaaccgatctgcccgaggagaagccggacgcgaccccccagaacccctttttgaagagccggccacaagtcaggcccaagccagctcccagtccaaagacagaaccacctcagggagaggaccaggtggatatctgcaatctgcgctccaagttgagaccggctaaatcacaggacaaaagcctcctggacggtgagggccctcaggctgttggaggacaagacgtggcattttcacgcagtttcttgcccggtgaagggccagggcgtgcgcaggatcgcactggcaaacaggacggcctgagccccaaggagataagttgcagagccccacccaggcctgccaagacaacagatcccgtgagtaaatcggtccccgtcccactccaggaagcccctcagcagcgacctgtggtgcctccaaggagaccgccaccaccaaagaaaacttccagcagtagtcgcccactcccagaagtgagaggaccacaatgcgagggtcatgagagtagggcggcaccgacgccgggaagggcactcctcgttcccccaaaggccaagccctttctgtcaaattccttgggtggccaggatgatactagggggaaggggagcctcggaccctggggtaccggaaaaattggggagaatagagaaaaagcggctgcagctagtgttcccaatgcggatggcttgaaggattctctatatgttgccgtcgcagacttcgagggcgacaaagatacctcgtcctttcaggaaggaaccgtattcgaggttcgagagaagaactccagtggctggtggttctgccaggtgctttctggtgcacctagctgggagggctggattccttctaattacctcagaaagaaaccatag

SEQ ID NO: 240349 - DNA, 2805 bp, Artificial Sequence
  Description of Artificial Sequence: Synthetic coding sequence
atggaagaaatttggaaattttcaacatacttgaaccttggatacgtctcaatgtgtctggagcatctcctctttgatcataagtactggctgaattgcatattagtggaagacaccgaaatacaggtgagtgtggacgacaaacatctcgagacaatatacctgggccttctcatccaggaagggcatttcttttgtcgcgcactctgttcagtgacgcctcccgctgagaaggaaggagaatgcctgactctgtgtaaaaacgaacttatctctgtgaaaatggccgaagccggtagtgaactagagggcgtcagcctcgtgaccggtcagcggggattggttctggtttccgcactggagccactgcctctgccatttcatcagtggtttttgaaaaattatcctggcagttgcggattatcacggaaaagagattggacaggctcctaccaaatcggtaggggcagatgtaaagccctcactggctatgaacctggcgagaaagacgaattgaacttctatcagggagaaagtatagagatcataggatttgtaatccctggcctgcagtggttcataggcaagtcaaccagcagcgggcaggtcggtttcgtgcccacccggaatatagacccagacagttattcccccatgtccagaaactcggcctttctctctgacgaggagagatgtagtctcctggccctgggctccgacaagcagaccgaatgctcttctttcctacatacattggctaggaccgatattacatcagtgtacagactcagcggctttgaatcaatacaaaaccccccaaacgacctgagcgcaagccaacccgagggctttaaggaggtcagaccgggacgcgcatgggaggagcatcaggccgtgggttcccgacagtccagtagttcagaggactcttctttggaagaagagttgttatccgccacaagcgattcctaccgcttacctgagccagatgatctggatgatccggaacttctgatggacctcagtactggacaggaggaggaggcggaaaatttcgctccaatcctggcgttcctcgaccacgaagggtacgccgatcacttcaagagcctttatgactttagtttctcctttctgacgtccagcttttattctttcagcgaggaagatgagtttgtggcttacttggaggctagtaggaaatgggcaaagaaatctcatatgacgtgggcgcatgctcgcttatgttttctgctcggcaggctgtctatcaggaaggtcaagcttagccaagctcgcgtgtactttgaagaagcgattcacatcctgaatggtgcattcgaagacctgtctctggtagccaccctttatataaacctggccgcaatctacctcaagcagcgcctccggcacaagggtagcgccctcctcgagaaagccggtgccctcctggcctgtctgccagacagagagagctccgcaaagcacgagctggatgtcgtcgcctacgtcttacggcagggaatcgttgttggttcctcccccctggaggctagagcctgctttctggccattcgcctgctgttgtccctggggaggcacgaggaggtactcccctttgctgagaggctccagttgcttagtggccaccccccagcctcggaagccgtggcatccgtcctgtcctttttatatgataagaagtaccttccccacctggccgtcgcttctgtacaacagcatggcatccaaagcgcacaggggatgtccctgcctatctggcaggtgcatctggttcttcagaatactacaaagctgctcggatttcctagtcccggttggggtgaggtgagcgccctggcttgccctatgctgaggcaggctctggctgcctgcgaggaactggcagataggagcacccagcgagctctgtgtttgatcctcagtaaagtatacctcgagcatagaagcccggatggcgctattcactatctgagtcaggcccttgtgctgggccagctgctaggcgaacaggaatcatttgagtcctccctgtgtctggcgtgggcgtatttgctcgcttctcaggctaagaaagctctagatgttctggagccactcctttgtagtctcaaggagactgagagtttaactcagcgtggtgtgatatacaatctgctgggcctggccttacagggcgagggtcgcgtaaaccgagcggctaaatcttacttacgggcacttaacagggcccaggaagtcggagatgtgcataatcaggcagtggctatggcaaatttggggcacctctccctgaagagctgggctcagcaccctgcccgaaactatttgctgcaagccgtgcgcctttactgcgagctgcaagcatctaaagagaccgacatggaactggtgcaggtattcttgtggttggcccaggttcttgtgagtggccatcagctgacacatgggttgctctgttacgaaatggccctgctgtttggcctgaggcatcgacatctgaagtccaagtacgtcccctgctgctgggaggctattgagaaatcagtcggctcctcatttatccatttcctatcacaggtgatatctttcatgagtctcctctgtgtccaggtgagtttcagacctcctaatccttcagccatctccacggcactgtgtccccagaccttacggcacgcttcacctacgatgtctacaggttggccatggctgtcgaactcaggaaccgggcgatggaaaggaggctgctggagtccctggggctcatttattggaacctag

SEQ ID NO: 240350 - DNA, 453 bp, Artificial Sequence
  Description of Artificial Sequence: Synthetic coding sequence
atgagcgagcagatgatgcagagcgtcggttgccgcatctctttatcagtcttccagttcctcggagaccagagacaggagctcgtggcttttcacaggcttgccactgtgtattattcattacatatgtacgagatggccgaggactgttacctgaaaacactcagcctctgtcccccttggctgcagagtcccaaagaggccctttattacgcgaaggtgtattataggcttggacgactgactttctgtcagctcaaggatgctcacgatgctacagaatattttctgctcgcccttgccgctgcagtgttattgggcgatgaagaactgcaggataccatccggtccagactggacaatatctgccagagcccgttgtggcatagccgcccatctggctgtagttctgagagggccaggtggctttctggaggcggactggccctttag

SEQ ID NO: 240351 - DNA, 3867 bp, Artificial Sequence
  Description of Artificial Sequence: Synthetic coding sequence
atgggaggatgcttctgtatacccagagagcgcagtttgacccggggaccgggaaaggagactccatccaaggatcccacagtgtcatccgaatgcatcgcctcgagcgagtacaaggagaaatgtttcctgccccagaatataaacccagaccttaccctgagcttttgcgttaagtctcgtagccggcgatgtgtaaacggcccattgcaggaggctgccaggaggcgcctctgggccctggagaatgaggaccaggaggtgcggatgctctttaaggatctgagtgcgagactggtctccatccagtcacagagagctcagtttcttataacttttaagacaatggaagaaatctggaagttttcaacatatctgaacctgggatacgtgagtatgtgccttgagcacttacttttcgaccacaagtactggctaaattgcatcttagtagaagatactgagatccaggtgagcgttgatgataagcatctcgaaactatttacctcggcctgctgatccaggaaggtcattttttttgtagggcgctatgctccgtgacccctccagcggaaaaagagggcgagtgcttaaccctctgcaaaaacgaattgattagcgtgaaaatggctgaagctgggtcagagctggagggtgtgtcactggttactgggcaaaggggactcgtgctcgtatcagctctggagccactccccctgccttttcaccagtggtttcttaaaaattacccaggatcctgcggtctgtcccgcaaaagggattggactggttcctatcagattggcaggggcagatgcaaggccctcaccggatacgagccaggggagaaggatgaattaaatttctaccaaggggagtccatcgaaataatcggctttgtgatacccggtctgcagtggtttataggaaagtctacctccagtggccaggtgggctttgtgccaacacggaatattgatcctgattcttatagtcccatgagcagaaactcggcctttttgagcgacgaggagcggtgctccttgttagctctggggtctgataaacagacagagtgtagcagtttccttcatacattggcacgaaccgatattacttctgtgtacagactgtcaggctttgagtcgattcagaatccaccaaatgacttgagcgcaagccagcctgaaggcttcaaggaggtccggccaggcagagcttgggaagagcaccaagcggtcgggagccggcagtcaagtagctcggaggactcctcgttggaagaggagctactaagcgccacaagcgattcataccggctcccggaaccagatgacctagatgacccagagctactgatggacctatccaccggccaagaggaggaggcagaaaactttgcccctatactggcctttctagatcatgagggctatgccgaccattttaaaagcttatacgacttttcttttagtttcctcactagctccttctacagtttttcagaagaagacgagtttgtcgcttacttggaggcctccagaaaatgggccaaaaaatcccacatgacttgggcccatgcgaggctgtgctttctgctcggtcgtctgagcatcagaaaagtgaagcttagccaggcaagagtctatttcgaggaggccattcatatcctaaatggagcattcgaggacctcagcctcgtcgctacactttacatcaatctggcagctatttatctgaaacagcggctgcggcataaaggaagcgcgctgctcgaaaaggccggagctcttctggcttgcctgcctgatcgggaatcttcagcaaagcatgagttggatgtagttgcatacgtgcttagacaggggattgtcgtcggctcttcgccgttagaagccagagcgtgctttctggccattcgtctgctcttatctcttggtcgacacgaggaagtcctgcccttcgccgaaaggctgcagctattatctggtcacccgcctgcctctgaggctgttgcctcagtgctgtccttcctgtacgacaaaaagtatcttccacacttggcggtggcctccgtccagcagcatggtattcagagcgctcagggaatgtctctgcctatctggcaagtccacttggtgctgcagaacaccacaaagttactcggatttccatccccaggctggggggaagtgtccgccctcgcctgtcctatgcttaggcaggccctggccgcttgtgaggaattagccgatcgaagcacccagcgggcactatgtctgatactctctaaggtgtatttagagcaccgcagcccagacggagctatccattatttaagccaagccctggtactgggccaactgctgggtgaacaagagagctttgaaagcagtctttgtctggcatgggcttacctgctggccagccaggccaaaaaggctctcgatgtgctggagccactgctctgttccctaaaggagactgagtccctcactcaacgcggagttatctacaatttgctggggctcgccttacagggcgaaggtagagtgaaccgggcagctaagagttacttaagagctctaaacagggctcaagaagtgggagacgttcacaaccaggccgttgcgatggctaatctgggccacctttcacttaaatcctgggcacaacaccccgcacggaactatctcctccaggccgtcaggctgtactgcgaattgcaggcttcaaaggaaacagatatggaattggtacaggtctttctgtggcttgcccaagtcctggtgtccggccatcagctgacacacggcctactttgttacgagatggctctattgtttggactgagacatcgacacctgaaatcacagctgcaagccaccaagagcctctgtcatttttatagcagcgtgtcacctaaccctgaagcatgtataacttaccatgaacactggttagccctagcccagcaattgcgcgatcgggaaatggaggggagactgcttgagtcattaggtcagctgtataggaacttaaataccgcccgatccctgcgcaggtctctcacctgtattaaggagagccttaggatcttcattgacttgggcgagacagacaaggcggctgaggcctggttaggtgcgggtcgattgcactacctgatgcaggaagacgagttagtggaactgtgcctgcaggccgcaattcagacggctctcaagtcagaggagcccctgctagccctaaagttatatgaagaagctggtgatgtcttcttcaacggcacccgtcaccgccaccacgccgtcgagtattaccgtgcgggagcagtgcccttggccaggcgcttaaaggctgtacggacagaacttaggatctttaataagctgaccgaactgcagatttctttggaagggtacgagaaggccctggagttcgccaccctcgccgcaagattaagcaccgtcactggggatcagaggcaggaactggtggccttccatcggctggcgactgtgtactatagcttacacatgtacgaaatggctgaagattgttacctgaaaactctaagcctttgcccaccgtggctacaatcacccaaagaggctctctactacgcaaaggtctactacaggctgggccgtttgacattttgccagctcaaggacgctcacgatgcaaccgaatacttcctactggcactggcagccgctgtgctgcttggtgacgaggagctgcaagacaccatccgttctcggttggacaatatttgtcagtcgccattgtggcacagccgaccgtccggctgttcttccgaacgcgctcggtggctgtccggagggggtctggctctctag

SEQ ID NO: 240352 - DNA, 2181 bp, Artificial Sequence
  Description of Artificial Sequence: Synthetic coding sequence
atggacctgagtacgggtcaggaggaggaagccgaaaatttcgctcctatcctcgctttcctggaccacgagggctatgcagaccacttcaagtccttatatgatttcagtttctccttcctcacctcctcgttctactcgttttcagaggaggacgaatttgtcgcctaccttgaggcgagccggaagtgggctaagaagtcccatatgacctgggcacacgccagactgtgttttctgcttggtcgtttgtcaattcgcaaggtgaagttgagccaggccagggtatactttgaagaagccattcatattcttaatggcgctttcgaggacttgagccttgtggcgaccctatacatcaacctggccgcaatctatctgaaacagcgactgcgccacaaagggtcagctctgctcgaaaaagccggtgctctcctggcttgccttccagatagggagtcctcagccaagcacgaattggacgtcgtggcctacgtattgcgccaaggcatcgttgtcggttccagccctctcgaagctagagcgtgctttctagcaatcaggctcttgctgtctctcggaagacacgaagaggtgcttcccttcgctgagcgccttcagctactctccgggcacccaccagcctcggaggccgtggcatccgtgctcagcttcttgtatgataagaagtaccttccccatctggccgtggcaagcgttcaacaacacggcattcaatctgcccaggggatgagtctgcctatatggcaggtgcacctggtcctccagaacaccactaaactactcggattccccagccctggttggggcgaggtctccgcacttgcctgccctatgctcagacaggctctggcggcatgtgaagagctcgccgaccggtctacacaacgagccctgtgcttaatcttaagtaaggtttaccttgagcacaggagtccagatggcgcaatccactacctatctcaggcgttagttctgggccaactcttgggggagcaggagtctttcgaatcatcactgtgtctggcctgggcctacctgctcgcatctcaagcaaagaaggccctggacgtactcgagccactgctgtgctccttgaaggagacagaaagccttacacagcggggagttatctataacctacttggcctcgccctccagggggagggacgtgttaaccgggctgcaaaaagttatttgagggctctgaatagggctcaagaggtaggcgacgttcataatcaagcggtggcgatggctaacttagggcatttaagtctaaagagctgggctcaacaccccgctcgcaattatctgctgcaggctgtccgattgtactgtgaacttcaagcgagcaaagaaactgacatggaactggtgcaggtgttcctgtggttggcccaagtccttgtcagtgggcatcaactcacacatggtctgctctgctacgagatggccctcctgtttgggcttagacatagacaccttaaaagccaattgcaggctacaaagagtttgtgtcatttctattcgtctgtgagtcctaatccggaggcctgcattacataccatgaacattggctcgctcttgctcagcagctccgcgaccgggaaatggaaggaagactcttagagtcactaggtcagctgtaccgcaatctgaatacggccagatctcttcggagatcactaacctgtattaaagaaagcctgcgcatcttcatcgatttaggcgagactgacaaagccgcagaggcttggctaggcgcaggcagactgcattacttgatgcaagaggacgaactcgtcgagctctgcctgcaggccgcaattcagaccgccctgaagtctgaggaacccctcctcgctctcaagctgtacgaggaggccggagatgtattcttcaacggcacccgtcatagacaccatgcagtagaatactatcgcgctggtgccgtacccctcgccagaagactgaaagcagtacgaaccgaacttaggattttcaacaaactgacagagctacagattagtttagagggctatgaaaaggccctagagtttgcaacgctcgccgcaagacttagcactgtgacagaggcccgagccggaggcctatcacctcccggatacagcgtcctgctgcctgctcacgtgtag

SEQ ID NO: 240353 - DNA, 720 bp, Artificial Sequence
  Description of Artificial Sequence: Synthetic coding sequence
atgccactcctccttctcggggagacagagccccttaagttagagagggattgcaggagtcccgtggacccctgggccgcagccagccccgacctggccctggcctgcctctgccattgccaggacctcagctctggggctttccccgataggggcgttttgggtggcgtgctgtttcctaccgtcgagatggtcataaaggtgttcgttgccacgtcctctgggtccattgccatacgcaagaagcaacaggaggtggtgggcttcctggaagcaaacaagatcgattttaaggagcttgacatagcgggtgatgaggataatagaagatggatgcgagagaatgtgcccggagagaagaagccacagaacgggatacccctgccaccccagatctttaatgaggaacagtattgtggcgatttcgatagctttttctcagccaaggaagagaatatcatatattcctttcttgggctggcccctccccctgatagtaagggtagcgagaaggccgaggagggaggtgagacggaagcccagaaagagggctcagaagatgttggtaacctgcctgaggcccaagagaaaaacgaggaggagggagaaaccgctaccgaggagacagaggaaatcgccatggagggggctgaaggcgaggccgaagaggaagaggagacagccgaaggggaggagccgggtgaagatgaagatagttag

SEQ ID NO: 240354 - DNA, 387 bp, Artificial Sequence
  Description of Artificial Sequence: Synthetic coding sequence
atgcgtgagaacgttcccggtgaaaaaaaaccacagaacggaattcccttgccccctcagatcttcaatgaggaacaatactgcggggacttcgattcattcttcagtgcaaaagaagagaacattatttacagctttttggggctcgccccaccacctgattccaaaggttctgaaaaggctgaggagggcggagaaacagaagcccaaaaagagggaagcgaggacgtcgggaatctccctgaagcccaggagaagaatgaggaggaaggcgaaaccgccacagaggaaacggaagagatcgcaatggagggcgctgaaggcgaggctgaggaggaggaggagacagccgaaggcgaagagcctggagaggatgaagattcctag

SEQ ID NO: 240355 - DNA, 387 bp, Artificial Sequence
  Description of Artificial Sequence: Synthetic coding sequence
atgagagagaatgtgccgggtgagaagaaacctcaaaacggtatcccgctgccacctcagatctttaatgaggaacagtattgtggggatttcgacagttttttcagtgctaaagaggaaaacattatttactcttttctaggattggcccctccccctgattccaaaggcagtgagaaagccgaggagggaggcgaaactgaggctcagaaagaaggttcggaggatgtgggaaacctgcctgaagcccaggagaaaaatgaggaggaaggagagacagccaccgaggaaacagaagagatagccatggagggcgctgagggtgaggccgaagaggaagaggagacggctgaaggtgaagagcctggcgaggacgaggacagctag

SEQ ID NO: 240356 - DNA, 387 bp, Artificial Sequence
  Description of Artificial Sequence: Synthetic coding sequence
atgagggaaaacgtcccaggagagaagaaaccacagaacggcatacctctgcctccgcagatctttaacgaggaacagtattgtggcgactttgatagcttcttttcggctaaagaagagaatatcatctattcctttctgggattagcccctccccctgactcgaaagggtctgagaaagctgaagaaggaggggagactgaggcacagaaagagggcagtgaggatgtgggaaacctgccagaagcccaggaaaaaaatgaagaagagggagaaactgcgacagaggagacagaggagatcgctatggagggtgctgagggtgaggctgaagaggaggaggagaccgctgaaggcgaagagcctggcgaggatgaagattcttag

SEQ ID NO: 240357 - DNA, 321 bp, Artificial Sequence
  Description of Artificial Sequence: Synthetic coding sequence
atgcgcgaaaacgttccaggcgaaaagaaaccacagaatggtattccacttccaccgcagatctttaatgaggagcaatattgcggcgactttgactcctttttttctgcgaaagaagagaacataatctatagcttccttgggcttgcacctcccccagattccaaggggtcggaaaaggccgaggaaggcggagagaccgaggcccagaaagaaggaagtgaggacgtcggtaacctgcccgaggcccaggaaaaaaatgaggaagagggcgagacggcaaccgaagaaaccgaagaaattgccatggagggagcttag

SEQ ID NO: 240358 - DNA, 2373 bp, Artificial Sequence
  Description of Artificial Sequence: Synthetic coding sequence
atgaacataatgaatacagaacaaagtcagaacagtatcgtttccaggattaaagtgtttgagggccagacaaacatcgaaacatctgggttacctaagaaaccagaaataactccccgatcactgccccctaagccaacagtctcaagtggaaagccctccgtggcccctaaacctgccgcaaatagggcgtcaggagagtgggacagcgggaccgaaaaccgactgaaagttacatcaaaggagggactcacaccctatcctccacttcaggaagcaggctcgataccggtgaccaagccagagctgccgaagaaacccaatcctggtctcattcgctcagttaatccagagatccccggacgaggtcccctagccgagagctccgatagcgggaagaaagtccctacccccgcaccacggcctttgctcctgaagaagtctgtctcctcggagaaccccacctatccgtcggctccgctgaagccagtcaccgtgcccccacgattagctggcgctagccaagcaaaggcctacaaatcactgggagagggtcctcccgctaaccctccggtccctgttctccagtcaaagcccctggtggatatcgacttgatctctttcgatgatgacgtgctgcccactcctagtgggaacctggctgaagagtccgttggcagcgagatggtgctggacccatttcagctacctgctaagaccgaaccaatcaaagaacgtgcagtccagcctgcgccaacgaggaaacccacagtgattaggattccagccaagcctggcaaatgtcttcacgaagacccacagagtcccccacccctgccagcggaaaaacctatcgggaacaccttttcaacagtgagcgggaagctgtcaaacgtggagcgtacaaggaatctcgaatcaaatcatccaggtcagactggaggattcgtccgggtcccgcctcgtctgccaccacggccagtgaacggtaagaccatccccacccagcagcctcctacgaaggtgccacctgagaggcccccacccccaaagctttctgccaccagacgatctaacaagaaattgcccttcaataggagctctagcgacatggacctgcagaaaaagcaaagcaatttagccacaggtctatccaaggcgaagtcccaagttttcaagaaccaagatcctgttctgccaccacggccaaaacctggccatccattatattcaaaatacatgctgagcgtaccacatggaatagctaatgaggacatcgtaagtcagaatccaggggagctgagctgtaagcgtggggatgtgctggtgatgcttaagcaaacggagaacaattatctggagtgtcagaagggagaggacacaggcagagtgcacctgtcacaaatgaaaattattacacccctggacgagcatttgagaagccgtccaaatgacccctcacatgcccagaagccggttgactccggtgctccccacgcagttgttctgcatgatttcccagcagagcaggtagacgaccttaacctcacgagcggggaaatcgtgtatctcctggaaaagatcgacaccgactggtacaggggtaattgtagaaatcagatcggaatctttcctgctaactacgtcaaagtcataatcgatatcccagagggcggaaacggaaagagggagtgcgtttcttcccattgtgtcaaggggtcccggtgcgtggcccgatttgagtatatcggggagcagaaggacgagctctccttttccgagggggagataatcatcctgaaggaatacgtcaacgaggaatgggctcggggtgaggtccgcggaaggaccggcatttttccgctcaacttcgtcgaacccgtggaagattatccaacatcaggagctaacgtactaagtaccaaagtgcccctcaagaccaagaaggaagactccggcagcaactctcaggtgaacagcctccctgccgagtggtgtgaagctctgcactccttcactgccgagacatccgatgacctttccttcaagcggggagatagaatacagatcctcgaaagactggactcagactggtgtcggggacggcttcaggatcgggagggaatatttccggcagtgtttgtgaggccttgccccgcagaggccaagtccatgcttgcaatcgtgccgaaaggtcgcaaggctaaagccctgtatgacttccgaggggaaaacgaggacgagctctccttcaaagctggggacatcattaccgagcttgaatccgtcgacgatgactggatgtccggcgagcttatgggcaaatccggcatcttccctaaaaactacattcagttcctgcagataagctag

SEQ ID NO: 240359 - DNA, 2373 bp, Artificial Sequence
  Description of Artificial Sequence: Synthetic coding sequence
atgaatataatgaacactgagcaaagtcagaattcgattgttagtcggattaaagttttcgaggggcagactaatatcgagacaagcggccttccgaagaaacccgaaatcaccccgagatcactcccaccaaaacccacagtgagtagcggaaagccttccgtggcacccaaacccgcagctaaccgggcttctggtgaatgggattctgggacagagaatcgcttaaaagttacgtcaaaggagggattgactccttacccccctcttcaggaggcgggaagcattcctgtgacaaaaccggagttgccaaagaagcctaacccaggccttatccgaagtgttaaccctgaaatccccggacggggacctctggccgagagctccgatagtggcaaaaaggtgcccacacccgcacctcgccctcttctgttgaagaagtctgtttcctcggaaaatccgacctaccccagcgcgccattgaaaccagtgacagtgcccccacgcctggcaggagcttcgcaggccaaagcgtacaaaagcctcggcgaggggcctcccgctaaccctccggtgccagttcttcaaagcaaacctctggtggatattgatttaatcagcttcgacgatgacgtacttccgactcctagtggaaatctggcagaggaaagtgtcggaagcgagatggtgctggatccattccaattgcccgctaaaactgagcccatcaaagaacgtgccgttcaacccgctccgactcggaagcctaccgtgatccgaatccccgctaagcctggtaaatgtctgcatgaagaccctcagtcacccccacccttgcctgcggaaaaacctataggaaataccttttccaccgtttccggcaagctgagtaacgttgagcggaccaggaacctcgagtccaatcaccctggccagactgggggattcgtgcgcgtccctccacgactaccccctagaccagttaatgggaaaacgattccaacacagcaacctccaaccaaagtgccgccagaaaggccccctcctcctaagttgtctgctacgagaaggagtaacaaaaaattgcccttcaaccgatcaagctccgatatggacttgcagaagaaacagtcaaaccttgccacagggctgtcaaaggctaaatcccaagttttcaagaatcaggaccccgtcctgccacccagacccaaacccggacatcccctttatagcaagtacatgctaagcgtgcctcacggtatcgccaacgaggatatcgtttcacagaacccaggggaactatcctgcaagaggggggatgttcttgtgatgctgaaacagacagaaaacaactacctggagtgccagaaaggtgaggatactgggagggtccacctgtctcaaatgaagattatcacacctttagacgagcatctgagatcccggcctaatgatccctcccacgctcagaagccagtcgatagtggggctccccacgccgttgtcctccatgactttccagccgaacaggtggacgaccttaatctgaccagcggagaaattgtgtacttactggaaaagatcgacaccgactggtacagaggcaactgtaggaaccagattggaatcttccccgctaattacgtcaaggttataatcgatatccccgaaggcggtaacggaaagagggagtgcgtgagctctcattgcgtaaaaggaagccgctgcgtggcgaggttcgagtatatcggcgaacaaaaggacgaactgtccttctccgagggcgaaattattattctgaaagagtatgtaaacgaagaatgggctaggggagaggtgcgcggaagaacgggaatctttccgctgaactttgttgaaccagttgaagactaccctacctctggtgccaatgtactctccaccaaggttcctttgaagaccaaaaaggaagactctggttcgaacagccaggtcaacagtcttccagccgaatggtgtgaagcgttgcattctttcacagccgagactagcgacgatctctccttcaaaagaggtgaccgaattcagattctagagcgactggattccgactggtgtaggggacgactgcaggatagggagggcatcttcccagccgttttcgtcagaccttgccctgccgaggcaaagagtatgttggccattgtccctaagggccgtaaagccaaagccttatatgactttagaggggagaatgaggatgaactcagcttcaaagcgggagatattataacagagctggaatctgtggacgatgactggatgtccggggagctcatgggtaagtctggcatttttccaaaaaactatatccagtttttgcaaattagctag

SEQ ID NO: 240360 - DNA, 2304 bp, Artificial Sequence
  Description of Artificial Sequence: Synthetic coding sequence
atgaatattatgaacactgagcagtcccagaattccatcgtgtcccgaatcaaagtgttcgaaggccagactaacatagagacatcgggccttcccaagaagcccgagattacaccaaggtcgctccctccaaaaccgacagtgtcaagtggcaagccttcagtggctccaaagccagccgctaatagagcgagtggagagtgggacagcgggactgaaaaccggttgaaggtgacatccaaagaaggactgacaccttacccccctttgcaggaggccggatctatacccgtgaccaaaccagaacttcctaagaagcccaatcctgggttgatacgtagcgttaatcccgagatccctggacgtggccctctagccgaatcttctgactctggtaagaaggtacccacccccgctccgagacctctgctgctgaagaagtccgtgtcgagcgaaaacccaacgtacccttcagctcccctgaaacccgtcacagtccctcctcgactagccggagctagccaggctaaggcttataagtctctgggtgagggcccaccagctaacccacctgtgccagtcctccagagtaaacctctagtcgatattgacctgatcagcttcgacgacgatgttctccccaccccaagcggcaacctggcagaggagtctgtagggtcagagatggttctggacccattccaactaccagcaaaaacagagcctataaaagaaagggcagtgcagccagcaccaacccgcaagcccacggtgatccgcattccagccaagccaggcaagtgccttcacgaagacccgcagtccccacctcccctgcctgccgaaaagcctattgggaataccttcagtacggtgtctgggaagctgtctaacgttgagcgcacgagaaacctggaatcaaatcaccccggtcagacgggtggcttcgtcagagtcccacccaggctccctcccaggcccgtgaacggcaaaaccatcccaacacagcagccgccaaccaaggttccaccagaacggcctccaccacctaagctgtccgccactcgtcggtccaacaagaaactcccttttaacaggtcaagttctgacatggatcttcagaagaaacaaagcaatctcgcaaccggtctgtcaaaggccaagagccaggtttttaaaaaccaggaccccgtgctgccacctcggccaaagcctggccacccactctactccaagtatatgaggggcgatgtcttagttatgcttaagcagacggaaaataattacttagaatgccagaagggggaagataccggccgagtccatttatcgcaaatgaaaattattacgccactggatgagcacctgcgctctagaccaaatgacccctcacatgcccagaagccagtagattccggcgctcctcacgccgtagtgctccacgatttcccagcggagcaagtggatgacctcaatctgacttcaggggagatcgtgtacttactagagaagatcgatacagactggtaccgagggaactgtcggaatcagattggaatctttccagcaaattacgttaaggttatcattgatatccccgaaggtggcaatggcaaacgggagtgcgtgtctagtcattgcgtgaagggctctcgttgcgtggcacgtttcgaatatatcggcgagcagaaggacgagctatctttctcagagggggagataatcatcctgaaggagtacgtcaatgaggagtgggcgcgaggcgaggtgcgcggaaggactggaatttttcctctaaactttgtggagcctgtggaagattatccaaccagtggcgctaatgtactctcaaccaaggtgccattaaagaccaaaaaagaggattcaggttctaattcacaggttaatagcctgcccgctgaatggtgtgaggccctgcactccttcacggccgagacaagcgatgatctatcattcaaaaggggagaccggatacagatcctggagcgcttggattccgactggtgccggggacggttgcaagacagagaaggaatcttccccgctgtgtttgttcgcccatgtcccgctgaggccaagtcaatgctggccatcgtgccaaaaggtagaaaggccaaagctttgtacgacttccgcggtgaaaacgaggacgaattatcatttaaagccggtgacataataacagaacttgaatccgtcgatgatgattggatgtcaggcgagttgatgggaaagagcgggatcttccccaaaaattacatccagtttctccaaattagctag

SEQ ID NO: 240361 - DNA, 2196 bp, Artificial Sequence
  Description of Artificial Sequence: Synthetic coding sequence
atgaacattatgaatacagagcaaagccagaactcaattgtatctcgcattaaagtgttcgaggggcaaacaaatatagaaacttccggccttcctaagaaacccgagatcacacctaggagcttgccacccaaacctactgtttcatccgggaaaccatctgtagctcccaagcccgctgcaaacagggcctcaggagaatgggactccgggaccgaaaacaggttgaaggttacaagtaaggagggactgacgccataccctcccctccaggaagcaggaagcatcccagtcacaaaacccgaactgccaaagaaacctaatccaggacttatcagatctgtgaatccagagattccaggtagagggccactggccgagagttcagattcagggaaaaaagtccccacccccgcacctcgtcccctgctgctgaagaagtccgtgagcagcgagaatccaacctatccttcagctcctctgaaacccgtaacggtacctcctaggctggccggagcttcacaagctaaggcctataaaagccttggcgaggggcctcccgcaaacccccctgtgccagtgctccagtctaagccccttgtcgatatcgacttgatatcttttgatgacgatgtcctacctaccccaagtggtaacttagccgaggagagtgtaggtagcgaaatggtcctcggactgcacgaggacccacaaagcccaccacccctgcctgccgagaagcctattggcaacacatttagcacagtgtcaggcaagcttagcaatgtggagagaacgagaaacctcgagagcaaccacccaggccagactggcggttttgtgcgagtgccccctcggcttcccccacgacctgtgaacgggaagactatcccaacacaacaaccccctaccaaagtgcccccagagcgccctccccctccgaagctctccgcaacccggaggtctaacaagaagttaccctttaataggtcatcctccgacatggatctgcagaagaaacagtcaaacctggcgaccgggctatcaaaggccaagtcccaggtgttcaaaaaccaggaccctgtgttaccaccaaggcctaaaccaggccatccattatactcaaagtacatgcgaggggatgttctcgtcatgctgaagcagactgagaacaattatctggagtgtcagaaaggggaagacacaggcagggtgcacctctctcaaatgaagatcatcacgccgctggacgagcatctgcgcagtcggcctaacgatcccagtcatgcgcagaagcccgtggactcaggggctccccacgctgtcgtgctgcatgatttccctgcagaacaggtggatgacctcaatctgacttccggtgagatagtgtatctgctggagaaaatcgacacagactggtatcggggaaactgtaggaatcagattggcatctttcccgctaactacgtgaaagtcattatagatatccccgaaggcggaaatggtaaacgcgagtgcgtttctagtcattgtgtgaagggatcccgctgtgtggcaagattcgagtacatcggagagcaaaaagacgaactgagcttttccgaaggggagatcatcatcctgaaagagtacgtaaatgaggagtgggcccgaggtgaggttcggggacgaacaggaatctttccgctgaattttgtggagccggttgaggattatcctacatcaggggcaaatgtcctgagtactaaagtgccattaaagacaaagaaggaggattcaggaagcaactcacaggttaacagcttacctgcagaatggtgcgaggcactgcatagctttacagcagagacttcagatgacctgagtttcaaacggggagatcggatacagatcctggagagactggattccgactggtgtagaggaagactccaggaccgcgagggaatcttcccagccgtgttcgtcagaccctgtccagcggaggccaaatcaatgcttgcaatcgtgccaaagggacggaaagccaaagctctgtacgattttcgaggtgagaacgaggacgaactctcctttaaggctggcgacattatcactgaacttgagtctgtggacgacgattggatgtcaggagagctgatgggaaaatcaggaatttttcccaagaactacattcagtttctccagatatcctag

SEQ ID NO: 240362 - DNA, 2196 bp, Artificial Sequence
  Description of Artificial Sequence: Synthetic coding sequence
atgaatatcatgaatacagagcagagtcagaatagcatagttagtagaatcaaggtgtttgaggggcagacaaatattgaaacatctggtctgccgaagaagccggaaatcaccccccgttctcttcccccaaagcccaccgtgtcctctggaaaaccgtctgtggctccgaagccagcagcaaatagggccagcggcgaatgggactctgggacagagaatcgcctcaaggtcacttctaaggagggactgacgccgtaccctccgttgcaggaagcgggaagtataccagtcactaaaccggagttacctaagaagccaaatcctggtctcatcaggtcggtcaatccagaaattcctggaagggggccactggctgagagttcagacagtgggaagaaagtgcccactcccgctccaagaccgctgctcctaaaaaaaagcgtgtcaagtgaaaaccccacctacccttcggcgccactgaagcccgttacggtgcccccacgtctcgccggtgcctcccaggccaaagcttacaaaagcctgggcgaaggccctccggctaaccctcctgtcccagtgctgcagagcaaaccgctggtcgatattgacctcatcagcttcgacgacgacgtgcttcctacaccatctggcaacctggctgaggagagcgtgggatcggagatggtactcggactgcatgaggacccgcaatcacccccaccactgcctgccgaaaagcctattggtaacaccttctccaccgtttccgggaaactctccaatgtggagagaacacggaacctggagtccaatcacccaggccaaacaggcggattcgtccgggttcccccaaggttgcccccacgcccagtcaatggaaagaccatacctacacagcagccccctacaaaagtgccacccgagcgaccaccgcctccaaaattatcggccacaagacgaagtaataaaaagctcccattcaaccggagttcctctgacatggatctacagaagaagcaatcgaacttggccaccgggctgagcaaggccaaatctcaggtgtttaagaaccaggacccggtgcttcccccaaggccaaagcccggtcaccccctgtactccaagtacatgaggggggacgtgctggtaatgctgaagcagaccgagaataattaccttgagtgccaaaaaggcgaggacaccggtagagttcacctgagtcagatgaagatcatcactccactcgatgaacatttgagaagcagacccaacgatccctcccacgcccaaaaacctgtggactcaggtgcaccccatgctgtcgttctgcatgatttcccggctgaacaggttgacgacctgaacctgacttcaggtgagatcgtctatctactggagaaaatagacactgattggtacagagggaactgccggaaccagattggaattttccccgctaactacgtgaaagtcatcatcgatatcccggaggggggtaatggtaagcgcgaatgcgtgtcctcgcactgcgttaaaggttccagatgcgtcgccaggtttgaatatatcggtgagcagaaggacgagctgagcttttcggaaggagagattattatcctgaaagagtatgtcaacgaagagtgggcccgaggcgaggtcagaggacgtaccggcatcttcccactgaactttgttgaaccagtggaggattatccaacgtccggggctaacgtgttgagcacgaaagttcccctcaaaacaaaaaaggaggacagcggctccaatagtcaagtgaactcattgcccgctgagtggtgcgaggcacttcattctttcacagcagaaaccagcgacgatttgtctttcaaacgcggtgatagaatccaaatactcgagcgcctcgactccgactggtgtcgtgggagattacaggatcgggaggggatcttcccagccgtgttcgtacgcccttgtcccgcagaggccaagtctatgttggcaatcgttccgaagggtaggaaagccaaggccctatacgattttcgtggggaaaacgaggacgagctgtcctttaaggcgggtgatatcatcactgagctcgagagcgtggacgatgattggatgagtggagaactgatgggaaaaagtggcatatttcccaaaaattacatacaatttctacaaattagctag

SEQ ID NO: 240363 - DNA, 2304 bp, Artificial Sequence
  Description of Artificial Sequence: Synthetic coding sequence
atgaacatcatgaacactgaacagagtcagaattctatcgtctccaggatcaaagtcttcgagggccagactaatatcgaaacaagcggactgcctaagaaacccgagatcacgcccagatctcttcccccaaagcccactgtgagctctggaaaaccatccgtggctccaaagcccgctgccaatagggcctctggggaatgggatagcggcaccgagaatagattgaaagtcacgtccaaggaaggtctgaccccctatcctccgctgcaggaggctgggtccattccagttaccaagccagagttgcccaaaaaaccaaatcccggattgatccgttcagtgaaccctgagattccaggaagaggccctctggccgagtcttcggatagcgggaaaaaagtgccaacgcctgccccacgacccctgctgttgaagaagagcgtctcttccgaaaatcctacttacccttctgctcctttaaaacccgtaaccgtgccaccaagacttgccggagctagtcaagcgaaggcctacaaatcattgggggagggtcctccagctaatcctcctgtgcccgtgctgcaatccaaaccccttgtggacatcgacctaatttcctttgacgacgatgtattgcctactcctagcgggaacctagctgaggagtcagtggggtctgaaatggtcctggatccatttcaactgcccgcaaaaaccgagcctattaaggaacgagccgtgcagcccgctcctacaagaaagcccacagtgatacgaatccctgcaaagcctgggaagtgtctgcacgaggatcctcagagcccgcctcctcttccggctgagaagcccattgggaacactttctctaccgtctcaggtaagctgagtaatgtggagagaacacgaaacctggaatccaaccaccccggacagaccggaggctttgtgcgcgtgcctcctagactcccccctagacctgtaaatggaaaaacaatccctacacagcaaccacccacaaaagtccctccagagagaccccctccacctaagctgagtgctacaaggcgcagtaacaaaaagttgcccttcaacaggtcctcatccgacatggatttacagaaaaagcaaagcaaccttgcaacaggattatccaaggcaaagagccaagtgtttaaaaaccaagatccagtcctgcctccaaggccaaagcccggtcacccactgtattccaaatatatgcggggagacgtgctggtcatgctaaagcagacagaaaacaactatctggaatgtcaaaagggagaggacactgggcgagtacatctgagtcagatgaagatcatcaccccactcgacgagcaccttcggtcacgcccaaatgatccttctcacgcccagaaacccgtggatagcggggcaccacacgccgtagtacttcacgatttccctgccgagcaggttgacgaccttaacttgacctctggtgaaatagtctacctcctcgagaaaattgatactgattggtatcggggtaattgtcgaaatcaaataggaatattccctgccaattacgtgaaagttattatcgatatccctgaggggggaaatggtaagagagagtgcgtgtcatcgcactgcgttaaggggtctcggtgcgtagcgaggtttgagtacatcggggaacagaaggatgagctctcttttagcgaaggcgaaataattatcttaaaggagtacgtcaacgaagaatgggcaaggggggaagtacgaggcagaacgggaatctttccactgaattttgtggaaccggtggaagattatcctacttccggggctaacgtactgtcaaccaaggtccccctgaaaacgaagaaggaagatagcgggagcaacagccaagtgaatagtctccctgccgagtggtgcgaagcgttgcactcttttaccgccgagacttccgatgacttgtcattcaaacggggtgaccgaatccaaatcttagaacgccttgattcggattggtgccgcggtcgcctgcaggatcgggagggaatctttccggctgtgtttgtgcgcccatgtccggctgaagccaaaagcatgttggcaattgtgcccaagggacgcaaggcgaaggccctttatgactttcgcggagagaacgaggacgaattgtcgttcaaagccggagatataatcaccgagttggaatccgttgatgacgactggatgtcaggggagcttatgggcaaatccgggatctttccaaagaactatatccagttcctacagatttcctag

SEQ ID NO: 240364 - DNA, 2304 bp, Artificial Sequence
  Description of Artificial Sequence: Synthetic coding sequence
atgaacatcatgaacaccgaacaaagccagaactccatcgtgtccaggatcaaggtttttgaaggccagacgaatatcgaaacttctggcctcccaaagaagccggagatcactcccagaagcctcccaccgaaacctaccgttagcagcggaaaaccttctgtggctccaaagcccgctgccaacagggccagcggagaatgggactcaggcacagaaaaccgactaaaagtcactagtaaagagggcttaactccctaccctcccctgcaggaagcgggaagcattccggtcacgaagcccgagctacctaagaagcctaaccctggactcattaggagcgtcaatccggaaatccccggaagagggcctctggccgagtcatccgatagcggcaagaaagtcccaaccccggctcctcgtccgctgcttctgaagaaatccgtgtcttccgagaaccccacatacccttccgcgccactgaagcccgtcaccgttcctcctagactggctggcgcttcacaggctaaggcctataagtctcttggagaaggccctcccgcaaatccacccgttccagtgctgcagagcaaacccctagtcgatatagatctgatctccttcgacgatgacgttctgccgacaccctcaggtaacctcgccgaggagtctgtcggctctgaaatggtgctcgatcccttccaactgcctgctaagacggaacctatcaaagaaagagcagtacagcctgcccctacccggaaacccacagtgattagaatcccggctaagccgggaaaatgcctccatgaagatccacagtcgcctccaccgctgcctgcagagaaacctattggcaacactttttccacagtctccggtaagttgagtaatgtggagagaactcgtaatcttgaatccaaccatccaggacagacgggtggctttgtccgagtacctccccgactgcctcctaggccagtaaatggaaaaaccatcccaactcagcagccccctacaaaagtcccccctgagcggccaccgcctccgaaactaagtgccacacggaggagcaataagaagctaccttttaatagaagttcatctgacatggacctccaaaaaaagcagtctaatctcgccactggcctgtctaaggccaaatcccaagtgttcaaaaatcaggaccccgtgttgcccccacggcctaaaccgggacaccccctgtactcaaaatacatgcgaggagatgttctggttatgctgaaacagacagagaataattatcttgaatgtcagaaaggggaagatacaggacgcgttcacttgtcccagatgaaaatcattacccccctggacgagcacctcaggagccgccctaatgacccgtctcacgctcagaaaccagtggactctggcgcaccacatgcagtggtactgcacgactttccagcggaacaggtggacgacctgaacctgacttccggtgagattgtatacctcctggagaaaatcgatactgactggtacaggggcaattgtaggaaccaaatagggatctttcccgcaaactacgttaaagtgatcatcgatatcccagagggaggaaatggcaagcgtgagtgcgtgtcctcccattgcgtaaagggttctcgctgtgtcgcccgtttcgagtatataggggaacagaaagacgagctctccttcagcgagggcgagattattatactaaaggagtacgtgaatgaggagtgggctcgaggtgaggtgcggggtagaactggaatcttccccctgaattttgtcgagccagtcgaggattaccccacttccggggctaatgtgctgagcactaaagtcccattgaaaacaaagaaagaggacagtggaagcaactcacaggtaaactcactgccagctgaatggtgtgaagcgctacatagcttcaccgccgaaacctccgacgacctttccttcaagcgtggcgacagaattcagatactggaacgtctcgatagcgactggtgtcgcggacggctgcaggatcgggagggcatctttccagctgtattcgtccggccttgtccggctgaggcgaagagtatgctggcgatcgtcccgaagggcagaaaggccaaggctctttatgattttcggggtgagaatgaggacgaactgtcatttaaggccggtgacatcattacggagctggaatccgttgatgacgattggatgagtggagaactgatgggtaagagtgggatttttccaaaaaattacatccagttcctgcagatcagttag

SEQ ID NO: 240365 - DNA, 2190 bp, Artificial Sequence
  Description of Artificial Sequence: Synthetic coding sequence
atggacgatctgaccctgctggacttgctggagtgtcctgtctgctttgagaagctagacgtgacagccaaagtcctgccttgtcagcatacattctgtaaaccctgcctgcagcgggtgtttaaggcccacaaagagttgagatgtcccgaatgtcggacccctgtcttcagcaacattgaagctctccctgccaaccttttactcgttcggttgctggatggggtcagatcagggcagtcttcaggacgcggaggctcatttcggagacctggcaccatgacgctgcaggatggcaggaaatctagaacaaacccgagacgcctccaggcgtccccatttcgccttgtgccaaacgtgcggatccacatggacggagtgcctagagccaaagcactgtgtaactacagaggacagaacccgggagacctgcgattcaataagggtgatataattctgctcaggcgacaactggatgagaactggtaccagggcgaaattaacgggatttcgggcaacttccccgcatcctcggttgaagtaatcaagcaactgcctcagccgccaccgctatgtagggccctctataattttgacctgcgtggtaaagacaagtccgaaaaccaagattgtctcacatttctcaaagacgacattatcactgtcatctcgcgtgtcgatgaaaactgggccgaaggtaagttgggcgacaaggttggcatatttccaatcctttttgtggaacccaatttgaccgctcgtcacctcctggaaaagaacaaaggcaggcagagcagccgcactaagaatctctcattggtatcctccagctcccgcggtaacaccagcaccctgaggagaggccctggcagccgtcggaaagtgccgggacagttctcaatcacaaccgccctgaacacattgaacagaatggtgcacagcccctctgggagacacatggtggagatatccacccccgtgttaatttcttcctccaaccctagcgtgatcacccaacctatggaaaaagcagatgtgccttctagctgtgtgggacaagtctcgacttaccacccagccccagtgagtcctggtcacagcaccgccgtcgtctccctgcccggaagccagcagcacctgtctgctaatatgttcgtggccttacacagttactcagctcacgggccagacgagctggacctgcaaaaaggcgagggagtccgagtgcttggaaaatgtcaagatggatggctgagaggtgtttctctggtcacaggacgggtggggatcttccctaataactatgttatccccatttttcgtaagacctcatctttcccagattcacgcagcccagggctgtatacgacctggaccctgtcaacgtcgagtgtctcgagccagggcagcataagtgaaggtgatccacgacagtcccggcctttcaagtccgtgtttgttcctactgccattgtcaatccagttcgttcaacagccggacccggtacacttggccaggggtctctccgaaaggggaggagctccatgagaaagaacggatccctgcagcgcccacttcagtccgggatccccacgttagtagtgggatccctccggcgttcccctactatggtactgcggccacaacagtttcagttctatcagcctcagggcattccctcctctccttccgccgtcgttgtagagatgggctctaaacctgctttgaccggagagccagctcttacgtgtatcagccggggaagcgaagcctggatccacagtgctgcctcctcgctgattatggaggacaaagaaattcccatcaaatcagagccactgccgaagccacccgcttccgccccaccttccatactggtcaaacccgagaactctcgaaatggcatcgagaaacaggtgaagactgtccgctttcagaactacagcccccctcccactaagcactacacatcgcacccaacaagtggtaagcctgaacagcccgcaactctgaaggcaagccagcctgaagcagcctctctagggccagaaatgacagttctcttcgcccacagatctggctgccacagtggtcagcaaaccgatcttcggaggaagtccgctttgggcaaggccacaactctcgtgtccacggcttccgggacccaaacagtgtttccatctaagtag

SEQ ID NO: 240366 - DNA, 2190 bp, Artificial Sequence
  Description of Artificial Sequence: Synthetic coding sequence
atggacgacctcactctgctggatctgctcgagtgcccagtgtgcttcgagaagctcgacgtgacggccaaggtgcttccttgccaacatacattctgcaagccctgtcttcagcgggtgtttaaagcccacaaagagttacgttgcccagagtgccgtacacccgtcttctcgaatattgaggctttgccggcaaatttgctgctggtgaggctgctggacggagtgaggtccggacagagctcaggccgtggcggatcttttaggcgacccggaacaatgactctccaggatgggaggaagagtagaactaaccctcgaagactgcaggcatctccttttaggctggtacctaacgtgcgaatccacatggacggggtcccccgtgccaaggctctgtgtaactaccgaggacagaatccgggtgaccttagattcaataagggcgacatcatcctcctccggcgacagctcgatgaaaattggtaccaaggagaaattaacggcatctccggaaactttcccgcttcttctgtggaggtgatcaagcaactgccccagcccccaccattgtgtcgagcactttataacttcgatctgcgcggaaaggataaatctgagaaccaggactgcctgacattccttaaggacgatattattaccgtcatatctcgggttgatgagaattgggccgaggggaaattgggagataaagtgggaatcttccctatcctgtttgtcgaaccaaatctaacagccagacacctactggaaaagaataagggccgacagagctctaggaccaagaacctgagcttggtgagctcgagctcccgcggaaatacaagtactcttcgccgtgggccagggtcacggaggaaagtccccggtcagttttcaataaccactgcactgaatactctcaacagaatggtgcacagcccgagtggaagacacatggtagagatctcaacccctgtgctgatttcatccagcaacccctcggtaatcacccagccgatggagaaggccgatgtgccatcttcctgcgtgggacaggtgtctacctatcacccggctccagtttcacccggacacagtactgctgtagtgtcacttccgggatcccagcaacatctttcagctaacatgttcgtggccctgcactcctactcagcccacgggcctgatgagctcgacctgcagaagggggaaggggtcagggttctcggaaagtgccaagatggatggctgcggggagtgtcccttgtaacggggagagtcgggatctttcccaacaactacgtgatcccaatttttcggaaaacctcttcctttcccgattcccgctccccaggcctgtacacaacttggactctcagtacctctagtgtatcatcacaaggatctatttctgaaggcgacccccgacagtctcgtccttttaagagcgtgtttgtcccaaccgccattgtcaatcccgtccgctctaccgctgggccaggaaccctggggcagggcagcctccgaaaagggagatcaagcatgaggaagaacggttcccttcagcgaccgttacagtcaggtatcccaactctcgtcgtgggaagcctgcggagaagtcccactatggttttgagaccccagcagttccagttctatcaaccccaggggattccttctagcccatccgcagtggttgttgagatgggcagcaagcctgccctgacaggcgagccagcactgacctgcattagccggggatcagaagcatggatccattccgctgcgtcctccctgattatggaagataaggaaatccctatcaaaagcgaaccccttcctaagccccctgcctccgcacccccttcaatcctggtcaagcctgaaaacagccgcaatgggatcgaaaaacaggtgaaaacggttcgctttcagaactactctcctcccccaacgaagcactacacatcccacccaacatcggggaagcccgagcaaccagcaacgttaaaagcttcacagcctgaggctgcttcccttggcccagagatgactgtgctatttgcccacagaagcggctgccattccggtcagcagacagatctcagacgcaaaagcgcacttgggaaagcaactacgctggtatctactgcgtctggcactcagacagtctttccctctaagtag

SEQ ID NO: 240367 - DNA, 387 bp, Artificial Sequence
  Description of Artificial Sequence: Synthetic coding sequence
atggaagacaaggagatccctatcaaatctgagcctctccccaagcctcctgcctccgccccaccctctatcctggttaagcccgagaacagcagaaacggaatagaaaaacaagtgaagactgtacgctttcagaactatagccccccaccaacaaagcattatacctcccatcccaccagcggcaaacctgagcagcctgctactctaaaagccagtcagcccgaagccgcaagtctgggacctgagatgacggtgctgtttgcccaccggtccgggtgtcactctggccaacaaactgacttgagacgtaaatctgccctcggcaaggccactactcttgtgtcgaccgcttctggtactcagactgtgttcccttccaaatag

SEQ ID NO: 240368 - DNA, 1686 bp, Artificial Sequence
  Description of Artificial Sequence: Synthetic coding sequence
atggctgctgaagaaatgcactggccagtgcctatgaaggccatcggcgctcagaatctcctaactatgcctgggggagtggccaaggctggatacttgcacaagaagggcggaacgcagctgcaactccttaagtggcctcttcggttcgtaattatccataagcgctgtgtctactatttcaagtctagtacatcggcctcacctcaaggcgcattcagcctttcaggttacaacagggtgatgcgtgcagcggaagagactacatcaaataacgtgtttccgtttaaaatcatacatatatccaagaaacaccgtacttggttcttcagcgctagcagcgaggaggagcgtaagtcatggatggctctgctgagaagagaaatcggacacttccatgagaagaaggatctccccttggataccagtgattcgtctagcgacactgatagtttctacggcgcagtcgaacgtccagttgacatctctttgtctccttatcccactgataatgaggattatgagcatgacgatgaggacgacagctatctagagcccgacagcccagagcccggacgtctcgaagatgccctcatgcacccacctgcttatccacctccccctgtgccgacaccacggaaaccagccttttccgacatgccacgagcccattcttttaccagtaaaggcccaggtcctctgctcccccctccaccaccgaagcacggtttgcctgatgtaggactggccgcagaagatagtaagcgcgatcccctgtgtccccgaagagcggagccatgcccccgagtgccagctaccccacggaggatgtctgatcctccgttgtctacaatgcccacggcgcctggattgagaaagccgccatgctttagggaatccgcttccccctcccctgaaccatggaccccagggcatggggcttgcagtacatcttcggcagcaatcatggctaccgccactagtcgtaattgcgacaagctaaagtctttccatctgagcccaagaggtccgccaaccagcgaaccaccacccgtaccagccaataaacctaagttcctgaagatcgctgaggaagacccccctagggaggccgcaatgcctggactctttgtccctcccgtggcccctagacccccagccctcaaactgcctgttccagaagccatggctcggccagcggtgcttccacggcctgagaaaccccagctcccccatttgcagaggtcacctcccgacggacaaagttttcgaagcttttcttttgagaagcctaggcagccgtcacaagctgataccggcggagatgacagcgacgaggattatgagaaggtgccccttccaaattctgtcttcgtaaacaccaccgaaagctgcgaggtcgagagactgtttaaggctactagcccgaggggtgaaccccaggacggactgtactgcatccgcaattcttctaccaagagcggcaaggtgcttgtagtgtgggacgagacaagcaacaaagtgaggaactaccgcattttcgaaaaggattctaagttttacctggagggtgaggtactttttgttagcgtgggctcgatggttgagcactaccatacgcatgtcctaccttcccaccaatcactactcttaaggcatccatacggctacaccggacccaggtag

SEQ ID NO: 240369 - DNA, 294 bp, Artificial Sequence
  Description of Artificial Sequence: Synthetic coding sequence
atggcggcagaagagatgcattggcccgtgcctatgaaggccatcggggctcagaacctgttgaccatgcccggaggggtggctaaagccggataccttcacaagaagggaggcactcagctccaacttctgaagtggcctctaaggttcgtgatcattcacaaacgatgtgtgtactacttcaagagcagcacaagcgcatcaccgcagggggcattttcattgagcggatacaaccgccagcctcgccctcaaccagcgcaagctctctcacagactgaagcgggaccctag

SEQ ID NO: 240370 - DNA, 1686 bp, Artificial Sequence
  Description of Artificial Sequence: Synthetic coding sequence
atggctgccgaggaaatgcactggccagtgcccatgaaagctattggcgctcagaacctgctcaccatgcctggtggcgtggccaaggcgggatatctgcataagaagggtggtacgcagttacaattactcaagtggcccttacgcttcgttattattcacaagcgttgtgtgtattatttcaaaagctcaacgagtgccagtccgcagggcgcattttccttgtctggatataacagggtgatgcgcgctgcggaagagactacgagcaacaatgtgttcccttttaagattattcacatttcgaagaagcaccgcacgtggttctttagcgcgagctccgaggaggagagaaaatcatggatggccctcctccggagggagatcggacactttcacgagaagaaggatctgccattggatacatcagacagttctagcgataccgattcattctatggcgcagtggaacggcctgtggacatcagcctttccccataccctaccgacaacgaggattacgaacacgatgacgaggacgatagctatctggaaccagatagcccagagccaggacgacttgaggacgcactgatgcacccacctgcttatccgccaccaccagtccccacccccaggaaaccagcttttagcgatatgcctagggcgcactctttcacttccaagggcccagggccattactccccccaccccctccgaaacacgggttgcccgacgtgggtctagccgcagaggactcaaaaagagaccccctatgtcctaggcgggcagaaccttgccccagagtgccagccactcccagacggatgtccgacccgcctctttcaaccatgccgacagcgccagggttaagaaagccaccctgcttcagagaaagtgcgagtccgtcacccgagccgtggactcccggtcatggagcctgctccactagctccgctgccatcatggccaccgctacctccaggaattgcgacaagctgaaaagtttccatctgagcccacgaggaccgcctactagcgagcccccacctgtgccagccaacaaacctaagttcctgaagattgccgaggaagacccccctcgcgaggccgctatgcccggacttttcgtgcccccagttgccccaaggccccctgccctcaagctgccagtgccggaggcaatggcccgacctgccgtcctccccaggcctgaaaagccacagctacctcatctgcagagatctccaccagatggccagtctttccgcagtttttcatttgaaaagccacgacagcctagtcaggccgatacagggggagacgatagcgatgaggattatgaaaaggtcccacttcctaactcagtgtttgtgaacacgaccgaaagctgcgaggtggaaagattgtttaaggccacttcccccaggggggagccccaagacggattatactgtatccgaaattcatcaacaaaatcggggaaggtgctggttgtgtgggacgagacctccaacaaggttagaaactacaggatttttgaaaaggatagcaaattttatctggagggtgaggtcctgttcgtcagtgtggggtccatggtggagcattaccacactcacgtgctaccctcccaccagagcctcctgctgaggcatccctacggctataccgggcctaggtag

SEQ ID NO: 240371 - DNA, 1770 bp, Artificial Sequence
  Description of Artificial Sequence: Synthetic coding sequence
atggctagcctcggccctcgcacacctgcgccaagcagaagtaggggaaggcgcgctatgtgttgggtaagcacgatatcgttcatggctgccgaagagatgcattggccagttcccatgaaggctattggagcgcagaaccttttaaccatgccaggcggtgtggcaaaggctggctatttgcacaagaagggaggaacacagttgcagctcttgaagtggcccctccggttcgttattattcacaaaagatgcgtgtattatttcaagtcaagtacgtccgcgagtccacaaggcgctttctccttgagcggctacaatcgtgtcatgagagcggctgaagaaaccaccagcaacaatgtgttccccttcaagattattcacattagtaagaaacataggacatggtttttctctgcctctagcgaagaggagcgtaagtcttggatggctctgctccggagagaaattggacacttccacgaaaagaaagatctgcctttagatacttcagactcttcatcagatacagattctttttatggagcagtggagagaccggtcgacattagcttgagcccctaccctacagataacgaggactacgagcacgacgacgaggacgatagctatttggaacctgacagccctgaacctgggaggttggaggacgcactcatgcacccacccgcatacccaccgcctccagtgcctacaccccgaaaacccgcattctctgatatgcccagagctcactcctttactagcaaagggcctggtccgttactgccaccaccccctcctaaacacggactgccggatgtgggcttggcagccgaggatagtaagagggacccactgtgtcctcgacgagccgagccttgcccaagagttccggctaccccacgacgtatgagtgaccctcctctgtctacaatgcccaccgctccaggactccgtaagcctccgtgcttccgggagtcagcttccccatctcccgaaccctggactccaggccacggggcttgtagtaccagctccgctgccattatggccacagcaactagtagaaactgtgacaagttaaagagctttcacttgtcccccaggggtccccctacctcggagccacccccagtcccggctaataaacctaaatttcttaagattgcggaggaggatccccctagagaagcagccatgcctggactgttcgtgcctcccgtggcccctcggcctcccgcactaaaactgccggtgcctgaggcaatggcgaggccggcagttctgccgagaccagagaaaccgcagctgccacacctccagcgttctccaccggatggccagtcatttcggagcttttcatttgagaaaccccgacagccatctcaggcagacactgggggtgacgactcagatgaggactatgagaaggtacccctaccaaatagtgtgttcgtgaatactaccgagagctgtgaagttgagcgcttgttcaaggccacctctccacgcggtgaaccgcaggacggcctctactgcattaggaacagttcaactaagagtggcaaagttctggtagtgtgggatgagacttcaaacaaggtccggaactatcggatcttcgaaaaagattcaaagttctacctcgagggcgaagtgctatttgtctcggttgggtctatggttgagcactatcacacacatgtgctgccatcccaccaaagcctcctgctgagacatccgtatggctataccggaccgagatag

SEQ ID NO: 240372 - DNA, 1686 bp, Artificial Sequence
  Description of Artificial Sequence: Synthetic coding sequence
atggccgcagaggaaatgcactggcccgttcccatgaaggctataggggctcagaatctgctgactatgccgggtggtgttgcaaaagccggttatctccacaagaaaggcggaacgcagttgcaactcctgaaatggccattacgtttcgtgatcatccataaaaggtgcgtatactactttaaatcaagcaccagcgcctctcctcaaggggctttttcgctctccggctacaacagggttatgcgcgctgctgaggagaccacctcgaataacgtgtttccattcaaaataatacacataagcaagaagcatcggacctggtttttcagtgccagttccgaagaagaacgcaagtcctggatggctttactacggcgagagattggtcacttccacgaaaagaaggatcttccactggacaccagcgactccagctccgacactgactctttctacggcgctgtcgagcgcccagtggatataagcctgagtccttaccctaccgataatgaggactatgagcatgacgatgaggatgattcctacttagagcctgatagcccagagccgggtagattggaagacgcattgatgcatcctcctgcgtacccccctccccctgttcccactcccaggaagcccgctttttcagatatgccacgggctcacagcttcacaagtaaaggccctggaccgcttctgcctccccctccacccaaacatggcctgccagatgtgggtctggctgctgaagattcaaagagagatcccctctgtcctcgtagggcagaaccgtgtcctcgggtacccgcaacaccacggaggatgagtgaccctccattatccaccatgcctaccgcaccgggtttaagaaaaccaccatgctttagggagtccgcatcgcctagccctgaaccatggaccccagggcatggggcttgtagtacttcttctgcagccatcatggcaacagctactagcagaaactgcgataaactcaagtcatttcatctaagccctcgtgggcctcctacatcagagcctcctcccgtgcctgccaataaacccaagtttctgaagatcgcagaggaggaccctccgagggaggctgccatgccaggcttgtttgtaccccctgtcgcccctcgtcctccggctctgaagctccctgttcctgaggctatggctcgacctgcagttttacctcggcctgagaagccccagttaccccacctacagcgtagtccacccgacgggcagtcattccgttcgttttccttcgaaaagcccaggcagccctcccaggcggatacgggcggagacgatagtgacgaggactatgagaaggtgcctctccctaactccgtattcgtcaatacaaccgagagttgtgaggttgaaaggctgttcaaagccactagtcccaggggcgagccccaggacggcctatactgcattcgcaactcctcaaccaagagcggcaaggtgctcgtagtctgggatgaaacaagcaataaagtacgcaattatcggatttttgagaaggactccaaattttatctggaaggagaggtgctttttgtgtcggtcggatccatggtagaacattatcacactcatgtgctgcctagtcaccagtcacttctgttacgccacccatacggctatacaggaccaaggtag

SEQ ID NO: 240373 - DNA, 429 bp, Artificial Sequence
  Description of Artificial Sequence: Synthetic coding sequence
atggccgcagaggaaatgcactggcctgtgccaatgaaagccatcggtgcacagaacctgttgactatgccaggaggtgttgctaaggctggctaccttcataaaaaaggcggtactcagctccaactgttgaaatggccgctgcgcttcgttataatccataaacgttgcgtttactacttcaaatctagcacaagtgcctcccctcagggcgcattttccctgtctggctataatcgcgttatgcgagccgcagaggagactacctctaacaacgtgtttccctttaagatcatacatatctctaaaaagcatcgtacctggttttttagcgcctctagtgaagaagagcgcaagtcatggatggctctgctgcgtcgcgagatcggccactttcatgagaagaaggatttaccgttagacacatag

SEQ ID NO: 240374 - DNA, 429 bp, Artificial Sequence
  Description of Artificial Sequence: Synthetic coding sequence
atggctgcagaagagatgcactggcccgttccaatgaaagccatcggtgcacaaaacctcctgacaatgcctggaggtgtagccaaggcaggatacctgcacaagaagggaggaacgcaactccagttacttaaatggccactgagatttgtgattatacacaagagatgcgtctactacttcaagagttctacatctgcctccccccagggcgctttttcacttagcggttataatagggtgatgagagccgcagaagagaccacgtcgaacaacgtgttcccttttaagatcatacacatttcaaagaaacataggacctggtttttctccgccagctctgaggaggaaaggaagtcatggatggccttgctcaggagagaaattggacactttcacgagaaaaaagatctgccgcttgacacttag

SEQ ID NO: 240375 - DNA, 1857 bp, Artificial Sequence
  Description of Artificial Sequence: Synthetic coding sequence
atggcaggctcaggaccacgacccagatcttggggccgaagagaggccggtgcaagggacgaagccgcagccgcaggcggtcgtggccctgggccatgtaggtgtagccaagggaggcgggcttggatcgcaccgggtaagcctgcaatgccagccgcttggacccccttcatggccgcagaggagatgcattggcccgtgcccatgaaagcgatcggcgctcaaaatttactcacaatgccaggtggagtggctaaagccggatacctccataaaaagggtggcacccagctgcagttactgaagtggccccttaggttcgtcatcatccataagcgttgcgtgtactactttaaatcttctaccagcgcatctccacagggagctttctccctgtccggttataacagagtaatgagggccgctgaggagacgaccagcaataacgttttcccttttaaaattatacacattagcaaaaaacatcgcacctggtttttttcagcttcttctgaggaagagcgaaaatcctggatggctctgttaagaagggagataggccactttcacgagaagaaggatcttcctctggatacgtctgatagctccagtgatacagattcattctacggagccgtagagcgcccagttgacatctctctgtctccatatccgacagacaatgaggactatgagcacgacgatgaagatgattcatacctggagcccgattcgccagagcccggacggctggaagacgcccttatgcacccacctgcatacccaccacctccagtgcccacccctcgcaaacctgcattttctgatatgcctagagcccattccttcaccagcaaggggcctgggccattactgcccccaccgccacctaaacacgggttacctgatgtggggcttgccgcagaagattccaagcgggatccactctgccccaggcgcgctgaaccttgcccgagggtccccgctacacccagaaggatgtctgaccccccactgagtactatgcctacggccccaggactgagaaaacctccctgcttcagagagtccgcaagtccatccccggaaccatggactcctggccacggggcttgctccacctcctcggcagctatcatggcaaccgccacgtcgcgaaattgtgataagctgaagagtttccatctctcccccagaggaccacccacaagcgaaccaccgcctgttccggcaaacaagccaaagtttctcaagattgctgaagaggaccccccaagggaggccgctatgcctggcctatttgtccctccggttgcccctcgcccaccggcactgaagttacctgtccctgaagccatggccaggccagccgtcctgcctcggccagagaaaccccagttgccacacctgcagcgtagccctcccgatggtcagtcttttaggtcattctcatttgagaaacctaggcagccaagtcaggccgacacaggaggcgatgattccgatgaggactacgaaaaagtgccattgcccaattcggtgtttgtcaacactacagaatcatgcgaagtggagcgactctttaaggccacctctcctaggggtgaaccacaggatggattgtactgcatccgcaattcttctaccaagagcggcaaggtactcgtggtctgggacgagacatcaaataaggttagaaactaccgaatttttgaaaaagatagcaaattctacctcgagggggaagttttattcgtaagcgtaggtagcatggtggagcattatcacacccatgtcttaccatcccaccagtccctcctccttcggcatccatacggctacactggtccacgttag

SEQ ID NO: 240376 - DNA, 519 bp, Artificial Sequence
  Description of Artificial Sequence: Synthetic coding sequence
atggccgctgaggagatgcactggccggtacctatgaaggccatcggagcgcagaatctactcacaatgcccggaggtgttgccaaggctgggtatctccacaagaagggtggcacacagctgcagctgctgaagtggccgttgcgattcgtcatcattcataagagatgcgtctactactttaaaagttctactagtgcttctcctcagggcgctttttccctctctggatataaccgagtaatgagggccgcagaggaaaccacaagtaataatgttttcccctttaaaattatccacattagtaagaaacacagaacctggttctttagtgccagctccgaagaggaaaggaagagttggatggccctcctgcgcagagaaataggccacttccacgagaagaaggacttacctctcgacaccagtgactcttcttcagatacggattctttctacggcgctgtggagcgcccagtggatatcagcttatccccctacccaaccgacaacgagtag

SEQ ID NO: 240377 - DNA, 567 bp, Artificial Sequence
  Description of Artificial Sequence: Synthetic coding sequence
atggccgcagaggagatgcactggccggtccctatgaaagccattggggctcagaatttgctgacaatgcctgggggtgtggcaaaggctggctacctgcataagaaggggggtacccagctgcagctgctgaagtggcctctgcgtttcgtgattatccataagcgatgcgtctactacttcaagagctctacctcagcctctccccagggtgccttctctctgtctggttacaaccgggtaatgagggcagccgaggagaccacttctaataatgtttttcccttcaagattatccacatcagtaagaaacatagaacctggtttttcagcgcctccagtgaagaggaacgaaagtcctggatggccctgttgcgtcgtgagattggacacttccacgaaaagaaggacctgcctctggacacatccgattctagctccgacactgattctttctatggggctgttgagagaccagttgatatttctttatcaccgtaccctaccgacaacgaggattacgagcatgatgacgaagatgactcatacttggaacccgacagctag

SEQ ID NO: 240378 - DNA, 1686 bp, Artificial Sequence
  Description of Artificial Sequence: Synthetic coding sequence
atggccgctgaagaaatgcactggccggtgcctatgaaggcgattggtgcccagaatctcctgaccatgcctggtggggtggcaaaggcaggatacctgcacaagaagggcggaacacagctacagctgttaaaatggccccttcgctttgtcattattcacaagcgctgcgtatactacttcaaatcgagcacatctgccagcccacagggggcatttagcctgtctggctataacagggtcatgagggcggcagaggaaacgacatcgaacaatgtgtttccctttaaaattatacacatttctaagaagcatagaacctggttcttctctgctagctctgaagaggagcggaagtcatggatggccctgctacgacgcgaaatcggtcactttcatgaaaagaaggacctccctcttgatacttctgattctagttcggataccgactcgttttacggagctgtcgagaggccagtggatattagccttagcccctatcccacggacaacgaagactacgaacatgacgacgaagatgatagttatttggagcccgacagtcctgagcccggacgtctcgaggatgcgttaatgcacccccctgcctacccaccgccacccgtccctacaccaagaaaacccgctttcagtgacatgccaagagcccactcttttacaagtaaggggccaggtccccttttgcctcctcctcctcctaaacacggcctgccagacgttggactggccgctgaggatagcaagagagatccactgtgtcctaggagggcggaaccatgcccaagagtccctgcaactcctcgcaggatgagtgacccgcctttgtcgacaatgcccaccgcgccaggccttcggaagcccccatgcttccgggaaagcgccagcccctctcccgagccttggacacctgggcacggcgcatgctccacatcctccgccgctatcatggcaaccgccacgtctagaaattgcgataaactgaagtcattccatctgagtccaagaggccctcccacctctgagccacctcccgtgccggctaacaagcctaaattccttaagatagccgaggaagacccacctcgagaggcagcaatgcctggccttttcgtccccccagtcgcacccaggcccccagctctgaagctgccagttcctgaggcgatggcacggccagcggtcctgcctaggcctgagaagccccaactcccccaccttcagcgttccccgccagacgggcagtccttcagatcgttcagctttgagaaaccacgccaaccctctcaggctgatacagggggagatgatagcgatgaggattacgaaaaggttccgctgcccaactctgtgtttgttaacacaacagagagctgtgaagtggaaagattgttcaaggctacttctccgaggggcgaacctcaagacggattgtattgcatccgcaatagtagtacaaaatccgggaaagtcctggtagtgtgggacgagactagtaacaaggtgcgcaattacaggatttttgagaaggattccaagttctacttagagggagaggtgctctttgtatcagtcggatcaatggtcgagcactaccacacgcatgtactgccctcacatcagtcccttttactacggcacccgtatggatacacagggccacgatag

SEQ ID NO: 240379 - DNA, 585 bp, Artificial Sequence
  Description of Artificial Sequence: Synthetic coding sequence
atggcagcagaggaaatgcactggccggtacctatgaaagctatcggggctcagaatctgctcacaatgcctggtggggtagccaaagctggttaccttcataagaaaggaggtacacagctgcagttgctgaaatggccactgcggttcgtcattatccacaaaaggtgcgtctactactttaaaagttccacctcagcatcaccacagggcgctttcagcctgagcggttacaatcgggtgatgcgtgccgctgaagagactacttcgaacaatgtattccccttcaagatcattcacatttccaagaagcacagaacctggttcttctccgcttccagcgaagaggagcgaaagtcctggatggccctgctgcgcagggagattggtcacttccatgaaaagaaagacctgcctttggacacgtccgacagttcctcggataccgacagtttttacggcgctgtggagcgaccagtcgatatttctctgtctccctaccccactgataatgaggactacgagcatgatgatgaggatgactcttatcttgagccagacagccctgaaccaggtcgcctgtag

SEQ ID NO: 240380 - DNA, 411 bp, Artificial Sequence
  Description of Artificial Sequence: Synthetic coding sequence
atggcagctgaggaaatgcactggccggtgccgatgaaggccatcggggctcagaacttgttgactatgccgggaggggtagctaaggcagggtatctgcacaagaaggggggaacacagcttcaactgctgaagtggcctctgcggttcgtgatcattcacaagagatgcgtttattacttcaagtcatcaactagtgcatcaccacaaggggctttcagcctgagtggatataaccgcgtgatgagagctgccgaggaaaccacgtcaaataatgtttttccgtttaagatcattcacataagcaaaaagcaccgcacatggttctttagtgctagcagcgaagaagaacgtaagagctggatggccctcctacggagggaaataggccacttccatgagaaaaagtag

SEQ ID NO: 240381 - DNA, 2892 bp, Artificial Sequence
  Description of Artificial Sequence: Synthetic coding sequence
atggccgctcagcggattagagctgccaatagtaacggtctacccagatgcaagtcagaaggaaccctcatcgacctgagcgagggcttctcagagacgtcctttaacgacatcaaagtgccatctcctagcgctctgctcgtcgacaaccctacgccattcggcaacgccaaagaggtaatcgctattaaggattattgcccaacaaacttcacaacactcaagttttccaaaggcgaccacctgtacgtcttggacacttccgggggtgagtggtggtacgcccacaacaccactgaaatgggatacatcccttcctcatacgttcagccactgaattaccgcaactccaccctctccgactcaggtatgattgataatctgcccgattcccctgatgaagtggctaaggaactggaactcctgggagggtggacggacgacaaaaaggttcccggacggatgtactctaataacccgttttggaacggagtccaaaccaatccctttttaaacggaaacgtacccgtgatgccctctttggacgagttaaatcccaaatctacggtggacctgcttttgttcgatgccggtacttcttcattcactgaatcttcttccgcaaccaccaacagcactggcaatatctttgacgaactgccggttacgaacggattacacgctgaacctcctgtgcgtcgcgacaatccctttttccgttctaagcgctcgtactcgttatccgaactgagcgtgcttcaggccaagtctgacgcacctacaagctcatccttcttcaccgggctgaagtccccagcgccagaacagttccagtcgagggaggactttcggaccgcgtggttgaatcacaggaaactcgctagaagctgtcacgacctcgatctgttgggacagtcccctggctggggccaaacgcaagctgtggagactaatatcgtatgtaaattagatagctccggtggggctgtacaactgcctgataccagcatttccatccatgtgcccgagggccacgtggcacccggtgagacacaacagatctctatgaaggccttactggaccccccacttgagcttaactctgacaggtcctgtagtatcagtccggtgctcgaagtaaagttgtcaaatctagaggtgaagacttcaatcatactggaaatgaaggtcagcgcggagattaaaaatgacctgttctccaaaagcacggtgggccttcagtgtctgcgatccgactcaaaggaaggcccttatgtgtctgttcctctgaattgttcatgcggcgacacagtgcaggcccagttgcataacctcgagccctgtatgtacgtcgcagtggtggcccacggcccaagcatcctgtacccttccaccgtgtgggattttatcaataaaaaagtgacagttggactgtatggacccaaacacatccaccctagcttcaaaacggtagttaccatctttggtcacgactgcgcaccgaagactttgctggtgtcagaggtaacccgccaggccccaaaccctgcgccagtggccctacagctttggggtaaacaccagttcgtcttatccagaccacaggatcttaaggtttgcatgttctcaaacatgaccaactacgaggtgaaggcaagcgagcaagcgaaagtcgtgaggggatttcagcttaagttagggaaggtctcccggctgattttccctataacaagccaaaaccctaacgaactttcagacttcaccctgcgagttcaggtaaaggacgaccaggaggcgatcctcacccagttctgtgtgcagactccccagcctcctcctaaaagtgcaataaagcccagcgggcagaggaggtttctcaagaagaatgaagtgggaaaaattatcctttccccttttgcaaccacaaccaagtaccctacatttcaggaccggcctgtgtccagtctcaaattcgggaagcttctaaagaccgtggtgcgtcagaacaagaatcattatctattggaatacaagaaaggggacggtatcgcactgctcagcgaggaacgagtgcgcctgagggggcagttatggacgaaggagtggtatatcggctattatcagggcagggtggggcttgtgcataccaaaaacgtgctggtggtcgggcgagccaggcccagtctttgctcaggacctgagttgtccactagcgtgcttttggagcagattttgcggccttgtaagtttcttacatatatctatgcctctgtccgtaccctcctcatggagaacatctctagttggcggtcatttgctgacgctctcggctatgtcaatctgcccttgacattcttctgtagggccgagctggactccgaacctgagagggtcgcctcggtgcttgagaagctcaaagaggattgtaataatacggagaacaaggagcggaagtcttttcagaaagagttggtcatggccctcctgaagatggattgtcaaggcctcgttgtgcggctgatccaggactttgtacttttgaccacggccgtggaggtcgcccagcgatggagagagcttgccgaaaagctggctaaagtaagcaagcagcaaatggatgcctatgagtcaccccacagggacaggaatggggtagtggattccgaagctatgtggaaaccagcttacgacttcctgctgacctggagtcaccagattggggacagctacagagatgtaatacaagaactccacctgggattagacaaaatgaaaaaccctattacaaagcgatggaaacacctgaccgggactctcattttggtaaactccctggatgtgctcagagccgcagctttctcacctgccgaccaggacgatttcgtaatttag

SEQ ID NO: 240382 - DNA, 2892 bp, Artificial Sequence
  Description of Artificial Sequence: Synthetic coding sequence
atggccgctcagagaatccgcgctgcaaactccaatggtctccctagatgtaagtctgaagggacactcatcgatctttccgaggggttctcagagacttcctttaatgatattaaggtcccctcccccagtgcgctgctggtagacaatcccacgcccttcggcaatgctaaagaggtcatcgccataaaggactactgccctactaactttaccactctgaagttttccaagggagatcatttgtacgttcttgatacgtcgggaggagagtggtggtatgctcataacactaccgagatgggatatataccatcttcttacgttcagcctctgaattaccggaattccacactaagcgatagcggcatgattgacaacctccccgattctccggacgaggtggcaaaggagctcgaactgctgggaggctggactgacgataagaaggtacctggacggatgtactctaataatccattctggaacggtgtgcagactaacccattcctgaatggaaatgttccagtgatgccttcgctggatgaactcaatcccaagtccacagttgatttgctgcttttcgatgctggcacatcctcctttactgaatcttcgtctgccacgaccaactctacgggcaatatttttgacgagctccccgtgacgaatggtttacatgctgagccccctgttcgcagagataatccgttctttcggtccaaacgcagctactcattgagcgaactgtctgtgctccaggctaaatccgatgcaccgacatcatctagctttttcactgggctgaagagtccggcacccgagcagttccagtcaagggaagattttcgtactgcatggctgaatcataggaagttggccagaagctgccacgacctggaccttctggggcagagtccaggttggggacagactcaagcggtggagaccaacatcgtgtgcaagctagactcaagtggaggcgctgttcagctgccggatactagcatcagcatccatgtgcccgagggacatgtggcacccggtgagactcagcagatatcaatgaaggctctgctggaccctccccttgaacttaactccgaccgatcatgttcaattagtccagtgctggaggtgaaactgagcaatctggaagtcaaaacctcgataattctggaaatgaaagtttccgcagagatcaagaacgacttgttttcaaagtcaaccgtcggactacaatgtctgcgctcagactccaaggaaggtccgtacgtttcagtgccactgaattgctcctgcggcgatacggtgcaggcacaactgcataacctggagccgtgtatgtacgtggctgtggtcgctcacggcccatcaatcctgtacccctctacggtgtgggactttattaacaagaaggtgactgtagggctctatggcccaaagcacatacatccctccttcaagactgtggtgacaatttttggacatgattgcgcacctaaaactctgttggtgtctgaagtgacaaggcaggccccaaatcccgcaccggtagcactgcaactgtggggcaagcaccagttcgtgttatctcgaccacaggacctcaaagtttgtatgtttagtaatatgaccaattatgaggtgaaagccagtgaacaggccaaagttgtgcgtggcttccagctgaagctggggaaggtctcgcgcctgatcttccccattacaagccagaacccaaatgagctttccgatttcaccctgagagtccaggtaaaagatgaccaggaggcaatccttacccagttctgcgtgcagacaccccaaccacccccaaaaagtgccataaaaccctccggacagcgcagattcctgaaaaagaacgaagttggtaagatcatcctaagcccattcgccactactactaaatatccaacattccaagataggcctgtgtcgtcattgaaatttggaaagctgctcaagactgtcgtacggcagaacaagaaccattacctgttggaatataaaaagggtgatgggatagccttactctctgaggaacgtgtccgcctgcgcggacagctctggaccaaagaatggtacataggctactaccagggccgagtgggtctggttcacaccaagaacgtcctggtcgtggggagagctcggccttcactgtgtagcggacccgagttgagtacatctgtgctgctggagcagattctgaggccttgtaaatttttgacatatatctacgcaagcgtgcgcacccttctgatggaaaatattagttcttggaggagctttgctgatgcgctgggctacgtgaacctccctctgaccttcttctgccgggcagagctggattccgaacctgagagggtcgcctctgtgttggaaaaactcaaagaggactgcaataataccgaaaacaaggagcggaaatccttccagaaagaattggttatggccttactgaagatggattgtcaagggcttgtcgttcgcctcattcaggactttgtcttgctgacgacggccgtcgaagtggcccaaagatggcgtgagctggcagaaaagcttgccaaagtgtccaaacagcagatggatgcctatgaatctcctcacagggacagaaacggcgtagtggactctgaggccatgtggaagccagcatacgacttcctgctgacatggagccatcagattggagatagttacagggacgtgatccaggaactccatcttggtctggataagatgaaaaatcctatcacaaagcgctggaaacatctaaccggcaccctgatcctcgtgaattccctggatgtgctgcgagctgccgcattctctcccgcagaccaagacgatttcgtgatttag

SEQ ID NO: 240383 - DNA, 2892 bp, Artificial Sequence
  Description of Artificial Sequence: Synthetic coding sequence
atggcagcccagcggatcagagccgcaaatagcaacggactgcctcggtgtaagagtgaagggacactgatagatctgagtgagggcttctccgaaacctccttcaatgacataaaagttccctccccgagcgctctcttagtggataatcccactcctttcggaaacgccaaagaggtgatcgcaataaaggattactgccctaccaactttaccacgctaaaatttagcaagggggaccatttatacgtcttggataccagcggtggtgagtggtggtacgctcataacacgaccgaaatgggttatatcccctcctcttatgtccaaccattgaactaccggaatagtaccctgagcgatagcggaatgattgacaatttgcccgacagtcctgatgaggtggccaaggagttagaactgcttggcggatggaccgacgataagaaagtaccaggacgtatgtatagtaataatccattctggaatggcgtccagaccaaccccttcctaaacgggaatgtccccgtgatgccctcgcttgacgagctgaaccccaagagtactgttgatttattgctgtttgacgctggtacctcctcctttaccgagtcaagcagtgcaacaaccaatagcacaggaaatatctttgatgagctgcccgtaaccaatggattgcatgctgaaccaccggtaaggcgggataacccatttttcaggagcaagagaagctattctctcagcgaattgagcgtcctgcaggcaaaaagcgacgctccaacaagttcctcattttttaccggacttaagtccccggctcctgagcagtttcagtccagggaggattttaggacagcgtggctcaaccaccgaaagctggctcgctcatgccacgacctcgatctgctcggacagtcccctggctggggacagacacaggctgtggaaactaatattgtgtgtaaactggattcctctggaggcgctgtacaactccctgatacgtcaatctcaattcatgtgccagagggacacgttgcccctggtgaaacccagcagattagcatgaaggccctccttgatcccccacttgaactgaattcagatcgcagctgctcaatttctcctgtgcttgaagtgaagctcagtaatctggaggtgaagactagcatcatactcgagatgaaagtatcagcagagataaagaacgatctcttcagcaaatcaactgttggtctccagtgccttaggagcgacagcaaggaagggccttatgttagcgtgccgctgaactgctcgtgtggagatactgtacaagcgcaacttcacaacctggagccatgtatgtatgtggcagtagttgcccacggaccctccatcctgtatcccagcacagtatgggatttcatcaataagaaagtgaccgtgggactgtatggccctaagcatatccatcctagctttaagaccgtggtgaccatttttggacacgactgcgcccctaaaactttactcgtgtccgaagtcacacgacaggccccaaatccagctcccgtggctctacagctgtggggaaagcaccagtttgtgttatcacgcccacaggatctgaaagtgtgtatgttttcgaatatgacaaattatgaggtgaaagcaagtgagcaagctaaagtcgttaggggtttccagctgaagctcggtaaagtttcacgtctcatattccccatcactagtcagaatcctaacgaactgtctgatttcacactgcgggttcaggtgaaggacgaccaggaagccatactgacgcagttttgtgtgcaaacaccccagccaccccctaaatcagcgatcaaaccgtctgggcaaaggcggtttctgaagaagaacgaagtgggtaaaattatcctctcccctttcgcaactaccacaaaatatccgacctttcaggaccgtcccgtgtcaagcctaaaatttggcaaacttcttaagaccgtggtgagacagaacaagaaccactatctccttgagtataaaaagggtgacgggatagcactgctctcagaggagcgggtgcggttacgcggtcagctctggacaaaggagtggtatattggatactatcagggacgagttggccttgtccatacaaaaaatgtgctagtggtcggcagagctagaccttctctgtgctccggtcccgaactttctactagtgtactattggagcagatcctgcggccatgcaaattcttgacctatatatatgcctctgtgaggacactgctgatggaaaatatctcatcatggcggagcttcgccgatgcactcggctacgtaaacctgcctctgacttttttttgccgtgccgagcttgattcggagcccgaacgagttgcaagtgtgttggagaagctgaaagaggattgtaataatactgagaataaagaacggaaaagcttccaaaaggagctggtaatggcccttcttaagatggactgtcagggtctggttgtgcgcctgatccaagactttgtgctcctgacaaccgcggtggaagtcgcccagagatggcgtgaattggctgaaaagctcgccaaggtttccaagcagcagatggatgcgtacgagagtccccatcgcgacagaaatggagtcgtcgattcagaggctatgtggaaacctgcgtatgactttctcctcacctggagccatcagatcggtgactcatacagagacgtgatccaggagctgcatctgggcttagacaaaatgaagaatccaatcactaaacgctggaagcacctgacagggactctgatccttgtaaattctcttgatgtccttcgcgctgcagcattctctcccgctgaccaggatgatttcgttatttag

SEQ ID NO: 240384 - DNA, 369 bp, Artificial Sequence
  Description of Artificial Sequence: Synthetic coding sequence
atggctgcgcagcgcatccgggctgcaaactcaaacgggctgccacgctgtaaaagtgagggcactctgattgatctctccgaggggttctcagagaccagtttcaatgacatcaaggtgcccagcccatcggcacttctggttgataatccaacgccgtttggcaatgcaaaggaggtgatagcaataaaagactactgccccaccaacttcaccacactaaagttcagtaaaggcgaccacctctacgttctggacacatccgggggtgaatggtggtatgcccacaacaccactgaaatggggtacataccaagctcatacgtccagccattaaattataggaactctacactgtcggattcatag

SEQ ID NO: 240385 - DNA, 1662 bp, Artificial Sequence
  Description of Artificial Sequence: Synthetic coding sequence
atggctgctcaaaggatccgagccgctaattctaatgggctgcccaggtgcaagtcagaaggaactttgattgacctgtcagaaggcttctctgaaacatcctttaatgacattaaggtaccctccccgtccgccctgctggtggataatccgacacctttcgggaatgcgaaagaggtcattgcaataaaggattactgtcctacaaattttaccaccctcaaattttccaaaggagatcacttgtacgtccttgacacttccggtggcgaatggtggtacgcccataacaccaccgaaatggggtacatcccctcatcttacgtacagcctctgaactatcggaattctacgttgagtgatagcggcatgattgacaacttgccggactccccggacgaagtggccaaagaactagaactgctgggtggttggaccgacgacaagaaagttccaggccgaatgtatagtaacaatcctttctggaatggtgttcagactaatcctttccttaatgggaacgtccccgttatgccatctctggacgagttgaacccaaagtcgacagtcgacttgctgttatttgatgccggtactagcagcttcacagagtcttcgtccgcaaccactaacagtacagggaacatttttgacgagttgcctgtgactaacggcttacatgcagagcccccagtgagacgtgacaaccccttttttcggtccaaaagatcttactccctctccgaactgagtgtgctccaggctaagagtgacgctcccacttcctccagcttctttaccggtctaaaaagccctgcgcctgaacagtttcagtctcgcgaagactttcgcactgcttggctgaatcaccgcaaactcgccagaagctgtcacgacctagatctgctggggcagagtcccggatggggccagacccaagccgtggaaacgaacatcgtctgcaaattggactcctccgggggagcagttcagctgccagatacaagcatcagtatccacgttccagaaggacatgtagcacctggtgaaacccagcagatttccatgaaagctttgctggaccctcccctggagctgaatagtgaccgcagctgctcgatcagccccgtgctggaggtgaagctgagtaatctggaagttaagacatctattattcttgaaatgaaggtctccgccgaaattaagaatgatctgttttcgaagtctactgtgggtttgcagtgtctgcggtcagactcaaaggaaggaccctacgtgagcgtccctctgaattgttcttgcggggatactgtacaggcccagcttcacaatctggagccatgtatgtacgtcgccgtggtggctcatggcccaagcattctgtacccttcaaccgtttgggacttcatcaacaaaaaggtcaccgtggggctgtacggtcctaagcatatccatccttcatttaagacagttgttacaatctttggtcacgactgtgcaccaaaaacgttactagttagcgaggtgacgcgccaggccccaaacccgcctattaccaaacgatggaaacacctgaccggcacactgatcctcgtaaattcactggacgtcctgcgggctgcggcttttagccctgcggaccaggatgattttgtgatatag

SEQ ID NO: 240386 - DNA, 171 bp, Artificial Sequence
  Description of Artificial Sequence: Synthetic coding sequence
atggccgctcaaaggattcgggcagcgaactccaacggccttccgagatgcaagtctgaggggactctgatagacttatctgagggcttttcagagacttccttcaacgacattaaggtgccatctccttctgcgcttttggttgacaatccgacacccttcgggaactag

SEQ ID NO: 240387 - DNA, 522 bp, Artificial Sequence
  Description of Artificial Sequence: Synthetic coding sequence
atggccgcacaacgaatcagagctgcaaattctaatggcctgccacgctgcaaatcagaaggcacccttatcgatttatctgagggtttcagtgagacatcattcaacgatatcaaggtgcccagccccagcgcgctccttgtagataaccctactccatttggaaatgccaaagaggtaatcgccatcaaggactactgcccgaccaacttcacgacactcaagttttcaaagggcgatcacctgtacgtgctagacacttcggggggtgagtggtggtacgcccacaatacaaccgagatgggctatatcccgtctagttacgtgcagccacttaactatcgcaatagcaccctgtcagactccggaatgatcgataacctccctgacagcccggatgaagtggcgaaggagttagagctgctaggaggatggaccgacgataagaaggtcccaggtagaatgtactcgaataacccattctggaatggcgttcaaacaaaccctttcttaaacggatag

SEQ ID NO: 240388 - DNA, 174 bp, Artificial Sequence
  Description of Artificial Sequence: Synthetic coding sequence
atggctgcccagcgcattcgcgctgcaaatagcaacgggctgccacggtgtaagagtgaggggacgctgattgatctgtcagaggggtttagcgaaacaagcttcaacgacattaaggttcccagcccaagcgctctgctggtcgacaatccaacgccatttgggaacgcctag

SEQ ID NO: 240389 - DNA, 606 bp, Artificial Sequence
  Description of Artificial Sequence: Synthetic coding sequence
atggagaatatcagcagctggaggtcattcgctgacgccctgggttacgtcaatctacctctgacttttttctgtcgagctgagctggattcagagcccgagcgagtcgcttccgtgctggagaagctgaaggaggactgcaataacaccgagaataaagagcggaagtcattccagaaggagctcgtgatggctctgcttaaaatggactgtcagggccttgtggtgagattgattcaggatttcgtgcttttaactacagccgtcgaggttgcccagaggtggagagaactggcagagaagctcgccaaagtgtcgaagcagcaaatggatgcttacgagagccctcatagagacagaaatggcgtcgtcgacagcgaggctatgtggaagcccgcttacgattttcttctgacctggtcgcatcagatcggagactcctatagggacgtcatccaggagctccatctgggcttggacaaaatgaagaaccctataaccaagagatggaaacacctcaccgggactttgattctggtgaatagcctggacgtgctgcgggctgccgcattctcaccagcagatcaggacgattttgtcatctag

SEQ ID NO: 240390 - DNA, 897 bp, Artificial Sequence
  Description of Artificial Sequence: Synthetic coding sequence
atgctgaaccacgccactcagcgcgtgatggaggccgaacaaactaagacccgcagcgaactggtgcataaggagaccgcagccagatataacgccgcaatgggacggatgagacaactcgagaagaagttgaagagagcaataaataagtccaagccatacttcgaattaaaagcaaagtactacgtgcagctcgagcagctgaaaaagactgtggatgatctgcaggcgaaactcactttggctaagggagagtacaagatggctcttaagaacctcgagatgatctcagatgaaattcacgaacgtaggcggtcctctgctatgggccctagaggctgcggtgttggggcagaaggatctagtacctccgtggaggacctacccggttccaagcctgaaccagatgcaatcagcgtcgcgagcgaggctttcgaagatgactcatgcagcaatttcgtatccgaagacgatagtgagacccaaagcgtgtccagtttctccagcggacccacaagcccgtctgaaatgccggaccagtttccagctgtggtccgcccaggcagcctcgatcttcccagtccggtttctctctccgagtttggtatgatgttccccgtgctcggcccacgcagcgaatgctcgggagcaagctctcccgagtgtgaggtagaaagaggggaccgggcagagggagctgagaacaaaacgtcagacaaagctaataataatagaggcctgagttccagcagtggttccggcggttcctcgaagtcacaatccagcacgtctcctgaggggcaggcgctggagaacagaatgaagcagcttagtctgcagtgcagtaaaggcagagacggcatcatcgccgatattaaaatggtgcaaatcggctag

SEQ ID NO: 240391 - DNA, 387 bp, Artificial Sequence
  Description of Artificial Sequence: Synthetic coding sequence
atgctgaaccatgcgactcagcgcgtgatggaagccgagcagacaaagacaagatcggagctggtgcacaaggaaactgctgctcggtacaacgccgcaatgggacggatgagacagctcgagaaaaaacttaaacgggcaatcaataaatctaagccttactttgagctgaaggctaaatactacgtccagctggagcagctcaagaaaacggtagacgatctccaagctaaattgactcttgccaagggagaatataagatggcactaaaaaaccttgagatgatcagcgacgagattcatgagaggcgccgatcaagtgctatggggccacggggatgcggtgtgggtgcagagggtagcagtacttccgtcgaggatctgtag

SEQ ID NO: 240392 - DNA, 1368 bp, Artificial Sequence
  Description of Artificial Sequence: Synthetic coding sequence
atggatgccgctctaaagcgatcccgttctgaagaaccagcagagatcctcccccctgctagagatgaggaagaggaagaagaagagggaatggaacagggcctggaggaggaggaggaagtggaccctagaatccagggcgaattggagaaactcaatcagtcaactgacgacattaatcgtagagagacagagctcgaggacgcaaggcagaagtttcgcagcgtgttggtggaggcaacagtcaaacttgatgagctagtcaagaagatcggcaaggctgtggaagacagcaaaccatactgggaggcacgaagagttgctaggcaggctcagctcgaggctcaaaaagccacccaagatttccaaagagctaccgaagtgctacgagcagccaaggagacaattagcctggcagagcagcgactgcttgaggacgataaacgacagttcgactcagcatggcaggaaatgctcaaccatgcgacacagcgagtgatggaggctgagcagaccaaaacacgttcggagctcgttcacaaagaaaccgccgcacgctacaatgccgcaatgggtcgaatgcggcaactagagaaaaagctgaaacgggctatcaacaaatctaaaccttattttgaacttaaggctaaatattatgttcagctcgaacagcttaaaaaaaccgtggacgatctgcaggccaagttgacattggctaaaggcgagtataagatggctcttaagaatttagagatgatctccgacgagatccatgagagacgaaggtctagtgccatgggtccacgcggttgcggagtcggagccgaaggttcttccacgtcggtggaggacctgcccggaagcaaacctgaacctgacgccatttcggtggcatcagaggcctttgaagacgactcgtgttctaacttcgtgtctgaggacgactctgagacacagagcgtgagcagcttttctagcggtccaacctcaccttcagagatgcctgatcagtttcctgccgtggtccggcctgggtccttggacctgccatcacccgtgtcactaagtgagttcggcatgatgtttcccgttctaggtcccaggtcagaatgcagcggagcttctagcccggagtgcgaggtcgaaagaggagaccgggctgagggtgcagagaacaaaacatcagataaggcaaataacaatagaggactgtcttccagtagcggttcaggtggctcgtctaaaagccaatccagcacatcccccgaaggacaagccctggaaaaccggatgaaacaactgtcactgcagtgcagcaaaggaagggatgggatcatcgccgacattaagatggttcagatcggatag

SEQ ID NO: 240393 - DNA, 897 bp, Artificial Sequence
  Description of Artificial Sequence: Synthetic coding sequence
atgcttaaccacgccacccagcgtgttatggaggcagaacaaactaaaacacgcagtgagttagttcacaaggaaactgctgcgagatacaatgccgctatggggaggatgcgtcagcttgaaaaaaaactaaaaagggccatcaacaaatcaaaaccctacttcgagctcaaggccaaatactacgtgcaattagagcagctcaaaaagacggtggacgatctacaggccaaacttacactggccaagggagagtacaagatggctctgaagaatctagagatgataagtgacgagatccatgagaggcgtcggtccagcgctatgggcccacgcggatgtggtgtcggggctgagggctcatctacctctgtcgaggacctgcccggatccaagcctgaacccgacgccatctcggtggccagcgaggcatttgaggatgattcttgttcgaatttcgtgagtgaggacgatagcgaaacacagtctgtgagctctttttcctctggaccaacgagcccgtcggagatgcccgaccagttcccagctgtcgtacggccaggcagcctggatctaccaagtcctgttagcctcagtgaatttggaatgatgtttccagtgttgggtccaagatccgaatgttccggagcgtcctcgcccgagtgtgaggtcgaacgcggagacagagctgaaggagccgaaaataagacttcagacaaagccaataacaacaggggactgagctcatcgtccggttccggtgggtcttctaaatcacagagcagtacatctcctgaggggcaggccctagagaatcgaatgaagcagttgtctctccagtgtagcaagggccgagacgggattatcgctgatattaaaatggtacagatcggatag

SEQ ID NO: 240394 - DNA, 156 bp, Artificial Sequence
  Description of Artificial Sequence: Synthetic coding sequence
atgctaaatcatgcgacgcagagagtcatggaggctgagcagaccaagacacggtcggagctggtgcataaagaaacagcagctcggtacaacgctgcaatgggaagaatgcgacagcttgaaaagaaactgaaaagggccatcaataaatcttag

SEQ ID NO: 240395 - DNA, 897 bp, Artificial Sequence
  Description of Artificial Sequence: Synthetic coding sequence
atgctcaatcatgctacacaacgggtcatggaggccgaacagaccaaaacacgttcagaactggtgcacaaggagaccgccgcaaggtataatgctgcaatgggcaggatgagacaattggagaagaagctgaaaagggctattaacaaatctaagccatacttcgaactcaaagcgaaatactatgtccagttagaacaattgaagaaaacagtcgacgacctccaggccaaactgacccttgctaagggagaatacaagatggcactgaaaaacctagagatgatttctgacgagattcacgagaggcgacggagcagcgccatgggtccacgagggtgcggagtgggtgcagagggatccagtacatcagtggaggatctgccaggatccaaacccgagccagatgcgatctctgtggcctccgaggcatttgaggacgactcatgcagtaactttgtctccgaagatgactcagagacacagagtgtcagcagtttttcatctggccctacatctccctccgaaatgcctgaccagtttccagctgtggttagacctggctcactggacctcccgtcacccgtgtctctgagtgaatttggcatgatgtttcctgtgctgggccctcggtctgagtgtagcggagcgagctccccagaatgcgaggttgaacggggtgaccgggcagaaggagcagaaaacaagacctccgataaggcaaataacaaccggggacttagcagttcatccggcagcggtggcagttctaagtctcagagctcaacgtcccctgaggggcaggccctggaaaatcggatgaagcaactgtcactccagtgctcgaaaggacgggatggcattatcgcagatattaaaatggtccagatagggtag

SEQ ID NO: 240396 - DNA, 2580 bp, Artificial Sequence
  Description of Artificial Sequence: Synthetic coding sequence
atgatggaaggcctcaaaaaacgaactcgcaaggcctttggaatacgaaaaaaggaaaaagacaccgacagtaccggctcccctgaccgcgatggtatccaggggaaaaagaagactcagaagacacaacttctgctaacctcttgcttctggctgagggctctttctcttaccctctctcaaaaaaagagcaatggcgctccgaatggattttacgcagagatcgactgggaacggtataactccccagagctggatgaggagggatacagcatcaggcccgaggagcccggatctaccaaaggaaaacatttctactctagctctgaaagcgaggaggaagaagaatctcacaagaaatttaatatcaaaattaagccactgcagagcaaggacatcttgaaaaacgccgcaacagtggatgagctcaaggcttctatcgggaacatcgccctcagcccctctccggttcgcaaaagtccccgaaggtcacccggagccatcaagcggaacctgtcaagtgaggaggtggcaaggcctcgtaggagtacccccacccccgaactcatctccaaaaagcctcccgacgataccactgcgctagctccactgtttggccctcctctggagagcgccttcgacgagcagaagaccgaggtcctgcttgatcaacctgagatttggggatccggtcagcccatcaatccgtcaatggagtctcccaagctcaccagacccttcccaaccggcacgccacccccactcccacccaagaatgtgcccgcaacaccacccaggacgggatccccacttacgatagggcctgggaacgaccaatcggcaaccgaggtcaaaatcgagaagctccccagcatcaacgatctggacagtatcttcggacctgtgctgagcccgaagagcgttgccgtgaacgctgaagagaaatgggtccactttagcgatactagcccagagcacgtcacccctgagctgactccaagggaaaaggttgtatcgccccctgctacccctgataaccccgctgattctccggcaccgggtccactcggtccgcctggtccaacagggcctcctggaccacccggaccaccccgtaacgtcctctctcccctcaatcttgaagaggtgcagaagaaggttgccgagcagacctttatcaaggacgactacttggagacaatttccagccctaaggatttcgggctcggccagcgggcaacaccacctcctccccctcctccgacttaccggacagtagtcagtagccccggacccggatccggaccaggtcctggaaccacctccgatggaaaaaccgaggcccagcgatatcaagtcatctgtccaagcttgcaggcagggggtaacgagctcgattcatacagtggcgcatcctcccccgctcgacctgcgacaccccttgtaccctgtcggtctacaactcctcctccgcctccccctaggcccccatctcgaccaaaactgcctccaggcaagccaggggtaggggatgtgtctaggccattctcccctcctatccacagtagctcccctccaccaatcgctcccctggctcgcgctgagtccacaagttccatatcttcaacaaattctctgtcagcggcaacaacccccactgtggaaaatgagcagccatccctcgtgtggttcgatagaggaaagttctatcttacgttcgaaggctcctcccgaggtccaagccccctcactatgggcgcacaggatacactacccgtggccgcagcatttaccgaaactgtgaacgcctattttaaaggggctgacccttctaagtgtatcgtgaagattaccggcgagatggtactgagctttcctgcaggcattacccggcactttgccaataatccatctcccgcagctttaaccttccgggtcattaatttttctaggctcgagcacgtcctgcctaaccctcaattgctgtgctgcgacaacacacagaacgatgccaacacaaaggagttttgggtcaacatgccaaatctaatgacccacctcaagaaagttagtgagcagaagccacaggctacctattataatgtcgatatgctgaagtaccaggtgtctgctcaaggaatccaaagcacgcctttaaatctcgcagttaattggagatgtgaaccctcttccaccgaccttcgcatagattacaagtacaacaccgacgcgatgaccaccgccgtggcactgaataatgtccagtttcttgttcctattgacggaggagtgactaaactccaggcagttctgcctccagccgtgtggaacgcagaacagcagaggattctatggaagatccctgacataagccagaagtctgagaatggaggcgttggatcactcctcgcacggtttcagctgtccgaaggcccttctaagccttctcctcttgttgtgcaatttacaagcgaggggagcacactttctggctgtgatattgagctggtgggtgctggttaccgcttctccctcataaaaaaaagattcgcagcgggaaagtacttggccgacaattag

SEQ ID NO: 240397 - DNA, 1857 bp, Artificial Sequence
  Description of Artificial Sequence: Synthetic coding sequence
atgatggagggtcttaaaaagcgaactcgtaaggcatttgggatccggaagaaggaaaaggatacagacagcacgggctctcctgacagagacggcattaattctcccgaactcgacgaagaggggtactctattaggccagaagagcccggatccacgaagggaaaacatttctactctagctccgaatcagaggaagaggaggaaagtcataaaaagtttaatattaaaattaagccgctgcagagtaaggacattctgaagaacgctgcaacggtggacgagctcaaggcaagcataggtaacattgcgctgagccctagtcccgtgcgcaagtccccacgccgttcgccgggtgccataaaacgaaatctgtcctccgaggaagtggcacgtcctaggcgctccactccaactcccgagctcatctccaagaaacctcccgacgatactaccgcattggcaccactttttgggcctccactagagtccgccttcgatgaacagaagaccgaggtcctgctggatcagcctgaaatttggggatccggacagcccattaacccatcaatggaatcaccaaaattgacacggcctttcccaaccggcactcctccaccgctgccccctaagaacgtcccggcaactcccccacggacaggatcccctctgactatcggccctggtgctagcagcccagcacgtccagccacgccacttgtgccctgccggagtactactcctcccccaccgccacccagaccaccaagcaggcccaagctgccccctgggaaacccggagtcggggacgtttccagacccttttctccccctatacattccagctctccaccgcctatcgccccactggcgagagcggagtcaacgagctctatatcctctaccaactcactgtccgcagcaacgactcccacagtggagaatgagcaaccttcgttggtctggtttgaccggggaaagttttacttgaccttcgagggttcttcacggggaccatctcctctcactatgggagctcaggacactctcccagtcgcagcagctttcactgagacagtcaatgcctatttcaaaggggcagatcctagcaagtgtatcgtcaagatcacgggcgaaatggtcctgagctttcctgcaggcatcactaggcactttgccaataatccctccccggcagcactgacttttcgcgtgattaacttctcccgacttgaacatgtgttgcctaacccgcagttgctgtgctgtgataacacccagaatgatgccaacactaaggagttctgggtgaatatgccaaacctaatgacccacctaaagaaggtgagcgagcagaagccccaggctacatactacaatgtggacatgctgaagtatcaggtgtctgcccagggaatacagtctacacctctgaacctcgcagtaaactggcgatgtgaaccatctagcacagacctgcggatcgactacaagtataataccgacgccatgaccacagcagtggctcttaataacgttcagttcctagtgccaattgacgggggagtgactaagcttcaagcggtcctcccacccgcagtgtggaatgccgagcaacagcgtattctgtggaaaatccccgatataagtcaaaagagcgaaaatgggggtgtgggatccctcctggctcgcttccaactgtctgaaggcccaagtaaaccaagtccactcgtcgtgcagttcacctcagagggcagcactttgtctggatgcgacattgaactcgtcggagctggttatcgcttttccctgataaagaaaaggtttgctgcgggaaagtacctcgcagataattag

SEQ ID NO: 240398 - DNA, 1893 bp, Artificial Sequence
  Description of Artificial Sequence: Synthetic coding sequence
atggagggtctcaagaagaggactcggaaggcttttggaatacgaaaaaaggagaaagacactgactcaaccggatcccccgatagggatgggattaaaaagtccaacggggctccaaacggcttttacgccgaaattgactgggaaagatacaatagccctgagttagatgaggagggttatagtattcggcctgaggaacccggaagcacaaaggggaaacacttttatagcagttctgagagtgaggaggaagaggaatcacacaaaaagttcaacattaaaataaaacctcttcagtccaaggatattcttaaaaacgccgctaccgttgacgagctgaaggcatctattggtaatatagcgctttctccatctcctgtgggagccattaaacgaaacctaagctctgaagaggtcgcaaggcctaggcgctcgacccctaccccagaattgatctcaaaaaagccgcctgacgacaccactgcactcgcacctctgtttgggccacccctggagagcgcctttgacgaacaaaagaccgaagtgttgctcgatcagcctgagatctgggggagcggccagccgattaatcctagtatggaaagtccaaagctcacccggccattcccgaccgggacgcctcccccactccccccaaagaatgtgcctgccaccccgcctcgaaccggttcccctctgaccatcggtcctggtgctagttcccccgctcggcctgctaccccactcgttccgtgtcgctcaaccaccccgccacctccccctccaaggccacctagtagaccaaagcttccaccagggaagcccggagtgggtgacgttagcagaccctttagccccccaattcactccagctctcctccacctattgcccctcttgcccgagctgagtccacgagttctatcagctccacaaactctctgtctgctgctaccacacccaccgttgtctccgaggatgacgtattttatgataaattaccatccttcgagagacggtgtgagactcccgcaggttcttctcgcggtccaagtccactgaccatgggtgcccaagacactctgcccgttgcagccgctttcaccgaaacagtgaatgcatatttcaagggcgcagacccctctaagtgtattgtcaagattacaggtgaaatggtcctgtcatttccggctgggatcacacggcactttgcaaacaacccatcccccgctgctctcaccttccgcgttatcaatttcagtaggctcgagcacgtgttacctaatccccagttgctatgctgtgacaacactcagaacgatgccaacaccaaggagttctgggtgaacatgcccaaccttatgactcacctcaagaaagtgagtgaacagaaaccccaggccacttactacaatgtagacatgctgaaatatcaggtgtccgcccagggcatccaatctactcccctaaacttggcggtgaattggcgttgcgagccttccagcaccgacctcaggatcgattacaagtataacaccgatgctatgacgacagccgtagctctcaataacgtgcagttccttgtccctatcgatggaggcgtaaccaagttgcaggctgtgctgcctcccgcagtttggaacgctgaacagcagaggattctctggaagatccccgatatcagtcagaagagcgaaaacggcggtgtcggtagtctcttggcccgtttccaactctccgaggggccatccaaaccatcccccctcgtggtccagtttaccagcgaggggagtaccctctcagggtgcgacatcgaactggtgggcgctggataccgcttctcactgatcaaaaagcgattcgctgccggaaagtacctggccgataactag

SEQ ID NO: 240399 - DNA, 2487 bp, Artificial Sequence
  Description of Artificial Sequence: Synthetic coding sequence
atgatggagggccttaaaaagaggacaagaaaggcctttggcatccggaagaaagagaaggacacagattccacgggctcccccgatagagatggaatccaaccctccccacacgaaccaccatataatagcaaggcagagtgcgctcgtgagggcggaaagaaagtgagcaagaaatcaaatggcgctcctaacggcttttatgccgaaatagactgggagcggtacaacagtccagagctggacgaggagggttacagtataaggcccgaggagcccggatctaccaaggggaagcatttctactcgagctcggaaagcgaagaggaggaagagagccacaagaaattcaacatcaaaatcaaaccccttcagtctaaggatatcctgaagaacgcagcgactgtggatgagcttaaagcatcaattggcaatatagccctttccccttctcccgttcgcaagtctcccaggagaagccctggagccatcaaaagaaacctgtccagcgaggaggtggctcgccctcgcaggtccacccccacaccggaattaatctccaaaaaaccccctgacgacacaactgcactggcgcctttattcggacctcccctggaatctgcattcgacgagcagaaaaccgaggttctcctcgaccagcccgaaatctgggggtctggacagcccatcaacccttccatggagtctccgaaattgactaggcctttccccaccggaacaccccctccactgccgcctaaaaatgttcctgccacccctcctaggaccggctcccctctgacaattgggccaggaaatgaccaatcagcaaccgaagtgaaaatcgaaaaactaccttcaattaacgatctggactcaatctttgggcctgtactgagccctaaatctgttgccgttaatgctgaggagaagtgggtgcatttcagcgatacctctcctgagcacgtgacacccgaactgacccctcgggagaaggtggtttcaccaccagccactcccgacaaccccgcagattcgcccgcaccgggaccccttggccctccaggcccaacggggccaccagggccaccagggccaccgcgaaacgtcctctctcccctgaatttggaggaggttcaaaagaaggtggcagagcagacattcataaaagatgactatttagagacgatcagctccccgaaggactttggactgggccaacgtgccacgcccccacccccacctccccctacatatagaacagtggtgagcagccccggacccggaagtggtcccggacccggtaccacttccggagcgtccagtcccgcacgacctgctacaccccttgtgccttgccgtagcacaacccctccccctccccctccgaggccaccgagccgccctaaactgccaccagggaagccaggtgtgggcgatgtgagccggccattttcaccccctattcacagcagctccccacctccaatcgcacctttagctcgcgctgaatccacaagctccatctctagtaccaacagcctgagtgctgctacgacaccgacagtggagaatgaacagcctagtctggtatggttcgatagaggcaagttttatttaacattcgaagggtcttcccgaggtccttctccactcactatgggagcacaagacacactcccagtcgccgcagctttcaccgagacagtgaatgcttacttcaagggtgccgatcccagcaagtgtattgtgaagatcaccggtgagatggtactcagttttcctgctggcataacccggcacttcgctaacaatccctcccccgctgcccttacattcagggtgatcaacttttctaggttggagcatgtgcttccaaatcctcagcttctgtgctgcgataatacacagaacgatgctaataccaaggagttctgggtgaatatgcctaacctgatgacacaccttaagaaggtgagcgagcagaagcctcaagccacatactataatgttgatatgctgaaataccaagtgagtgcccaaggaattcagagtacacctctgaatttggcagtcaattggcgatgcgaaccaagttctaccgacctacgcattgactacaaatacaacaccgacgccatgactaccgctgtcgccctgaacaacgtacagtttctggtccctatcgatggaggtgtgaccaaacttcaggctgtgctgcctccagctgtctggaacgccgaacagcagcgtattttgtggaagataccagacatttctcagaagagcgagaacggcggtgtcgggtctctcctggccagatttcagctgtcagaaggtccttcgaagccttcccctctcgtggtccagtttacctcggaagggagcaccttgagcgggtgtgacattgaactggttggagctggttacagattctcactcattaaaaaacgctttgccgctggaaagtacctcgccgataattag

SEQ ID NO: 240400 - DNA, 2577 bp, Artificial Sequence
  Description of Artificial Sequence: Synthetic coding sequence
atggagggtctcaaaaagcgcactagaaaggctttcggaatcaggaagaaggagaaagatacagactctacgggttcccccgatcgggacggaattcagggcaagaagaaaacacagaaaacccagctccttctgacttcatgcttctggctgcgggcactaagtctgacactcagccagaagaagagtaatggcgctcctaatggcttttacgcggagattgattgggaaaggtacaattctccggagttagatgaagagggctatagtatcagacctgaagagcctggctctacaaagggcaagcatttttatagttctagtgagagcgaggaggaagaggaaagccataaaaaatttaacatcaagattaaaccactccaaagtaaagatatccttaaaaacgcggctacagtagatgagctaaaggcgagcatcgggaacatagccctgtcaccttccccagtgagaaaaaaggaacgccgtgagaagggagctattaagcggaaccttagtagtgaagaagttgcgaggcctaggcgttctacacctacccccgaactcattagcaaaaagccccctgacgacactacagcgttggctccgcttttcggtccacccctcgaatctgctttcgacgagcagaagaccgaggtgctgctggaccaaccagagatttggggctctggtcagccaatcaacccgtccatggaaagcccaaagctgaccaggcccttccccacaggaactccccctccactacctcccaagaacgtgcccgcaacccctccgaggaccgggtcgcctttgacaattggccctggcaacgatcagagcgcgactgaggtgaagattgagaagctcccatccatcaatgacctggattccatcttcggaccggtcctgtccccaaagtccgtggcggtcaatgctgaggagaagtgggtgcatttcagcgacacctcccctgaacacgtcaccccggagctgacccctcgggagaaggtcgtctcccccccagcaacacctgacaatcccgctgattcacccgctcccggacccttaggcccaccaggtcctaccggcccacctggtccaccaggcccacctaggaatgtgcttagtccactgaacctggaagaggtgcaaaagaaagtggctgaacagacattcataaaggacgattatctcgagacaatctctagccctaaagacttcggattaggacagcgcgcaacaccgcctcctcctcccccacctacttatcggaccgtcgtttcttctcccggaccgggaagcggcccagggccaggtacaacatctgatggaaaaacggaagcccagcggtaccaggttatctgtccatcccttcaagcagggggaaatgaactggattcttattcaggtgcctccagccccgcaaggccagccacccccctcgtcccttgccggagcaccaccccgcctccccctccaccacggccaccgtccagaccaaagctgccgcctgggaaacctggagtgggagatgtaagccgcccattctccccacccattcactcaagttctcctccaccaattgcccctctagcaagggctgaatccacttcctcaataagttcgaccaattcgctcagcgccgctactacgccaacggttgaaaacgaacaacccagtttagtttggtttgaccggggaaaattttacctgacattcgagggttccagccggggacccagtcccttaactatgggcgcacaagatactctgcccgtagccgctgccttcacagaaacggttaacgcatacttcaaaggggctgatccctccaagtgcatagtcaagattaccggggaaatggtgctaagctttcctgcaggtattacaagacacttcgccaataacccatctcccgcagccctgaccttcagggtgattaacttcagtaggttggaacatgtgctacccaacccacagcttctgtgttgcgacaacacgcagaacgacgccaacacaaaggagttttgggtcaacatgcctaacctgatgacccatctgaaaaaagtgagtgaacagaaaccgcaggccacatattacaatgtggatatgctcaaataccaggttagtgcccagggtatccagagcacacctctcaacctcgcagtcaattggagatgcgagcctagctcaaccgatctgcgtatagactacaaatacaacaccgacgcaatgactaccgccgtggcactcaataatgtacaattcctcgtgccaatcgatgggggtgtcacaaaactgcaggctgtcctgcctcccgcagtctggaatgcagaacagcaacggatcctttggaagatcccagacatcagccagaagtctgagaatgggggtgtgggctcattgctggcgcgttttcagttaagtgagggcccatcaaaaccttctcctctggtggttcaattcacatccgagggctccactcttagcgggtgcgacatcgagctggttggggctgggtatagattctcattgattaagaaaaggttcgctgctggcaagtacctggccgacaactag

SEQ ID NO: 240401 - DNA, 1896 bp, Artificial Sequence
  Description of Artificial Sequence: Synthetic coding sequence
atgatggagggcctgaaaaagcgtacacgcaaggccttcgggattcgcaagaaggaaaaagacacggattccaccggatccccagacagggacggtatcaaaaagtccaatggtgcccctaatggcttctatgctgagatagactgggaaagatacaactcccctgaactggacgaagaagggtactctattcgtcccgaagagcccggaagcacaaagggtaaacacttctattcttctagtgaaagcgaagaagaagaggagagccataaaaaatttaacattaagatcaagcctctgcagagcaaggatattctaaagaatgccgcaaccgttgacgaactgaaggccagcatcgggaatattgcactgtcgccttctccagtgggcgcaattaagagaaacctgtcatctgaagaagtggcgaggcctagaagaagcacgccaacccccgagctaatctctaaaaaacctcccgatgatacgacagccctggctcctctgtttggacctccccttgagtctgcctttgacgaacaaaagactgaggtgctcctggaccagcctgaaatttggggatcgggccagcctattaacccatccatggaatcacctaagctcaccagaccgttcccgactggcactccccctcccctgccgcctaagaatgtacctgctacgcctccaagaacaggtagccctctgaccattggacccggagccagctccccagccaggcccgcaacacctctcgtgccatgtaggtccactaccccacccccaccccctccaagacctccctcccggcctaaattgcccccaggaaagcctggcgtgggcgacgtctccaggcccttcagtcccccaattcactcttcctctcctccacccatagcccctctggcacgggctgaatccacgtccagcatctcctccaccaactccctgtccgccgctaccacacccactgttgtcagcgaagacgacgtgttctatgacaaactgccttcattcgaaaggcgctgtgagacacctgccggttccagccgcggtccaagtcccctgaccatgggagcgcaggatacattgcctgtcgcagccgcattcactgaaacagtgaatgcatatttcaagggggcagacccatctaagtgtatcgtgaagattactggtgagatggtgctgtcgttccctgccggtatcaccaggcattttgcaaacaaccctagcccagccgctctgacattcagggttattaatttctcacggctggagcacgtcctgccaaatccacagctgctgtgttgcgacaatactcaaaatgatgcaaacaccaaagaattttgggtcaacatgcctaacctaatgacgcacctgaaaaaagtgtctgagcagaaacctcaggctacatactacaacgttgatatgctgaagtatcaagtatccgcacaggggatccagtccacacccctgaatctggcagtaaactggagatgcgagccaagttctactgatctgcgaatcgattataaatacaacactgacgccatgaccaccgccgttgcactcaataacgtacaattcctggtgccaattgacggcggagttactaaactgcaggccgtgctgccccctgctgtgtggaacgccgagcagcaacggattctgtggaagatcccagacataagccagaagtcagagaatgggggagtaggatctctgctggcacggtttcaactgagtgagggcccatctaagcccagtcctttggtggtgcaattcaccagtgagggcagcactctttctggatgcgacattgagctggttggcgcaggctaccggttttcgctgattaaaaaacgctttgcggctggtaagtaccttgcagataactag

SEQ ID NO: 240402 - DNA, 2496 bp, Artificial Sequence
  Description of Artificial Sequence: Synthetic coding sequence
atggaaggcctgaagaaaagaacgcggaaggcctttggaatccgaaagaaagaaaaggacacagactccactggctcacctgatcgtgacgggattcagggaaaaaagaaaacccaaaaaactcagctgctcctgacaagttgcttttggcttagggcactaagtctcaccctcagccaaaaaaagtccaacggcgcacccaacggattttacgccgagattgactgggagaggtacaattcgccagaactggacgaggaggggtatagcatacggccagaagagcctggcagtactaaggggaaacatttttactcaagttctgaatccgaagaggaggaagaaagtcataagaagtttaatataaaaattaagccgttacagagcaaagatatcctgaaaaacgccgcaaccgtcgacgaactgaaagctagcatcgggaatattgcgctgtctccatcacccgtcagaaaaaaagaacggagggaaaaaggtgctattaaacgcaatcttagttctgaggaagtcgccagacccaggaggagcactcctacacccgaactaatttcaaagaaaccccctgacgacactaccgcccttgcgccactattcggccctccacttgagagtgcattcgacgagcagaagacagaggtgctgttagaccagccggagatctgggggagcggacaaccaatcaatccctctatggaaagtcctaaactcaccaggccctttcccaccggcaccccccctcccctcccgcctaaaaatgtgccagctaccccgcctaggactgggtctccattgactatcggccctggcaatgatcagtccgccactgaggtgaaaatcgaaaaattgccctcaatcaacgatcttgactctatcttcgggcctgttctgagccctaagtctgtcgctgttaacgccgaagagaagtgggtgcacttcagtgatacgtcccctgagcacgttaccccagaattaaccccgagggaaaaagttgtcagtcccccagctacacctgataacccagcggacagccctgcgcctgggccactagggcctccgggaccaacaggccctcccggtcctccagggcctcctcggaatgttctctctcctcttaatctcgaagaggttcaaaagaaggtagctgaacagaccttcattaaggacgactatctcgaaactatttctagtcctaaagattttgggttgggccagcgagctaccccaccccctccaccaccccctacttatagaactgttgtgtcaagtcctggcccagggtccgggcctggaccaggcaccacatcaggtgcttcttcaccagctcgccctgctactcccctagtcccctgccggtctactacgccacctcccccacctcccagaccaccctctcgacctaagttgcccccaggcaaaccaggagtgggtgacgtgtcgcggcctttctcccctcctatccattcctcttccccaccacctattgcccctttggcccgagccgagtccacctccagcatatcgtcaacaaactctctcagtgctgcgaccacccccaccgtcgaaaacgaacagccatcgcttgtctggtttgaccgagggaaattttacctcaccttcgaaggatcgtccagagggccttcaccattaactatgggtgctcaagacaccttgcctgtggcagccgctttcacagagacagtaaatgcatattttaaaggggctgacccaagcaagtgcattgtcaagatcactggcgagatggttctgtcttttcccgcagggatcacacgccacttcgcaaacaacccatcccccgcagccctgacgtttagggtcattaatttttcaaggcttgaacacgttctgcctaatccgcagcttctgtgttgcgataacacacagaacgacgctaataccaaggaattctgggtcaacatgccaaacctaatgacacacctcaagaaagtctcggaacagaaaccccaggccacatattataatgttgatatgctgaaataccaggtttctgcacagggcatacagagtacgccgctgaatttagctgtgaactggcggtgcgagcccagcagtactgacttgagaatcgactataagtataacacagacgctatgacaacggccgtcgccctgaacaacgttcagttcttggtgccgatagatggaggcgtaactaagcttcaggcagtcttgcccccagcggtgtggaatgccgaacaacagcggatcctatggaagatcccggacatttctcagaaatctgagaatggtggcgtggggtctctcttagcacgattccagcttagcgaagggccttctaaaccatcccctctcgttgtccagttcacttccgaaggcagcactttgtctggttgcgatattgagctggtgggcgctggctacagattttcacttatcaaaaagcgctttgccgcaggcaagtatttagctgacaattag

SEQ ID NO: 240403 - DNA, 783 bp, Artificial Sequence
  Description of Artificial Sequence: Synthetic coding sequence
atgatggagggcctgaaaaagaggacccgcaaagctttcgggatcaggaaaaaggagaaagacaccgactctacgggttcccccgacagagacggcatccagccctccccacatgagcccccttacaacagcaaggccgagtgcgcacgggaggggggtaagaaagtgtcgaagaagtctaatggtgcgcctaatgggttctatgccgaaatcgattgggagagatacaatagccctgaactggacgaagagggctatagtattcgtccagaggaacccggttcaacaaagggcaagcacttctattccagtagtgaatctgaagaggaggaggaaagtcataagaagttcaatatcaagattaaacccttacagagtaaggatatactgaaaaacgccgctaccgttgatgagctgaaagcctcaatcggaaacattgccctgtcacccagtcccgtcggcgctataaagaggaatcttagcagtgaggaggtggccagaccacggagatctacaccaaccccggaactgatctcaaaaaagccacctgacgatactaccgccctggcaccacttttcggcccacccctggaaagtgccttcgatgagcagaagaccgaggtcctactcgatcagccagaaatctggggctccggccagccaatcaatccaagcatggagtctcctaagctgacccgccctttccccacaggcactccgcctcctctgcccccaaagaacgtgcccgcaacaccccctcgtactggatctccacttacatag

SEQ ID NO: 240404 - DNA, 1002 bp, Artificial Sequence
  Description of Artificial Sequence: Synthetic coding sequence
atgacctgtagcgtgacccacatcgtcagttttagtctaccttttctgaatccatcgcatcccgcatctactcctggccacacggaaaatgaacagccgtctttggtctggttcgacagaggtaagttctatttgacatttgaggggagtagtcgcggaccttctccattgactatgggggcacaggataccctgcctgttgcggcagcgtttaccgagacagtgaatgcctacttcaaaggagccgatccctcaaaatgtatcgtcaaaatcacaggcgaaatggtcctcagcttccccgctggcattaccagacactttgccaataatccaagccctgccgcactgacctttcgtgtgatcaactttagccgactagagcatgtgcttcctaatcctcagttactgtgctgcgacaacacacaaaacgacgcaaatactaaagaattttgggtcaatatgcctaacctaatgacacacctgaagaaggtgtccgagcagaagccccaggcgacatattataatgttgatatgttaaaataccaggtgtccgctcagggaatccagagcaccccactcaacctggcggtgaactggagatgcgagccatccagcaccgacctgaggattgattataaatataatacggatgccatgactacagcagtggccttaaacaatgtgcagtttcttgtgcccatcgatggaggggtgactaaattgcaggccgtcctgcctcctgccgtgtggaatgctgaacaacaaagaatactttggaaaatccccgatatctctcaaaagagcgagaacggtggggtggggagtctgctggctcgatttcagctgtctgaagggccttctaaaccttcccccctggttgtgcaatttacttctgagggctctactctgtccgggtgcgacattgaattggtcggcgcaggttatagattctctttgatcaaaaaacgatttgccgcagggaaatacttagcagataactag

SEQ ID NO: 240405 - DNA, 1107 bp, Artificial Sequence
  Description of Artificial Sequence: Synthetic coding sequence
atgagtgtcgccggattgaaaaagcaattttacaaggctagtcagctcgtgtcggagaaagtcggcggtgcggagggcaccaaattagatgatgactttaaggagatggaaaaaaaagtagatgtgacaagcaaagcagttaccgaggtgctagccagaaccatcgagtacctgcagcctaatcccgctagccgcgcaaagcttacaatgctgaatactgtgagcaagatccgaggtcaggttaaaaacccaggttatccccagtcggagggacttctgggtgaatgcatgatccggcatgggaaagaactaggtggcgagagcaattttggagatgcgctgctggatgctggtgagagtatgaagagactggcggaagtgaaggacagcctcgatattgaagtcaagcagaacttcatcgatccactccagaatctgtgcgaaaaggacctgaaggaaatccagcaccatctgaaaaagctcgagggaaggagactggattttgactacaaaaaaaaaaggcaagggaagattcctgacgaagagctccgccaagccctggagaaattcgaggaatccaaggaggtagcagagacttctatgcataatctgcttgagactgacatagaacaagtcagccagttatctgccctcgtcgacgcccagctcgattatcaccggcaggccgtccagattttagacgagttggccgagaaactgaaaagaaggatgagagaggcaagttcgagacccaagcgcgagtacaagccaaagcctcgggaacctttcgatctgggagaacctgaacagtcaaacggcggatttccatgcacaacagcgccaaaaatcgccgctagctcatcctttaggagttccgacaaacccatccgaaccccatcacgaagtatgccaccactcgatcagcccagctgcaaggcgctctacgatttcgagcccgaaaacgacggtgaattgggcttccacgaaggtgacgtaattacgctcaccaaccagattgacgaaaattggtacgaggggatgctggacggccaatcaggcttttttccactgagctacgtggaggtcctggtcccattacctcagtag

SEQ ID NO: 240406 - DNA, 963 bp, Artificial Sequence
  Description of Artificial Sequence: Synthetic coding sequence
atgagtgtggctggccttaagaaacaattttacaaagcgagtcaattagtgagcgagaaagtcgggggagccgagggaactaagctggatgacgactttaaagagatggaaaaaaaggtggatgttacttctaaggccgtcacggaggtgcttgcacggactatcgagtatctccaacccaacccaggagatgcactgcttgacgccggagagtctatgaagcggctggctgaggtgaaggatagtctggatattgaggtgaaacagaacttcatagaccctctgcagaacttgtgtgaaaaggacctgaaagaaatccagcatcatctaaaaaagcttgaaggtcgtaggttggacttcgattacaaaaagaagaggcagggtaagattcctgatgaagaactgcggcaggctctggaaaaatttgaagagtccaaggaagttgccgaaacttctatgcataacctactggagaccgacattgaacaggtctctcagttgtctgcgcttgtggatgcccagctcgattaccatagacaggctgtccagattcttgatgagctggccgagaagttgaagagacgaatgcgggaggcatcctcaaggccaaagcgcgagtataagccgaaaccacgtgaacccttcgacctgggcgaaccagagcagagcaacggcggattcccctgcacaaccgcacccaagatcgctgcgagcagcagcttccgaagcagcgataagccaatcaggacccccagcaggagtatgcctcctttggatcaaccctcatgcaaagccctctacgacttcgagcctgagaacgacggcgagctcggatttcacgagggagacgtgatcacactgactaatcagatagatgagaactggtatgaaggaatgcttgacggacagagcggcttttttccactgagttacgtagaagtcctggtgccgctacctcagtag

SEQ ID NO: 240407 - DNA, 915 bp, Artificial Sequence
  Description of Artificial Sequence: Synthetic coding sequence
atgagcgtggctggccttaaaaagcagttttataaagcttctcagttagtctcagaaaaggtgggcggtgccgagggaaccaagcttgatgatgactttaaggagatggagaaaaaagtcgacgtgacgtctaaagcagtgacagaggtcctggccagaacaatagagtatctgcagccaaatcctgcttcccgcgcaaaacttaccatgctgaataccgtgtctaaaattcggggacagaatctgtgcgagaaagaccttaaagaaatacagcaccatcttaagaaactggaaggacgtagactggactttgactacaagaaaaagaggcagggcaaaatccctgatgaggagctgcgacaagctctagagaaattcgaagaatctaaggaggttgccgagacttccatgcacaacctgctcgaaacagatatcgagcaggtgagccaactgtctgcattagtagatgctcagctggactaccaccggcaagcagtacagatcctagacgaactggcggaaaagcttaaaaggcgcatgagagaagccagttctcggccaaagagggagtacaagcctaagcccagagaaccattcgatctcggagagccagagcagagcaacggcggtttcccatgcacaactgctcctaagatcgctgcaagttcatccttcagatctagcgacaaaccaatcagaactccaagccgcagtatgccccctctggatcagccttcttgtaaagccctgtacgatttcgaacctgagaatgatggggagctgggctttcacgagggtgacgtgattacactaaccaaccagatcgacgagaattggtacgagggcatgctggatggtcagagcggcttctttccattgtcttacgtagaagtgttggtgcctcttccccagtag

SEQ ID NO: 240408 - DNA, 1059 bp, Artificial Sequence
  Description of Artificial Sequence: Synthetic coding sequence
atgtccgtcgccggattaaaaaagcagttccataaggccactcagaaggttagcgagaaagtgggcggagccgagggcacaaagttggatgatgattttaaagaaatggagcggaaggtggatgtcacaagtagagccgtgatggagatcatgactaagactattgagtacctccagcctaatccagcaagtagggcgaagctctctatgatcaatactatgtctaagattcggggtcaagaaaagggtccaggctatccacaggcagaagccttgctggccgaggctatgttgaaatttggtcgggagcttggtgatgattgcaacttcggtcccgctctgggagaggtgggtgaggcgatgcgggaactgtccgaagtgaaagatagtcttgacatagaagtcaagcagaatttcatcgacccacttcagaacttgcacgataaagatctcagagaaatccaacaccatctcaagaaattagaggggcgacgcctggactttgactacaaaaaaaagcgtcaggggaaaatccccgatgaagaattaaggcaggctcttgagaaatttgatgaatctaaggagattgccgaatcttctatgtttaatctgttggagatggacattgagcaagtgagccagttatctgccctggtgcaggctcagcttgaataccacaaacaagctgtccagattttgcagcaggtgactgtgcgcttagaggaacgcatccgccaggcttccagtcaacccagacgggagtaccagccaaaaccccgaatgtcactggagttccctactggggactccactcaacccaacggcggactctctcatacagggacacctaaaccatcaggagtccagatggatcagccttgttgcagagctttatatgacttcgaacctgaaaatgaaggcgaacttggcttcaaagagggggatattatcacccttaccaaccaaatagacgaaaattggtatgaaggtatgctgcacggccattctggtttctttcctattaattacgtggagattctggtggcattaccccactag

SEQ ID NO: 240409 - DNA, 678 bp, Artificial Sequence
  Description of Artificial Sequence: Synthetic coding sequence
atgtctgttgctggcctgaaaaaacagttccacaaggccactcagaaagtgagcgagaaagtcggcggagcagaggggaccaaactggatgacgatttcaaggaaatggaaagaaaggtggatgttacgtccagagcagttatggagattatgacgaaaaccatcgaatacttgcaaccaaatcccggatctctggaggcagaggccctattggccgaagccatgctcaaattcgggagggagttaggcgatgactgtaactttggccctgctcttggtgaggtcggtgaagcaatgagagaattgtctgaagtaaaagacagtctagacatcgaagtgaaacagaatttcattgatcccctccaaaacctacacgataaggacctgcgggaaattcagcaccacctcaaaaaactcgaaggcagaagacttgacttcgattataagaagaagcgacagggaaagattccagacgaggagctgaggcaagccctggaaaagttcgacgagtccaaggaaatcgctgagagctctatgttcaatctgcttgagatggacatcgaacaggtgtctcagctctcagccctggtacaggctcaactggaataccacaagcaggccgttcagattttgcagcaagttacagtgagactggaagagcggatccgacaggcgtag

SEQ ID NO: 240410 - DNA, 918 bp, Artificial Sequence
  Description of Artificial Sequence: Synthetic coding sequence
atggagatcatgacgaagacgattgagtatctgcagcctaatcccgcttcccgggctaagctgtccatgatcaataccatgtcaaagatcagaggacaagagaagggccctggttatccccaagcagaggccctgctggccgaggctatgttaaagtttggacgagaacttggcgacgattgtaatttcgggccagcactcggagaggtcggtgaagctatgcgcgaactgagcgaggtaaaggactcgctagatatcgaggtgaagcagaatttcatcgatcccctccaaaatctgcatgataaagacttgcgagagattcagcaccacctaaaaaaattggaaggaaggaggttggatttcgattataagaaaaagagacagggcaagatccccgacgaggagctccgccaggccctcgaaaagttcgacgagagtaaagagatagcagagtccagtatgttcaatctcctggaaatggacatagagcaggtgtcgcaattgagcgctctcgtgcaggcccagctggagtatcacaaacaggctgtccagattctccagcaggtgactgttagactagaagaacgcatccggcaggcgtcaagtcagccaaggagggagtaccaacccaagccacgtatgagcttggagtttccgactggggatagtacccaacctaacgggggactgtcacacaccggcaccccaaaaccatccggtgtccaaatggaccagccttgctgccgggcattgtacgacttcgaacccgagaatgagggcgaactaggatttaaggaaggggacatcatcaccctgaccaatcagatcgacgagaattggtacgaaggaatgctgcatggacatagtggcttttttcctattaattatgtggaaattttggttgccctcccacactag

SEQ ID NO: 240411 - DNA, 546 bp, Artificial Sequence
  Description of Artificial Sequence: Synthetic coding sequence
atgagcgtggctgggctgaaaaagcaattccacaaagccactcaaaaagtgtccgaaaaggtaggaggcgcagaggggacgaaactggatgatgatttcaaggaaatggagatcgaacaggtgtcacaactgagtgcactggtccaagcacagctagagtatcacaagcaagctgttcagattctgcagcaggtcaccgttagacttgaggaaaggatcaggcaggcctcgagtcaaccacgccgagaataccagccaaaacctcgcatgtccttggaatttccaacaggcgacagtactcagcccaatgggggtttgagccacacaggaacccccaagcctagtggggttcagatggatcagccttgttgccgggctctgtacgactttgagcccgaaaacgagggcgagctagggtttaaggaaggcgatataattacccttaccaaccagattgatgagaactggtatgagggcatgctgcacggacattctggattctttccaatcaactacgtcgagatactcgtggcactccctcactag

SEQ ID NO: 240412 - DNA, 1068 bp, Artificial Sequence
  Description of Artificial Sequence: Synthetic coding sequence
atggatggaatttttgccggtatcatctgtaatcaggcgaatcggtgcctgacatggacaagccagcagctatttagcgaaaagatcagtggtgccgaagggacaaagctggacgatgaattcctcgatatggaacggaagatagacgtcaccaacaaggtcgtcgccgagatcctctcaaagactaccgagtatctgcagcccaatccagcttacagggcgaagttaggcatgctcaatacagtgagcaagatcagaggtcaggtgaagaccacaggatatccccagactgagggcttgttgggagattgcatgctgaagtacggcaaggagcttggcgaggactcaacgttcggcaacgcccttattgaggtgggcgaaagcatgaaactcatggcagaggtgaaagacagcctggatattaatgtgaaacaaacctttatcgatcccctgcaactgctgcaagataaggatctgaaagaaatcggacatcacttgaagaagctggaggggaggaggttggattacgactacaaaaaaaaacgtgtcggtaagattccagatgaagaagtcagacaagctgtagaaaagttcgaagagtctaaggagctggccgaacggtctatgtttaattttcttgagaacgacgtcgagcaagtttcgcaactggcagtgttcattgaagccgctctggattatcatcgacagagcactgagattctccaggaactgcaatcaaaattacagatgaggatctcagcagcttcttccgtgcctagaagagagtacaaaccacggcctgtgaaacggagtagttctgagcttaatggggtctccactacttcagtggtgaagacaaccggcagtaacatccccatggatcagccatgctgtaggggcttatatgattttgagcccgagaatcagggtgagctgggtttcaaagaaggggacatcataactcttacaaaccagatcgacgagaactggtacgaggggatgatccatggggagtcagggttttttcctatcaattatgtggaggtcattgttcctttaccacagtag

SEQ ID NO: 240413 - DNA, 1044 bp, Artificial Sequence
  Description of Artificial Sequence: Synthetic coding sequence
atgtccgtagccggactgaaaaaacagttccataaagcctcacagttatttagcgaaaagatttcgggggctgagggcacaaaactggacgacgagtttctagatatggaacgcaaaattgacgtgacaaacaaggtcgtcgccgagatattgagcaaaaccaccgaatacctgcagcctaacccagcgtacagagctaagctgggaatgctaaataccgtttcaaaaatccgcggtcaggtgaaaaccacgggctatccccagacagaaggcttacttggagactgtatgctgaagtacggaaaggagcttggggaggactctaccttcggcaacgcgcttatagaggtgggtgaaagcatgaaattgatggccgaagtaaaagactctctcgacataaacgttaaacagacatttattgaccctcttcaattacttcaggacaaggacctaaaagaaatcggccaccacctgaaaaagttggagggacggaggctcgattatgattataagaagaagcgggtcggcaagatcccagacgaagaagtaagacaggctgtggagaaattcgaggagtccaaggagctcgccgagcgtagcatgttcaatttcctcgagaacgatgtggagcaggtcagccaattggccgtgttcatcgaggccgcactggattaccaccgtcaatctaccgaaattctgcaggagctgcaatctaaactgcaaatgaggattagtgcagcctcctccgttcccaggagagaatacaagcctcgacctgtaaagcgttcaagctctgagcttaacggtgtttcaaccacaagcgtggttaagaccaccgggtcaaatatcccaatggaccaaccgtgttgcagaggtctgtatgacttcgagccagaaaatcagggagagctgggtttcaaagagggcgatattatcacattgaccaaccagatcgatgaaaactggtacgagggcatgattcatggcgagtctgggttttttcctatcaattacgtggaggtgattgtgccccttccacagtag

SEQ ID NO: 240414 - DNA, 1068 bp, Artificial Sequence
  Description of Artificial Sequence: Synthetic coding sequence
atggacggcattttcgccggaatcatctgcaaccaggcaaacagatgcctcacatggacatcacagcagctgttttccgagaaaatcagtggcgcagagggtacaaaactggatgatgagttcctggatatggaaagaaagatagacgtcaccaacaaagttgttgcagagatcctgtctaagactaccgaatatctacagcctaaccccgcttaccgggctaaactggggatgttgaacacagtatctaagattcgagggcaggtgaaaaccacgggttatccccagaccgaaggactcctgggagactgcatgctcaagtatggcaaagagttgggggaagattccacattcggaaatgccctaatagaggtgggcgagagtatgaaattaatggccgaggtgaaggactccctcgacatcaatgtgaagcagacctttatagaccccctacaactgctgcaggacaaagatctcaaagagatcggacaccatctgaagaaacttgagggacggagactggactacgactataagaaaaaaagggtgggcaaaatcccagacgaggaggtgagacaggccgtggagaagtttgaggagtccaaggagctggcggagcgctctatgttcaatttcttagagaacgatgtcgaacaggtcagtcagctcgctgtcttcatcgaagccgcattggactatcaccgccagtctactgagattcttcaagagctgcagagcaaattgcaaatgcggatttcggcagcttccagcgttccacgaagggagtacaagccgcgtcccgttaagagatctagctccgagcttaatggagtgtccacaacctctgtcgtaaaaaccactggcagcaacatccctatggaccaaccctgttgtcgcggtctttacgattttgaacctgagaatcagggagagcttgggttcaaggagggcgacatcattaccttgactaaccagatagacgagaactggtacgagggcatgatccacggtgagagtgggttcttccctatcaactatgtggaggtcatcgtcccactgcctcagtag

SEQ ID NO: 240415 - DNA, 867 bp, Artificial Sequence
  Description of Artificial Sequence: Synthetic coding sequence
atgagcgttgctggacttaagaaacagttccataaagcaagccaacttttttctgagaagatttcaggcgctgaaggcacaaagctggacgatgaatttctggacatggaacgcaagatcgacgttactaataaagtggttgccgagattctttcaaagacaacagagtacctacaacctaaccctgcataccgagctaagctcggtatgttgaatacagtgtcaaaaatcaggggacaagtgaagacaacaggatacccccagaccgaaggactgcttggggattgtatgctcaagtatgggaaagagttaggggaggacagcacttttggtaatgctcttatcgaagttggggagtcgatgaaactcatggcagaggtcaaagattccttggatatcaatgtcaaacagacttttatcgatcccctgcaacttttgcaggacaaagatctgaaggagatcggtcaccacctgaagaagcttgaggggcgtagactggactacgactacaaaaaaaagagggttggaaaaatccccgatgaagaggtgcgacaggccgtggaaaagttcgaggaatcgaaagagctcgccgagagaagtatgttcaatttccttgaaaacgatgttgagcaggtctctcagttagccgttttcattgaggctgcactggactaccaccgacaaagtaccgagattctccaggagctacagtctaaactccagatgagaatcagtgcggcatcttctgtgccaagacgcgagtataagcccagacctgtgaagcgaagctcttctgagttgaatggcgtaagtactacttccgtggtgaagaccacagcgtattctcgattagagcctgctgactag

SEQ ID NO: 240416 - DNA, 1662 bp, Artificial Sequence
  Description of Artificial Sequence: Synthetic coding sequence
atggtggaggcgatcgtggaattcgactaccaggcacagcacgatgacgagctcactattagcgtaggtgagatcattacgaacataagaaaagaggacggcggttggtgggagggacagattaatggacgcaggggactctttccagacaattttgttcgggagattaaaaaagagatgaagaaggatcctctgactaataaggccccagaaaagcccctgcacgaggtgccctccggaaattccttgctcagctccgaaaccattttacgcacaaataaacggggagaaagaagacggagacgatgtcaggttgccttttcctacctcccccaaaatgatgatgaactggagctcaaagtaggggatatcatagaggtggtcggggaggtggaggaggggtggtgggaaggagtgctgaatggcaagactgggatgttccccagcaactttatcaaggaattatccggtgaatccgacgagctgggaattagccaggatgaacagctgagtaaaagccggccagagggcctgccccctgcgtctctgcttccatttccagcgcacggggcaaagggcaaaaccaccttcgagggcaccattctctacagggcagcacccggtaagactgaaggacatcgccgttactatagtctgcgcgagaccacggggtccgagagtgacggaggggatagctcaagcactaagagcgagggggcaaatgggacagtggccaccgccgctatacagcccaaaaaggtgaagggggtgggttttggcgatatcttcaaggataagcccatcaagctgcgaccgagatccattgaggttgagaacgactttttgcctgtggaaaagaccataggaaaaaagctccccgcaacaacggccactcctgattcaagcaagactgaaatggactcacggacaaagtcgaaggactactgtaaggtcatctttccgtatgaggcccagaatgacgacgagttaaccatcaaagaaggtgacatcgtgacactgatcaataaggactgtatcgacgtgggctggtgggaaggagaactcaacggtcggaggggcgtgttccctgacaacttcgtgaagctgctcccaccagacttcgaaaaagagggcaaccgcccaaagaaacctcctccaccttctgcgcctgtgatcaaacagggcgcaggtacgaccgaacgcaaacatgagatcaaaaaaatccccccagaaaggccagaaatgctgccaaaccgcactgaagagaaggaacggccagagcgggagcctaaactggatcttcaaaagccttccgttcccgctataccccctaaaaagcctcgcccaccgaagactaactctctcagtagacctggagccttaccccctcgaagaccagagcggccagtcggccctctgacacacacccgctactgttgcgccctcacttctggcgctggggtgggttggctgtggaaggagcaccgtagaggtaccgattgccacagaccgtgggaggaggggcgaggcgaggggggtgctcaggcgtcgcttctacatccaccagcgaaactctctgaggatacaggtcacttctgtccgtgctcttgtacccaggcaggggtcagcgtccgcctgagaggagcagtgtgggttagctag

SEQ ID NO: 240417 - DNA, 1887 bp, Artificial Sequence
  Description of Artificial Sequence: Synthetic coding sequence
atggaagtgagtgcagccaaggcaccttccgcagccgatctttctgagatcgagatcaaaaaagaaatgaagaaggacccattgaccaacaaggcacccgaaaagccccttcacgaggtgcccagcggcaactcattactttcttccgagacaattttgagaacaaataagaggggggagcgcaggaggcgccgatgccaggtcgccttctcgtatctccctcagaacgacgatgaactggaactgaaggtaggtgatatcattgaagtcgtcggagaagttgaggaaggctggtgggagggggtcttaaatgggaaaactgggatgtttccgagcaacttcatcaaggagctttctggggagtctgacgagctgggtatcagtcaggatgaacagctaagtaagagctctctgagagaaacgaccggatctgagtccgacggaggggattccagtagcacgaaatctgagggcgctaatggcactgtggctacagcggctattcagccgaagaaggtgaaaggggtcgggttcggcgacatcttcaaggacaagcccattaaactacggcctcgcagcattgaagtcgagaatgacttcctccctgtggagaaaaccataggtaaaaagctgcctgccaccacagcgacacctgattccagtaagaccgaaatggacagccggacaaaatcaaaggactactgtaaggtgattttcccatatgaagcacagaacgacgatgaattgacgatcaaagaaggagacatagtaactctcatcaacaaggactgcatcgacgtggggtggtgggaaggggagcttaacggaagaaggggcgtcttcccggataactttgtaaagctcctgcctccagactttgaaaaggaggggaatagacccaaaaaacctcctccgccaagcgcccctgtaatcaagcagggcgctggcacgacagaaagaaagcacgagattaagaaaatcccacccgaaaggccggagatgctgcccaatcgcacagaagagaaggagagacccgaacgggaacccaagctggaccttcagaagccgtcagtgcctgctatacccccaaagaagcccaggccaccaaagactaactccctgtctaggcccggtgcgctgccacctcggaggcctgagagacccgtcggcccactcacacatacccgcggtgactccccaaagatcgacctggccggatcctccttgtccggtatccttgataaggatctttcggaccgctccaatgatatcgatctagaggggtttgatagcgtcgtctcatcaacggagaaactgagtcatcccactacctctcgacctaaagcaacgggtcgaaggccaccatcccagagtttgacatcttctagtctgagtagccccgacattttcgactcccccagccccgaggaggacaaggaggagcatatcagtctggcccaccggggagtcgatgcatcaaagaaaacatccaagaccgtgaccatttcgcaagtgtcggacaacaaagcctcattgcctccgaagcccggtacaatggccgctggaggagggggaccagccccactctctagcgccgctcctagcccgctatcttcaagtttaggcacagccggacatagggccaattctccatcattgttcggcacagaggggaagcccaagatggaaccagctgcctcttctcaagcggctgttgaggagctacggacacaagttcgagagctccgtagtatcatcgaaacgatgaaggatcagcaaaagagagagatcaaacaactgctctcagagttagacgaagagaagaagatacggctgcggctacagatggaggtgaatgacattaaaaaggctctccagagcaaatag

SEQ ID NO: 240418 - DNA, 1953 bp, Artificial Sequence
  Description of Artificial Sequence: Synthetic coding sequence
atgaagaaagacccccttacaaataaggcccctgagaaaccccttcatgaggtgccctctgggaactctctgttgtcgagtgagactattttgcgcacaaacaaacgcggagagagaaggcgacgccgttgtcaagttgccttctcctatctgcctcaaaacgacgatgaactggaactgaaggtgggagacattatcgaggttgttggagaggtagaggaaggctggtgggaaggcgtcttgaatggcaaaaccggaatgttcccctctaactttataaaggagctgagtggtgagtccgacgaactgggcatctctcaggatgagcagctgtccaagagccgcccagaggggctgccacctgcatccctcctcccatttccagcacatggagccaagggcaagacaacattcgagggcacaattctgtatagagccgcaccaggaaagaccgaaggccataggagatactacagtctcagagagaccactggatccgaatccgatggcggagattccagctcaacgaaaagcgagggcgctaacggcacggtcgctactgctgctatacaacccaagaaggttaagggggtgggtttcggcgatatttttaaggacaagcctattaagcttagaccccgatctatagaggtggaaaacgacttcctgcctgtggagaagacgatcggcaaaaagctgccagcgaccaccgcaacgcccgattcatccaaaaccgaaatggatagccgtacaaagtccaaggactattgtaaggtcatcttcccatacgaagcgcaaaatgatgacgagctcactattaaagagggggacatcgtgacactgatcaataaagactgtattgacgtcgggtggtgggaaggcgaactcaacggcaggcgcggtgtgttcccggacaactttgttaagttactgccacccgactttgagaaggagggcaaccggccaaagaagcccccacctccttccgccccagtgattaagcagggtgccggaaccacagaaaggaagcacgagatcaaaaaaattcctccagaacggccagaaatgctgcccaaccgaactgaggaaaaggagagaccagagcgcgaaccaaaactcgacttgcagaagccctctgttcccgctatccccccaaaaaaaccccgtccaccaaaaaccaactctttgtccaggcctggagcactaccgccacggagacctgaaagacccgtgggcccactcacacacacccggggagattctcctaagattgacctggcgggttcttctttgagcgggattctggacaaggacctgtcggaccggtccaatgacattgatctggaaggattcgactcagtagtgtcttcaaccgaaaagctgtcacatcccacaacatccagacctaaagctacaggtcggagaccaccgtcccagagtctaacatcttcttcactgagctctcccgatatctttgacagccctagtcctgaggaggataaagaggaacacatcagcctggcacatcggggagttgatgccagcaagaagacttccaagactgtaactatttcacaggtctcagataacaaagctagtttgcctccaaaaccgggaacaatggccgctggcggaggagggcctgccccactgtcatccgcagcgccatcgccactgtccagctccctcggcaccgcagggcaccgtgctaattcgccttctcttttcggcactgaaggcaaaccaaagatggagcctgctgccagcagccaagccgctgtagaggagcttcggactcaggtccgagaactgagatccattatcgaaactatgaaagatcagcagaagcgagagattaagcaactgttatcggaactcgacgaggaaaagaaaatccgattaaggctgcagatggaggttaacgatattaaaaaagctctccagtctaaatag

SEQ ID NO: 240419 - DNA, 1284 bp, Artificial Sequence
  Description of Artificial Sequence: Synthetic coding sequence
atgggtgaggagacaatcggcaaaaaattaccagctaccacagcaacaccggactcttctaaaaccgagatggatagtcggactaaatcaaaggattactgcaaagtgattttcccatatgaagcccagaacgacgacgaactcaccataaaggagggggacatcgtgacccttattaacaaggactgtattgatgtagggtggtgggaaggggaactgaacgggaggcggggtgttttccccgacaacttcgtgaagctcctgcctcccgattttgaaaaggagggaaaccgcccaaaaaagcctccgcctccaagcgctcctgtgattaaacagggcgctggaactacggagaggaaacacgagataaagaaaatcccacctgaacgccctgagatgctacctaaccgcaccgaagagaaagagaggccagaacgcgagcccaaactcgatcttcaaaagccatccgtgcctgctatccctcctaaaaagccccgaccccctaaaactaactcactaagcagacctggagctctccctccacgcaggcccgagagaccagttggcccattgactcatacacgcggagacagcccaaagatcgacctggccggatcgtcgcttagcggaattttggataaagaccttagcgacaggtcaaacgacatcgatctggaggggttcgatagcgtcgtgagctccactgagaagctgtcccacccgactaccagcagaccgaaagccactgggcgtaggcccccaagtcagagcctaacgtctagctcgctgagcagtccggacatttttgacagtcctagccccgaagaggacaaggaggagcatatttctcttgcgcatagaggagtggacgccagtaaaaagacatccaagaccgtcactatttctcaggttagcgataataaagcctcactgcccccaaagcccggaactatggctgcgggagggggtgggccagctccattatcgtctgctgcaccatcacccttatcttcttccctggggaccgctgggcatcgcgctaattcccctagtttattcggcaccgaggggaagccaaagatggaaccagctgcgagcagtcaggccgcagtggaagaactgcgtacacaggtgcgcgagctccgatctatcattgaaactatgaaggaccagcaaaagcgagagattaaacaattgctcagtgagctggatgaggagaaaaaaatccgtctgcggctgcagatggaagtgaacgatataaaaaaagccctacagtctaagtag

SEQ ID NO: 240420 - DNA, 1938 bp, Artificial Sequence
  Description of Artificial Sequence: Synthetic coding sequence
ctaacaaataaggctccagaaaagcccctgcatgaggtccctagcggtaacagcctgttgagttcggagacgatcctgcgaacaaacaagcgaggcgagcgcaggagacggaggtgccaagttgcttttagctacctaccccagaacgatgatgagttagaactgaaagttggggatattattgaagtggtaggggaagtagaagagggatggtgggaaggagtcctgaatggcaagacaggaatgttcccatcgaattttatcaaggaactgtccggcgaaagcgatgagctggggattagccaggatgagcaactgagcaaaagccggcctgagggcctcccccctgcatccctactgccgttcccagctcacggggctaaaggaaaaaccaccttcgagggcacgattttgtatagggccgctccgggtaagaccgagggtcataggcgatattacagtctccgcgaaaccacaggttctgagtctgatgggggtgacagttcatcaacaaagtcggaaggggcaaatggaacggtcgctaccgccgctattcagccgaagaaggtgaagggcgtcggatttggggatatcttcaaggacaagccaatcaaactccgtcccagatctattgaggtggagaatgattttttgcctgtggagaaaactatcggtaaaaaactgcccgcaactacggccacccctgatagttctaaaacagaaatggactcccgcactaaatccaaagactattgtaaggtaatttttccgtatgaagcccagaatgacgatgagctgaccataaaggagggggacatcgtgacactgatcaataaagactgcattgatgttggatggtgggaaggggagcttaacggtaggcggggagtgtttccggacaatttcgtcaagctgttgcctccggattttgagaaagaaggcaatcgcccaaagaaaccaccgcctccttctgcaccagttatcaagcagggggcagggaccactgagcgcaagcatgaaattaaaaaaattccccctgaacgccctgaaatgttaccgaatcggaccgaggagaaagaacggccagagagagaacccaaattagatttgcagaaaccctctgtccccgctatccctcccaagaagccgcgtcctccaaaaacaaacagtttgtctcggcctggggcactgccacccaggaggccagagcgaccggtgggccctctgacccatacaaggggagattcgcccaagatcgacctggcaggttcatccttatcaggtatcctggacaaggaccttagcgaccgctccaatgatatagacctagaaggcttcgactccgtggtttcttcaacggaaaagctgtcccacccaaccacttctagaccaaaggctacagggcgacgcccaccatcgcaatcactaactagcagttccctgtcaagccctgacattttcgattccccatcccccgaagaggataaggaggaacatatcagcctggctcaccggggagtggatgcttccaagaagacgtccaagacagtaacaatttcacaggtgtctgacaacaaggccagcctcccgcctaagccaggaacaatggccgcaggaggcggaggaccagctcctctgtcatctgccgctccttccccacttagctcctccttggggactgctggccatcgtgcgaattcaccgagtctctttggcaccgaggggaagcccaaaatggaacccgctgcatcctctcaggcagccgtggaggaactgaggacccaggtgcgggagctgaggagcatcatcgagactatgaaggatcagcagaagagggagatcaagcagttactgtccgagctggatgaggaaaaaaagattcgcctgcgcctgcagatggaagtgaacgacattaaaaaggccctgcagtccaaatag

SEQ ID NO: 240421 - DNA, 450 bp, Artificial Sequence
  Description of Artificial Sequence: Synthetic coding sequence
tttgagacatcagagagacgtaggagacggtgtcaggtggcttttagctacctgcctcagaatgacgatgaactggagctcaaggtaggcgacataatcgaggttgtcggagaagtcgaagaggggtggtgggagggcgtgctgaatgggaaaaccggaatgttccccagtaacttcattaaagaactgagcggggagtccgacgagctgggtatttcacaggatgaacagttaagtaaaagctccttgagagaaaccacaggatcagagagcgatgggggtgattcctcctccactaagtccgaaggtgcgaacggcaccgtcgccacagcagcaattcaacctaagaaggtcaaaggcgtcgggttcggcgatattttcaaggataagcctataaagctgcgtccaagaagtatagaagttgagaatgatttcctcccggtagagtag
